United States Patent 9,254,311 (MODIFIED POLYNUCLEOTIDES FOR THE PRODUCTION OF PROTEINS) - sequence listing, part 22

SEQ ID NO: 46867 - DNA, 450 bp, Artificial Sequence
  Description of Artificial Sequence: Synthetic coding sequence
atgatggccgtggagcagatgcccaagaaggactggtacagcatcctgggcgcggatccatctgctaatatctccgacctcaaacagaaatatcagaaactcatcctgatgtaccaccccgacaaacagagcacagacgtgcccgccggcaccgttgaagaatgtgtccagaagttcatcgagatagaccaggcatggaaaatactgggcaacgaggaaacaaagagagagtatgacctccagcgctgcgaagacgatctcaggaatgtagggcccgttgacgcacaggtgtatctagaggagatgtcctggaatgagggcgatcactctttttatctgagctgtaggtgtggcggaaagtactccgtcagtaaagatgaggccgaggaagtgtctttgatttcgtgtgatacctgtagtctcatcattgaactactgcactataactag

SEQ ID NO: 46868 - DNA, 255 bp, Artificial Sequence
  Description of Artificial Sequence: Synthetic coding sequence
atggccgtggagcagatgcccaagaaggactggtacagcatcctgggggcggatccaagtgcaaatatctctgaccttaagcaaaagtaccaaaagcttattctgatgtatcatcccgataaacagtctaccgatgtgccagccggcaccgtggaggaatgcgttcagaagttcatcgagattgaccaggcttggaagattctgggcaacgaggaaacaaaacgggagtacgacctgcagcgatgcgggtcttag

SEQ ID NO: 46869 - DNA, 1167 bp, Artificial Sequence
  Description of Artificial Sequence: Synthetic coding sequence
atgaacaccatgtacgtgatgatggcccagatcctgcggagccacctcattaaagcgacagtgatccctaacagagttaaaatgttgccttactttgggataatccgcaatcgcatgatgtctacccacaagtccaaaaagaaaatccgagagtactacagattgttaaacgtggaggaggggtgttcagctgatgaggtgcgcgagagtttccataaactcgctaaacagtaccatcctgacagcggcagcaatactgcggattccgctacatttatccgcatagaaaaggcttaccgcaaagtgctgtcgcacgtcattgaacagacaaatgcctctcagagtaaaggggaagaagaggaagatgtagagaagttcaaatataagaccccccaacaccgacactatctgagcttcgagggaattgggtttggtacgccgactcagcgggagaagcactaccgacagtttcgtgccgaccgggcagctgagcaggtgatggaatatcagaagcaaaaacttcagagtcagtattttcctgacagcgtgatcgtcaagaatataagacagtccaaacaacagaagatcacccaggctatcgaacggctggtagaggacctgatacaagagagcatggccaagggggattttgataacctttcgggcaaaggcaaaccactgaaaaagttctctgactgttcctatattgacccgatgactcacaatttgaataggatactgattgataatggctaccagccagaatggatcctcaaacagaaggaaatttccgatacgattgagcagctacgggaggcgatactggttagtagaaagaagctaggcaaccccatgacaccaacagagaaaaagcagtggaaccatgtgtgcgagcagtttcaggagaatattcgcaagctgaataaaagaatcaacgacttcaacctgatcgtgccaatcctcacacgtcagaaagttcactttgacgcccaaaaggagatcgtccgggcccagaagatctacgagaccctgattaaaaccaaggaagtcacagatagaaacccaaacaacctggatcagggcgaaggcgaaaaaactcccgagataaagaaaggttttcttaattggatgaacctgtggaaatttataaagatacgctccttttag

SEQ ID NO: 46870 - DNA, 1167 bp, Artificial Sequence
  Description of Artificial Sequence: Synthetic coding sequence
atgaacaccatgtacgtgatgatggcccagatcctgcggagccacctaattaaagcaactgtcatccctaatagagtgaaaatgcttccttacttcggaatcatccggaatcgcatgatgtctactcataagtcaaagaaaaaaatccgagagtattaccgtctgctgaatgtggaggagggctgtagcgctgacgaggtgcgtgagtcattccacaaattggcaaaacagtaccaccccgactccggaagtaacacagccgattccgccacatttatccggatcgagaaggcgtatagaaaggtgctcagccacgtcatcgaacagactaatgcctcacaatccaaaggcgaagaagaggaggacgtggaaaaatttaagtataaaactccacagcatcgacattatctgtcttttgaaggcattggattcggcacacctacgcagcgtgagaagcattatcggcagttccgggctgatcgggccgcggagcaagtgatggagtaccagaagcaaaaactccagtctcaatatttccccgatagcgtcattgtaaagaacatacgtcaatctaaacagcagaagatcacccaagcaatcgaacgcctggtcgaagacctcattcaggagagtatggctaagggggattttgataacttgagtgggaaagggaaacctctgaaaaagttttcagactgtagctatatcgacccaatgactcacaatttgaacaggatcctgattgataacggctaccagccggaatggatcctgaagcagaaagagatttcagacacaatagaacagctgagagaggctatcctcgtctctaggaaaaaactggggaacccaatgacgcctaccgaaaaaaagcaatggaatcacgtatgtgagcagtttcaggaaaacatacggaagttgaataaaaggattaatgatttcaacctgattgtgcctatactcacccgccagaaggtccacttcgacgcccagaaggaaattgtcagagctcaaaagatctatgaaacactgataaagacgaaggaggtgacagacaggaacccaaacaacttggaccagggtgagggcgagaaaactccagagataaagaaaggcttcctgaattggatgaatctgtggaagttcatcaagatcagatctttctag

SEQ ID NO: 46871 - DNA, 1167 bp, Artificial Sequence
  Description of Artificial Sequence: Synthetic coding sequence
atgaacaccatgtacgtgatgatggcccagatcctgcggagccacctgataaaggccacagtaattcctaacagggtgaaaatgttaccatatttcggaattatccgaaacagaatgatgagtacccacaaaagcaaaaaaaagattcgggagtattacaggttattgaacgtggaggagggatgctctgcagacgaagtccgggaaagctttcataagttggcgaaacaataccatcccgattcaggctctaacaccgctgatagcgccacctttatccggattgagaaggcttatcgaaaggtgttgtcacatgtcatcgagcagaccaatgccagccaatccaaaggcgaagaagaggaagatgttgaaaagttcaagtataagaccccccagcataggcattatctgtcatttgaagggattgggttcgggaccccaacacagagggaaaaacactatagacaattccgcgcggaccgagcggccgaacaggtgatggaataccagaagcagaaactgcagtcccagtattttccggactccgtaattgttaaaaacatccggcagtctaaacagcaaaagatcacacaagccatagagagactggttgaagatctgattcaagaatccatggctaaaggcgactttgataacctctcaggcaaggggaagcctctcaagaagttttccgattgctcttacattgatcccatgacacacaaccttaacaggatcctcatcgacaatggatatcagccagagtggatcctgaaacaaaaggagattagcgacactatcgaacagcttcgggaggccatcctcgtttctcgtaaaaagctcggcaatcctatgacgcctacggagaagaagcagtggaaccatgtgtgcgaacagttccaggaaaatattagaaagttaaacaaaagaattaatgacttcaacctcattgtccccattctgacaagacagaaagtgcacttcgacgcccagaaagagatcgttcgggctcaaaaaatctacgagacattgattaaaaccaaggaggtaacagatcggaacccaaataaccttgatcaaggagaaggtgagaaaactcccgaaatcaaaaaggggttcctcaattggatgaacctgtggaagttcatcaagatccgatctttctag

SEQ ID NO: 46872 - DNA, 462 bp, Artificial Sequence
  Description of Artificial Sequence: Synthetic coding sequence
atgggcgcccccctgctgagccccggctggggcgccggcgccgccggaaggagatggtggatgcttctcgcaccactcctgcccgccctccttctcgtgaggcctgccggggccctagtcgagggcttgtactgcgggacccgggactgttacgaagtactgggagtgagtcgctcagccggcaaggcggagatcgcgcgggcctacaggcagttggcacgtaggtatcatccagacagatacagaccccagccaggcgacgaaggcccaggtcggacccctcaatctgcggaggaggccttcttactcgtggcaaccgcctacgagaccctgaaggtcagtcaagctgccgccgaactccagcagtattgcatgcagaatgcctgcaaagatgcattgctcgtcggcgtgccagccggctctaacccctttcgggaacccaggtcctgtgccctgctctag

SEQ ID NO: 46873 - DNA, 996 bp, Artificial Sequence
  Description of Artificial Sequence: Synthetic coding sequence
atggccagcaacttcaacgacatcgtgaagcagggctacgtgaagattcggagccgtaagctgggcatattccggagatgttggctggtgtttaaaaaagcctcctccaaaggcccacggcgccttgaaaagtttcctgacgagaaagccgcgtattttagaaatttccacaaagtgactgagctgcacaacattaagaacattaccagacttccaagggagactaagaaacacgccgtggctatcatctttcacgacgaaaccagtaaaaccttcgcctgtgagagcgagcttgaggccgaagaatggtgcaagcacctgtgcatggagtgtttagggactaggctaaatgatatctccctgggggagccagacttgcttgctgccggcgtgcagagggagcagaatgaacgttttaacgtgtacctcatgccaacacctaacctggacatctatggggagtgtaccatgcaaatcacccatgagaatatctacctctgggatatacataacgctaaagttaaattagtgatgtggccgctgtcctctttgcggagatacggacgggacagtacatggtttaccttcgagtccgggagaatgtgtgacacaggcgaggggctctttacctttcagacacgggaaggcgaaatgatctaccagaaggttcactccgccacgcttgcaattgcagagcaacacgaacggctaatgcttgaaatggagcagaaagccaggctgcaaaccagcctgaccgagcccatgaccctcagtaagtcgatctctctcccgcggagcgcctattggcaccacattacacgtcagaacagcgttggagaaatttatagtttgcagggccacggttttggaagctctaagatgagcagggcccaaactttccccagctatgctcctgagcaatcagaagaagcccaacagcccctctcacgctcctctagttacggcttttcctactccagttcacttatccaatag

SEQ ID NO: 46874 - DNA, 615 bp, Artificial Sequence
  Description of Artificial Sequence: Synthetic coding sequence
atggccgaggacacctacagccacaagatggtgaagaccaaccaccggcgatgcaggacaaagtttactgaagagcagctgaaaatcctcatcaacactttcaatcagaagccataccccggttatgccacaaaacagaagctcgctctggagattaatactgaggaatcacgcatacaaatctggttccagaacagacgggctcgacatggctttcaaaaacgccctgaagctgagaccctcgagtcttctcagtctcagggccaagatcagcctggcgtggaatttcagagtagagaggcacgtcgatgtagaaccacttacagtgcatcccaactgcacaccctaatcaaagcattcatgaagaatccgtatcccggcatcgactctcgggaagaactggcaaaggaaataggtgtgcccgagagcagagtgcagatttggtttcaaaatcgaaggtcgcggctccttctgcagagaaaaagagagcccgtcgccagcttagagcaggaggagcagggcaagattcctgaaggcttgcagggggctgaagatactcagaatggaacaaacttcacatccgattcacattttagcggggcgcgaacatggtag

SEQ ID NO: 46875 - DNA, 2259 bp, Artificial Sequence
  Description of Artificial Sequence: Synthetic coding sequence
atgaccgccggcagcgtgtgcgtgccccagatcatccccctgcgggtgccccaaccaggtaaggcaaaccacgagatcgacaacaacacacttctggaaatgaagtcggacacgcccgacgtaaatatatattatacgctggacggatcgaaacccgaatttctcaagagaatcggatatggagaaaataatacttttaagtacatcaaaccaataactctgcccgacggcaagattcaggttaaagcaattgccgtgagcaaagattgcaggcagagtgggatagtcacaaaagtatttcacgtagattacgagccccctaatatagtctccccagaggacaatgtcgagaacgtcctcaaggactctagccgacaggaattcaaaaacggcttcgtgggctccaaactgaaaaaaaaatataaaaatagcgagaatcagaggtcatggaacgtaaacctgcgtaagttcccagaaagcccactcgagatcccggcttatggggggggctcaggcagcaggccccccacgaggcagtcccagagtccaggcttcgctcatgtgagtggtcaaaaatgccttacatctactgaaattatgcgcatccagcgagagaccgatttccttaaatgcgcacattgcctggcaccacggcccagcgatcccttcgcacgcttttgtcaagagtgtggctctccggtaccacccatcttcgggtgtcgcttacccccccccgaaggcgcacagatggggctatgtgcggagtgtagaagtctagtgcctatgaacacacccatctgtgtagtatgtgaggccccactggcactacagttgcagccccaagccagtctgcatctgaaggaaaaggtgatatgccgggcatgcggcactggtaaccccgcgcatctgagatattgtgttacatgtgagggcgcattgccgagcagccaggagtccatgtgtagtggcgacaaggcgcccccaccccccacacagaagggtggtacaatatcttgctatagatgtgggcgatggaacctttgggaagcctcattctgcggttggtgtggagcaatgctggggatacccgccggctgttccgtctgtcccaaatgcggggccagtaatcacctgtccgcaagattctgcggctcttgtggcatttgcgtgaaatctctcgtcaagctgagtctggatcggagcctggcactggccgcagaggaaccccggcctttctccgaatctttaaatattcccctgcccagatccgatgttggcacgaagcgcgacattggcacgcaaactgttgggctgttctacccaagtggtaaactcttggctaagaaggaacaggaactagctagccaaaagcagcgacaggaaaagatgtctgaccataagccccttttaactgcaatcagtcccggccggggatattggagaagacagctcgaccatatctctgcacacttgaggtgctacgcacagaacaatccagaatttcgggctcttatcgctgagccccgtatgggcaagctgattagcgcaacagttcatgaggacggatgtgaggtttccatcaggctcaactactcacaggtgtcaaacaaaaacctctacctgaataaagcagtaaattttagtgaccatttgctaagttccgctgccgaaggcgacggtggactatgtggaagccgcagcagctgggtgtctgattatagccagagtacttccgacactatcgagaagatcaagaggattaaaaattttaagacgaaaaccttccaggagaagaaagagcagctcatcccagaaaacagactcctgctgaaggaggtcggtccaacaggggagggaagagtaagtgtgatcgagcaactgctggacgaaggggccgatcctaattgctgcgatgaggacaacaggcctgttattacggtcgctgtgatgaataaacaccacgaagctattcccgtgctggtacagaggggagctgatattgatcagcagtggggacccctcagaaacaccgccctccacgaggccactctgctggggctggccggaagggaatcaacagcaaccctgttgggatgcaacgcctctatccagaaaaagaatgccgggggtcagaccgcctacgacctggccctgaacaccggcgacgacttagtgacttctctgttcgccgccaagtttggccagggactggaggaccagctggctcagaccagatccctgtcccttgacgactgttag

SEQ ID NO: 46876 - DNA, 2193 bp, Artificial Sequence
  Description of Artificial Sequence: Synthetic coding sequence
atgaccgccggcagcgtgtgcgtgccccagatcatccccctgcgggtgccacagccagggaaagccaaccatgaaatagacaataacaccctgctggagatgaagtccgatacccccgatgtcaatatctattacaccctggacggctcaaaacctgagttccttaagcgtatcggatatggagaaaataacacctttaagtatatcaaacctatcaccctccccgatgggaagattcaggtgaaagccatcgctgtatctaaagattgtaggcagtctgggatcgttacgaaagtgtttcacgttgactatgagccacccaacatcgtgagccccgaggacaacgtagagaacgtgctgaaagactcatcccgacaggccagggagttcaagaatggctttgtggggagtaagctcaaaaagaagtacaagaattcagagaatcaacggtcgtggaatgtgaacctcagaaaattcccagaatcaccgctggagatcccagcctacggagggggctccgggtcccgcccacctacacgccaaagccaaagccccggctttgcgcatgtctccgggcaaaagtgtttaacctccactgagatcatgcggattcagcgtgagaccgattttcttaaatgtgctcattgcctggctcctcggccctctgatccgtttgcaaggttctgtcaggaatgtggatcacctgtaccaccaatcttcgggtgccgcctccctcctcctgagggggctcaaatgggactatgcgcggagtgccggtcattagtccccatgaacacgccaatctgtgtggtgtgtgaagcaccgctggctctgcagctacagccacaggcatcccttcacctgaaagagaaagtgatctgcagggcttgtggcaccggaaaccccgcccatttgagatattgtgtgacttgcgaaggggctttacccagtagtcaggagtcaatgtgctccggcgacaaagccccgccacctcctactcagaagggtggaactatttcttgctaccgttgtggtcgttggaacttatgggaagcaagtttttgcggctggtgtggcgccatgctcggcataccagctgggtgttcggtttgccccaagtgcggagcctccaatcacctgagcgccaggttttgtggctcttgtggtatttgtgttaaatccttggttaaactttcactagataggagtcttgcccttgccgccgaggagcctagacccttcagtgaatcactgaatatacccttgcccagatcagatgtcggaacaaagcgcgatattggaactcagaccgtcggcctcttctacccaagtggcaaactgctcgcaaagaaagaacaggaacttgcttcacagaagcagcggcaagagaaaatgagtgatcacaaacctctattgactgctatcagtcccggccgggggtattggcgtaggcagctcgaccacatcagtgcccatcttaggtgttatgctcagaacaatccggagtttcgcgccctgatcgctgagccccggatgggcaagctgatttccgccaccgtacatgaagatggctgtgaagtgtcgatcagactcaattactcccaagtctctaataaagtgaggaaactacggctgcgcgaggtgaagcagccagcctccagcaagggtactaaacttgctgggagaccgctgataaagaacttcaaaaccaagaccttccaagaaaagaaagagcaactcattccggagaatcgcctgcttctgaaggaagtgggtcctaccggcgagggtcgagtttccgtgatagaacagttgctggacgagggtgcagacccaaattgctgcgacgaagacaaccggcccgtgattacggtggccgttatgaataaacatcatgaggctattcctgtgctcgtgcagagaggtgctgatattgaccaacagtggggcccattgagaaataccgctctgcacgaggccacccttttggggttagccggaagggaaagcacagctacgctgttaggctgtaacgccagcatccaaaagaagaacgcgggtggccagaccgcatatgatctggccttgaatacaggcgacgatctagtgacatcactgttcgctgccaagtttggtcagggtctcgaggaccagctggctcagactcgatcactttcgctggacgactgctag

SEQ ID NO: 46877 - DNA, 1917 bp, Artificial Sequence
  Description of Artificial Sequence: Synthetic coding sequence
atgctgaccctggagagcttccagcgggtgcactggaagagccagctcatggtggaggaccaggtgctggaccacccacccgcctcccccaggcaggacacagttcctttcacatttaagtcgttcctattcggccactccatggagattcggccgtggaagcgcaaggggaggactttgtttcgaagactacttttccaaagccctgggttcgcccatgtgagcgggcagaagtgcctcacctcgacagagattatgcgtattcaacgcgaaacagatttccttaaatgcgcccactgtttagctccccgaccatctgatccgtttgccaggttttgtcaggagtgtggcagcccagtcccgccaatttttggctgtcgacttccaccaccagagggagctcagatgggactctgcgccgagtgtcggtcactggtgcctatgaatactcccatttgcgtcgtatgcgaggctcctctggcactgcagctgcagcctcaggcaagcttgcatttgaaagaaaaggtgatatgcagagcgtgtggcacagggaaccctgcgcacctgaggtactgcgtgacttgcgaaggtgcactgccaagctcccaggagtctatgtgcagcggggataaagctcctccgcctcctacgcagaagggcgggacaatctcctgctaccgatgcggacggtggaatttatgggaagccagtttttgcggatggtgtggggccatgttgggcattccagcaggatgttcggtgtgtcctaagtgtggagctagcaatcacctgtccgccaggttctgtgggtcatgtgggatctgcgttaaaagtctcgttaaattaagcttggaccgatcactcgccctcgcagccgaggagcctagacccttctcagagagccttaacataccgctaccaaggagcgacgtggggaccaagagagacatcggcacgcagacagtggggttgttctacccgtcagggaaattgctagccaaaaaagaacaagaactggcatctcagaagcagagacaggagaagatgtcagatcataagcccctgctgaccgccatcagccctgggcggggttattggaggcgccagcttgatcatatctcagcgcatttacggtgctacgctcaaaacaatcccgagtttagagcgttgatcgctgagcctcgaatggggaagctgatctctgccaccgtccatgaggatggttgtgaggtttcaattaggctgaattatagtcaggtctccaataagaatctgtacctaaacaaagccgtgaacttttccgaccatctgcttagctctgccgctgagggcgatggaggcctctgcggatctcgctcaagttgggtcagcgactacagtcagagcacttctgataccatagagaagattaaacgtatcaagaattttaaaacaaagacatttcaagaaaaaaaagaacagctgattcccgaaaaccgcttgctactgaaagaagtgggacctacaggcgagggacgagtgtccgtcattgaacagttacttgatgaaggagccgaccccaactgctgcgacgaagataatcgcccggtgatcacggtagctgtgatgaacaagcaccacgaggccatacctgttctggttcagaggggagctgatattgaccagcagtggggcccactccgcaacacggctctccacgaagcaacgctgctggggctggccgggagagagtcgactgctaccctgttgggctgcaacgcatccatccagaaaaaaaatgctggcggacagaccgcttacgacctggcactgaacacgggagacgacctcgtaacgtcgctgtttgcggccaaattcgggcagggactcgaggaccagttagcgcagacccgaagtctaagcctggacgactgctag

SEQ ID NO: 46878 - DNA, 1656 bp, Artificial Sequence
  Description of Artificial Sequence: Synthetic coding sequence
tgacagcgggagaccgacttcctgaagtgcgcccactgcctggccccccgcccaagcgaccctttcgcgaggttttgccaggaatgtggctctcccgtaccccctatttttgggtgtaggctccccccacccgagggcgctcagatggggctgtgtgccgaatgtaggagcctcgttccaatgaatactcccatctgcgtcgtctgcgaagcacccctcgctctgcagctgcagccgcaagcgagccttcatctcaaggagaaagtgatttgccgagcatgcggcacgggtaaccctgcccacttacggtactgtgtgacgtgtgagggcgcactaccatcatcccaagagagcatgtgttcgggtgataaggctccccccccacccacccagaaaggcggcacgatcagttgctataggtgcggacgatggaatttgtgggaagcatcattctgcgggtggtgcggggcaatgttggggatcccggcaggctgctccgtgtgccctaagtgcggggccagcaatcatctctctgccaggttttgtggaagctgcggaatttgcgttaagtcgctggtaaagctatcgctcgaccgatccctggctttggccgctgaggaacctagacccttctccgaatcactaaatatccctctgccacggagtgacgtggggactaagcgagacataggtactcaaaccgttggactcttctaccccagcggcaagcttctggcaaagaaagaacaggaactcgctagccagaaacagcggcaagagaagatgagtgaccacaagccgctgctaactgcgattagccctggtagaggctactggaggcgccagttagaccacatcagtgctcatctcagatgttatgcccagaacaaccctgagttcagagcactcattgccgagcctcgcatgggaaaattgatttcagccactgtgcatgaggatggttgtgaggtcagcattaggctgaactattctcaagtttccaataaaaatctctacttgaacaaagccgtgaacttttcagatcacttgctcagtagcgctgccgaaggcgatggggggttgtgtggctctcggagctcttgggtgagcgattacagccagtccacatcagatacgatcgaaaaaatcaagcggatcaagaatttcaaaactaagacatttcaggagaaaaaggagcagttgatcccagagaaccgtctgctgctgaaggaggtgggtcctaccggagaggggcgggtcagtgtaatcgagcagctgttggacgaaggcgcagaccccaactgctgtgacgaggataatcgcccggtgattacggtggccgtaatgaacaaacaccacgaagctataccagttttggtccagcgaggggccgatatagaccagcaatggggcccattgcgcaatacagctctgcacgaagcgactttactcggactggccggacgtgagtctacagcgaccctgctgggatgtaacgcttccattcagaagaagaacgctggcggtcagaccgcctatgacctcgccctcaacacaggagacgatctggttacttctcttttcgcggcaaaatttggacaaggtctggaggaccagctagctcagactagaagcctgtctctagatgactgctag

SEQ ID NO: 46879 - DNA, 1758 bp, Artificial Sequence
  Description of Artificial Sequence: Synthetic coding sequence
atgctgaccctggagagcttccagagccccggcttcgcccacgtgagcgggcagaagtgcctgacatcaaccgagattatgaggatacagcgggagactgacttcctgaagtgcgctcactgtctggcccccaggcccagcgatccatttgctagattttgccaagagtgcggtagtcccgtgcctcctatatttgggtgtaggttgccacctcccgagggagcgcagatgggcctctgtgctgagtgtcgctcgctggtgccaatgaatacaccgatctgtgtcgtctgtgaggcgcctttagcactccagctccaaccacaggcttccttacacttaaaggagaaggtgatatgtcgggcctgcggcacgggaaacccagctcaccttagatattgcgtgacttgcgagggcgcccttccgagttctcaggagagcatgtgttctggggacaaggccccacctccaccgacacagaagggtggtacaatttcttgttaccgttgcggccgctggaatctttgggaggcttcattttgtggctggtgcggagcgatgctcgggattccagcaggttgctcagtctgccctaaatgcggggcgtccaatcaccttagtgccaggttctgtggctcctgcggcatctgtgtcaaaagtctggttaagctctcattggatagatccctggctctggccgccgaggagccccggcccttcagcgagcctagatgtgcatggcagagtctgaacattccgcttcctagatccgacgtgggtacaaaacgcgatattggtacccagacggttggtctattttatccctcaggcaaactgcttgccaaaaaggagcaggagctagcatcgcagaagcagaggcaagagaagatgtccgatcacaaacctcttttaactgccatctctccaggccgtgggtattggaggcggcagttagaccacatctcagctcatctgcggtgttacgctcagaataatcctgagtttcgcgccctgattgctgaaccgcgaatgggcaagctgatctcagctacagtgcatgaggacgggtgcgaggtgtccatcagactcaattacagtcaggtttccaacaaaaatttgtatttgaacaaggctgttaacttctctgatcatctgctaagctcagcggccgaaggagacgggggactctgtggaagtagatcgtcttgggtctctgactattcgcagagcactagtgacactattgaaaaaataaaaaggatcaagaacttcaagactaagacctttcaggaaaagaaggaacagctgatccccgagaatagacttctgctgaaggaggtgggacctaccggggagggcagggtctcagttattgagcagcttttagacgagggggctgaccctaattgctgcgatgaggacaaccggcccgtgattacagtggcagtaatgaataaacaccatgaggccatcccagtgctggtgcaaaggggagcagatatcgaccagcagtggggacccctccgaaacaccgccctgcacgaggccaccctgctcggcctggccgggagagaatccaccgccacactcttagggtgcaacgcaagtatccagaaaaaaaacgctggcggccaaacggcctacgatctggccttgaacaccggcgacgatcttgtgacgagcctgttcgcagcaaagtttggtcaggggttggaggaccagctggctcagacccggtcactctcactggatgactgctag

SEQ ID NO: 46880 - DNA, 1614 bp, Artificial Sequence
  Description of Artificial Sequence: Synthetic coding sequence
atgaccatcaacagcttcaagagccccggcttcgcccacgtgagcggacagaagtgcctcacctcgacagaaattatgcggatccaaagggagacagattttctcaaatgtgcacattgccttgccccccggccttcagaccccttcgcccggttctgccaggaatgtggctctcctgttccaccaattttcggctgccggctccctcctcccgaaggcgcccagatgggcctgtgcgctgaatgcaggtcacttgtgcctatgaacactccgatctgcgtcgtttgcgaagcccccttagcacttcagctgcaaccccaggcctctttgcaccttaaggagaaagttatctgccgcgcttgcgggaccggaaatccagcacatcttcgctattgtgtcacatgtgaaggagctctgccttcctcccaagagctcggaattcctgccgggtgcagcgtatgtccaaagtgtggcgcctccaaccatttgagcgcgaggttctgtggctcttgtggtatctgtgtcaagtcattagtaaaactttccctagaccgcagcctggctctggcagcagaggaaccgagaccttttagcgagagccttaatattcccctacctagatccgacgtgggtaccaagcgggatatcggcacacaaaccgtcggcctgttctaccctagcggcaagctgcttgccaagaaagaacaggaattggcctctcagaagcagcgccaggagaagatgagcgatcataagcctctgctgaccgccatctcacctggccggggctattggagacgacagctggaccatatctccgcccatcttcgttgttacgcgcagaacaatcccgagttccgcgctctcattgccgaaccccgtatgggaaagctgattagtgccactgtccacgaagacgggtgcgaggtgtctattcgactgaattattctcaagtctccaataaaaacctgtacttgaataaggctgtgaacttcagtgatcacctcctctcctccgctgcggagggggatggagggctctgtgggagtcgtagctcatgggttagcgactactctcagtctacctccgacaccatcgagaagattaagaggatcaagaacttcaagactaagacctttcaagaaaaaaaagaacagctgatcccagagaaccggcttttgctgaaagaggtgggtcccaccggagagggtagggtgagtgtgattgagcaactgctggatgaaggggccgaccccaactgctgcgatgaggataaccggcctgtgatcaccgttgccgttatgaacaaacatcacgaagcgattcccgtcctggttcaacgtggagcggacatcgaccagcagtggggccccttgaggaatactgcactgcacgaggcaaccctgctcgggttggctggacgggagagcacagctaccctgttaggctgcaacgctagtatccaaaagaagaatgctggaggtcagacagcctacgacctagctctgaacacaggagatgacctggtcaccagcctgttcgcagctaagttcggccaaggattagaagaccaactcgctcagacacggagcctgtctctcgatgactgctag

SEQ ID NO: 46881 - DNA, 1755 bp, Artificial Sequence
  Description of Artificial Sequence: Synthetic coding sequence
atgaccatcaacagcttcaagagccccggcttcgcccacgtgagcggccagaagtgcctgacaagcaccgagattatgcgaatccagagggaaaccgactttctgaaatgcgctcactgcctcgccccccgcccatccgacccctttgctaggttctgccaggaatgtgggtctcctgtcccccctatcttcggttgccggctgcctccacccgagggcgctcaaatgggcctttgtgccgagtgtcgctcactcgtgcctatgaacactccaatttgcgtcgtgtgcgaggcaccgcttgccctgcagctgcaacctcaggcctccttgcacctcaaggagaaagtgatttgccgcgcctgcgggactggtaacccagcacatcttagatactgtgtcacttgcgaaggcgccctgccatcttcgcaggagtccatgtgttcgggggataaggcacctccacctcctacccagaaaggaggaaccattagttgctacagatgtggcaggtggaatctgtgggaggcaagcttctgcggctggtgtggcgcaatgctggggattccagctggctgctcagtgtgcccaaaatgtggcgctagcaaccatctctctgcccggttttgtggatcctgcgggatttgcgtcaagtcgttagtgaaattaagtctggacaggtctctggctctcgcagccgaggaacctcgccccttctctgaaccacggtgtgcgtggcagagtttaaacattcccctgccccgctccgatgtcggcactaaacgagacataggcactcagactgtgggcctgttctacccttctgggaagctgctcgcaaaaaaggagcaagagcttgccagccagaaacaaaggcaggagaagatgtcagatcacaaacccctcctgacagcaatttcccctggtcgcggctactggcgacgccaactggatcacatctcagctcacctgcggtgttacgctcagaataacccagaattccgggccctgattgcggagcctagaatggggaaactgatctccgcgactgtccacgaggacgggtgtgaagttagcattagattgaactattctcaggtaagcaataagaatctgtacttgaacaaggccgtgaactttagtgaccacctgctgagctccgcagctgagggcgacgggggcctctgcggttcccgttccagctgggtgagcgactatagccagagcacctccgatacaatcgagaagataaaacggatcaagaacttcaaaactaaaacttttcaagaaaaaaaagaacagcttatccccgaaaacagactgctactcaaggaggtggggccaactggagaggggagagtctccgtgatcgagcaactgctggacgagggtgccgacccaaactgctgcgatgaggataatcgccccgttattactgttgcagtaatgaacaagcaccacgaagccatccctgtgcttgtccaacgaggagcagacatcgatcagcagtgggggccacttcgaaatacggcactgcatgaagctacactgctgggtctggcgggcagagaaagtactgcaacactcctaggctgcaatgccagcatccagaagaaaaacgccggcggccaaaccgcctatgatcttgccctgaacacgggcgacgatctcgtcacgagtctctttgcagcaaagtttgggcagggactggaggaccagctagcgcagactagatcccttagcttagacgattgttag

SEQ ID NO: 46882 - DNA, 1050 bp, Artificial Sequence
  Description of Artificial Sequence: Synthetic coding sequence
atggccggcggcagccccgccgccaagcgggtggtggtgtaccggaatggcgatcctttctttcctgggtcccagctggtggtgactcagaggcggttccctacaatggaggcctttctctgcgaggtgaccagtgccgttcaggcccctttagccgtgcgggccttatataccccctgccacggtcaccctgtcacgaatttggcagacctgaaaaaccgggggcagtacgtagctgcgggtttcgagaggtttcataagctccattatttgcctcatagagggaaggacccaggcggaaaaagttgccgtttgcaggggccacccgttaccagacacctatgtgatggagccatcggccgccagctgcctgccggagcccccagctacatacatgtgtttcggaatggcgacttagtatcacccccattctctcttaagttgtcacaagcagcctcccaggattgggagaccgtgctgaaactgctgaccgagaaggtgaaactccagtcaggagcagtgtgcaaattgtgcactctcgaaggcctccccctcagtgcaggaaaagaactggtaactgggcattattacgtggcagttggcgaggatgagtttaaggatctgccttatctagagttgctcgtcccctcaccatctcttccccggggatgctggcagcctccaggatctaagagccggcctcatcggcaaggagcccagggacatagggctcaggtgacccagcctagccccaaagaacctgaccggattaaaccgtcagccttttacgccagacctcagcagacaattcagcccagaagcaagcttcccacacttagtttcccctctggagtgattggtgtgtacggggcgccccaccgtcgcaaggaaactgcaggcgcgctcgaagtagcggacgatgaggatactcagaccgaagagcctctggaccagcgcgctgcgcagatagtcgaggaggcattatcactggaaaaccagccgggagcgggtgccgccatttccgcctcggcacccgccctgccatcatag

SEQ ID NO: 46883 - DNA, 453 bp, Artificial Sequence
  Description of Artificial Sequence: Synthetic coding sequence
ctgatcctggaggagcagttccccagcggcctgatcggccccctgttcactatgaatggccatcttctgggcgattccaaagacctgcaagataaccacttttacgtggctgttggtctggagactttcaaatactttccctattggaaatcccccagagtgccgtccgaggttcagcagcgctatgcaaacgtggagaaaaacagtcagcgaaagaaaaaagtggatagcaaagggaaggaaccttgcaagtatgatggtataccccccaagacacaagactccgtctactatgctaaagaggaaaaaaaaaaaaccttagccgagcctttagttcagcgcggagccgagggtgacgtctataaggcaccaaccccttcaaaagagacgcaaggggctttggatgtgaaggaggaacataatgttcagttagaggtacctgtagatcagtag

SEQ ID NO: 46884 - DNA, 579 bp, Artificial Sequence
  Description of Artificial Sequence: Synthetic coding sequence
atggccgccccccccaaggcccccatccgggtgcggaacctgaccattcgggctggtgctcttaccggcaaggagaacaatatgttacagccggaaacacacatcttcacagcacctgaggaagggagttcccagggcgcattgctgctcggacaggctccagagccacttagccttccctgtacaccagtaactctcgagcagcagctggtatccccaagtggcgacccacatcgagcgcccgccttaccttcaatctgttctaccctcattctgcaaccctgtgccacactggatcccctgctcctgcagccccaggtgcccaaagtgtcggaccaagcactggtctccgcacacagtgagtggcagcgcaagctggaagccgctgaagccctgctgacactacgaaacagcgcacaggctcctcctgatagcattagcctgcatcagccttgtaacccgcctgccccagcgggcgacaaaggcttccagccgccctcgcctagcctgcggccgagaccggcgtctagcatctcattgcctattggtcacctaggttgcatttcactgctcagttag

SEQ ID NO: 46885 - DNA, 534 bp, Artificial Sequence
  Description of Artificial Sequence: Synthetic coding sequence
atggagagcatctacctgcagaagcacctgggcgcctgcctgacccaggggctggccgaagtggccagagtcaggcccgtcgaccccatcgaatacttggctctttggatttacaagtacaaggagaacgtcaccatggagcagctacgccagaaggaaatggcgaaattggagcgggaaagagaactggcccttatggaacaggagatgatggagcggttgaaggccgaagagctcctgttgcaacagcagcagctggccttgcagcttgagctggagatgcaggagaaagagcgtcagaggatccaggagttacagcgcgcccaggagcagctagggaaagaaatgaggatgaacatggaaaacctcgtgagaaacgaggacatactgcacagcgaggaggccaccctcgattctggtaaaacactggcagagattagcgacagatatggagcccctaacttgagccgggttgaagaattagatgagcctatgtttagcgatatcgcactgaacattgaccaggacctgtag

SEQ ID NO: 46886 - DNA, 534 bp, Artificial Sequence
  Description of Artificial Sequence: Synthetic coding sequence
atggagagcatctacctgcagaagcacctgggcgcctgcctgacccaggggctggccgaggtggcccgcgtgagaccagtcgaccctattgaatatcttgctctttggatttataaatacaaagagaacgtgaccatggagcagctaaggcagaaggagatggcaaagctggagagagagcgggagttagctcttatggagcaggaaatgatggagagactgaaggccgaggagctcctgctccagcagcaacagttggcactgcaattagagcttgaaatgcaggagaaagagaggcagaggattcaagaactgcagcgggcccaggagcagttaggtaaggagatgaggatgaacatggaaaacctcgtgcgcaacgaagatattctgcacagcgaggaagccacacttgactctgggaagacactggcagagattagtgataggtacggagctccgaatttgtctcgcgtggaagaactggacgagcctatgtttagcgatattgccctgaacattgatcaggatctttag

SEQ ID NO: 46887 - DNA, 555 bp, Artificial Sequence
  Description of Artificial Sequence: Synthetic coding sequence
atggagagcatctacctgcagaagcacctgggcgcctgcctgacccagggccttgctgaagtggcccgcgtaaggcctgtggatcccatcgagtacctcgcattgtggatatacaaatacaaggagaacgtcactatggagcaactccggcagaaggagatggccaagctggagcgtgaaagagaactcgccctgatggagcaggaaatgatggagagactgaaggctgaagaactgcttttacaacaacagcaattggcattacagctggaactcgaaatgcaggaaaaggaaagacagcgtatccaggaacttcagcgagctcaggagcaactggggaaagaaatgcggatgaacatggagaacttggtaagaaatgaggatattctgcattctgaggaagccacactggattctggtaagacactagcagagattagcgaccggtatggagctcccaacctcagtcgtgtcgaagagcttgatgagccaatgttctccgacgtgtccatctccgtcttttgcgagaagactaggttttgcttttgcttctag

SEQ ID NO: 46888 - DNA, 243 bp, Artificial Sequence
  Description of Artificial Sequence: Synthetic coding sequence
atggagagcatctacctgcagaagcacctgggcgcctgcctgacccaaggtctggctgaagtcgcacgtgtgcggcctgtagaccctatcgagtatcttgccttatggatttataaatataaggaaaacgtcacaatggaacagctgcggcagaaggagatggccaagctcgagcgagaacgagagctggctctgatggaacaggagatgatggaacgactgaaggcagaagagctgttatag

SEQ ID NO: 46889 - DNA, 462 bp, Artificial Sequence
  Description of Artificial Sequence: Synthetic coding sequence
atggagagcatctacctgcagaagcacctgggcgcctgcctgacccagggtttagcagaggtcgctcgggtgcggcccgtggaccccatcgaataccttgctttgtggatctacaagtacaaagagaacgtcacaatggaacaactgcgccaaaaagagatggccaagctggaaagagagagagagttggccttaatggagcaagaaatgatggaacgactcaaggccgaagagctgctcctccagcagcagcaactcgccctacagcttgaacttgagatgcaggagaaagagcggcaaagaatccaagagctacagcgggcccaggaacaactgggcaaagaaatgcggatgaatatggaaaacctcgtcaggaatgaggatattctacactcagaagaagctacactagatagcgggaagacactggctgaaatctcagataggtacggggctccctag

SEQ ID NO: 46890 - DNA, 534 bp, Artificial Sequence
  Description of Artificial Sequence: Synthetic coding sequence
atggagaccaactacctgaagcggtgcttcggcaactgcctggcccaggctctcgccgaagtcgcaaaggtaagacccagtgatccaatcgaatatctggcccactggttataccactacaggaaaaccgctaaggctaaggaggaaaatagggaaaagaagattcacctccaggaggaatatgattcatcacttaaggagatggagatgactgagatgctgaaacaagaagaataccaaattcagcagaattgcgagaaatgccacaaggagctgacctcagagaccgtctctaccaagaaaactatttttatgcaagaagacaccaaccctcttgaaaaagaggctttaaaacaggaatttctccccgggacttcatcactcattcctgggatgcctcagcaggtgccaccttctgaatccgcaggccaaatcgatcagaactttaagatgcctcaagagataaactacaaagaggccttccagcatgaggtggctcacgagatgcctcccggatcaaagtccccgttctag

SEQ ID NO: 46891 - DNA, 534 bp, Artificial Sequence
  Description of Artificial Sequence: Synthetic coding sequence
atggagaccaactacctgaagcggtgcttcggcaactgcctggcccaggctctcgctgaagtcgcgaaggttcgacctagcgaccctatcgagtatctggcgcattggttgtaccactataggaaaactgccaaggcgaaggaggagaatcgcgagaagaaaattcatctccaggaggaatacgacagtagcttgaaagagatggaaatgacagagatgctcaaacaggaggaataccagatccagcagaattgtgagaagtgccataaggagcttacaagcgagacagtttctactaagaaaactatattcatgcaggaggacactaatccgctcgaaaaggaggctctgaaacaggaattcctgcccggaactagttctctaatcccaggcatgccccagcaagtcccccctagtgagagcgccggtcaaattgatcaaaacttcaagatgccccaagaaatcaactataaagaagcatttcagcacgaggtggctcacgagatgccacccgggagcaagagccctttttag

SEQ ID NO: 46892 - DNA, 576 bp, Artificial Sequence
  Description of Artificial Sequence: Synthetic coding sequence
atgatcctgcggcccccccagcagtgcggcaccgccgcccggatggagaccaactacctgaagaggtgcttcgggaactgcctggctcaagcactcgcagaggttgcaaaagtcaggccatccgatcccattgaatatctggcacactggctgtaccactaccgaaagacagctaaagcaaaagaagaaaacagggaaaagaagatccatctgcaagaagaatacgacagttcgctgaaagagatggagatgacagagatgttgaaacaggaagaataccagatccagcagaactgcgaaaagtgtcacaaggaactgacctctgagacggtgagtactaaaaagacaatcttcatgcaggaggatacaaaccccctggaaaaggaggcgctaaagcaggagtttctgcccgggaccagctccctgattccaggtatgcctcaacaagtccctccaagcgaatctgctggccagatcgatcagaattttaaaatgccgcaggaaattaattacaaggaagccttccagcatgaggttgcccacgagatgccgcctggtagcaagtctcctttttag

SEQ ID NO: 46893 - DNA, 534 bp, Artificial Sequence
  Description of Artificial Sequence: Synthetic coding sequence
atggagaccaactacctgaagcggtgcttcggcaactgcctggcccaggctttggccgaggtggctaaggttcggccctccgatccaattgaatatcttgcccactggctgtaccattaccgcaagacagcaaaggccaaagaggagaatcgtgaaaagaagatacatttacaagaagaatacgacagcagcctgaaagagatggagatgaccgaaatgctcaaacaggaagaataccagatccagcagaattgcgagaagtgtcataaggagcttacctcggaaaccgtgagtaccaagaagacaatcttcatgcaggaagatacaaatcctttagaaaaggaggccctgaaacaagagtttctgcccggcacctcatctcttattcccggcatgccccagcaggtgcccccgtccgagagtgccggacagattgaccaaaattttaagatgccacaggaaatcaattacaaagaagccttccagcacgaggtggcccatgaaatgccccctggatctaagagtcccttctag

SEQ ID NO: 46894 - DNA, 381 bp, Artificial Sequence
  Description of Artificial Sequence: Synthetic coding sequence
atggagaccaactacctgaagcggtgcttcggcaactgcctggcccaggcactggcagaagtggcaaaggtccgacctagcgaccctattgaatacctggcccattggttgtaccactaccgcaagacggccaaggctaaggaagaaaaccgagaaaagaaaattcacctgcaggaggaatacgactcctccctgaaagagatggaaatgactgagatgctcaagcaagaggagtaccagatccaacaaaactgcgagaaatgtcataaggagttgacttctgagaccgttagtactaagaagacgatcttcatgcaagaggacactaacccactggagaaggaagctctcaagcaggagtttcttcctggcacaagttag

SEQ ID NO: 46895 - DNA, 534 bp, Artificial Sequence
  Description of Artificial Sequence: Synthetic coding sequence
atggagaccaactacctgaagcggtgcttcggcaactgcctggcccaggcccttgcagaagtcgctaaggtccgcccgtctgaccccatagaatacttggcccactggctataccactaccgtaaaaccgccaaagccaaagaagagaatcgcgaaaaaaagattcatctgcaagaggagtacgactcctcactgaaggagatggaaatgaccgagatgttaaaacaggaggaatatcagatacaacagaattgtgagaagtgccacaaggagctcacttctgagacagtatcaacaaaaaagacaatctttatgcaggaggacaccaaccctttggaaaaagaagccctcaagcaggagttcctgccaggaactagctcgttgattcccggcatgccgcagcaggttcctcccagcgagtctgctgggcagattgatcaaaatttcaagatgccgcaagaaataaactacaaagaggcatttcaacatgaggtggcacacgagatgcctcccggtagcaaaagcccgttctag

SEQ ID NO: 46896 - DNA, 915 bp, Artificial Sequence
  Description of Artificial Sequence: Synthetic coding sequence
atgagcctgaacccccccatcttcctgaagcggagcgaggagaactcttccaaattcgtggaaaccaagcagtcccaaacaaccagcatcgccagcgaagacccattgcagaacctctgcttggcttcccaagaagtcttacaaaaggctcaacagtcaggccggagcaaatgcttaaagtgcggtgggagcagaatgttctactgttatacgtgttatgttccggtggagaacgtcccaatcgaacagatccccttagttaaactgcccctaaagatcgacataatcaagcaccccaacgagacggacggtaaaagtaccgccattcacgctaagcttctggcccccgaattcgtgaacatttatacttacccctgcatccccgagtatgaagagaaagaccatgaggtggccctgattttccccgggccgcaatcaatcagtattaaggatatctcattccacctgcagaagagaattcagaacaacgtgcgagggaaaaacgatgatcccgacaagccctcctttaaacgcaagagaaccgaagaacaggagttctgcgaccttaatgactccaagtgcaaaggcactaccctgaagaagatcattttcattgattccacctggaatcagacaaacaagatctttaccgacgaacgactgcaaggactgttgcaggtggagctgaagaccagaaaaacttgtttctggcggcatcagaagggcaaacccgacacgtttctctccacgattgaggccatttactacttcttagtggactaccacactgacattctcaaagagaaataccggggacaatacgataatttgttgttcttctatagtttcatgtaccagctgattaaaaacgcaaaatgcagtggcgataaggaaactggaaagctcacccattag

SEQ ID NO: 46897 - DNA, 330 bp, Artificial Sequence
  Description of Artificial Sequence: Synthetic coding sequence
atgagcctgaacccccccatcttcctgaagcggagcgaggagaactccagcaaattcgtcgagacaaagcagtcccagaccacgtcaattgccagtgaggacccgcttcaaaacctctgtctggcctcccaggaagtgctccagaaggcccagcagagcggacggtccaaatgtctcaaatgcggcggtagccgaatgttctactgctacacctgctacgtccccgtcgaaaacgttcctatcgagcagatccctctggttaagttttctctgtatcatttgggacagtccatggtatcatccgccagtaagatcacatgtatcggctag

SEQ ID NO: 46898 - DNA, 915 bp, Artificial Sequence
  Description of Artificial Sequence: Synthetic coding sequence
atgagcctgaacccccccatcttcctgaagcggagcgaggagaacagctcgaaattcgtggagacaaaacagagccagacgaccagcatcgcctcagaggacccgctacaaaatctatgtttggccagccaggaggttctgcagaaagcacaacagagcgggagatccaaatgtctgaaatgcggcgggagtaggatgttctattgctacacctgttacgtcccggttgagaacgtgccaattgagcaaatccctctggtgaagctgccactaaaaattgacatcatcaaacatccgaatgagactgatggaaaaagcaccgcaattcacgccaagctcctggccccagaattcgtgaacatatacacatacccatgtatcccagaatacgaagaaaaagaccacgaagtagctctgattttccctggaccccagagtatcagcattaaggacatctcttttcatctgcagaagaggatacagaataatgttcgcggtaagaacgacgaccctgacaagccctccttcaaaagaaaacggactgaggaacaagaattttgtgacctgaatgactccaagtgcaagggcacaacactcaagaaaattatctttatcgattctacttggaatcaaactaacaaaatcttcacagacgagcgtcttcaagggcttctgcaggtggagctgaagactagaaagacgtgcttctggcgccaccagaaaggcaagccagacactttcctcagtacaatcgaagccatctattatttcttagtggactatcacactgatatccttaaagagaaataccgggggcagtacgataacttgctattcttctactcatttatgtatcagctgattaagaacgccaaatgttccggcgataaggaaacgggcaaactcacacactag

SEQ ID NO: 46899 - DNA, 654 bp, Artificial Sequence
  Description of Artificial Sequence: Synthetic coding sequence
atgctgcccctgaagatcgacatcatcaagcaccccaacgagaccgatggaaagtcgactgccattcatgctaaacttttggcacccgagttcgtcaatatatacacctatccctgcattcctgaatatgaggaaaaagatcatgaagtggcacttatctttccaggaccacaaagcatcagtatcaaggatattagttttcatctgcagaaaagaattcagaataacgtcagggggaagaatgatgatcccgacaagccgagttttaagaggaaacggactgaagagcaggaattttgcgatctgaacgatagtaaatgtaagggcaccacgctgaaaaagattatctttatcgactctacatggaaccaaacaaataaaatttttaccgacgagaggctccagggcttattgcaggtcgaactcaagacacgcaaaacttgcttttggagacaccagaagggaaaacccgacacattcctgtctaccattgaggctatctactatttcttggttgattatcacaccgacatcctgaaagaaaagtacagaggacagtatgataatcttctcttcttttactcctttatgtatcagcttattaaaaacgccaagtgttccggtgacaaagagaccggcaaactgacccactag

SEQ ID NO: 46900 - DNA, 915 bp, Artificial Sequence
  Description of Artificial Sequence: Synthetic coding sequence
atgagcctgaacccccccatcttcctgaagcggagcgaggagaactcttctaagttcgtagagaccaagcagtcgcaaacaacttctattgcaagcgaagaccctctccagaacctctgccttgcatcccaggaggttcttcagaaagcacaacagtctggacgctcaaaatgcctgaagtgcggcggaagtcgcatgttctattgctacacttgctatgtgcctgttgagaacgtccccatcgagcagattcccctggtgaagctccccttaaaaatcgacatcatcaagcacccaaatgagaccgacggcaagtctaccgccatccacgccaaactcctggcgcccgaatttgtaaatatctacacctatccttgcatccctgagtatgaagagaaagatcacgaggtggctctgatcttcccggggccacaatctatctccatcaaagatatttcattccacctccagaagcgcatccaaaataacgtaagggggaagaatgacgaccccgacaaaccatcctttaaaaggaagaggaccgaagagcaggaattttgcgacctgaacgatagcaaatgcaagggcactaccctcaaaaaaatcatatttatcgactccacatggaatcagacgaacaagatcttcactgacgaacgcctgcaagggctgctccaggtcgaacttaaaaccagaaagacttgtttctggcggcatcagaagggaaagcccgacacgttcttgtctactatcgaggcaatttactattttctcgtcgattaccatactgatatcctgaaggaaaagtaccggggccaatacgacaatctcttgttcttttacagcttcatgtaccagctgatcaagaatgccaaatgctctggagacaaggaaacaggaaagctcacccattag

SEQ ID NO: 46901 - DNA, 285 bp, Artificial Sequence
  Description of Artificial Sequence: Synthetic coding sequence
atgagcctgaacccccccatcttcctgaagcggagcgaggagaactcaagtaaattcgttgagaccaaacagtctcagaccacttccattgccagtgaggatcctttgcagaatctgtgcctggcttcccaagaagtactgcagaaggctcaacaatcaggacgaagcaaatgcctcaagtgcgggggaagccgcatgttctactgttatacatgctacgtcccagtcgaaaatgtccctattgaacagattcctctggtgaaactccctctgaagatcgactag

SEQ ID NO: 46902 - DNA, 897 bp, Artificial Sequence
  Description of Artificial Sequence: Synthetic coding sequence
atggagagccagaaggaggcccggaccctgcaggagcccgtggcccggcctagtggcgcctcatcaagtcagacacctaacgacaaagaacgccgtgaaggcggtgccgtcccagcagctgccgctttgggagccgaagctgatgatgattccgctgacggtctgtgggaattgccagtggagcccgcggagaggagacccgagtgcacacgctgttcaagaccgcaaaaagtgtgcctatgccctttcctgccagcccacccattgcacatctccacacatctttacatcatccagcatcctgccgaggagaacaaggtgctgcgcacagtgccgctgttagccgcttgcctgccccaggacaagtgcaaggtcaagattgggagaaggttctctgaggagagggaccctgagctgtccactgtgtgtaggaaaagtggtactctgattctgtacccgggcgcggaggctgccaatctcgaagaatttatcttggattcacccgtgtacccttctacaatcattatcattgatggaacatggtctcaggctaaagacatattctacaaaaattcactatttagacaccccaagcaggtccagttgaaaacatctatcagcagtcaatacgtaatcagaatgcagcccactaatcgctgcttgagcacactcgaatgtgccgctgtcgccctcagcatcctggagaaaaacaactacatccaggaaactttgcttagacccctgcaggccttgtgcagctttcaactgcagcatggcgctcaaattaggctcagcaaggaacacctgctgaagaatggattgtaccctaagccaatgcctaagaataagagaaagctgcggaagatggaactcctcatgaacagcgtgaagatctag

SEQ ID NO: 46903 - DNA, 3477 bp, Artificial Sequence
  Description of Artificial Sequence: Synthetic coding sequence
atggccacccggaaggacaccgaggaggagcaggtggtgcccagcgaagaggatgaggccaacgtgcgcgcggtccaagctcattaccttcggagccccagtcctagccagtacagcatggtgagcgacgccgagactgagtctatttttatggaaccaattcacctatcatcagccatagcggccaagcagataattaacgaagaattgaaaccgccaggagtgagagctgacgccgagtgccccggtatgttggagagtgctgagcagctgttagtggaagatctgtacaatcgggtgcgggagaagatggatgacaccagcttgtataacaccccatgcgtacttgatcttcagcgtgctcttgtacaggaccggcaggaggccccttggaatgaggtcgacgaagtatggccaaacgtcttcatcgctgagaagtctgtggccgtaaataaagggcggttaaagagattaggaatcacacacatcctaaatgcagcccatgggacaggagtatatacaggacccgagttttacacaggactggaaatccagtatctcggcgtcgaggtggacgatttccccgaagtcgacatttcacaacactttcgcaaggcctcggagttccttgacgaagcattgttaacctaccgcggtaaggtgctggttagttccgaaatggggatatctcggagcgccgttctagtggttgcctatttgatgattttccacaacatggctatcttggaggcactgatgacagtgagaaagaaaagggctatctacccaaatgaaggatttctgaaacagcttcgcgagctcaatgagaaactgatggaagaacgcgaggaggactacggacgagagggggggtcagctgaagctgaggagggagaagggactggaagcatgttgggggcccgcgttcacgcactgacagtggaagaggaggacgattcggcttctcatctgagtggtagttctctgggcaaggctacacaagcctcaaagccacttacgctgattgacgaagaggaggaagaaaagctgtacgaacagtggaagaagggccagggtcttttgtccgataaggtgccacaggacggcgggggctggcgctccgcttctagtggtcaggggggggaggaactggaggatgaagacgtcgaaaggatcatccaggagtggcaatctaggaacgagcgctaccaggctgaaggttacaggcggtggggtagagaggaagaaaaagaagaagaatccgatgcgggttcatctgtggggcggcgccgacggaccctctctgaaagcagcgcatgggaatccgtgagcagtcatgatatttgggtgttgaagcagcaactcgaactcaaccgtcctgatcatggccggaggcgcagagccgatagtatgtccagcgaaagcacctgggacgcatggaacgagcgtcttttagagattgagaaggaggcttcacgccggtaccatgctaagtcaaagagagaagaggccgctgataggagctctgaggcagggagtagggtgagggaagatgatgaagatagcgtgggatccgaagcctctagcttctacaatttttgtagcaggaacaaggacaagcttacagcccttgagcggtggaagataaagaggatacagtttgggttccataagaaagatttaggagctggggactccagcggggaacctggagccgaagaggccgtaggggaaaagaatccgagtgacgtgtctctgacagcttaccaggcctggaaacttaagcaccaaaaaaaggtgggcagcgaaaataaggaggaggttgtagaactttccaagggcgaggactcagcccttgccaagaagcgacagagacggctcgagctgcttgagcgcagccgtcagacactagaggaaagtcaatcaatggccagctgggaggccgatagttcaaccgccagcggttccatcccgctgtcagcgttctggtccgccgatcctagcgtgagtgccgacggagatactacttcggtactgagtacccagtcccaccggtcacatctcagccaggctgcttctaatatcgcgggctgttctactagcaaccctacaacccccctacccaatttacctgtcggacctggggataccatctcgattgcatctatccaaaattggatcgccaacgtagtaagcgaaaccctcgcccagaagcagaatgaaatgctgctgttgtcacgaagcccctcagtggcaagtatgaaggcagtgcccgcagccagttgccttggggatgatcaggtgagcatgctgtccgggcactcaagttcctcgctgggtggctgtttactaccccaatctcaagcccgcccatcctctgacatgcaatccgtgctctcatgtaatacaacgctgagctccccagcggagtcatgccggtccaaggtgagagggacctctaaaccgatttttagtctgttcgcagacaacgtcgaccttaaagaactcggacgtaaggaaaaggaaatgcaaatggaactacgggaaaaaatgtcagagtataaaatggaaaagcttgcctcagataataagcggagttctctgtttaaaaagaagaaggtgaaagaggatgaggatgacggcgtgggcgacggcgacgaagacacggactccgccatcggcagctttaggtactcgtcacgaagcaattcacaaaaaccagagacagacacgtgcagctccctcgccgtgtgcgatcactacgcttccggttcccgggtcgggaaggaaatggactcgtccatcaacaagtggctaagcgggctaagaacggaggagaaaccgcccttccaatctgactggtcaggctcatcaaggggaaaatacacacgcagctctctgttaagagagactgagagcaagagctcttcttataagttttctaaatctcagtcagaagagcaagatacatcttcataccatgaagcaaacggaaactcagtacgtagcacctctcggttttcctcttcatctacccgcgaagggagagagatgcacaaattcagcagaagcacttacaatgagacctcaagttctcgggaggaatctcccgagccatacttcttccgtaggacacctgagagctccgagcgcgaggaatcccccgagcctcagaggcccaattgggccaggagtagagattgggaagatgttgaggagtcgtctaagagtgacttctcggaatttggggccaaacgaaagttcacccagtcctttatgaggtcggaggaggaaggcgagaaagagaggacggagaaccgggaagaaggacgttttgcctcaggcagaaggtcccagtatcgccggtccacagatagagaagaggaggaggaaatggacgacgaagccataatagccgcatggaggcgccgtcaggaggagacccgtacaaaactacagaagcggcgggaggactag

SEQ ID NO: 46904 - DNA, 3477 bp, Artificial Sequence
  Description of Artificial Sequence: Synthetic coding sequence
atggccacccggaaggacaccgaggaggagcaggtggtgcccagcgaggaagacgaagctaatgtacgggccgtccaggcacactacttacgctctcctagtccatcccagtactccatggtgagcgatgctgaaactgagtccatctttatggagcccattcatctgagctctgcaatcgccgctaaacaaataatcaacgaagaactgaaacccccgggcgtccgcgcagatgccgagtgtccagggatgcttgagtctgccgagcaactgctggtggaggacttgtataatagagtcagggagaaaatggacgatacaagcctgtacaatacaccttgcgtgctggacttacagagggcgctcgtccaggatcgtcaggaggccccctggaatgaagtcgacgaggtgtggcctaacgtgttcatagctgagaagagtgttgcggtgaataaaggccgcctgaaaagactggggatcacacatatcttgaacgcagcgcatgggacaggggtctacactggtcccgagttctacaccggattggagatccagtacctgggcgtagaggtggatgacttcccagaggttgatatcagccagcattttcgaaaagccagtgaattcttggacgaggccctgctgacttaccgaggcaaggttctcgtaagctcagaaatggggattagcagaagcgccgtactggtggtagcatacctcatgatattccacaacatggcaattttagaagccctgatgacagtccgaaagaaaagggccatctaccccaacgaagggtttttgaaacagctgagagaactgaacgaaaaactgatggaagagcgagaggaggattacgggcgtgaaggaggatctgctgaggcggaagagggcgaaggaaccggatcgatgctgggagccagagtgcacgccctaaccgtggaggaagaggatgactccgccagtcatttgtcgggctcgagtttgggcaaagcaactcaggcaagcaaacctcttaccctgattgatgaggaagaggaagaaaagctttacgaacagtggaagaaaggccagggattactcagtgacaaggtcccccaggacggcggggggtggcggagcgctagcagcggacagggtggggaagaacttgaagacgaagacgtggagagaattatccaggagtggcagtccagaaatgagcgatatcaggcggaagggtacagacggtggggtcgtgaggaagaaaaagaggaagaatctgacgccggatcctccgtagggcgcaggaggcgaacactcagcgaatcctccgcctgggagtccgtgagttctcacgatatctgggttcttaagcagcagctggaactcaaccgtccggaccacggtagacggcgcagggccgactctatgtcaagcgaatcgacatgggacgcatggaatgagagactgctcgaaatcgaaaaagaggcgagccgccggtatcacgcaaaaagcaaaagagaggaggccgcggatcgaagctctgaagcaggttcccgggttagggaggacgacgaagatagtgtcggatcagaggctagtagcttttacaatttttgctcccggaataaagacaagctgacagccctagagagatggaagattaaacgaatacaattcggtttccacaaaaaagacctgggcgccggagactctagcggagaacctggtgccgaagaagcggtaggagagaagaaccccagcgacgtctcactgacggcataccaggcttggaaactgaagcaccagaagaaggtgggaagtgagaataaggaagaggtggtagaattatcgaaaggcgaggacagcgctctggccaaaaagaggcagcgcagactggagctgttggagaggtcccgacaaactctcgaagaaagccagtccatggcctcgtgggaagctgattcaagcaccgctagcgggagtatccccctttccgccttctggtctgccgatcccagcgtcagtgctgacggcgacacaacatctgtactcagtacacaaagccacaggagtcacctgtcccaggctgcttcaaacattgctgggtgctccaccagcaatcctacaactccactccccaatctccccgtcggcccgggcgataccatcagcatagcgagcatccaaaattggattgctaatgtggtgtccgagaccctcgctcaaaagcagaatgagatgctcctcctgagccgctcccccagcgtcgcaagtatgaaagccgtgccagccgctagttgcttgggcgatgaccaagtaagtatgttgtccggccattcctcatccagtctgggcggttgcttgctgccacagtctcaggcccgcccgtcctccgatatgcagtctgtcctgtcgtgcaacacgactctgtcttcccctgctgaatcgtgtcggtcaaaggtccgaggaacttctaagccaattttttcattatttgccgataatgtggacctgaaggaactcggtagaaaagagaaggagatgcagatggagctgcgcgaaaaaatgtcagagtacaagatggaaaagctggccagcgacaacaagcgctcctccctgttcaagaagaagaaggtgaaggaagatgaggacgacggcgtgggagacggagacgaagacaccgacagcgccatcggaagttttaggtatagctcgcgttcaaactcccagaaaccggaaactgacacttgtagctccctggcggtgtgcgaccactacgcctcggggtctcgggtcgggaaggaaatggacagttccatcaataagtggttgtcaggactgcgcacagaggagaaaccaccgttccaaagcgactggtcaggaagcagtaggggcaaatatactagaagcagtttgctgcgggagacagagagcaagtccagctcatacaagttcagtaagagccagagcgaagagcaggacacgagcagctatcatgaggccaacggcaactccgtgagatctacttcacgattctcttcaagctccaccagggaggggcgggagatgcataaattcagtagaagcacctacaacgagacctctagcagtagagaggagtcccccgagccctatttttttagacgcacacctgagagttctgaacgggaggagtctcccgagccccagagacccaactgggcacggagccgagattgggaggatgtggaggaatctagtaaaagtgatttctctgaatttggggctaaacggaagtttacccaaagcttcatgcggagcgaggaagagggagagaaagaacggacggagaaccgcgaggaggggaggtttgccagtggacggaggtctcagtaccggaggtccaccgaccgggaggaggaagaggagatggatgatgaagctatcatcgctgcttggcgcagacgccaagaagaaacaaggacgaagcttcagaagagacgagaggactag

SEQ ID NO: 46905 - DNA, 3477 bp, Artificial Sequence
  Description of Artificial Sequence: Synthetic coding sequence
atggccacccggaaggacaccgaggaggagcaggtggtgcccagcgaagaggacgaggcgaatgtgcgggctgtccaggctcattatctccggagtcccagtcccagtcaatactctatggtaagtgacgccgagaccgagagtattttcatggaacccattcatctgtcaagcgccatagccgccaagcagatcatcaacgaagagttgaaacccccaggcgtccgcgcagatgctgagtgccccggaatgttagaaagcgcagagcagctcctggtggaggacttatataatagagtcagggagaagatggatgacacttccctgtacaacactccctgtgtcctggatctgcaacgggcgcttgtacaggatcggcaggaagccccttggaacgaggttgatgaggtgtggcccaatgtttttatcgctgagaagagcgtggccgtgaataagggcagattaaaacgcttggggatcacacatatccttaacgctgcccatggaacaggtgtgtacactggcccagagttttacaccggcttggaaatacagtatttgggcgtggaagtggacgacttccccgaggtggacatttctcagcacttccgaaaggcctccgaatttctggacgaggcactgttgacctaccgcggaaaagtgctggtgtccagtgaaatgggaatcagccgatccgcagtcctagtcgtagcgtatctcatgatttttcataacatggccatccttgaagcattaatgacagtcaggaaaaagagggcaatatacccaaacgagggctttctgaagcaattgcgcgaactgaacgagaagcttatggaggagagagaggaggactatgggcgggagggagggagtgcagaggctgaagagggcgaggggacgggatccatgctgggtgcccgggtgcacgctctcacagtggaggaagaggatgattccgcttcccacctgagtgggtctagtctgggtaaggccacacaggctagtaagcccttaacattgatagatgaggaagaagaggaaaaactttatgagcagtggaaaaaaggccaaggcctcctgtcagacaaggttcctcaggacggcggggggtggcgttctgcatccagcggtcagggcggggaggaactagaagacgaagacgtggaacggatcatccaggagtggcaatcacggaacgaaaggtaccaggcagaagggtaccggaggtgggggagggaggaagagaaagaagaggagtccgatgccggctcctctgtgggacgtaggcgccgcacattgagtgaatcaagcgcctgggaatcagtgtcttctcacgacatctgggtgttaaaacaacagttggagttaaacaggcctgatcatgggcgaaggcggagagcagatagtatgagctcagaaagcacctgggacgcctggaacgagcgtttgcttgagattgagaaggaggcctctcgccgatatcacgccaagtctaagcgtgaggaagctgctgatcgctcatccgaagcaggctcacgtgtacgcgaagatgacgaagacagcgtgggatcggaagccagttctttctataatttctgcagccgaaataaggacaaactcaccgccttggaacgatggaagattaagcggatccagtttgggttccacaagaaagatttaggagcaggcgatagtagcggcgaaccgggcgccgaagaagctgtgggagaaaagaatccctccgacgtgtctctgacagcctatcaggcttggaagctcaaacaccagaaaaaagtcggatctgagaacaaagaagaggtggttgagcttagcaaaggtgaagattcggcccttgccaagaagaggcagcggcgtctggagctcttggagagatctagacagactctggaggaatcccagagtatggcgagctgggaagcagactcttccaccgcgtcgggatcgatcccgctgtcagctttctggtctgcggacccctcagtgagtgccgacggagacacaacttccgtgctcagtacacagtcgcacaggtctcacctcagccaagcggccagtaatatcgcggggtgtagcacatcaaacccaactaccccgctccccaacctcccagttgggccaggagatactatcagcatcgcaagtattcaaaattggatcgccaacgtggtctcagagacgttggcacagaaacagaacgagatgttacttctgtcaaggagtccctccgtggccagcatgaaagccgtcccagcagcctcttgcctgggcgatgatcaagtctcaatgctatctggccactcttcctcttcgctgggaggatgtctcctgccccagtcacaagctcgcccctcatcagatatgcaaagcgtattgtcttgcaatactacactgtccagcccagctgaaagctgccgttcaaaggtacgcgggaccagcaagcccatcttctcgttattcgccgataacgtggatcttaaagaactgggccgaaaagagaaggaaatgcagatggaacttagagagaagatgtccgaatataaaatggagaagttagcctctgacaacaagcgaagctcactttttaagaagaagaaagtaaaggaggacgaagacgatggggtgggtgatggagacgaagacacagatagcgcaatcggcagttttcggtattcaagcagatctaactcccagaagcccgagaccgatacgtgttctagtcttgcagtgtgtgatcattacgcctccgggtcaagagtaggcaaggaaatggatagttcgataaacaagtggctgagcgggttgaggacagaggagaagccgcctttccagagcgattggtcaggttcttctaggggcaaatacacccgttcctccctgctccgggaaacagagagcaaatcatcctcttacaaatttagcaagtctcagtccgaagagcaggatactagcagctatcatgaagcaaacggaaactctgtgagaagtacctcccgtttttctagctcaagcactcgagagggcagggagatgcacaagttttccagaagcacgtataatgagacctcctcaagtcgggaggagagtccagagccctacttctttcgaagaacacccgagagcagtgagcgtgaggaatcgccggagccccaacgcccgaactgggcgcggagtagagattgggaggatgtggaggaaagcagcaagtccgatttcagtgagtttggggccaagcgaaagttcacacagtcctttatgcggtccgaagaggagggggagaaggagaggaccgaaaaccgcgaggaaggcagattcgcctctgggcggcgatcacagtaccggcgctccaccgaccgcgaggaggaggaggaaatggacgacgaagccattattgccgcttggcgaaggcgccaggaggaaaccaggactaaacttcagaaaagacgcgaggattag

SEQ ID NO: 46906 - DNA, 531 bp, Artificial Sequence
  Description of Artificial Sequence: Synthetic coding sequence
atgggccccgccgaggccggccggcggggcgccgccagccccgtgccccccccgttggtgcgtgttgctccaagcctgttcctgggcagcgctcgcgctgcaggagctgaggagcagctggctagagcaggggtgactctgtgtgtcaatgtcagcaggcagcaacctggtccccgcgcccccggagtcgccgaactcagagtgcctgtttttgacgaccctgcagaggatcttctcgctcatctcgagcccacatgtgcagcaatggaggccgcagtgcgagctggaggggcttgccttgtttattgcaagaacggcagatcccgtagcgccgcagtctgtactgcctatctaatgcgtcatagaggattgagcttggcgaaggccttccagatggtgaaatcagcacgacctgtagccgaaccaaatccaggattctggagtcagttgcaaaagtatgaggaggctctgcaggcccagagttgtctacagggagagccccccgcattaggcctggggccagaggcctag

SEQ ID NO: 46907 - DNA, 531 bp, Artificial Sequence
  Description of Artificial Sequence: Synthetic coding sequence
atgggccccgccgaggccggccggcggggcgccgccagccccgtgcctcctccactggtgcgagtcgccccctctctgttcctgggatctgctcgggctgctggggctgaagagcaattggcccgcgcaggcgttacactttgtgtgaacgttagccggcagcagccagggccgagagccccgggagtggcggaactgcgcgtgcccgttttcgacgaccccgccgaggacctgctggcccatttggaacccacttgtgccgccatggaagctgctgtacgagccggaggcgcctgcttggtatactgtaaaaacggacggtcaaggtcagcagcagtgtgtactgcctatctgatgcgccaccgaggtctcagcctcgccaaggcatttcagatggtaaagtctgcgcggccagttgccgagcccaatcccggcttttggtcccagctccagaaatatgaggaagctctgcaggcccagtcctgtctgcagggggaaccaccagctctcgggttaggccctgaagcatag

SEQ ID NO: 46908 - DNA, 1155 bp, Artificial Sequence
  Description of Artificial Sequence: Synthetic coding sequence
atggagggcctgggccggagctgcctgtggctgcggcgggagctgagcccaccccggccaagactgttactcctggactgtagaagccgcgaactatatgaatcagcgaggatcgggggcgccttgtccgttgcactccctgccctgttgctgaggagactccggcgcgggagcctcagtgtgcgcgccttgctccctggacctccgctgcagcctcccccacccgcacccgttctcctttatgatcagggaggaggccgcaggaggcgcggagaggcagaagctgaggctgaggaatgggaggctgaatcggttctcggaacattgttgcagaagcttcgggaggaaggctatcttgcttactatcttcagggtggatttagccgtttccaagctgagtgcccccacctgtgtgagacatccctggccggtagggcgggatcgagcatggctcccgtaccgggccccgtccctgtcgtcgggctcggcagtctgtgtctgggtagtgattgctctgacgcagagtctgaggcggaccgtgatagtatgtcctgcggcctggacagcgagggggccacccccccccccgtgggcctgcgcgcaagcttccccgtccagatactacctaatttgtatctgggcagcgcacgcgactctgccaatctggagagtctcgcaaagctgggcatacgctacatcttgaacgtcacacctaacctgccaaacttttttgaaaaaaacggagacttccattataaacagataccaatttctgatcactggtctcaaaatttatctcggttcttccccgaggcaatagagtttattgacgaagcactatcccagaattgtggggtgctggtccattgtttggcaggcgtcagccggtctgttacagtgacagtagcttatctgatgcagaagctccacctctctctcaacgacgcgtacgatttggttaagcgcaagaagtctaatatcagtccgaattttaactttatgggccagctgctagactttgagaggagccttcgactcgaggagaggcactcccaggagcagggctccggaggccaggcctctgctgcatccaatccgccctcattcttcaccacgccgacctccgacggcgcattcgagctcgcgcccacttag

SEQ ID NO: 46909 - DNA, 1707 bp, Artificial Sequence
  Description of Artificial Sequence: Synthetic coding sequence
atgaagtggaaggagaagctgggcgacggcgtgtacgacaccttcatgatgattgacgagacgaagtgccccccctgtagcaacgtgctttgcaatccgtctgagcccccaccaccacgacgcctcaatatgaccacagaacagttcaccggggatcacacccagcatttcctggacggcggggagatgaaagtcgaacaactgttccaagaattcggaaacaggaagagtaatacaattcagtctgatgggatttctgactccgagaaatgctcgccaaccgtttcccaagggaaatcatccgactgtctgaacacagtgaaatctaatagctccagcaaggcccccaaggtggtgccactgactcccgagcaggccctgaaacagtacaagcaccacctcaccgcgtatgagaagttagagattattaactaccctgagatttattttgtgggcccaaacgccaagaagaggcatggggtcattgggggacctaacaatggaggctacgacgacgctgacggtgcttatattcatgtgcctagagaccatctggcctaccggtatgaggtgctcaagattatcgggaagggttcctttggacaggtggcccgtgtgtatgaccacaagctccgccaatacgtggcccttaagatggtacggaacgagaaaaggtttcaccggcaggccgccgaggaaattcgtatcctggagcatctgaagaagcaggataaaaccggcagcatgaatgtgattcacatgctggagtccttcacattcagaaaccacgtctgtatggcctttgagttactgagcattgacttatacgagctcataaagaagaacaaatttcagggtttctccgtccagctcgtacgcaaatttgctcagtccatcttgcagtctctagatgccctgcacaaaaataaaatcattcattgcgatcttaagcctgagaatattctcctgaaacatcacggcaggagttccacaaaggtgatagatttcgggtcatcctgctttgaataccaaaaactgtatacatatatccaatctaggttctacagggctcctgagatcatactgggctcccggtatagtacaccgattgatatatggtcctttggctgtattctcgctgaactactaacagggcaacctctatttccgggcgaagacgagggcgatcaactggcgtgcatgatggagctgctcggcatgcccccccccaaactgttagagcagagcaaacgggcaaaatacttcattaacagcaaaggaatccctcgttattgctccgtgactactcaggcagacggcagagtcgtcctcgtcggaggacggagcaggagaggaaaaaagcgcggcccaccaggatcaaaagattgggggactgctctcaagggctgtgatgattacttatttatcgagttcctgaaacgatgtctgcactgggatccgtctgcaagactgacccccgcccaagccctccgccatccctggatctctaaaagcgtccctaggcccctcacaacaatcgacaaggtctcaggcaagcgggtggttaacccggccagcgcctttcagggtctgggtagcaagcttccccctgtggtgggcatcgctaacaaactcaaagcaaatctgatgtccgagactaatggatccatccccctttgtagcgtgctacctaaactgatctcttag

SEQ ID NO: 46910 - DNA, 1767 bp, Artificial Sequence
  Description of Artificial Sequence: Synthetic coding sequence
atgctgcccctgctggacagcagcaagcgggccggcaccctgggctcaggttgtggagtgccccgggtccatagcgccgccctgtccagggaggagggtgcttcacgggacatatggcgcatcaaggtttgggccagggttatgacaacaccagcagggagcggctccggttttggctcagtttcatggtgggggttgtctccggctctcgatctccaggctgagtctccaccagtggaccctgatagtcaagcagatacagtccactcaaacccagagctggatgtcttgctcctcggctctgtcgatgggagacatcttctcagaacactctctcgcgctaaattttggccccgtaggcgattcaatttcttcgtgcttgagaataatctcgaggccgtggccaggcacatgcttatcttcagcctcgcgctggaggagcccgaaaagatgggtctgcaggaacgttcagaaacttttttagaagtatggggcaatgctctgttgaggccgcctgtggcggcgtttgtaagggcccaagctgatctgctagcccacctggtgccggagcctgaccggctagaggagcagctcccttggctgtcactacgagccctcaaattcagagagcgggatgcgttggaggcagtgttccgcttttgggccggaggagagaaggggccacaggcctttcctatgtccaggctttgggattcccgcttacgccactatttaggtagtagatacgatgcacgtcggggtgttagtgactgggatcttaggatgaaattgcatgatcgcggcgcacaggtgatacaccctcaggagttcaggcggtggcgcgatactggcgtggctttcgaactgagagatagtagtgcctatcatgttcctaaccgaaccctggcttccggacgactgttgtcctatcgcggcgaacgcgttgcagcacgcggttactggggcgacatcgccacgggaccgttcgtcgcctttgggatagaggccgatgacgagagcctgctccgcacaagcaatggccagccggttaaaaccgccggagaaataacccagcacaacgtaacggagctgcttagggacgtggcggcgtgggggcgggctcgggccacgggcggcgatcttgaagaacagcagcatgcggagggctcacctgagcccggaacccccgcagcacccaccccagagagtttcacagtgcatttcctgcctctggattcagcccagaccctccaccacaagtcttgctacaatggccgtttccagttactttacgtggcctgcggcatggtccatcttctgatacccgaactgggggcctgcgtggccccaggcgggaatttaattgttgaactcgcccgttacttggtcgacgtgagacaggaacagctacagggctttaacacgagggttcgcgaactcgcgcaggcggcaggcttcgctccacagactggggcaagaccatccgagacattcgcccggttctgtaagtctcaggaaagcgcactcggtaatactgtgcctgccgtggagccgggcacacccccactggatatcttggctcagcctctggaagcttccaaccccgccttggagggattgacacagccactgcaagggggaaccccccactgcgagccgtgccaattgccctctgagtcgcctggaagcctgagtgaggtgctggcccaacctcagggagccctggctcctcccaattgcgagtctgacagcaagactggggtgtag

SEQ ID NO: 46911 - DNA, 1827 bp, Artificial Sequence
  Description of Artificial Sequence: Synthetic coding sequence
atgctgcccctgctggacagcagcaagcgggccggcaccctgggctcaggctgtggagtgccccgcgtccactccgccgccctttcccgagaagagggcgccagccgggatatctggcggataaaagtgtgggctagggtgatgacaacacctgctggatccggaagtggatttggttcagtgtcctggtggggactctcaccggccttggatctgcaggctgaacgggacgccactgttgacgcgctaccaactacgatggtgccccagcccgcagtgattctgccagggccgccggtagacccagacagccaggccgatacggtacatagcaatccagagctcgatgttctgctactcggctctgtcgatggaaggcacctgcttaggacattgtctagggcgaaattttggcccagacgtcgctttaacttcttcgtgctggaaaacaacctcgaagcggttgctaggcacatgcttatcttctctctggcccttgaagagcccgaaaagatggggcttcaagaaagatctgaaactttcctcgaggtttgggggaacgcactgctgcggccaccagtggctgcctttgttcgggcacaagcggatctcttagcccatctggtgcccgaacctgaccggctcgaggagcagctgccatggctgagtctgcgagctttgaagtttagagagagagatgcattagaagccgtctttagattctgggccggcggagaaaagggacctcaggcattcccaatgagtagactgtgggattctaggcttcgccattatctggggagtagatacgacgctaggcgtggagtctccgactgggacctgcgaatgaaattacacgatagaggagcccaggtgatacacccccaggagtttcgcagatggcgagacaccggtgtggcattcgagcttagagactcaagcgcctaccatgtcccaaatagaactttggcaagtgggcgcctgctgtcttatcgcggcgagagagtggcagcccgaggctactggggggatatcgccaccgggccgtttgtggccttcggcattgaggcggatgatgagtcactgctgcggacaagcaacggccagccggtgaaaactgcgggggaaattacccaacacaatgtgacagagctgctgcgggatgtggcagcatgggggcgcgcacgggctactggaggggatctggaagagcaacagcacgcagagggatctccagagccggggacacctgcccccacccccgagtcatttactgttcactttctccccctggattccgcacaaactttacatcataagtcatgttataacggccggtttcaactgttgtatgtggcatgcggcatggtccatctcctcattcccgaactaggcgcctgtgtcgctccaggaggcaacctcatagtcgaactggctcgttatctggtggacgtgcgccaggagcaacttcaggggtttaatactagagtgagggaactagcccaagctgccggcttcgcccctcagacgggcgcacggcccagtgagacctttgcacgcttttgtaagtctcaggaatccgccctgggcaatacagtcccggccgtcgaaccagggacaccccctcttgacattcttgcgcagcctctggaggcgtccaaccccgcgctcgaaggtctgactcagcctctccagggaggcacaccgcactgcgagccttgtcagctcccatctgaaagccctggctctctgtctgaagtgttagcccagccacagggtgcactggcccccccgaactgcgaatctgattctaaaactggcgtgtag

SEQ ID NO: 46912 - DNA, 288 bp, Artificial Sequence
  Description of Artificial Sequence: Synthetic coding sequence
atgaccacccccgccggcagcggcagcggcttcggcagcgtgagctggtgggggctctctccagcattggaccttcaggcggaatcacctccagtggaccctgactctcaggccgacactgtgcattcaaatcctgagctcgatgtgctccttctgggttcagtggatgggcggcatctgctgaggacactgagccgggccaaattttggccccgccgccgttttaacgtctcttgggatgaggacgagtcccctgactctagagtcctggaaggggggagggattag

SEQ ID NO: 46913 - DNA, 9279 bp, Artificial Sequence
  Description of Artificial Sequence: Synthetic coding sequence
atgagcgacgccaacaaggccgccatcgccgccgagaaggaggccctgaatctgaaactgccccctatcgtgcacctgcctgagaatataggcgtggatactccaacccagtcgaagctcctcaaatatagaaggagtaaggaacagcagcagaagatcaaccaactagtaatcgacggtgccaaacgaaatctggatcgcacattgggaaagcggacacccttgctgccaccgccagactaccctcagacaatgaccagtgaaatgaaaaagaaagggtttaattacatttacatgaaacaatgcgtggagagttctccacttgttccgatccaacaggaatggctggaccacatgctgcgtctgattcccgagtctctcaaggaagggaaagaaagagaagaattactggagtccctaatcaatgaggtctcgtctgatttcgaaaacagcatgaagagatatctcgtgcaatccgtgctggttaagccgccggtcaagagcctggaggacgagggaggccctttgcccgagagcccagtgggactcgattattcaaacccatggcactcctcgtatgtgcaggcccgaaaccaaatcttttcaaacttgcacatcatacaccccaccatgaaaatgctactagacctcggatacacaaccttcgctgacactgtgctattggacttcacaggtattcgggccaagggccctattgattgcgagtcccttaaaacagacctcagtatccaaacgaggaatgctgaggagaaaatcatgaacacctggtaccctaaggtcattaacctctttaccaaaaaggaggctctggagggagtgaaacccgagaagctcgacgcattctatagctgcgtgtcaaccctcatgtctaatcaattgaaagacctcttaaggcgaaccgtggagggttttgtcaagctgttcgacccaaaagatcagcaaaggctgcctatcttcaagatagagttaacttttgatgatgacaagatggaattttatccaacctttcaagacttggaggataatgtgctctcgctggtcgaacgaatagcggaggccctgcagaacgtgcaaactataccatcgtggctgtcaggcacctctacgcccgtgaacttggatacagagctgccagagcacgtgcttcactgggccgtggacactttgaaggccgccgttcatcgcaacctggagggagctcggaaacactatgaaacatatgtggaaaagtataattggttgctggatggaacagcagtcgagaacatcgaaaccttccagacggaagaccatacctttgacgagtatacagagtttatcgaaaagttcttgagcctagcaagtgaaataatgctgctacctcagtggatccattataccatggtcagactggattgtgaagatctgaagacaggtctgacaaacaaggctaaagctttcgcgaacatcctgttgaacgatatcgcctctaagtatcgaaaggaaaatgagtgcatctgcagcgagttcgaggccataaaggagcacgcacttaaagtacctgagactaccgaagaaatgatggacctaatttcctatgtggagaaagcgcggaccgttggcatcgaggagctgatcctccggatccaggaaagtaaacgacaaatgtcctactttctggacgtgttcttgtttcctcaggaagacctggctctcaatgctacggtgttaatgtggccacggaaaatcaatcctatcttcgacgaaaacgacgaacttattgagaatgccaagcacaaaaaggaaaacgaactcatggcaaagagagaaaaactcatcctggagattgagaaggagtctaggcgcatggaagagtttacagagtttgcagagctggaaagaatgcagcaatacgtaacggatgtgaggcagctccagaagcgaatccaggagtctgaggaagctgtgcagtttatcaacaaggaggaggaactgttcaagtgggagctcactaagtaccccgagctcgacaagttgaaggtcaatatcgagccataccagaagttttttaattttgtcctcaagtggcaacgatcggaaaaacggtggatggacggcggttttctagatctgaacggagaaagcatggaagctgatgttgaagagttcagccgcgagatcttcaagacacttaaatttttccagactaaactgaaaaaagagcttcaggaaaagagaaaggcggcacggaaacgctcacttgaggaggaaaagatagaagaggagccgaaggacaacgctactatcacaatgtgcagaatgagggccaggcactggaagcaaatctccgaaatagttggatatgacctgacaccagatagcggcacaacactcagaaaagtcctgaaactgaatctgacaccatacctcgaacagtttgaagtcatctctgcaggggccagtaaggaattcagcttggagaaggccatgaacaccatgatcggcacatgggaggatattgcctttcatatctccctttacagggataccggagtttgcatcctgtcaagtgtggacgagatccaggcaatcctcgacgatcagattatcaagacacagacaatgcggggctcaccctttatcaagccgttcgagcacgagattaaggcctgggaggacagacttatcagaattcaggaaaccatcgatgaatggcttaaggtccaggctcagtggctgtacctggaacctattttttgctccgaggatattatgcagcagatgccggaagagggacggcagttccagaccgttgacagacactggagggacataatgaaattctgcgctaaggaccccaaggttctagccgccacaagcctgacaggcctgttggaaaagctccagaactgcaacgagttactcgagaaaattatgaagggattgaacgcttaccttgagaaaaaacgcctcttttttcccaggttcttcttcctgagtaacgatgagatgctggagattttgtctgaaaccaaagacccccttagagtgcaaccccatctgaagaaatgcttcgaaggcatcgcaaaactggaatttttacctaacctcgacataaaagccatgtacagttccgaaggagagagagtggaactgattgccctgatttctactagtgcagccagaggggctgtggagaaatggctgattcaggtggaggacctgatgttaaggtccgtgcacgacgtgatcgccgccgcacgcctggcctacccagaaagtgcacggcgtgactgggtacgtgagtggcctggccaagtggtactgtgtatctcccagatgttctggacaagtgagactcaggaagtcatatctggcggaacagaagggctgaaaaaatattacaaagagttacagaaccaactgaatgagatagtggagctcgtgagaggcaaactgtccaaacaaacccgcaccacccttggcgctctggtgactatagatgtgcacgcccgagacgtggtaatggacatgatcaagatgggcgtctcgcacgataccgatttcctgtggctagcccagttacgctactattgggaaaacgaaaacgcgcgcgtccgtatcatcaactgcaacgtgaagtatgcatatgagtacctcggaaactccccaaggctggtaataaccccattgactgacagatgctatagaacgctgattggggccttctacctaaacctggggggcgcgccagagggcccagcaggtactggaaaaactgagacaactaaagacctcgctaaagcgttggcagttcagtgtgtcgtgttcaactgttcagatggactggactacctcgcaatggggaagttttttaagggcctcgccagctccggcgcgtgggcctgttttgatgagttcaaccgtatcgaactcgaagtgttaagcgtggttgcccagcagattctctgtatccagagggccatacaacagaagctggtagtgttcgtgttcgaaggaaccgaactgaaactgaatcctaactgtttcgtggctattaccatgaatccaggatatgccggccgaagcgagctgcccgataatctcaaggtgcttttccgcacagtggcgatgatggtgcctaattacgctctgatcgcagagatttccctctacagctacgggttcctgaatgcaagacccctctccgttaagattgtgatgacctaccgtctgtgtagcgagcagctgtcgagccagtttcactatgattatggcatgagagcggtgaaagctgtgctcgtggcggctggaaacttaaagctcaaataccctaacgaaaatgaggacattctccttctaagatcaatcaaagacgtgaacgagccaaaatttctgagtcacgatataccgttgttcaatggtatcaccagtgatctgtttcccggtataaaactgcccgaggcggattaccacgagtttttagagtgcgctcacgaggcgtgcaatgttcataatctgcagcccgtgaaattctttcttgaaaagatcatacagacttatgaaatgatgatagtgcggcacgggtttatgctcgtcggagagccttttgccgctaagactaaggttctccatgtcctcgccgacacactcacattgatgaatgaacacggctatggcgaagaggaaaaagttatttatcgaaccgtaaatcccaaatccattactatgggacaactgttcggacagtttgacccagtttcacacgagtggacagacggtatagtcgcaaatacttttagagagtttgctctgtccgagacacccgatagaaagtgggtagtgttcgacggtccaatcgataccctgtggatagagtccatgaacaccgttctggacgataacaagaaactgtgtctgatgagcggtgaaatcatccagatgtctccacagatgagccttatttttgagaccatggacttgagccaggcctctcccgctaccgtgagccgatgtggtatgatctatttggagccgagtcaactcggatgggaacctctcgtcagttcatggctgaactcgttaaaaggacccctctgcgagccagagtatcaggcccttctgcgtggcttgttcgcctggttgatacccccgagcttgaatcagcgggtggaactttttcagctcaactatttgtataccaccattgtgagcaaaatccttaagatacttatcacctttaggatctctaactactttaaatatgtcccgttaaagactcagtgtactttcatcaagtttttcttgcaccaacaggcttgcttcatctttagtctgatatggagcatcggagggtcctgtgatacagacgggcgacgcgtattcgatacgtttatacgtctcatcatactggggaaggacgacgagaatccggttcccgattcagtggggaagtgggagtgcccctttgatgagaaggggttggtctacgattatatgtacgaactgaaaaataaggggagatgggtgcattggaatgagctcattaaaaacactaacctgggcgataagcaaatcaaaatccaagacattattgtgcctaccatggatacgattcggtacacctttctgatggacctgtccattacatacgcgaaacctttgttattcgtgggtcctaccggaactgggaaaagtgtgtacgttaaggacaagcttatgaaccacctggagaaggatcagtattttcctttttacattaacctgtctgcccggacttctgctaaccaggtgcagaacatcatcatggctagacttgataaaaggagaaagggagtcttcggaccacccatgggcaagaagtgcatcatcttcattgacgatatgaatatgcctgctttggagaagtatggtgcacaacccccaatagagctcctgcgccaattttttgattgcggccactggtacgatttaaaagacaccagcaaaatcactctggttgatatagagctcattgcagccatggggccccctggtggaggccgaaaccccgttacacccagatgcattcggcattttaacatttgttctatcaactcgttttctgatgagacaatggttcgcatattctctagcatagttgctttttacctgaggacacatgaatttcctcccgagtatttcgtgattggcaatcaaattgtgaacggcacaatggagatctataagcagagcgttgagaaccttctccccactcctactaaaagccactacaccttcaacctgagagacttcagcagggtcattagaggctgtctcctgattgaaagggatgccgttgccaataaacatacgatgataaggctgtttgttcacgaagtactgcgcgtgttttatgatcggctgattaatgatgacgatcgcaggtggctattccagctcacaaaaaccgtaatcaaggaccactttaaggagtctttccattcgattttcagccatttacggaagcagaacgcccccgtaactgaggaagacctacggaatctgatgtttggtgactatatgaacccagatttggagggggatgatcgagtttacatcgagattccaaacatccatcatttttctgatgtggttgaccagtgcctggacgagtacaaccaaacccataagacacgaatgaatttggtcatctttaggtatgtgctcgaacacctctccaggatatgccgggtgttgaagcaaagtggcgggaacgccctcctggtcgggctcgggggcagcggtcgccagtcccttacgaggctggccactagtatggcaaaaatgcacatcttccagcccgagatcagcaagtcatacggtatgaatgagtggcgtgaggacatgaagtcattcatcgcggtccctgtgaccaaccgtattgtcgataataaaagcaagattctcgaaaaacggcttcgctatctcaacgaccactttacctataatctttattgtaacatctgcagatccctgtttgaaaaagacaagctcctgttctcgttcctgctgtgtgcgaatctgttgttagcaaggaaggagatcgagtaccaagagctgatgtttctcctgacgggaggcgtaagcttgaaatcagctgagaaaaatcctgaccctacatggctgcaggacaagagttgggaagagatctgtcgggcaagcgaatttccagcgtttagggggctcaggcagcacttttgtgagcatatctacgagtggcgcgaaatctacgactctaaagaacctcacaacgccaaattccccgcccccatggacaagaacctcaacgagctccagaagatcattatcctgagatgcctgcgaccagataagatcaccccagctatcactaactatgtgactgataagctgggcaaaaagtttgtggaacctccaccatttgacctcaccaagtcttacctggactctaactgcacaatccctctcattttcgtactgtctccaggagcagaccctatggcctccttgcttaagttcgcaaacgataaatccatgtcaggcaataaattccaggctattagccttggtcagggccaggggcccatcgctgccaagatgattaaagctgcgattgaagaggggacctgggtgtgtttgcaaaactgtcatctagccgttagctggatgccgatgctggaaaagatctgcgaggatttcacttccgagacatgcaactcctccttcagactgtggctcaccagctaccctagcagcaagttcccggtgactatactgcaaaacggcgtaaagatgaccaacgaacccccaacaggcctgcgtctaaatctgctgcagagctatctgaccgatccagtgagtgacccggagtttttcaagggttgccgtggtaaggaactggcttgggaaaaactgctctttggcgtctgttttttccacgctctggtccaggagcgcaagaaattcggcccactgggttggaatatcccttatgggtttaatgaatccgatctgcggatatcaatccgccagcttcagttgttcattaacgagtacgacaccattccattcgaagctatcagctatctgaccggggagtgtaactatggcggtagggttactgatgactgggatcggagacttctgctgacgatgctggctgacttctacaacctgtacatcgtagaaaaccctcattataaattttctcccagtggcaattacttcgcccccccgaaaggcacttatgaagactatatagaatttatcaagaagctgccctttacacaacaccctgaaattttcgggttgcatgaaaatgtggatatttccaaggacctacagcaaactaaaacgctgtttgaaagtctgttactcacccagggaggtagtaaacaaacgggagcaagcggttcaacggatcaaatcctgctggagattaccaaagatattctcaacaaactaccctcagattttgacatcgagatggctttgcgaaagtaccccgttcgctacgaggagtccatgaacactgtgttggtccaggagatggagcgctttaacaacttgataatcactatccgaaatacgctccgtgacttagagaaggccatcaagggggtggtggtgatggactcggccctggaggctttgtcgggatcactcctggtgggcaaagtcccagaaatttgggcgaaaagatcttacccttctttgaaaccattaggctcttatatcactgacttcctggctcgcctaaactttttacaggactggtacaatagtggcaagccatgcgtgttttggttatctggtttctttttcacccaggctttcctcactggagccatgcagaattacgcacgcaaatacacaactccaatcgatctgttagggtatgaattcgaagttattcccagcgacaccagtgacacatctcccgaagacggtgtatatatccacggcctttatttagacggtgcgcgctgggaccgcgagtccggcctgctagccgaacagtacccaaagttgttattcgatctgatgcctatcatttggattaaacctactcagaaatccagaattattaagtctgacgcctatgtgtgccccctgtataaaacttcggaaaggaagggcaccctgagcaccacaggccactccaccaactttgttatcgccatgctgctcaaaacagatcagcctacccggcactggataaaacggggcgtggccttgctgtgtcagctggacgactag

SEQ ID NO: 46914 - DNA, 13374 bp, Artificial Sequence
  Description of Artificial Sequence: Synthetic coding sequence
atgaccatggcccccgacgtgcggctggagtacctggaggaggtggcttccattgtgcttaaatttaaacccgacaaatggtccaagttaattggggcagaggagaacgtggcactcttcaccgaatttttcgagaaaccagacgtgcaggtcttggtgttgaccctgaatgctgccggtatgatcatcccatgtctcggattcccccagtcccttaaatctaagggcgtctacttcatcaagactaagtcagaaaacattaacaaggataattaccgggcccggttgctgtacggggacataagtcccacccctgtggatcagctgattgccgtggttgaagaggtactgtcatctctgctgaaccagtccgagaatatggctgggtggccacaggtagtgtcagaggatatcgtgaagcaggtgcaccgcctgaaaaatgagatgtttgtgatgagtggcaagatcaaggggaagacactgctcccgatccctgagcacctgggctctctcgatggcacactcgaatctatggaaaggatcccgtcctcattggacaacctgctcctccacgcgatcgagacaactattatagattggagccaccagatacgcgatgtcttgtctaaggactcagcccaggccctgctggatggcctccaccctctgccacaagtggaattcgagttttgggatactagacttctcaatctcaaatgcatacacgagcagctcaaccgccccaaagttaacaagatagtggaaatcctggaaaaggccaaatcttgctattggcctgcccttcaaaacgtctatacaaacgtcaccgagggcttgaaggaggccaacgatattgtgctgtacttaaaaccgctgcgtatacttctggaggagatggagcaggccgatttcacgatgctccctacatttatcgccaaggtgctggacacaatctgcttcatttgggcaacctcggagtactacaatactcctgcacgcattattgtcattctgcaggaattttgcaaccagattatagagatgactcgcacatttttaagtcctgaggaggtactgaagggactgcagggtgagatagaggaagtgttgagcggaatctctctggccgtcaacgttcttaaggaactgtaccagacatacgacttctgctgcgtaaatatgaagcttttcttcaaagataaggaacctgtgccctgggaattccccagctcattggccttctcaagaataaactccttcttccagagaatccaaacaattgaggagctatataagaccgccatagagttcctgaagttagagaaaatagaattggggggtgtcagagggaatctgctcggctccctcgtgacacgtatctacgatgaagtgttcgaactcgtcaaagtgttcgcagattgtaaatacgatcccctggatcctggcgatagcaactttgaccgggattatgcagactttgagatcaaaatccaggatctggacaggcgattagcaactatcttctgtcaagggtttgacgactgctcttgtattaaaagcagtgcgaagctactgtacatgtgcggggggctgatggagcggcctttgatcttagctgaggtggcacctcggtacagcgtcatgctcgagttgtttgatgcagagctggacaacgccaagatcctatacgacgcgcaaatggcggccagtgaggaaggcaatatccctctgatccacaagaacatgcctcccgtagcggggcagctgaagtggtcgttagagctgcaggagcgccttgaagtgagtatgaagcacctgaaacacgtggaacacccagtcatgagtggtgcagaagcgaagctgacgtatcaaaaatacgatgagatgatggagctcctgcgttgtcacagggagaagatctaccaacagtgggttgccggcgttgaccaggattgtcatttcaacctgggccaaccgctgatattgcgggacgctgccagcaacctcatccatgtcaacttttccaaggctctggtcgcggtactccgggaggtgaaatacctgaatttccagcagcagaaggagataccagactctgctgaatcactgttctcagagaatgaaacttttcgtaagttcgttggaaatctggagctgattgtcggttggtacaacgaaatcaaaactatcgtgaaagctgttgaatttttactcatcaagtccgagctcgaggcaattgacgtgaaactgctctcagccgagaccactctattctggaacggagaaggggtgtttcagtatatccaggaggtaagggaaattctccataatttgcagaaccgcatgcagaaggccaaacaaaatatcgagggcatatctcaggctatgaaagactggtctgcaaatcctctcttcgaaagaaaagacaacaaaaaggaggctctcttagacctcgatggcagaatagccaacttaaacaagaggtacgcagccgtacgggacgcaggcgtgaagattcaggccatggtcgccgaaaatgccgagctgttcagggcggatacactgtctctgccctggaaggactatgttatctacattgatgatatggtacttgatgaattcgatcaattcattcggaagagtctcagctttctcatggataatatggaatccatcgccccactgttcgagattcgcatggagttagatgaagacggcctgacctttaaccctactttggaagtgggaagcgataggggattccttgccctgattgaaggactggtaaacgacatctacaacgttgcgcgtttgatacctcgcctggccaaggatcggatgaactacaaaatggacctggaagacaacaccgatctgattgagatgagggaggaggtcagctccctagtcatcaatgccatgaaggaagccgaggagtaccaggactcttttgaaaggtattcttacctgtggaccgataatcttcaggaattcatgaagaacttcctgatctacgggtgcgccgtgactgctgaagatttagacacatggactgacgacaccattccaaagacacctcctacactcgcacagtttcaagaacagattgattcatacgaaaaactgtatgaagaggtatccaagtgcgaaaatacgaaggtctttcacgggtggctgcaatgtgattgcagaccttttaagcaggccttgctctcaaccatcaggcgatggggcttcatgttcaaaagacacctgagtaaccacgttactaattcccttgctgacctcgaggccttcatgaaagtggctagaatgggcctgacaaagcccttaaaagagggtgattacgacggcctggtggaagtaatgggacatctaatgaaggtcaaggagaggcaggccgctaccgacaatatgttcgagccgctaaaacaaacaatcgaactgctcaaaacttacggtgaggaaatgcctgaggaaattcacttgaaattgcaggagctgcctgagcactgggctaatactaaaaagctcgctatacaagttaaacttacggttgcccctttgcaagccaatgaagtctcaattttgcgacggaaatgtcaacagttcgaactcaagcagcatgagtttcgggagcggtttcggcgagaggcaccattcagtttcagtgaccccaacccatataagtcacttaataagcaacagaaaagcatatccgctatggaaggcatcatggaggccctgtctaaatccggtggtctgtttgaggtccccgtcccagactacaagcaattaaaagcgtgccaccgagaggtgcgcctcttgaaagaactgtgggatatggtggtcgtcgtgaatacgagtatcgaagactggaaaactacaaagtggaaggacatcaatgtcgaacagatggatattgattgtaagaagtttgccaaagacatgcgttctcttgacaaagaaatgaagacttgggacgccttcgtgggcctggacaatactgtgaagaacgtgatcacctcgctgagagccgtgagcgagctccaaaaccctgccattagagaacgccactggcagcagctgatgcaggcaacccaggtgaagtttaaaatgagtgaggagacgactctcgccgacctgttacagctaaatttgcattcctatgaggatgaggtgcgcaatattgtcgataaagcagtaaaggaatccggtatggagaaagtgcttaaggccctcgattctacgtggtcaatgatggaatttcagcacgagccacacccacgaacaggcacaatgatgctgaaaagcagcgaagtactggtagaaaccctcgaggacaaccaggtgcagcttcagaatttaatgatgtccaagtacctggcccatttcttgaaagaggtgacctcttggcagcagaaactctccactgcagacagcgtgatctcgatatggttcgaagtccagcgcacatggtctcacctggagagcatctttatcggatccgaagatattcgcacacagctgcccggggatagccagcggtttgatgacatcaaccaggaattcaaagccctaatggaagatgccgtcaagactccgaatgtcgttgaggccacgtccaagccagggctgtacaacaaactggaggcactaaagaaaagcttagcaatctgcgaaaaggctctcgcggagtatctggagaccaagcgcttggcctttcctcggttctacttcgtctccagcgctgacctgctagatattcttagcaatggtaacgatccagttgaggtttcccggcatctgtccaagctgttcgattcgttgtgtaagttgaaattccgcctggatgcttctgacaagcctctgaaagttggtctcgggatgtattcaaaggaagacgagtatatggtgttcgatcaggagtgtgacctgtcaggccaggtggaagtttggctgaatcgtgttctggaccggatgtgttctaccctgcggcacgagatccccgaggcagtagtgacctacgaggaaaaaccccgggaacagtggatcctggactaccccgcccaggtagcattgacgtgcacccagatttggtggaccactgaggtgggattagcctttgctcggctcgaggaaggatacgagaacgccattcgggactataataaaaaacaaatctctcagctcaacgtgctgatcaccctgctgatgggcaacttaaatgctggggatcgcatgaaaattatgacaatctgtacaattgacgttcacgcgcgagacgtcgtggctaaaatgatcgttgtggaatcaagtcaagcatttacgtggcaggcccagttaagacatagatgggacgaagaaaaacgacactgtttcgccaacatatgcgatgcccagattcaatactcctatgaatatctcggcaatactccaagactggtgatcacaccactgacagaccgctgctatatcaccctgacgcagagcctgcacctgattatggggggtgcacctgcgggaccggcaggaactggcaaaaccgaaactacgaaggacctggggcgcgccctgggcaccatggtgtacgtctttaactgttctgaacaaatggattataagtcctgtggtaatatctataaaggcctggcccaaaccggggcttggggatgttttgatgagttcaatagaatatctgtggaagtcctgagcgtcattgccgtgcaggtaaagtgtgtgcaggatgccatccgcgcaaagaagaaggctttcaacttcctcggagagattattgggcttattcccacagttggaatctttattacaatgaacccagggtacgctggcagggccgagcttcctgaaaacctcaaggccctatttaggccctgcgcaatggtggtgcccgattttgaactcatctgtgaaatcatgctcatggccgagggtttcctggaggcgcgtttgttagcaagaaaattcattactctgtacaccctctgcaaggagttactttcaaagcaggaccattatgattgggggttgcgggcaataaagtctgttctcgtcgtcgccggatccctaaaaagaggcgatcctagcagggccgaagatcaggtcctcatgagggccctgcgtgatttcaatatccctaagattgtgactgacgacctacctgtgttcatggggctgatcggagatctgttccctgcgctggatgtgcctaggaagcgagacctaaacttcgaaaagattatcaagcagtcgatcgtcgagctgaaactgcaagctgaggattcatttgttctaaaggttgtgcagcttgaggaattgctacaggtcaggcacagcgtgttcatcgtgggcaatgcaggctcaggtaagtctcaagtgcttaaaagcctgaacaaaacataccagaatctgaaaaggaagccggtggccgtcgatctggacccaaaagccgtgacctgtgatgaactctttggtattattaatcccgttacccgagaatggaaagacgggctcttttctacgatcatgcgtgacctagctaacatcacccatgatgggcccaagtggattatcctggacggagatatcgacccgatgtggattgagtctctaaacaccgttatggatgacaacaaggtgctcacattagcttctaacgagcgcattccactgaaccgcactatgagactggtgttcgagatctcccacctcagaaccgctactccagctacggtcagtcgcgccggaatcttatatatcaaccccgctgacctagggtggaaccccgtggtctccagctggattgagcgtagaaaagtccagtcagagaaagcaaacttaatgatactgtttgacaagtacttgcccacctgcctcgacaaactgagatttggctttaagaagatcacccctgtgcccgagatcactgttatacaaaccatattgtacctgttagagtgccttctgacagaaaaaacagtgcccccagactcgccacgtgagctgtacgagctatatttcgtctttacatgtttttgggcatttggaggggcaatgtttcaggaccaactcgtagattacagagtcgaattctcaaagtggtggatcaacgaatttaaaaccatcaagtttccaagtcaggggaccattttcgactactatatcgaccctgacacgaagaagttcctcccttggactgataaggtaccaagcttcgaactggaccctgatgtgcctctccaggcctcattagtccatacgacagagactataagaatacgttatttcatggatctgctgatggaaaagagctggccagtcatgctagtcggcaacgctggcaccggaaaatcagtcctgatgggagacaagcttgagagcctcaatactgataattatttagttcaggcagtgccttttaacttctatacaaccagcgccatgctacaaggtgtgctggagaagcccttggagaagaaaagcggccgcaattacggcccccccggaactaagaagctagtgtactttatcgatgatatgaacatgccagaggttgataagtacggcactgtggctccacacactctcatacgtcagcacatggatcacaggcactggtatgaccgacacaagctgactctgaaggacatccacaattgccagtacgttgcctgcatgaaccctaccagcggtagtttcaccatcgattcgcgactgcagcgccatttctgtgtcttcgccgtcagcttccctgggcaggaagctcttacaaccatatacaatactatcctgacacaacatttggcatttagatctgtgagcatggctatacagagaatttctagccagcttgtcgctgctgctctggctctgcaccagaagatcaccgcgacctttctgccaactgccataaagttccactacgtgttcaatctgcgggatctgagcaatatttttcaggggctcctattttctacagctgaagtcctgaagacacccctcgacttagtgcggctttggttacatgaaacagaacgcgtctatggcgataaaatggtcgatgagaaagaccaggaaactctccacagggtgaccatggccagcactaaaaagttctttgatgatttgggtgatgaactgctcttcgctaagcccaacatcttttgccactttgcacagggcattggtgaccccaaatacgtgcctgttacagatatggctcccctaaacaagctgcttgtggatgtgttggactcttacaacgaagtgaatgctgtgatgaatctcgtcctattcgaggatgctgtagcccacatatgtaggatcaatcgcatcctggaatccccgcgcggcaacgccctgctggtgggggtcggcggaagtggcaagcaaagcttaagccgcttggccgcatacatctctggtttagacgtgtttcagataaccctcaaaaagggctatggcataccagatttgaaaatcgatctcgcggcccagtatattaaagcagccgttaagaatgtgccctcagtgtttcttatgaccgactcccaggtagccgaagagcagtttctggtcctgatcaacgatttgttagcgagtggagaaatcccggggctattcatggaagatgaagtcgaaaacatcataagttccatgaggcctcaggtgaaaagccttggaatgaatgacacccgtgaaacgtgctggaagttctttatcgaaaaggtgcggagacagctcaaagtcatactgtgcttttccccagtggggagtgtgctgcgggtcagggctcggaagtttcccgcagtggtcaactgcactgcgatagattggttccacgagtggcccgaagatgccctggtgagcgtgtctgcccggttcttagaagaaactgagggaattccgtgggaggtgaaggcaagcatctcattctttatgtcatatgtgcacacgaccgttaatgagatgtctagggtctatctggccactgagaggagatataattacactacaccaaagacctttctggagcagatcaagctctatcagaatctgctcgcaaagaaaaggacggagctcgtcgctaagatagaacgtctagaaaatgggctgatgaaattgcaaagcacagcaagtcaggtggacgatctcaaggctaaactagcaattcaagaggccgaattaaagcagaaaaatgaatccgcggaccagcttattcaggtggtcgggatcgaagccgaaaaggtctcaaaggagaaggctatagcagaccaggaagaagtgaaagtcgaagtcatcaacaagaacgtgaccgagaaacagaaggcgtgtgagacagacctcgcgaaggctgagcctgctctcctcgctgcacaggaggcgttggacacactcaacaagaataaccttaccgaattgaaatcattcggctcccctcccgacgccgtcgtgaacgttactgcagcagtaatgattcttacggcacccggggggaagattcccaaagacaaatcctggaaggctgccaaaataatgatggggaaagtcgatacgtttttagactccctgaagaaattcgacaaagagcacattcctgaggcatgcctgaaagcttttaaaccttaccaggggaacccaacattcgatccggagtttatccgcagtaagtcgacagcagcagcgggactctgttcatggtgcattaatatcgttagattctatgaagtgtattgtgacgtcgcccccaaaagacaggctctcgaggaggccaacgctgagttagccgaagcccaggagaaactcagcagaattaagaacaagattgccgaattgaacgccaacctttccaacctgaccagcgcattcgaaaaggccacagctgaaaagatcaaatgtcagcaggaggctgatgccacgaatcgagtgattctgctcgccaacaggctcgtgggcggactggccagtgagaacatacgttgggccgaaagtgtggagaatttcagaagccagggcgtgaccctgtgtggggatgtgctgctgatttccgcattcgttagttacgtgggatactttactaaaaaatacagaaacgaactgatggagaaattttggatcccttatattcataacctgaaggttcccatcccgatcacaaacggcctcgaccccctaagccttttgacagatgatgccgacgtcgccacgtggaataatcaggggttgccctctgacagaatgtctaccgagaacgctaccattctcggcaatacagaacggtggcctctgattgtggatgctcagctgcaaggcatcaagtggatcaaaaacaagtatcggtccgagctgaaagccatccgcttgggacagaagagctacctggatgtgatcgaacaggcaatctccgaaggcgacactttgctcatagagaatattggggaaaccgttgaccctgtgctcgacccgctgctgggccgaaacacaatcaagaaaggaaaatatatcaaaatcggagacaaagaagtggagtatcacccgaagttcagactcattttacacactaaatattttaatccacactataagcccgaaatgcaggctcagtgcaccttgatcaactttttggtgacacgagacggcctcgaagaccagctgttagctgccgtcgtggctaaggagcgccctgatttggaacaacttaaggctaatttaactaaatcacaaaatgagtttaaaatcgtgctcaaagaattagaggacagcctgctcgcgaggctctcagctgcctctggaaacttcttgggagatacggcgctggtggaaaacctggaaactacgaaacacacagccagtgagatcgaggaaaaggtggtggaagctaaaattactgaagtgaaaataaatgaggctcgtgagaattatagaccagctgcagagcgcgcaagtttgttatacttcattttaaatgacctcaataaaataaatccggtgtaccagttcagcctgaaggcgtttaacgttgtcttcgaaaaagctattcagcgaacgacgccagccaatgaggttaaacaacgtgtgatcaatctgacagacgagattacttattctgtttacatgtataccgctcggggcctctttgagagagacaaacttatttttctcgcacaggtcacatttcaagtcttaagcatgaagaaagagctcaacccagttgagctggattttctgctgcggttcccatttaaagcaggggttgtgtctcctgtcgacttcttacagcatcagggctggggaggcataaaagcactgtctgagatggatgagttcaaaaacttggactcggatattgagggaagcgcaaaacggtggaagaagctggtggagagcgaggccccagagaaggaaatcttccctaaggaatggaaaaataagaccgctctgcagaagctctgtatggtgcgctgcctgcggcctgaccggatgacatacgcaattaaaaatttcgtcgaggaaaaaatgggctccaaattcgtggaaggaagatccgtggagttcagcaagtcctacgaggaaagctcccctagtacctcaatcttctttatactttcccctggcgtggatcctctcaaggatgtggaagctctggggaaaaagctggggttcacaattgacaacgggaagcttcataatgtttctttgggtcagggtcaggaagtcgtagcagaaaatgcccttgacgttgctgctgaaaagggccactgggtgattttgcaaaacattcacctggtcgctagatggctcggaacactggacaaaaaactggagcactattctaccgggtcacacgaagactatcgggtattcatctcggccgaaccagcgccatcccccgaaacccacatcataccgcagggaattctggaaaacgctattaagatcaccaacgagccaccaacaggcatgcacgcaaacctccataaggctctggatctcttcacacaggacacactggaaatgtgcaccaaggagatggaattcaaatgcatgctgttcgcactctgctatttccatgccgttgtggcagaacgccgtaagttcggtgcccagggttggaaccgcagttacccctttaataatggcgacctgaccatttccatcaacgtgctatacaactacctggaggccaatccaaaggtcccctgggatgatctgcgatacctttttggggagattatgtatgggggacacatcactgacgattgggacagaaggctctgccgtacatatctggccgaatacatccgcacggagatgctagagggggatgtgctgctggcacccggatttcagataccacccaacctggactacaaaggttaccacgaatacatcgatgaaaaccttcccccggagtcaccgtacttatacggcttacaccctaatgccgaaattggctttcttaccgtgacaagcgagaaacttttccgcaccgtgttagagatgcagccaaaagaaactgacagtggtgcagggactggggtgtcgcgagaggaaaaggtgaaagccgtgctggatgatatattagaaaaaatccccgagactttcaacatggctgagattatggcaaaagctgcggagaagaccccttatgtagtggttgcgttccaggagtgtgagcgcatgaacattcttacaaacgaaatgagacgcagcctcaaagagctgaatctgggactcaagggcgagcttaccataacaactgacgtagaggatctgtccactgccctgttttacgatacagtccctgacacgtgggtggcccgggcatatccaagtatgatggggcttgccgcctggtacgctgatcttctgctccgcataagggagctggaggcctggacgaccgactttgcattgccgacgactgtatggctcgctggcttcttcaacccacagtcctttctgactgcaataatgcagagcatggcacgtaagaacgagtggccactggataaaatgtgtctatcagtggaagtgacaaagaagaaccgcgaggacatgacggcgccaccccgcgaaggcagttacgtctacggccttttcatggagggagcacggtgggacacccagactggcgtcatcgccgaagcaagactaaaagagcttacacctgctatgccggtcatattcattaaagccatacccgtggacagaatggagaccaagaatatatatgagtgccctgtgtataaaaccagaattcgcgggccaacttatgtgtggaccttcaacctgaagaccaaggaaaaagctgctaaatggattctggcagccgtagcgctgcttctccaggtgtag

SEQ ID NO: 46915 - DNA, 13458 bp, Artificial Sequence
  Description of Artificial Sequence: Synthetic coding sequence
atgaccatggcccccgacgtgcggctggagtacctggaggaggtggccagtatcgtgctgaaattcaaaccggacaagtggtcgaaactgataggagccgaggagaatgtcgcactgttcacagagtttttcgagaaacctgacgtgcaggtcctggtactgacgttgaacgcggccgggatgattataccatgtcttgggtttcctcagtccttgaagtccaagggcgtgtacttcataaagacaaaatctgaaaacatcaataaagacaattaccgagctaggctgctgtacggcgacatttcccctacgcctgtcgatcaactgattgccgtggtggaagaagtcctgtcatccttgcttaaccaatcggaaaatatggctgggtggccccaagtcgtgtctgaggacatcgtgaagcaggtgcaccgcctcaagaacgaaatgttcgtgatgagcggcaagattaaaggcaaaaccctgctgcccattccggaacacttgggaagcctggatgggactctggagtctatggagcggatccctagctctctggacaaccttctgctgcatgccattgagaccacaattatagactggtctcaccagattagggacgtgttaagcaaggactctgcccaggccctccttgacgggctgcacccgctacctcaagtggaattcgaattttgggatactaggctcctgaaccttaaatgtatccacgagcagctcaatagaccaaaggtgaataaaatcgtggagatccttgaaaaggcaaagtcctgttattggccagccctgcaaaatgtgtacaccaacgtgaccgagggcctgaaagaggcgaatgatatcgttctgtacctcaaaccattgaggatcctgctggaagaaatggagcaggctgacttcaccatgctgccaacattcatcgctaaggtgctggacacaatctgttttatttgggctaccagcgaatactataacactcctgccagaatcattgttatactgcaggagttctgtaaccagatcattgagatgaccaggacattcctctctccagaagaggtcctaaaaggtctgcaaggggagatagaggaagtcctgtcggggatttcccttgcggtcaacgtgctgaaagagctttaccagacttatgatttttgctgtgtcaacatgaagctgtttttcaaagacaaggaaccggttccatgggaattcccttccagcctggcattctctaggattaactcattttttcagcggatacagaccatagaagagctatacaaaacagccatcgagttcctgaagctcgagaagattgagctgggcggggtccggggcaacctcttgggcagcctcgtaacccgcatttatgacgaggtgttcgaattagtgaaggtttttgccgactgtaagtacgaccccctggaccccggggatagcaacttcgaccgcgattacgctgatttcgagattaaaatacaggatctggataggaggttggccacgatcttttgccaggggtttgacgattgctcctgtatcaagtcttcggccaagctgctctacatgtgcggaggtctgatggagcggcctttgatcttagcagaggtggcaccccgctacagtgtaatgctcgagctgttcgacgctgaactggacaacgccaaaattctgtatgatgctcagatggcagcctcagaagagggaaacatcccgcttatccataaaaatatgcctccagtggctgggcagctgaagtggtccctagaactgcaggaaaggttggaggtgagcatgaaacacctcaagcacgtagagcaccctgtaatgtctggtgcggaagctaagctgacgtaccaaaaatacgatgagatgatggagctactgcgctgccaccgcgagaagatctaccagcagtgggttgcgggggtggaccaagactgtcattttaatttaggccaacctttgattctgcgcgatgctgctagtaacctcattcacgtgaacttcagcaaagcactggtcgctgtcttgcgggaagtgaaatacctcaactttcagcagcagaaggaaatccctgattctgccgagagtcttttttctgagaatgagaccttccggaaatttgtcggcaacctggaactgatcgtgggttggtacaacgagattaaaaccatcgttaaggcggtggagttcctcttgataaaaagcgaacttgaagcaatcgacgtgaaactcctgtctgcggagacaaccctattttggaatggcgagggggtgttccagtacatccaggaagtgagagaaatcttgcacaatttacaaaatcgtatgcagaaggccaaacagaatatcgaaggaatcagccaggccatgaaggactggagcgccaatcctctgtttgaacggaaagataataagaaggaggccctgcttgacctggacggcaggatcgccaatctcaacaaaaggtacgcagcggtccgggacgctggggtgaagatccaggccatggttgctgagaatgccgaactgttcagggctgacacattgagcttgccatggaaagactacgtcatctatattgacgacatggttctggacgagttcgatcagtttatccggaagtccctgtccttcctcatggataacatggtcattgatgaatccatagccccgctcttcgaaatccggatggaactggacgaagatgggttgactttcaaccctaccttagaagttggatccgatagaggatttcttgctctgatagagggcctcgtcaacgacatctataacgtggccaggctaatccctcgactagcaaaggaccggatgaactacaagatggacctcgaggataatactgatctcatcgaaatgcgcgaggaagtttcctccttggtgatcaacgccatgaaagaggcagaagaatatcaggacagttttgagcgatattcttacctctggactgacaacctgcaagaattcatgaaaaactttctcatatatggatgtgccgttactgccgaggatctcgacacatggacagatgacacgatccccaaaacccccccaacgcttgcccagttccaggaacagatcgattcttatgaaaagctgtatgaggaagttagtaagtgcgaaaacaccaaggtgttccacggatggttgcagtgcgattgtcgacccttcaagcaggcgctgctgtcaacaatcaggcgatggggattcatgttcaaacgccacctgtcgaaccatgtcacaaattctttggctgacctggaggcttttatgaaggtggcaagaatgggcctcaccaaaccactaaaagaaggcgattatgacggactggtagaggtaatgggccacttaatgaaggtgaaagaaaggcaggctgctacagataacatgtttgaaccattgaagcaaaccattgaactgctgaagacttacggtgaagaaatgccagaggagatacacttgaaactccaagaactgcccgaacattgggccaatacaaagaaactggctattcaggtcaagctgacggtagccccattacaggcaaacgaagtgtccattctgcgtagaaaatgccagcagttcgagctgaaacagcacgaatttcgagagcgatttaggagagaagccccgttctcattcagtgaccccaatccatacaagtccctcaataaagtgtttttattgaagggaatcatggaggccctgagtaaaagcggaggtctctttgaggttccggttccggattataagcagcttaaagcctgccatagggaggttaggctcctgaaggagctatgggatatggttgtcgtagtgaacacctcaatcgaggattggaaaaccacgaagtggaaagatatcaacgttgagcagatggatatcgactgtaagaagtttgccaaggatatgcggtccctggacaaggaaatgaagacttgggacgcattcgtgggcttagacaacactgtgaaaaatgtgattacctctcttcgggctgtatcagaactgcagaaccccgcaattagggaaagacattggcagcagttaatgcaggcaacacaggtcaaatttaaaatgagcgaagaaacaacccttgccgatcttctccaattgaatctgcattcttatgaggacgaagtgcgcaacatcgtggataaagcagtcaaggagtccggcatggaaaaggtgttaaaagctctggactctacatggagtatgatggaattccagcacgagccgcatccgcgtaccggcactatgatgctgaagagttctgaagttttagttgaaaccttggaagataatcaggtgcaactgcaaaacctcatgatgtcgaagtatctcgcgcactttcttaaagaagtgaccagctggcagcagaagctgtccacagccgattctgtcatatcaatatggtttgaagttcaacgtacatggtctcacctggaatctattttcattggctctgaagacatacggacccagttgcccggtgattctcagcggtttgacgatatcaatcaagaattcaaagctttgatggaggacgccgttaagacacccaatgttgtggaggccacatcaaaacctggcctctacaataagctcgaggccctcaagaaatctctggccatttgcgaaaaggcgctggcagaatatctggaaacaaaacgactggccttccccaggttttattttgtttcaagcgcagacctcctagacatcttaagtaacggaaatgaccccgtagaagtgtcgcggcacctgagtaagcttttcgactctctgtgcaaactgaaattccgtttagatgcgtcagataaacctctgaaagtgggcctgggcatgtacagcaaagaagacgagtatatggtgttcgaccaggagtgtgacctgtccgggcaagttgaagtgtggctgaatcgggttctggaccgcatgtgtagcactcttagacatgaaatccctgaggccgtggttacatacgaggaaaagccgcgggagcaatggattctcgactaccctgcccaaatttggtggacaaccgaggtgggactagcatttgcacgcctggaggaaggctacgagaacgcaattcgcgactacaacaagaagcagatatcccagctgaacgtgcttatcactctgctgatgggcaacctgaacgccggagacaggatgaagatcatgaccatatgcacaatcgacgtgcatgctagggacgtcgtggcgaagatgatagtcgagtcttcccaagcctttacctggcaggcccaactgaggcataggtgggatgaggagaaaaggcactgctttgcgaacatttgcgacgctcaaattcagtactcatatgaatatctggggaacaccccgcgattggtcataactccattgacagaccgctgttatatcaccctaacacagtccctacatcttatcatggggggtgcacctgccggtccggcggggactggcaaaacggagaccaccaaggatctggggagagccctcggaacaatggtgtacgtgttcaactgttctgaacagatggattataagagttgcggtaacatatacaaaggcctggcccagacgggcgcatgggggtgtttcgacgaattcaatcgcattagcgtggaagtgctgagtgttattgccgtccaagttaaatgcgtgcaggacgccatacgagccaagaagaaggctttcaactttctcggcgagataatcggactaattccaacagtgggaatattcataacaatgaatcctggctacgccggaagagcggagctcccagaaaatctgaaagcattgtttaggccttgtgccatggtggtgccggatttcgaactgatatgcgaaattatgttgatggctgagggtttccttgaagcccggctcctggcccgcaaatttattactttgtacacgctttgtaaagaactgctgagtaaacaggaccactatgattggggattgagggcaatcaagagtgtgctcgtggtggctggatccctcaaacgcggtgatccctccagggctgaagaccaggtgctcatgagagctctcagggatttcaatatccctaaaatcgttacggatgatttacccgtgttcatgggacttataggcgatctcttcccagccctggacgtaccccgtaagagagacctgaatttcgagaaaattataaaacagtccatcgtggagcttaaattgcaggccgaggattccttcgtacttaaggtggtgcagttggaagagctgctgcaagtcagacactctgtttttattgtcggaaacgcaggttccggaaagagccaggttctcaagagccttaataaaacataccagaacctgaagcgcaagccagtggcagtcgacctcgatcccaaagccgtgacatgcgacgagctgtttggaatcatcaaccctgtaacccgcgaatggaaagatggtttgttcagtacgatcatgcgggatctggcaaatataactcacgacggacccaaatggattatccttgatggagacatagaccctatgtggatcgagtccctcaacacagtgatggatgacaataaggtccttacactggcaagcaatgagagaatccctttgaaccgcaccatgaggctggtgtttgagatctctcatttgcgcactgctacccccgccacagtgagccgggcaggtatcctgtacattaacccagcagaccttggttggaaccccgtagtctcgagctggatcgagcgcaggaaggtgcaaagtgagaaagctaacctcatgattctgttcgataaatacctgcccacttgcttggataaactaagatttgggtttaagaagatcacacccgtcccagagatcacagtcattcagacgatcctatatttgctggaatgcctgctgactgagaagacagttccgcccgactctccaagggagctgtacgagctttacttcgtgtttacatgcttctgggccttcggaggggcaatgtttcaagatcagctggttgactaccgagtggaatttagtaagtggtggatcaacgaatttaagaccatcaaatttccctcccaaggaactattttcgattactacattgatcccgatacaaagaagtttctcccatggacagataaagtgcccagctttgagctcgatccggatgtgccactgcaggctagtctggtccacacgacagagacaatacggatccggtacttcatggacctcctcatggagaagagttggccggtcatgttggttggcaatgctggcacaggaaagtccgtactcatgggggacaagcttgagagccttaacaccgataactatctcgtacaagccgttcccttcaatttttatacgacatccgcaatgctgcagggcgttctcgagaagccgcttgagaagaagtccgggaggaattatggaccacctggcacaaaaaaactggtttactttatcgatgatatgaatatgcccgaggtggataagtacgggaccgtcgcccctcacacacttattcgacaacatatggatcacaggcactggtatgaccggcataagctgacgctgaaagacatccacaattgccagtatgtggcatgtatgaaccctacctccggttctttcacaattgattctcggctacaacggcacttttgcgtgttcgctgtgtccttcccaggccaggaggccttaaccaccatatataacaccatcttgactcagcatctggcctttagatcagtgtccatggccatccaaaggatcagctcccaactggtcgcagctgcgttagccttgcaccagaaaatcactgcaacttttctgccgactgccataaaattccactatgttttcaacctgcgggacctttcaaatatattccagggcttgctattctccacagctgaggtgttgaagactcccctcgacctagtcagactgtggttgcacgagactgagcgcgtttacggagacaagatggtagacgagaaggaccaggagacactacaccgcgtcacaatggccagcacgaaaaaatttttcgatgacttgggggatgagctcctgttcgccaaacccaacatcttttgccacttcgcccagggcattggagatccgaagtacgtccctgtcactgacatggcaccccttaacaaactcctagtggatgtgttggacagctataacgaggttaatgccgtgatgaatttggtcctgttcgaggacgccgtcgcacacatctgccgcatcaatcggatactagaatccccccggggtaacgccctgctcgtgggcgtgggtggtagtggaaaacagagcctttccagactcgccgcgtatatcagcgggctggacgtattccaaataaccctgaagaaaggatacggaattcccgatctgaagattgacctggcggctcagtatatcaaggccgcagtcaaaaatgttcctagcgtgttcctcatgaccgactctcaggtggctgaagaacagtttctcgtattgatcaatgatcttttggcgtcaggcgaaatcccaggcctcttcatggaagacgaagtggagaacattatttcatctatgagaccacaggtgaagtcacttggtatgaatgatacaagggagacatgctggaagttcttcatcgaaaaggttaggagacagctgaaggtcattctctgcttctctccggtcgggtcagtcttaagggtccgagcccggaagtttccagccgttgtaaactgtacggccatcgactggtttcatgaatggccagaggacgcattagtctccgtgtcggccaggttccttgaagagacagaaggtatcccgtgggaggtcaaggcctctatttccttctttatgagctatgtccacaccactgtgaacgagatgtcacgagtttacctggcaaccgagcggagatataactacactacgccaaagacatttctggagcagatcaagctgtaccaaaatctactcgccaagaagcgaacagaattagtggccaagattgaacgacttgaaaacgggctaatgaagctgcaaagcacagcctctcaggtcgatgatttgaaagctaagctggccatccaagaagccgaactgaagcagaagaacgagagcgctgatcagttaattcaggtggtcgggattgaggccgagaaagtatctaaagaaaaggctatcgcagatcaggaggaggtaaaagtggaagtcatcaacaagaatgtgaccgaaaaacagaaggcgtgcgagacagatctggcaaaggctgaaccagcgctgttggccgcgcaggaggccctcgacaccctgaacaaaaacaatctgacagagctcaaatccttcggctctcctccagacgcggtagtcaatgtaacagcagcggtgatgatcctgaccgcccccggcgggaagatccctaaggacaagtcttggaaggccgccaagatcatgatgggcaaagtggatacctttcttgatagcctcaagaaattcgacaaggagcacattcctgaagcctgcttgaaagcattcaagccgtaccaggggaacccaacatttgaccccgaatttataaggagcaaatccaccgcggctgccggtctttgcagctggtgtatcaatatagtgagattttacgaagtgtactgtgacgtggctccaaaaaggcaggcgctcgaggaagcaaatgctgagttagccgaggcacaggagaagctttctcggatcaaaaataaaatagcagagctcaacgccaatctgagtaatctgacctcagcgttcgagaaagcaactgcagaaaagattaagtgtcagcaggaggcggatgctacgaatcgagtcatcttgctcgctaatcggctggtagggggactagcgagcgaaaacatccgttgggccgagagcgtggagaactttcgcagccagggggtgaccctctgtggcgacgtcctgctgattagcgcatttgtaagctatgttgggtatttcactaaaaagtataggaatgagctcatggaaaaattttggatcccatacatccacaacttaaaagtgcctatccccattaccaatgggctcgatcctctcagtttgctgacagacgatgccgacgtcgcaacctggaacaaccagggcctgcccagcgaccggatgagcaccgagaatgctacaatcttaggcaatactgagcgatggcctctgatcgtggacgcccagctccaggggattaaatggatcaaaaacaagtaccgctcagagctgaaggcaattcgactcggtcaaaagtcctatttagacgtgatcgaacaggcaatttcggaaggcgatacattgctgatcgagaatatcggtgaaaccgttgaccccgttctggacccactgctgggcagaaacactataaaaaaaggtaaatacatcaagatcggcgacaaagaggtggaataccatcccaagttcagattgattttacacacaaaatacttcaatccacactacaagccagaaatgcaggcccaatgtactctgatcaactttctggtgacccgcgacgggctggaggaccaacttcttgctgctgtcgtggcaaaggagcggccagatctcgagcagcttaaggcgaatctgacgaaatcgcaaaatgagttcaaaatcgtgcttaaggaactggaggattcactcttggcaaggctgtctgcagcttcagggaatttcctgggtgacactgcccttgtggaaaacctggaaactactaagcatacagcttccgaaatcgaagagaaggtggtggaggccaagatcaccgaggtcaagatcaacgaagctcgggagaattacagaccagcggccgagcgcgcaagcttactctacttcattctgaacgacctcaacaaaattaatcctgtctatcagttctccctcaaggcctttaacgtcgtgttcgaaaaagccatacagcggacgactcccgcaaacgaagtgaaacaacgggtgattaacctcacggacgagattacttactctgtgtacatgtacaccgccaggggcctcttcgaaagggataaactgatattcttggctcaggtgaccttccaggtgctctctatgaaaaaggagctgaatccagttgaattggacttcctgctgagattcccattcaaagcaggcgtcgtctctcccgtagatttcctccagcaccaggggtggggaggaattaaggcgctgtcagagatggatgagtttaaaaacctggattccgatattgagggctcagcaaaaagatggaagaaactagtggaatctgaagcaccagagaaggagatttttcctaaggaatggaaaaataagaccgcactgcagaaactgtgtatggtcagatgcctccggcctgatagaatgacatacgccatcaagaatttcgtggaggagaaaatgggctccaaatttgtcgaaggcagaagtgtggaattttcaaaatcctatgaagagtcatcaccctccacctctatatttttcattcttagccccggcgtggaccccctgaaagacgtggaggccctcggcaagaagttgggatttaccatcgacaatggaaagttacacaacgtctccctgggtcaagggcaagaagtcgtggctgaaaacgcccttgatgtggcagccgaaaagggacactgggtgatcttacaagtacgcggaggtcagcactgccggaatatccacctggtcgctcggtggcttgggaccctggataagaagctcgagcactactctactgggtcccacgaggactacagagtgttcatctcagccgaaccagctccttccccggagactcatataattccccagggcatcctggagaacgctatcaagatcacaaatgagcctcccactggcatgcacgcaaaccttcataaagcactcgacctgtttactcaggacacactggagatgtgcaccaaagagatggaattcaagtgcatgctgttcgccctgtgctattttcatgcagtggtcgccgaacgacggaaatttggcgcgcaagggtggaacaggagttacccttttaacaacggagaccttactataagcatcaatgtgctatacaactatctggaagcaaatcccaaggtgccgtgggacgatctccggtacctgtttggggaaatcatgtatggcgggcatattactgatgattgggatcggcgcctgtgtaggacctatcttgcggaatacattcggaccgagatgctggagggcgacgtactcctggccccagggttccagataccaccgaatctcgattataaagggtatcacgagtacatcgatgagaatcttccccctgagtctccatacttgtatggccttcacccaaatgcagagatcggtttcctcaccgtaactagtgagaaactgttcaggaccgtactggagatgcagccgaaggaaaccgattctggggctggcacaggggtctctcgagaggagaaggcgggtagtctaaaactcctgccgtcagaaaggaaaggcgaggacctagagctgcgccgcggggggtgtcctggaactggttttcaggtcaaggccgtcctggatgacattctcgaaaaaattccagagactttcaatatggcagaaattatggctaaagctgctgagaagactccctatgtggtggtagccttccaagaatgcgaaaggatgaacatccttactaacgagatgaggcggtcactgaaggagctgaatctcggcctaaagggggagctgacaattactactgacgtggaggacctcagtaccgctctcttctatgacacagtgccggatacttgggttgctagagcttatccatcgatgatgggcctcgccgcctggtatgctgacctcttgcttcgcattcgtgagcttgaggcctggactactgatttcgctcttcctacgactgtgtggttggccgggtttttcaatccacaaagctttttgaccgcaatcatgcagtcaatggcacggaaaaacgaatggcctttagacaaaatgtgtctgagcgtggaagtaactaagaaaaaccgagaggatatgactgctcccccacgcgagggcagctatgtatatgggctgtttatggaaggtgctcgatgggacacccaaaccggagttattgctgaagcaaggctgaaagagctgacccctgctatgcccgtaatattcattaaggcgattcccgttgacaggatggagaccaagaatatttacgagtgcccggtgtacaagacccgaattagaggccctacctatgtgtggacgtttaatctgaaaaccaaggagaaagcagccaaatggatcttagccgcagtggccctgcttctgcaggtatag

SEQ ID NO: 46916 - DNA, 1545 bp, Artificial Sequence
  Description of Artificial Sequence: Synthetic coding sequence
atggccgacgccgaggtgatcatcctgcccaagaagcacaagaagaagaaggagagaaagtctttgcccgaggaggacgtggccgaaattcagcacgccgaggaattccttattaagccagagagtaaagtggcaaagctggacacatcacagtggccactactcctcaaaaacttcgataaacttaacgtgagaaccacccattacacacctctggcctgtggttccaaccctctaaaacgagagataggcgactatatccgaactggttttataaatcttgacaagccttctaacccaagctcccacgaagtagtcgcctggatccgacggattctcagggtggaaaaaaccggacactccggcaccctggaccccaaggttacgggctgtctgatagtttgcattgagagggccacaaggctggttaaatcgcaacagagcgcgggcaaggagtacgtgggtatagtaaggctccataatgccattgaagggggtacacagctgagtcgcgccctggagacattgacaggtgccctattccagcgtccccctctcatagctgccgtcaagcggcagctccgggtgagaaccatctatgaaagcaagatgatcgagtacgatcctgagcggcgcctgggaattttctgggtcagttgtgaagcgggcacctacattcgaactttatgtgtccatctaggcctgttgctgggggtgggcggccagatgcaggagttacggcgagttaggagcggcgttatgtccgaaaaagatcacatggtcaccatgcacgacgtactggacgctcagtggctctatgataatcacaaggatgaaagttacctgaggagagtggtctatccgcttgagaagctcctaacgtcccataagcggttagtaatgaaagactctgcagtgaatgccatctgttacggagccaaaatcatgctgcccggtgtactgagatatgaagacgggatagaagtcaatcaagagatcgtcgtcatcaccaccaaaggcgaagctatctgcatggcaatcgcgctgatgacgacagctgtaatttccacatgcgaccacggtattgtggcgaagattaaacgtgtcattatggagagggacacgtatcccagaaagtggggactggggcccaaggccagccagaagaagctcatgatcaagcagggccttcttgacaaacacggcaagcccacggacagtaccccagccacctggaaacaggagtatgtcgactactccgaaagcgcgaagaaggaagtggtcgcagaggtcgttaaagcaccccaagtcgtggctgaggcggccaaaaccgccaagaggaagcgcgaatcggagtccgagagcgacgaaacaccgcccgctgcaccacagttgattaagaaagaaaagaagaagtctaagaaagacaaaaaagccaaagcaggacttgaatccggagccgaacctggagatggcgactccgacactactaaaaaaaaaaaaaagaagaaaaaagccaaagaggtggaactcgtgtctgaatag

SEQ ID NO: 46917 - DNA, 13125 bp, Artificial Sequence
  Description of Artificial Sequence: Synthetic coding sequence
atgaaggtggaccggaccaagctgaagaagacccccaccgaggcccccgctgattgccgggccctaattgataagctgaaagtttgcaacgacgaacaactgctgttggagctacagcagatcaagacatggaacatcggcaaatgtgagctgtatcactgggtcgatcttctggaccggttcgatggcatactggctgatgcgggacagactgtggagaacatgagctggatgttggtgtgcgacaggcctgagagggaacaactgaaaatgctgctgcttgccgtgctgaactttacagccctgttgatagagtatagcttctcgcgtcacctttactcctccattgagcatctcaccaccctgctggccagtagcgacatgcaagtggtcctagctgttctgaaccttctctacgtgtttagcaagcgttccaactacataacccgacttgggtccgacaaacgtacccccctgctgacgagactccagcatctggccgagtcctggggcggcaaagagaatggattcggactggccgaatgttgtagagacctgcatatgatgaagtatcctccgtcagccaccaccctacatttcgaattctatgctgacccaggggccgaggtaaaaattgagaaacgaactacttctaacacactccactatatccatatagaacaacttgataagatttctgaatctcccagtgagattatggagagtctgaccaagatgtacagcattcctaaggacaagcagatgctccttttcactcacatccggttggcccacggattttcaaaccatcggaaaagactgcaagctgttcaagccaggctgcatgccatcagtattctcgtctacagtaatgccttgcaagagtctgctaactctattctttataacgggttgattgaggagttggttgacgtccttcaaataaccgacaaacagcttatggagatcaaggccgctagtcttcggactctaacctcaattgtgcacctcgaacgcacccctaaactatctagcatcatcgactgcactgggactgcgagctaccacggatttctccccgtactggtgaggaactgcatccaggcaatgatcgatccatccatggacccttatccgcaccagttcgcgactgctcttttttcttttctataccatttggcctcgtatgacgctggaggggaagccttagtaagctgtggtatgatggaggctctgctgaaggtcatcaaattcctcggggatgagcaggaccagattacattcgtgacccgggccgtgcgggtggtggacctgatcaccaacctcgatatggccgcctttcagtcacattcgggactgtctatcttcatttaccgtcttgaacacgaggtggacctgtgccgcaaggagtgtccgttcgtgatcaagccaaaaatacagcggccaaataccacacaggagggagaggagatggaaaccgatatggatggagtacagtgcataccccagagagccgctttactaaagtccatgctgaactttcttaagaaagcaatccaagatcctgccttcagcgacgggatccggcacgtcatggacggctccctgccaacttctcttaagcacatcattagtaatgccgagtactacggaccatcgttatttctgcttgccacagaagtggtaaccgtatttgttttccaggaaccttccttgttgagcagtttacaagataacggactgaccgacgtgatgttgcatgccctcttaatcaaggatgttccagccacccgtgaggtactcgggagcctgcccaacgttttttctgctctttgtttgaatgcccgagggttacaaagtttcgttcaatgtcagcctttcgaacggttgtttaaggtgctcttaagccccgactatctccccgcaatgcgcagacgccggagctctgatcccctgggcgacaccgcttcaaacctgggtagcgctgtggacgagctgatgaggcaccagccaactcttaagaccgacgccaccacggctataattaaactgttggaggagatctgtaatttaggacgggaccccaagtacatctgccagaagcctagcatacagaaagccgacgggaccgccaccgcccctcctccaaggagcaaccatgctgctgaagaggcttcgtccgaggatgaggaggaagaagaagtccaggcgatgcagtccttcaacagtacacagcagaatgaaactgaacctaatcagcaggtcgtaggcaccgaggagcggatccctattcccttgatggattacattcttaatgttatgaagttcgtggagagcattctgtcaaacaataccactgacgatcattgccaagagtttgttaatcagaagggacttctgcctttggtgactattcttgggcttcctaacttgcctattgattttccaactagcgccgcctgccaggctgtagccggtgtgtgcaaaagcattctcaccctttcgcacgagcctaaagtcctgcaggagggcctcctgcaactggactcaatcctttcctctttggaaccgcttcacaggccaattgaatcccctggcggttcagtcctgttgcgcgagttggcatgtgcaggaaatgtggccgatgctactctgagcgcacaggccacacctctgttacatgccctgacggcggctcacgcctacattatgatgttcgtgcacacatgtagagtaggacagtctgagatccgatctatatcagtcaatcagtggggctcgcaactgggactctcagtgctctcaaagctctctcaactgtactgctctctcgtgtgggagtctacggtgctcctgtctttatgcacaccaaacagcctgccctctggatgcgaatttgggcaagcagacatgcagaagctcgtccctaaggacgaaaaggcaggtaccacgcagggcggaaagcgatccgacggcgagcaggatggagctgcagggagcatggacgcaagcacacagggcctattggagggcataggcctggacggcgatactttggcccctatggaaacagacgagcctacagccagcgattccaaaggcaagtcaaagattaccccagccatggccgctaggattaagcagattaagcccctactttctgcatcttccagactgggcagagctcttgccgaattgtttggtctgctagtcaagctgtgcgtcggcagccccgtgcggcaacggcggtcacaccacgctgcctcgaccaccaccgcccccacacccgcagcaaggagtacagcttccgctctcacgaaactcctcactaaagggctctcatggcagccacctccatacactcccacacctcggtttcgccttacattcttcatctgtagtgtcggattcacaagtcccatgttgttcgacgagaggaagtacccttatcacctgatgttacaaaagtttctttgtagtggcggccacaatgctctgttcgagacctttaattgggctcttagtatgggaggtaaggtgccggtttctgaagggctggaacactctgacctgccagatggcacaggggagttcctcgatgcctggttaatgcttgtggagaagatggtaaatcctacgacggtcctggagtccccccattcgctacctgcaaaactgcccgggggggttcaaaatttcccccagttttctgcactacgtttcctagttgtcacacaaaaggcagcgtttacttgcataaagaatttgtggaaccggaaaccccttaaagtgtacggaggacgcatggccgaaagtatgctagccatcctgtgtcacatcctccgtggagagcccgtgataagagagcgcctcagtaaagagaaggagggatccagaggggaggaggatacaggccaggaagagggtggttcacgtcgggaacctcaggtgaaccaacagcaactacagcaactgatggatatgggctttacccgcgagcatgcaatggaagccctcctgaatacttcgaccatggaacaagctactgaatacctgctgacccacccccctccgatcatggggggagtggtcagggatctgagtatgagcgaggaagaccagatgatgagagcaattgcaatgtccctcggccaggatatcccgatggaccagagggccgaaagcccagaagaagtcgcctgccgcaaggaggaagaggagcgaaaggcacgggagaaacaggaggaggaagaagcaaagtgtcttgagaagtttcaggatgcagacccgctcgaacaagatgaactgcataccttcacagatactatgctgcctggctgtttccacctgctggacgagctgcccgacacagtctatagagtttgtgaccttattatgaccgccattaagcgtaacggtgcagattatcgcgatatgattctgaagcaagtggttaaccaggtttgggaagcagccgacgtactgatcaaggcagctctgcctctaacgacatccgataccaaaaccgtgtcagaatggatttctcagatggcaacgctgccccaggctagcaatctggctactagaatactactcttaaccctgttgttcgaggaactcaaattaccatgtgcttgggtggtcgagtcttctggtatcttgaatgtgctcatcaaactacttgaggttgtacagccgtgtcttcaagctgcaaaagagcagaaggaagtgcaaacccctaaatggatcacacctgtgttgttgcttatagacttctacgagaaaaccgccatttcctccaagcgcagggcacagatgacaaagtacctccagtcaaactcaaataactggagatggtttgatgatcggtccggtcgttggtgctcttactccgcatctaacaactcaactatcgactctgcttggaagagtggggaaactagcgtgaggttcacagccgggaggcgccggtatacagtacaatttacaaccatggtccaggtgaacgaagagactggaaacaggcgccccgttatgttgaccttattacgggtccctagactgaataaaaattcaaagaattctaacgggcaggaacttgagaagaccctcgaggaaagtaaagagatggatattaagcggaaagaaaataagggaaacgatactccgttagcattagagagcactaacacagagaaggagactagtcttgaggagacaaaaattggtgagattttgattcagggtctgaccgaagatatggtcacggttctgataagagcctgcgtgagtatgctcggcgtcccggtcgatcctgatactttacacgcaacactgcgtttgtgcttgcgtctgacacgcgaccacaagtacgcgatgatgttcgccgagctgaagtccacacggatgattctgaatctaacacagagcagtggattcaatggattcacaccactggtgaccctgctgctacgacacatcatcgaggacccctgcactctcagacacacaatggagaaggtcgtgagatcagccgcaaccagtggtgccggatccacaaccagtggggtggtatctggttctctgggctctagagagattaattatatcctcagggttcttggccctgcagcatgtcggaatcccgacattttcacagaggttgctaattgttgcatccgaatcgccctccccgctcctcgcggtagcggtaccgcctccgacgacgaatttgaaaaccttcggataaaaggcccgaacgcagtacaactggtaaaaacgactccgctgaagcccagcccccttcccgtaatacctgataccattaaggaggtcatttacgatatgcttaatgctcttgctgcctaccacgcaccagaggaggcagataagagtgaccccaagccgggtgtgatgacacaggaggtaggccagctgctacaagacatgggggacgatgtgtaccagcaatacaggtccctgacaagacagagctcagatttcgacacacagtcaggctttagcatcaacagtcaagtgttcgctgcggacggtgcttctaccgaaacatccgcctctgggaccagccaaggtgaggcctccacccctgaagaaagtcgagatggcaagaaggacaaagagggagatcgcgcatccgaagagggtaaacagaaagggaagggaagtaaacctctcatgcccacatctaccatcctgcggttgctcgcggagttggtgaggtcctatgtcggcatagcaacactcatcgctaactacagctatactgtaggccagtcagagctgataaaggaagactgtagtgttctggcttttgtcctcgaccatctcttaccgcacacgcaaaatgccgaagacaaggatacaccagcgcttgcccgtctgtttctggcgagcctcgccgctgctggctccggcactgatgcacaggtggctttggtaaatgaggtgaaggctgcgctcggcagagccttagccatggccgagtcgacggagaagcatgcaaggcttcaagcagtgatgtgtattatatctactatcatggaaagctgcccgagcaccagctctttttactcatccgcaacggccaagacacaacataacggcatgaataatattattagactctttcttaagaaaggactggtgaatgacttggctagagtgccgcattccttagatttgagcagccctaacatggcgaacacagtcaatgccgcattaaagccacttgaaacacttagtcgtattgtaaaccaaccttcctcgttattcggctccaaatctgcctcaagcaaaaataaatcagagcaggacgcccagggagcctcccaggattcaagcagtaatcagcaggatcccggcgagcctggggaagctgaagtgcaggaggaggatcatgacgtgacccagacagaggtggctgatggagatattatggatggcgaggcggaaacagactcagtggtcatcgctgggcagcctgaagttctcagctcacaggagatgcaggtggaaaacgagttagaggacctcattgatgaactgctggagagagatggcggatccggtaatagcactattattgtcagtcgcagcggggaagatgagtcccaagaagatgttcttatggacgaagctccttctaacctctcccaggcatcaactcttcaggcaaacagagaagattcaatgaatattctggatcctgaggatgaggaggaacacactcaggaagaggactctagtggctccaacgaagatgaagacgattctcaggatgaggaagaggaggaggaggaagacgaagaagacgatcaggaagatgatgaaggggaggaaggagatgaggacgacgatgacgacggctccgagatggagcttgacgaggactatccagatatgaatgcatcaccactggttagatttgaaaggttcgaccgagaagacgatctgatcattgagttcgacaatatgtttagtagtgccactgatatacctcctagtccaggcaatatccccaccactcacccactgatggtacgccatgccgaccatagctccctgactctggggtccggcagcagtaccactaggctgacccagggcatcgggagatcccaacggaccctccgccagctgacagcaaataccggacataccatccatgtgcactaccctgggaatagacagccaaaccctcctctgattctgcagaggttacttggtccctccgcagcggcagatatactccagctgagcagctccttgcccttacagtcaagaggccgggcccgactactggtgggaaacgatgacgtgcatatcatcgccaggtccgacgacgagcttttagacgacttctttcatgatcagtcgaccgctacatcgcaggcggggacgctgtcatcgatcccgaccgctctcacccgctggaccgaagaatgcaaggtgctggatgccgagtcaatgcacgattgtgtgtccgtggtaaaagtgtccatcgttaaccatctggagtttctcagagatgaagagttggaagagcggagggagaaaagaaggaaacagctggcagaagaggagacgaagattaccgacaaagggaaggaggacaaagaaaacagggaccagtcagcacagtgcaccgccagtaaatccaatgattctactgagcagaacttgagcgatggaactccgatgcctgacagttatcccacaaccccctccagcaccgacgcagcaactagcgagagcaaggaaacactgggcaccctccagtcaagtcagcaacaaccaactctgccgacccctcccgcactgggagaggtgccgcaggagttgcaaagccccgccggcgaaggtgggagcagcacacagctcctgatgcctgtggagcctgaagaactaggcccaacacggccctctggcgaggccgaaactacgcagatggaactttctcccgccccaacaatcacaagcttgagcccggagcgggctgaagattccgatgccttaacggcggtcagttctcaactcgaggggagtcctatggacacttcttctctggcctcctgcactctagaggaagctgtgggcgacacctcagcagctggatcaagcgaacaaccaagagctggttcgagtacccctggcgacgcgccccctgccgtggcggaggtacaaggcaggtctgacggcagcggggaaagtgcccagcctccagaggattcttcccctcctgcatcctccgaaagcagctcaacacgtgattcagctgtcgcgatttcaggggccgattcgcgaggaattctggaggaaccattgccttctacctctagcgaagaggaggatccactggccggcatcagtctgccagagggcgtggacccctctttccttgccgctcttccggatgacatccgacgagaggtcctgcagaaccagctgggaatcaggcctccgactcggacagccccttccacaaatagttctgctcccgccgtggtcggcaatccaggtgtcaccgaggtgtcccctgaatttctggccgcactaccccctgcaatccaggaagaggtgctcgctcaacagcgggccgagcagcagcgtcgcgaactggcgcagaatgcgagctcagacacgcccatggaccctgtaacgtttattcagactctgccatctgacctgagacggtcagtgctcgaagacatggaggacagtgtcttagctgtaatgccccccgatatagcagccgaggctcaggctctccggagagagcaagaggccagacagcggcaactaatgcacgaacggcttttcggacactccagcaccagtgctttatcggcaatactgagaagccccgcctttaccagcaggctgtctggcaaccgcggtgtgcaatatactcggcttgcggtccagaggggggggacctttcagatgggggggtcatcgtctcataatagaccttccggatccaatgtggatacgctgttgaggttgcggggtagactgctgttggaccatgaggccttgtcatgcctactggtgctgctctttgtcgacgaaccaaaactgaacacatctcggttgcacagggtgctgcgtaatctctgttaccacgcacagacaagacactgggtcattcgttcactgctttcaatcctgcagaggtctagcgaatcagaattatgtatagagacccctaaattaacaacatcagaagaaaaagggaaaaaatcctcaaagagctgcggcagctctagccacgagaatcgccccctcgatctgcttcacaagatggaatcaaaatcctctaaccaactctcatggctttcagtgtctatggatgctgcactcggttgccgaacgaacatcttccagattcaaagatctggcggccggaagcacaccgagaagcatgccagtggcgggagcaccgtgcatatacacccgcaagccgcccctgtcgtgtgccggcacgtcctcgatacactcatacagttggctaaagtgttcccaagccactttacccagcagcggacgaaggagacaaactgcgaatccgacagagaaagaggtaataaagcatgctctccctgctcttcacaatcctccagctccggcatctgcacagacttctgggatctgctggtgaaactggacaatatgaacgtttccaggaagggcaaaaactccgtcaaaagtgtccctgtgagcgctgggggagaaggcgagacgtccccttattccttggaagcgtctcctttgggccaacttatgaacatgctgtcccatccagtaattaggcggtcaagcctcctgaccgaaaagctgctgaggttgctgtctttgatctctatcgctctgcctgagaacaaggtgtccgaggcacaagcaaacagcggctcaggcgccagcagtacgactactgcaacaagcaccacctctacaactactaccaccgccgcaagcacaactccaacaccccccacagccccaacacctgtcacaagtgcaccggccctggtggcggcaaccgcaatttcaacaattgtggtagccgcatctacaacagtaaccactcccaccaccgccacaacaaccgtgtcaattagcccaaccacaaaaggaagcaagtccccagctaaggtgtcggatggcgggagttcgtctaccgatttcaagatggtgtcttcaggtctgaccgaaaaccaattgcaactgagtgtggaggtgttaacatcacactcgtgctcggaggagggactggaggacgccgcaaacgttctcttgcagttgtcccggggggattccggcacaagagacaccgtgctgaagttgttgctgaacggcgcccgccatctggggtatactctgtgcaagcagatcgggacgttattagcggaactgagggagtataacctggaacaacagcggcgagcgcaatgtgagacactgtcacccgacgggttacccgaggagcagccgcaaaccacaaaactgaaaggcaaaatgcagtccagatttgacatggccgaaaatgtcgtgattgttgcgtcccagaagcgtcctttaggcggtcgtgaactccaactcccaagtatgtccatgcttacctcaaagacgagcacccagaagtttttccttagggtgctgcaggtcatcattcagcttagagacgatacacggcgggccaacaagaaggcgaaacagactgggcggctcgggtcatctggcttgggctccgcttcatcaattcaggctgcagtgcgccaattggaggctgaggctgatgcgataattcaaatggtgcgcgaaggccagcgcgcccggcgccagcagcaggcagcgacatccgagagttcgcagtctgaagcttctgtacgtcgcgaagagtctcctatggacgtggaccagccgagcccgtcagcacaggatactcagtccatcgccagcgacgggacaccacagggggaaaaggagaaggaggagagacctcctgagcttcccctcctgagcgagcagctctcgttggacgagttgtgggatatgcttggcgagtgcctcaaagaattagaggagtcccacgaccaacatgctgtattagtgttacaaccagccgtggaagcattctttctcgtgcacgccactgaacgcgaaagcaagccccctgtgagggacacaagagagtcccagctggcccacatcaaagacgagcccccccccctctcacctgcgccactgacacccgcaaccccttcctctctcgacccgttcttctctcgggaacctagcagtatgcatatctcaagttcactacctccggacactcaaaaattcctgcggttcgcagaaacccatcgtacagttttgaaccagattctcagacagagcacaacgcatctggctgacgggccttttgccgttctggtggactatatccgcgtgttagactttgacgtgaaaagaaaatatttcagacaagagctcgaaaggttggacgagggtctacgcaaagaggatatggccgtgcacgtacgacgcgaccatgtcttcgaagacagttacagggagctgcacagaaaatcaccagaggagatgaagaaccgtttgtacattgtgttcgaaggtgaagaaggccaggacgcgggaggactgctgcgcgagtggtatatgatcatcagtagagagatgtttaatccaatgtatgccctgtttaggacaagcccaggtgaccgggtgacatacacgattaaccccagctctcattgtaaccctaaccacctgagctacttcaagtttgtcgggcgtattgttgccaaagcggtgtacgataacagattgttagagtgctacttcacacgcagcttctacaagcacatcctgggtaagtcggtccgatacacggacatggagagcgaggattaccacttctatcaaggcctcgtgtacttgctggaaaacgacgtcagtaccctgggatatgaccttacattctcaacggaagtccaggagtttggcgtctgcgaggttagggatttgaagcccaacggtgcgaatattctcgtgacagaagagaacaagaaagaatatgttcatctcgtctgccagatgcgtatgaccggggccataaggaagcaactggccgctttcctagagggtttctatgaaattattcccaagagattgatttccatctttacggaacaggaactggagctcctgatcagcggactgccaaccatcgatattgatgacctcaaatccaatacagaataccataaatatcagagcaattccatccaaattcaatggttttggcgcgcattacgctcttttgaccaggcagatagagctaagttcctccagttcgtcactggcacgtctaaggtgcccctgcaaggtttcgccgcactggaaggcatgaatgggatccagaaatttcaaatccatagggatgacagatcaactgaccggttaccctctgctcatacctgcttcaatcagctggatcttcccgcctacgagtcctttgagaaactgaggcacatgcttctgcttgccatccaggaatgttcggaaggttttggcctggcatag

SEQ ID NO: 46918 - DNA, 1746 bp, Artificial Sequence
  Description of Artificial Sequence: Synthetic coding sequence
atgaccagcgccgtggtggacagcggcggcaccatcctggagctgtccagcaacggcgtcgaaaaccaagaggagtcagaaaaggtttcagagtatcctgcagtcattgtcgaaccagtacctagcgctcggctggagcagggctacgctgcccaggtactggtgtacgatgacgaaacatacatgatgcaggacgtggctgaggaacaggaagtggagaccgaaaatgtggaaacagtagaagccagcgtccatagttccaacgctcattgcacggacaaaaccatcgaggctgcagaagctctgttgcacatggaaagtccaacttgtctccgcgactcaaggtcacctgagtttatacacgccgcaatgaggcctgatgtcataaccgaaacagtggtagaggtgtctacagaagaaagcgaacccatggacaccagtccaattccaaccagcccagacagccatgagcccatgaaaaagaagaaagtgggcagaaaaccaaagacccaacagagtcccattagcaatggctcccccgaactcggcataaaaaagaaacctcgtgaaggcaaaggaaataccacatacttatgggagttcctgctggatctgctacaggacaaaaacacctgtccgcgctacatcaaatggacacagagagaaaaaggaattttcaagctagtggacagcaaggccgtctccaagctgtgggggaaacacaaaaacaagccagacatgaactacgaaactatgggcagggccttacggtactactatcagagagggatcctagccaaggtggagggacaaaggcttgtatatcaattcaaggacatgccgaagaacatcgtggtgatagatgacgataagtctgaaacctgtaacgaggatctagccggaaccactgacgagaagtccctggagcgcgtgtccctctccgcagaatctctgttaaaggccgcgtcatcagtcagatcaggcaagaacagcagccccattaactgtagccgggcagaaaagggagtcgcacgcgtggtcaatatcacatcacccggccatgatgcaagcagcagaagtcccaccaccacagcctctgttagcgctacagcagcacctcgcaccgtccgagtagccatgcaggtgcctgtggttatgacaagccttggccagaagatctcaacagtggcggtgcagtccgtaaacgctggggctccgctgattacgtccaccagccctaccaccgctacctcacccaaagtggtgatacagacaatccccactgtaatgccggccagcaccgaaaacggagataagatcacgatgcagccggccaagatcatcacgatccctgccactcagctggctcagtgccagttgcagactaagtctaacctgacaggtagcggaagcataaatattgtaggcactccactggcagtgcgtgctctgactcctgtgtcgatagcacacggtactccggtcatgcggctgtccatgcctactcaacaggcatcaggtcagacccccccgagagtaatctccgccgttattaagggaccggaagttaagtccgaagctgtcgctaagaaacaggagcatgatgtgaaaacactccagttagtggaggaaaagcctgcggatggaaataagacagtgacccatgttgtggtcgtctcagccccatccgccatagcccttcctgtcacaatgaagaccgaggggctagtgacatgtgagaaatag

SEQ ID NO: 46919 - DNA, 1602 bp, Artificial Sequence
  Description of Artificial Sequence: Synthetic coding sequence
atggccaccagcctgcacgagggccccaccaaccagctggacctgctgatccgcgccgtcgaggcaagtgttcacagctcaaatgctcattgtactgacaagacgatagaggccgccgaagctctactgcacatggaaagtcccacatgtctccgggacagcagatctccagtggaagtattcgtgcccccatgtgtgtctacccctgagtttattcacgctgcgatgcgtccagatgtcattaccgagacggttgtggaggtgtcaaccgaggagtccgaaccgatggacacctctccaattccaacctctcctgatagccacgagcccatgaagaaaaagaaggttggtagaaagccgaagacgcagcagtcacctatatccaatggcagtccagaactcggtatcaaaaaaaagcctagagaaggaaaagggaatacgacctacctgtgggagtttttgcttgatcttctccaggataagaacacatgtcctcgatacataaaatggactcagcgcgagaaagggatctttaagctggtggattccaaagcagtctccaagctgtggggaaaacacaaaaacaagcccgacatgaactatgaaacgatgggccgagctctacgatactactatcagcgtggaatccttgctaaggtggagggtcagagactggtctaccaatttaaggacatgccaaaaaacattgttgtgatcgacgacgataagagcgagacgtgtaatgaagacctagccgggaccactgatgaaaagagtcttgagcgagtttctctgagtgcagaatccctcctgaaagctgcatcttctgttagatccggcaaaaacagctcgcccattaactgttctcgcgccgagaagggggtggctagggtggtgaacatcactagccccggacatgatgcatcttccagatcccctactacaaccgccagtgttagcgctaccgcagctcctagaaccgttagggtggcaatgcaggtccctgtggtgatgacctcactggggcagaaaatctctacggtggccgtacagtccgtcaacgcgggagcaccactcattacgtctacaagccccactactgcaacttccccaaaagtcgtaatccagaccattccaacggtcatgccagcttctactgaaaacggcgataagatcaccatgcagcctgctaagattatcactatccctgccactcaactggcccagtgtcagctccagacaaagagcaacctgacaggctctgggtccattaatatcgtgggcacaccattggcagtgcgagcactgaccccagttagcattgcccacgggacacccgtcatgcgactaagtatgcctacacaacaagcctccggccaaactcctcccagagttattagcgctgtgatcaaagggccagaagtcaagtctgaggcagtcgccaagaaacaggaacatgacgtcaagactctacagttggttgaagaaaaacctgccgacggaaataaaaccgtgacccacgttgtcgtggtctcagctccttctgccatcgctctgccagtgaccatgaagaccgagggcctcgttacctgcgaaaaatag

SEQ ID NO: 46920 - DNA, 1515 bp, Artificial Sequence
  Description of Artificial Sequence: Synthetic coding sequence
atggccaccagcctgcacgagggccccaccaaccagctggacctgctcatcagggctgttgaagcatccgttcattcatccaatgcacactgtactgacaaaacgatcgaggccgccgaggccctgcttcacatggagagccccacatgcctgagggatagcagaagcccggtagaagtctttgtgcccccttgtgtctcaactcctgaattcatccatgcggccatgcgccccgacgtgattacagaaacagttgtggaagtctcaaccgaagaatccgaaccgatggacacttcaccaataccaacctcgccagattcccatgagcccatgaaaaagaaaaaaggaaataccacatacctgtgggaattcctactcgacctgctgcaggacaagaatacctgcccccgttatattaaatggacccagagagaaaagggaatcttcaagctcgtcgattccaaggccgttagcaaactctgggggaaacacaaaaacaagccggacatgaactatgagacaatgggcagggctctgaggtactactatcagcgggggatcttggccaaagtagagggtcagcggctcgtttaccaatttaaggatatgccaaagaacattgtggtgattgatgatgacaagtcagaaacctgcaatgaagatttggccggcacaactgacgaaaagtctctggagcgtgtgagtctctccgctgagtccctgctgaaagctgcctcatcggtgcgtagcggcaagaattcttctcctattaattgtagcagggccgagaagggggttgcccgagtcgtcaatataacttctcctgggcacgacgcatcatcacgaagccctactaccaccgcttcagtgagcgctactgctgctccacgcacagtccgtgtagctatgcaggtgccagtggtgatgacaagtctaggacaaaagatcagtacggttgctgtgcagagtgtgaatgccggagccccactgataacctccacttcaccgacaactgccaccagtcctaaagtcgtcatccagaccattcccaccgtcatgccagctagcacggagaacggagataagataacgatgcaacctgctaagattatcactattcctgccacccagctggcgcaatgccagctccaaaccaaatcaaaccttactggaagcggctccattaatatcgtcggaactccgctcgctgtcagggcactcacacccgtgtcaattgctcatggtacccccgtgatgaggctctctatgcccacccagcaggcctctggccagactcctccgcgggttatcagcgctgtgatcaaaggacccgaggtgaagtctgaggcagtggcaaagaaacaggaacacgacgtcaaaaccctacagctggttgaggagaaaccagccgatgggaataagacggtgacccacgtcgttgtggtgtccgctccctccgctatcgccttgcctgttaccatgaagacggaagggcttgtgacctgcgagaaatag

SEQ ID NO: 46921 - DNA, 1782 bp, Artificial Sequence
  Description of Artificial Sequence: Synthetic coding sequence
atgaccagcgccgtggtggacagcggcggcaccatcctggagctgtcctccaacggagtggagaaccaggaggaatcagagaaagtgtccgaatatcctgctgtgatcgtggaacccgtcccatccgcgcgactggagcagggttacgcagcacaggtcctcgtctatgacgacgagacctacatgatgcaggatgtggctgaggaacaggaggtggagacggagaacgtggaaacagtggaagccagtgtgcatagctctaacgctcactgcaccgacaaaaccatcgaagccgcagaggcgcttctgcacatggagagtccaacatgcctgagagacagccgctcgccggtcgaggttttcgtgccgccctgcgtgagtaccccggagttcatccacgctgcgatgcgcccagacgtgataaccgagacggtggtggaagtatccacggaggagagtgaacccatggatacatccccaattcctacgtccccagactctcacgagccaatgaagaagaagaaagtgggcagaaagcctaaaacgcaacagtcaccgattagtaacggctctccggagcttgggataaagaaaaagccccgagagggcaagggcaatacgacgtacctgtgggagttccttctggaccttctccaggataagaacacatgtcccaggtacataaaatggactcagcgggagaaaggcatattcaagcttgtggatagcaaggcagtgtccaagctttggggtaaacacaagaacaagcccgacatgaactacgagaccatggggagagccctgaggtactactatcaacgcggtattctcgccaaagtggagggacagagactggtttaccagttcaaggacatgcctaagaatattgtggtgatagatgatgataagagcgaaacctgcaatgaagacctggccggaaccaccgacgagaagtccctggaacgcgtttccttaagtgccgaatctcttctgaaagccgcctcctccgtccgctcgggtaaaaatagcagtcctatcaattgctctcgcgccgaaaagggcgtagcccgagttgtgaacatcacttcccccggccacgatgcctccagccgctctcctacgacgaccgcctctgtgtctgcaaccgccgcaccgcgcactgtgagggtagctatgcaggtccccgtggtaatgacctctctggggcagaaaatctctacggtcgcggtgcagtctgttaatgcgggcgctcccctgatcacaagtacgtctcctacaacagctacatccccaaaagtggttattcagaccatcccaacggtcatgcctgcatcaacagagaatggggacaaaatcaccatgcagcctgctaagattatcactatccctgctactcaactagctcagtgtcagttacaaactaagtctaatcttaccggttctggctccatcaatattgtgggcacgccccttgccgtcagagccctgaccccggtctcgatcgcccacggcacgccagtcatgaggctgagcatgccaacccagcaggcttccgggcagacccctcctagagttatatctgcagtcattaagggccccgaggtcaagtcagaagctgtcgctaagaagcaagagcacgacgtgaagacattacagcttgtggaagagaagccagccgatgggaacaaaaccgtgacccacgttgtggtagtctccgccccttcagctattgccctgccagtgacgatgaagacagaagggcttgtaacatgcgaaaagtag

SEQ ID NO: 46922 - DNA, 1746 bp, Artificial Sequence
  Description of Artificial Sequence: Synthetic coding sequence
atgaccagcgccgtggtggacagcggcggcaccatcctggagctgtcaagtaacggtgttgaaaatcaggaagaatccgaaaaggtgagtgagtacccagctgttatcgtagaacctgtgcccagcgccaggctggagcagggctatgcggcacaggtactcgtgtacgacgacgagacatatatgatgcaggatgtcgctgaagaacaggaggtggagacagaaaacgtcgagacagttgaggccagtgtacacagctctaacgctcattgcactgataaaacaatagaggcagccgaagccctcctgcatatggaatcgccgacatgcctgagagactcaaggagtcctgagttcattcacgcggccatgcggcctgatgtgattacagagaccgtcgtagaagtatccaccgaggagagtgagcccatggatacctcgcccatccctacgtctcccgatagtcatgagcctatgaagaaaaagaaggtggggcgtaagcccaagacacaacaatcgccaatatctaatggaagccctgaactcggtattaagaaaaaacccagagagggcaagggaaatacgacctatttgtgggagtttctgcttgatttgttacaggacaagaatacatgcccgagatacatcaagtggacccagcgggagaagggcattttcaaactggttgatagcaaagcggtttccaaactgtggggaaagcacaaaaataaacccgacatgaattatgaaaccatgggacgcgctctacggtattattatcaaagaggaatactcgccaaagtggagggccagaggctggtataccagttcaaagatatgcctaaaaatattgtggtgattgacgacgacaaatctgagacatgtaacgaggatctcgccggcacaacagacgagaagagcctggaacgggtaagtctgagcgccgagtcccttcttaaggccgcctcttctgtgagatcaggtaaaaactcaagccctattaactgctcccgagctgaaaagggagtggcccgggtggtgaacataactagcccagggcatgatgcaagttcccggagcccaacgactacagcttctgtcagcgcaactgcggccccaagaaccgtcagggtagcaatgcaggtgcctgtggtgatgacttctttggggcaaaagatttccacggttgcggttcaaagtgttaatgccggtgctccactgatcaccagcacgtcaccaacaacagctacctctcctaaagtcgtgattcaaacaatcccaacggtgatgcctgcatccaccgaaaatggggacaagatcaccatgcagccggctaagataatcacaatcccagccactcaactcgctcagtgtcagctccagacaaagtccaacctcactggatctggctccattaatatcgtggggaccccactcgccgtgcgtgcactgacaccagttagcatcgctcacggtacccctgtgatgcgcctttccatgcccacacagcaggccagtggccagacacctccaagagtgatatctgcagtgattaaaggccccgaggtgaaaagcgaggctgtcgcgaaaaagcaagagcacgacgtgaagacgctccagcttgtggaggagaaacctgccgacggaaacaaaacggtcacccatgtcgttgtggtgagcgcacccagtgcaattgctctccccgtgaccatgaagacagaagggctggtgacatgcgaaaaatag

SEQ ID NO: 46923 - DNA, 1191 bp, Artificial Sequence
  Description of Artificial Sequence: Synthetic coding sequence
atgagcgtgatcgtgttcaagggcaacaccacctacctgtgggagttcctccttgacctcttgcaggataaaaacacatgtcctagatatatcaagtggacacaacgcgaaaaagggatttttaagctcgtcgacagcaaagcagtgtcgaagctgtggggtaagcacaaaaataagccagacatgaattacgagaccatgggccgggcactgagatattactatcaaagggggattctggcgaaagtggagggccagagactggtctatcagttcaaggacatgccaaagaacatcgttgtgattgatgacgataagtccgaaacctgcaacgaagatctcgccggaactactgatgaaaagagccttgagagagtttccctgagcgccgagtcactgttaaaagctgcatcatctgttaggagcggaaagaatagtagccccatcaattgtagtcgggcggaaaagggagttgctcgggtggtgaacatcacctctcccggtcacgatgcctcgtcacgtagccccaccactaccgcgagcgtctcagctactgccgccccacgaacagtcagggtggccatgcaggtgcctgtggtgatgaccagccttggacaaaagatctctaccgtagcagtccagtctgtcaatgccggtgcccctctgatcacctcaacaagccctaccacagccacgagcccaaaggtcgtgattcagacaatcccaactgtgatgcctgcttctacggagaatggcgacaagattaccatgcagccggcaaaaattatcacaatccccgcaacacaacttgcacagtgccagctccaaaccaagagcaacttaacagggagtggatccatcaacatagtgggtactccactcgcagttcgggctctgactcccgtgtcgattgcccacggaacacctgtcatgaggcttagtatgcctacccagcaagcttctggccagaccccccccagggttattagcgcggtgataaaaggcccagaagtcaaatccgaggccgtggccaagaaacaggaacacgatgtgaaaactctgcagctggtggaggagaaaccggcggacgggaataaaactgtgactcatgtagtggttgtctccgccccgtctgctattgcgttgcccgtgactatgaaaactgaggggctcgtcacttgcgaaaaatag

SEQ ID NO: 46924 - DNA, 2385 bp, Artificial Sequence
  Description of Artificial Sequence: Synthetic coding sequence
atggccagccccaccctgagccccgacagcagcagccaggaggccttatcagcccctacatgttcccctactagcgactctgagaatctgtctcccgacgaattggagctccttgctaagctcgaggagcagaatcgcctgttggaggccgacagcaagtctatgcgttcgatgaacggcagccgaagaaactctggtagttcccttgtctcatcctcctctgccagttcaaatctttcccatctcgaggaagacacttggatcctctggggcaggatcgccaacgagtgggaggaatggcgccgtaggaaagaaaagctgcttaaagagctcataaggaaaggtattccgcaccacttcagagccattgtatggcagctgctctgcagcgctaccgatatgcccgtgaagaaccagtattctgagctgctgaagatgagttctccatgtgagaagctcatccggcgagatatagccagaacataccctgagcacgaattcttcaaaggccaggattccctgggccaggaagtgctgttcaacgttatgaaagcctactccttagtcgacagagaggtcgggtactgccaaggctctgctttcatagttggacttctcctcatgcagatgcccgaagaagaggcgttttgcgttttcgtgcggttgatgcaggagtaccggcttagagagctcttcaagcccagtatggcggagctgggactgtgcatctatcaattcgaatatatgctccaggagcagcttccagacttgaacacacatttccggagtcagagttttcatacaagcatgtatgctagttcctggtttctgaccctatttctcactacattcccattacccgtcgcaactcgggtatttgacatattcatgtacgaagggcttgagatcgtgtttcgcgtgggactcgccttgctgcaagtaaatcaagctgagcttatgcagttggatatggaaggaatgtcacagtatttccagagggtcataccccatcagtttgattcttgtcccgataagctcgtcctgaaggcctaccaggtgaaatataatcccaaaaaaatgaagcggctggagaaagaatatgccgctatgaagtcaaaggagatggaagaacagatcgagatcaagcgattgcggaccgagaaccgcctcctgaagcagagaattgaaacactggaaaagggccaggtaacaagagctcaggaagccgaagaaaattacgtgatcaagagagagcttgccgtagtcaggcagcaatgttccagcgcagccgaagacctccagaaagcccagagcacaattcgtcaattgcaggagcaacaggaaaaccctagactgactgaagattttgttagtcacctggaaacggagcttgaacagtctcggctacgggaaaccgaaaccctgggcgccctgcgcgagatgcaggacaaggtcctcgacatggagaagcgcaattcttcgctgcccgacgaaaataacgtggctcaactgcaagaggagctgaaggctctcaaagtgagggaaggacaagctgtagcctcaacgagggaactgaagctccagctgcaggagttgagcgacacctggcaggcccatctggccagaggcgggcgctggaaggaaagccccagaaagctcgtcgtaggtgaattgcaggacgagcttatgtctgttagactgagggaagctcaggccctcgctgagggccgggaattgaggcagcgtgtggtggaactggagactcaagaccatatccatcggaacctgctgaacagggtggaagctgagagggcagccctccaagagaagctgcagtatctggccgcccagaacaagggacttcagacccagctatcagaaagcagacggaagcaggcagaggcggagtgcaagtcaaaggaagaggtcatggccgtgagacttcgcgaggctgacagcatggccgctgtggccgaaatgagacagcgcatcgcagagctggaaatccagagagaggagggcagaattcagggacagctgaaccacagcgatagctcgcagtacatccgtgagctaaaggatcagatcgaagagttaaaagccgaggtaagactactgaaaggccccccgccctttgaagacccactggcttttgatggcctctccttggcacgccatctcgacgaagattctctcccctcttcggacgaggagctgctgggagtgggcgttggagctgcactgcaagatgcactctaccccctatcacctcgagacgctcggttcttcagacgcctcgagcggcctgctaaagactctgaaggttctagcgacagcgacgccgatgaactggccgctccctattcccagggcttagacaattag

SEQ ID NO: 46925 - DNA, 2418 bp, Artificial Sequence
  Description of Artificial Sequence: Synthetic coding sequence
atggccagccccaccctgagccccgacagcagcagccaggaggccctaagtgctccgacttgcagtcccaccagcgatagtgagaatctgtctcccgacgagctcgaactcttggctaagcttgaagagcagaataggcttctggaggccgattccaaatctatgaggtctatgaatggaagcaggaggaacagcggtagctcactagtctcctcgagtagtgcgtcatcgaacctctcccatctcgaagaggacacatggattttgtggggccgcatcgcaaacgagtgggaggaatggcgtagacggaaagaaaaactccttaaggaactaattaggaagggaataccacaccatttcagggccatagtctggcagctcttgtgctcagccacagacatgcctgtgaaaaaccagtactccgagctgctgaaaatgagcagcccttgcgaaaaactgataaggcgcgacattgcgcgaacctatcctgaacacgagttctttaaaggtcaagactcactcggtcaagaagtgttgtttaatgttatgaaggcctactcattagtagaccgtgaagtggggtactgccaggggtctgccttcattgtgggacttctcctcatgcagatgcctgaagaagaggccttttgcgtgtttgttcgacttatgcaagagtataggctacgcgagctgtttaagcctagcatggcagaactgggactgtgtatttaccagttcgaatacatgctgcaagagcagttgcctgatctgaacactcattttagatcccagtcgtttcacacatccatgtatgctagttcttggtttctgactctgttcctcacaaccttccccctgcctgtagccacccgcgtgttcgatatatttatgtatgagggcctggagatagtgtttcgtgtggggctggcactccttcaggttaatcaagctgaactgatgcagctcgatatggaagggatgtcgcagtactttcagagggtgatcccccatcagttcgacagctgtccagacaaattggtgctgaaggcttatcaggtcaagtataaccccaagaagatgaaacggttggagaaggagtacgccgctatgaagagcaaggaaatggaagagcagattgagatcaagcggctgcggaccgagaaccgtctgttgaaacaacggattgaaaccctcgagaaagagtccgccgcgctggccgacaggctaatccaaggccaagttacccgcgcccaggaggcagaggagaattatgttataaaacgcgagctcgccgtcgtccggcaacagtgttcctcagccgcagaagatcttcagaaggcccagagcaccattcgccagctgcaggaacagcaggaaaatccgcgtctgactgaagatttcgtaagccacctcgagactgagttggaacagtctcgtctaagagaaaccgaaactctaggagctctccgggaaatgcaagataaggtgcttgatatggagaagagaaactctagtctgccggacgagaataacgtcgcccaattgcaggaagaactcaaagccctgaaggtgagagagggtcaagctgtggcgagcacccgggaattgaaactacagctgcaggagctgagcgatacatggcaggctcacctggctagaggtggtagatggaaggagagtccccggaagttggtggtgggggaactgcaagacgagctgatgtcagtcagactccgagaagcccaggctttagcggaaggccgggaattacggcaaagggtcgtagagctggagacccaggaccacatccataggaatttgctcaatagagtggaagcggagcgggcggctctgcaagaaaaactacagtacctcgccgctcagaataagggccttcagacgcagctgtcagaatctagaaggaaacaggcagaggcagagtgcaaaagcaaggaagaagttatggccgtgaggctgagggaggccgacagcatggcagccgttgcggaaatgcgccagcgcattgccgaactggaaatccaacgcgaagagggtaggatccagggccaactgaatcatagtgattcttcacagtacatccgggagttgaaggatcagattgaggaactcaaggctgaggtgcgccttctgaaaggaccacccccgttcgaggaccccctggcttttgatggcctttctctggccagacatctggacgaggatagcctgccaagctcagatgaagagcttctgggtgtgggcgtgggggctgccctgcaggatgctctatatccactttctccgagggatgcccggttcttccgaagactagaacggccggcaaaagattccgaaggtagctctgattctgacgcagacgaactagctgccccttacagccagggcttggacaactag

SEQ ID NO: 46926 - DNA, 7740 bp, Artificial Sequence
  Description of Artificial Sequence: Synthetic coding sequence
atggccgaggccgtgaagccccagcggcgggccaaggccaaggccagccgcaccaagaccaaggaaaagaaaaaatacgaaacgccccagcgggaggagtcctccgaagtgtctctgcctaagactagtcgggagcaggaaatcccttctttagcatgtgagttcaaaggagatcatcttaaggtcgtgaccgactcccagctgcaggatgatgcatccggccagaatgaaagtgagatgtttgatgtgccccttacgtctctgacaattagcaacgaggagtccttaacatgcaatactgagccaccaaaagagggaggtgaggcccgtccatgcgtgggggactctgcagtgactcccaaagtgcatccaggagacaatgtgggcacaaaggtggagaccccaaagaactttaccgaggtcgaagaaaacatgtccgtgcagggcgggttgagtgaatcagccccacagtccaacttctcttatacccagcctgccatggagaatatccaggtccgtgagacacagaacagcaaagaggacaaacagggtttagtctgtagttctgaggttccacaaaatgtcggcctgcagagctcttgtccagcgaagcacggctttcaaacacccagggtgaagaagctgtaccctcagctgccggctgaaatcgctggagaagctcctgcgcttgtggctgtcaagccacttctgaggtccgagaggctctacccggagctgccttcgcagctagagttggttccttttacgaaggagcagctgaagattttggaaccaggtagttggctggaaaatgtggaaagttatcttgaagagtttgactccatggcacaccaggatcgacacgaattttatgagctactactcaattatagcagatgcagaaaacagctcttgctggccgaggccgagttacttactttaacatccgattgccagaatgccaagtcaagactgtggcagttcaaagaggagcagatgtctgttcaagggatttgcgctgatcaggtgaaagtcttcagctatcatagataccagcgtgtggagatgaatgagaacgccttggtggagctcaagaagcttttcgatgccaaatccgaacatctccatcagaccctcgctctccactcatatacaagtgtcctctcacgtttgcaggtagagagctacatatacgccctgctgtcctcaagcgcggtgctgaggagttccgcaatccatcagcaaggtcgagcctccaaacagacggagagtatcccatcagacctgtgccagcttaaggaatgtatttccgtcctgttcatgtttactaggcgcgtaaatgaagacacgcaatttcacgacgatattttactctggctgcagaagctggtgtccgtcctgcagcgggtgggatgcccaggggaccacctgttcctgcttaaccacatactgcgctgtccagcaggcgttagcaagtgggccgtgccatttattcaaatcaaggtattgcataatcccagtggagtctttcacttcatgcaaagcttggctctgctcatgtcgcctgtcaagaacagagccgaatttatgtgccacatgaagccatccgaaagaaagccaagtagtagcggcccaggatcaggcacatggacactagtagatgagggaggggaagaggacgaagacccagaaactagctggatcctgttgaacgaagatgacctcgtcactatcctagcgcagtttcccttccacgagttgtttcagcacctcctgggtttcaaggcaaagggcgattacttacctgagacgacaaggccgcaggaaatgatgaagatctttgccttcgccaacagtctggtagagctcctggcggtgggactggagacgtttaaccgagcacgatatcgccagttcgtgaaacgcattggctacatgatccgcatgacactggggtatgtctctgaccactgggcccagtatgtctcccacaatcaaggctccggcctcgcacaacagccatacagcatggaaaagctccaggtcgagttcgacgagctgttcttgcgggcagttctccacgtactgaaggcaaaacgcctgggcatttggttgtttatgtccgaaatgcccttcgggaccttgtctgtgcagatgttatggaagctgttctatctcatgcaccaggtcgagtctgagaacttgcagcagctcagtagtagtctgcagcccgcacagtgtaagcagcagctgcaggacccggaacactttactaacttcgaaaagtgcttgagttcaatgaactcctcagaagaaatttgtctccttacaacgttcgctcagatggcccaggcccgccggacaaatgttgacgaagacttcataaagattatcgttttagagatctacgaagtttcctacgtaacgctcagtacaagggagacattctccaaggtggggagagaactactgggaaccataactgcggtgcatcctgagatcatctccgttcttttggatcgcgtgcaagagactatcgatcaggtgggtatggtgtccctgtatctgtttaaggagctgcctttgtacctttggcaaccgtcagccagtgagatcgccgtgattcgggattggctccttaattacaacttgacagtggttaaaaataaactcgcatgtgtgatcttggagggcctcaattggggcttcgctaaacaagccaccttgcatttggatcaggccgtgcacgccgaggttgccctgatggttcttgaggcctaccaaaaatacttggcacaaaagccgtatgccggaatcctgagcgaatcaatgaagcaagtgtcatacctggctagcattgtacggtatggggaaacaccagagaccagcttcaaccaatgggcctggaacctgatcctgcgcctaaagctacataaaaacgattatggtattcaaccaaattgcccagccgtgcctttttcggtcacagtgccagacatgaccgaatctcccacattccacccactgttgaaggctgtgaaggctggaatgcccattggctgctacttggccctctctatgacagcagtgggccatagcatagagaagttctgcgctgaggggatacccctgctaggcatccttgtacagtcccgccatttacgcactgtggttcacgttctagataaaattctgccactgttttatccttgccagtattacctgttgaaaaacgagcaattccttagccacctcctgctgtttttacatctcgattctggcgtgccacagggagtaacacagcaggtcacgcataaggttgcccagcacctgacgggtgctagccacggtgacaacgtaaagttgctgaattcaatgatccaggcacacatcagcgtctcgacccagcctaatgaagtggggcccgtggctgttttagagttctgggtgcaggcacttataagccaacatctgtggtatcgggagcaacctattcttttccttatggatcacttgtgcaaagccgcgtttcagctgatgcaagaagattgcatccagaagctgttatatcagcagcataagaacgctcttggataccactgtgaccgatctcttctgtcctctttggtgtcttggatagttgctggtaacatcactccatcttttgtggagggccttgccactccaacccaggtatggttcgcatggaccgttctgaatatggagagtatttttgaggaagatagccagctgagacgcgtgatagaaggcgaactagttattaactccgcctttactccagatcaggccctcaaaaaggctcagacccagcttaaattgcccatcgtgcccagcctgcagcgcctactcatttacagatgggcccaccaggccttggtgactccttctgaccacccgttacttccactgatctggcaaaaattctttctcctgtatctccacaggcctggaccccagtatggtctgccaatagatggttgcatcggacgaaggttcttccaatccccagcgcatatcaacttgttgaaagagatgaagagacgccttactgaagttgcggacttccaccatgctgcaagcaaagcccttcgcgtccctgccgagggctccgagggacttccagagtctcattccggcaccccagggtatctcaccagtcctgagctgcataaggagttggttcgactttttaatgtatacattctttggctggaagacgaaaacttccaaaaaggggacacctacatcccgagcctgccaaagcactatgatatccaccgtctagcgaaggtgatgcagaatcagcaggacttatggatggaatatctgaatatggaaaggatttaccacgaatttcaggaaacggtaggcctgtggactcaggctaagctcgagtctcatagtacgccttgttctctgtctgtgcagcttgatttcacagatcccctgctggcaaaggagagagtgttgtccaacttgcgcaaacatgaagcaccacaaccaccgcttgcccttcatcctaccaagcctcctgtccccgtcatcagctcagcagtgctcttgtctcagaaagatgcgacccagttggtgtgcacggatctgaacttgctgcagcagcaggctcgtaccgcagcgttgcgggagtcacagcaggtggcactggatggcgagcttttggacacaatgcctaagcagtatgtcaaccgcgaggagcagactactctgcatttagagtgccgtggatcgtccgggaaaaaatgccaaggggcagcagttgtgactgtgcagtttgagggcatgcataaaaatgaagccatctcacagcaactccatgtcctgcgtaaagaagttaagcagctgcaggctgaagctgccaaaccgccatctctgaacatagtcgaggccgccgttcacgccgagaatctcatcactgcactggtcaatgcctataagttgcagcccactccggggatacagaaggttggcatatctcttttttttactattgttgattatgtctccgacgagacacagcgccaccccccgacgcggcagttttttacttcctgcatagaaatcctgggccaggtcttcatcagtgggatcaaatccgagtgtcgtaaggtgctggaaactatactcaagaactcaagattgtgctcccttctctcacctttttttactccgaacgctgcccccgccgagttcatccagctgtacgagcaggtggttaagtttttgtcggaagacaatagcgatatgatcttcatgctactcacgaagttcgatctaaaacagtggctgtctgccactaaaccgcccctgtcagaccggactcggttgcttgagtcgatccacctggctttgacagcgtggggtcttgaaccagatgaagacatcctaatgccattcaacctgttttgtaagcactggacctacctgctcttataccagttcccggatcagtactcggacatcctccggctccttatgcagtcctcagccgagcagctgctctcacctgagtgctggaaggcaactctgagagccctcggatgctgcgctccgagttgccaacagggagcagcatcgactgagggtgccgttttgccctctagtagcgatgctcttttgtccgataaacaggtgatggagactatacagtggctgagcgactttttttacaagctgcgtttgtctaaaatggattttaagtcttttgggttgttttcgaagtggagtccctatatggcggatgtcaagacatttctcggatacttagtgaagagacttatcgacctggagatgacctgtctcgctcaggatcctaccgctagcaggaagaccgtcctcaaatccctgcattccgtgatcatacagctttttaaaccctggattctggttctcgaggacaatgagtcttcccagcagaggcactatccgtggctggaatctgacacagtagtggcctcaagcatcgttcaactgttcacggactgtattgacagtctgcacgaatcgttcaaggataagctgcttcccggggacgctggagcactgtggctccacctcatgcactactgtgaggcctgcaccgcccctaaaatgcccgagttcattttatatgcctttcactcaacctatcgtaagctgccttggaaggatttgcatcccgaccagatgcttatggaagcattctttaaggtggagaggggcagtcctaagtcatgtttcctgttccttggaagtgtgctgtgcgaagtgaactgggtgtccgtgctgtctgatgcatggaactcttcgccccatccagaaacgcgctccatgatagtgtgtcttcttttcatgatgattctactggctaaagaagtgcaacttgtggaccagacggactcaccgttactctcactgttagggcagacatcctcgcttagctggcatctcgtggatatcgtttcatatcagagtgtcctcagctatttttcctcccactacccccctagcattatcctcgccaaggagtcgtacgcggagctcatcatgaagctcttgaaggtgtctgccggattgtcgatacccacggacagccagaaacacctagacgcagtgccaaaatgtcaagcctttacacaccagatggtgcagtttttgtccactttagagcagaacgggaagattacccttgccgtattggagcaagagatgagcaagctcctcgatgacataatcgtctttaatccaccagatatggacagtcaaacgaggcacatggccctgagcagcctgtttatggaggtcctcatgatgatgaacaatgctaccattccaacagccgagttcctaaggggcagcatccgcacgtggatcggtcagaagatgcacgggctggtcgtgctgccacttcttactgccgcctgccagtcactcgcctcagtgaggcacatggctgaaactactgaggcctgcattacagcttactttaaggaatctccactgaatcagaacagcggctggggtcctatcctggtctcgctgcaggtgccagagctgacaatggaggaatttttgcaggaatgcctgaccctcggaagttacctcacgttgtatgtgtacctgctccagtgcctgaactccgagcagactctacgcaacgaaatgaaggtcctgctgattctaagtaagtggctggagcaggtatatcctagttccgtcgaggaagaggcaaaactcttcctctggtggcaccaggttctgcagctgagtttaatccaaacagaacaaaacgactcagttctgactgaatccgtgattcggatcttactcctcgtccagtcccgtcagaacctcgtggccgaggaacggctgtcaagcggtatactgggagcaatcggctttggtagaaagagcccgctgtctaaccgcttcagggtggttgctcggagtatggcagccttcctgagcgtacaagttcccatggaggaccagattcgtttgagaccagggagcgaattgcacctcactcctaaagcccagcaggctttgaatgccctggagagcatggcttcttcgaagcagtatgtggaataccaagaccagatcctgcaggcgacgcagtttatcagacatcctggccattgcctccaggatggtaagtcattcctcgccctgctggtgaattgcttgtatcctgaggtgcattatctagatcatatccggtag

SEQ ID NO: 46927 - DNA, 4071 bp, Artificial Sequence
  Description of Artificial Sequence: Synthetic coding sequence
atgatccaggcccacatcagcgtgagcacccagcccaacgaggtggggcctgtagcagtgttggagttttgggtccaggccttgattagccagcatctctggtaccgcgagcagcccattctctttctgatggatcatttgtgtaaagcggccttccagctaatgcaggaggactgcatacagaaattgctttatcagcagcataagaacgcactgggataccactgcgatcggtctctcctgtcgtcgctggtgtcctggatcgtcgccggaaacataacccctagtttcgtggaaggattagcaaccccaacacaagtgtggttcgcttggactgtgctcaacatggaaagtatatttgaggaggattctcagcttcggagagtcattgagggagaactcgtgatcaattcagccttcacccctgatcaggccctcaagaaggcgcagacccagttgaaattgccgattgtgcccagcctgcaacggctgctaatatacagatgggctcaccaggcccttgtgactccatccgaccaccccctgctgcctctgatatggcaaaagtttttccttctgtatctccatcggccagggccccaatatggcttgcccattgacgggtgcatcgggcgacggttctttcaatcaccagcacacataaatttactgaaagaaatgaagcgtagattaacagaggtcgcagactttcatcacgccgcgtccaaggcgttacgagtgccagctgagggaagcgagggtcttcctgaatctcatagcggcacacccggctacctgacctctcctgaacttcacaaagagcttgtacggctgttcaacgtatacatcctgtggctggaggacgaaaattttcagaaaggggatacttacattccctcgcttccaaaacattatgacatacaccggctggctaaggtaatgcagaatcagcaggacttgtggatggagtatctcaatatggaaaggatctatcatgagttccaggagactgtgggtctctggacgcaggccaaactggaatctcactcaaccccttgttctctgtcagtgcagctcgattttactgacccactcttagcgaaagaacgagtcttaagtaacctgagaaaacacgaggccccacagcccccccttgcactacatccaaccaaacctcccgtccccgtaatatcaagcgcggtgctactgagccagaaggacgccactcaactggtgtgtaccgacctgaatctgctacaacagcaggccagaactgcagctctgcgagaatcccagcaggttgccttggacggggaattactcgacacaatgccaaagcagtacgtgaaccgcgaagaacagaccacattgcacctggaatgtcgagggtcttccgggaaaaagtgtcaaggcgccgctgtcgttaccgtgcagtttgaaggaatgcataaaaatgaggccatcagccagcagctccacgtattgcgcaaagaagtcaaacaattacaggccgaggccgcgaagccgccctcattaaacatcgtggaagctgcagttcacgcagagaacctcataacggctctcgtgaatgcgtataaactccagcctacgcctgggatccaaaaagttgggataagcttgttctttaccatagttgattacgtatccgatgaaacacaacggcatccacctaccagacagttttttactagctgcattgagatcctgggccaggtgttcatttccgggataaaatctgagtgtcggaaggtgctcgaaacaatcctgaagaatagccgcctgtgctctctcttaagtcctttttttacacccaacgccgcacccgctgaatttatccagttgtacgaacaggtggtgaaatttctgtccgaggacaactcggacatgatcttcatgctcctgactaagttcgacttaaagcagtggctgtctgcaacaaagccccccctcagcgacagaacaaggctgctggaaagcatacatttggcccttaccgcttggggactggaacccgacgaagacatccttatgcctttcaacctattctgcaagcattggacctatctacttctttaccagttccctgaccagtattccgacattctgagattactaatgcagagctctgccgaacagcttttaagtcccgaatgttggaaggccaccctgcgggcactagggtgctgcgcccctagctgccagcaaggggctgcctccaccgagggggctgtgctgccctcctcttccgatgctttgctgtcagacaagcaagtgatggagactattcaatggctctctgacttcttttataagttacggctgtccaagatggatttcaagagtttcgggttgttcagtaaatggtctccgtatatggcggatgtcaaaacgtttcttggttacttagtgaaaagactgatcgatctggaaatgacgtgtcttgcccaggatcctacggccagccgcaaaactgttctgaagtccctccatagtgtaatcattcagctattcaagccgtggatccttgtgctggaggacaacgagagctcccaacagcgtcactacccttggttggagtcagatacagtggtcgcctctagcatcgtacagttgttcacagactgcatcgatagtctgcacgaaagtttcaaggacaaactgcttcctggtgacgcgggcgccctgtggctgcatctaatgcactactgtgaggcatgcacagctcccaagatgcctgagttcattctgtatgctttccactcaacatatcgaaaattaccctggaaggatctccatcctgatcagatgctgatggaagcgtttttcaaggtggagcgagggagtcctaagtcatgctttctctttctgggttccgtgctctgtgaagtgaactgggtttctgtgctgagcgatgcctggaacagctccccacatcccgagacaaggagcatgatcgtatgcctacttttcatgatgattctgctggccaaagaggttcagttggtcgatcagaccgactcacccttgctcagtctcctgggacaaacaagttccttatcatggcatctggtggacatagtttcttatcaatccgtgctgagttacttttctagccactaccctccaagtattattctggcgaaggagtcttacgcagagctgattatgaagctgctgaaggtgtccgctggcctttctatcccaacggacagccagaaacacctggatgctgtgcctaaatgtcaggccttcacacatcagatggtccagttcctgtctaccctggaacagaatggaaagatcactctagccgtccttgaacaagagatgagtaagttgcttgatgacatcatcgtgttcaacccgcccgatatggactcacagacaaggcatatggctttgagtagcctcttcatggaggtcctaatgatgatgaacaatgctacaattcccacggctgaatttctgcgcggctccatccgaacctggatcggacagaagatgcacggactggtggtgctgccccttttgacggccgcttgccagagtctagcatccgtccgccacatggccgaaactaccgaagcttgtataactgcctactttaaagaaagcccactcaatcagaatagcggttggggcccaatcttggtgtccctgcaggttcccgaactgacaatggaggaattcctgcaggagtgcctgactcttggctcctacctgacattatatgtgtacctgttgcagtgcctgaactcagagcagaccttacggaacgagatgaaagttctgctgatcttgagcaaatggctggagcaggtctatccttcttctgtcgaggaggaagccaagctattcctgtggtggcatcaggtcctccagctcagcctgattcagactgaacagaatgattcggtattaacggaatccgtcatccgcatccttctgctggtgcagtcaaggcagaatcttgtggctgaagagcggctgtccagtggcattctgggggcgatcggttttggaagaaagtccccactgtccaataggtag

SEQ ID NO: 46928 - DNA, 1524 bp, Artificial Sequence
  Description of Artificial Sequence: Synthetic coding sequence
accacccccgtggagcggggcagccccaagagctgcttcctgttcctggggtccgtgctgtgcgaggtaaactgggtctctgtcttgagcgatgcttggaactctagcccccacccggagaccaggtccatgatagtctgcttgctctttatgatgatcttgctggcgaaggaggtccaactagtggaccaaaccgactctccactgttgtcgctactgggccagactagcagcctgtcatggcatttggtcgacattgtaagctatcaatcagtattgagctactttagctcccactatccgccctccatcatcctcgccaaggagtcatacgcagagctcatcatgaaactgctgaaagtgtctgccggtctctcgatccccacagacagtcagaagcacctggatgcagtcccgaaatgtcaggcattcacgcaccaaatggtccagttcctgtccactcttgaacagaatggcaaaataactctggcagttctggaacaagagatgagcaaactattggacgatataatcgttttcaatcctcccgacatggactctcagacgagacatatggccctctcaagcctgttcatggaagtcctgatgatgatgaacaacgcaaccattccaacggctgagttcctcaggggcagtatcagaacctggatcggccagaagatgcacgggctcgtcgttctgcctctcttgacggctgcgtgtcaaagcctcgcctctgttagacacatggcagagactacagaggcctgtattaccgcatattttaaagaaagccctttgaaccaaaacagtggctgggggcctattctcgtgagtttgcaggttcctgagctaacgatggaggagttcctgcaggaatgcctcaccctgggctcatatctgaccttgtatgtgtaccttttgcaatgtctgaactccgagcagactctgcgaaacgaaatgaaggtgttgctaatcttgtccaaatggttggaacaggtttatccctcctcagtggaagaagaggctaagctgtttctgtggtggcatcaggttctgcagctgtccctcatccaaaccgagcaaaatgattctgtgctgaccgaaagtgtgataagaatactcctcctggtccaaagcagacagaacctcgtcgccgaagagcgcctctcgtccggcatactcggcgccatcggctttgggaggaagtctcctttatccaaccggtttcgggtcgtcgctcgtagcatggctgctttcctgagcgtgcaggtgccaatggaggatcagatcaggctccgtccgggcagcgaactgcacctcacccctaaagcacagcaggccctgaacgctctagagtctatggcaagcagcaagcagtacgttgaatatcaggaccagatcctgcaagcaacccagttcattaggcacccaggacattgcctgcaagacggaaaatcattcctcgcactcctcgtaaactgcctttaccctgaggtacactatctcgatcacatcaggtag

SEQ ID NO: 46929 - DNA, 636 bp, Artificial Sequence
  Description of Artificial Sequence: Synthetic coding sequence
atgaaccggaagaagctgcagaagctgaccgacaccctgaccaagaactgcaaacacttcaacaaatttgaggtgaactgcttaatcaagcttttctacgatctggtgggcggcgtggagcgccagggactcgtggttgggctcgaccggaatgcgtttaggaacatcctgcatgtgactttcgggatgacggatgatatgattatggacagggttttcaggggattcgacaaagataacgacggttgcgtaaatgtattggagtggatccatggactctctcttttcttacgagggtctcttgaggagaagatgaaatattgcttcgaagtctttgatctgaacggagacgggtttataagcaaggaggaaatgttccacatgctcaaaaattcactgctcaagcaaccctcagaagaggaccccgacgagggcataaaagatctcgtcgaaataacattaaaaaagatggatcacgaccacgacggcaagctctcctttgccgattacgagcttgctgtgagagaagagaccctgttattggaagccttcgggccttgcctacccgaccctaagtcccagatggagttcgaggcacaggtgttcaaagaccccaacgaatttaacgatatgtag

SEQ ID NO: 46930 - DNA, 480 bp, Artificial Sequence
  Description of Artificial Sequence: Synthetic coding sequence
atgaaccggaagaagctgcagaagctgaccgacaccctgaccaagaattgcaaacacttgtttaggggattcgataaggacaatgacggatgcgtgaacgtgcttgagtggatacacgggctcagtttgttcttgagggggtcccttgaagaaaaaatgaagtactgttttgaagttttcgacctgaacggtgacggctttatcagcaaagaggaaatgttccacatgttaaagaatagcctcttaaaacagccatctgaggaggacccagatgaaggcatcaaagacctggtggaaataaccctgaagaaaatggatcatgaccacgatggaaaactgtccttcgcagattacgagctcgccgtgcgtgaggaaacgctccttctggaggccttcggcccctgtctcccggaccctaagtcgcagatggaatttgaggcccaggtctttaaagacccgaacgagtttaacgatatgtag

SEQ ID NO: 46931 - DNA, 636 bp, Artificial Sequence
  Description of Artificial Sequence: Synthetic coding sequence
atgaaccggaagaagctgcagaagctgaccgacaccctgaccaagaattgcaaacacttcaacaagtttgaggtcaactgcttgatcaagttattctacgatctcgtcggtggcgttgagcggcagggactggtggtgggtcttgacaggaatgcctttaggaacattctgcacgtgactttcgggatgaccgatgatatgatcatggacagggtctttaggggttttgacaaagacaacgacggatgtgtgaacgtgctggagtggatacacggcttgagcctattcctgcgcggcagtctcgaagaaaagatgaaatattgcttcgaagtgtttgacttgaacggcgacggatttatatcaaaggaggagatgtttcatatgttaaaaaacagtctgctgaagcagccaagtgaagaggatcccgacgaaggtataaaggatctcgtggagattacattaaagaagatggatcatgaccacgacgggaaactaagttttgccgattacgaactggccgtccgcgaggaaacccttctcctggaggctttcgggccttgtctgcccgacccgaaaagccagatggagttcgaggcccaggtcttcaaggatcctaacgaattcaatgacatgtag

SEQ ID NO: 46932 - DNA, 390 bp, Artificial Sequence
  Description of Artificial Sequence: Synthetic coding sequence
tgagtgaacgtgctggagtggatccacggcctgagcctgttcctgagaggttctttagaggaaaagatgaagtattgctttgaggtgttcgatcttaacggcgacggcttcatttcaaaggaggagatgtttcacatgttgaagaacagcctcctcaagcagccctcagaagaggatccagacgaaggcatcaaagacctcgtggagatcacgctaaagaagatggaccacgatcacgacggcaaattgtcattcgctgattacgaacttgcagtcagagaggaaacccttttgctggaggcctttggcccatgtctaccagatcccaagagtcagatggagtttgaggcacaggtgtttaaagaccctaacgaattcaatgacatgtag

SEQ ID NO: 46933 - DNA, 480 bp, Artificial Sequence
  Description of Artificial Sequence: Synthetic coding sequence
atgaaccggaagaagctgcagaagctgaccgacaccctgaccaagaattgtaaacatctgtttcgtggattcgacaaagataacgatggctgcgtgaatgtgctcgagtggatccatggcctttcactgtttctgcgcggcagcttggaagaaaagatgaagtattgttttgaggtgttcgacctgaatggtgacggatttatttccaaggaggagatgttccacatgctgaagaattctctcctaaagcaaccatctgaagaggaccccgacgagggtatcaaagatctggttgagataaccttaaagaaaatggatcatgatcatgatggaaagctgtcctttgctgattacgagttggctgtgcgtgaagaaaccctccttctcgaagcatttgggccttgcttgcctgacccaaagtcccaaatggagtttgaggcccaagtgttcaaggatcccaatgagttcaacgacatgtag

SEQ ID NO: 46934 - DNA, 384 bp, Artificial Sequence
  Description of Artificial Sequence: Synthetic coding sequence
atggagaccagcagccgggagctgcaggccgccgagtacctggagaaacatcagatcaaggaagtggtctcttaccttacttcggctctcctgttcttccgacccgagaagccaaaggaatacttgatctccctgctggagcggctgcgaatagccaaggtcaccggggtcgcattccccttcttcatggacaattccaacattgttgcaatgtttgaaatgatggacagttcaggacgaggaacaatcagttttgtgcagtacaaggaggcacttaagactttgggtctgtgcaccgaggacgaggatctgcaggacgatggacataagattacattggacaagtttaaagaagaagtgaataaacggatgaaggaaatttag

SEQ ID NO: 46935 - DNA, 450 bp, Artificial Sequence
  Description of Artificial Sequence: Synthetic coding sequence
atgagcagcatcaaccccaacaccagcggcatcctgctggagggcttcttgaacatcgtgagaaaaaagaaggaagctcaaagatatcggaacgaagtcaggcacatattcactgcctttgacacttattaccgcggctttcttacccttgaagattttaaaaaggcattcagacaggtggcccctaagttacccgagcggaccgtccttgaggttttccgcggcctgcggatcttctcaaagtgcctgctatgccacatcgaccagaaatcgaagaaccctagtagtggactcctggctgctgactccattatacaggcacacccgtcccccgtgcaaatcttacgacagatgtacatcaacaacgagctggaagggcggggcttcatttgggattcttcaatctcttggaggtttatgtggaatatttacggtactggcgagtactag

SEQ ID NO: 46936 - DNA, 492 bp, Artificial Sequence
  Description of Artificial Sequence: Synthetic coding sequence
atgttcttcagcgaggcccgggcccggagccggacctgggaggccagcccaagcgaacaccggaagtgggtcgaggtatttaaggcgtgtgatgaagaccacaagggctatctgagcagagaagattttaaaaccgctgtggtcatgctgttcggttataagccctccaagatcgaagtagacagtgtcatgagctctatcaatccaaatactagcggcatacttctggaaggttttctaaacatagtgagaaagaaaaaggaggcgcagcgctatagaaacgaggtcaggcacatctttacagcttttgacacctactaccgtggatttctgaccctcgaggacttcaagaaagctttcaggcaggtggctccaaagctacccgagaggactgtgctcgaagtgtttagggaggtggaccgggacagtgacggtcacgtaagctttcgcgacttcgagtacgccttgaactacggccagaaagaagcttag

SEQ ID NO: 46937 - DNA, 420 bp, Artificial Sequence
  Description of Artificial Sequence: Synthetic coding sequence
atggtgttcaaggcctgcgacgaggaccacaagggctacctgagccgggaggatttcaaaacggccgtggtcatgctgttcggttataagccatccaagattgaagtggactccgtgatgagcagcatcaatccaaatacgtctggtatactgctcgagggttttttgaatatcgtgaggaaaaagaaagaggcacaacgttaccgaaatgaggtgcgacatatctttactgcattcgatacgtattatagagggttcctgaccttggaggactttaagaaggcctttagacaggttgcgccaaaactgccagaacggactgtcctggaggtatttcgggaagtggatagggactcggatgggcatgtcagcttccgtgacttcgaatacgcactcaattatggccagaaggaggcttag

SEQ ID NO: 46938 - DNA, 357 bp, Artificial Sequence
  Description of Artificial Sequence: Synthetic coding sequence
atggtgttcaaggcctgcgacgaggaccacaagggctacctgagcagggaagactttaagaccgctgttgtcatgctcttcgggtataaaccgagtaaaattgaggttgacagcgtcatgagttctatcaaccccaacacctcgggaattctcctggagggtttcctcaacatagtccgaaaaaagaaagaggcccaacggtacagaaacgaggtgcgtcacatattcactgcatttgacacctactatagagggtttcttacattagaagactttaagaaagccttccggcaagtcgccccaaaactccccgagcgaacagtcctcgaggtttttcgcggcatttttagcgcctag

SEQ ID NO: 46939 - DNA, 2355 bp, Artificial Sequence
  Description of Artificial Sequence: Synthetic coding sequence
atggagaccaaggtgcacctgttctgccaggccgaggagaacatcgacttactcgacgatggctctaacagctttgctactgatctgagtagtggcacaatcaaccacaagaaatatatcaaattttcaaaaacaatagaaaaagagatcagccctgagatccgatctctgtcgcctgaatacaagaaaatcttcgaaacatcaatcatcttttgtggagaagaaaaatcgtcagatttttcaggcgaaaagaaggtcgggcgcaaatcactgcaagttcaacaacatagcaaacggacagaaatcattcccccttttctgaagctgtccaaggagaaggttacaaggaaggaaaattccttatgcaaactccccaatcagtatagcgtccacaaaacaagctcaccattgtgtacttcctcagccatcacccgcgaaaaggagatgctttcgaacctgtatatgaccctttatgacgaggtaacccacggatatctgcatagtaaggagctttcgggcaatcacatggtggacatcggagacatcattttcacactcaacgaattgcaggagcaatatgaggacgtgtccattaccgaaggcagcccactaaacgaaattacctctgatagaaaactttcgagcgtggctggctgttacctgaaatacaaaaagaagaactccctgtcgtccaagctcccagaaccaagtattagcaagaaactgaataaaaagagtaatcaatattattcaaagatcatggagaacgatgatcttgagagtaagcgtccaaagaacacttggcagattagaaagttcctgggcggagtgggttcatctaacgtgggtgtgcaggagccctatagcaaaaacggcatcaacttcaagaaacacagcgagaaaggggagattcatgactccaagtcgaaaccccagagcctcaaatctagcacaagtctgagtaaaagcctcgacaaatccgatatctcttctatccccaaattgcagaaacctgctgtgcgcaagcactccagcctccagaagcaggttagctcgaccgagaaaacggccatctcgacactggagaacttttgtgaagcaatttcgaagctgcaggagaactacatagctgctgaagaactccagagcattctcccaagtactggaatcaacctactagatgaggagtttcagaagatcgtcactgataccagtagaaacgagaacggaatggtcgaactcgacgatttcgtcaacgccctagcaaaagaacgcagcttcccagagtgtaacgcactgcccggcgtaataaaggccattgacaagatcaaggataagaatgttgactatgaggacttgaatacttgtttgcagaattttggtatctaccttagcaagcctgaattcaaaaagataaccgagctcacagaagcaggcgaaaccaagaaggtgaacttcaaggaatttatcgacactatgatgagtaacactgagtgcttttctgagaagttagtgctcccagatgccatcgaaacactcgatgacctgcgcaaagaaacaatgagcgtgtctgatctctggaacacgctgtcatcgctaaatagcaatctgaagaaggacgaatttctggccgccctcgagttggtcaccgtcgatgagggggataaggtccagttcgaggaatttgccaaggttgtccgcaatatgcgagatgccgccaggctggaagaacttcaagaagtggttcttgcggctgacctgctggagggtgacatgattgctgggaagaaccttgaggactttctgcggaatgtgggcattaagtcccccaaggaggaggtggaaaagatcctccagagcgatttcgtgagcgaggacaatatggtgaatattaaagactgtatgcgcgccttgcgggacactcaaaaattttccaactacattgactttaggaaggaggctagcaatcttaagctcccaaaggtcaatgagatcaaagaagcagccaacatcttaagccatgtggacaatgggaagatcggaattccagacctggagcacgcactaaagtgcctgaacgttaacctgacagaggaagattttaacgaggcactcaattgctgcaacgtgtccgacaatatggaggtggatctgaaggactttctgatgaagatgaaggaatcaccccatttccagaagtccaaggcgacccagatcctcctagcaacaacccaaatcctgcagaacgatctggtagacgtgtccgatctgaaaaccctgctcatggataaagacttacatactgcaaatgcaattctcacagtgatgctgcgccacgtgcctgagcacgggtag

SEQ ID NO: 46940 - DNA, 810 bp, Artificial Sequence
  Description of Artificial Sequence: Synthetic coding sequence
atgctgggccccggccaggtgcggctgcggccccgggtgtggcgggacaaagccggggggagagtcgcggacggagcctcgggcctgccacccgccagagggagttggagagaaacagggactggacgcgctcttggcgcctccagcccaccaagacccgcccagggtagtagttcccccggcatccagtctgggccaagttcccggcccggctcacccagaggggcagaacaagcgggaactccaaggcccagattaagtttaggcataagccaggccacaggttccgcggcacgctggcggacacgcaggacaggcaaaggtttaggatataattctgacgagatcaggcctaggacccttttgattgaacatttgatggagggagggcgacgagatcatcacaccatgaccgttctgtggggcacccaggaaatcatcgtcgccgagttccacaaaaagattaaggaagcattcgaagtttttgaccatgagtctaacaatactgttgacgtccgtgagattggtactatcatcaggtcccttgggtgttgccctacggagggagagttacacgatctgatcgcagaagtggaggaagaagagcctacaggctatatccgcttcgagaaattcctcccagtgatgactgaaatattactcgaacgtaaatatagacccatccccgaggacgtgctattgcgcgctttcgaagtcttggacagcgctaaacggggattcctgaccaaagatgagttgattaaatatatgacggaagaggatggggtcagtctgagacggccaggttag

SEQ ID NO: 46941 - DNA, 489 bp, Artificial Sequence
  Description of Artificial Sequence: Synthetic coding sequence
atggccgacgagaaggaccgggaggagatcatcgtggccgagttccataaaaaaattaaggaggccttcgaagtcttcgatcacgaatccaataacaccgtggatgtgcgggagatcggtaccattatcagatccctcggctgctgtccaacagagggggagcttcacgacctaatcgctgaggtggaagaagaggaacctaccggatacatcagatttgaaaagttcctgcccgtgatgaccgagatccttctcgagcgcaaataccggcccatccccgaggatgttctcctccgcgcctttgaagtgcttgattccgctaaaagggggtttctcacaaaggacgagttgattaagtatatgacagaggaaggagaaccattctcccaggaggagatggaagagatgctgtccgctgccatagatcctgaaagcaattccatcaactacaaggactatatcacaatgatggtgatcgatgaaaattag

SEQ ID NO: 46942 - DNA, 402 bp, Artificial Sequence
  Description of Artificial Sequence: Synthetic coding sequence
atggccgacgagaaggaccgggaggagatcatcgtggccgagttccacaagaagatcaaagaggcatttgaggtgtttgaccacgaatcaaataatactgttgatgtgagggagataggcacaatcattcgctcactagggtgttgtcctaccgaaggcgagctacatgacctcatcgctgaggtggaagaggaggagccgacaggatacatccgattcgaaaaattcctgcccgtgatgactgaaatcctactggaacggaagtacagacctattcccgaagatgtgttgttgcgagctttcgaagttctcgatagcgccaagcgcgggttcctaaccaaggacgagcttatcaaatacatgacagaggaagacggcgtctccttgcgacggcccggctag

SEQ ID NO: 46943 - DNA, 1317 bp, Artificial Sequence
  Description of Artificial Sequence: Synthetic coding sequence
atggccgtgagcgagatcaagcccaagctgaagctgaaccccctgaccaaagtgcctatctcccataataagagggaccgagatttgcccggctccctccaatgtcagctgcaacataaagaaaagaagttatctgcgtcacagatggcagccttccaggatgcctataacttcttctataaggataaaacagggtgtatcgactttcatggactcatgtgcactgtggcgaagttaggtatgaatttaaccaagcatgatgtctataacgagttgaagtgcgcagacatcgaccgtgatggtaaggtgaatttttcggatttcattaaagttctgacagacaaaaacctcttcttgaaggcggtcgtccccgagaaggaaacttgtctggatttagcaggaaatccggggatactgctgtttgaaatacttagtcggttgctagagaccagcgcattacctcgaaaaagcattatcgagattgtctcttacttccaacgaaagtttcagcacactggtccagggatgctctggtctccctatacaatgggatacggtaaacgcactttgaagcctgatatctgcactcccccttccagctctatggcagccttcgctaacgcggcaaggatagccataatgaaggagaaggacctttttaagtttttggaggagcttaagagatgtaacagcgggtccgatagtccctatagcaagatccctattttccccctgtttccaaatgtggacggcgtggttatgggaaagccctttaaggacatgcagaagcttgaaatgctgcggattaaggagcctcttcactttttcgaggactatttctttcacaagcgcgattggaaaacccaggcagctaatatcaagagcatggaccccgcctcagggtattctaacaatatctttaccattgaccagatgctgaaaaagaagcagacgtgtacggtggctgatgccaccgctattaaacagcatgtcaagcgcgccacagacacttacaacttaggcatcgcactagagcaccgaaaggaaatgttgaacctctggcagaaaatcaggggggacctgatcgggatggattctcgcaacgaaagcttctatgataccttttcaacgtacacctggtcttggaacgtgtgccaagaattactgtcacccaaagacctgaggctgtacgacgcctacgtcaacagaaacagttcacacaattcaagaagctcgtcatcttcagatacatccgagtgttataccgacagcgggaggaagcggaagaggaaaggactgaaagggttccagcagtag

SEQ ID NO: 46944 - DNA, 489 bp, Artificial Sequence
  Description of Artificial Sequence: Synthetic coding sequence
atggccgtgagcgagatcaagcccaagctgaagctgaaccccctgaccaaggtccctatatcacacaacaaaagggatagagatttacccgggagtcttcagtgccagctgcaacataaagagaagaagttgtccgcatcccagatggccgcatttcaggatgcctataacttcttttacaaagataaaaccggttgcatcgattttcatggtttaatgtgcaccgtggcaaaactaggcatgaacctcacaaaacacgatgtctacaacgagctgaagtgcgccgacattgaccgggacggcaaagttaatttcagcgatttcattaaagttctcactgacaagaacctctttctgaaagccgtcgtgcctgaaaaggagacctgcctggacttagctggcaaccctgggatcctactgttcgagattcttagccggctgcttgaaacttctgctttgccgaggaagtctatcatagaaatagtttag

SEQ ID NO: 46945 - DNA, 525 bp, Artificial Sequence
  Description of Artificial Sequence: Synthetic coding sequence
atggccgtgagcgagatcaagcccaagctgaagctgaaccccctgacaaaagtacctatctcccacaataagagggacagagatctgccaggatctttgcaatgtcagctccagcacaaggaaaagaagctttccgcctcccagatggctgcctttcaggacgcctataacttcttctataaagataagaccggctgtatcgattttcacggcctaatgtgcacggtggctaagctagggatgaacctaacaaagcacgacgtgtataacgagcttaagtgcgccgacatagatcgggacggcaaagtgaatttctccgatttcatcaaagtgctcacagataaaaacctcttcctcaaggccgtggtccccgaaaaagaaacgtgcctggatctggccggcaaccctgggattctgctgtttgagatcctttctaggctgctcgaaacctctgcgctccccagaaaaagcattattgagatcgtgtcctatttccagagaaagtttcagcatactggcccatag

SEQ ID NO: 46946 - DNA, 1473 bp, Artificial Sequence
  Description of Artificial Sequence: Synthetic coding sequence
atgaaggagctgatgccccacctgaccttcaacggcaacggcaagatcaacgtgaactcaatcatggaaggactgaaaaaatttaagcctaagggaatggtgactctgcacaagttgaagactgctaacgacatcaaggatcgcgtgaccgggcatatggcggtgtccgagatcaaacctaaactgaaactgaacccgctgaccaaggtgcctatttcccacaataaacgtgatagggatctccctggatccttgcagtgccagctccagcacaaggagaaaaagctatccgcttctcaaatggctgcattccaggacgcgtacaacttcttctataaggacaaaaccggttgtatcgattttcatggcctgatgtgcaccgtggctaagctgggcatgaatctgaccaagcacgacgtttataacgaacttaaatgcgcagacatcgatagggatggcaaagttaacttttccgactttattaaagtcctgaccgacaagaacctatttctcaaggccgtcgtcccagagaaagagacgtgtctggacttggcgggaaatcctggtatcctgctgtttgagattctgtccaggcttctggaaaccagcgcgctgccccgcaagagcatcatcgagatagtttcctactttcagcgcaaattccagcatacaggcccaggaatgctgtggtcgccatatacgatggggtatggtaaacggactttgaaacctgatatctgcacccccccaagcagctctatggcggccttcgctaatgccgcccgaattgcaattatgaaggagaaggacttgttcaagttccttgaagaactgaaacgttgtaacagcggatccgactctccctacagcaagattcccattttcccgctcttcccaaacgtggacggagtggtgatgggcaagccatttaaggacatgcagaagcttgaaatgctcaggattaaggagcccttacacttcttcgaggactacttttttcataaaagggactggaagacccaggcggctaatatcaaatctatggatccagcttctggttatagtaacaacatctttaccattgaccagatgcttaagaagaagcagacgtgtacagttgccgacgccacagccatcaagcaacatgtgaaacgagcaactgacacctacaacttgggcattgcactagagcatcgcaaggagatgctaaacctctggcaaaaaatccggggcgacctgattgggatggactctcggaatgaaagcttttacgacaccttcagcacctacacatggagttggaatgtatgccaagagctcctatcccctaaggatctgagactgtatgacgcctatgtcaaccgcaactcgtcgcacaactctagaagttcctctagtagtgacacaagcgaatgctacacagattccggccggaagcgcaagcggaaaggtctcaagggcttccaacagtag

SEQ ID NO: 46947 - DNA, 4140 bp, Artificial Sequence
  Description of Artificial Sequence: Synthetic coding sequence
atgaacgagagcgccagccaggaggagctgcggcccgcccaggagaacaggaaagaggataaagagcggaagtggaatcttaccgaagtaaaggagctgcacgagaccctccagtctgtgcccgatgtccctgtaaaggaagataccaatagcgtagtcgaaaaagccatggatgaaatcaagagccaggagctgaacctggaggggcagcgcaaaatcagcccagggagtataaaggacagcaaaactgaggcctccgggaacatagcaatacgcaagtctgcaaaagttatttttgctctggatgagaccgagctgaagtcaaaaccagagcacacatggaagaagaatctgttcgagcgaatggaggccagagctcaggccatgcagcagaagatcattgacaaggaaaacctcaaaaaagagttagaaaaaaaggccgagaaaaagctgcccagagataatctggccaaggaatggttcaatacagattccatgacattgaacaacaccgcctacctcctcgataaacttttgcctaccttggtgcctggtgtggagaacatgctgacacaagttgagaagaagaaggttctcactgaagcagataccccgtctaaattcgatcctattaactatctgggggaatatcttataaggaacaatccgaactatattaaggatcccgggatgagcggctatcagcgacttatgaaggaggtgacagaggatttgaaaatatacgtgcctgataccatttgtaatagagtgagtaagatgaaagagaacgtcaaacagaatcgaaagcagcgggagagtattgataagataatcgtcaaggtggcaaatactagaaagcaggctttgcaggagcagttcgacgaatggatcctcgatccgaagggtatgatccccaagtctgtaatacaaaatgtgcttcaggaattcttccagaatccggattttaagctcgggagtcactgcaagcagctcgacatcaccgattctacagagccgaggttgaacaagatggaatttaccgagtatattagcagccatatcaaagacttgaagagcgagatgttcgaagaactgctgaagcatctgtgtcactcagccgacgagttccgcgaagtgattaaagcagatatgcggaggcaaatgttcgcagaactgttcctgcattgcgatcatggcaaagtaggttttttggataggcagagaactctggccctgctcgagctgttctacgaccactcatctcagatgctcagatccctgctgcgcaaccccagacaatggcccttcattgagttcgaagaaatcaacctgactgagctatggggcgacatggacaatcagaaacatatatatgagggctttgataaagtgctgctcgagatgaacactctattgagtgctaatcacgcctctaagacgcagtctaaactgctggagtctcccgatcaacctaagctaaatgaacagaggacgtccactccgtcacccaacccccccgaacaacagagaggggtgaccgctgaacaggggcctcaacgcatcagcatcgaggaacagcaacagggcaagaagccaaccgctgagcaggagctgtacatcgaatcagtaatcgagcccggaacccacaccgagtcaactcttgagcaagggtcctcacgcaggttgctcacggaacaggagacacatagggaaagcacgactgagcaaggacagcataagggttccatcgaggggcagggccctagaagggtttcggtgtctgaacagggctcctcacgggagtcagtggctgagcagggaagcaggcgcgagagtatagccgagcaagatcgccataaaggatctgtggccgagcagggcagtcggcggatgtccgcagccgagcaaggatccctgagggagtcagtgattgaagagccctatcaaaaatccgagcaggggccatacggtgagattatctctgaagaacaggaggacataggaagcacatcccagagccgaaaagacagcatcctgaagtcaaccaaatacggggagcctattacttcagagtacatcgaggttccgcttcaggagaaaaggtcctgggagcagacctacgaggaggagatttttttgtcatctgaactgcaggaggaggttcccactctgtcccggaaggaccacttccccgaaactacaaagaaggaggtccagaaggacaaaccttgtgaaccaaagtcccaaaagatcgagggcaagtcatggtccggggaattttttacatgcaactggaaaatgaaatacgttacgttcgaagatgaggaacaagccaacttgatttatggcaactctagattcacagctaagctacacattcagttccccaaaccccatccaggacacgaggtcaggctgagcagtaaacagttccaaaactatatcgaactcgtggtgtccgaactccgaggcaatgaggaccaggtcctggaaagcgtggtggagttccttatgaatgctctcgagcgaagccacatcgaaagcttgaggaacagcgcccggagaaaatggctccaccagatccaatgtgcagccgagactagcggtgtgtctctggaacccgtgtattccgagactttcaaagccctgatgcaggatgctgaggctcacggaaacaagaaaatcagtgcgcacatttctttgctcgaggagaatctgctgctgcctgaaaaaggtaatgtgcttctgcggaatgtggcctgcacgttggacgacgctcagtttgtgctaaacagggtcttgtatcgagacatgaagggcatcagttttaccgtggtggacgagggcaagcccatacatgtgccccaggtgcagtaccacggcaatatttttttttggaaccagagtcggaacaagcacgactacaatggcagttttcttgcgctgccactgcaggatgcgtatatgcgcatttttggtgtcctggcggttgataccctcagagatccccatgaaataaatatcttccttccacacgagattagattctaccaaggggtcgctaacgtcttctctactgcttatcattatgtgcacagtcgtgaacatattttgcatattgtgattacaggcatcgggtggctgtacgatgttacatcaagcatcaccagcatcacaacttatttcgtcgagcccagcccagcgcaggattcagactatgtgctgagaaacatgatggtaactggccaactaggattaaccgagatccacaagaatccacctacaattcataggaagtcttgtatttttcgggatttcttatttaaatgcacagactcctcagaagtggtgctcgcaagcgcctgcggcgagactcatatcgtagtacccctacgggagagaaccggcgaggccctcggggtgttggacttcaatattggacagaatagaatgctgttatgccaagagtacaaggaccttcaaaaaatgatgaaggtggtgcaggtcgcttgctacgaaatcctcggcgaattttcgggagaaatcaagaaaaagtatattttggagatcgaaaacgtgagggaagtccagcgagctggcatcctgttctttagaatcatgctgctggaactgcaagagtccatacagctgctgaattctatggagtttgtctccctgctcctgtatgaccacaccctggtcactgagcctaattctccccaggatagtaagtctatggagctggaggccaacgtgaagctggtaagagatattttgaaagcagtcatactgttcttccatccggaattagaattttcctcagattttggctcttgggacaagtgtaagttctatgttaacaagtatcttgtgaataatatctgcgctttcgaccctacagcaaagcacgtcgaggtgaatgtccaactgatcgacgagtacatccgcgaccatagccggactgaagtgtggaagtttggcaacgtggtgatcgaacatctgtaccattggattcacatctgttccgctctcatgaaaatcacaaaacagcttaactctggaattactcctcctctgccatctaaaaccgataactacatgtacgccaaaatgcctggcgagggtcttcaggagaaatag

SEQ ID NO: 46948 - DNA, 2781 bp, Artificial Sequence
  Description of Artificial Sequence: Synthetic coding sequence
atgaacgagagcgccagccaggaggagctgcggcccgcccaggagaacaggaaggaggacaaggaacgaaaatggaatctaaccgaggtgaaggagctgcatgaaacactccagagcgtgcctgatgtgcctgtgaaggaggatactaactcagtggtggagaaagcaatggacgagattaaatcacaggaactgaatctggagggacagcgcaagatatctcctgggtcgatcaaggacagtaagaccgaggcttcaggcaatattgctataagaaagagcgcgaaagttatcttcgcattagatgagaccgaactgaagtcaaaacctgaacacacttggaagaagaacctcttcgaacgtatggaggccagagcacaggccatgcagcagaaaattattgataaggagaatcttaagaaagaactggagaaaaaggccgaaaagaagctaccccgcgataatctggccaaggagtggttcaacactgacagcatgacactgaacaataccgcttacttattagacaaattgttgcctaccctggttcccggagttgagaatatgctaacacaggtcgagaaaaaaaaggtcctgacggaggctgatactcccagcaagtttgacccaatcaattacctgggggagtacctgatccggaataatcccaattatattaaggaccccggaatgtcaggttatcaacgtctgatgaaggaagtgacagaggacctcaagatatatgtgcctgataccatctgtaaccgggtgtccaagatgaaggagaatgtgaaacaaaaccgtaagcagagagaaagcattgacaaaataatcgtaaaggttgcaaacaccagaaaacaggccctccaggaacagttcgatgagtggattcttgatcccaagggcatgatcccaaaatcagtcattcagaatgttttgcaagagttttttcaaaaccccgatttcaaactgggatctcattgcaagcagcttgacattaccgattctactgagccgagactgaacaaaatggaattcacagaatatatctcctcgcacatcaaagatttgaaaagcgagatgttcgaagaactcttaaagcacctgtgtcactccgcggacgagttccgcgaggttatcaaagccgatatgcggcgtcaaatgttcgcagagctattcttgcactgtgatcatgggaaagtcggatttctggacaggcagcgaacactcgcattattagagttgttctacgatcacagcagtcaaatgttgcgctccctcctgcgtaaccctcggcaatggccttttatcgaattcgaggagattaatctgactgaactgtggggcgatatggacaaccagaaacacatttacgaaggctttgataaagttctcctcgaaatgaacactctcctgagcgcgaatcacgcgtcgaagacacaaagcaagttactcgagtctccagatcagccaaagctcaacgagcagagaaccagtaccccatccccaaaccctcccgaacagcagagaggggtgaccgcagaacagggtccacaacggatctctatagaagagcaacagcagggcaagaaacctaccgcagagcaagaactgtacatcgaatcggtcatcgagcccggtacacacactgaaagtaccttggaacagggaagctctcgccggctgctgactgagcaggaaactcaccgggagtccaccactgaacagggccagcacaagggtagcatcgagggccagggcccccgtcgcgtctcggtctcagagcaggggagtagtcgcgagagtgtggccgaacagggttctaggagggaatctattgccgagcaggatcggcacaagggttctgttgctgagcaaggctccaggcgaatgagcgccgctgaacagggaagtcttagagaaagtgtcatcgaggagccgtatcaaaaaagcgagcagggcccttacggagagattatcagcgaagaacaggaggatatcgggtccacaagccagagcagaaaggactccatcctgaagagtacaaagtatggggagcccatcaccagtgaatatatcgaggtgccgttacaagaaaaacgatcttgggaacagacgtacgaagaggagatctttctcagcagcgagctgcaggaggaagtgcctaccctgtctcgcaaggatcatttccctgaaactacaaagaaggaggtgcaaaaggacaagccttgtgaaccaaagagccagaagatcgaaggtaagtcgtggagcggcgagttcttcacttgtaattggaagatgaagtatgtaactttcgaagatgaagagcaagcaaatctcatttacggcaacagtcggttcacagaccttcacagtatcatccggaatattcagtcatgtaaggaagtaaaaggcagaactgcctttaacggcgtctctttcaacctgctccagttcgttcagctgctggagactttcgtgggagaagatgccccactgtcagtcagcgagacactcacctcatttttcaaagagggatatgtggagacggaacaggaaaagatgaacgctcttgagcaattttcccagaacgcattccaggttaggcagaggttgctactggaagctatattccagaagtgggatagtgatggtagcggttttcttgatcttaaagaggttgacgagctgctgtacacctacaaggagggtatggagaaggagagcatgaagaagggtttgacactgagccctggctggtctgccgtggcgcagctgtag

SEQ ID NO: 46949 - DNA, 2928 bp, Artificial Sequence
  Description of Artificial Sequence: Synthetic coding sequence
atgaacgagagcgccagccaggaggagctgcggcccgcccaggagaaccgtaaggaagacaaagagcgaaaatggaacctgactgaagttaaagaactgcacgaaaccttacagagcgtcccagatgtgccagtaaaagaggacactaacagcgtagttgaaaaagctatggatgagatcaagtcgcaggaactgaacctggaaggccagcgaaaaatatcccctggatccatcaaagactccaagaccgaagctagtggtaatatcgccattagaaaaagtgcaaaggttatcttcgctctggacgaaaccgaacttaagtccaagccagagcatacctggaagaagaatttgtttgagagaatggaggccagagcccaagctatgcagcaaaaaatcatagataaggagaatctgaaaaaagaattagagaagaaagcggaaaagaagctaccaagagataacctcgctaaagagtggttcaacaccgactccatgactttgaataataccgcgtatcttctcgacaaactgctgccgacattggtgccaggcgtggagaatatgctcacccaggttgaaaaaaaaaaggtgcttaccgaggctgataccccttctaaattcgaccccatcaactacctgggggagtatcttatcagaaacaaccccaattacataaaggacccaggcatgagtggctaccagaggctaatgaaagaagtgactgaagacctcaagatctatgtgccggatacgatttgcaatagagtcagcaaaatgaaagagaatgtgaagcagaacagaaagcagagagagtcaatcgacaagattatcgtgaaagttgctaacactcggaaacaggccctgcaagaacagtttgatgaatggattctggaccccaaagggatgatccctaagagcgtaatacagaatgtgctccaagagtttttccagaatcccgattttaagctgggatctcactgtaagcaattggatataactgactccaccgagcccaggttgaacaaaatggagttcactgagtatattagctctcatattaaagatttgaaaagtgagatgttcgaggagttactgaaacacctgtgccactcagccgatgagtttcgagaggtgattaaagccgatatgcggcggcagatgttcgccgagctatttctacattgtgaccacggtaaggtcggattcctcgacaggcagaggaccttggccctcctagaattgttttacgatcattctagtcagatgctgcggagtctcctccggaatccgagacaatggccctttatcgagttcgaggaaattaatcttacagagctgtggggggatatggataaccagaagcacatatacgagggtttcgataaagtactgttagaaatgaacacactcttaagtgcaaatcacgcctccaagactcagagcaagctgctggaatcgcctgaccaacctaagctgaatgagcagcggacctcaaccccctcgcccaatccgcctgagcagcagcgcggggtgaccgcggaacaggggcctcagcgcatttcgatcgaagaacaacagcaggggaaaaaacccacagcagagcaagagctgtatattgagtctgtgattgaacctgggacccacaccgagtccacactcgagcaggggagcagtcgccggctcctaactgagcaggagacacacagagagagcactactgaacagggccaacacaagggctctatcgaaggccagggcccgaggcgggtgtcggtgtctgagcagggatccagtcgcgaatctgtggctgaacagggaagtaggagagagtctatcgccgagcaggaccgccacaagggttccgtggctgaacaggggagtcgccggatgagcgcggcagagcaaggatcccttcgcgaatcagtaattgaagagccctaccagaagagtgagcagggaccttatggagagatcatatccgaggagcaggaggacatcgggtccactagccagagcaggaaagactccatcctcaagtccactaaatatggcgaacctattacttcagaatatatcgaagttcccctacaggaaaagaggtcatgggaacagacatacgaagaggaaattttccttagctcagaactgcaggaagaggtgcccacactgtctcgcaaggaccactttccggagactactaaaaaggaagtgcagaaggataaaccatgcgagcccaagtcgcagaagatcgagggcaagtcctggagcggcgagttctttacgtgcaattggaaaatgaaatatgtgaccttcgaggacgaggaacaagctaacctgatttatgggaattccagattcaccgacctccattcaatcattcggaacatccagagctgcaaagaagtaaaaggccgcactgctttcaacggcgtctcctttaacttactccagtttgtgcagctgctggaaacatttgtgggcgaagacgcccctctgtccgtgtctgaaaccctgactagcttcttcaaagaaggttacgtagagacagagcaagagaagatgaacgccttagaacagtttagccagaacgccttccaggtacggcaaagattgttattggaggcgatattccaaaagtgggacagcgacggttctgggttcctggatctgaaggaggtggacgagctgttgtacacctacaaagaaggcatggaaaaggagagtatgaaaaaagaccactccagaactgaggtttggaagttcggcaatgtggtcatcgaacacctgtaccattggattcatatctgttccgcccttatgaaaattacgaagcagttgaattcaggcatcaccccgccactgccgtctaaaaccgacaattatatgtacgccaagatgcctggcgaggggcttcaggaaaagtag

SEQ ID NO: 46950 - DNA, 4512 bp, Artificial Sequence
  Description of Artificial Sequence: Synthetic coding sequence
atgaacgagagcgccagccaggaggagctgcggcccgcccaggagaacaggaaggaagataaagaacgtaaatggaatctgactgaggttaaagagctgcatgaaaccctacagtcagtgccagacgttcctgtgaaagaagacacaaactctgtggtcgaaaaggctatggacgagattaaaagtcaagagctcaatctggagggccagcggaagattagtccaggcagtatcaaagacagcaagaccgaagcttcggggaacatcgcgattcggaagtctgctaaggtcatttttgcccttgacgagaccgaactgaagtctaagccagagcatacctggaaaaagaacctgttcgaacgcatggaagctcgagcacaggctatgcaacagaagatcattgataaagaaaatctgaaaaaagagttggaaaagaaggccgaaaagaagttacctcgggataacctcgctaaagagtggtttaataccgattccatgaccctgaacaataccgcatacctgctcgataaattgcttcccactctcgttcccggcgtcgaaaatatgctcacccaagtcgagaaaaagaaagtgctgacagaagcggacactccttcaaagtttgaccctatcaattacctcggcgaatatcttatccggaataaccctaattatatcaaagaccctggaatgtccgggtatcaacgcctgatgaaggaagtgaccgaggatctcaaaatctacgtgcctgataccatttgcaacagggtttccaagatgaaggagaacgttaaacagaaccgcaagcagagggagtctatcgataagattattgtgaaagtggccaatacgcgcaagcaggccttgcaggaacagtttgatgagtggatactggacccaaagggtatgatcccaaaatctgttatccagaacgtgttgcaggaattcttccagaatcccgacttcaagttaggcagtcactgcaaacagctagacataacagactccacagaaccaaggctaaataagatggaatttactgaatacatttcaagtcacatcaaggatctcaaatccgagatgttcgaggagctacttaaacacctctgtcactcagccgatgagtttcgagaagtcataaaggccgacatgcgtcgtcagatgtttgccgagctatttctgcactgcgatcacggtaaggtgggctttctggaccggcagagaacgctggcgctccttgagctgttttacgatcactcatcccagatgctgcggtcgttgctcagaaacccgagacagtggccttttattgaattcgaggaaatcaacttaaccgaattgtggggagacatggacaaccagaagcatatctatgagggcttcgacaaagtgctgctggagatgaacactttacttagtgctaaccacgcatccaagacccagtcaaagctgctggagtcgccagaccaaccaaagttgaacgaacagcgaacttccaccccttctccaaatccacctgaacagcagcgtggagtgacggccgaacagggacctcagcgtatttcaattgaagagcagcagcagggcaaaaagccaaccgcggagcaggagctctatattgagtccgtgatcgagccgggaacgcacaccgagtcaacgttagagcagggatcatctcggaggctgcttacagaacaagaaactcatcgcgaatctaccacagaacagggacaacataaagggtcaatagagggccagggtcctagacgagtgagcgtgtccgagcagggatccagccgggaaagtgtggccgaacaagggtccagacgtgagagtattgctgagcaagaccggcacaaaggaagcgtcgcagaacagggatccaggagaatgagcgcggcagaacaagggtcactgagagaatcagtgattgaagagccgtaccagaagagcgagcaagggccatacggagaaatcatctccgaagagcaagaagacatcgggagtacctctcagtcacggaaagattccatcctcaagagcacgaaatatggagaacctatcacttcagagtacatagaggtcccactccaggagaagcggtcatgggagcagacatatgaggaagagattttcctgagcagtgaactccaggaagaggtgcctaccctttcacggaaggatcacttcccggagactaccaaaaaagaagttcagaaggataaaccttgtgagcccaagagtcagaaaatcgagggaaaatcttggtctggggagttttttacgtgtaactggaagatgaagtatgtcacattcgaagacgaggagcaagctaacttaatttatggtaacagcaggttcacggatttgcattctataatcagaaacatccaaagctgcaaggaggtcaaaggacgaactgcatttaacggcgtaagttttaatcttttacaattcgtccagttgctcgagacttttgtcggcgaagacgctcccctgtcagtatcagagacactcacaagcttcttcaaggagggctatgtggaaaccgaacaagagaagatgaatgcgctggagcagttttctcagaatgcattccaggtgcgccagcggctcctgctggaagctatcttccagaaatgggatagtgacgggtccggattcctggatctgaaagaagtcgacgaattgctgtacacctacaaagaaggaatggaaaaagagtcaatgaagaaagcaaagctgcatattcaattccctaaaccccacccaggacatgaggttaggctttctagtaagcagttccagaactatatcgaactggtagtgtctgaactgcggggtaacgaggaccaggtgttagagagcgtagtggagtttctgatgaacgccctggagcggagccatatcgaatctctccggaacagcgcacgccggaaatggctccaccaaatccagtgtgcagccgaaacaagtggggtaagtctggaacctgtctattccgaaactttcaaagccttgatgcaggacgctgaggctcatggaaacaagaagatttccgcacacatatctctgctggaagaaaatttactgctaccagagaagggaaatgtcctgcttcggaatgtagcttgcaccttagatgacgctcagttcgtgctgaacagggtcctgtatcgcgatatgaaggggatctctttcaccgtcgtggacgaaggaaaacccatccatgtgccccaagtgcagtatcacggaaacatctttttctggaatcaaagccggaacaaacacgactacaatgggtctttcttagcactgcccctgcaagatgcttatatgcgtatcttcggcgtgctcgcggtggatactttgcgtgatccacacgaaattaacatcttcctgccccacgagattagattctatcagggggtggctaacgtgttttcaacagcatatcactatgtgcattcacgggagcacatcttgcacattgtcataaccggaatcggttggctgtacgacgtgacaagctctatcacatccatcactacatatttcgtcgagccctctcccgctcaggattctgactacgtgcttaggaacatgatggtcacgggtcaactgggacttacagaaatccataagaatcctccaaccatccatagaaagagttgtatctttcgcgattttttgttcaagtgcacagatagttctgaagtggtcctggcgtctgcatgcggtgagacccacattgttgtccctcttagggagcggaccggtgaagcattgggggtgttggatttcaatattggccagaacagaatgcttctctgtcaggaatataaagatctgcagaaaatgatgaaagttgtgcaggtggcatgctacgagatcctgggagaatttagcggggagataaagaagaagtatatcctagagattgagaatgtacgagaggtccagcgggcaggcattcttttttttcgaataatgctgctagagctccaggagtccatccagctgttgaattcaatggagttcgtttcactcctgctctacgaccatactcttgtgacagagcctaatagccctcaggattcgaagtccatggagctggaggcgaatgtgaagcttgttcgagacatccttaaggccgtgatcttgtttttccatccagagttggagttttcatccgattttggttcctgggacaaatgcaaattttatgttaacaagtacctcgtgaataatatatgtgctttcgaccctactgcaaagcatgtcgaggtgaacgtgcagctgattgacgaatacatccgggaccatagcaggactgaggtgtggaaattcggcaatgtggtcatcgagcacctctatcactggattcacatatgctcggcccttatgaagattactaaacagctcaactccgggataactccacctttacctagtaagactgacaattacatgtacgccaaaatgccaggcgaaggtttgcaggagaagtag

SEQ ID NO: 46951 - DNA, 2571 bp, Artificial Sequence
  Description of Artificial Sequence: Synthetic coding sequence
ctgggccagatgaagtgcaaggagctgaacctggagggccagcggaagatctcccctggtagtattaaggactcaaaaaccgaagccagtggaaatattgccatccgaaagtccgctaaggtgatctttgccctagacgagactgaactcaagagcaaaccagagcatacctggaagaagaatctctttgagcgcatggaggccagggcccaagccatgcagcagaagataattgacaaggagaacctaaagaaagaattagagaaaaaggctgaaaagaagctgccccgcgacaacttggctaaagagtggtttaataccgatagcatgacattgaacaatactgcctacctgttggataaattgttgccaaccctggtccccggagtggagaacatgcttacccaggttgaaaaaaagaaagtcttgacagaggcagacaccccaagcaagtttgacccaatcaattatctgggggagtatctgattagaaacaatcctaactacattaaggaccccggaatgagcggatatcagcggctgatgaaggaagttactgaagacctgaaaatttacgtccccgacacaatctgtaacagagtatctaagatgaaagagaatgtcaagcagaacagaaaacaacgcgagagcatcgataaaatcatcgtcaaagtggcaaacacacggaagcaggccctacaggaacagttcgacgagtggatccttgaccccaagggaatgattccaaaaagtgtcatccaaaacgtgttgcaggaattcttccagaatcccgactttaaactagggtctcactgcaaacagttggacattactgatagtactgaaccacgccttaataaaatggagttcacagaatatatttcttcccacattaaggatctgaaaagcgaaatgtttgaggaactcctcaaacatctctgccacagtgcagatgaattcagggaggtcatcaaggccgatatgcggaggcaaatgttcgctgaactcttccttcactgcgaccacgggaaagttggtttcctggatagacagcgcacattggcacttttggagttgttctatgatcactcgtctcagatgctgcgctcccttttaagaaatccgcgccagtggcccttcattgagttcgaagaaatcaacttaacagagctgtggggtgatatggataatcagaagcacatttatgaaggattcgataaggtccttttagaaatgaataccttgctttctgcaaatcatgcttctaagacccagagtaagttgttggagagccctgaccagcctaagttgaacgaacagagaacatcgactccatctccaaatccgcctgagcagcagcgaggggtcacagctgagcagggcccgcagagaatctccattgaggagcagcagcagggcaagaagccaacagctgaacaggagctctatatcgagagcgtaatcgagcccggcacccatactgaaagcacactcgaacagggctcaagtcgtaggttgttgaccgaacaggagacacaccgcgaatccacgacagaacagggccagcataaaggatccatcgagggacaagggcccaggcgggtcagtgtctccgaacaggggtctagccgcgagagcgtggcagagcaaggctctcgtagggaatctattgcagaacaagatcgacataagggctcagtggcagaacagggctcaaggcggatgtcagcagcggaacagggcagtctcagggagtctgtaattgaagagccttaccaaaaatccgagcagggcccgtatggcgaaattattagcgaagagcaagaagacattggtagtacctcccaatctagaaaagacagcattctgaagagcaccaaatacggtgaaccaatcacatcagaatacatcgaggtgccccttcaggaaaaacgtagctgggaacaaacctatgaagaggaaattttcctatcttccgaattgcaggaagaggtgcccactctcagtcgtaaggatcactttcccgagaccaccaagaaagaggtccagaaggataaaccgtgtgaacccaagagccagaaaatagagggcaagagttggtctggggagttctttacgtgtaactggaagatgaagtacgtgaccttcgaagacgaggaacaagctaacctgatttacggtaacagccgtttcactgacctgcactccatcattcgcaatattcagtcctgtaaggaggtgaaaggacggaccgccttcaacggtgttagcttcaacttgcttcaatttgtgcagctgcttgaaacattcgtgggcgaggatgctccattatctgtttcggaaacactaacttcgttttttaaagaaggctacgtcgagaccgagcaggaaaagatgaatgcattggagcaagtgtccctatgtcggcaagccggagtacagtggaggaactgtagctccctgcagcctccaacgccagggttaaaacgctcctcacatcacagattgctctccaattgggactaccgagaacgtaggaagttcttccccctggagactaaattcccctag

SEQ ID NO: 46952 - DNA, 1527 bp, Artificial Sequence
  Description of Artificial Sequence: Synthetic coding sequence
atgaaggagaacgtgaagcagaaccggaagcagcgggagagcatcgataagatcatcgtgaaggtggccaatacacgtaaacaggctctgcaggagcaattcgatgaatggattctcgatcctaaaggcatgatcccaaagagtgttctccaaatacagaatgtgctgcaggaattcttccagaatccagattttaagctgggcagccattgtaaacagttagatatcacagactccacagagccacgcctgaataagatggagttcactgaatacattagctcacatatcaaagacctgaagagcgaaatgttcgaagagttgctgaagcacttatgccactctgccgatgagttcagggaggtaattaaagcagacatgaggcggcagatgttcgccgaactgtttttgcattgtgatcacggaaaagtagggttcctggatagacagcgtaccctggctctactggaactcttctacgaccactcaagccagatgctgcggtccctcctgaggaatccaagacaatggcctttcatcgagttcgaggagattaacctgacagagctgtggggagatatggataaccaaaagcatatatacgaaggattcgataaggtgctgctggaaatgaacacgttactcagcgcaaatcatgccagtaagactcagtccaaactgttggagagtcccgatcagccgaagttgaatgagcagcgtaccagtacgccctcgcccaaccctccagagcagcagcgtggagtgactgctgagcaggggcctcaacggatctccatcgaagaacagcaacaggggaagaagcctaccgctgagcaagagctgtacattgagtctgtgatcgagccaggcacacatactgaatctacacttgaacaaggcagctcccgccggcttctcacggaacaggagacccaccgggaatcaacgaccgaacaaggacagcacaagggttctattgagggccagggacccagaagagtaagtgtaagcgaacaaggtagctctagggagtctgtcgccgaacaagggagtcgtcgggaatccattgcagaacaggaccgccacaagggatcagtcgctgagcaaggctcccggagaatgtcagccgcagagcagggatcactgcgcgagtccgtgatcgaagagccgtaccaaaagtccgagcagggaccctatggcgaaatcatctctgaggagcaggaggatattggttctacatcccagtccaggaaagacagcatcctgaagagcactaaatatggggagcctatcacctctgagtacattgaggtgcctctgcaagagaagcgcagctgggagcaaacttacgaggaggaaatctttctgtcctccgaactgcaggaggaggtgcccaccttgtcacgaaaggaccattttccagagaccacgaagaaggaggtccagaaggataaaccctgtgagcctaagagccagaaaatcgaggggaagtcttggtcgggcgagttttttacctgtaattggtag

SEQ ID NO: 46953 - DNA, 2571 bp, Artificial Sequence
  Description of Artificial Sequence: Synthetic coding sequence
atggacgagatcaagagccaggagctgaacctggagggccagcggaaaatttcgcccggttccataaaggactccaagaccgaggcctcagggaatatcgctatccggaaaagtgccaaagtaattttcgccctggatgagactgaactgaagagtaagcctgaacatacttggaagaaaaacctgtttgagagaatggaggcaagggcacaggcaatgcagcagaagataatcgacaaagagaatctgaaaaaggagctcgagaagaaagccgagaaaaaattgcctcgggataacctagctaaggagtggtttaacacagactctatgaccctcaataatactgcttacctgttagacaagctgctccctaccctcgtgcctggagtcgagaacatgttaactcaagttgaaaagaagaaggtcctgaccgaagccgatactccaagcaaatttgaccctatcaattatctgggagaatacctgatcaggaacaatcccaactacattaaagacccaggcatgagcggctaccaacgcttaatgaaagaggtcaccgaagatctgaagatctacgtgcctgatacaatctgtaacagggtctctaagatgaaggaaaacgtgaaacagaaccggaagcagcgggaaagcatcgataagattatcgttaaggtcgcaaatactcgcaagcaggccctgcaagaacagtttgacgagtggatcctagaccccaaaggaatgatccccaaatccgtgatccagaatgttctgcaggagtttttccaaaatcccgattttaagctggggtcccattgtaagcagctggatatcacggattcaaccgaaccccgcttgaataagatggaatttactgaatacatttcatcacacatcaaggatcttaagagcgagatgttcgaagagctccttaaacacctgtgtcactcggcagacgagtttagagaagtcatcaaagccgacatgaggaggcaaatgttcgccgagctctttctgcactgtgaccatggcaaggtgggcttcttggaccgtcagcgaactctcgctctcctagagctgttctacgaccactccagtcagatgctgcgaagcttgctgaggaacccacggcaatggccttttattgaatttgaagaaattaacttaacagaactttggggagacatggataaccagaagcacatctatgagggcttcgacaaggttctgctcgaaatgaacacactgctatctgccaaccacgcctctaagacccagtctaaacttctcgagtctccagaccagcctaaacttaacgagcagcgaaccagtactcctagccctaacccaccggagcagcagcgtggcgtcacggccgagcagggcccccaacggatttccatcgaagagcagcagcagggaaagaaaccaactgccgaacaggagctgtatatcgagtctgttatcgaaccgggaacacacaccgagtctaccctagaacaaggaagctctagacggctcctgaccgagcaggaaacccacagggagtctacgacggagcaaggacagcacaagggaagcattgaggggcagggccctaggagagtcagcgtctctgagcagggctcctccagggagtcggtggccgagcaaggttcaagacgggagtccatcgccgaacaggatcgccataaaggttcagtcgcagaacaggggtctcgccgaatgtccgccgccgagcagggctctctgcgtgagagtgtgattgaggagccctatcagaaatctgagcagggaccgtatggagaaataattagtgaagaacaggaggatatcgggagtactagccaatcccggaaggactccatcctgaaatccacaaaatatggggaacccattacttccgaatacatcgaggtgcctctacaggaaaagcgctcgtgggagcaaacgtatgaggaggagattttcctcagttctgaactccaggaggaagttcctacactgtcgcgcaaagatcactttcccgagaccacaaaaaaggaggtgcagaaagacaaaccttgcgagcctaagtcccagaagatagagggaaagtcatggtcaggtgaatttttcacatgtaactggaaaatgaaatatgtgaccttcgaagacgaggagcaggcaaacctgatttatggcaacagtaggtttacagacctacatagcatcatcagaaatatccaatcatgcaaagaagtgaaagggcggaccgctttcaacggggtgtcttttaatttactgcagttcgtacagttgctggagacctttgtgggagaggatgctcctctgtccgtgagtgaaactcttacatcatttttcaaggaaggctatgtggaaaccgaacaggaaaaaatgaatgccctggaacaggtatctctgtgcagacaggccggtgtgcagtggagaaattgttcctcactgcaacctcccacgcctggactgaagcgctccagccaccatcgcctgctatctaactgggactatcgggaacgtcggaagttctttcctctggaaacgaagttcccctag

SEQ ID NO: 46954 - DNA, 1710 bp, Artificial Sequence
  Description of Artificial Sequence: Synthetic coding sequence
atggagttcaccgagtacatcagcagccacatcaaggacctgaagtcagagatgtttgaagagctcctaaaacatctgtgccacagcgcagatgagtttcgagaggtcataaaggcagatatgaggaggcagatgtttgcagagttatttttgcactgcgaccatggcaaagtcgggttcctcgacagacagcgaacccttgcactcctggaactcttttacgaccattcatcacagatgcttcgctctctgctgagaaatccccgtcagtggccttttattgagtttgaagaaattaacttaaccgagctgtggggcgatatggataatcagaaacacatctacgagggctttgacaaggttctgctggagatgaataccctgctgtccgccaatcatgcttccaagacacaatcgaagcttttggaatcccccgaccaaccgaaacttaacgaacagagaacatccacccccagccccaacccccccgagcagcagagaggggtcactgcagaacagggcccccagagaatcagcatcgaagagcagcagcagggcaaaaaacctacggctgaacaggagttatatatcgagtccgtcattgagccgggaacccatactgagtcgactctggaacagggctcttcgcggagattactcactgagcaggagacacacagagaatcgactaccgaacagggtcaacataaggggagcatcgaaggacaggggccaaggcgggtgagtgtgtctgagcagggcagctctagggagtccgttgccgagcagggttcgagacgtgagtctattgctgaacaggaccgacacaagggctctgtcgcagagcagggctctcgtcgcatgagtgctgcagaacagggctctttgcgggagtccgtaatagaggaaccctaccaaaaaagcgagcaaggaccatacggggagatcatctctgaggagcaggaagacatcgggtcgacttctcagagccgcaaagatagtatcctgaaaagcaccaaatacggggagccaatcactagtgagtacattgaagttccactgcaagaaaagagaagctgggagcagacctacgaggaggagatctttctgtcctccgagctacaagaagaggtgcccacgctctccagaaaagaccacttccctgaaacgacaaagaaagaagtacagaaagataaaccttgtgagccaaaatcccagaaaatcgaagggaaatcctggagcggagagtttttcacatgtaattggaaaatgaagtacgtcactttcgaagacgaggagcaggcgaatctgatctatggtaacagccggttcacggacttgcacagcatcattcgcaacattcagtcctgcaaagaggtgaagggccgcacggccttcaatggagtgtcttttaacctgctgcagtttgtgcagctgttagaaactttcgtcggtgaagatgccccactgtccgtgtctgaaaccctgactagttttttcaaggagggctatgtagagaccgaacaggagaaaatgaatgccctcgaacaggtgtccctgtgccgccaggctggcgttcagtggagaaactgctccagtctccaacccccgaccccaggtcttaaaaggtcaagccaccaccgtctcctctccaattgggactatcgcgaacgcagaaagttcttccctcttgaaacaaagtttccatag

SEQ ID NO: 46955 - DNA, 1890 bp, Artificial Sequence
  Description of Artificial Sequence: Synthetic coding sequence
atggccatcagcccccggagcgacgccaccttcagcagccagaagagtacccccagtgagtcccctcgtaccaagaaatttccactgaccgaagaggagatcttctacatgaactgcagagcagcctacctcacggtgttcaagtcatctctagagaacattatctcgaaggatcagttgtacctggctctgcagcacgcaggcagaaatccaagtcagaagaccatcaacaaatactggaccccacaaactgctaagttgaactttgacgacttctgtatcatcctcaggaaggagaagcctacatccaaagcagagttgctgaagtccttcaagcagctggacgttaatgatgatggctgcatccttcacactgatttgtataagtttctaacaaagcgcggcgaaaaaatgacacgtgaagaggtaaacgccattattaacctcgcggatgtgaacgcagacgggaaattcgactacatcaagttttgtaagctctacatgacaaccaatgagcaatgtctgaagacgaccttagaaaagctggaggttgactcaaagctcatgcggcatcaatttgggaatcacattgagggaagtcctgaaagagacccctccccagttcccaaacctagtcccaagatcacaaggaaaacagaccctgagactttcctgaacaagggggatacgcgttccagcttactttctgccacgcggaaattcaagacaagcgtgtcctttaccgtgacaatgggggcaaatggcaatcgaaattccaagctaatggagcccaatctgatcaaagattggcagcatatgcagtccaagggctgtttcttcctggaggaagacggcgagataatttctcatcagtacagaatgcagattgctcagaggtctatggtatatctgactatcaaacctttgaatcttagtcaggtagaaggaaagccatccccttggttgtctgtcgatactgcactgtatatactgaaagagaatgagtctcaagccaatttacaactggtctgtttcaccgaactgcggaacagagaagtgtttggctggaccggggaactggggcctgggatttactggcttattccctccaccaccggctgccggctgcgaaagaaaattaaacctgtcacggatgaagctcagcttgtgtaccgcgatgagacgggcgaactgttcctaaccaaagaatttaaatccaccctctctgacattttcgaggtgattgatctggacgggaacgggttgctgtctcttgaggagtataacttctttgagttgagaacaagtggggaaaagtgtgacgaggacgcctgggcagtatgtcgggagaatttcgatactaagcgtaatgagctgaccagacaaggcttcatggatctgaacctcatggaggcgaacgacagagaaggggacccttgtgacctctgggttaccctgcacagtatggggtacaataaagcactggagctcaccgaagcatgtccattcgtcattgacatctacgccgagaaatgtaaacccaaaattaaggccgttcatatggaagcgtgttccggccagctggagaaagctatttgcaagagtgtgttatcaaacggcgatgccaaagtcatggacggctacgaaaacataatagtgcacacctacagctgtgatacctggattacgtccgtaattgaaaacaagagtgacgagaaggtaattatacacatctccaacgagctttcgaaaaattgcataaataaccgtggcctgaacatatttgcagtggaagttgggcctaagagcaccatggtgtgtcaacatgtgatgcccctcaatgaaaggcaggaatggatctactactgcatctattcactgatcagctag

SEQ ID NO: 46956 - DNA, 594 bp, Artificial Sequence
  Description of Artificial Sequence: Synthetic coding sequence
atgcggctgaagcagggcagcttcctgtggtacctgtacctggacaagatctactgtcttttaagcgtgagaaatgttaaagccttggctgagtactttcatatcctggacgtccacggaaagaataccctgaatgacgtgctgttttatcacttcttacatcacgtgactgacctcaagaaggctcaaatcaatatcgttttcgatatgctggattggaatgccgtgggggagatcgactttgagaagttctacatgctggtctgtatgctattggctcatcaaaatcacctagagggtcagtttatgtacagacactcacgtccagtgtttgatctcctggacttgaagggcgacctcagaatcggcgccaagaactttgagatgtacagatttctctttaacatccagaagcaagaactgaaagatctttttcgcgactttgatatcacaggtgataatagactcaattaccaggaatttaaactgtataccattatctacacggataagctgcagaaacggcagaaaacggaggaaaaggagaagggcgagcggaagcgcagcttatacagcaaatgccacataaagtag

SEQ ID NO: 46957 - DNA, 2454 bp, Artificial Sequence
  Description of Artificial Sequence: Synthetic coding sequence
atgtacggcgtgtgcggctgctgcggcgccctgcggccccggtacaaacgactggtcgataacatttttcccgaggacccagaagatggccttgtaaagaccaatatggagaaattaacattctacgccctatccgcgccagagaaattggatcggataggggcatacttgagcgagcgacttatccgggatgtcggacgccaccgctacggatatgtttgtatcgctatggaggccttagatcagctgttaatggcctgtcactgtcagagcatcaatttattcgtcgaaagcttcctaaagatggtggcgaagctgctcgaatccgagaaaccgaatctgcagattttgggcacaaattctttcgtgaaattcgcaaatatcgaggaggacacaccatcctaccataggtcctacgatttttttgtgagcagattctcagaaatgtgccactcttctcacgatgacctggagattaaaacaaagatccggatgtcaggaattaagggactccagggggtggtgcgcaagaccgtcaacgatgagctgcaggccaatatttgggatcctcagcacatggataagatcgtcccatccctccttttcaatctccagcacgttgaggaggcagaatccagatcacccagtccactacaggcgcccgagaaggaaaaggaaagcccagcagaactcgctgagcggtgcctaagagaactactcggccgggcagcgtttggcaatattaaaaacgcgatcaaacctgtgttgatacacctcgataatcacagtctttgggaaccaaaggtctttgcgatacgatgtttcaagatcatcatgtatagcatccagccccagcacagccaccttgtgatacagcagcttctggggcacctcgacgctaattcaagatctgctgcgacagttagagcagggattgtagaggtgctttctgaggccgcggtcatcgccgctactggctccgttgggcccacagtgctagagatgttcaatacactgcttagacagctgaggctgagtattgactatgccctaacaggaagctatgacggtgctgtatctttaggaaccaagattattaaagagcatgaggagagaatgtttcaggaggccgttatcaaaacagtcggtagcttcgctagtacccttccaacctatcagagaagtgaggtgattctgttcattatgagcaaggtccctcgcccctctttgcaccaggctgtggatacagggaggactggcgaaaaccggaataggctgactcagatcatgcttctcaaatcactgttgcaggtcagcaccggctttcagtgtaacaatatgatgtcagccctgcctagcaattttctggaccgtttgctttcaacagccttaatggaggatgcagagatccgactcttcgtgctggaaatcctgatcagcttcatcgatagacacggcaaccgccacaaattctctactatctcaaccctaagtgacatcagcgtgttgaaactgaaagtggacaaatgtagccgccaggacacagtctttatgaaaaagcactcccaacagctgtatcgccacatctacttgagctgcaaggaagagacaaacgttcagaaacattatgaggccctctatggcctcctggctctcatctctatagagctcgccaatgaggaggtggttgtggatctgatcagattggtgctcgctgtccaggatgtggcacaagtgaatgaggagaatctgcccgtgtataacaggtgtgcgctgtacgctctgggagctgcctacctgaacctgatcagtcaattaaccacagtaccagcgttctgccagcacatccatgaggtcatcgagacccgcaagaaagaggccccctatatgctcccagaggatgtgttcgtagagcggccacggctgtcacagaatttggatggagtggtcatagagctgctcttcagacagtctaagataagtgaagtgctaggtggaagcggatataacagcgatcgtctctgtctgccctacattccacagttgacggacgaagatagactctcaaagagaagatccattggtgaaaccatctctctgcaggtcgaagtggagtcccgaaattcaccagagaaggaagagagagtgccagctgaggaaatcacatacgaaaccttgaaaaaagccatcgtggactcggtagcagtcgaggagcaagaaagagaacgaagacgccaggtggtagaaaaatttcagaaggctcctttcgaagaaatagccgctcattgcggggctagagcgtcgctcttgcagtcaaagttaaaccaaatctttgaaataaccattcgcccacctcctagcccaagtgggacgattaccgcagcctacggccagcctcagaaccactctatacctgtgtatgaaatgaagtttcccgatctatgcgtatactag

SEQ ID NO: 46958 - DNA, 2349 bp, Artificial Sequence
  Description of Artificial Sequence: Synthetic coding sequence
atggagaagctgaccttctacgccctgagcgcccccgagaagctggatagaattggcgcctatctctctgaaagactgatcagagacgtaggacggcatcgatacggatacgtgtgtattgcaatggaggccctggaccagctgctcatggcctgccattgccagtcaattaacctattcgtagagagtttcctgaaaatggtggccaaactcctcgaaagcgaaaagcctaacttacagatcctagggaccaactccttcgtgaaattcgccaacatcgaggaagacaccccaagctatcatagaagctacgactttttcgtctctcgatttagtgagatgtgccactccagtcacgatgatctggagatcaagacaaagataagaatgagcggcatcaaaggtctgcagggtgtggtgcggaagacagtgaacgatgagctccaggccaacatttgggatcctcaacacatggacaaaattgtcccctccctgctctttaatttgcagcatgtggaggaagctgaatctagaagccctagccccctccaggcccctgagaaggaaaaagagtccccagccgagcttgcagagcgctgccttcgcgagttgcttggcagggctgcctttggcaacatcaaaaacgcaatcaaacccgtgctcattcaccttgataaccactcactttgggagcccaaggtcttcgctattcggtgttttaagatcattatgtatagtatacagccccagcactcccacttggtgatccagcagctgctgggccatttggatgctaacagcaggagtgccgcgacggtgcgggccgggattgtagaagtactatctgaagcagccgtgattgcagcgacggggagcgttgggcccacagtccttgagatgttcaacaccctgctgcgccaacttcgcctgagcatcgactacgccttaacgggatcctacgatggcgccgtttctcttggcaccaagataatcaaggagcacgaagaacgtatgtttcaagaagccgtgataaagaccgtgggctctttcgcctccacccttcctacataccagcgctctgaggtgatacttttcatcatgagcaaggtgcccagaccgagtcttcatcaggcggtcgatactgggcggactggcgaaaaccgaaataggttgactcagattatgctactgaagtctctactacaggtgtcaaccgggttccaatgcaataatatgatgtcagctctgcccagcaacttcctcgatcggctcctgagtaccgctttaatggaagacgccgagatacgcttgtttgtgcttgagattctgataagcttcattgacagacacgggaatagacacaagttcagcaccattagcacactgagcgacatctccgtcttaaaactgaaggtggacaaatgttcacgtcaggatacagtttttatgaaaaaacattcacaacagctttatcgacatatttatttgagctgcaaggaagaaaccaacgtgcaaaaacattacgaagccttgtatggcctcctggcattgatatctatagagctcgcaaacgaagaggttgtagtggatttgattaggctcgtcctggccgtgcaggatgttgcccaggtcaacgaagaaaacctgcccgtgtacaaccgttgtgccctgtatgccttaggcgccgcctacctgaacctaataagtcagttgaccacagtccccgccttctgtcaacacatccacgaagtaattgagacaagaaagaaagaagcgccgtatatgctgcccgaagacgtcttcgttgaacgacccaggctatctcaaaatctggacggtgtcgtgatcgaacttttatttcgtcagagcaagatatcagaggtgctggggggttccggctacaatagcgatcggctgtgcctgccttatattccccaactgacagatgaggatcgactaagcaaaaggagatccatcggcgagaccattagccttcaggtggaagtagagagccgtaattcacctgagaaggaagagcgtgtgcctgccgaagagataacctacgaaacattaaaaaaggccatcgtggactctgtggcagtcgaggagcaggagcgggagcgaaggcggcaggttgttgagaagttccagaaagcgcccttcgaagagatagctgcccactgcggtgctcgggctagcttgttgcagtctaagctgaaccagatttttgagatcaccattaggcctcctccgagtcctagtggcaccattactgctgcctatggtcaaccccagaaccacagcatccctgtctacgaaatgaaattccctgatctgtgcgtgtactag

SEQ ID NO: 46959 - DNA, 4572 bp, Artificial Sequence
  Description of Artificial Sequence: Synthetic coding sequence
atgaccagcgtgtggaagcggctgcagcgggtgggcaagcgggccgccaaatttcagtttgtcgcttgctatcatgagttggtgctggagtgtacaaaaaagtggcagcctgacaagctagtggtcgtttggactcgtaggaacagacgcatctgtagcaaggcacattcttggcagcccggcattcagaacccctatcgcggaactgtagtgtggatggtacccgaaaacgtggacattagcgtaaccctctaccgggatcctcacgtggatcagtatgaagctaaagaatggaccttcatcatcgagaacgagtcaaaaggccagagaaaggtgcttgcaacagccgaagtcgacctggctagacacgctggccccgtgccagtacaagtgcccgtccggcttaggctcaagcccaaatctgtcaaggttgtgcaggccgaactgagcctgacactgagtggtgttctcttgcgcgaggggcgggctacagacgatgatatgcaaagcctggccagtcttatgtccgtcaaacctagcgatgttgggaacctggacgacttcgcggagtccgatgaggacgaggcacacgggcctggcgcacccgaggctagagctcgcgtgccccagccagatccgagtagagagctgaagactctctgcgaagaagaagaggaaggccagggtcgccctcagcaggccgtggcgagtccttcgaatgcggaagatactagtccagctcccgtgagcgctccggctccacccgctcggacgtcccgaggccaggggtcagaacgggccaacgaggccggcggtcaggtcggacccgaggctcctcgtcccccagagactagccctgagatgcgcagttctagacagcccgcgcaggacactgctcctactcctgcgcctagactgcggaagggttctgatgcactcaggccaccagtgccacagggcgaggacgaggtgcccaaagcttctggtgccccaccggccgggctcgggagcgcccgtgagacccaggcccaggcctgcccgcaggaaggcactgaggcccatggtgcgcgtctgggaccaagcatcgaggataagggtagcggtgatccattcgggcgtcagagactgaaagccgaggaaatggataccgaggacagaccggaggcatctggagtggacacagaaccaaggtcaggtggccgtgaggctaatactaaaaggtcaggtgtacgggctggcgaagcagaggagtccagtgctgtatgtcaggttgacgccgagcaaagatctaaagttagacacgtggacactaagggccctgaagccaccggagtgatgcccgaggcacgctgtagaggaacgccagaggcaccaccaagagggagccagggacggttgggggtgcgtacccgggatgaggcccctagtggtctctccctcccacccgcagagccagctggccattcaggtcagcttggagacctggaaggcgcccgggctgctgccgggcaggagcgggaaggcgcagaggttcgcggtggtgcccctgggatcgagggaacgggcctggagcaggggcctagtgttggagccatttccactcgacctcaagtctcttcttggcagggcgcccttctcagtacggcccagggcgctatcagtcgtggccttgggggatgggaagcagaggccgggggctctggagacctggagactgagaccgaagttgtaggactcgaagtgttgggcactcaggagaaagaggtggagggtagcgggttccccgagaccaggacactggaaatcgaaatactgggagccctcgaaaaggaggcagcccggtcacgagtgctcgagtccgaagttgcggggaccgcacaatgtgagggcttagaaacccaggagaccgaggtgggcgtgatagagacacccggcactgaaacagaagtcctgggtactcagaagaccgaggccggggggagtggagttctgcagaccaggacaaccattgctgagactgaggtactcgttacacaagagatcagtggcgacttgggccctctgaaaatcgaggataccattcaatcggaaatgttgggaactcaggagacagaggtagaggcctcccgcgtgcctgagtccgaagcagaaggcactgaagcaaagatcctggggacacaagaaattaccgcacgcgattccggtgtgagggagatagaggccgaaatcgccgagagtgatatccttgtcgcccaagaaatcgaagtggggctcctcggagtcctgggcatcgaaacaggcgcagctgaaggggccattctggggacccaagaaatagcgtctcgggacagcggggttcccgggctggaagctgacactacagggatacaggtgaaggaagtgggaggatcagaagttccagagattgcgacaggcacggccgaaactgagattctcgggactcaggagatcgccagccggagcagcggcgtgcccggccttgaaagtgaagtggctggagctcaggaaacggaggtcggaggcagcggtatcagtgggcccgaggcaggaatggcggaggcgcgcgtgctaatgactcggaagaccgagatcattgtgcccgaagcggaaaaggaagaggcccagacctctggggtccaggaagcagaaaccagagtgggttccgccctcaagtatgaggccctacgcgcccccgtgactcagccacgcgtattagggtcccaggaggccaaggccgaaatttccggtgttcaaggatccgaaacacaagtactccgggttcaggaggccgaggcgggggtctggggtatgagtgaaggaaagtctggggcatggggggcccaggaagctgagatgaaagttctcgagtccccggagaacaagtccggcactttcaaagcccaggaggcagaagctggcgtcctgggtaatgaaaaaggtaaggaggccgagggaagtctgaccgaagcatccctccccgaagctcaagtagccagcggggcaggagccggcgcacccagagcctcttcccccgaaaaagccgaagaagatcgccggttaccagggagtcaggctcctcccgccctggtctcttcttcccagtccctgttagaatggtgccaggaagtgaccaccggctatagaggtgtgcgcattaccaactttacaacttcgtggaggaacggactggcattttgtgctattttgcaccgtttctacccagacaagattgattacgcgtctctggacccccttaatataaagcagaacaataagcaggcattcgacggattcgctgccctgggtgtgagccgtctgttggagcccgcagacatggtgcttctgagcgtgccggataagctaattgtcatgacatacctgtgtcagatcagagcattttgcacgggacaagaactgcagttggtccagttggagggggggggcggtgccggcacgtaccgtgtcgggtcagcccagccttctccacctgatgatttagacgcaggaggtttagcccagcgcctgcgagggcacggggccgagggtcctcaggaacctaaagaggcagcagatcgcgcggatggcgccgccccgggagtggcctcccgaaatgcagtggccggtagagctagtaaagatggaggagcagaggcgccacgggaatccagacccgcggaggtgccagccgaagggctcgtgaacggggctggtgcccctggcgggggcggtgtccgattgcgacgaccttccgtgaacggggaaccagggtccgtgccgcctcctcgagcacatggcagtttttctcacgtgagagatgcggatctgctgaaaaagcggcgctccagactgaggaactcgtcctctttctctatggacgaccctgacgcgggtgcgatgggggctgccgccgccgaaggccaggctcctgatccatctcccgcgcccgggccacctaccgcagcggatagccagcagcctccaggcggcagtagcccgagcgaggagccccccccaagtcccggtgaagaagccggcttacagcggttccaggataccagccagtacgtgtgcgccgaacttcaggcacttgagcaagagcagcgtcaaattgatggaagggcagcggaagtcgagatgcagctcaggtctctcatggagtcaggcgctaacaagctccaggaggaggtgctaatacaggagtggttcactcttgttaacaaaaaaaatgcacttatcaggcgccaagaccaacttcaactgctgatggaggaacaggacttggaacgaagatttgaattgctgtcccgagagcttcgcgccatgctggcgatagaagattggcaaaagacaagtgcccagcagcaccgcgagcagttgttgcttgaagagcttgttagcctggtaaaccaacgggacgagttggtccgggatctcgaccataaggaaagaatcgccctggaagaagacgaaaggctagaacgcggtctggaacagcgaaggagaaagctgtcaagacagttatctcgacgcgagcgctgcgtcctcagttag

SEQ ID NO: 46960 - DNA, 1005 bp, Artificial Sequence
  Description of Artificial Sequence: Synthetic coding sequence
atgaagcacttcctgcggatgctgatccaggtgtgcctgtacttctattgtaagtttctatggaggtgtctgaaatttgtaatgcgtaaactgaccggaaggtgcgagcttcaaagaatctgttataatacaaaaccaggggcgagccgaactatgaagatcgagacctccttgcgcgacagtaaatcgaaactcttgcagaccagcgtgagcgtacacccagatgctatagagaaaaccatagaggacatcatggaactaaaaaagatcaacccagatgtgaacccccagttgggaatatcgctgcaggcctgcctgctgcagattgtagggtaccgtaaccttattgccgacgtggaaaagcttagacgggaagcctatgactccgataaccctcagcatgaggaaatgcttctcaagctctggaagtttctgaagcccaatacaccgctcgaatctagaattagcaagcagtggtgcgagatcggatttcagggagatgatccgaagaccgatttccgaggtatgggtctgctgggcctgtacaacctgcagtatttcgctgaacgggacgcaacagccgcccaacaggttctctctgactcattgcatccaaaatgccgcgatataacaaaggaagaaattagtaaattctctaaagccgagtgggagaagaagaggatggacaaggcaatcggatatagcttcgccatagtcgggattaatattaccgatctcgcttacaatctccttgtttccggagccctcaaaacgcatttttacaatatagcccctgaggcgcccaccctgtcccactttcagcagactttctgttaccttatgcatgaatttcacaagttctggatcgaagaggatccaatggacattatggagttcaatcgcgtgagagagaaattcagaaaacggattattaagcaactccagaatcccgatatggccttatgcccccatttcgctgcgagcgaagggttgatcaatatgtag

SEQ ID NO: 46961 - DNA, 981 bp, Artificial Sequence
  Description of Artificial Sequence: Synthetic coding sequence
atgaagcacttcctgcggatgctgatccaggtgtgcctgtacttctattgcaagtttctgtggaggtgcctgaagttcgtcatgcggaagctgactggacgctgcgagctgcagagaatctgctataatactaaacccggcgcctcccgtacaatgaaaatcgaaactagtctgcgggacagtaaaagcaaactgttacagacaagtgtgtccgtgcacccggatgctatagagaaaacaattgaagacataatggagctgaagaagataaatcctgacgtgaacccccaactgggtattagcctgcaggcgtgccttctgcaaatcgtgggttacaggaatcttattgctgacgtggagaaactaaggagagaggcctatgacagtgacaacccccagcatgaggaaatgctcttgaaactctggaaatttctgaaacccaacacgccattagaaagtagaatctccaagcagtggtgcgagatcggattccagggtgatgaccccaaaacagatttcagagggatggggttgttaggcctttacaacctccaatacttcgctgagagagacgctacagccgcccaacaggtgttatctgatagtctgcacccaaaatgcagcaagttttctaaggccgagtgggaaaagaaacggatggataaggccataggatattccttcgctatcgtgggtattaacattactgatctcgcttacaacttactggtgagtggagctctcaagactcatttttataacatagcgccagaggcacctaccctcagccacttccagcagacattttgctacctcatgcatgagttccacaagttctggatagaggaggatccaatggacataatggaattcaaccgggttcgggagaaattccgcaaacggatcattaagcaactgcagaatccagacatggctctgtgccctcacttcgctgcatctgaggggctcatcaacatgtag

SEQ ID NO: 46962 - DNA, 1176 bp, Artificial Sequence
  Description of Artificial Sequence: Synthetic coding sequence
atgaacgagaagagctgcagcttccacagcaaggaggagctgcgggacggccagggcgaacggctgagtgctggctattcgccgtcttatgataaggacaagagcgtgctcgcgtttcgtggaattccaatatctgaactcaagaaccacggtattctgcaggctctaacgactgaagcctatgaatgggagccgcgtgtagtgtctacagaagtggtgagagctcaagaagagtgggaggctgttgacactatccagcctgaaacgggatcacaagcctcgagtgaacagccaggtcagctgatctctttctcagaggcactccaacatttccaaaccgtggatctgagcccgttcaagaagaggattcagcctaccatcagacggacaggactagccgctctccgacactacctttttggcccaccgaagctgcatcaacggctgagagaggagagggatctggtcttgacaattgctcagtgtggtcttgacagccaggaccccgtccacggtagggtcctgcagaccatatataagaaattaaccggatccaagtttgactgcgccttgcacggaaaccactgggaggacctgggctttcaaggggccaatccagctaccgaccttagaggcgctggtttcctggcccttctgcacttgctctacctcgtgatggattcaaagacgctgccgatggctcaggaaatttttaggctgtccagacaccacattcagcagttcccattttgtcttatgtcagtaaacattacccacatcgccatccaggctctacgtgaagaatgccttagcagagaatgcaaccgtcagcagaaggtcattcccgtggtcaatagcttctacgcagccacatttcttcatctcgcccatgtctggagaacacagcgcaagaccatcagcgacagcggctttgtgctcaagggcgtgctttttcttttagggcgccctaggttgaatgctcagtgccccaggagcagagagcccaaggtcgtcgctcggctggtattggcagcggtattgcctcacccccatttcctcaagttccagctgaccaagatctcaattacgcatcccctagagtccgcatcttctcccttttctgcattaaccgtcgccctgttttggagttatacttacgacaaacacattttctag

SEQ ID NO: 46963 - DNA, 1146 bp, Artificial Sequence
  Description of Artificial Sequence: Synthetic coding sequence
atgaacgagaagagctgcagcttccacagcaaggaggagctgcgggacggccagggcgaacggttgtccgctggctacagcccgagctatgacaaggacaaatcagttctggcatttcgagggatccccatctccgaattgaaaaaccacggaatcttgcaggcactaacgaccgaggcatatgagtgggagcccagggtagtttcaaccgaggtggtccgtgcccaggaagaatgggaagcagtggacacgatccaacccgagacaggatcccaagcgtcctctgaacaaccaggtcagctcatcagcttttccgaggccctgcagcacttccagaccgtcgacctgagccccttcaagaaaagaatccaacccacaatcagacggaccgggctggcagcgctcagacattacctgttcggtcccccaaaactgcaccagaggctgagagaggagcgggacttagtcttgactattgctcagtgcgggttggattcgcaggatcccgtgcatgggcgcgtcctccagactatctacaagaagctgacagggagcaaatttgactgcgccctgcacggcaatcactgggaagatctagggttccagggtgcaaatcccgctactgatcttagaggggcagggttcctggcactgctccaccttctttacctcgtcatggatagcaagactctcccgatggcacaggagatatttcgtctgagtcgacaccacattcaacaattccctttctgcttgatgagcgtgaatataactcatatcgccatccaagcccttagagaagagtgcctgtcaagggaatgtaatagacagcaaaaggtaattcccgtcgtgaatagcttttacgccgcgacattcctgcacttggcacacgtttggcgtacccagcgaaagacgatctcagattcggggttcgtgctcaaggaactagaggtgctggctaagaaatcaccgcgccgactattgaagaccctcgaattgtatctagcaagagtgtccaagggccaggccagcctgctgggcgcccagaagtgttacggaccagaagctccccctttcaaggatctcacgttcactggggagtcggacctccagagtcacagtagtgagggggtttggttgatctag

SEQ ID NO: 46964 - DNA, 1146 bp, Artificial Sequence
  Description of Artificial Sequence: Synthetic coding sequence
atgaacgagaagagctgcagcttccacagcaaggaggagctgcgggatggtcagggtgaacgcctctctgccggctacagtcccagctacgataaggacaaaagcgttctggcatttcgtggaatacccattagtgaactgaagaatcacggtatcctgcaagccctcaccacggaagcatacgaatgggagcctagagttgtgagtacagaggtggtaagggcgcaggaagaatgggaggccgtagatactattcagcccgaaactggctctcaggcaagcagcgagcagccggggcagttgattagtttcagcgaagcgcttcagcattttcaaactgtggatctcagccctttcaagaaacggattcagcccaccatccgccgaacaggcctcgctgccctgaggcattacctattcggtcctcccaaattgcatcaaagactgagggaagaacgcgatctcgtgctcactatagcacagtgtgggctggactcccaggaccctgtacatggccgcgtgctccagaccatctataagaaattgactggaagcaagtttgactgtgccctgcacggcaaccattgggaagatctgggcttccaaggcgctaaccccgctaccgacctgcgcggagctgggttcctggccctcttgcacctgctttacctggtgatggatagcaaaacactgcccatggcccaagagatattccgattgagccgccaccatatacaacaattccctttttgtcttatgagtgtgaacattactcacattgctatccaggccctacgggaggagtgtcttagtcgggagtgtaatcgccagcagaaagtcatccctgtggtgaactcattctatgccgctactttccttcacctcgcccacgtctggaggacacagaggaaaacaattagtgacagcggctttgtgctcaaggagcttgaagtgctggccaagaagagcccaaggcgactgctgaagaccctagagctgtacctggcccgggtctctaaagggcaggcctccttgctgggcgcacagaaatgctatggccccgaggctccgccattcaaggatcttacttttaccggcgaatcagacctccagtctcattccagcgaaggagtttggcttatctag

SEQ ID NO: 46965 - DNA, 612 bp, Artificial Sequence
  Description of Artificial Sequence: Synthetic coding sequence
atgaacgagaagagctgcagcttccacagcaaggaggagctgcgggacggacagggcgaacgcctttctgctgggtattccccctcctacgacaaggacaagagtgtgctcgcctttagaggcattcccatctctgaactgaagaatcatggtatcttgcaggccctgacaacagaggcgtacgagtgggagcccagagtggtcagcactgaggtggtccgcgcacaggaagagtgggaagccgtggacaccatacagcccgagaccggttcccaggcatcctccgaacaaccagggcagttaatttccttctcggaagccctccagcacttccaaacagtcgacctctcacctttcaagaagcgaattcagccgaccattcggcggacaggtctcgctgctctgagacattatctgttcggccctcctaagcttcatcagaggctgagggaggagagagacctggtgctcacaatcgctcagtgcgggctagacagccaggatccagtacatggccgggtactccagacaatctacaagaagctgactggcagtaaattcgactgtgcgctgcacggcaaccactgggaggatcttggattccaagggtag

SEQ ID NO: 46966 - DNA, 1146 bp, Artificial Sequence
  Description of Artificial Sequence: Synthetic coding sequence
atgaacgagaagagctgcagcttccacagcaaggaggagctgcgggatgggcagggcgaaagactatcagcaggctattctccaagctatgacaaagataaaagtgtgctggcattcagagggatccccataagcgagttaaagaatcatggaatactccaggccctgactacagaggcctatgagtgggaacctagggtcgtgagcacggaggtcgtcagggctcaggaagagtgggaagcggtggataccatccaaccagaaacaggaagccaggctagctccgagcaacctggtcagctaatttcgttttctgaggccctgcagcacttccaaacggtggatcttagcccattcaagaagcggattcagcctactattcggagaaccggtttggctgcactgcggcactacctcttcggccccccaaagctccaccagcgattaagagaagaaagagaccttgtactgacaatcgcccaatgcgggctagatagtcaggaccccgtgcacggcagagtgctgcagacaatctacaagaagttgaccggatccaagtttgattgcgctctccacggtaaccattgggaagaccttgggtttcagggggctaatcccgccaccgatctgcgaggcgctggcttcctagctcttctccacttactgtacttggtgatggacagtaagacgttaccaatggcccaggagatcttcaggttatcgcgacaccatatacagcaattccctttctgcttaatgagtgtgaacattacacatatcgccattcaggccctgagagaagagtgtctaagccgcgagtgcaatcggcagcagaaggtcattccggtggtgaattccttctacgccgccaccttcctccacctggctcatgtctggagaacccagcgtaagacaatcagcgacagcgggttcgtgctaaaagaactggaagtactggctaagaagtcccctcggaggctgctgaaaactctggaactttacctggcccgggtgtcaaaagggcaggcctctcttctgggagcgcagaagtgctatggcccggaggcccccccattcaaagacctgacttttacaggggagtcggatctgcagtcgcacagctctgaaggcgtgtggctaatctag

SEQ ID NO: 46967 - DNA, 1146 bp, Artificial Sequence
  Description of Artificial Sequence: Synthetic coding sequence
atgaacgagaagagctgcagcttccacagcaaggaggagctgcgggatggacagggggaacgtctcagcgccggatattcgccttcttacgataaggacaaatcggttctggccttcagagggatacccatcagcgagctgaagaaccacggtatcctgcaggcgttgacaacagaggcctacgagtgggagccacgcgttgtgagtactgaagtggtgcgggcccaggaggagtgggaggccgtggacacgatccagcccgagactgggtcacaagcctcatctgagcaacctggccagctgatctcattcagcgaggcactccagcacttccagacagtggacctgagtcctttcaaaaagcgcatccagcctacgatacgccgcacgggactggctgccctgagacactatttgtttggtccacccaagctgcatcagcggctgcgcgaagagagggatcttgtccttacgatagcgcaatgtggcctcgacagccaggatcccgttcacggtagggtgctgcagactatttataagaagttaacagggagtaagttcgattgcgctctgcatggtaatcattgggaagacttgggtttccagggcgcaaatcctgcaacagatctgcgcggcgcaggattcctagccctgctgcacttactctatcttgtgatggattcgaagaccctccctatggcccaggaaatattccgattgagcaggcaccacatacagcagtttccattttgcttgatgagtgtcaatattacccacattgctattcaagccttaagggaggaatgtttgtcaagggagtgcaaccgccagcagaaagtgatccccgtggtgaatagcttttacgctgctacatttctacacttagcgcatgtgtggagaacccaacgcaagaccatcagcgacagtggctttgtgttgaaggaattggaggtacttgccaagaagagcccccggaggttgctcaagactctagagctatatttagctcgcgtgagcaagggacaggctagcctcctcggggcccagaagtgttatggccctgaagccccaccatttaaagatctaacatttaccggagagtcagacctgcagtcccactccagtgagggagtctggctcatctag

SEQ ID NO: 46968 - DNA, 363 bp, Artificial Sequence
  Description of Artificial Sequence: Synthetic coding sequence
atgaacgagaagagctgcagcttccacagcaaggaggagctgcgggatggacagggtgagcgcctttctgccggatactcaccatcttacgacaaagataagagcgtcctggcctttagaggaattcctatttcagaactgaaaaatcacggcattttgcaagctctcactactgaggcttatgagtgggagccccgggtggttagcactgaggtggtgcgggcacaggaagagtgggaggccgttgataccatacagccagaaactggatcacaggcatcctctgagcagcccggccagttaatctcttttagtgaagccctgcagcactttcagaccgtggacctgagtccattcaaatag

SEQ ID NO: 46969 - DNA, 765 bp, Artificial Sequence
  Description of Artificial Sequence: Synthetic coding sequence
atgaacgagaagagctgcagcttccacagcaaggaggagctgcgggatggacagggtgagagactcagcgctggttactcaccatcttacgacaaggacaaatcggttctcgccttcagaggtattcccatttctgagctaaagaatcacggtattttgcaagcgctcacaactgaggcgtatgagtgggaaccaagagttgtgtctaccgaggtagttcgagcccaggaggagtgggaagcagttgataccattcagccggagaccggttcacaggctagcagtgagcagcccggccagctgatctctttttctgaagcacttcaacatttccagacagttgatctgagcccttttaagaaaaggatacaaccgaccatccggagaacaggcctcgccgccctgaggcactacctctttgggccccccaagctgcatcaacggcttcgcgaagagcgcgatctggttttgacaatcgctcaatgtggactcgatagtcaggatcctgtccatggccgagtgctgcagacaatctataagaagctgaccggcagcaagtttgattgtgcccttcacggtaaccattgggaggacttgggttttcagggtgctaatccggccactgacctcagaggagccggatttctcgccctcctacacctactttacctggtaatggattctaagaccctgcctatggcacaggagatctttagactgagtaggcaccacatccagatcgagcggaaccagggtaaaggctag

SEQ ID NO: 46970 - DNA, 3363 bp, Artificial Sequence
  Description of Artificial Sequence: Synthetic coding sequence
atggtgctgaacagcctggacaagatgatccagctgcagaagaacacggcaaacatccgtaacatttgtgttctcgcccacgtggaccatggaaaaactacactggctgattgcctgattagcagcaatgggatcatctcttcaaggcttgctggtaaacttagatacatggattctagggaggacgaacagattagggggatcactatgaagtccagcgccattagcctgcactatgcaacaggcaatgaagaatatctaataaacctgatcgatagtcctggccacgtcgatttctcttctgaggtaagcacagcagtgcgaatctgtgacggatgcataatagtcgtcgatgccgtcgagggagtgtgcccacaaacacaggccgtcctcagacaggcttggctggaaaatatccgtcctgttctggttattaacaaaatagatcgactcattgtggagctcaagtttaccccacaggaggcctacagccatctgaaaaacattctggagcagatcaacgccctcactggaacgctgttcacctccaaggttctcgaagaacgcgccgagagggaaaccgaatctcaggtgaatcccaacagcgagcagggagaacaggtgtatgattggtcaacagggttggaggacacggatgatagccacctgtattttagccccgagcagggcaatgttgtgttcacttcagctatcgatggatggggttttgggatcgaacacttcgcccgcatatactcccagaaaatcggaattaagaaggaagtcctgatgaaaacgctgtggggggactattacataaatatgaaagctaaaaagataatgaagggcgatcaggcgaagggaaaaaaacccctgttcgtacagctcatcctggaaaatatctggtccttatacgatgcagtgctgaaaaaggacaaagacaagatcgacaagatagtgacatcactgggactgaaaataggcgcacgcgaagctagacactcagaccctaaggtccagatcaatgcaatttgtagccaatggctcccaatctcccacgctgtgcttgctatggtgtgccaaaaactgccgtctcctctggacataactgccgaacgggtagaacgcttaatgtgcactggctcccagaccttcgacagctttccaccggagacacaggctttgaaggctgcgttcatgaaatgcggatctgaggacaccgcccccgttatcatcttcgtgagcaagatgtttgcagtggacgccaaggctctgccccagaacaagccccgcccgctaacccaggaggagatcgctcagcgccgagagcgggcccggcaacggcatgccgagaaactcgctgcagcgcaggggcaggcaccactagagcctacccaagatggttcagcgatcgaaacgtgtcccaaaggagaagaaccaaggggtgatgagcaacaggtggagtccatgacccccaaacccgtcctccaggaggagaataatcaggaaagcttcattgcattcgcgcgggtgttttccggagtcgcccgaaggggcaagaagatcttcgtactgggacctaagtatagcccattggagttcctccgcagggtgccgctgggcttcagtgcaccacctgacggtttaccacaggtgcctcatatggcctattgcgccctggaaaatctataccttttgatgggcagagaactggaatatctagaggaagttccaccaggtaacgtcctcggaatcggaggtcttcaagacttcgtgttaaagtctgccacactgtgtagcctccccagttgccccccctttattcctctaaactttgaggcgactcccattgtcagggtggctgtggaacctaagcacccatccgagatgccacaacttgtgaaagggatgaagctcctgaaccaagcggatccttgcgtccaaatccttatccaggaaactggagagcacgtgctggtcaccgctggcgaagtacatcttcaaagatgcctagacgatctaaaagaacgttttgcaaagattcacatctcggtgagcgaacccataataccttttcgggaaacaatcactaaaccccccaaggtggacatggtcaatgaggaaatcggaaaacagcagaaagtcgcagttattcaccagatgaaagaggaccaaagcaagatacccgagggcatacaggtggatagcgatggcctgatcactattacgacaccaaataagctggccacgcttagcgtgagagcaatgcccctgccggaagaggttacacagattttggaggaaaactcagacctgattcggtctatggaacagctgacatcctcgctcaacgaaggtgagaacactcacatgattcaccagaaaacacaagagaagatttgggagtttaagggaaagctagaacagcaccttactggaaggcgatggcggaatatagttgaccagatttggtcttttggccccaggaagtgtggccctaacatcctcgtcaacaagtcggaggattttcaaaactcagtctggactgggccagctgacaaggcttcaaaggaggcatctaggtaccgtgacctggggaatagcattgtgagcggttttcagctcgccacactgtccgggccaatgtgcgaagagccattgatgggagtgtgctttgtattagagaagtgggacctctctaagttcgaagagcagggcgccagcgatctcgctaaggagggtcaggaggagaacgaaacatgttcgggcgggaatgaaaatcaggaactccaggacggctgctcagaagcgtttgagaagaggacaagccagaagggcgagagcccacttaccgactgttatggccccttctccggacagctgatagctacaatgaaagaggcttgcaggtacgccctgcaagtcaaaccccagcgccttatggctgccatgtacacctgtgatataatggcaactggtgacgttctggggcgcgtgtacgcagtactttcaaagcgggaaggaagagtacttcaggaagagatgaaagaaggcacggatatgtttatcattaaggccgtactgcccgtggcagaaagcttcggattcgccgatgagatccggaagcgaacctcaggcttggcatcaccccagctggtgttttcacactgggagataattccctcggatcccttctgggtcccaaccacagaagaggagtatcttcactttggcgagaaggccgacagcgaaaaccaggccagaaaatatatgaacgctgtccggaagcgtaagggcctgtacgtcgaagagaaaatcgtcgagcatgccgaaaagcaacggactctgagcaagaataaatag

SEQ ID NO: 46971 - DNA, 3210 bp, Artificial Sequence
  Description of Artificial Sequence: Synthetic coding sequence
atggtgctgaacagcctggacaagatgatccagctgcagaagaacacagctaatatccgtaacatttgtgtcttagcacacgtggatcacggtaatgaggagtacctgattaacttgatcgacagccctggtcatgtggactttagctctgaggtcagcactgctgttcgaatttgcgacggatgtataatcgtcgttgacgctgttgagggagtctgtccccaaactcaagccgtcctgcggcaggcatggctggagaacatccggcccgtactggtcatcaataagattgataggctgattgttgaactgaagttcactccacaggaggcctacagtcatctcaagaacattcttgagcagattaacgccttaaccggcactttgttcacttcgaaagtgttggaggagcgagcagagagggagactgaatcacaagtcaaccccaactccgagcaaggagaacaagtttacgactggtccaccggactggaggatacagatgactcccatctctatttctcgcccgaacaaggcaatgtggtgttcactagcgccattgatggatggggatttggtatcgagcactttgcgcggatatacagccagaaaattggcatcaagaaagaagtgttgatgaagacactgtggggagattactatataaatatgaaagccaagaaaattatgaaaggggaccaagctaaaggtaagaaaccactgtttgttcagctgatactcgagaatatctggtccctgtacgacgcagtgctgaaaaaagacaaggacaaaattgataagattgtaacgagtcttggattgaagatcggagcacgggaggcccgccatagcgatcccaaggtgcagattaatgccatatgcagccagtggctccccatatcacatgccgtgttggctatggtgtgccagaagctcccttctccgctcgatattaccgccgaaagagtggagcggctcatgtgtaccggctcccagacgtttgattcttttcctccagaaacccaggccttaaaagccgcttttatgaaatgtgggagtgaagacacagctccagtgatcatcttcgtatcaaaaatgtttgcagtggacgcaaaggctttgccacagaataagccacgcccccttactcaagaggagattgcccagagaagagagcgggcccggcagagacacgcagaaaagctcgctgctgcacagggacaggcccctctggaaccaacacaggacggctccgcaatcgagacgtgtccaaaaggtgaagaacctcgaggggacgaacagcaggtcgaatcaatgacacctaagcccgtgctgcaagaggaaaacaatcaagaatcctttatcgctttcgcacgcgtgttctccggcgtagctcggaggggcaagaaaatctttgtattgggacccaagtacagtccgttagaatttctccggagagtgcctctgggattttcagctcctcctgacgggctgcctcaggtgccacatatggcctattgtgcgctggagaacctgtacctgctgatgggccgtgagcttgaatacctggaagaagtgcctcctggaaacgtcttaggaatagggggcttgcaggatttcgtgctgaaatccgctacactgtgcagcctgccgtcctgccctccctttattccactgaactttgaagccactccaattgtgagagtcgcagtggagccaaagcatcccagtgaaatgccacagttagtgaaggggatgaaactgctcaaccaggccgatccctgcgttcagatcctcatccaggagacaggcgaacacgtgctcgtcaccgccggggaagtgcatttgcagagatgtctggacgatctaaaggagcgctttgccaaaattcacatcagtgtgtctgagcctatcattccattccgcgaaaccataaccaagcctccaaaagtggacatggtcaatgaagagataggaaagcagcaaaaagtagcagtcatccaccagatgaaagaggatcagagcaaaatccctgagggaatccaagtggatagtgatggactaatcacgattactacacccaacaaactggctacactaagcgtgcgcgccatgcctctgcctgaagaagttacgcagattctggaagagaactccgaccttattagaagcatggagcagctgactagctcactgaacgagggcgaaaatacacacatgattcaccaaaaaacacaggagaagatctgggagtttaaagggaaactcgagcagcacttgactggtcggagatggcgaaatatcgtagaccaaatctggagcttcggtccccgtaagtgcggacccaatattctcgtaaataaatcagaggactttcaaaattcagtgtggaccggacctgcagataaagctagcaaagaggcatctcgctacagagacctcgggaactccattgtgtccggcttccagctcgcaaccctgtctgggccaatgtgtgaagaaccactgatgggcgtgtgctttgttctggagaagtgggacctctccaaatttgaagagcaaggagcatctgatttggccaaggaaggacaggaagagaacgaaacctgctccggtggaaatgaaaaccaggagctgcaggacggctgcagcgaagccttcgaaaagagaacctcacagaaaggggaatcgcctctcacggactgctatggccccttcagtggccagcttattgcaaccatgaaggaagcctgccggtatgcgctgcaggtcaagccccagcgtctcatggctgccatgtatacctgcgacatcatggccacaggggacgtgctcgggcgcgtgtatgccgtcctaagtaagagagaggggagggtgctccaggaagaaatgaaagaagggaccgatatgtttatcattaaagcagtgctccctgtcgccgaatcgtttggttttgccgacgagattcgtaagaggacctcggggctcgcatccccacaactggtcttctcccactgggaaatcatcccttcagatcccttctgggtccccaccacagaagaggaatacctccactttggtgagaaggcagacagcgagaatcaagcaagaaagtatatgaacgctgtgcgcaagcggaaaggcctgtacgttgaggagaaaatcgtggagcatgctgagaagcagcggactctaagcaaaaataagtag

SEQ ID NO: 46972 - DNA, 93 bp, Artificial Sequence
  Description of Artificial Sequence: Synthetic coding sequence
atggtgctgaacagcctggacaagatgatccagctgcagaagaacacggccaacatcagaaacatttgcgtgttggctcatgtcgaccattag

SEQ ID NO: 46973 - DNA, 54 bp, Artificial Sequence
  Description of Artificial Sequence: Synthetic coding sequence
atggtgctgaacagcctggacaagatgatccagctgcagaagaacactgcgtag

SEQ ID NO: 46974 - DNA, 420 bp, Artificial Sequence
  Description of Artificial Sequence: Synthetic coding sequence
atgtggcacaccgtgccccgggccggcctgggccgggtgggctgccgcggcctgccaggatgccgcgcccacccacctggagcatgggcctgctgtaccgagcaagcatgggctctggcacccctgacggtaccatcgcgcccaagcctgtgctcaggcccacggacaggatcaggccagcaagctccggggctccaggacgtgttatcactatggagtgtctgcgatgatgaacattcgtggtcctttctttacgccggcccatgggcctcagagagagctacaggctggaggctgagccatgaggtggaaggccagtcgcaggggcttcaggtgacttcttgccgtcaccatgccctcctgccatgggctgtgctgggtgcccctagctggccttgggcccagtggcccgtcgcctag

SEQ ID NO: 46975 - DNA, 309 bp, Artificial Sequence
  Description of Artificial Sequence: Synthetic coding sequence
atgggcgccgagtgggagctgggcgccgaggccggcggcagcctgctactgtgtgcagcactcctggccgctggatgcgctttaggtctgagattagggaggggacaaggagccgctgacaggggagctctgatttggctttgctacgatgcactggtgcactttgccctcgcatttcctgctgatcacccagtaagggtaagagccgtgtggctactcgatgatttgccacccagggttgcccaccaaaagccgcagccccagcaccaacagctcgccgtgttactcgctcttcccgtctttttttag

SEQ ID NO: 46976 - DNA, 387 bp, Artificial Sequence
  Description of Artificial Sequence: Synthetic coding sequence
atgggcgccgagtgggagctgggcgccgaggccggcggcagcctgctgctgtgcgccgctctgttagccgcaggctgcgccttgggcctgaggttaggcagaggacagggggcagcagaccggggagctctgatttggctgtgctatgatgccttagtgcacttcgccctggagggacccttcgtttacctctctctcgtgggcaacgtggccaattctgatgggctcattgcttcgctttctgatgcccggtgggtctatttcgaccccactatcgtgtcagtcgagatactgacagtcgctctggacggatcccttgctctatttctaatctatgctatcgtcaaggaaaaatactaccgcgacagagtggcctggggcgagtag

SEQ ID NO: 46977 - DNA, 1815 bp, Artificial Sequence
  Description of Artificial Sequence: Synthetic coding sequence
atgctgggcatgaacatgctgctgatcaccctgttcctgctgctgcccttatcgatgctaaaaggtgaaccttgggaggggtgtcttcattgcacacatacaacatggagcggcaacattatgaccaaaacattactgtaccacacgtattatgaatgcgctgggacatgcctggggacatgcacacataaccagactacttatagcgtatgcgaccccgggaggggccagccgtacgtgtgctacgacccgaagtcttcccctgggacatggtttgaaattcatgtgggatctaaagaaggggatctcttgaaccaaacaaaggtcttcccaagcggaaaagacgtcgtgagcctgtatttcgatgtgtgccagatcgttagcatgggaagtcttttcccagttatcttttcttctatggaatactacagcagttgtcacaagaataggtacgcccatcccgcctgttccaccgacagcccggtcacaacttgctgggactgcacaacatggtctaccaatcagcagtcgctgggcccgattatgctgaccaagattccactcgagccagattgcaaaacctctacatgcaactcagtcaatctgaccattctcgaacctgaccagcctatttggactactgggttgaaggctccattaggggcaagggtcagcggggaggagatcggccccggggcctacgtatacctatacattatcaagaagacccggactcgctctactcagcagttccgggtcttcgagagtttctacgaacacgtgaatcagaagcttcccgaaccaccacctctcgcatccaatttgtttgcccaactggcggaaaacattgcgagcagccttcacgtagcatcttgttatgtctgtggtggaatgaacatgggggatcagtggccatgggaggccagagaactcatgccccaggataattttacactgaccgccagtagtttggagcccgcgccaagtagccagagtatttggtttctgaagacaagtattatcggtaagttctgtatcgccagatgggggaaagcctttaccgaccccgtcggagagttaacttgcttaggacagcaatattacaacgagaccctgggcaagacactctggcggggcaaatccaataacagcgagagtccccatccatctcctttttcccgtttcccctctcttaatcactcttggtatcagcttgaagccccaaatacttggcaggctccatctggcctgtattggatctgcggacctcaagcctacaggcagctccctgcaaagtggtcaggagcctgtgtgctgggaactatcaggccatcctttttcctgatgcccctgaagcagggagaagcacttggatatcccatctacgacgagaccaagcgaaagtcgaagcgtggcattactatcggggactggaaggataacgagtggccgcccgaaaggattatacagtattatgggcctgcaacgtgggctgaggacggaatgtggggatataggacacctgtctatatgctgaatcgcatcatacgcctccaggcggtgctagagattatcaccaatgaaacagctggcgccttaaatctgcttgctcagcaagctactaaaatgagaaatgtaatataccagaatcggctcgccttagactatctgctggcacaagaggagggtgtctgtggcaagtttaatttaactaattgttgcctggagctggatgacgaaggtaaggtgatcaaggaaatcaccgcaaaaattcagaaactggctcatatccccgtgcagacatggaagggctag

SEQ ID NO: 46978 - DNA, 1692 bp, Artificial Sequence
  Description of Artificial Sequence: Synthetic coding sequence
atgggcagcctgagcaactacgccctgctgcagctgaccctgaccgcatttttgacaattctcgttcaaccccagcatttactggccccggtgtttagaacgctgtcaattttaaccaaccagtctaactgttggctgtgtgagcatttagacaatgctgaacagccagaattagtcttcgtgcctgcaagtgcaagcacatggtggacatatagcggccagtggatgtacgagagagtttggtaccctcaagctgaggttcagaaccactccacctcctcctacaggaaggtgacttggcattgggaggcctctatggaagcccagggcttgtcatttgcgcaggtgagacttctcgaaggtaacttctcactttgcgtcgagaataaaaacggctcaggtccttttttgggaaatatcccaaagcagtactgcaaccagatcttgtggttcgactccactgatggaacatttatgccgagcatagacgtcacaaatgaaagcaggaacgacgatgatgatacatcggtatgcctgggtactcgacagtgtagctggttcgccggctgtacaaaccgcacctggaacagttcagcagtgcctttgatcgggctgcccaatacacaggactataaatgggtggacagaaatagtgggctaacctggtcagggaacgacacgtgcctctactcctgccaaaaccaaacgaaaggactcctgtaccagctctttaggaatctgttttgcagctatggccttaccgaggcccacggcaagtggcgatgcgcggacgcttcaattacgaacgataagggccacgacggacacagaactcccacttggtggcttaccggcagcaacctgaccctcagtgttaataacagtggcctgtttttcctctgtggaaacggcgtttacaaaggatttcccccaaaatggtcagggcgttgtggcctcggatatttggtgccatctctcacgaggtatcttaccctcaacgcatctcagattaccaacctccgtagttttattcacaaagtgactccacacagatgcacacagggggacaccgacaatcctcctctttactgcaatcctaaagacaactccacaatcagagcattgttcccatccctgggcacctatgacttggagaaagcaattttaaatatttctaaagcaatggagcaggaattctcggcaactaagcagactttagaagctcaccagtcgaaggtttccagcctggcatcagcatctagaaaggaccatgtcctggatatccccacaactcagaggcagaccgcttgcgggaccgtgggcaaacagtgttgtctctatataaattactccgaagagatcaagtctaacattcagcggcttcacgaagctagcgaaaacctgaaaaacgtaccgctcctcgactggcaggggatttttgctaaggttggtgattggtttaggtcttggggatatgttcttctgatagtcctcttttgtctctttatttttgtgctcatctacgtgcgggtcttccgaaaaagcagacgcagcctgaactctcagccattaaacctggcgctcagcccgcagcagagtgctcagctcctggttagcgaaacctcttgtcaagtgtccaatcgtgccatgaaaggactgactacacatcagtacgacaccagtctgttgtag

SEQ ID NO: 46979 - DNA, 1692 bp, Artificial Sequence
  Description of Artificial Sequence: Synthetic coding sequence
atgggcagcctgagcaactacgccctgctgcagctgaccctgaccgcatttttgaccatactggtccagccgcagcatctactcgcgcctgtgtttcgcactctttcaattctgacaaaccaaagcaactgctggctctgtgaacatctggataacgcggagcagccagagctggtgtttgtgcctgcctcggccagtacttggtggacctacagtggccagtggatgtacgagagagtgtggtaccctcaagccgaagtgcagaaccatagcacctcttcatatagaaaagtcacctggcactgggaagcgtctatggaagcacaaggtctctcttttgcacaggtgcggctgctggagggaaattttagcttgtgtgtcgagaacaaaaacggtagcgggccctttctgggcaatattcctaagcaatactgcaatcagattctttggttcgacagcacagatgggacatttatgcccagcatcgacgtgacaaacgagtcacgcaatgatgacgacgatacttctgtttgcctgggcacaagacaatgcagctggttcgcaggatgcaccaacagaacatggaattccagtgctgtgccactcattggcttgcccaatactcaggattacaaatgggtcgacagaaactctggattgacgtggtcaggaaacgacacttgcctgtattcatgtcagaatcagactaagggtttactctaccagctgttcagaaacctcttttgtagctacggacttaccgaggcccacggaaaatggaggtgtgccgacgcatctatcacaaacgacaagggacatgacgggcaccgcacaccaacatggtggctcactggcagtaacctaactctttcggttaacaacagcggattgttcttcctgtgtgggaacggggtatacaaaggattcccccccaagtggtcgggtcgctgcgggctagggtatctggttccttccttgacccgctacttgaccctaaatgcttcccaaataaccaacttaagaagtttcatccataaggtgactcctcacagatgtacacagggcgatacagacaatccccctttgtactgtaacccaaaggacaatagtactatcagggctctctttccgagcctcggcacttacgaccttgagaaagcaattctcaatatttcaaaagcaatggagcaggagttcagcgccaccaaacagaccctcgaagcgcaccagagcaaggtgagctcgctcgcatccgcctctagaaaagatcacgtactggacattcccacaacacagagacaaaccgcctgcggaacagtggggaagcagtgctgcctgtatattaactattccgaggagatcaaatcgaatatccagcgcctacacgaggctagcgaaaacttgaagaacgtcccactcctggactggcaggggatcttcgcaaaggtcggagattggtttaggtcctggggatatgtcctgctgattgtgctgttctgcctcttcatttttgttctgatttatgtaagggtttttaggaagtcacgaaggtcactgaactcccaaccactgaatctagccctatctccacagcaatccgcccagttactggtcagcgagacctcctgtcaagtgtctaatagagccatgaaaggtctgactactcaccaatatgacacaagcctcttatag

SEQ ID NO: 46980 - DNA, 1608 bp, Artificial Sequence
  Description of Artificial Sequence: Synthetic coding sequence
atgaccgagaagttcctgttcctgtacctgagcctgctgcccatgccattgttgagccaggcgcagtggaatgagaattcgctggtttcctttagtaaaattattgcttccggtaatcatctctcaaattgctggatctgtcataacttcatcacccgatcatcctcatatcagtacatcttggttcggaatttctccctcaacttgactttcggatcggggatccctgaaggccaacataagagtgtgcctctgcaggtaagcctggcaaatagcgcacaccaggtgccttgtctagacctgaccccacctttcaaccaaagttcaaagacttccttctacttttataattgttcaagtctcaaccaaacctgctgcccctgccctgagggacactgcgacagaaagaatacttccgaggaggggtttccctcacccacaatacatccaatgtccttctccccagctggctgccacccgaatctgactcattggtgcccagctaaacagatgaatgactatagagataagagccctcaaaatcgatgcgccgcttgggaaggaaaagagctgattacttggagggtactctattctctccctaaggctcacacggtgcctacctggccaaagtccacggtcccgttgggcggtcccctatcccctgcatgtaaccagacaattccggccgggtggaaaagccagctccacaaatggtttgactcccacatccctagatgggcatgcacccctcccggttatgtgttcctttgcggacctcaaaaaaacaagttgccctttgatggctcccccaagattacatatagcacccctccagttgccaacctgtacacgtgcatcaataatatccagcacaccggcgagtgcgccgtgggattgctcggacccagagggattggcgtgactatttataacacaactcagccaaggcagaagcgggccctggggctcattctggcaggaatgggcgctgcgattgggatgattgccccatggggcggtttcacgtatcacgacgttactctgagaaacctctccagacagatagacaacatcgctaaatcaactcgggatagcatctcgaaattgaaagctagtattgactccctcgccaacgtggtcatggacaacagactcgccttggattatttgcttgcagagcaagggggggtctgcgccgtgatcaacaaaagttgctgcgtgtacgtaaacaatagtggcgccatcgaagaagatattaagaaaatctatgacgaagctacctggctacacgacttcggcaagggcggagccagtgctagggcaatctgggaggcggtcaagtctgctttgccctccctcaactggttcgtgcccttactgggccctgcgaccgtcattctgctactgttccttttcgggccctgcttcttcaatctcttgataaaatgcgtttcgtctcgcattaagcagttccatatgaaatctccacaaatggaacgataccagctgagcgttatcggggggccatccacttataagcacattagccctttagacgcctccggtcagaggttcagggagaccatggaagagttctcactatag

SEQ ID NO: 46981 - DNA, 795 bp, Artificial Sequence
  Description of Artificial Sequence: Synthetic coding sequence
atggccctggaggccgccggcggcccccccgaggagaccctgagcctgtggaagagggagcaagccagactcaaggctcatgtagtggacagggacactgaggcctggcagcgcgatcctgccttcagcggactgcagcgggtcggtggcgtcgatgtctccttcgttaaaggggacagtgtgagagcatgcgctagcctcgtcgtgctatccttcccagaattagaggtgcttctggtcgacggaaatggcgtgctgcaccaccgaggcttcggagtcgcttgccacctgggcgtgctgacagacttgccttgcgtaggagtggcaaaaaagctgttgcaagtagacggcttggagaacaacgccttgcataaggagaagattaggttattgcagacaaggggcgattcattccccttgctgggtgacagcggtaccgtgctgggtatggcactgcggtcacacgacagaagcacgcggcctctgtacatttctgtaggacacaggatgtccctcgaagcggctgtgaggcttacctgttgttgctgtaggtttcggataccagagcccgtgagacaggccgacatttgctcaagggaacatatacgaaagtcgcttggcctccccggtcctcctaccccccggagccccaaggcacagcggccggtggcctgtccaaaaggagacagtggagaatcatccggcgaaggccagccgcctcaggatcacagtcccgggccacggacagccccacgccctggatcccaagagcaagccggcaaggactggcagtag

SEQ ID NO: 46982 - DNA, 849 bp, Artificial Sequence
  Description of Artificial Sequence: Synthetic coding sequence
atggccctggaggccgccggcggcccccccgaggagaccctgagcttatggaaaagagagcaggcacggctgaaagcacacgtcgtggatcgggatacagaagcgtggcagagggatccggccttctctggcctgcaacgggtgggaggggtcgatgtcagctttgtgaagggggactctgtgcgggcatgtgcttccctcgttgtcctatcatttcctgaacttgaggtggtctatgaagaatccagaatggtgtccctgacagctccttatgtgtccgggttcttagcatttcgcgaggtccccttcctgctggagctggtgcagcagctacgggagaaggaaccggggctgatgcctcaagtgcttttagtcgacggaaatggagttctgcaccatcgcggctttggagtggcatgccacctaggcgtgttgactgacctgccctgtgtcggagtagcgaaaaagctcctacaggtcgacgggcttgagaacaatgctctacataaagagaaaatccggttacttcaaacgcggggagactcgttccctctactcggcgatagcggaaccgtcctggggatggccctgcggagccatgatcgcagcacgcggcccctgtatatctcggtggggcaccggatgtcactggaagctgcagtccggctgacttgttgctgctgcagattccgcatacctgagcccgtgagacaggctgatatttgctcccgggaacacataagaaagagtttgggtctgccgggcccacccacgcctcgcagccctaaggcccagcgcccagtggcgtgtcctaagggggatagcggtgaatctagtgcgttgtgctag

SEQ ID NO: 46983 - DNA, 714 bp, Artificial Sequence
  Description of Artificial Sequence: Synthetic coding sequence
atggccctggaggccgccggcggcccccccgaggagaccctgagcctttggaagcgggaacaagcaagattgaaagcgcacgtggtggatagggacactgaggcctggcagcgggatccagctttttccggattacagcgcgtgggcggcgttgatgttagcttcgtgaagggggattccgtcagggcgtgtgccagcctggtagtcctctctttccccgaactggaggtgctgttggttgatggcaatggcgtgttacaccatcgaggcttcggagtcgcctgtcacttgggtgtcttaaccgatttgccttgtgtcggggttgccaaaaagctgctgcaggtagatgggctagagaacaatgctctgcacaaagagaaaataaggctgctgcagacccgcggcgatagttttcctctgttaggggactctggcaccgtcctcggcatggcactacgctcacacgaccgatccactcgccctctgtatatctctgtcgggcatcgcatgagtctcgaggcggcggttaggctgacctgctgttgttgtaggtttaggatccccgagcctgtgaggcaggccgacatttgtagccgcgaacatatccgcaagtctctgggcctgcctggtcctcctactccacgatctcctaaagcacagcggcctgttgcgtgccccaagggcgacagcggtgagtctagcgcgctctgctag

SEQ ID NO: 46984 - DNA, 771 bp, Artificial Sequence
  Description of Artificial Sequence: Synthetic coding sequence
atggaccccacctgcagcagcgagtgcatctacaacctgatccccagcgacctgaaggagcccccccaaccacccaggtacatcagcatattcaaggccacagtgaaagacgatatgcagaaggccaaaacagctatgaagactatgggccctgctaaagtcgaggtcccctcccccaaagattttctgaaaaaacactcgaaagaaaagacactacctcccaaaaaaaacttcgaccgcaacgttcccaaaaagcccgctgtgccactgaaaactgatcatccagtcatgggaattcagtccgggaaaaacttcatcaatactaatgctgccgatataatcatgggagtagcgaagaagccaaaaccaatctatgtcgataagagaaccggcgacaagcacgacctggagcccagcggactggtccccaaatatattaataaaaaggactatggcgttacccctgaatatatttgtaaacgcaacgaggagattaagaaagcccaggaagactacgataggtatatccaggagaatctgaagaaggctgccatgaagcgactgtccgatgaggaaagggaggctgtgctgcagggcctgaagaagaattgggaggaggtccacaaggagtttcagtcactaagcgtgtttattgactccatcccaaaaaagattcggaagcaacggctagaggaagagatgaaacagttagaacacgatataggtattattgaaaaacacaaaattatatacatcgccaacaatgcctag

SEQ ID NO: 46985 - DNA, 768 bp, Artificial Sequence
  Description of Artificial Sequence: Synthetic coding sequence
atggaccccacctgcagcagcgagtgcatctacaacctgatcccctctgatctgaaagaacccccacaacctccccggtatatcagcatcttcaaagccactgtgaaagacgacatgcagaaggcgaaaaccgccatgaagacgatgggcccggccaaagtggaggtgccatcccccaaggactttcttaagaagcactcaaaagaaaagaccttgccgcccaaaaaaaactttgatcgtaacgtccccaagaagcccgcagtaccactgaagaccgatcaccctgtgatgggaatccagtctggaaagaactttatcaacaccaacgctgcagacatcattatgggcgtcgccaagaagcctaagcctatctatgtggacaagaggactggagacaaacatgacctagagccatccggtctagtccccaagtatatcaataaaaaggattatggggtgacacccgagtatatctgcaaaagaaacgaagagatcaaaaaggcccaggaggactacgaccgctatatccaagaaaatttaaaaaaggcggcaatgaaaagacttagcgacgaggagagggaagctgtcctgcaggggctcaagaagaactgggaggaagtgcacaaggaattccaatcgctttctgtgttcatcgattcaataccgaaaaagatccgcaagcagcggctggaggaagagatgaagcagttggagcatgatatcggaatcatcgaaaagcataagatcatttacattgccaacaaatag

SEQ ID NO: 46986 - DNA, 771 bp, Artificial Sequence
  Description of Artificial Sequence: Synthetic coding sequence
atggaccccacctgcagcagcgagtgcatctacaacctgatccccagtgacctaaaagagccccctcagccacctcgatacatctccatttttaaagccaccgttaaagatgacatgcaaaaggccaaaaccgccatgaaaacaatggggccagcaaaagtggaagtgccgagccccaaggattttctgaaaaagcactctaaagagaagactctcccacctaaaaaaaactttgatagaaacgtgcccaagaagccagccgtacccctgaagactgatcaccccgtaatgggaatccagagcggcaagaatttcatcaatacaaatgctgccgatatcatcatgggagtggccaagaagcctaagcctatttacgtagacaaaaggaccggggataaacatgatttggaaccctccgggctggtgccaaaatacattaataaaaaagactatggggtgacccccgagtacatctgtaagcggaacgaggagatcaagaaagcccaggaagactacgacagatacatacaggagaacctgaagaaggctgccatgaagcgcctaagcgatgaggagcgcgaagcagtactgcaggggctgaagaagaactgggaggaagtgcataaggagtttcaatctcttagcgtgtttatcgacagcatacctaaaaagatccgtaaacagcgcttggaagaggaaatgaaacaacttgaacatgatattggaatcatagaaaaacacaaaattatatacattgccaacaatgcttag

SEQ ID NO: 46987 - DNA, 1305 bp, Artificial Sequence
  Description of Artificial Sequence: Synthetic coding sequence
atgagcatcgagaagatctgggcccgggagatcctggacagccgggggaatccaactgtagaagtggatctgtatacagcaaaaggcttattccgcgccgccgtcccaagcggagccagcaccggtatttacgaggccctcgaactgagagatggggacaaacagcgctatctcggaaaaggcgtgctgaaagcagtggaccacattaattctacaatagcaccggctcttatcagcagcgggttgagtgtagtcgagcaggagaagctggacaacctcatgctggagttagacggaacagagaacaaatctaagtttggagccaacgcgatccttggcgtgtcattggctgtctgtaaagccggcgctgctgagcgagaattgccattatatcggcatatagctcagttggctggcaactcagaccttattctccccgtaccagcttttaacgtcattaacggcggatcacacgctggcaataagctggccatgcaggagttcatgatcctcccagttggggcagagtctttccgcgatgcaatgagacttggagcagaagtgtatcacacactgaaaggtgtgattaaagataaatatggtaaggatgcaaccaacgtgggcgatgaaggtggatttgcccctaacattttggaaaattccgaggcactggagctggtaaaagaggcaattgataaagcgggttacaccgaaaagatcgtgattggtatggacgtagcagcaagcgagttttaccgcgatgggaaatacgacttggatttcaaaagccccaccgatccctcacgctatatcacaggggaccagctaggcgcactataccaggactttgtgcgcgactaccccgtagttagtatcgaagaccccttcgatcaggatgattgggctgcttggagcaagtttacggcaaatgtggggatccagattgtcggcgatgatctcacagtcacaaaccccaagcggatagagagggcagtggaggaaaaagcctgcaactgccttcttcttaaagtgaatcagataggttctgtaacagaagctatacaggcttgcaagctggctcaagaaaacggctggggggtgatggtgtcacaccgaagtggggagacggaagacacatttatcgctgatctggttgtgggtttatgtaccgggcaaatcaagactggcgccccctgtaggtccgaacgcctggctaaatataatcagcttatgcggatagaagaagaactgggcgacgaagctcgcttcgctgggcacaatttcaggaatcctagtgttctttag

SEQ ID NO: 46988 - DNA, 1887 bp, Artificial Sequence
  Description of Artificial Sequence: Synthetic coding sequence
atggaggaggagggcggcggccggagctgcggcaccacccgggagctccaaaagctcaagcagcaggctatggagtactatagagaaaacgacgtgccaaggcggctggaggaactgttgaattctaccttttaccttcagcccgcagatgtatatggtcaccttaaagcaaattgcttcagcaagctggcgaagcccccaaccatatgtaaaattgttggcaaggacgtcctcgacgggctgggcctccctacactgcaggtcgacatattctgcaccatccagaatttccccaagaacgtgtgttctgtagtgatttccacgcactttgaggtccacgaaaacgcccttcccgagttagctaaggccgaggaagccgagagagccagtgccgtatcgactgccgtacaatgggttaattcaactattacccatgagcttcagggtatggctcctagcgatcaggcagaagtcgaccatcttttgcgtatcttttttgcaagcaaggtccaggaagacaaaggccgaaaagagctcgaaaagagtttggagtatagtacagtgccgacgcctctacccccggtacctcccccaccaccccccccacccccaaccaagaagaaaggccagaaaccaggcaggaaagacacaataacagagaagcccatcgcccccgctgagcctgtggaacccgtattgtcaggctctatggccataggcgctgtaagtctggcggtggcaaaggcttgtgcaatgctactaaacaagccactctacctcaatatagcactgctaaaacacaaccaggaacagccgacaacattaagcatgcctttgcttatggtatcgctggtgtcctgtgggaaatcttcttccggtaaactcaacctaatgaaggaggttatatgtataccacaccctgagctgacaacaaagcaaggagtcgaaatgctaatggagatgcagaagcacatcaataagatcatcgaaatggtctcccctagcccacccaaggccgaaaccaaaaaagggcacgacggtagtaagcggggccaacagcagatcacaggtaagatgagtcacctcggctgtttgacgataaactgcgatagcattgaacagccgctcttactcattcaggagatttgtgcgaatctaggactcgagctcggaaccaatcttcatctcgctataaattgtgctggacacgaattgatggattataacaaagggaagtacgaggttatcatgggcacctacaaaaacgcagctgagatggtggacctatatgtcgacctaatcaacaagtacccctcaataattgcactgattgacccgttccgcaaagaagactctgagcaatgggatagcatctaccacgctctgggatcccgatgctatattatcgctggcacagcatcaaagagtatcagcaaactgctggaacagggaaacatcagcatccccaagagcaatggccttatcatcaagcatactaaccaaacaacaatgtccgacctggtggagatcaccaatctcattgattccaagaagcacattacagtctttggaagcacagagggagaaagttctgatgatagccttgtggacttagcagtcggccttggagtcaggttcatcaaactcggcggtttgtccaggggcgaacgtgtaactaagtataaccgactgttgacgatcgaggaagagttggtgcagaatgggaccctcggatttaaggaggagcataccttcttctacttcaatgaggaagcggaaaaggctgccgaggcacttgaggctgctgcagctagggagccactcgtgcctacattccccacccaaggcgtggaagagtctgccgaaaccggcgcaagctccggttag

SEQ ID NO: 46989 - DNA, 1824 bp, Artificial Sequence
  Description of Artificial Sequence: Synthetic coding sequence
atggccttccggcggcaggtgaagaacttcgtgaagaactacagcgacgctgaaataaaggtcagagaggctacatccaatgacccatggggaccctccagttctctgatgctggacatctccgaccttacgtttaacacaattagcctgtccgaaatcatgaatatgctgtggcatcgactcaacgaccatggcaagaattggcggcacgtctataaatcgttgaccctgatggactatctcattaagaacgggtctaagaaggtgattcaacactgtcgcgaaggtttttgcaacttgcagacgttaaaagactttcaacacattgacgaggctgggaaggatcagggctactacatacgggagaagtcaaaacaagttatcacactcttgatggacgagcctttactgtgcaaggaaagggaggtggcctgccggacacgccaaagaacctcgcactccatcctgttcagcaagagacagcttgggtcttctaacagcctgacagcatgtacttctgcccccaccccagatattagcgcaagtgagaagaagtataaattgccaaaattcggtcggctgcataataaacggaacgtttgcaaggcaggcctgaaacaagagcattgtcaggacgtgcacctgccgaccgagaccatgttgtcacaagaaactctgcccctgaaaatccatgggtggaaatccactgaggatctgatgacgttcctggacgatgaccccgaacttcccctattagccacgcccccttcaatagtcagccctattacatgcctgtccgaagctgaagaggtgtgtaacctgtctggagccgacgctgtccctaccctctccgagaattccccttccggccagagagacgtcagcttggacaagagatccgatggaattttcacaaatacggttactgaaaacctattggagaccccgctcgaaaagcagagcgctgccgaaggcttaaagactctgacaattctgcctgcatgttggagctctaaggaagagtttattagccctgacctgcgagtgagtaaatcagactccacattccacaatcaggcgtctgtcgaaaccttgtgtctgagtccttcatttaagatctttgacagagtgaaggagatagtcatcaataaagcttaccagaagcccgctcagtccagcatccagatggatgacaaaattctgaagaccacaacacgcgtctctaccgcttccgagggagcgtcttctttttcacccctcagcatgtcaagtcctgacctggcttcacccgagaagtctgcacacctgctgtcacccattctagcaggtcccagcttttggactttgtcacaccagcagctgagctctactagcttcaaagatgaggacaaaacagccaagctccatcattctttcgctagtcgggggcctgtgtccagtgatgtagaagaaaatgattccctcaacctgctgggtattttgccaaacaattcagactccgctaagaagaatattagtcacatatcctccagccactggggggaattttcgacccagaacgttgaccagttcatcccactgtcgtgttcagggttccaatccacaaaagatttcccacaggagccggaagctaagaactcaatctcagtattgttgcgcgaagtcaagcgcgcgatcgcccggctccacgaagacctgtctacggtcatccaggaattgaatgttatcaacaatatccttatgagcatgtctctcaactcatcgcagattagccagtcatcccaagtgccacagagcagcgaaggaagcagtgaccagatctag

SEQ ID NO: 46990 - DNA, 906 bp, Artificial Sequence
  Description of Artificial Sequence: Synthetic coding sequence
atgcaggccagcgccgaccaggtggagcgggacatcctggagacccagaaaagactgcaacaagaccggctcaatagcgaacagagtcaggcactgcaacatcagcaggagaccggcagctccttaaaagaagccgaggttctgcttaaagatctcttcctagacgttgataaggctcgcagactcaagcaccctcaggccgaagaaactgagaaggacatcgagcaattacacgagcgcgttacacaagagtgtgcagagtattgcgctctttacgagaagatggtcctgccaccaagaagagggatacagggccggctgggaacgcgtgcgggtgcggagacagaagctggtctgaggcgccctgtatgggctggccacggaggagctgggggtacagatcggggggcgcaacatcgcgccgagggcgaccaacgtccacggagagcggccgcagagcccggcggggccgggtgccgtcatcaccctgaacccattccaagaccaacagaaggcggcgtagtggctagagccgagcccggccaacctgtgcacgcactacagggctgcacatggcagctgtctgcactcgccgaacaacagagacggatcttacagcaggattggtccgacctaatggcggaccctgcgggggtgcgtagggagtacgagcactttaaacagcatgaattattaagtcaggagcaatccgtgaaccagctagaagaggacggcaagagaatggtggagctccggcaccccgctgtaggaccaatccaggcgcaccaggaggctctcaagatggagtggcaaaactttttgaatctctgtatctgtcaggagacacagttgcagcacgtcgaggattattctagaatactctgcccttcaagctctccccactag

SEQ ID NO: 46991 - DNA, 1038 bp, Artificial Sequence
  Description of Artificial Sequence: Synthetic coding sequence
atgcagcacgtgagcagcagccagagcagccagcggcacgtgcagtggccaggagcatgcccaggtgccggggaggagcagccggcatgttcccagccaagcctgcccctgacactacctagtccatcccaccaactgcaacaactgatggacggctctggtcttacacaaatcgctcagggagctcaagtgcagcttcaacatcctgggacccccatcacagtgagggagcgccgtccgagccagccccatacccagtcaggaggtacgatccaccacctcgggccccaatcaccagcagctgcagggggcgcaggactgcagcctctcgcctcccctagccacatcacgacagcaaacctgccacctcaaccccgacctctgggctttgagcggacacctggcgttctcctgcccggggccggtggcgcagcaggttttggcatgacctccccccccccccccacatccccttcccggaccgccgtcccccccggcctgtcctctctgccactaacgtcagtaggcaacaccggaatgaagaaggtgcctaagaaattagaggagataccaccggcgtcacccgagatggctcagatgagaaagcaatgtttagattaccatcaccaggagatgcaggccctcaaagaggtgtttaaagagtatcttattgagttatttttcttacagcattttcaaggcaacatgatggattttcttgccttcaaggagcgactctacggtccccttcaggcttatctgcgccaaaacgacctggacatcgaggaggaagaagaggagcacttcgaagtgattaacgacgaggtcaaagtggtggcccgaaagcatgggcagccgggcaccccggtggccatcgctacccagcttccacctaggacttcagccgccttcccggctcaacagcaacctcttcagccgttagctcctactacggtgctatcagttagcgctgactggaatgcgctactgcaaagacccaataagtatatatggggcctccaatatttagaaatgtag

SEQ ID NO: 46992 - DNA, 1467 bp, Artificial Sequence
  Description of Artificial Sequence: Synthetic coding sequence
atgcagcacgtgagcagcagccagagcagccagcggcacgtgcagtggcctggcgcgtgcccaggggctggggaggaacagccagcatgttcacagccttccttaccattaaccctcccttcaccctcccatcaactgcaacagctgatggtaaggggcggacccgcaggcggtcagaatatgaatgtcgacctgcaaggggtcggccctggtcttcagggatcaccccaggttacactggccccccttcccctaccgtctccgactagtccagggttccagttctcggcccaacctcggagattcgaacacgggtcaccatcctacatccaagtgacgtcccctcttagccagcaggttcagacacaatcaccaacccagcctagccccggccccggtcaagcactccagaatgtgcgggccggggcaccggggcccggcttggggctctgttctagctcaccaactggggacttcgtggatgcatcagtgctagtccggcagatcagcctttctccttcctctgggggacactttgtgttccaggatggaagcggcctgacacagattgcacagggagctcaggtccagctccagcatccgggaacaccaattaccgtgcgggagcgccgtccatcgcaaccccatacacagtcaggaggcaccatacatcatttaggccctcagtctcctgctgcggcaggcggtgccgggctgcaaccccttgcaagccccagccacataactaccgccaatttgccaccccagatctcatcaattattcaaggccagctggttcaacaacagcaagtgctgcagggcccccccctgccgcggcctctgggatttgaacgaactcccggggtgctgttgcctggcgccggaggggctgctggatttggcatgacctcacctccaccacccacgagccccagtcgcacagccgtcccaccaggactatcctccctgcctctcacttccgttggaaacacgggcatgaaaaaggtgcccaaaaaacttgaagaaattcctcccgccagtcctgagatggcccagatgcggaagcaatgcctggattaccaccatcaggagatgcaggcgctgaaggaggtttttaaggaatatttaatagagctcttctttctccagcacttccagggaaacatgatggacttcctggccttcaaagagcgcctctacggacctctgcaagcctacttgcgacagaatgatctggacattgaggaggaagaagaagaacattttgaagtcattaacgatgaggtgaaggtagtggcgcggaagcacggccagcccggaaccccagtcgctatcgcaacccagcttcccccccggacctcagcagcctttcccgcgcagcagcagccattgcaacagatccatatgggaactcccgtccccggggacgtgaacagtatcaagatggaagcttccaagcgccagtag

SEQ ID NO: 46993 - DNA, 1260 bp, Artificial Sequence
  Description of Artificial Sequence: Synthetic coding sequence
atgcagcacgtgagcagcagccagagcagccagcggcacgtgcagtggcccggcgcctgtcccggcgccggggaagaacagcctgcctgttcccagcctagtctgccgctcaccctgcctagcccctctcaccaattgcaacagctgatggtccagacccaatcacctacccagccttcacctggccccggacaagcactccagaacgttcgtgcaggggctcccggcccgggattgggcttatgtagttctagtcccacaggcgattttgttgacgccagtgtactcgtccgccagatcagcctctctccctccagcggcggtcactttgtgtttcaagatggcagcgggttgacccaaattgctcagggggcccaggtgcaattgcagcaccctggcacacccattacagtgcgggaaagaaggccttcccaacctcatacacaatccggtggaaccattcaccatctcgggccacagtcacccgctgccgccggcggagcgggtctgcagccattggcaagcccatctcacatcactaccgccaatctacccccacagatttcaagcatcatacagggacagctagttcaacagcaacaagttttgcaaggaccccccctgcctagaccactgggattcgagcggacaccaggcgtgcttctccccggcgccgggggtgccgccggatttgggatgaccagcccaccacccccaaccagtccttcacgcactgccgtgccccctggactctccagtctcccactgacaagcgtcggcaatactggaatgaagaaagtgcctaagaaacttgaagagattcctccggcatcccccgaaatggcacagatgagaaaacagtgtctggactatcaccaccaagagatgcaagcactgaaagaagttttcaaagaatatctcatcgaattgttcttcctgcagcactttcagggtaacatgatggactttctcgcctttaaagaaagactgtacggaccactgcaagcatacctccggcagaacgacctggacattgaggaggaagaagaggaacacttcgaagtcattaacgatgaggtcaaagtggttgcgcggaaacatggccagcccggcacacctgtggcgatcgccacccaattgccccccagaacaagcgcggccttccctgcccaacaacagcctcttcaggtactctcggacggcagcacggtacagcttcctcgcttgagctcactgggcttcgaggacagcatgtgctag

SEQ ID NO: 46994 - DNA, 1071 bp, Artificial Sequence
  Description of Artificial Sequence: Synthetic coding sequence
atgcagcacgtgagcagcagccagagcagccagcggcacgtgcagtggccaggggcgtgccctggtgccggagaagaacagcccgcatgctcacagccttccttacccctgaccctgcccagcccaagccatcagcttcaacagctcatggatggttctgggctcacccaaatagcccagggcgcccaggtgcagctgcagcaccctgggacacccatcacggtgcgtgaacggcgtccctctcaaccgcacacccagtctggcggcacaatccaccacctcggaccccagtctccagctgccgccgggggagccgggcttcagccattggctagtccatctcatattacaaccgccaacttgccaccccagatcagcagtatcatccagggacagctcgtgcaacagcaacaggtgctgcagggcccccctctgcctcggcctctgggctttgagaggactcctggcgtactgctgcctggggccggtggagctgctggctttggaatgactagccctcctccccctacttccccaagcagaacagctgtccctcctggcctttcgtccctccctctgacttcagtgggaaacactggcatgaagaaagtgccaaaaaaactagaagagattccaccagcttcaccagagatggctcaaatgaggaagcagtgtcttgattaccatcaccaggagatgcaagcgctgaaggaggtgttcaaagaatacctgatcgaactcttctttctccaacattttcagggcaatatgatggacttcctggctttcaaagaaagactgtatggcccactgcaggcatatttgagacagaacgacctcgatatcgaagaggaggaggaagagcattttgaagttatcaatgatgaggtcaaggttgtggctagaaaacatggacaacctgggacccctgtggcgatcgcaacccagttgccaccccgcacctctgctgctttccctgcccagcagcaacctttgcaggtgctgtctgatggatcaacagtgcaattgcctagactctcttcactgggcttcgaggattctatgtgctag

SEQ ID NO: 46995 - DNA, 654 bp, Artificial Sequence
  Description of Artificial Sequence: Synthetic coding sequence
atgcagcacgtgagcagcagccagagcagccagcggcacgtgcagtggccgggagcttgtcccggggccggagaggaacagcctgcatgtagccaacctagtctccccctgacccttcctagcccatctcaccagctccagcagcttatggacggatcagggcttacccagatcgcccagggtgcccaggttcagcttcagcaccccgggactcctatcacagtcagagaacggcgcccatcgcaaccacatactcagtccggtggtacgattcaccaccttggccctcagtctccggcagctgcggggggggcagggttacagcctctggcctctccgagccacattaccactgcgaacctgccgccccagatcagctccatcatccagggccaactcgtccagcagcagcaggttctgcaaggccctccacttcctcgcccacttgggtttgagaggacgcctggggttctccttcctggtgccggaggtgccgcaggattcgggatgactagtcccccccctccaactagcccaagtagaacagccgtccctccaggcctctcaagcttacctctgacatccgtgggtaacacagggatgaagaaagtgcccaagaagctggaagaaattccccctgcaagtcccgaatag

SEQ ID NO: 46996 - DNA, 1071 bp, Artificial Sequence
  Description of Artificial Sequence: Synthetic coding sequence
atgcagcacgtgagcagcagccagagcagccagcggcacgtgcagtggcctggagcttgtcctggagcgggtgaagagcagcctgcctgtagccaaccatcattgcccttgacgttaccaagccctagccatcagttgcagcaactcatggacggatctggcttgacccagatcgcccagggggcgcaggtgcagttacaacatccaggaacccctattactgtgcgtgagagaaggccctcgcagccccatacccagtcaggaggaacaatccatcatctcggacctcaatcacctgccgctgctggcggcgccgggctccagcctctggcctcaccgtcccacatcaccacagctaatcttccaccacaaatcagctctatcatccaaggccagctggtgcaacagcagcaagtgctgcagggaccaccactaccccgccccctcggttttgagcgaacccctggcgtgctgctgcccggagctggaggagcggccggctttggaatgacgtcaccgccgccccctacatctccaagcaggaccgccgtccctcctgggctctcatcgctccccttaacctctgttggaaacaccggcatgaagaaagtgcctaagaagttggaagagatacccccagcctctccagaaatggcccagatgaggaagcagtgcctggactaccatcatcaggaaatgcaggctttaaaagaagtgtttaaagagtacctcatcgaacttttttttctgcagcactttcagggcaatatgatggacttcctggcatttaaagagcggctctacggcccgctccaagcatatttgcgacaaaacgacctggatatcgaggaggaggaggaggaacacttcgaggtcatcaatgacgaggttaaggtcgtggctcgcaagcacgggcaacctggtactcccgtcgccattgccacgcaactccccccccggacatccgcggcgtttcctgcccaacagcagcctttgcaagtgttaagcgacggtagcactgtgcaacttcccagactgtccagcctcggctttgaggacagtatgtgctag

SEQ ID NO: 46997 - DNA, 672 bp, Artificial Sequence
  Description of Artificial Sequence: Synthetic coding sequence
atgcagcacgtgagcagcagccagagcagccagcggcacgtgcagtggccgggtgcctgccccggtgccggtgaagagcagcctgcctgctcacagccatccctgcctttgaccctgcctagcccctcccaccagttacagcagctgatggtgcagacgcaatcaccgacccagccaagccctggtccagggcaggccttgcagaatgtgcgcgcaggcgcacctggacccggcctcggcttgtgtagttcctccccaacgggcgattttgttgacgcttcggtgctggtgcggcaaatcagtctgagccccagttccgggggccactttgtctttcaagacggctccggtctaacacaaattgcccagggggcgcaggtgcagctccagcatcccggtacccctatcaccgttcgcgagcgacggccttcccagcctcatacacaatctggaggaaccattcaccatctcggcccacaatctccagctgctgccggtggagccggactccagcctcttgcttcaccgagtcacattacaacagccaatctgccgccacaaatctccagcatcattcaggggcagctggtgcagcaacagcaggtcttacaaggaccccctctcccaagacctttaggcttcgagagaacccccggggtgctgctgccctag

SEQ ID NO: 46998 - DNA, 471 bp, Artificial Sequence
  Description of Artificial Sequence: Synthetic coding sequence
atgcagcacgtgagcagcagccagagcagccagcggcacgtgcagtggccaggcgcctgtcccggagctggcgaagagcagcctgcctgttctcagccctctctgcctctgacattacccagccccagccatcagctccaacagttaatggtacagacacagagcccgacacagccctcccctggcccaggacaggcccttcaaaatgtgagagccggcgcacccggaccgggcctgggactatgcagctcttcaccgaccggcgacttcgttgacgccagcgtcctggtgcgtcagatttctctttcgccaagttctggtgggcactttgtgtttcaggatggctccggtctaacgcagatcgcacaaggtgcacaagtccaactgcaacatcctggcaccccgatcacggtgcgggaaagaagaccctcacagccccacactcaaagcggcggaaccatccaccactag

SEQ ID NO: 46999 - DNA, 3393 bp, Artificial Sequence
  Description of Artificial Sequence: Synthetic coding sequence
atgcagttccccagcccccccgccgcccggagcagccccgccccccaggcggctagcagttcagaggcagccgctcctgcgacaggacagccagggccaagttgcccagtgcctggaacctcccgaaggggccggcccggaaccccaccggcaggcagggtggaagaagaggaagaggaggaagaagaagatgttgataaggaccctcatcctacacaaaacacctgtctcagatgtcgacacttttccctaagggaacgcaagagagaaccgcgacggacaatgggcggctgcgaggttagagaatttcttttgcagtttgggttttttttacccctactgactgcatggccgggggattgtagccacgtctctaataaccaagtggttttgctggacaccacaacagtcctcggcgaactcggttggaagacatatccacttaatggttgggacgcaattaccgagatggacgagcataatagacccatccacacttatcaggtctgtaacgtaatggagcccaatcagaacaattggctccggacgaactggatttctagagacgcggcccaaaaaatctacgtggagatgaagttcactctcagagactgtaattccatcccttgggttttggggacttgcaaggaaacattcaatctcttctatatggagtcggatgagagccatggtattaaattcaagcccaaccagtacaccaagattgacaccatcgccgctgacgagtctttcacccaaatggatctcggtgaccggatactcaaactgaacaccgaaatccgggaggtgggtccaatagagaggaaaggcttctatctcgcttttcaagacatcggcgcctgtattgcgcttgtgagcgtgagggtcttttacaaaaagtgcccattcacagtcagaaatctcgccatgtttcctgatactatcccacgagtcgatagctccagcctcgtggaagtgcgcggatcttgcgtaaagtcagccgaagaaagagatacccctaaactctactgtggagcagacggcgactggctggtcccactagggcggtgcatttgttctaccggttacgaggaaatcgaggggagttgtcatgcctgccgtccagggttttacaaagcctttgccgggaataccaagtgctctaagtgccctcctcactcgcttacctatatggaggctaccagtgtgtgccagtgcgagaagggatattttcgggcagagaaggatccaccaagtatggcctgcacaagacctccgtcagctcctcggaacgttgtctttaacataaatgaaaccgccctgatactggagtggtccccaccctccgacacaggagggcgcaaggacctcacttattctgtcatctgcaaaaaatgtggactggacacgagtcagtgcgaggattgcgggggtggactgaggtttatcccacggcacactggactcatcaacaatagtgtcatcgtgctggacttcgtgtcccacgtgaactacacatttgagatagaggccatgaatggcgtgtccgaactaagtttctctccaaaaccattcactgctatcactgtcacaaccgatcaagacgcaccatctctaattggagttgtgcgcaaggattgggccagtcagaattccatagccctgtcctggcaagcaccagccttttccaatggagctatcctggactatgagatcaagtattacgagaaagaacatgaacagcttacctacagcagtacacgatctaaagcccccagcgtcatcatcacaggcttgaagcccgctacgaagtacgtgtttcatatccgagttaggacagctaccggctactccgggtacagccaaaaatttgagttcgaaaccggcgacgaaacgagcgatatggccgctgaacagggccagatactggtcattgcaactgctgcggtgggtgggtttacactcctggtcatcttaaccctcttctttctgataaccggacgctgccagtggtatatcaaagctaaaatgaaatcagaagagaaaaggagaaaccatctccagaatggtcatctgcgctttcccggcataaagacatacattgaccccgatacgtacgaagatccttccctggccgttcacgaattcgcgaaggagattgatcctagtcgaataaggattgaaagagtgatcggggccggggagttcggtgaggtctgcagtggacggctcaaaacaccagggaagcgcgagatccccgtggctatcaagacgctgaaaggagggcatatggaccgacagcggcgagattttctacgggaggcctctatcatgggacagtttgatcatccaaacataatccgactggaaggagtggtgaccaaacgatcattccctgctattggcgtcgaggccttttgtccctcttttctaagggccgggttcctaaattccatacaggcccctcatcctgtaccgggcggaggcagcctgccacctagaatcccggcaggcaggcccgtgatgattgtggttgagtacatggaaaatgggagcctcgatagtttcttaagaaaacacgatggtcactttacagtcattcagctggtggggatgctaagagggattgcctccgggatgaaatatctgtcagacatgggttacgtgcaccgagatctcgccgcccggaatatcctggtgaatagcaacctggtgtgcaaagtcagcgacttcgggctgtctcgcgtcctcgaggacgaccccgaggctgcatacactacgaccgggggtaaaatacccattcgttggacagcgccagaggcgattgcttatcgtaagttttcttccgcctctgatgcatggtcctatggtattgtgatgtgggaggtgatgtcatacggggaacgcccatactgggagatgagtaatcaggatgtcatcctgagtatcgaagaaggttacaggctgcctgcccctatgggttgcccggccagcctccaccagctaatgctccattgttggcaaaaagaaagaaaccatcggcccaagtttacggatatcgtgtctttcctggacaaactcattaggaacccttctgccttgcacacgctggttgaagacattttggttatgcccgaaagccctggagaagtccccgaatatccgttgttcgtaactgtgggtgactggctagacagcatcaagatggggcagtataagaataacttcgtcgccgcagggtttacaacattcgatctcatcagtcggatgtcaatcgacgatattcggaggataggcgttattttgatcggacatcagagaagaattgtgtcaagtatacaaacactccgcctgcatatgatgcacattcaggagaaagggttccacgtttag

SEQ ID NO: 47000 - DNA, 726 bp, Artificial Sequence
  Description of Artificial Sequence: Synthetic coding sequence
atggccgccgagcagggccagatcctggtgatcgccaccgccgccgtcggaggtttcacattgcttgtaattctcactctttttttccttatcaccggacggtgccagtggtatatcaaggcgaagatgaaatctgaggagaagagacggaaccatctccagaatgggcacttacggtttccggggatcaaaacttatatcgaccctgatacatacgaggaccccagtctcgccgtgcacgaattcgcaaaagagattgatccctccaggatcaggattgagcgggtcatcggagctggggagttcggtgaagtttgttctggaagactgaagaccccaggaaagagggaaattccagttgccattaagacgctcaagggtggtcacatggaccgacagaggagagattttctgcgagaggctagtatcatgggccagtttgatcaccccaatatcattcgattggaaggagtggtgaccaaacgctccttccccgccatcggagtggaggcgttttgccctagcttcttacgggcagggttcctgaattcgatccaggcgccacatcctgttccgggaggtgggtcgttgccgccacgcatccccgcagggaggccagttatgattgtagtggaatacatggaaaacgggtctttagattcgtttcttcgcctctaccccaaggctgagtataacggaaaacagtgtagcagatactcaatctag

SEQ ID NO: 47001 - DNA, 1005 bp, Artificial Sequence
  Description of Artificial Sequence: Synthetic coding sequence
atgaaggacagccccttccaggtgaccaagctgtactggctgaacgagaagtgggacttcatcgcatccgcatcagacatggccgccgagcagggccaaattttggtgatagccacagctgcagtggggggcttcactctgctggttattctcactctcttctttctgatcaccggtcggtgccagtggtatatcaaagccaagatgaagtctgaggagaagcgccgtaatcacctgcagaacggccatttgagattccccggaatcaagacatacatagaccccgacacctatgaagatccttctctagcagtacacgaattcgcgaaagaaatagaccccagccgtatcaggatcgagcgcgtgattggagcgggagagttcggggaagtgtgctcaggcagactcaagacacctgggaagcgggaaatccccgttgcaattaagacattgaaaggaggccacatggaccgccaaaggcgagactttctcagagaggcgtcaataatgggccagttcgaccacccgaatataatccgccttgagggcgtcgtaactaaaagatccttccctgcaatcggcgtggaggcattttgcccgtcctttctgcgtgccggttttctgaacagtattcaagctccacaccctgtgcccggtggcggaagcctcccaccccgcatcccagctggaagaccagtgatgatcgttgtcgaatatatggagaatgggtcgctagattcttttctcagaaagcatgacggccacttcacagtgattcagcttgtgggcatgttgcgagggattgcctcaggcatgaaatatctgtccgacatggggtatgtgcacagagacttggccgccaggaacatcttggtgaatagtaacttggtgtgtaaggtgtcagactttggactgagtcgggtactcgaagacgaccccgaggccgcctacacgaccaccgacctgttccagaccctcacactaaatctctgctactctgcctag

SEQ ID NO: 47002 - DNA, 858 bp, Artificial Sequence
  Description of Artificial Sequence: Synthetic coding sequence
atgggcggctgcgaggtgcgggagttcctgctgcagttcggcttctttctcccgttactgacggcatggccaggagactgcagccacgtgtccaacaaccaagtggtcctgcttgacacaactaccgtgttgggcgaactgggatggaagacctacccactgaatggatgggacgcaatcaccgaaatggacgagcacaatcgcccgatccacacctaccaggtgtgcaacgtgatggagcccaatcagaacaactggctgcgaacaaactggatttctcgtgatgcggcccaaaagatatatgtagagatgaaatttacccttagagactgcaatagcataccctgggtgctcggcacctgcaaagaaacatttaatttattctatatggaatcagacgaaagccatggaatcaagtttaagcctaaccagtatacaaagattgatacgatagctgccgacgagagctttacccagatggacctgggcgacaggatcctcaagctgaacactgagatcagggaagtgggccccattgagaggaaagggttttacctcgctttccaggacattggggcatgtatagccctggttagcgtacgggtcttctacaagaaatgtcccttcaccgtgcgcaatctagccatgttcccagacaccatcccccgggtggattcttcctccctggttgaagttcgcgggtcgtgtgtgaagagcgctgaggaacgggatacacctaagctttactgcggagccgacggagattggctggtgccattgggtaggtgtatctgctcaactggatatgaggaaattgaggggagctgccatggggcctctaagggaagatgtttttag

SEQ ID NO: 47003 - DNA, 7263 bp, Artificial Sequence
  Description of Artificial Sequence: Synthetic coding sequence
atgagcggccacaccctgccccccctgcccgtgcccggcaccaactccacggagcaagccagtgtgccccgtgcgatggccgctacgctcggggcagggacaccacctcgccctcaggcacggtccattgcaggcgtgtacgtagaagccagtggacaggcgcaaagtgtgtacgcagccatggagcagggccttcttccagccgggcttggccaagccctgctcgaggcccaagccgccacaggagggctggtagatctggccagaggacagctgctgccagtatccaaggccctacagcagggcctagtcgggcttgagctcaaagagaaacttctggctgcggagcgggctaccactggctaccccgatccttatgggggtgagaaactggctttgttccaagcaatcggcaaagaagtagttgatagagccttaggccagagctggctggaagtacagttggcaacggggggactggtcgaccctgcccaaggagtgctagtggctccggagcctgcatgccaccagggattacttgacagagaaacgtggcacaaactctccgagttggaacctggaaccggcgacctcagatttcttgacccgaacactctggaacgcttaacctatcaccaactgctggagaggtgcgtcagagcaccaggttcagggctagctctgctccccttgaagatcacctttcggtcgatgggcggggccgtttcagctgcagaacttctcgaagtggggattctggacgagcaggcggttcaggggcttagagaaggcagactcgccgcagtcgacgttagtgcaagagccgaagtgcggcggtacttggaagggaccggttcagtcgccggtgttgtccttttgcccgaaggacacaagaaatctttttttcaggccgccacagaacacctattgcccatggggacagcattgcccctcctggaggcccaagcagccacccatactctcgtcgatccgataaccggacaaagattgtgggtcgatgaggctgtgcgagctgggctcgtatcaccggaattgcacgagcagctgcttgtggcagagcaggcagtcaccggccaccatgatcccttcagtggctcgcagatcccactgtttcaggccatgaagaaaggcttggtggatcgaccgcttgctctcaggctcctggatgcccaactagcaacgggtggtctggtgtgccccgcaaggcgtcttcggctgcccttggaggccgcgctgcggtgtggctgcctagatgaggacacccagaggcagctgtctcaggccgggtcattctctgatggcactcacggaggactgagatacgaacaacttctggccctatgtgtgacagatcccgaaacaggactggcgtttttgccactgtccggagggccacgcggtggcgagcctcagggacccccgtttatcaagtactccacccgacaggccttgtctactgctacggccactgtgtctgtggggaagtttcgaggtcgcccagtgagcttatgggaactcctgttttccgaggctatctcatcagagcagagggccatgttggcccagcaataccaagagggtacccttagcgtggaaaagctcgctgccaaactgtccgctaccctggaacaagctgcagcgacggctcgagtgactttcagcggcctacgcgataccgtcacccctggagagcttttaaaggccgagatcatcgaccaggacctttacgagagactggaacacggtcaggccactgccaaggacgtcgggagcctcgctagcgtccagcgatatctacaaggcacaggctgcatcgccggcttgctcctccccggaagtcaggaaagactgagcatatatgaagcaagatgcaagggcttactacggcccggcactgccctcatcctactggaggcccaggccgccacgggattcatcattgaccccaaggcaaataaggggcattcagtggaggaggccttaagagctgcagtgatcggcccagacgtatttgccaaactactcagcgccgagcgagcggtcacaggatacacggatccatacaccggacagcagattagtctgttccaggctatgcagaaaggcttgatcgtgagggagcatggcatccgcctgctcgaagcacagattgctaccggcggcgtgatcgatcctgttcattctcatcgcgtacccgtggatgtggcataccgcagagggtactttgaccaaatgcttaatcttatcctgctcgaccctagcgatgacacgaaagggttcttcgatcctaatacacacgagaatcttacatacttgcagctcctggagaggtgtgtccgcgacccagagacaggtctttacctactcccgctctccagtactcaatcaccccttgtcgattctgctacccaacaagcttttcagaatcttctactgtccgttaagtacggcagattccagggccagagggtcagcgcgtgggagttgattaattcagagtatttctccgaggggcgtagacgccaactccttaggcgctaccggcagcgagaggtgacattggggcaagtggccaagctcctggaagccgagacgcagcgccaggctgatatcatgttgccagctttaaggagcagggttacagtccatcagcttctcgaggctggcatcattgatcagcaactgcttgatcaggtattggccggcaccatcagcccggaagccttactgctcatggacggggtgcgtaggtacctctgcggcctgggcgctgtggggggtgtccgtctgttgccaagcgggcagcggctgagcctctatcaggctatgcgacagaagcttctcggccccagggtcgctctggctctattggaggcccaagcagcaacagggaccataatggatcctcactcgccagaaagcctgagcgttgatgaagcagttcgcaggggggtagtggggcccgaactgtacggacgcttgaagcgggctgaaggagccatcgctgggtttcgggacccatttagcggaaaacaggtgagcgtcttccaggcaatgaagaaaggactcatcccctgggagcaagcagcccgtttattggaggcgcaagtagccaccggagggatcatagaccccacctctcaccaccacttgccgatgccggtggctattcagagggggtacgtagaccaagagatggaaacagctctgtcctccagcagtgagactttcccaaccccagacgggcagggacgaacaagctatgcccagctgctcgaagagtgtcccagggatgaaacctccggactgcatttgctccctctcccggaatctgccccagctctgcccaccgaggagcaggtacagcgctccctgcaggcagttcctggtgctaaagatggcacttcgctgtgggacctccttagctcttgtcacttcaccgaagaacagcgcaggggtctgcttgaggatgttcaggagggcagaacaactgtcccccaactcttagcgagcgttcagcggtgggttcaggaaacaaagttgctcgcccaggcccgagtcatggtcccagggcctcgcggggaggtaccagccgtatggctacttgacgccggaattataactcaagagacgctggaggcccttgcccaggggacccagagtccagcccaagtggctgaacagcccgccgtgaaggcctgtctctggggaacaggctgcgtcgcaggggtcctgctgcagcctagcggggccaaagcatctatcgcgcaggccgttagagacggactcttgccaactggactggggcagcgccttctcgaggcccaagtggccagtgggttcctcgtggatccattaaataaccagcggctgtcagttgaagatgcagtcaaggttgggttagttgggcgggagctcagtgagcaactggggcaggctgagagagccgctgctgggtaccctgacccctattctagggctagtctcagcctatggcaggccatggaaaaaggcctggtgcctcaaaacgaaggtttgccgcttttacaggtgcaattggccacaggcggcgtagtcgaccccgtacatggcgtgcacctgccacaggctgcagcctgtcggctcgggctcctagacacccagactagccaagttttaactgctgtggacaaggacaacaagtttttctttgacccgtccgctagggatcaggtcacctaccagcaactccgggagagatgtgtatgcgatagtgagacaggccttttactgttaccattaccaagtgataccgtgttggaagtggacgatcacacggctgtcgctcttcgcgctatgaaggttcctgtgtcgactggaaggtttaaaggttgctcagtgtccctgtgggacctactactcagtgagtatgttggggctgataagaggcgtgaactcgttgctttgtgtcggtccggaagggcagccgcactgcgacaagtcgtatctgctgtgacaacactcgtggaggctgcagaacgtcagcccctgcaggccaccttccgtggcttgcggaagcaggtatctgcccgcgacctctttcgggcccagctgatttccagaaaaacgttggacgaactttcccagggcaccactaccgtgaaggaagttgctgaaatggacagcgtcaagaggtctctggaggggggcaacttcatcgcaggagtccttatccagggcacacaggaaaggatgagtatcccagaggccctgcgacgtcacatactcaggccaggaaccgctctcgtgctgctcgaggcgcaggcggccaccggcttcattattgacccggttgaaaatagaaagcttaccgtggaagaagctttcaaagcgggtatgtttgggaaggagacatacgtgaagctcctgtcagccgaaagagccgtgacaggttatacagatccttacaccggccaacaaattagtctgttccaggccatgcagaaggacctcattgtgcgggagcacggaatccgattgttagaggcccaaattgctaccgggggcatcattgaccccgtccacagccacagagtgccggtggacgtggcttaccgctgcggatatttcgatgaggagatgaaccggatcctcgcggatccctcagatgataccaaagggtttttcgatcctaacacacatgaaaatttgacctacttgcagctgttggagcgctgtgtggaggatcccgagacagggctgtacctgttacagatcatcaaaaagggggagaattacgtctacatcaacgaggccaccagacacgtcttgcaatcaaggacagccaaaatgagagtggggcgcttcgccgatcaggtagtctctttctgggacctgctttccagtccatacttcacagaagatcggaaaagagagctgatccaggaatatggtgcccagtccggtggactggagaagctgttggaaatcatcacgactacgatcgaggagacggaaacacagaaccaggggatcaaagtggcagcgattagaggagaggtcaccgcagccgatctttttaattccagggtcatcgaccagaagacactccacacactgcgggtgggacggaccggcggccaagccctctcgactctcgagtgtgtgaagccgtaccttgaaggatctggttgcatagcaggcgtaacggtccccagcacgcgtgaggtgatgagcctccacgaagccagccgcaaagaattaatacccgccgcttttgctacatggctcctcgaggcacaagcagcgaccggattcctcctcgacccatgcactaggcagaagttgagtgttgatgaggccgtcgacgtcgggctggtaaatgaggagctgcgcgaacgactgttgaaagccgagagggccgccacagggtaccgcgaccccgcaacaggagacacgatcccactgttccaggccatgcagaaacagctgatcgagaaagcggaagccctgcgcctgctcgaagtccaggtcgcaaccggcggcgtgatcgaccctcagcaccatcaccgactgccgctcgagaccgcctacagaagaggctgccttcacaaagatatctacgcactcataagcgatcaaaaacatatgaggaagaggtttgtggaccccaacacacaggagaaagtcagttacagagaactgcaagagcgttgtcggcctcaggaagacaccgggtggctcctatttcccgtgaataaggccgctcgagattccgaacacattgatgacgagactaggcgcgctctggaagccgaacaagtggagatcaccgtgggccggttccggggccagaagcctacactctgggctctcctcaattccgagtacgtcaccgaagagaagaagctacagctcgttagaatgtataggacccacacccggagggccttgcagaccgtcgcacaactaatactggaacttatcgagaagcaagaaacctccaataagcacctctggtttcagggtattcggcgccaaataaccgcctccgagttgctgtccagcgcaatcattacggaggagatgttgcaagatctggaaacaggcaggtccaccactcaagaacttatggaagacgaccgagtcaaacggtatctagaggggacttcctgcattgctggcgtgctcgtacctgctaaagatcagccagggagacaagaaaaaatgtccatttaccaggctatgtggaagggggtcctgagaccgggaactgccctggtcctccttgaggctcaggccgcaaccggcttcgtgatcgatccagtaagaaacctgagactctcagtcgaagaagctgttgctgctggagtagtcgggggggaaatccaggaaaagctgctcagcgccgaacgagctgtcaccgggtacactgacccctatacagggcagcaaatatccctcttccaagccatgcaaaaggacctgatagttagggagcacggaatccggctgctggaggcccagatcgctacagggggcgtgattgatccggtgcactctcaccgggttcctgtggacgtcgcttatcggcgtggctactttgatgaggaaatgaacagggtcctggccgatcctagtgacgatactaaagggttctttgatccgaacacacatgaaaatctgacctacctgcagctacttcagagagctacacttgatcccgagacaggactcctcttcctatcgctgagcctccagtag

SEQ ID NO: 47004 - DNA, 15267 bp, Artificial Sequence
  Description of Artificial Sequence: Synthetic coding sequence
atgagcggccacaccctgccccccctgcccgtgcccggcaccaacagcaccgagcaggcctctgtgccccgcgccatggcggctaccctgggtgctgggacccccccacgtccccaggcccgcagtatcgcaggagtgtatgtggaagcttccggtcaggcgcagtcagtgtacgcagcgatggaacaaggtctactgcctgcggggctgggacaagcactgctagaggcgcaggccgccaccggcgggctcgttgatctcgctagaggacagctgctgccggtgtccaaggcgctgcagcagggtctggtgggcctggagctgaaagagaagctactggccgcagagagggccaccaccggctacccggacccttatggcggggagaagcttgccctttttcaggcaatcgggaaagaagttgttgaccgtgcccttggccagagctggctggaggttcagttggccaccggagggctggtggatcctgcccagggcgttctcgtggctccagagcccgcttgtcaccagggtctgcttgatcgggaaacttggcacaagttgtctgagctggaaccgggaaccggcgacctcaggttccttgatcctaacactctggagagattgacctaccaccagctgttggagcgatgcgtcagggcccccggcagcgggcttgcattattgccactgaaaataacgtttagatcaatgggcggggctgtctctgctgccgagctgctggaggtgggcatcctagatgaacaggccgtccaaggactgcgtgaaggtcgcctggccgcagtggacgtgtccgcccgggccgaggtccgccggtatctggaaggcaccgggagcgtggcaggcgtggtgctcctacctgaggggcataagaagtcatttttccaggcagccacagaacatctcttacccatgggcactgctttacctttgctcgaagctcaagctgcaactcacactctggtggatcctatcaccggtcagaggctctgggtggatgaagccgttcgggctggcctggtatctcctgagctgcacgagcagctgctggtggcggaacaggctgttacaggccaccacgacccattctctggcagtcaaatccctctattccaggctatgaagaaaggactcgtggacagaccactcgcactgcgtctgctggacgctcagctggccactggcggacttgtgtgtccagccaggaggttgcgccttcctctggaagcagcactccgatgcggatgtctggacgaagatacccagcgccaattatctcaggccgggtctttttccgacgggacacacggcggactgaggtatgaacagctgctggctctgtgtgtcactgatcccgaaaccggcttggccttcctacccttatccggaggcccaagaggaggggaaccccaaggccccccttttatcaaatacagcactcgccaagcactttcgaccgcaacagctaccgttagcgtcggcaagtttagaggacgtcctgtgtctttatgggagcttctgtttagtgaggctattagttccgaacagcgtgccatgctggcacaacaataccaggagggaacgttgtccgtggaaaagctggccgctaagctgagcgcaaccctggagcaggccgccgccacagctcgggtcaccttcagcggacttcgggatacagtgacgcccggtgaattgctaaaggctgagataatcgatcaggacctgtacgaaagacttgagcacggacaggccaccgccaaggacgtcgggtcactcgcgagcgttcagcgctacttgcaaggaactggatgcatcgctggcctgctgctgccaggatcccaggagcggctctcaatctacgaggctaggtgcaagggtctgttgcggcccgggaccgctctgatccttctcgaagctcaggcggcaactggctttatcattgatccaaaagccaataagggacacagcgtggaggaggctctacgcgccgcagtgataggccctgacgtgtttgctaagctgctgtctgcagagcgggccgtgactggttataccgatccttataccggacagcaaatctctctctttcaagccatgcagaaaggcctaattgttagagagcacggcattaggttactcgaagcccagattgccacggggggcgtgatcgacccagtgcacagccacagggtgcccgtcgacgtggcttatagaagaggctacttcgatcagatgcttaacctaatactcctggacccgagcgatgatactaagggatttttcgaccccaatacacacgagaacctgacttacttacaattgctcgagcgctgcgtgcgggatcccgaaactggattgtacctcctaccactctctagcacacagtcccctctggtggacagtgccacacagcaggcattccagaatctccttttgtctgtcaagtacgggaggtttcaggggcaaagggtgtccgcctgggagctgatcaattctgagtattttagcgagggtcggcgccgtcagctccttcgaagatatcgccaacgggaagtgactctgggacaagtggccaagttacttgaggccgagacccagcgccaagcagacatcatgttacctgctctgcgctctcgtgtcacagttcaccagcttctcgaggccgggattatcgaccaacagctattggaccaggtactcgctggcacgatatcgccggaggctcttttgctgatggatggtgtccgccgatatctgtgtggattgggagccgtggggggcgtgcgccttctgccctccggtcagaggctgagcctataccaagcaatgcggcagaagctgctcggcccgcgcgttgccctggcgctgctagaagcccaggcagcgaccggtaccatcatggacccccatagtccagaatccttgagcgtcgatgaggccgtaaggagaggtgtcgtgggaccagagctttatggacgcctgaagcgtgctgagggcgcaatagcgggttttcgggatcccttttcaggcaagcaggtgtccgtattccaggccatgaaaaaggggctgatcccatgggagcaggctgcacgacttttagaagcccaggtggccacaggtgggattatcgacccaacctcccaccatcacctccctatgcccgttgccatccagcgcggctatgtcgatcaggaaatggagacagcactgtcgagtagtagtgagacattccccactcccgacgggcagggtcggacttcctacgctcaactactggaagaatgtcctcgcgatgaaacctccgggctgcatttactgccactgcctgagtccgccccagcacttcccacggaagaacaggtgcagagatccctgcaggcagtgcccggggcaaaggacggcacttcactgtgggatctgctgtcctcctgtcacttcacagaagaacaacgaagagggctgctcgaggacgtacaggaagggcgaaccaccgtgcctcagttactggcatccgtgcaaaggtgggtgcaagaaactaagctgctggctcaggcccgcgtaatggtgcccggaccccgtggagaagttcctgcagtgtggctcctcgatgcagggattattacacaggaaacactggaagccctagcacaggggacacagtcaccagcccaggtggcagagcaacccgccgtaaaggcatgcctgtggggcaccgggtgcgtcgctggggtgttgctgcagccgagtggggccaaggcatctatcgcgcaagctgtgcgagacggactgttgccaacaggactgggtcagaggctccttgaggcacaggtggcctccggttttcttgtggacccccttaacaaccagcgcctcagcgttgaggatgccgtgaaggtggggctggtgggtcgggaactcagtgagcagctcggacaagctgagcgcgcggctgctggataccccgacccctactccagagcctcactgtccctgtggcaggcaatggagaaggggctggtccctcaaaatgaaggcctgccccttttgcaggtgcaattagcaactggaggtgtggtggaccctgtgcatggcgtccatcttccgcaagctgcagcctgtcgcttgggtctactagacacccagacctcccaggtgctcacagctgttgataaagataataaattcttttttgaccccagtgccagagaccaggtaacgtatcaacagctccgtgagaggtgcgtctgcgatagtgaaaccggcctgcttctgttgcccctccccagtgacacggtactcgaggtggatgaccatactgcagtcgcgctacgggcaatgaaggtgcctgtcagcaccgggcggttcaaaggatgtagtgtgtctctttgggacttgctactctctgagtacgtgggtgcagacaaacggcgtgagctggtagccttgtgcaggagcggcagagcagcggcactccggcaagtggtgtctgccgttacaacattggtggaagccgccgaacgccagccactccaggccacattccgcgggcttaggaagcaagtgtctgccagagacctgtttcgggcccaattgatctccagaaagacccttgatgagctgtctcagggaaccacgactgtgaaagaggtggccgagatggacagtgtgaagaggtccctggagggtggaaatttcatcgcaggagtgcttatccaaggcactcaagagcgcatgtccattccagaggctctccgcaggcacatcttgcgtcccggaacagctctggtgttgctggaggcacaagctgccacggggttcatcatcgacccggtggaaaatagaaagctcactgtagaggaggccttcaaggccggcatgttcggtaaggagacctacgtgaaacttctgagtgccgaaagggctgtgacgggatacactgatccctacactggacagcagatttcacttttccaggccatgcagaaggatctcattgtacgcgagcacggaatccgtttgcttgaggctcagatcgcaacaggggggattattgatcccgtccacagccaccgcgtgcccgtggacgtggcttacaggtgtgggtatttcgacgaagagatgaaccgcattctggccgatccatctgacgacaccaagggtttcttcgaccccaatactcacgagaatctcacctacttacagctattggagcggtgtgtcgaagacccagaaacaggcctgtaccttctacagattattaaaaaaggcgagaattacgtatacatcaatgaggcaactagacatgttctccagagtaggacagcaaagatgagagtgggtcggttcgctgatcaggtggtcagcttctgggatctgctctcctctccttactttaccgaggaccggaagcgagagctgatacaggagtacggggctcagtcaggcggtcttgagaagctgctggagataatcacaactaccatcgaagaaactgagacccaaaatcaggggatcaaggtggccgccattcgcggggaagtcaccgctgccgacctcttcaactccagggtgatcgatcagaagaccctgcacactctgagagttggaagaacagggggccaggcactgagtacacttgagtgcgtaaagccttacttggaaggcagtggctgtattgctggcgtaaccgtgccaagcacacgagaagttatgtcgctgcatgaggctagtcgcaaggagctcattcctgccgccttcgccacctggctacttgaagctcaggccgcaactggatttctcctggacccctgcacaaggcagaagctttcagtcgatgaagccgtcgacgtcggcctggtgaacgaggaactgagagaaagactcttaaaagcagaaagggctgcgaccgggtatcgtgaccccgctaccggggatactatcccgcttttccaggctatgcagaagcagctgattgagaaggcggaagctctgcgcctgctagaggttcaggttgccaccggcggcgtgatcgacccacagcatcaccaccgcctaccgctggagacggcctataggcgcgggtgccttcacaaagacatctacgccctcatctctgatcagaagcatatgaggaaacggtttgtcgacccgaacacccaagagaaggtctcctatcgggagctccaggagagatgtcggccccaagaggacacaggctggctgctttttccagtgaataaggcagcccgggattctgagcacattgacgatgaaacgagaagagcccttgaagcagaacaagtcgagataactgtggggcgctttcggggacagaaacctaccctgtgggccctgctgaatagcgagtacgtgacagaggagaagaagttgcagttagttcgcatgtacagaacacacacaagaagggccctgcaaactgttgcccaactgatactcgagcttatcgaaaagcaggagacatccaacaaacacctctggtttcagggcattagaagacagatcaccgcatccgagctactgagttcagctatcatcaccgaagagatgcttcaagatttggaaacagggcgcagcaccactcaagagctgatggaagatgacagggttaaacgatatttggaaggaacatcatgtattgccggcgtattggtgccagcgaaggaccaacccggtaggcaggaaaagatgagtatctatcaagcaatgtggaagggggtacttcgaccaggtactgcgcttgtccttttggaggcacaggcggccacaggttttgtgattgaccccgtgcggaatctgagactcagcgtggaggaggcagtggctgctggcgtggtagggggcgaaatacaagagaagttactctccgccgaacgggccgttactggatacactgacccatatacaggacagcaaatttctctgtttcaagctatgcagaaagatcttattgtgagggaacacggcatccgccttttggaagcccagattgccactggcggagtgattgaccctgtgcacagtcaccgggtgcccgttgacgtggcgtatcgtaggggctactttgatgaggaaatgaacagagtacttgctgatccatcagacgacaccaaaggcttcttcgaccccaatacccacgagaacctcacatatgtccagctgcttagacggtgtgttccagatcccgacaccggtctttacatgctgcagcttgccgggagaggctcagccgtgcaccagctatcagaagaactaagatgcgcgctgagggatgcgagggttacccccggaagcggcgcattgcaggggcagtcggtgagcgtctgggagttgctgttttaccgggaggtttccgaggatagacggcaagacttgctcagtcgttacagggccgggaccctgactgtggaggagctgggcgcgacacttacatcactcctcgctcaggctcaggctcaggcaagggccgaggccgaggcggggtccccacgccctgaccccagggaagcgctgcgggcggccaccatggaagtgaaggttgggcgactcaggggccgcgccgtgcctgtgtgggacgtcctggcttcaggatacgtgagtcgggctgcccgcgaggaactgctggccgagttcggctcaggtaccctcgacctcccagcactcacacgacgcctgacagctattattgaagaagctgaggaggcacccggcgcgcggcctcagctgcaggatgcctggagaggcccccgtgagcctgggcccgccggacgtggagacggagactctgggagatctcagagggagggccagggtgagggagaaacccaggaggcggccgccgccgcggccgctgctgcagccagacgccaggagcagaccctccgcgacgctaccatggaagtacaaaggggccaatttcagggaagacccgtgagcgtgtgggacgtccttttctcttcctacctgtctgaagcacgtagagacgaactgcttgcacagcacgccgccggggctctgggtcttccagatcttgtggctgtgctaacccgggttattgaggaaaccgaggaaagactgagtaaggtctcttttagaggcctgcgccgacaagtaagcgcttctgaattgcatacatccggtatactcggccccgagactctcagggacctcgcccaggggaccaaaacactgcaagaggtgactgagatggatagtgtaaagcggtacctcgagggtacgagctgtatcgctggagtgctagtgcctgccaaggaccagcctggaagacaggagaagatgtctatttatcaggccatgtggaagggcgtgctgcgcccgggcacagcccttgtactccttgaagcccaggcggctactgggtttgtgatcgacccggtcaggaatctcaggttgtccgtagaggaggcagtcgcagctggtgtggtcggcggagagattcaggagaagctgctctcagccgagcgggccgttaccggctacactgacccctacaccggccagcaaatctccctctttcaggcaatgcagaaagacctcatcgtgagagagcacggtatcaggctgctcgaagcccagatcgctactggcggagtcatcgaccctgtgcacagtcatagagttccagttgacgtcgcttaccagagaggctacttcgatgaagagatgaaccgggtgcttgccgacccctcagatgacactaaggggttcttcgacccaaacacacatgagaatctgacctatgtgcaactgctaagacgttgcgtgcctgatcctgacactgggctgtacatgctccagctcgctggccgcggaagtgctgttcatcagctgagtgaggagttacggtgtgcacttcgggatgcaagagtgacacctggttctggagcgctgcagggtcagtcggtctcagtgtgggagctccttttctatagggaagtctcagaggatcggcggcaggaccttcttagtagataccgggccgggacactgaccgtggaggaacttggtgcgaccttaactagtctgcttgcccaagctcaggcccaggcgcgggccgaagcggaggccgggtcacctaggcccgatcctcgggaagccctcagagccgctacaatggaggtgaaagtcggaaggttaagagggcgagctgttcctgtgtgggatgtcctggccagcggctacgtatcaagagccgcgagagaagaactcctggccgaatttggcagcgggacactggacctcccagcacttactagacgactgacagcaatcatagaggaagctgaggaggcacccggcgccagaccccaacttcaggatgcatggcgggggccccgtgaaccaggcccagctggccgtggcgacggcgactccggtcgatcacagcgtgagggccaaggcgaaggtgagacccaggaggcggccgccgccgcccggcgacaagagcagaccctaagggacgctaccatggaggtgcaaaggggccaatttcagggcaggcccgtgagtgtctgggatgtgttattctcatcttatctgagcgaggcacgccgggacgaactgcttgcccagcacgcagcaggtgctcttggactaccggacctggtagcagttttgactcgcgtgatcgaggaaacagaagagagattgagtaaagtgtcatttcgagggctaagatgccaagtgagcgccagtgagcttcacacttcaggcattctagggccggaaacattgagagacctcgcacagggcaccaagactctacaagaagtgactgagatggatagcgtgaagcggtacctggagggcacctcctgcatagccggggtattagtgcctgccaaggatcaacccggtcgccaagagaagatgtctatctatcaggctatgtggaaaggggtgctacggccggggaccgctttggttctgttagaagctcaggcagccactggttttgtgattgatcccgtgagaaacctcaggctgagtgtggaagaggccgtagcggccggggtggtcggaggggagatccaagagaagctcctgagtgccgagcgggctgtcaccggatacaccgatccttacacgggacagcagataagtctgtttcaggcgatgcaaaaagatcttatagtccgggagcatggaatccgcttgttggaggcacagattgcaacaggcggtgtgatagatccggtccactctcatagagtacctgttgacgtggcctataggcggggctattttgacgaggaaatgaaccgggtgcttgcggatccaagcgacgacacaaagggcttttttgatcctaacacacacgagaacctgacttacgtgcaactgctgcggagatgtgtaccggatcctgataccgggctttacatgctgcagctcgcaggaaggggatctgctgtgcaccagctgtccgaggaactccgctgtgccttgagagatgccagagtcactccggggtccggcgcactccaggggcagagcgtgtctgtgtgggagttactattttaccgggaagtctcagaagacaggcgccaggatctcctatctaggtaccgggccgggacacttaccgtcgaagagctgggagccacgcttacatccctcctggctcaggcccaagcccaggcacgggctgaagctgaagctgggagccctagacctgacccaagggaggctctcagggccgcaacaatggaggttaaggtcggcaggctgaggggccgtgcagtccccgtctgggatgtcctggctagcgggtatgtgtcacgcgcagcgcgcgaggagttgctggccgagtttggctccgggactctggatttgcccgccctcactagacgcctgactgccatcatcgaggaagcagaagaggcccctggcgcacggccacagctccaggatgcttggaggggacccagagagccaggaccagcagggaggggggatggtgattccggcaggtcccagcgcgaggggcagggagaaggtgagacccaggaggccgcagccgccacagctgccgctcggcggcaggagcaaactttgcgcgacgctacaatggaggtccagagaggtcagtttcagggtcgacctgtctcagtctgggacgttctgtttagttcctacctctcagaagcaaggcgcgacgaactgctcgcccagcatgccgctggagccttgggcctcccagaccttgtcgccgtcctgacacgagtgatcgaagaaactgaagaaaggctgtcaaaggtttctttcagagggctgagacggcaagtgtccgcttccgaattgcacacctcagggatcctaggacccgagacactgagagacttagcccagggcacaaagaccctgcaggaagttaccgagatggacagcgtgaagcggtatttagagggaacatcgtgcatagctggggtactggtccccgccaaagaccagcccggaagacaagagaagatgtccatctatcaggcaatgtggaaaggtgtgcttcgccctggaactgcattagtcctgctcgaggcacaggcagccacaggatttgtcatcgatccggttcgaaacttgagactctctgtggaagaggccgtcgccgcgggagttgtcggcggagaaatccaggagaagctcctgagtgccgaacgcgctgtgactgggtacaccgatccctacacaggacaacagatctccctgtttcaagcaatgcagaaagatttaatcgtgcgggaacacggaattcgcctgttagaggcacagatcgccaccgggggggtgatagatcctgtccattctcatagagtccctgtggacgtggcgtaccgacgtggctattttgacgaggagatgaacagggttctcgcagacccatccgatgatactaagggcttctttgatcccaacacccatgagaatctgacttatgtgcagctgctgcgacgctgcgtgcccgaccctgataccggcctgtacatgctccagctggccggtcgaggcagcgctgtgcatcagttgtcagaagaactgcggtgtgctctgagggatgcccgcgtcacgccgggttctggtgctctccagggtcaaagcgttagtgtatgggagctgcttttctatcgtgaagtgagcgaggatcggcgtcaagatcttttgtcacggtatcgagccggaacactgacagtagaagaactgggtgctacactgacttccctgctagcacaggcccaagcacaggcgcgggccgaagctgaggccggatcccctcggcccgacccaagagaggccctgagggccgctaccatggaagtaaaggtggggcgactcagggggcgtgcagtgcccgtctgggatgtgctagccagcgggtacgtgtcacgagcagctcgcgaggagttattagccgaatttggctcgggcacactggaccttcctgcccttactcggcgcctgaccgcaatcatcgaggaggccgaggaggcaccgggtgcaaggccgcagctgcaggatgcatggcgcggaccacgcgaaccaggacccgccgggcgcggggatggagattccggacgatcgcagagagaaggacaaggagaaggggagacgcaggaggctgctgctgccaccgccgccgctcgcaggcaggagcagacactgcgcgacgcaaccatggaggtgcagcggggccagttccagggacggcccgtgagtgtctgggacgtgctcttttccagttatctgtctgaagcgagacgcgatgagctgctcgcccagcatgccgccggcgccctcggattgcctgacctggttgctgtgttgaccagagtcattgaggaaacagaagaaagattgagcaaggtcagcttccgagggctgagaagacaggtcagcgccagcgaactccacacctccggcattctcggaccagaaacgctccgagacctagctcagggcaccaagactttgcaggaagtcactgagatggactctgtaaaacgatacctggagggcacctcctgcatagctggggtgctggtgcctgccaaggatcagcccggccatcaggagaaaatgtcaatctaccaagctatgtggaagggggtcttgagaccaggaactgcccttgtccttttggaggcccaggccgctactggatttgtcatagatcccgtgaggaatttgcgcctgagcgtcgaggaggcagtcgccgccggggttgtaggcggggagatccaagaaaagctgctgtctgctgagcgcgcggtgaccgggtacactgacccgtacacaggacagcagatctcactgtttcaggctatgcaaaaagatctgatcgtgagagagcacggtatcagactgttggaggcccagatcgcaacgggcggagtcatagaccccgtgcactcacatagggtgcccgtcgatgtcgcttatcggcggggttacttcgacgaggaaatgaatagggtcctggcccatccgagtgatgacacaaagggattcttcgatccgaacacgcatgagaatctcacttacgtgcaacttctgaggcgctgcgttcctgaccccgataccggactgtacatgcttcagctggccggacgcggctcagccgttcaccagctctccgaagagttgagatgcgccctccgcgacgcccgcgtaatgccagggagcggcgctctccagggtcagagcgtgtctgtgtgggaactactgttttatagagaagtgtctgaagacagacggcaggatctcctgtctagatatcgcgccggcacactgacagtggaggaactcggagctaccctgacctctctgctcgcacaggcccaggcccaggctcgcgcagaggccgaggctgaggctggatccccccgccctgatccccgggaggccttgagagcagcgactatggaggttaaggtgggtcgtctgcggggcagggccgtgccagtttgggacgtgctggcctccgggtacgtaagtggggccgcaagagaagaactgctggccgagtttggcagcggcaccctcgacctgccggccctcacgcgtcgacttactgctatcatagaagaggcggaggaggcgcctggggcccggccccagctccaggacgcatggcgcggcccaagggagcccggacctgctggaagaggagatggcgactccggacgatctcagcgggaggggcagggcgaaggtgagacacaagaggccgcagcagccgccaggaggcaagagcagacactcagggacgcaaccatggaggtgcagagaggacaattccagggcagacccgtgtcggtctgggacgttttattttcaagctatctgagcgaagctcaccgggacgaattgttggcgcagcacgcggcaggtgcactaggcctgccggaccttgtagcagtactgacccgcgtaatcgaggagacagaggaacgcctaagtaaagtctccttccgcggccttcgccgacaagtgtctgcctcagaactgcacacctctggcatactgggacccgaaaccctgagagacttggcgcagggtaccaagactctgcaggaagtcaccgagatggattcagtgaagcgttaccttgagggaacttcttgcatcgccggcgtcctcgttcccgcaaaagaccagccagggcggcaggaaaaaatgtcaatctatcaggccatgtggaaaggcgtgctgcggcctggcacagcactggtgctgctggaagctcaagcggccacaggttttgtgatagacccagtgcggaatcttcggctcagcgtggaggaagctgtggcggctggggtagtcgggggggagatccaagaaaagttgctgagcgccgaaagggccgtcactgggtacacagacccttacaccggacaacaaataagtttgttccaggcaatgcagaaggatctgattgtcagagaacacggcatccgactcctcgaagctcagatagcaaccggtggcgttattgatccagtacatagtcacagagtgcctgtggacgttgcctatcgacggggttactttgacgaagagatgaaccgtgtgctagcagacccctccgacgacacaaagggattttttgatccaaacactcacgagaacctgacctatctgcagctgttgcagcgggccaccctcgacccggagactgggcttctgttcttaagcttgtcccttcagtag

SEQ ID NO: 47005 - DNA, 2715 bp, Artificial Sequence
  Description of Artificial Sequence: Synthetic coding sequence
atggagagcttccacacccggttcagcgcctggacccccttcagcaataagtcccttaaccgccaactgttccaggagagggtggccctcattagccactggtttgacttgtggactaataagcagaggcaggagttcctgttcgctatattcctccggtgtaccaagtcacagctgcggtttgttcaggattggttcagcgagaggatgcaggtcgccaaggttgacttctcaaccgtcctgccacgttttattagcttgtacatatttagcttcttatcccctaaagatctgtgcgcagccgctcaggtatcttggccttggaagttcctgaccgaacaagattgcttatggatgcctaagtgcgttaagtttggctggttcctgccatacactcccacagacaatgagtatggtgcctggaagcgccattacatcgcctgcgttagccacctcgattggctgactccgagggaggcggccgcgacttacggaacgctaaatgaacccaaaactgaggacgaggagttgctcgagagacagagggagaagtgcctcagaaaacgtatctgggagaagatagctttaaggaaaaaggagctgtttaaagttagacctccatgggtttcaggcacctgttgttctagcgtactgaagccccgctgtcagccacggctgtctcaaacggtgagagagcgagtgggcctgcacgaggcactggaaaagcaacttgtgctaacctccctcgaaactctccccaaacggagcaacattagcgggtcccacagctatccgttgttaagcaaaaaaaattggcacggagtgcacaagaacgatgataggagttcctatgcattacgaccccatttcatgctaattagttcccgaatccctgcctacgagatggtcatggagtccgtaaaagccggggtggtgagcgtggtttacgaacatagcgtgaccttggaatcgcttctgtacctgatagaaaaggcattggacgggcaaaaagcacaatcgatcggaatcttcagtgacggtgactcaagagaaattaacttgctgcaaggttataagatcggagtgaagaacctcctgagaccagaagtgcgcgacttttgggagaagctggggtcttatgttgccactgaggaggaaggtggacatgtagatttcttcgtacctctgggggcatccgaggccggcatagaggtactgtctcagctgagccagctcacagggacctttttcaccgccccaaccggcatcgccactggctcatatcagcacatcctctcagactggctgggatcacagtgggggaaggccccctcctcaatctatttctgtgaaagcaagctccagacatggtccagtttcacagacttcctcgaagaaaccctcaaaacagttcggaaacaactgtatccctttttcaaggagctccaaaagagcatttctgggcgcatgattggacaatttatgttcgatactatgggcatgacaaatatccttaacaaccaagataccgcacaagctcttgcagatggactaatggagttgtcaaaggaggattcagagaggaatgtggttgaagacaactcctgggataccaaatctaggttaagtaaaaacgatctcaattttgaagccttgatcaacctggagaggatcctgcagaaggatagtgcagagaagagagcccgcgtggtgagagaactgcttcagtctgagcggaagtatgtccaaatactggagatcgtgcgtgatgtgtatgtggctcctttgaaggcggcactctctagcaacagagctatcctttccgctgcgaatatccaaataatcttttgcgacatccttcagatcctgagtctgaacaggcagtttctcgacaatctgcgggataggctccaagaatggggaccggcacattgtgttggcgagatcgtgactaagtttggaagccaattgaatacttacaccaatttcttcaataactatcctgtgattctgaagacaatcgaaaaatgtagggaaatgattcccgctttcagaacttttctgaaacgccacgacaagactatcgtgaccaaaatgcttagcctgccagagctactcctttacccatcacggagatttgaggagtatctgaacctgttgtacgccgttaggctgcacacgcctgccgagcacgtggacaggggtgacctgacaacagccattgatcagatcaaaaagtacaagggatatatcgaccagatgaagcagaacattactatgaaggatcacctatccgacatacagagaatcatctggggctgtcctactttgtccgaagtgaacaggtacctcatcagggttcaagatgtggctcagctgcattgctgcgacgaggagatttcatttagcctgcgactctatgagcatatccacgatctgtcactcttcctgttcaatgatgctttgttggtgtcgtctaggggcacgtcacatacaccgtttgagagaacctcgaaaacaacctatcagttcattgcgagcgtggccctacaccggctgctgattgagaacatcccagacagcaagtatgtaaagaacgctttcatcttgcaggggccgaaatataaatggatctgtgctaccgagatcgaggatgataaatttctctggttgtccgtgctgcgtaacgctatcaagagcagcatggagaaatag

SEQ ID NO: 47006 - DNA, 234 bp, Artificial Sequence
  Description of Artificial Sequence: Synthetic coding sequence
atggagagcttccacacccggttcagcgcctggacccccttcagcaacaagtccctaaacagacaactgtttcaggagagggtggcactcatcagccactggttcgacctctggaccaacaaacagaggcaagaatttttattcgcaatctttctgcggtgtaccaagtcacagctccggttcgtgcaggactggttcagcgagcgaatgcaagtggccaaagtggacttctag

SEQ ID NO: 47007 - DNA, 2715 bp, Artificial Sequence
  Description of Artificial Sequence: Synthetic coding sequence
atggagagcttccacacccggttcagcgcctggacccccttcagcaataagagtctcaaccgacagctttttcaggagcgggtggccctcatctcccactggttcgatctctggaccaataaacagagacaggagttcctgtttgcaattttcttgaggtgtacaaaatcccagctcagatttgtccaggactggtttagcgagaggatgcaggtcgccaaagttgatttttctaccgttttgccgcgttttatttcattgtacattttttcctttctgagccctaaagacctctgtgccgctgcccaggtgagctggccatggaaattcctgactgaacaggattgcctatggatgccaaagtgtgttaaatttggctggtttctgccctacactcccacagacaacgagtacggcgcttggaaaagacattacattgcctgcgtgagccacctggactggctcactccaagagaagcagcagctacatatgggacactgaacgagcccaagaccgaagacgaggagctcctcgaaagacagcgtgaaaaatgtctgagaaagcgaatttgggagaagattgccttgcggaagaaggagctgttcaaagtcagaccaccttgggtatcaggcacttgttgttcctccgtgctcaaaccccgatgtcaaccaagactatctcagacagttagagagcgcgtgggcttacatgaagctctggaaaaacagctagtgctgaccagcctggaaacgctgcctaaacgtagcaatatttccggatctcactcataccccctgctgtccaaaaagaattggcacggcgtgcataagaacgacgacagatccagctacgctcttcggccccattttatgctaattagcagtaggatacccgcatatgagatggtcatggagtcagtgaaagcgggggtagtgtctgtggtgtatgagcactctgtgacactagagagcctgctgtatctcattgaaaaggctttagacgggcagaaagcacagtcaattgggattttctctgacggcgatagcagggaaattaatctactgcagggctataaaatcggggtcaaaaatttgctgcgccctgaggtcagagacttctgggagaaacttggtagctatgtggccactgaggaggaaggagggcacgtggacttctttgtgcccctgggagctagcgaggcaggaattgaggtgctgtcccagttaagtcagctgacagggacattctttaccgcccctactgggatagctacaggctcataccaacatattctgtctgattggcttggatcacagtgggggaaggctccctcgtccatctatttttgcgaatctaagctgcagacttggagtagttttactgactttctagaagagacccttaagaccgtgagaaagcagctctacccattctttaaagagctccagaagagtatctccggaaggatgattggccaatttatgtttgatacaatgggaatgacaaacatcctgaataaccaagacaccgcccaagccctggccgatgggctgatggaactgtcaaaagaagacagcgagagaaatgttgtggaggataactcctgggacaccaaaagtcggttgtctaagaacgatctgaattttgaagcactcattaatttggaaaggatcctgcagaaggatagcgctgagaaaagagcgcgagtggtcagagaactgttgcaaagtgaaaggaagtatgttcagatcctggaaatcgtcagagacgtttacgtggcaccactgaaagcggccctgtcatcaaatcgggcgatccttagcgctgctaacatccaaataattttttgcgacatactgcagattttgtcgctcaatcgccaatttctggataacctccgagatcgtttacaggaatgggggccagcccactgtgtgggggaaatagtgacaaagttcggtagtcagttaaacacttataccaattttttcaacaactatcccgtgatccttaagactatcgaaaagtgcagagagatgattccggcctttagaacctttttgaaacggcacgataagacaattgtgaccaaaatgctgagcctacccgagctgctgttgtacccatcacggcggttcgaggaatacctgaatctgctttacgcggttcggctgcacacacccgcggagcatgttgatcgcggagatctgacaaccgcgatcgaccaaatcaaaaaatacaagggttatattgatcagatgaagcaaaatataactatgaaagatcacctctctgacattcaacgcatcatctggggctgtcctaccttgagtgaagtgaaccggtatctaatcagagtacaggatgtcgctcagctccattgctgtgatgaggaaatctcattctcactgaggctgtacgagcacatccacgatctgtcattatttttgttcaatgatgctcttttggtatcttctcggggaacaagccacacacccttcgaaagaacatcaaagacaacctatcagttcattgccagcgtggctctccatcgcttactgatcgagaatatacctgattccaagtacgttaaaaacgcattcatattacagggccccaaatacaagtggatctgtgctacagagatagaggatgataagttcctttggctctccgtgctccgcaacgcaatcaaatcctcaatggaaaagtag

SEQ ID NO: 47008 - DNA, 2277 bp, Artificial Sequence
  Description of Artificial Sequence: Synthetic coding sequence
atgcaggtggccaaggtggacttcagcaccgtgctgccccggttcatttccctctatatcttttcttttctttctccgaaggatctgtgcgcagctgctcaggtatcctggccgtggaagtttctaaccgaacaggactgcctctggatgcccaagtgtgtcaagttcggttggtttttaccctacactccaacggacaatgagtacggagcgtggaaaaggcattacatcgcatgcgtttcccatcttgattggctgacgccgagagaagcagccgcgacatatggaacactcaacgagccaaagacggaagatgaggagcttctggagaggcagcgagagaaatgcctgcgcaagaggatttgggaaaaaatcgccctgagaaaaaaggagcttttcaaggtcagacccccctgggttagcggcacgtgctgctcgtccgtgctgaagcccaggtgtcagccacggctcagtcaaacagtaagagagagggttggcctccatgaagcattagaaaagcagctggtactgacatccctggaaaccctgcctaagagaagtaatattagtgggtctcatagctatccattgctcagcaagaagaactggcacggggttcacaagaacgacgataggtcaagctatgcactgagaccgcacttcatgttaatctcaagccggattccagcgtacgaaatggttatggaatccgtgaaggcaggggttgtttccgtagtctatgaacatagcgtcacattagagtcgctgctgtatttgattgagaaggctctggacgggcagaaagctcagagcatcggtattttttcagatggagattctcgtgagattaatttacttcagggttacaagattggtgtgaaaaaccttttgcggcctgaggtgagagacttttgggaaaagttggggagctatgtggccaccgaggaggaaggaggccatgtggacttttttgttcctctaggcgcgtcagaggcggggatcgaggtgctctcgcagctgtcacaattaacaggcacctttttcacggcaccaaccgggatcgcaacgggctcatatcagcacatccttagcgattggcttgggtcccaatggggcaaggcccctagttccatatacttttgcgagtccaagctgcagacttggagttcattcacagactttttggaagaaacgctcaagacggtccgcaagcagttgtaccccttcttcaaagaactccagaagtccatttctggccgcatgataggacaatttatgttcgacactatgggcatgaccaacatccttaataaccaggatactgctcaggctttggccgacggactgatggagctctccaaagaagattctgaaaggaatgtggtcgaggacaactcttgggatactaagtcacggcttagcaaaaacgatctgaacttcgaagcgttgattaatctggaaaggatcctgcagaaagacagcgctgagaagcgtgcgagggttgtgagagagcttctacagtctgagaggaaatatgtccagatcctggaaatcgttagggatgtttacgtggctccgttgaaggccgcattaagctctaacagggccatcctcagcgcagcaaatatccagataattttctgtgacattctgcaaattctgtcactcaaccgacaatttttggacaatctgcgagaccgactgcaggagtgggggcccgcccactgtgtgggggagatagttacgaagttcggctcgcagctgaatacctacacaaacttcttcaataactatccggtcattctgaagacgatcgagaagatgaagcagaacataaccatgaaagatcacctgtcggatatacagcgcatcatttggggctgcccaacgttatcggaagtgaaccgatacctgatcagagttcaggatgtggcgcagctgcactgttgcgacgaggagattagtttctccctccgcttatatgagcatatccatgacctcagcttgttcctctttaatgatgctctcctcgtcagcagccggggaacatcacataccccatttgaaagaacctctaaaaccacttaccagtttattgctagtgtcgccctgcacaggctgttaatcgaaaatattcctgacagcaagtatgtgaaaaacgcatttatcctgcagggaccgaagtacaagtggatctgcgccacagagattgaggatgacaaattcctgtggttgtcagtgcttagaaacgctattaaatcctcaatggagaagtag

SEQ ID NO: 47009 - DNA, 987 bp, Artificial Sequence
  Description of Artificial Sequence: Synthetic coding sequence
atggccaccaagcggctggcccggcagctgggcctgatccggcggaaatcaattgcacctgcaaacgggaacctaggccggtcaaagtcgaagcagctcttcgattacctgatagtgattgactttgagtccacatgttggaacgatggaaagcaccatcactcccaggaaataattgaatttccagccgtgctgctgaataccagcaccggacagatcgactccgaattccaggcgtacgttcagccacaggaacatccgattctgagtgagttttgcatggagcttacagggattaagcaggcccaggtagacgagggggtcccacttaaaatctgcttgagccagttctgtaaatggattcacaagatccagcagcaaaagaatatcattttcgccaccggaatttcagagccttccgccagtgaagttaagctgtgtgccttcgtgacctggtctgactgggaccttggggtgtgcctcgagtacgagtgcaagcggaagcaactgctgaaaccagtgttcctcaatagttggatcgacctgagagcaacctataaactgttctaccgcaggaagcccaagggcctctccggagccctccaggaagtgggtatcgagttttccggccgggaacacagcggcttagacgattccagaaacacagctctgctagcctggaagatgatccgggacgggtgtgtgatgaaaatcacccgatctctgaataagggcccgttcttgctcccttcttggacgtggaactccgatttggcatcaggagaccagcatgcctttctgcagcaggagttcggctgcggtacatatcggactttgctgcagaaacccaacatgtcaaagcaggagaaagggaacattctttggctaacaatggtgtggttgagtctcgcttgcttgcagagaaagaattacaacgactgcatgctgaatacagcctcacaaactgtgactaccgagaaattttag

SEQ ID NO: 47010 - DNA, 2076 bp, Artificial Sequence
  Description of Artificial Sequence: Synthetic coding sequence
atggccaccaagcggctggcccggcagctgggcctgatccggcggaaatctattgcccctgccaacgggaaccttggaagaagtaagagcaagcagctgtttgattaccttatcgttatcgatttcgagagcacatgttggaacgatggcaagcatcaccacagccaggagatcattgagttccccgcggttctgttaaacacctccaccgggcaaattgatagcgagttccaagcctatgtgcagccccaggagcaccctatcttatctgagttttgcatggagcttactggaatcaagcaggcccaggtggacgaaggcgtccctctcaaaatttgtctgtcccaattctgcaagtggattcataaaattcagcagcaaaagaacattatctttgccaccggcatctcagagccaagcgcaagtgaggtgaagctgtgtgcctttgttacttggtccgactgggacctgggcgtgtgccttgagtacgagtgcaagcgcaaacagctcctcaagccagtattcctgaattcatggatcgacttacgagctacctataaacttttttatcgccggaagcccaaaggactttccggggccctgcaggaggtggggattgaattctcgggacgcgaacactccggattggacgatagcaggaacacagcccttttggcatggaagatgatcagggacggctgtgtgatgaaaattacccgttcgttgaataaggtcccaacaaagaaaaacttcagtattctggctcggaatctgaatactattcaggtggaggagatgagcgcctgcaatataagtatccaaggcccctctatctataataaggaaccaaagaacatcatcaacccccatgaaaaagtgcagatgaagtcaatctgcgccaactccccaataaaagcacagcaggatcagctgcaggtgaaaaataacataaaagcatctcttcacaatgtgaaaagctctcttcctctgtttaacaccaagtcctctacgagtgtaggccaactacagtcgcccacactgaactccccgatttatatgcagaaacagggtaaaaacgaacacctggcttttaacaccaaatcaaaggcaagcacagtcggttctgagctggtcctcgtttctactactgtgcccacagtgcatcacgtctccgatctcgagatgtcatccacgctagattgcttgcccgtgttagcagactgggaggatgtcgttctcctgcccgcgtcccagcctgaggagaacgttgattgcactgtaccaatttctgattccgacctagagatctccttcaattcaggagaacgcctcatggtcctcaaagaactggagatgtctagccacgagaatttcggagacatagaggaaaccccgcaaaagagcgaaacttccaagagcatcgtgtataagtcaccccatacaacaatctacaacgtgaaagaagctaaggacccgggttcagacattagcgcctttaaacttccagagcataaatcctccacattcaaccgggtaaacgcaaacatgtcccatccccttgtgctgggcaagcaccctctgctatctggcggcaccaagagaaacccatgctcaccccaagcgttcccccctgccaaaaaacagccctttacaattcatgaagagaaaccaacctcatccgactgtagcccagtgcgcagctcatcctggcggcgtctgccgagcattctgacatcaacggttaacctgcaggagccctggaagagcggcaaaatgacccccccactctgcaaatgcggacgcagatctaagagactggttgtgtcgaacaacggtccaaatcacggcaaggtgttctactgctgtcccattggaaagtatcaggagaataggaaatgctgcggctactttaaatgggagcagacactgcagaaagagagagccaactctatggtcccaagtcatagcaccggaggtcttaccttcagtagtcccgagacatcacacatttgtgacaggaacttaagcatcagtactaagaattctctgaggcttcgtccatcgatgagaaactag

SEQ ID NO: 47011 - DNA, 1281 bp, Artificial Sequence
  Description of Artificial Sequence: Synthetic coding sequence
atgagcgcctgcaacatcagcatccagggccccagcatctacaacaaggagccaaagaacataatcaatccacacgagaaagtgcagatgaagtcaatctgtgccaattccccgattaaagcgcagcaagaccagctgcaggtcaagaataatatcaaggcttcactccacaacgtgaaatcttctctgcctctctttaacactaaatcttcgacctctgtgggtcagttgcagagtcccaccttaaattcccccatctacatgcaaaagcaaggcaaaaatgagcatttggcttttaataccaagagcaaagcgagcaccgttgggtcagagcttgtgctggtgtctaccacggtgcctaccgtccaccatgtgtcggacctggagatgtcatcaacactggactgtctacccgtgctcgccgactgggaggacgtggtcttgctgccagcaagccagcccgaagagaatgtggattgcaccgtgccgatttccgattccgatcttgagataagtttcaactccggggaaaggttgatggtccttaaagaattggagatgagcagccatgagaacttcggtgatatagaggaaacgccccagaaaagcgaaaccagcaagtccattgtgtataagagcccgcatactacaatatataacgttaaagaggctaaagatcccggcagcgatatttccgcctttaaattgccagagcacaagagctctaccttcaatcgcgtcaacgccaatatgagtcatcctttggtattgggcaaacatcctctgttgagcggcggcactaagcggaacccgtgttctccacaggcatttcccccagcaaagaaacagccctttacaatccatgaggagaagccgacttccagcgactgcagtccggtcaggtcttccagctggcggaggctaccctctatcctgacgagtacggtcaatctccaagaaccgtggaagtcggggaaaatgaccccgccattatgcaaatgtgggcggcggtccaagcgactggtcgtatccaacaacgggcctaaccacggcaaggtgttctactgctgcccaatcggaaagtaccaagaaaaccgtaagtgctgcgggtactttaaatgggagcagactctgcagaaggagcgagccaattctatggtgccatcgcactcaaccggcgggcttacgttcagctctccagaaacttctcatatctgcgatcgcaacctgtcaatctccacaaagaattcgctccgcctccgcccatcaatgcgcaattag

SEQ ID NO: 47012 - DNA, 696 bp, Artificial Sequence
  Description of Artificial Sequence: Synthetic coding sequence
atggtgagcttccccccccagcggtaccactacttcctggtgctggacttcgaagctacctgtgataagccccagatccatccgcaggagatcatcgagttccccattctcaaattaaatggacgaacaatggagattgaatcaacttttcatatgtacgtccagcccgtggtccatccccaattgactcccttctgtacagaactgaccggaattattcaggccatggttgacggccagccttccctgcagcaggttctagagagagttgacgaatggatggctaaggaaggcctcctcgatcccaacgtgaagagtatatttgtgacctgtggagattgggatctgaaggttatgctccctggacagtgccagtacctggggctgcctgttgccgattattttaaacagtggatcaacctcaagaaaggcagttctcctgggactgccagcggaactagttgttaccagagcgaagaagcccagagaaaggagaacaccccaggagtgaaggcttattcctttgctatgggttgctggcccaagaacggacttttagatatgaataaaggcttgagcctgcaacatatcggtagaccacactcaggcatcgacgattgcaaaaatatagctaacattatgaaaacactcgcctacagaggcttcatattcaagcagaccagtaagccattctag

SEQ ID NO: 47013 - DNA, 1014 bp, Artificial Sequence
  Description of Artificial Sequence: Synthetic coding sequence
atggccaccgccagccccgccgccgacggcggccggggccggccctgggagggaggcctggtaagttggccacccgctccccccttgacactcccatggacatggatgggccccagctgggggcaacaccccgggcactggggttttccggctctgacagagccctctgcctctcctgccgctgggctgggcatttttgaggtgagacgcgtgctggacgcttccggctgtagcatgctcgctcctctgcagacaggagcagcacggttctcctcatacctgctctctcgcgccaggaaagtcctcgggagccatctgttctcgccctgcggcgtgccagagttttgctccatcagcacacgaaagcttgctgctcacggctttggcgcttcgatggctgccatggtatcattccccccccagcgatatcactactttctcgtcctcgattttgaggccacgtgcgataagccccaaatccacccgcaggagattatcgaatttcccattctgaagctcaatggacgtactatggagatagaaagcacgttccacatgtacgtgcagcccgtcgtgcacccacaactcacccccttctgcactgagttaaccggcataatccaggccatggttgatggccagccatcccttcaacaggttttggagagagtggatgagtggatggccaaagagggactcttggatcccaacgtgaagtcaatcttcgtgacctgtggtgattgggacctcaaagtcatgctgcctgggcaatgtcaatacctgggcctgccagtggcggactattttaaacagtggataaatctgaaaaaagcgtacagtttcgcaatgggctgctggcctaagaacggactcctggacatgaataaaggacttagcctccagcatatcggtaggccgcacagcggcatcgacgactgcaaaaacattgctaacatcatgaaaacacttgcctaccggggattcatcttcaaacagacttctaagcccttctag

SEQ ID NO: 47014 - DNA, 669 bp, Artificial Sequence
  Description of Artificial Sequence: Synthetic coding sequence
atgttcgtgatgctgcaggtgccctggctgcagagctgcgccaacctggtgcagattggggctcccctgcccctgcttgggtgtcttggacagtactttgaggtgctcggatccatggaggtattggccggccaatatggcatggagattatcgaatttccaatactgaaactgaatggcagaacaatggagattgaaagcacattccacatgtacgtgcagccagtagtgcatccccaattaacgccattctgtactgagctaaccggtattattcaagccatggtggatggtcagcctagcctgcaacaggtcttagagagagttgacgagtggatggccaaagaagggctgctggaccctaacgtgaagagtatcttcgttacatgtggagactgggacctgaaggtgatgctgccggggcagtgtcagtacctcggactcccagtggcagactactttaagcagtggataaatcttaaaaaggcctatagtttcgctatgggctgttggccaaagaatgggctgctggacatgaacaaagggttatcactgcaacatattgggcgtccccacagcgggatcgacgattgtaaaaacatcgctaatatcatgaagaccttggcttaccggggcttcatattcaagcagacatccaaacccttctag

SEQ ID NO: 47015 - DNA, 660 bp, Artificial Sequence
  Description of Artificial Sequence: Synthetic coding sequence
atggccaccgccagccccgccgccgacggcggccggggccggccctgggagggaggcctggtttcctggccgcctgctccgcccctgactctgccatggacatggatgggcccgagctgggggcagcaccccggagagataatcgagttccccatcctgaaacttaacgggcgcactatggagatcgaatcaaccttccacatgtatgtccaaccagtcgttcaccctcagttaactccattttgcacggagctgacgggaatcatccaggctatggtggatggacagccctcattgcagcaggtattggaaagggtcgatgaatggatggccaaagaaggattgctggacccaaacgtgaaaagcatcttcgtaacttgtggcgactgggatctgaaggtgatgctccctggtcagtgccagtatctaggattgccagtagccgactacttcaaacaatggattaacttaaagaaagcctattcctttgctatgggatgctggcctaagaacggccttttggacatgaacaaaggcctctcactgcaacacattggtaggccacattcaggaattgatgactgcaagaatatcgctaatattatgaaaactctggcctatagggggttcatatttaagcagacaagtaaacccttctag

SEQ ID NO: 47016 - DNA, 531 bp, Artificial Sequence
  Description of Artificial Sequence: Synthetic coding sequence
atggccaccgccagccccgccgccgacggcggccggggccggccctgggagggaggccttgtgagttggccccccgcccctcccttaacactcccttggacatggatgggtccttcatggggtcagcaccccggcgagataatcgaatttccaattctgaagctgaacggaagaacaatggaaattgagtccacctttcacatgtatgttcaacccgttgtgcatccccagctgacccccttttgcaccgagctgacgggcataattcaagctatggtggatgggcagccctccctgcagcaggtgctggaacgggtcgacgaatggatggccaaggaaggcttgctcgatccaaatgtgaaatccatctttgtgacctgcggagactgggatttgaaagtcatgctacccggccagtgccagtacctgggattgcctgtggccgactattttaagcaatggattaatctgaaaaaggcttattcgtttgcaatgggatgctggccaaaaaatggtctcctggatatgtag

SEQ ID NO: 47017 - DNA, 615 bp, Artificial Sequence
  Description of Artificial Sequence: Synthetic coding sequence
ctgcaggagatcatcgagttccccatcctgaagctgaacggccggacaatggagattgagagcaccttccacatgtacgtgcaacccgtcgttcaccctcagctgactcctttctgtacggagcttactgggatcatccaagccatggtggatggccaaccttccctccagcaggtattggagagggtggacgagtggatggccaaagaagggttgcttgacccaaatgtgaagtccatcttcgtgacctgcggcgactgggacctgaaggtgatgctgcccggacagtgccagtacctcggactgccggttgctgactactttaaacagtggattaacttgaagaagggatccagcccaggaactgcttccggcacatcttgctaccagtctgaagaagcccagcggaaagagaatactcccggggtgaaggcatatagtttcgcaatggggtgttggcccaagaatggactccttgacatgaacaaggggctttctttacagcatattggcagacctcattctggtatcgacgactgtaagaacattgccaatatcatgaaaacgttagcataccgtggctttattttcaaacagacgtcaaagccattttag

SEQ ID NO: 47018 - DNA, 753 bp, Artificial Sequence
  Description of Artificial Sequence: Synthetic coding sequence
atggccaccgccagccccgccgccgacggcggccggggccggccctgggaagggggtctggtctcatggccaccagccccaccattgacgcttccctggacatggatgggcccctcttggggacagcacccaggccattggggcttccctgctttaaccgaaccttccgcaagccccgctgctggacttggtatcttcgaggtgaggagagatgcgtccggttgctcgatgctggcgccactccaaacaggcgccgcacggttttcttcctatctcctgagcagggcacgtaaagttctgggctcacacctgttttcgccttgtggggtaccagagttttgctcgattagcactcgtaaactggctgcacacggcttcggcgcctccatggcagcaatggtgtcctttccaccccaaagataccactacttcctcgtccttgatttcgaggccacctgcgacaagccacagattcaccctcaggagattatcgagtttccgattctaaagctcaatggtcgtaccatggagatcgagagtactttccacatgtacgtgcaaccagtggtgcatcctcagctgacacccttttgtacggagttaactggaataatccaggccatggtggatgggcagcctagcctacaacaggttttagagagagttgacgaatggatggcgaaggaaggcctgcttgatcccaacgtgaaatccatattcgtaacttgtggagactgggacctgaaagtctag

SEQ ID NO: 47019 - DNA, 483 bp, Artificial Sequence
  Description of Artificial Sequence: Synthetic coding sequence
atggagatcgagagcaccttccacatgtacgtgcagcccgtggtgcatcctcagctgaccccgttttgtacagagcttactggcatcattcaggccatggtggatggacagccttctctacagcaggtactggagcgggttgatgagtggatggcaaaagaggggctgctggacccgaatgttaagtccatatttgtcacatgtggagactgggacttaaaagtgatgctccccggtcagtgtcagtatcttggcctgcctgtcgctgattactttaagcagtggataaatctaaagaaggcctactcctttgctatgggctgctggcccaaaaacggcctgcttgacatgaataagggcctctcgcttcagcacataggaagaccccacagcggaattgatgattgcaagaatattgccaatatcatgaagacgctggcgtatagggggtttatttttaaacagacgtccaaacccttctag

SEQ ID NO: 47020 - DNA, 3018 bp, Artificial Sequence
  Description of Artificial Sequence: Synthetic coding sequence
atggagaagcagcgggccctggtggccgccaaggacggcgacgtggcaaccctggagcgcttgctagaagcaggtgcactgggcccgggaatcacggacgcactgggggccgggctggttcaccatgcgacgagagctggtcacctggactgtgtgaagtttctggtgcagcgagcccaactcccaggcaaccagagagcacataatggcgctactccagcccatgacgctgccgctacaggcagcctcgccgaactgtgctggctggtgcgcgaggggggctgcggcttgcaggaccaggatgcatctggcgtatctccgttgcatctggccgccagatttgggcaccccgtgttagtagagtggttgcttcatgaggggcactcggccactctcgaaacaagagagggagccaggcccctccaccacgcagcagtctctggtgatctcacctgcctcaagttactcactgccgctcacgggagtagtgtcaataggcggacacgatctggcgctagccccctgtatctggcatgccaggaaggtcacctgcatctggcacagttcctagttaaggactgcggtgctgacgtccatttacgggcgctggatggtatgtccgcactgcacgccgctgctgcgcggggacattattcactggttgtttggctggtcacattcactgacattggtctgacagcaagagataacgagggggctaccgccttgcactttgcagcacgtgggggacacacacctatccttgaccggcttttgctgatggggacacctattttgagagactcctgggggggtaccccccttcacgatgccgccgagaatgggcagatggaatgctgccagactctcgtgtcccaccacgtggatccctctctgcgcgatgaagatgggtacactgccgcggacctggccgagtaccatggtcatcgagactgtgcccaatacctgcgggaggtagctcaacccgtgccccttctgatgactccgccacccccaccattcccccctccccctctcctggctacccgtcgaagtctagaggacggtagaagggggggaccagggcccggtaatccctcaccgatgtcactgtcccccgcttggcctgggcaccctgaccaaccactcccccgcgaacagatgacatcacccgcaccccccaggattatcacttccgccacggccgatcctgagggtaccgagacggcattggcaggtgacaccagcgatgggctggccgccctccaactcgacggtctgccatctggagatattgacggactcgtgcccactagggacgagaggggtcagcctatccctgaatggaaacggcaggtgatggtgcggaaactgcaggcccggctcggagccgaatcaagcgccgaagcccaggacaacggcggctcttccggacctactgagcaagcagcctggcggtattctcagacacaccaagccatattgggcccatttggggagctgctgaccgaggacgatctggtttatcttgaaaagcagatcgccgatctgcagcttaggagacgatgccaggagtacgaaagtgaactcgggcgcctggcggccgagctgcaagccttattgccagaaccactcgtgtcgattacagtgaactcccactttcttcctcgggcaccagggcttgaggtggaggaggcctctattcctgcagctgagcccgcaggatcagccgaggcaagcgaggtcgctcccggcgtgcaacccctgcctttttggtgcagccatataagccggctggtgcgtagtctctctcttctgctgaagggggttcacggtctagttcagggagacgagaagccctctacacgcccactgcaggatacctgtcgcgaggcttccgcttcgcccccaaggagtgaagcccagcgccagatccaggagtggggcgtctccgtacggactttacggggcaactttgagtcagccagcggccctctgtgcggcttcaatcccggtccctgtgaacccggggcgcagcatcgccaatgtctgagcggctgttggcccgccctgcccaagcctagatctggactcgcatcaggggagcctcggcccggggataccgaggaagcttctgacagtggtattagttgtgaggaagtgcccagcgaagccggggcagctgcggggcccgacctcgctagcttacgcaaggaaaggattattatgctgtttctgtcccactggcgcaggtccgcatatactccagcactgaaaaccgtggcgtgtcgaacgctgggggctcgccatgcggggctgcgggggcaggaggcagcccggagtccaggaccaccatccccaccttccgaggggcctcggctgggccatctgtggcaacagagaagcaccatcacccacctgcttggtaattggaaggctatcatggcccacgtgcccgctcgccagctaaggcgtctctcccgccagcccagaggtgcacttagcccagaacagttcctgccacacgtcgacggggcaccagtaccttactctagcctgagcctggatctcttcatgctgggctactttcagcttttagagtgtgatctcccagccgaggagaggaaactgaggcatctcctgtgcttcgaggtctttgaacacttggggacccacggctgggaagcagtaagggcattccataaagctgttaccgacgaagtggcggccggtcgccgagcatggactgacgggttcgaagacatcaaagctcgatttttcggcagcagtcagaggcccgcgtgggacactgaacctgggagaaaatccggcctgactctgttagggcctttgccccatgcagcagtaccatgcagcggacccgagccaaccgctcagaggctcggaagcaggagtcagcagggctcctttaacggggaagatatctgcggatacatcaatagaagttttgctttttggaaagaaaaagaagccgagatgttcaactttggtgaatag

SEQ ID NO: 47021 - DNA, 2886 bp, Artificial Sequence
  Description of Artificial Sequence: Synthetic coding sequence
atggagaagcagcgggccctggtggccgccaaggacggcgacgtggctacactcgagaggctgctggaggccggcgcccttggtcccgggatcactgacgctttaggagctggacttgtccaccacgctacacgggctggacatctggattgcgtcaagttcctcgttcagcgagcccagctgcctggaaaccagagagcccacaacggcgctacacccgcccacgacgctgcagccacaggctcgctggccgagctctgttggctagtgcgtgagggaggttgcggtctccaagatcaggatgccagcggcgtcagtccactccatctggccgcccggtttgggcatcctgtgttggtcgagtggctcctgcacgaggggcactccgccactctggagacgagagagggggcgagaccgctgcaccatgcagccgtgtccggcgatctgacttgcctcaagctgcttaccgccgctcatggctcctcagtgaacaggcgaacgcgcagtggtgcctccccgctgtacctcgcctgccaagaaggccatctacacctggctcagttcctcgttaaggattgtggcgccgacgtgcacctccgggcactggatggcatgtctgccttgcatgcagctgcggcccgggggcactactcattggtggtatggcttgtgactttcaccgacattggactgacggcaagagacaatgagggcgcgaccgcccttcactttgccgcacgtggcggccacacgccaattctggatcgtcttctcctgatgggcacccctatcctaagggattcctggggggggacccccctccatgacgccgcagagaacggccaaatggaggtgccgttactgatgacccccccccccccaccattccccccgcctccactcctggcgacaagaagatcacttgaagacggccgcaggggcggccccgggcctgggaatcctagcccaatgtctcttagccctgcgtggcccgggcatcctgaccagcctttgcccagagagcagatgacgtcaccggctccgccacggattattactagcgcaactgccgatccagaagggacagaaactgccttggccggcgatacctcagacggattggccgccctacagcttgacggactgccctctggggacatcgatggcctggtgcctactcgggatgaaagggggcagcctatccctgagtggaaacggcaggtgatggtaaggaaattgcaggcccgactgggtgcagaatcttccgcagaggcacaggacaacggcggatcttcaggtcccaccgagcaggctgcttggcgttacagccagactcatcaggccatccttggccccttcggagagttgttaacagaagatgatttggtgtacctagagaagcagattgccgatctccagctccgacgtagatgccaggaatatgagagtgaattaggtcgattagccgctgagctccaggcactcctccccgaaccactggtgagtatcactgtaaatagccattttcttcctcgagctcctgggctggaggtagaagaagccagtataccagctgctgaaccagcagggtcagcagaggcgagcgaggtcgctccaggagtccagcccctgcccttttggtgtagtcacatcagtaggctcgtgagatctctcagcttgttgctaaagggtgtccacggtcttgtccaaggcgatgagaaaccttcgacccggcctctgcaggatacatgcagggaagccagtgccagcccaccacgctctgaagctcagaggcaaatccaggagtggggggttagtgtgcgcacgttgcgcggcaacttcgagtcagcttctggacccctttgtggcttcaatcccggcccctgcgagcccggggcacagcatcggcagtgtctgtctgggtgctggccagccttaccaaagcctcgctccggcctggcgagcggcgagcccagacccggcgataccgaagaagcctcagatagcgggatcagttgtgaggaagtgccctcagaggctggtgccgcagctgggcccgacctagcctcacttcgcaaggagcgaataatcatgctgttcttgtcccactggcgacgttccgcatatacaccagcgttaaagaccgtcgcctgccggacattaggcgctcgccacgctgggctgcgcggccaagaagccgcaaggagtccaggacccccatctcctccgagcgaaggtccccgcctgggacacctgtggcagcaacgcagcaccatcactcacctcttgggcaactggaaggccattatggctcatgtaccagctagacagctgcggcgcctcagtcgccagccgaggggcgctctcagtccagagcagttcctgcctcacgtggatggggccccagtgccctacagcagcctgagtttggatctgtttatgctcggctatttccagctcctcgaatgcgatctgcccgctgaagagcgcaagctccgtcacctcctgtgttttgaggtgttcgagcacttgggaacgcatgggtgggaagccgtgagagctttccacaaggctgtcaccgacgaggttgctgcaggaagaagagcttggactgacggtttcgaggatataaaagcaagattcttcggtagctcgcagaggccggcctgggacaccgaaccaggacgaaagagtggattaactctcttgggcccattgccgcacgccgccgtgccatgcagcggccccgaaccaactgctcagaggctcgggtcgcgcagccagcaggggagcttcaacggcgaggacatctgcggatacattaaccgatccttcgccttttggaaagaaaaggaggcagaaatgtttaacttcggagaatag

SEQ ID NO: 47022 - DNA, 1914 bp, Artificial Sequence
  Description of Artificial Sequence: Synthetic coding sequence
atgagcctgagccccgcctggcccggccaccccgaccagcccctgccccgggaacaaatgacctcacccgctccaccaagaattataacgagcgcgacagcagaccctgagggcactgagaccgcactggcaggagacaccagtgacggtcttgccgctctgcagctggacggtctcccctcaggagatatcgacggcctcgtcccgacgagggatgagaggggacaaccaattcccgaatggaagcgccaggtgatggttcgcaagctgcaggccagactcggagcggagagcagtgccgaggctcaggacaacggtggatcctcggggcctacagaacaggctgcatggagatattcccagacgcaccaggccatcctggggccattcggagaactgctcaccgaagacgatctggtttatctagagaaacaaatagccgacttacagctgcgacgcaggtgccaagaatacgagtctgaactcggtcgcctggccgcggagttgcaagccctgctcccagaaccactcgtaagcattaccgttaacagccatttcctcccacgtgccccgggattggaagtcgaggaagcttctatccccgctgccgagccagccggttctgcggaagcctcagaggtcgcacccggagtgcaaccactccccttctggtgttctcatatctccagattggttcggagtctgagccttctgcttaaaggggttcacggcctagtccaaggagatgagaagcccagcactcgtccgctgcaggacacctgccgggaggccagtgcttctccacctaggtcagaagctcagcgacaaatccaggaatggggggtgagcgtgcgcacacttcgtgggaactttgaatcggcatccggaccgctgtgtggattcaatcctggaccatgcgagccaggagcccagcatcggcagtgcctgtcggggtgttggcctgctctgcccaagcccaggagcggcttggccagcggcgaaccccggccaggagacactgaggaggcttcagactctggtatctcctgcgaggaagtgccatccgaggccggtgccgccgccggcccagacttggcatctctgaggaaggagaggattattatgctttttctctcgcactggcgcaggagtgcatatactcccgctcttaagaccgttgcctgccggacactgggggccagacacgccggcctacgtgggcaggaggctgctcgatctcccggcccgccaagccccccatcagaaggaccacgattggggcacctctggcagcagcgttccactatcacacacctgctgggcaactggaaagcaattatggcccacgtgccagctagacagctgagaagactgagccgacagccccgcggcgcactgtcccccgaacagttcctccctcatgtagatggcgctcccgttccttacagcagcctatccctcgacctgttcatgttggggtactttcagctgctggagtgcgatcttcccgctgaggagagaaaactgagacacctcttatgcttcgaagtcttcgagcatttgggcacccacgggtgggaggctgtgagggcgttccacaaagctgtcaccgacgaggttgccgcgggaagacgcgcctggactgacggattcgaggacataaaggctcgttttttcggaagctcccagcggcctgcctgggacacagaacctggaagaaaatcaggactgactctcctgggccctctgccacatgccgctgtcccttgctccggcccagagcctaccgcacagagactaggttcaaggtcccagcaggggtccttcaatggcgaggacatatgcggttatatcaaccgctcctttgccttttggaaggaaaaggaagccgaaatgtttaacttcggagagtag

SEQ ID NO: 47023 - DNA, 249 bp, Artificial Sequence
  Description of Artificial Sequence: Synthetic coding sequence
atgagcctgagccccgcctggcccggccaccccgaccagcccctgccaagagaacagatgacatcccccgcacctccacggataatcacctccgctaccgccgaccccgaaggcaccgagactgccctcgcaggagatacatcggatggcctcgccgcccttcagttggatggactgcccagtggcgatattgatgggctcgtgcccactagagacgaacggggccagcctatcccagaatggaagtag

SEQ ID NO: 47024 - DNA, 1194 bp, Artificial Sequence
  Description of Artificial Sequence: Synthetic coding sequence
  Description of Combined DNA/RNA Molecule: Synthetic coding sequence
atggccggctacgagtacgtgagccccgagcagctggccggcttcgataagtacaagtacagtgccgttgataccaacccactgagtctctacgtaatgcaccccttttggaatactatcgtgaaagtgttccctacatggctggcacccaacttaattaccttttccggtttcctcctggtcgtcttcaacttccttctcatggcctattttgacccagatttttacgcaagtgccccgggacacaaacacgtgcccgattgggtgtggatcgttgtcggcattctgaacttcgtcgcctataccctcgatggcgtggatggaaagcaggcacgccgcaccaactcaagtacccccttgggagaactctttgatcacgggctggattcctggtcgtgcgtatattttgtggttaccgtgtacagtatctttggacggggcagtaccggcgtaagcgtcttcgtcctttacctcttgttgtgggtggtgctctttagctttattctcagccactgggaaaaatataataccggcatacttttcctcccatggggctatgacatttctcaagttactatatctttcgtgtacatcgtcactgccgtggttggagtcgaagcatggtatgagcctttccttttcaattttttgtaccgtgacctcttcaccgccatgatcattgggtgcgctctgtgcgtgacactgcctatgtctctgttgaatttcttccgcagttataaaaacaatacactcaagcttaactctgtgtacgaagcaatggttccattattttcaccttgcctgttgtttatcctgagcacagcgtggatcctgtggtccccctctgatatactcgagctccacccccgggtcttctatttcatggtggggactgcattcgctaattctacctgtcaacttatcgtgtgccaaatgtcgtccacgcggtgtcccactctgaactggttactggtgcctctgttcctggtcgtgctcgtcgttaatctgggagtcgcctcttacgtcgaaagcatcttgctgtacacactcacaaccgctttcactctggcacatatccattatggagtaagagtggttaagcaacttagtagccatttccaaatctaccccttcagtctccgcaagcctaattctgatugactgggaatggaggaaaaaaatatcggcttgtag

SEQ ID NO: 47025 - DNA, 357 bp, Artificial Sequence
  Description of Artificial Sequence: Synthetic coding sequence
atgcaccccttctggaacaccatcgtgaaggtgttccccacctggctggcaccaaacctgattacatttagtggatttctgctcgttgtttttaattttctcctgatggcctatttcgatccggacttttacgcatccgctcctggccacaaacacgttccagactgggtgtggatagtcgtggggatccttaacttcgttgcatacactctcgatggcgtggacgggaaacaggccaggcgaacaaactcctccacccctctgggagagctctttgatcacggactggacagctggagttgtgtgtattttgtggtgacggtgtattcgatctttggtaggggctcaacaggctag

SEQ ID NO: 47026 - DNA, 1200 bp, Artificial Sequence
  Description of Artificial Sequence: Synthetic coding sequence
atgggccggaagagcctgtacctgctgatcgtgggcatcctgatcgcttactatatctatacccctctgcccgataacgtggaggagccgtggaggatgatgtggatcaatgcacacttgaagaccatacagaatctcgcaacttttgtagaacttttagggctgcaccacttcatggattctttcaaggtggtcggctcatttgatgaagttccccccacttccgacgagaacgtaacagtcacggagacaaaattcaataacattctcgtgcgtgtgtatgttccgaaaagaaagtctgaagccctgcgcagaggcttattctacattcatggcgggggctggtgcgtgggttccgcagcgctgtccggctacgatctcttatctcgctggacagctgaccgcctggatgcggtggttgtatctactaactacagactggctcccaaataccatttccccattcaatttgaagatgtgtacaatgcactgcgatggttcttgcggaaaaaagtcctggccaagtacggggtgaacccggagcgcattggaataagtggggatagcgcaggcggaaaccttgctgctgctgtgactcagcagctccttgatgaccctgacgtgaaaatcaaactcaagatccagtctttgatctaccccgccttgcagcccctggacgtggacctcccgagctatcaggagaactccaacttcctcttcctatcaaaaagtctaatggtacggttctggagcgaatacttcacaaccgatcggtcccttgagaaggccatgctctcccgacaacacgtgcccgtagaatctagccacttgtttaagtttgtgaattggtcttccctactccccgagaggttcatcaagggacacgtttataacaaccccaactacgggtccagcgagctcgcaaagaaatatcctgggtttctggacgtacgggccgcacccttactcgccgacgacaataaacttcgagggttaccactgacctacgtgatcacctgtcagtatgatctgcttcgcgacgacggcctgatgtatgtcacgcggctccggaacaccggtgtacaggtaactcataaccatgtggaggacgggtttcacggcgccttctcattcctgggcctgaaaataagccacagactgattaatcagtatattgagtggctgaaggagaacctgtag

SEQ ID NO: 47027 - DNA, 2745 bp, Artificial Sequence
  Description of Artificial Sequence: Synthetic coding sequence
atgagccggttcttcaccaccggcagcgacagcgagagcgagagcagtttgtctggcgaagagttggtgaccaagccagtcgggggaaactatggcaagcagcctttactattgagtgaagacgaagaggatacaaagagagtcgttcgcagcgcgaaggataagagattcgaagagttgaccaaccttatccgcacaattcgcaacgccatgaaaattcgggatgtaaccaagtgcctggaagaattcgaactgctgggtaaggcctatggtaaggcaaagtcaatagtggataaagaaggtgtaccccgattctacatccggatcctcgcagatctggaagactatctcaacgagctgtgggaggataaagaggggaaaaaaaaaatgaacaagaataacgccaaagcattaagcaccctacgacagaagattcgaaagtacaatagggactttgagtcccatattacctcatataagcagaatcccgaacagtcggccgatgaagacgcagaaaagaacgaggaggatagtgagggctcaagtgatgaggatgaagatgaagatggggtgagcgctgcaacttttctcaaaaagaagtccgaggcaccttccggggagtctaggaagttcctgaaaaaaatggacgatgaagatgaggacagtgaggattcagaagatgacgaagattgggataccgggagtactagctccgattccgactctgaggaagaagagggaaagcagactgcattagcctcacgcttcctgaaaaaagctcctaccacggacgaggacaagaaagctgccgaaaaaaagagagaggacaaggccaaaaagaagcatgaccgtaaatccaagagactggatgaggaggaagaagaggacaacgagggaggggagtgggaaagagtaagaggaggtgtccctctggtgaaggagaagcctaaaatgttcgctaagggtacagagatcacccatgctgtggttattaagaagctgaatgagatccttcaggcacgcggcaagaaaggcaccgatcgggccgcccagattgagcttcttcaactgttggtccagattgcagccgagaacaacctaggcgagggggttatcgttaagatcaagttcaatattatcgcgagtctctatgattacaacccaaacctagcgacatatatgaaacccgagatgtggggcaagtgtctggattgcattaatgaactgatggatattctgttcgcaaaccccaacattttcgtgggtgaaaacattctcgaagagtctgagaatctgcataacgcggatcagcctctgagggttcgaggctgtattctgactttggttgaacggatggatgaggagtttaccaaaatcatgcagaacaccgaccctcacagccaagagtacgtcgaacatctaaaggatgaggcccaggtctgcgcgatcatcgagcgagtacagaggtacctcgaagagaaaggcactaccgaggaggtatgtcgaatttatctgctgcgcatcctccatacttattataaattcgattacaaggcccatcagagacagctgactccccccgagggttcatcgaagagcgaacaggaccaagccgagaacgaaggcgaggactctgcagtgctgatggaaaggctgtgcaaatatatttacgcaaaagaccgcaccgatcggatccgaacctgcgccatcttatgtcatatatatcaccatgccttgcactcacgttggtatcaggcccgcgacctgatgctgatgtctcatctgcaggataatatccagcacgccgatcctcctgtgcagatactttacaaccgtactatggtccagcttggaatctgtgcctttagacaaggcctcacaaaagacgctcacaacgccctactggatatccagtcttccggaagagctaaggagctactggggcaaggcctgttactgaggtcattacaggaaaggaatcaggaacaagagaaggttgaaaggcgccggcaggtcccctttcaccttcacatcaacctagagcttctcgagtgcgtgtaccttgtgtctgccatgttactggagataccttacatggctgcccatgagagtgatgcccgccggcgtatgatttccaaacagttccaccaccagttgcgagttggagaaagacaacccctgctgggcccccccgagtctatgagagagcacgtcgtggctgccagcaaagccatgaagatgggcgattggaagacatgtcactcattcattattaacgaaaagatgaacggcaaggtttgggatctctttccagaggcagataaggtccggaccatgctggtcagaaagattcaggaagaatctctgagaacctatctcttcacctactccagtgtttacgactcgattagcatggaaacactctccgacatgtttgagttggatctgcccactgtccattccataatatctaaaatgattatcaacgaagaattgatggctagcctggatcagccaacccagacagtcgtcatgcacaggacagagcctaccgcccaacagaatctggcccttcagctggctgagaaattaggatctttggttgagaacaacgagagggtcttcgatcataagcagggcacctacgggggctattttagagaccaaaaggatgggtatcgtaagaatgagggctatatgaggagaggggggtaccgtcagcagcaaagtcagacagcctactag

SEQ ID NO: 47028 - DNA, 2745 bp, Artificial Sequence
  Description of Artificial Sequence: Synthetic coding sequence
atgagccggttcttcaccaccggcagcgacagcgagagcgagagcagcctgagcggagaggaacttgtgaccaaacccgtggggggaaactatggaaagcagcccctgctactgtctgaagatgaggaggataccaaacgcgttgtgcgatccgccaaagacaagcgcttcgaagagctaacaaaccttatccgcaccatcagaaacgcgatgaaaataagagacgttaccaaatgcctggaagagttcgagctgttaggtaaagcctacggtaaagcaaagagcatcgtggataaggagggggtgccaagattttacatccggattttggccgacctcgaggattacctcaacgagctttgggaggataaggaggggaagaaaaaaatgaacaagaacaacgctaaagctcttagtacattgcgccaaaaaattcgaaagtacaatcgggactttgagtctcacataactagctataagcagaacccagagcagtctgccgacgaggatgcagaaaaaaacgaagaagactcggagggctcaagcgacgaggatgaagatgaggacggggtgagcgccgcaacatttctgaaaaaaaaatccgaagcacccagcggggaatctcggaagtttctcaagaagatggacgacgaagatgaggattctgaagactcggaggatgatgaggattgggacacaggttccaccagtagcgactccgactccgaagaggaagagggcaagcaaacagccctagcatcaagattcctgaagaaggcgcctactaccgacgaggataaaaaggctgccgaaaagaaacgggaggataaggccaagaagaagcacgaccgcaaatccaaacgtcttgatgaagaggaggaggaggacaatgaaggtggagaatgggagcgagtgagggggggtgttccattagtgaaggagaaacccaagatgttcgccaaagggaccgagatcacccacgccgtggtcataaaaaaactgaacgaaatactgcaggctcgtggaaaaaaaggcaccgacagggccgcacagatagagctgctccagttattggtccagatcgcggccgagaataacttgggcgagggcgtgattgtaaaaatcaaattcaacatcatcgcgtctctgtatgattacaatcccaacttggctacatatatgaagcccgagatgtggggtaagtgtctggattgcataaacgagttgatggacatcttgtttgccaatcccaacatttttgttggagagaatatccttgaggaatccgagaacctgcacaatgcagatcagcctctgagggtcaggggttgtattcttacgctagtggaaaggatggacgaagaatttaccaaaatcatgcagaacaccgaccctcattcacaggagtatgtggaacaccttaaagacgaggcccaggtgtgtgccatcatcgaacgcgttcagaggtacttagaggaaaaagggacaacagaggaagtgtgtcggatctacttgttgcggatcctgcacacctattacaagtttgactacaaggcccatcagagacagctgactcccccagaagggagcagtaaatctgaacaggaccaggccgagaacgagggcgaagactctgccgttctcatggagagactgtgcaagtatatttacgccaaggatcgcactgatagaatccggacttgtgccatcctctgccacatctatcaccatgctctccacagtaggtggtaccaagctagggacctgatgttgatgtcccatctgcaagacaatatacagcacgctgaccccccagttcagatcttatataatcgcaccatggtgcaactcggtatctgtgccttcagacagggccttacgaaggacgcacacaatgctttgctggatatccaaagttctgggcgagctaaagagttgctgggccagggcctgcttttaagatccctgcaggagcggaatcaggagcaggaaaaggtggaacgacggcgtcaggtgcccttccacctgcatatcaatcttgagctccttgaatgcgtctatctcgtgtcggccatgcttttggagattccttacatggccgcacatgagtccgacgccaggaggcggatgatctccaagcagttccatcatcagttgcgcgtgggggagagacagcctcttttgggcccaccggaatccatgagggagcacgtcgtggctgcctcaaaggccatgaagatgggagattggaaaacatgtcattcatttatcatcaacgaaaagatgaacggcaaggtttgggatctgttccccgaggctgacaaagtcaggacgatgctcgtcagaaaaattcaggaggagtccttgcgcacttacctcttcacctattctagtgtgtatgacagcataagtatggagaccctatctgacatgtttgaactcgatctgcccacggtccactctatcatttccaaaatgataatcaacgaggagctaatggcttctctagaccaacctacgcagaccgtggtgatgcatcgcaccgaaccaacagcccagcagaacctggctctccagctggccgaaaaactcggctctttagtggaaaacaacgagagagttttcgaccacaagcagggcacctacggggggtatttcagagatcagaaagacggataccggaagaacgaaggatacatgcggcgtggggggtacaggcaacagcagtcccagacagcttattag

SEQ ID NO: 47029 - DNA, 2745 bp, Artificial Sequence
  Description of Artificial Sequence: Synthetic coding sequence
atgagccggttcttcaccaccggcagcgacagcgagagcgagagctcactgtcaggcgaggagctcgtaacaaagcctgttggggggaactacggaaagcagcccctgctgctcagtgaagacgaagaagacactaagcgggtggtgcggagtgcaaaggacaagaggtttgaagaactgacaaaccttatcagaaccatcagaaatgccatgaagatccgggacgttaccaagtgcctcgaggaattcgagctgttagggaaggcctacggtaaagccaagtcaattgtggacaaggagggtgtgcctagattttacatcagaattctcgctgatctcgaagattatctgaatgagctctgggaagacaaggaaggcaaaaaaaagatgaacaagaacaatgccaaggcgttgtctaccctccgccagaagattagaaagtataatagggactttgaaagtcatatcacctcatataagcagaacccagagcagagcgccgatgaagatgccgagaaaaacgaagaagattctgaaggaagctcggatgaagatgaggatgaggatggagtcagcgccgccacctttctgaagaagaaatccgaagcccccagtggagagagcaggaaatttctgaagaagatggatgacgaagatgaggactcggaagattccgaggatgacgaggactgggacacaggttcgaccagcagtgatagtgactctgaggaagaggaaggcaagcagacagcgctggcaagtcggtttctgaagaaagccccaacaaccgatgaggataagaaggctgcagagaagaagagggaggacaaggctaaaaaaaagcacgaccggaaatcaaagcgattagatgaggaagaggaggaggacaacgagggcggcgaatgggaacgtgtcagaggtggagttcctctagtgaaggaaaaacctaaaatgtttgcaaagggaacagagataacccacgccgttgttatcaagaagttgaacgaaatcttgcaggctaggggcaaaaaggggaccgacagagctgcccagatcgagctactccagttgcttgtccagatcgccgctgagaacaacctgggcgagggagtgatcgtcaagattaagttcaatattattgcgtcactgtacgactacaaccccaatctcgccacttacatgaagcctgaaatgtgggggaaatgtctggactgtatcaatgaactgatggacatcctgtttgccaaccctaatatcttcgtgggagagaatatcctggaggaaagcgagaatctgcacaacgcagatcaaccattgagggtgcgggggtgcattttaacgttggttgagcggatggatgaagaattcaccaagattatgcaaaacacagacccacattcgcaggagtacgttgagcatctgaaggacgaggctcaggtatgtgccatcatcgagagggttcaaaggtatctggaggagaaaggcaccacagaggaggtttgtcggatctatctgcttaggattctgcatacctattacaagtttgattacaaagcccaccaacgtcaattgacaccacctgaaggctcttctaagtccgagcaggatcaggccgagaatgagggagaagactcagctgtactgatggagcgcctgtgcaaatacatctatgccaaggataggacagacaggattcgcacctgcgccattctctgccacatataccatcatgcactacactcccgctggtaccaggcaagggacctcatgctgatgtcccacctgcaagataacatacagcacgccgaccctcccgtccagatcttgtataatagaacgatggttcagctgggcatttgtgccttccgacaggggctgactaaggacgcacataatgccctgctcgacattcaatccagcgggagagctaaagaactgcttggccaaggtttacttttgaggtcattacaagagcgcaatcaggagcaggaaaaggtggaaaggcgaaggcaagtcccatttcacctgcacatcaatctggaactcctagagtgcgtttacctggtgtccgcgatgctgctggagattccatatatggcagcgcatgagtccgacgcacgcagacgcatgatcagtaaacagtttcaccatcagttgcgtgtgggtgaacgtcagccactactcgggccccctgaaagcatgagggagcatgttgtggctgcgtcaaaagccatgaaaatgggcgactggaaaacctgccactctttcatcatcaatgaaaaaatgaacggtaaagtttgggacttgttcccagaggcggacaaggtgaggaccatgttggtacgtaagatacaggaggaaagcttacgtacttatctcttcacttactccagtgtgtatgactccatctccatggaaaccctgtctgatatgtttgaactggatctgcccacggtccacagtattatttcgaagatgattatcaatgaggagctgatggccagtctggaccagcccacccagaccgtggtcatgcataggaccgaaccaaccgcccaacagaatttggccctgcagttggcagaaaagcttggaagtcttgttgagaacaatgagcgggtcttcgaccataaacagggcacctatggcggctactttcgggaccagaaggatggctaccgcaaaaatgaaggctatatgagacgtggaggatacagacagcagcagtcccagactgcgtactag

SEQ ID NO: 47030 - DNA, 2289 bp, Artificial Sequence
  Description of Artificial Sequence: Synthetic coding sequence
atgagccggttcttcaccaccggcagcgacagcgagagcgagagctccctgtccggggaggaactagtgaccaaacccgtaggcgggaactatggcaaacagccactcctacttagtgaggacgaggaagatacaaaacgggtcgttcgatccgccaaggataaaagattcgaggagcttacaaacctgattcgaactattaggaatgctatgaaaatcagagacgtgaccaaatgcttggaggagtttgagctcttgggcaaggcgtatgggaaggctaaatcaattgtcgacaaggaaggagtccctaggttttacataagaattctggctgatttggaagattatttgaacgagttatgggaagacaaagaggggaaaaagaaacacgacagaaagtccaaacggttggatgaggaggaagaagaagacaacgaaggtggtgagtgggagagggttcgggggggcgtccccctcgtgaaggaaaagccgaaaatgttcgcaaagggaaccgaaattactcatgctgtggtcattaagaaacttaacgagattttacaggctagaggtaaaaaaggcactgaccgcgccgcacaaatcgaattgctccagttactggtccagatcgcagcagaaaacaacctcggcgaaggggtgatagtgaaaatcaaatttaacatcatagcatctctgtatgactataatcctaacttggctacctacatgaagcccgaaatgtggggaaagtgccttgactgtattaacgaactcatggacatcctgttcgcgaatccaaatatctttgtcggcgaaaacattttagaagagtccgagaacctacacaacgcggaccagcctctgagggtgcgcggttgcatcctgaccttagtggaacggatggatgaggagttcactaagatcatgcaaaatactgatccacattcacaggaatatgtcgaacacttaaaagacgaggctcaagtgtgcgccatcatcgagcgggtccagaggtatctcgaagagaaggggacaactgaggaggtatgtcggatctatctactgcggatcctacacacctactacaagttcgactacaaggctcaccagcgccaactgaccccaccggagggcagttctaaatcggagcaggaccaagcagagaatgaaggagaggactccgctgtcctgatggagaggctctgtaaatacatctacgctaaggaccgcaccgacaggatcaggacttgtgctattttgtgtcacatttaccatcacgcgctgcacagcagatggtaccaggctcgagacctaatgctcatgtcccacctccaagacaatatccagcacgctgaccctcccgttcagatcttatataacagaaccatggtgcagcttgggatctgcgcgttcaggcagggactgaccaaggacgcccacaacgctctcctcgatatacagtcatctggccgcgccaaggagttacttggacaagggttgctccttcgaagcctgcaagagcggaatcaggaacaagaaaaagtggaacgacgccgccaggtgccctttcatctccatatcaacctagagctgctggaatgcgtgtacctggtgtctgccatgttactcgagatcccatacatggcggctcacgagtctgacgcacggcgcagaatgataagcaagcaatttcatcaccagctaagggtcggggagcggcagccgctcctgggccctccggaaagcatgagggaacatgtggtggctgccagtaaggccatgaagatgggtgactggaagacttgccattcctttatcattaacgagaagatgaacggtaaggtgtgggacttattccccgaggctgataaagttagaactatgctcgtgagaaagatccaagaggagagcttgcgaacatacctgtttacatactcctcagtgtatgactcaatctctatggaaacactatctgatatgttcgagcttgacctgccgactgttcacagcattatcagcaaaatgatcattaacgaggaactgatggcctctctggatcagcccacacaaactgtagtgatgcaccgtacagaacctaccgcccagcagaacttagctctccagctcgcagagaagctcggatcactagtggagaataatgagagagtctttgatcacaagcagggtacctatggtggttatttccgggaccaaaaggacggctatagaaaaaacgagggttatatgcggagaggcggatatcggcagcagcagtcccaaacagcatattag

SEQ ID NO: 47031 - DNA, 2700 bp, Artificial Sequence
  Description of Artificial Sequence: Synthetic coding sequence
atgagccggttcttcaccaccggcagcgacagcgagagcgagagctctctaagcggggaagagcttgttaccaagcccgttggaggtaattacggcaaacagcctctcctcctgtcagaagacgaggaggacacaaagagggtggtgcggtccgccaaggataaacgctttgaggagctgactaatctgattcgaaccattcgcaacgccatgaagattagagacgtcacaaagtgcctggaggaattcgaacttctgggtaaggcatatggaaaggccaagagtattgtcgataaagaaggcgtaccaagattctatatcaggattctcgccgatttggaggattatttgaacgaactctgggaggataaagagggcaaaaagaaaatcagaaaatacaatagggactttgagtcccacataacttcctacaagcaaaaccctgagcagtccgccgacgaggatgcagagaagaatgaagaggactcagaaggttctagtgacgaagacgaagatgaggatggcgtgtccgccgctacatttctcaaaaagaaatcagaggcgccttccggcgagagccgcaagttcctcaagaagatggatgatgaggacgaggattctgaggatagtgaagatgacgaagactgggataccggtagcaccagctcagattcagacagtgaggaagaagaggggaagcagaccgccttggcctctcggtttctcaaaaaggctcccactacggacgaagacaagaaggctgcagagaaaaaacgtgaggacaaggctaaaaagaagcacgataggaagtccaagcgcctcgacgaggaggaagaagaggacaatgaaggcggagaatgggaacgagtccggggcggggtgcctctggtgaaggaaaaaccaaagatgtttgccaaaggtacagagattactcacgcagttgttattaagaaactgaatgagatcttgcaggcccgtgggaagaaagggaccgacagggcagctcagatagagctgttgcagttattggttcaaatcgctgcagagaacaatctgggcgagggcgtaatcgttaaaataaaatttaacattattgcaagcttgtatgactacaaccccaatcttgcgacatacatgaagccagagatgtggggaaagtgtctggactgcatcaatgagctgatggacatcctctttgccaaccccaatatcttcgtgggtgaaaatatactggaagagagtgaaaacctgcacaatgctgatcaacccctgagagtgcgaggatgtatactgacacttgttgagcgcatggacgaggagtttacgaaaataatgcagaataccgaccctcactctcaggaatacgttgagcacctcaaggacgaagcccaggtctgcgccatcattgagagggttcagagatatttggaagagaaggggacaacagaggaggtgtgtagaatctacctgctccgcatcctgcatacatattacaaatttgactataaggcccaccaacgtcagcttacacccccagagggctcaagcaaaagcgagcaagaccaggcagagaatgagggggaggattctgctgttctgatggaaagactctgtaaatacatttatgccaaggaccggactgatagaattcgaacatgcgccattctatgtcacatttatcaccacgcactgcattcacgttggtatcaggccagagatttgatgctcatgagccatctacaggataatatacagcacgcagaccctcccgtccagatcttatataacagaactatggtgcaactcggcatctgtgctttcaggcagggcctcactaaagacgctcacaacgccctgctggatattcagtctagcggcagggccaaagagctgctggggcaaggtcttctgctaaggtcactccaggagaggaatcaggaacaggaaaaggtcgagcggcgaaggcaggtccccttccacctccacattaacctcgaattgttggagtgcgtgtatcttgtctcagctatgctcctcgaaattccctatatggctgcacacgagtctgacgcccggagacgaatgatatcaaagcagttccatcatcagctgagggtgggtgagagacaacctttgctcggaccccccgagtctatgcgagagcacgtcgtcgccgcctctaaagctatgaaaatgggcgactggaagacctgccatagttttatcatcaacgagaagatgaacgggaaggtgtgggacctcttccccgaggcggacaaggttagaacaatgttggtccggaagatccaagaggaatcgttgaggacgtatcttttcacctactctagcgtgtatgacagcatatccatggaaacgctctcagacatgttcgagttagatttgccgacagtccacagcattatctcgaaaatgatcataaatgaggagcttatggcatctctggaccagcccactcaaaccgtggttatgcaccggaccgaaccgacagcccagcagaatctagcattgcagctggcagagaaactcggctccctggtcgagaataatgagcgggtgttcgatcacaagcaaggaacctatggagggtacttccgcgatcaaaaggatggttacaggaaaaatgagggttacatgaggagaggcgggtatcggcaacagcagtcccagactgcttattag

SEQ ID NO: 47032 - DNA, 729 bp, Artificial Sequence
  Description of Artificial Sequence: Synthetic coding sequence
atgctggccgtggaggtgagcgaggccgagggcggcatccgggagtgggaagaggaggagaaggaagaagaggcagccgagagaaccccaacaggcgaaaagtcccctaattccccacgcacactactgagccttcggggaaaagctcgaacaggtggacctatggaggtcaaacttgagctgcatccattgcagaataggtgggccttatggtttttcaaaaacgaccgcagcagggcatggcaggataatttgcacctggtgaccaaagttgacacggtggaagatttctgggctctctatagtcatatccagctagcatcaaagctctcatctgggtgcgattatgccctctttaaagatggtatccagcctatgtgggaagacagtcggaacaagagagggggtagatggttggtgtcattagccaagcagcaaaggcacatcgaactcgacaggctctggctggaaactttactgtgtctcattggtgaatcctttgaggaacattcacgcgaggtgtgcggagccgtcgtaaatattcggactaagggcgacaagatcgctgtgtggacaagagaggccgaaaaccaagctggcgtcctgcatgtcgggcgtgtgtacaaggaaagactaggcctgagtcccaagacaattatcggctatcaagcccacgctgatacggctaccaagagcaactccctcgccaagaataagtttgtcgtgtag

SEQ ID NO: 47033 - DNA, 729 bp, Artificial Sequence
  Description of Artificial Sequence: Synthetic coding sequence
atgctggccgtggaggtgagcgaggccgagggcggcatccgggagtgggaggaggaggaaaaggaagaagaagccgcagagaggacgcctacaggagagaaatctccgaactcaccaaggactttactgagcctccgtgggaaggcccgaacagggggaccaatggaggttaaattggagctccaccccttgcagaaccgatgggccctgtggtttttcaaaaatgatcgatctcgcgcatggcaagataacttgcatctggtgacaaaggtcgacactgtcgaggacttctgggctttgtattcccacattcagctcgcatccaaactctcctcggggtgtgattacgcgctatttaaagatggaattcaacctatgtgggaagatagtagaaacaagcgaggtggaagatggctggtatcgttagcaaagcagcagcgacatattgagctggacagactctggctggagaccttgctctgcctcatcggcgagtcgttcgaagagcatagtcgggaagtttgcggggctgtcgtcaatatacggaccaagggagataaaattgccgtttggacaagagaagccgaaaaccaagccggggtgttacacgttggacgggtatataaggaaaggctgggcctaagtcctaagacgatcattgggtaccaggcccacgccgacaccgccactaaatccaattctcttgctaagaacaaatttgtggtctag

SEQ ID NO: 47034 - DNA, 273 bp, Artificial Sequence
  Description of Artificial Sequence: Synthetic coding sequence
atgctggccgtggaggtgagcgaggccgagggcggcatccgggagtgggaggaggaggagaaagaggaggaggccgccgaaaggacccctactggggaaaagagccctaacagtcctcgaacccttctcagtcttcgcggtaaagcacgtaccggtgggcccatggaggtgaaattggagttacatccactccagaatcgatgggccctgtggttctttaagaatgatagaagcagagcctggcaggataatttgcatctcgtgaccaagtag

SEQ ID NO: 47035 - DNA, 525 bp, Artificial Sequence
  Description of Artificial Sequence: Synthetic coding sequence
atggccgccgccatggtgcccggccggagcgagagctgggagcggggcgagccgggccggccagccctgtacttttgtggctcaattagaggaggccgggaagatcggaccctgtatgaaagaattgtctcaagactgaggaggtttggaacagttttgacggaacacgtcgctgcggcagagttaggggcacgaggggaggaagcagcaggcggagatcgcctgatccatgaacaggacctagaatggctgcaacaggcggacgttgtggtggctgaagttacccagccatctttgggtgtggggtacgagttagggcgggctgtcgccttcaacaagcgtattttgtgtctgttccggcctcagtctggcagagtgttgagtgccatgattaggggggctgctgatgggagccgcttccaagtctgggattatgaggagggtgaagtggaagccctgctggaccggtactttgaggccgaccctccggggcaggtcgccgcttccccagatcctaccacttag

SEQ ID NO: 47036 - DNA, 423 bp, Artificial Sequence
  Description of Artificial Sequence: Synthetic coding sequence
atgagccggagccggcagccccccctggtgaccggcatcagccccaacgagggaatcccttggaccaaggtgaccattagaggcgagaatctgggcaccgggcccacagacctcataggactgacaatttgtgggcacaactgtttattgacggcagagtggatgagcgcttcaaagatcgtttgcagggtggggcaagcgaaaaatgacaagggcgacattatcgttacaactaagagtggaggcagagggaccagtaccgtatcgttcaaattgctgaaacctgagaagattggaattcttgatcagagcgcagtgtgggtggatgagatgaattactacgacatgagaaccgataggaacaagggcatcccccctttgtctctgcgtccggccaatccgttgggtatcgagatagaatag

SEQ ID NO: 47037 - DNA, 1560 bp, Artificial Sequence
  Description of Artificial Sequence: Synthetic coding sequence
atgctggacctggacaacgacacccggcccagcgtgctgggccacctttctcaaaccgccagtttaaagcgcggaagttcattccagagcgggcgtgatgacacatggcggtacaagacccctcaccgtgtcgcatttgtggaaaagttgacgaagctcgtgctgagccagctccccaatttctggaagctatggatctcatacgtaaacggatctcttttttctgagactgcagagaaatcggggcagatcgagagatctaagaatgtgcgacagcgacagaatgatttcaaaaagatgattcaggaagtcatgcacagtctcgtgaaacttactcgcggtgcactcctaccactttctattagagatggagaggcaaaacagtatggcggatgggaggtaaagtgtgagctgtccgggcaatggttagctcatgctattcaaactgtgaggctcacacacgagtctctgaccgccctggaaatcccaaatgatttgctgcagactatccaggatcttatattagacctccgggtgaggtgtgtcatggccaccctgcagcacactgcggaagagattaagcggctcgccgagaaggaagattggatcgtagataatgaggggctgacaagtctgccatgccagttcgaacagtgtattgtctgtagtctgcagagcctgaagggcgtcctcgaatgtaaaccaggggaggccagtgtattccaacagccaaagactcaggaggaggtctgccaattatccatcaatattatgcaagtctttatctactgtctggagcaactgtccacgaagccagacgcagatatcgatactacacatttgtcggttgatgtgagctctccggatttatttggctccatacatgaggacttttcgcttacctctgagcagaggcttttaattgtgctgagcaattgctgctatctggaacggcacacgtttctgaatatcgcagaacatttcgaaaagcacaacttccagggcatcgaaaaaatcacccaagtttctatggcttccctgaaagagttggatcagaggctatttgagaattacatagagctcaaagcagacccgatagtgggctctcttgaacccggcatctatgccggctatttcgactggaaggactgccttccaccaacaggcgtgcgaaactatctcaaggaagctctggttaacattattgctgtccatgcggaagtattcactatttcaaaagaactagtcccacgggttctcagtaaggtgatcgaggctgtgagtgaagaactgtctcgtctaatgcaatgtgtgagcagcttttctaaaaacggtgccctccaagcccgtctcgagatttgcgcccttcgggacactgtggcagtatatttaacacccgaaagcaagtctagcttcaaacaagccctggaggccctgccccagctgtctagcggcgccgataagaagctccttgaggagctgttgaataagtttaagtctagtatgcaccttcagctgacatgcttccaggcagctagtagcactatgatgaagacctag

SEQ ID NO: 47038 - DNA, 1230 bp, Artificial Sequence
  Description of Artificial Sequence: Synthetic coding sequence
atggccgccctggagaacggcgagctgggccccctgctgagccccggaactctccgcggactggaggatgagtgtgtgactgatgtgaaggcacagacgcgggctgccctgttacgcgtactacaggaagatgaggagcattggggctcactggaagatcaaccatcatccttggcgcaggatgtttgtgagctgctggaggagcacaccgaacgtgccccccggatcagccaggaattcggagaacggatggcacattgttgtcttggaggactggcggaattcctccagagctttcagcagcgggtggagagattccacgagaacccagctgtacgagaaatgcttccagacacctatatctcaaaaaccatcgcattggtgaattgcggccctcctttgcgagccctggctgagcggttggcccgagttggtcctcccgaatccgaacccgccagagaagccagcgcatcagcactggatcacgtgacaaggctgtgccatcgggtagtggcaaacctcctttttcaggaacttcagccacacttcaacaagctgatgcggcgcaaatggctgtcatcacccgaggctctcgatggcatagtcggcaccctcggcgcccaagcacttgcactgcgacgtatgcaggatgagccataccaagctctggtcgcggaactgcaccgcagagccctcgtggaatacgtgaggccgctgttgcgaggaagactgagatgttcctcagctcgcacacgaagccgagtggccggcagactgcgggaagacgctgcccagctgcagaggcttttcagacgcctggagagccaggcttcttggttggacgccgtggtaccacatctggccgaggtcatgcagctggaagataccccaagtattcaagtagaggtaggggtgctggttagggactaccctgacatccgccagaaacatgtggctgccctcctagacatccgcggcctgcggaacactgcagcaaggcaggagattctcgccgtggcccgggacctggagctctccgaagagggggccctgtcccctccgcgtgacagagcgttcttcgcagacataccagtgccacggccttccttctgcctcagcctgccattatttctgggccgccttcctctgagcaggctagcacgcccaagtctagcctgtctgccacgaccgagacccccttctttggcccgcccacgagctcagaggtag

SEQ ID NO: 47039 - DNA, 1230 bp, Artificial Sequence
  Description of Artificial Sequence: Synthetic coding sequence
atggccgccctggagaacggcgagctgggccccctgctgagccccggcaccctaaggggcttggaagatgagtgcgtgacagacgtgaaagctcagaccagggctgccctactaagagttttgcaggaagatgaggagcattggggaagccttgaagatcaaccatcttccctggcacaagacgtatgcgagctgttggaggagcataccgagagggcgccccgtattagccaagagtttggcgaacgaatggcccattgctgcctcggggggctagcagagttccttcagagctttcagcagagagttgagaggtttcacgaaaatcctgccgtcagagaaatgctgcccgatacctatatctcgaaaacaatcgccttggttaactgtggtccacccctcagagcgctcgcagaaagattagcccgggtgggaccacccgagtcagagcctgcccgggaagcaagtgccagcgccttggaccatgtaacccgattgtgtcacagagtggtagccaacctgctgtttcaggaactgcagccacactttaacaaacttatgcgccggaagtggctgtccagccctgaggccttggatggcattgtcgggacacttggcgcccaggctctcgctttaagaaggatgcaggatgagccgtaccaggcactggttgcagaactccacagaagggccctggtggaatacgtcaggccactactgagggggcgtttacgctgttcttccgcgcggacccgatccagagttgcaggacggctccgtgaggatgcagcacagctgcagagattgttcagaaggctagagagtcaagccagctggctggacgctgtggttccacatctggccgaagtgatgcagttggaggacactccctcaatccaggtggaagtgggagtccttgtccgggactacccagatatccggcagaaacatgtggctgctctcctggatatacgtggcctccgtaacacggctgcccgccaggagattctggctgttgcacgagatctcgagctgtctgaagagggtgctctgtcgccaccacgcgacagagcgtttttcgctgatatccctgtgcctcggccaagtttctgtttgtccctgcccttgtttcttggcagactccccttgagccggctagcaaggccttctttggcttgcctgcctcgcccccggcccccatcactggcaaggccccgtgcacaaaggtag

SEQ ID NO: 47040 - DNA, 2169 bp, Artificial Sequence
  Description of Artificial Sequence: Synthetic coding sequence
atgcccagcccccagaccgacacccccggccccgagctgcagagcccaaaggaggcagaggagcctcaaacacctgcccaggggtctcggcggacttcatctagaaaggagcccaacgcccatcggaaagacgggaccaggctgggtctgggcagtcttcgccaggcttttagcagggcttctcagcgggctctcacacaggttagtaaagaagatactggactgtttcggagaagttcttgttccctgtttcgcagttttcggcaggcactaaacgatggacctgccaccggacattcccaggctacacctgaagtgccctcaggcgtgatgaatggcgtatcacagcaggcatcaaccggggcagcctcagaggagctgaagccagaggccgagggcaaatctgtcgcagatctcataacagagcgccagttgctggccgcctttgagcagcttctcaggttagaaaccttgctggtggccgaaaaagccagtcgtacatttgaacaggaccctaccgccttcgcccggcgggccatggacgtatgcttgctgtacgatgggctcgcagcagaaatcggagctatcgtgagagagactttggattctgatggtgtggatgctgccgcactggcggagctggccagggtggtgagtgccgaggaagaggcacaccctagcccacctgatgacggcgactttctgaggacccctagaaggtggaggcagcattgggaggaagccgtccgccggtcagcacaagaacgggtgcggagaccgggggcagggtgggccttcggtgaagcggagggcgctagtggcctcgctcagctactggcggaactcggcgggcttgtgcgcagagatctgcagaaggttcgccaagaggttcagccagcatacgctgccgcaggatttccggcctgggaggtttatctccgagctttccactcagccgtcgcccagcgtctccaggagctggctagggatgccagggggtgtgagcaactctatatcctgctggattgggcggctaatgtgtacggctctcctgacttcctgggggcccctggcttggccctgcctgcagagccgcttcctcccctcctggcaccagatgtttgggcacggcttgagagcgactacacatcatttcttgaagccaaaatcgcaagctgctttgactccattctacagctcgaacagagtcactgggccgctgccgaggtgcccgaggtgttgcaaggcctgtaccaggcacccctatctatggatgtccacatgctagtggccgagcacgtcaaggccgctggggctatcagcgctgagctcgaggccacaacgcttagaatctgtactagggcactggggctgtttgtgcctcggtttgaaaaggcctttctggcctccgaggcagtgtccgagccccacttaggcgcttatatcaacgcgtgcgaagaactcagaacaagtctgttaagtagattcccgggtacccaggaagaactagagaagccactcgtgacagcaacctgttcttttcaaaaacatctccttcaaggcctccagagggaactacagccactgtttcgagtggtctgtacaagagactggctaacccaggattggcttcatccccttatggacaaggtggtgacattcgcaggacacctgcaacgtgtggctaggcctagagctcaggagactctgcaggaggtgcacagattcgttgtccgagaataccttgctagggcactgcggcccagagagaggttccgtgggatggagcggatgcacggcagccaaaaaatgtcccttgatgcccaggcaattagcgacaccttccagggcctgggtagcgaggccacgtggctggatcaggctatacagtgtgtggcggaaattctgggagaaacctacaaggacgacatccagcggcacctggaaacattgatccggagctacccagacattcgaagagaccacatactggcaatactggcactccgacgcctcggtcgccagagaaatcaacatctgcttcagcacacgcaggacctactgcgcgcagctgccggtgccgcaggggctgaggcccctagagggcgtgtgctcttcgaggaaatcaaggtaccatccgccatggcagtacttatcacttgcgtgtag

SEQ ID NO: 47041 - DNA, 1545 bp, Artificial Sequence
  Description of Artificial Sequence: Synthetic coding sequence
atggaggacagcgagttcctggcctacgtggagctgctggacgaggttgagcagggatctgtgagagcgaaggcctcttccgtttctctacacgcagagcggacctggatggagaagatgaaggtagaagatttgaatgtttgtgaacctgctagtccagctccagaagcgccagcaacatccctcttgaacgacttgaagtactcgccgagtgaagaggaagaggtgacgtatacggtgatcaaccagtttcagcagaaatttggggcggccattctccacatcaagaagcagaacgtgcttagcgtggctgcagaaggagccaacgtgtgtaggcatggaaagttgtgttggcttcaggttgccaccaactgccgcgtttacctgttcgacattttcctgcttggttcaagggcgtttcacaacgggctgcagatgattctggaagacaagagaattctcaaagtgatacacgattgcagatggctgagcgactgcctgtcacatcaatacggcattctgctgaacaacgttttcgatacccaggtcgccgatgtgttgcagttctccatggagaccggagggtaccttccaaactgcattactactcttcaggagagtctcatcaaacatttgcaggtggcgccaaagtacctgtctttccttgaaaaaaggcagaaactgattcaagagaaccccgaagtgtggtttatccgtcctgtgtctccttccctgttaaaaatcctggcgctcgaagccacctacctcctgccactcagactggcactgcttgatgaaatgatgtccgatttgacaacactggttgatgggtaccttaacacttatcgcgagggatccgcagatcggttaggggggaccgagccaacctgcatggaactgcccgaggagttgttgcagttaaaagatttccagaaacaaagaagggagaaggctgcaagagaataccgcgtgaacgcccagggcttattgatacgcactgtcctccagcctaagaaattggtaacagagactgccggcaaagaggagaaagtgaagggcttcctcttcggtaaaaacttcagaatcgacaaagctcccagctttacctcacaggattttcacggcgacgtaaatttactcaaagaagaaagcctaaataaacaggccacgaacccacagcaccttcctccaaccgaggaaggggagacttcggaagactcttccaataagctaatttgcactaaaagcaagggctcagaagaccagcgcattacccaaaaagagcattttatgactccaaagcacgagtttcaggcaagtttgtcactgaaggaagaaacagagcagctcctcatggtcgagaataaagaagatctcaagtgtactaagcaggccgtgtctatgtccagcttccctcaggaaacccgcgtgtctcccagtgataccttttacccaatcaggaagactgtggtttcaacacttcctccctgtccggctctagaaaaaatcgacagctggatcagcccttttctcaatttgccatag

SEQ ID NO: 47042 - DNA, 1719 bp, Artificial Sequence
  Description of Artificial Sequence: Synthetic coding sequence
atggaccccagcagcgactaccacttcctgagccagatcctgtggaaacgcgtaaaactgaccttggtctgtggcgtgtttgaaggcgtactacagcacgtcgatcctaacaagatcgtggtactgaagaaagtcaaaaacgtcgaaacagggcgttcggtgcctggagttaagctgtttttcgggcacgagatcgttaacgtcgagctgctagatgaggtcgaacaaggctctgtgcgagcaaaagcctcctcagtgagccttcatgctgaaagaacatggatggaaaaaatgaaggtcgaagatctgaacgtgtgcgaaccagccagtccagcacccgaagcccccgctacaagtcttttaaacgacctgaaatattccccctccgaagaggaggaggttacatacaccgtgatcaatcagtttcagcagaaattcggggccgctatcctacatattaagaaacagaacgtactgtccgtggccgcagagggcgccaatgtgtgcagacacggaaagctgtgttggcttcaagtggctaccaattgtcgggtttacctcttcgatatttttctgctcgggagtcgcgcctttcataacggcttacagatgattctcgaagacaaacggatcctcaaggtgatccacgattgtaggtggctcagcgattgcctgtcacatcagtacggcattctcctgaacaatgtcttcgatacacaagtggcagatgttctccagttctccatggagactggtggatacctccccaactgtatcacaaccctgcaggaaagcctgatcaagcacctccaggtcgctcctaagtacctgagcttcctagagaagcgccaaaagcttattcaagaaaacccggaagtgtggtttatacggcctgtgagccccagccttttaaaaatcctagctctggaggccacctatctcctcccacttcgtttggccctgctcgacgagatgatgtccgacctgacaacgttagtcgacggttatctgaacacttaccgcgaaggatcggccgacagactgggcggcaccgagcctacttgcatggagctacccgaagagctgctacaactgaaggattttcaaaaacagcgtagggaaaaggctgctcgcgaataccgggtgaacgcccagggcctgctcataagaaccgtcctccagccaaaaaagctggtgacagaaactgctggcaaggaagaaaaggtcaaagggtttctctttggcaagaacttcagaatcgacaaagcaccctctttcacctcacaagactttcatggggacgttaatctgctgaaagaagagtccctgaataagcaggctaccaacccacagcatctgccccccaccgaggaaggtgagacatccgaagattcttctaacaagctaatctgtacaaaaagcaagggctctgaggaccaaaggataacccagaaagagcactttatgacaccaaaacacgaattccaggccagtctgtccttgaaagaagaaactgaacaactgctgatggtggaaaataaggaagatttaaagtgtacaaagcaggctgtaagcatgtcaagctttccgcaagagactagagtcagcccaagcgacaccttctacccaatccgtaaaaccgtagtgtccacattgcctccctgtcccgctttagagaaaatagattcctggattagccctttcctgaacctgccctag

SEQ ID NO: 47043 - DNA, 816 bp, Artificial Sequence
  Description of Artificial Sequence: Synthetic coding sequence
atgagccggcagaacctggtggccctgaccgtgaccaccctgctgggagtggccgtaggagggtttgtcctttggaaggggatccagcgaaggcgccggtcaaagacgagccccgtgacacagcagccgcagcagaaggtgctgggaagtagagagctgcctcctcccgaggacgatcaactccatagctcagctccacgatccagttggaaagagaggatactgaaagcgaaggtcgtcactgtctctcaggaagccgaatgggaccagatcgaaccactgttaagaagcgagctggaagattttccggtcttaggaatcgattgcgaatgggtaaacctggagggcaaggcatcacccctatctctgcttcagatggcctccccctccgggctgtgtgtccttgtgcgacttccaaagttgatctgcggcggtaagactctccccagaacacttctggatattctcgcagatgggacaatccttaaggtaggcgtgggttgctcagaagatgcaagtaaactattacaggactacggtctcgtggtgcggggatgccttgatctgcggtatctcgccatgcgccaacgcaataatctgctgtgcaatgggctcagtctgaagagcctggccgagaccgtactgaacttcccactggacaagagcctactgctgcgttgtagcaactgggacgctgagacgctgactgaggaccaggtaatatacgctgcgcgtgacgcacaaatctccgtggccctgttcttgcacttactcggatatccattctcaaggaacagcccgggtgagaagaggtag

SEQ ID NO: 47044 - DNA, 1866 bp, Artificial Sequence
  Description of Artificial Sequence: Synthetic coding sequence
atgagccggcagaacctggtggccctgaccgtgaccaccctgctgggcgtggccgtgggcggctttgttctgtggaagggaatccagaggaggcggagatctaagactagtcccgttacccaacagcctcagcaaaaagttctaggctccagggagctccctcctcctgaagacgaccagctccatagctccgctccacggagcagctggaaggagagaatcctgaaggccaaagtcgtgaccgtcagccaagaggcagagtgggatcagattgagccactgctgagatctgagctagaggactttcccgtgcttggcatcgattgcgagtgggtgaacctggagggtaaagcctcccccttgtccctcctacagatggcctctccgtctgggctgtgcgtactcgtgagactgcccaagcttatctgtggcggcaaaacactccccaggacgctgctggacattctcgccgatggcactatacttaaagtaggtgtggggtgcagcgaggatgcgagtaagcttctgcaggattacggcctcgtggtaagaggatgcctcgacctgcgctatttggccatgaggcagaggaataacttgctgtgcaacgggctcagtctgaaatccctcgcagaaacagtactcaacttccctttggataagagcttactgctccgatgctctaattgggacgccgaaactcttacagaggaccaggttatttatgctgcacgagatgcacaaatatccgtggcactctttctgcacctcctgggttatcccttctccaggaattctccaggggagaagaatgatgatcactcatcctggcggaaggtgctggaaaagtgccaaggggtggtggacattcctttccgtagcaagggtatgtctaggcttggagaggaggtgaatggggaagctaccgaaagtcagcaaaagccaagaaacaagaaatctaagatggacgggatggttccagggaatcatcagggtcgtgacccaagaaaacacaaaagaaagcccttgggggtgggatactcagccagaaagagtcccctctatgacaattgttttcttcatgccccagacggccagccgctttgcacttgtgaccgcaggaaggcacagtggtatctggataagggaattggtgagctagtgagtgaggagccattcgtagtcaagttgcgattcgaaccggctggtagacccgagtccccaggggattactacttaatggtcaaggaaaatctgtgcgtggtgtgtggaaaaagagactcgtacattcgcaaaaatgtcattccacacgagtataggaaacacttccccatagagatgaaagatcacaatagccatgacgtgttactgctgtgcacaagctgtcatgcgatttctaactactacgacaaccacttgaagcagcagcttgcaaaggaattccaagcacctatcggctccgaggagggcctgagacttcttgaggatcccgagcggagacaggtacgcagcggggcccgcgcgttacttaatgcagaatctctgcctacccagagaaaggaagagctgctgcaggccttacgcgaattctataatactgatgtagtgacggaggagatgctgcaagaggccgctagcttggaaacccggatcagcaacgagaactacgtcccccatggcctgaaggtggttcagtgtcactcgcagggaggcctgaggtctctgatgcaactcgagtctaggtggcgtcagcacttcctagattctatgcagcccaagcatctgccccagcagtggagcgtcgatcacaaccaccagaaacttctgcgaaaatttggtgaagatctgcccatccagttaagctag

SEQ ID NO: 47045 - DNA, 1491 bp, Artificial Sequence
  Description of Artificial Sequence: Synthetic coding sequence
atggccagccccagcggcctgtgcgtgctggtgcggctgcccaagctcatttgtggaggaaaaactctccccagaaccctcctcgatatactggccgatgggacaattctgaaagtgggggtgggctgtagcgaagacgcttctaaattgcttcaggattatggtttagttgttaggggctgtttagaccttagatacctggcaatgcgacagagaaacaatctgttatgcaacggcctgtcattgaaatctctggcagagaccgtactgaatttcccactcgacaagagtctcttgctgcgctgttcgaattgggacgccgagaccctgacggaagaccaggtgatatatgcggccagagacgcccagatctcggtggctctgttcctacacctgttgggttacccttttagtcgcaattcacctggggaaaagaacgacgaccacagttcttggaggaaggtgctggaaaagtgtcagggtgtggttgacatcccatttcggtccaaagggatgagcaggcttggggaggaggtcaacggagaggccacagaaagccagcagaagccccgcaataagaagtcaaaaatggatgggatggttccagggaaccatcaggggcgggaccccagaaaacacaagagaaagcccctgggtgttggatatagtgctagaaaaagcccgctgtatgacaactgctttctgcatgctccagacgggcagccattatgcacctgtgatagaaggaaagcccagtggtacttagataaagggattggcgagcttgtttccgaagaaccattcgtggttaagctgagattcgagcccgctgggcggccggagtcacccggcgactactatttaatggtcaaagagaatctttgtgttgtctgtgggaaacgcgattcttacatacggaagaacgtcattccgcatgagtaccgtaagcactttcctatcgagatgaaagaccacaattcacacgacgtgctcctactatgcaccagttgtcacgcgatctccaattactatgataatcatctgaaacagcagctagcaaaagaattccaggcacctatcggtagcgaagaagggttgcggttgctggaggaccctgaacgccgacaagtgagaagcggagcccgggccctccttaatgctgagagtttgcccacccaaaggaaggaagaattactgcaggcactcagggagttttataacacagacgtcgtgacagaagagatgctacaagaagccgcgtcccttgaaactcggattagcaatgagaattacgtcccacacggcctgaaagtggttcagtgccatagccaggggggactgcgctccctgatgcagctggagtcaagatggagacagcatttcctggactcaatgcagccaaaacacctgccccagcagtggagcgtggatcataaccaccagaagcttctaaggaagttcggggaggatttgccaatccagctctcctag

SEQ ID NO: 47046 - DNA, 1866 bp, Artificial Sequence
  Description of Artificial Sequence: Synthetic coding sequence
atgagccggcagaacctggtggccctgaccgtgaccaccctgctgggtgttgctgtaggcggctttgtgctctggaagggaattcagcggcgcagacgatctaagactagtccagtcacacagcaacctcagcagaaggttctggggtcgagggagctgcctccgccagaagatgatcagttgcactcttccgcgccacgcagtagctggaaggagaggattcttaaagccaaggtcgttaccgtgtcccaggaggccgagtgggatcaaatcgagcctttgctcagatcggaacttgaggacttccccgtgctgggcatcgattgcgagtgggtgaatctagaaggcaaggcttctccactgagtctgctgcagatggcaagtccatcaggattgtgtgtactagtccgccttcccaagctgatctgcggaggcaaaactctgccacggactcttttggacattctcgccgacgggacaatactgaaagtcggtgtgggatgctcagaggacgcgagcaagctactccaagattacgggctggtggtccgcggttgtctggatctgaggtatctggcaatgagacagcggaataatctcctttgcaatggactcagcttgaaatctctggctgagacagtgcttaatttcccactagacaagtctctgctactgcgttgttccaattgggacgcagagacgctgacggaagatcaggtgatctacgccgctcgagacgctcagatctctgttgccctcttcctgcatcttttgggctaccccttttcacgtaacagtcccggagagaaaaatgatgatcattcttcatggcggaaggtgttagagaaatgtcagggcgttgtggacattccctttagatcaaaggggatgtctcgcctgggcgaagaagtcaacggggaagcaacagaaagccaacagaagccgagaaacaaaaagagcaaaatggatggaatggttccaggtaaccatcagggcagagacccccgtaaacataagcggaagccccttggggttgggtattctgccaggaaatcccccttgtatgacaactgcttcctgcatgcgccagacggccaaccactctgcacatgtgatcgcagaaaggcccaatggtatcttgacaaaggcatcggagaattggtgagtgaggagccctttgttgtcaagctcagatttgaaccagccggcaggccagagtcaccaggggactactacctcatggtgaaggagaatttgtgcgtggtatgcgggaagcgggacagctatattagaaaaaatgttatcccccacgagtatcgcaagcacttccccattgaaatgaaggatcataatagccacgacgtgctcctcctgtgcacgtcgtgtcatgcaatctcaaactactacgacaatcatctcaaacaacagctcgctaaggagttccaggcccccattggctcagaggaggggttaagacttctggaagaccctgaacgccggcaggtacgttccggcgccagggctcttctcaatgccgaatctctcccaacgcaaaggaaagaggagcttttgcaagccctcagggaattttataatactgacgtcgtgactgaggagatgctgcaagaggcagcaagtcttgaaaccaggattagtaatgaaaattatgttccccacggcttaaaggtagtgcagtgccatagccagggggggcttagatccctgatgcagctggaaagtaggtggaggcagcacttccttgattccatgcagcccaaacaccttccccagcagtggtcggtggaccacaatcaccagaaactcctgaggaagttcggagaggatttgccaattcagttgagctag

SEQ ID NO: 47047 - DNA, 1491 bp, Artificial Sequence
  Description of Artificial Sequence: Synthetic coding sequence
atggccagccccagcggcctgtgcgtgctggtgcggctgcccaagctaatttgtggcggtaagacccttcccagaaccctccttgatattcttgctgacggcacgattctcaaggtgggagtgggctgcagtgaagatgcctccaagctgctccaggattacgggctcgtcgtgcgagggtgtctagacctgcggtatcttgcaatgagacagagaaacaatcttctgtgtaacggcctgtcattgaagtcccttgccgagactgttctaaatttccctctagataagagtcttctactgcggtgctctaactgggatgccgaaactctgacagaggatcaggtaatttatgccgccagagatgcccaaatctccgtggcgctcttcctacatctcctggggtacccattttcacggaatagtcctggcgagaagaatgacgaccactcatcctggcggaaagtcctcgaaaaatgtcagggggtggtggatatcccattcaggtcaaaaggtatgagccggcttggagaagaagttaacggggaggcaactgagtcgcagcagaagcctaggaacaagaaatctaagatggatggcatggtgcccgggaatcaccagggtcgagaccccagaaagcacaaaagaaaaccactgggagtggggtacagcgcacgaaaatcaccattatatgataactgcttcctgcatgctccagacggtcagcctctgtgtacctgcgacaggcgaaaggcgcagtggtacttggacaagggcatcggtgaactagtaagcgaagagccatttgttgttaaattaaggtttgaacctgccggccgcccagagagcccaggcgactattacctaatggtgaaagagaacctctgtgtggtgtgcggcaagagggattcctacattcggaaaaacgtgatcccccatgaataccgcaagcacttccctatagagatgaaggaccataacagccatgacgtattgctcctttgtactagttgccacgcgattagcaattattatgacaatcatttgaagcagcaactggcaaaagaattccaggcccctatcggatccgaagaagggctgcgtctgcttgaggaccccgagagacggcaggtgcgctccggagcgcgagccctcctgaacgccgaatctctgccaacccaacgaaaggaggagctcctgcaggctctgcgtgagttttataacactgatgtagtgaccgaggaaatgctgcaggaagctgcgtcactcgagaccagaatctccaacgaaaattacgtgccacacgggttgaaagtcgtgcagtgtcattctcagggtggactgagaagcctgatgcaattggaatccagatggcggcagcactttctcgattctatgcagccgaaacatctgccccagcagtggtccgtcgatcacaatcatcagaagctgctaaggaagttcggggaagacctgccaatccagttaagctag

SEQ ID NO: 47048 - DNA, 1491 bp, Artificial Sequence
  Description of Artificial Sequence: Synthetic coding sequence
atggccagccccagcggcctgtgcgtgctggtgcggctgcccaagttgatttgcggtggcaaaacactgccccgcaccctactggacatcctcgcggacggtaccattctcaaagtaggcgtcggctgctcggaagacgccagcaagcttctccaggattacgggttggtggtccgcgggtgcctggatctgagatatctggcaatgcggcagcgtaacaatctcttatgcaatggattgtccctcaagagcctcgccgagacagtgttgaattttcccctggacaagtctttgctgctgcggtgctcaaattgggacgccgagacccttacagaggatcaggtgatttacgccgcgcgggacgctcaaattagcgtcgctctgtttctgcatttgctcggatatcccttttccaggaacagtcctggagagaaaaacgacgatcactcttcgtggaggaaggtgttggaaaaatgccagggcgtggtggatattccgttcaggtccaaaggcatgagcaggttaggcgaggaagtcaacggagaggcaaccgaaagccaacagaagcctcggaataagaagtccaaaatggatggaatggtacccgggaaccaccagggccgcgacccacgcaagcacaaaaggaagccacttggggtgggctatagtgcacgaaaaagtcccctttacgacaattgttttttgcacgctcccgatggtcagcccctgtgtacatgtgatcggagaaaggcacagtggtacctagacaaggggattggcgaactcgtctctgaggaaccgttcgtggttaaactgaggttcgagcctgctggtaggcctgaatcccctggcgattattatctgatggtaaaagagaatctatgcgttgtctgcgggaaacgggatagttacataaggaagaacgtcatcccacacgagtatagaaaacacttcccaatcgagatgaaggatcacaattcccatgatgtcctgttgctgtgtaccagctgtcatgcgatctctaattattatgataatcacctaaaacaacagcttgcaaaggagttccaagctcccattggcagtgaggaaggacttagacttcttgaggatcccgaacgacgccaagtccggtcaggtgctcgggctctactcaacgctgagtcgctgcctacgcaacgcaaggaggagctccttcaggcgctaagggaattttacaatactgacgtagtcacagaggagatgctccaggaggccgccagcctggaaactcggatatctaatgagaattatgtcccccatgggttgaaagtagtacagtgccattctcaggggggcctccgctctttaatgcagttggagtctcgctggaggcagcattttctggattctatgcagccaaaacatctgccccagcagtggagcgtggaccacaaccaccagaaacttctgcgaaagttcggcgaagatttgcccatccagttgtcttag

SEQ ID NO: 47049 - DNA, 1491 bp, Artificial Sequence
  Description of Artificial Sequence: Synthetic coding sequence
atggccagccccagcggcctgtgcgtgctggtgcggctgcccaagctaatttgtggaggcaagacactgccaagaacactcttagatatcctggctgacggaaccatccttaaagtgggggttggctgctcagaggatgcttcgaagctgctgcaggattatggcctggtcgtgcggggatgtttggatctgaggtatctggccatgcgccagcggaataatctgctgtgtaacggcctgtccctcaaatcgcttgcagagactgtgctgaattttccactcgataaatctctgctgcttcggtgttccaattgggacgccgaaacacttactgaagaccaggttatatacgcagccagagacgcccagatcagtgtagccctctttctgcatctattaggctaccctttctctcggaatagtcccggtgagaagaacgatgaccattcatcgtggcgcaaagttctcgagaagtgccagggcgtggtggatatcccctttaggtctaagggcatgtcaaggctcggagaagaggtgaacggtgaagctacagaatctcagcagaagcctcggaataaaaagtccaaaatggatggcatggtgccaggcaaccatcaaggaagggaccccaggaagcataagagaaagccgctaggagtgggttactctgcaaggaaaagccccctctatgacaattgctttctccatgcaccagacggccagcccctgtgtacctgcgatcggcgaaaggcgcagtggtacctcgataagggtatcggggaattagtgtccgaagagccatttgtggtcaagttacgctttgagcccgctggcagacccgagtcacccggagattactacctgatggtgaaagagaatctgtgtgttgtgtgtggaaaaagggactcatacattaggaagaacgtgatacctcatgaatataggaagcatttcccaatcgagatgaaggaccataactcccacgatgtcttgcttctctgcacgagttgtcatgcaatttccaattattatgacaatcatttgaagcaacagcttgctaaggaatttcaggcacctataggcagtgaggagggactcaggctccttgaggatcctgaaagacggcaggtcagatctggagctagagccttgttaaatgccgaaagccttccaacccagaggaaggaagaactgctgcaggctcttagagaattctataacacggatgtggttaccgaagaaatgttacaggaagccgcgtcattagagactcgtatctccaatgaaaattacgtaccgcacgggctgaaagtggtgcagtgtcactcccagggcggcctgcggtccttaatgcagctggaaagtcgttggcgtcagcactttctcgatagtatgcagccaaagcacttaccccaacagtggtctgtggaccataaccaccagaagcttttacgcaagttcggcgaagatctgccaattcagttgagttag

SEQ ID NO: 47050 - DNA, 345 bp, Artificial Sequence
  Description of Artificial Sequence: Synthetic coding sequence
atggccagccccagcggcctgtgcgtgctggtgcggctgcccaagctgatctgcgggggtaagactctgccccgcaccctcctggatattctggcagacggaacaatcctgaaggtgggcgttggctgttctgaagatgcctctaagcttttgcaagactatggattagtcgtgagaggttgtctcgatttgcgatatctggccatgaggcagaggaataatctcctgtgtaatggcctgagcctgaagagcctggctgaaactgtgctgaactttccccttgacaaatctttactgctccgctgttcgaactgggacgccgagaccttaacggaagaccagtag

SEQ ID NO: 47051 - DNA, 1491 bp, Artificial Sequence
  Description of Artificial Sequence: Synthetic coding sequence
atggccagccccagcggcctgtgcgtgctggtgcggctgcccaagttgatctgcgggggcaaaacacttccaaggacgctcctggatattctcgcagacggaactattctaaaagtgggagtgggatgtagcgaagacgcaagcaaactacttcaggactatggactggttgtccgggggtgcctggacctgagatatttggccatgagacagagaaataacttgttatgtaacggcctcagtcttaaatctctggctgagaccgtgttgaacttcccactcgacaagtccctcttgctgcgttgctccaactgggacgccgagaccctcaccgaggaccaagtcatctacgctgcgcgcgatgcccagatctcagtcgccttgttccttcatctgctcggataccccttcagcaggaattcccctggggagaagaatgatgaccattcctcttggaggaaagtcctcgaaaagtgccagggggtcgtggacattccctttaggtcaaaaggcatgtcccgattgggcgaagaggtcaacggagaagccaccgaatctcagcaaaaaccaaggaacaaaaagtctaagatggatgggatggtgccgggcaatcatcagggccgggaccctaggaaacataagcggaagcccctgggcgtcggatattccgcacggaaaagcccactgtatgacaattgtttcctacacgcgccggatgggcaacccctgtgtacgtgcgacagaaggaaggcccaatggtatttggacaagggcatcggggaactggtgtccgaagaaccctttgtagttaagctgagattcgagccagccggcagacctgagtccccaggcgattattatctgatggtcaaggagaatctgtgcgttgtatgcggaaaacgagatagttatatccgtaagaacgtgattccgcacgagtatcgcaagcactttcctattgagatgaaggatcacaactctcacgatgtactcctgttatgtactagttgtcacgcaatcagcaattattatgacaatcaccttaagcaacagctggctaaagaattccaggcaccgatcgggagtgaggaaggcctgcggctgcttgaagacccggaacggcgacaggttagatctggggctcgagccttattgaacgccgaatctctcccaactcagagaaaggaggaactgcttcaggcgctacgggagttttacaacacagacgtggtgaccgaggagatgctgcaggaggcagccagtctggaaacgcgcatttctaatgaaaactacgttccccacggcttgaaggtggttcagtgtcattcccagggtgggttgcgatcattgatgcaactggagtcgaggtggagacagcacttcctggatagcatgcagcccaaacacctcccccagcagtggtctgtcgaccataatcaccagaaactgctacgtaaatttggagaggacttaccaattcagctatcatag

SEQ ID NO: 47052 - DNA, 2631 bp, Artificial Sequence
  Description of Artificial Sequence: Synthetic coding sequence
atggaccccggcgaccccgccggcgaccccgccgccggcgagcggcaccgaatgggccgagaccccctcctcttacttcaggcactgcagaccttgtggtctacccgcgagcgtaaacaactgcgcgaagaggcatggagagggttcgcagcacttgacgacccgttggctggtttacttgacatgctcgagtcctgcagaggccagaggggggagggccccagccttgctgcctggatttcccaccagctccagtgctggctccaggcgcagccatgtccctccttggcccagcacagcctccgcctcaaacaactgcaggcccgagctgtcaaggtcttaactgagtctcctccgtctctggccgcgcctcttgcttccattttccagctgcaggatgctgataggtcatgcttgctcgcccatgtgcatcgcctgcatcatgaaggcagattcagagaggcagctacccttggcgcgacacttaaactccagagcgagttaggcgtcgaaaagatgagcatccctttgctattgcaggataaggtggcattggtagagagatatgtggcaggctttcccgacttacagcgcagactgctagtccttatggactcttggtgtcagccgggtttcgacattaaagacgtcgcaaggaggtatccagaggtcacgagcctgagccttgagaagttgtcccccaaagccctttctcggcaggttctgcgtctgcaggagcgctacggtgtcgccccggctctgtgcccaaatgccgccatccaacaaagacttgctgccctccgacacctttgccacaagcggtttgtcgagaagagcctgtcacaggagaattggactgatcacgttcaagggcttgtggggcagagcccatggctgcaggagcagcttagccagcttcttgtttctcattcagaccccgtcacagctgcccagtgtgccatggaactcctcctccccgaagaaaggctgcctgccgcagtggccgtggagttaagaaggttccggctccagggtagagccacggaggccgattctcgccttgaagtgaaagacatgaaagaccgctattatcaactgccaatccccagggaaaacgttcaccttctggctagttgggaggacctgacaaggcatgagggagccctgctgcagtgccaccaagtcgtgggggtggatgtcgagtggaccccagtgttcgtagccggaggacgacctagacccagtctactccaggtggccgtggagggccatgtcttcttgctcgatgtcctcgctctgtcacagcccccaactggacaaggtgcccaggccttttccagactcgtggcccagttgctctccgacccatcgattaccaagctgggctatgggatggtgggcgacctgcagaaattgggcacgagctgtcccgctctcgcccacgtggagaagcagattctgggggggatggacttgctgcttgttcaccgccagatgagggtagcgtccgtaccagccccggccgtggacagagctagagaacttaggggactctccctattggtccagcaagtgttaggaacggccctggataagacccaacagctcagcaattgggatcgccgcccactgtgtgaggaacaagttatttatgctgccgccgacgcctactgccttcttgaagtgcaccaagccctttgccgtgaacctgcccggtttcatttgtccgaagacctggccggctcccgtcgtcctcgtcacagagagaggcccggcgcccgcaagcctccaggcctgcaaaaggcttctgcaccagccgcgccacgtcaggttcctgttgctgttgccgttagcgagggtgctgcaccacaaattcccgcacgggcctttagggttgtgtgtgacaacatgttgcagggcctcgccagatcactaaggtgtctcggcgttgatgcccgaatgctggggaatggggaagatcatagaagggcagcagaggtagcgagacaagagggtcgcattattttaaccagcggccagccttttcataagctgcgggcccaagtcggcgcaggacggtgtctgtctgtggactgttctctaaaggcgcagcaacaagctaaggctgtgctgaagcacttcaacgtgcgggtcacccatgcggacattttcagccggtgtcaggcctgcaattgtgatcagtaccttaaggtcagccgtgacatgatgaaacagttgatgtggctatcatctcaccaggaagggccccggagtagcggagacgaagctacacagtctcaggccgttcaggagccaggccctgctccggacgccgcacctgaaggctgcacctatgatcgaccctgtcgatggctacagatggccgatctccgggcagaaacaccagatatgctggccgacgggacgcgactgcagctggccggagttccagtgggagtactcaggactcccggactccggtgcttctactgctgcaccggatgtggtaaggtattttgggatggttctcaccttgggcgcgttgctactcatttcagagatatgctagagtcggccccttctccatgcgaaccctcgccggcaccgagtcccgccagctctccattttag

SEQ ID NO: 47053 - DNA, 1545 bp, Artificial Sequence
  Description of Artificial Sequence: Synthetic coding sequence
atggagctgctgctgcccgaggagcggctgcccgccgccgtggccgtggagcttcgtaggttccgactccaggggagggccactgaagctgattcccgcttggaggtgaaggacatgaaagacagatactatcaactaccgattccccgagagaatgtgcatctcctcgctagctgggaagatctcactcggcacgagggcgctttgctacaatgccaccaggtcgtgggagttgatgtggagtggactcccgtgttcgtggcaggaggccgaccgagaccctcactcctgcaagttgcggtcgaggggcatgtgtttctgctggacgtgttggccttaagtcaaccaccaacagggcaaggggcccaggcttttagtaggttagtcgctcagctactcagcgacccgtctatcacgaagcttggttacgggatggtcggcgatctgcagaaactgggcacaagttgtcccgccctggctcacgtagaaaaacaaatcctcggagggatggatctcttactggtgcaccgacagatgcgcgtggccagcgtccccgcgcccgcagtggacagggccagagagttaaggggcctctctctgctagtgcagcaagttctgggaaccgctttggataaaacccagcagctttccaattgggaccgccgcccattatgcgaggaacaggtcatttatgcagccgcagacgcctactgcctgctcgaagtccaccaggccctgtgtcgtgagcctgcccgattccacctgagcgaggacctggcaggctcccggaggcctcgccatcgggaacggccaggagctcggaagcctcccggtctccagaaggcttcagcccccgccgcacctcgccaaggattggctaggagtcttcgttgtctgggcgttgacgctcgaatgttaggcaacggcgaggaccatagacgcgccgccgaggttgccagacaggagggcaggattattctcacatcaggacagcccttccataagctacgtgcccaggtgggcgccgggcgttgcctttccgtggattgcagtctgaaagcccagcagcaggccaaggctgtcctgaaacatttcaacgtgcgggtcacacatgccgacatatttagcagatgtcaggcctgcaactgcgaccagtatttgaaggtgagccgggatatgatgaaacagctaatgtggctttcctcgcatcaggagggcccccggagctccgggccagcccctgacgccgcacctgagggctgcacctatgatcgcccgtgccggtggttgcagatggcagacctccgggcggaaactccggatatgctcgccgacggcacgcgcctgcagctggcgggcgtcccggtgggcgttctccggactcccggcctaagatgtttctactgttgtactggttgcggcaaggtcttttgggatgggtcccacctggggagagttgcaacgcatttccgagacatgctggagagtgctcccagtccttgcgaaccgagccccgccccttcccccgcaagtagtcctttctag

SEQ ID NO: 47054 - DNA, 2682 bp, Artificial Sequence
  Description of Artificial Sequence: Synthetic coding sequence
atgaccccccccagccgggccgaggccggcgtgcggcggagccgggtgccaagcgaagggcgctggcgcggtgctgagccaccaggaatctctgctagcactcagcctgcctccgctgggagagccgcccgccattgcggggctatgtctggcgccagaggagaaggtcctgaagctggggccggtggggcaggtggccgtgctgcccccgaaaacccgggaggcgtcctgtccgtagagctcccaggtctgctggcccagctcgccaggagcttcgcgctcttactgcctgtgtatgccctgggctacctgggtctgtctttttcctgggtgttactggcattagctttgctagcctggtgccgcagaagccggggactgaaggccctacgattgtgcagagctcttgctctcttagaagacgaagagcgcgtggtcagacttggtgtcagagcatgtgaccttcccgcatgggtgcatttcccagacacagagagagctgaatggctcaacaagactgtcaaacacatgtggccttttatatgtcagtttatcgaaaaactgtttcgcgaaacaatagaaccagctgtcaggggggccaatacgcacctgtctacattttcattcacgaaagtcgatgtcggccagcaacccctgcggataaacggtgtgaaagtatacacagaaaatgttgacaaacgccaaattattctagatttgcaaatcagctttgtcggcaattgcgagatcgatctggaaatcaagcgctacttctgccgggccggcgtaaagagcatccagatacatgggaccatgcgagtaatactggagcctctcattggagacatgcccttggtcggcgccctgagcatcttttttctgcgtaagcctctgcttgagatcaattggacaggcctgacaaacctactcgatgtacctggtctgaatggcttgtcggacactattatcctggatattattagcaattatctggtattgcccaacaggataacagtaccattggtgtcggaggttcaaatcgcccagttgcgttttcctgtgccaaagggggtccttaggattcactttattgaagcccaagacctgcaggggaaagatacctatttgaaaggtctcgtgaaaggcaaatccgatccatacgggatcatccgagtaggcaatcagatcttccagtccagagtgataaaggaaaacctgagtccgaagtggaacgaagtttacgaggcacttgtgtatgagcaccctgggcaggagctcgagatcgagctcttcgatgaagatcctgataaagacgatttcctgggcagtctgatgattgacttaattgaggtcgaaaaagaaagactcctggacgagtggtttactttggacgaggtgccgaaggggaagctgcatctcagacttgaatggttaacattgatgccaaatgcctccaacttagacaaggttttgactgatatcaaagctgacaaggatcaggcaaacgatgggctttcctctgcgctcctgatactctacctggactccgcccgaaacctgccatccggcaagaagataagcagcaacccaaatccagtggtgcagatgtctgtgggccataaagcccaagagtccaagattagatacaagacaaacgagcccgtgtgggaagagaattttactttttttatacacaacccaaagaggcaggacctggaggtggaggtgcgggatgagcagcaccagtgctctctcggaaacctcaaggtgccgctgtctcagctcctgacttccgaggatatgactgtttcacaacgctttcagctgagtaatagcgggcccaattccacaatcaagatgaaaattgctttgcgagttctccacctggagaagagagaaagacctccagatcatcagcattcggctcaggtcaagcggccaagcgtgtctaaagaaggacggaaaactagcatcaagagccacatgagtggaagccccgggccaggcgggagcaacacggcacccagtacgcctgtcatcggcggatcagacaaaccaggaatggaagagaaagcccagccccctgaagcaggccctcagggtctccatgacttgggcaggtccagctcatctctcctggcctcacctggacacatttccgtcaaggagcccactccatcaatcgcaagcgacataagcttacctattgcgacccaggaactgaggcagagactccgacaactcgagaatgggactaccttgggacaaagccccctgggccagatacaactcaccatccgccattctagccagcggaacaaactgatcgtggtggtccacgcctgccgaaacctcatagccttttccgaggacgggagtgatccatatgttcgaatgtaccttctaccagataaacgaagaagcggcaggcgtaaaacacacgtgagcaaaaagacactgaacccagtcttcgaccaatcctttgacttttccgtgtccttgcccgaagtgcagaggcggactctcgacgtagcagtgaagaatagcggaggttttctctcaaaagataaaggactcctcggcaaggtgttggtggcgctggcctctgaggagctcgccaagggctggacacagtggtacgacctcaccgaggacggtacccgaccccaagctatgacatag

SEQ ID NO: 47055 - DNA, 672 bp, Artificial Sequence
  Description of Artificial Sequence: Synthetic coding sequence
atgcccgtgttccccccctgcgtgctgcaggtgcgggacgagcagcatcagtgctctctgggcaaccttaaggtgcccctgtcacagctgctgacatctgaggatatgaccgtgagtcagaggttccagctctcaaacagcgggccaaacagtacgatcaaaatgaagattgctttgcgtgtactgcatctggagaagcgcgaacgcccccctgatcaccagcactctgcgcaggtcaagcgcccctccgtcagtaaagaagggcgaaaaacatctatcaaaagccacatgtccgggtcaccgggacccggaggctccaataccgcgccctctactcccgtgattgggggctctgataagcctgggatggaagaaaaagcacagccgccagaagctggccctcaagggctgcacgacctaggccgatcatcatctagtctgctcgccagtcctggacatatttcggtgaaggagccaaccccaagcattgcgtctgacatttccctgccaattgcgacccaggagctgagacagagactgcgacagctggaaaatgggactacactcggacagtcgccactaggacagatccaactcacaattcggcatagttcccagaagcaagcgtaccgcggcagagcatgtttacagaagccacattgcttgctgtag

SEQ ID NO: 47056 - DNA, 2829 bp, Artificial Sequence
  Description of Artificial Sequence: Synthetic coding sequence
atgaccgccaaccgggacgccgccctgagcagccaccggcaccccggatgtgcacagcgtccacggacacccactttcgcaagctcaagccaacggcgctccgcatttgggttcgatgatggcaatttcccaggcctaggagagagaagccatgctcccggatctagactgggtgctagacggagagcgaagacagcccgaggcctgcgggggcatagacagcgaggcgccggggcagggttaagtcggcctggaagtgcaagggccccatctcctcctcggcctggagctccagagaacccaggaggggtactgagcgtcgagctgccaggactcctggctcagttagccaggtcgtttgccctcctgctgcctgtttacgccctggggtatctgggtttgtccttcagctgggtgcttctagctttggctctgttggcttggtgccgtcggtctcgggggctgaaggctctgcggctgtgcagagctcttgctctgttggaggatgaagaaagggtcgtcagactgggagtgcgagcttgcgacctgccagcctgggtgcatttccccgatacggaacgcgctgagtggcttaataagacagtgaaacatatgtggccattcatttgccagttcattgaaaagctgtttcgtgagacgattgagcccgccgtacgcggcgctaatacccacttgagcaccttttcattcactaaggtggacgttgggcagcagcccctcaggataaatggcgtaaaagtgtacactgagaatgtcgacaaacgccagatcatcctcgatctgcagatatcattcgttggcaactgcgagatcgacctggaaataaagcggtacttctgtagagccggcgtgaagtccatacagatccatggcactatgcgggtgatcttagagcctctgatcggggacatgccactcgtcggagccctgtcgatattttttctccggaagccactgcttgaaattaattggacagggcttactaaccttctggacgtgcccggactgaatgggctctctgacaccataattttagatattatctccaactatctggtcctccccaacagaatcaccgttccactggtttcggaggtccaaatcgctcagctccgatttcctgttccaaagggcgttctgcgaatccattttatcgaggcccaggatcttcagggaaaagatacgtatctgaagggactcgtaaagggtaagtccgacccctatggtataataagggtggggaatcaaatcttccagtcccgggtcatcaaagaaaacctcagtccgaagtggaatgaggtttacgaagcactcgtatacgagcacccgggacaggagctggagatcgaactgttcgatgaggacccagacaaagatgacttcttagggagtctgatgatagaccttattgaggtggagaaggaaagactgctggacgaatggtttacccttgacgaggtgccaaaaggcaaacttcacctgcgcctggagtggctcaccctgatgccgaatgcttccaatttagataaagtgctgacagatattaaagcggacaaggatcaggcgaatgatgggctaagtagtgccctgctcattctttacctggactccgcccgtaacctcccttctaatccactcgagttcaatccggacgtgctgaagaaaacggcggttcagcgagctctgaaatctggtaagaaaatctcatctaatccaaatccggtcgtccagatgtccgtgggccataaagctcaggagtccaaaattcggtacaagacaaatgagccggtctgggaggaaaacttcaccttctttatccataacccaaagaggcaggatttggaggtggaggtgcgggacgaacagcatcagtgcagcctgggcaaccttaaagtcccacttagccaactactaacgagcgaagacatgactgtctcccagaggtttcagctctctaactcggggcctaactccaccattaagatgaagatcgctcttagagtgctgcatctggaaaaaagagagaggccccccgaccatcagcactccgcccaggtcaaaagacctagcgtctccaaggaaggacgaaagacaagtatcaagtcacatatgtccgggtcccccgggccaggtggcagcaacaccgcgccttccacaccggtaatcggggggagcgacaagcccggaatggaggagaaggcccagcccccagaggctggtcctcagggtctccatgacctgggtcggtctagttcaagcctgctcgcatcccccggtcacatctcagtgaaagaaccaacaccaagcatagcaagcgacatatccctgccaattgcaacccaggagctgcggcaacgcctgcgccagctggagaatggcactacactcggtcaaagtcctctcggacagatccagctcacaatcaggcactcctcccagcggaataaactgattgtggtcgtgcacgcctgtagaaaccttatcgctttttctgaggatggttcagatccttatgtgcgcatgtatctgttgccagacaaaagacggagtggccggaggaaaacccacgtttccaaaaagacacttaacccagtattcgaccaaagctttgactttagcgtgagtctacctgaggtgcagcgcaggacactcgacgtggccgtaaaaaattctggagggttcctctccaaggataaggggctgctggggaaggtgcttgtagcgttggcctcagaggaattggctaaaggttggactcagtggtatgatctcacagaggatggcaccagacctcaggctatgacatag

SEQ ID NO: 47057 - DNA, 1584 bp, Artificial Sequence
  Description of Artificial Sequence: Synthetic coding sequence
atgtggcccttcatctgccagttcatcgagaagctgttccgggagactatcgaacctgccgtcaggggagctaacacacacctgagcactttttcctttaccaaggtggacgtcgggcagcagcctctccggataaatggcgtcaaggtgtacactgagaatgtggacaaacggcaaattatcctcgatctgcaaatcagtttcgtcggaaactgtgagattgatctcgaaataaaaaggtacttctgcagagccggcgtgaaatctatccagattcacggtacaatgagggtcatcttagagccactgattggtgatatgccgctcgtgggagctctttctatattttttctacgcaagccactcctggagatcaattggactggcctgacaaatctgttggatgtccctggactgaacggactttcggataccatcatcttagacattatctccaactatctggttctgccaaatcgaatcactgtgcctttggtcagtgaagttcagattgcccagctgcggttcccagtgcccaagggagtgctgcgtatccactttattgaagcccaagatctgcagggaaaagacacatatctgaaaggcctggtgaaaggaaagagtgacccctatgggataatcagagtgggaaaccagattttccagagccgggtgatcaaggaaaacctgagtcccaaatggaacgaagtgtacgaagccctcgtttatgagcatcctggtcaggaactcgaaatcgaacttttcgacgaggatcccgacaaagacgatttcctgggatcccttatgatcgatctaattgaagtggaaaaggagcgcctgcttgacgaatggtttacgctcgacgaggtgccaaaaggaaaactgcacctccggctggagtggctgactctcatgcctaatgccagtaacctggacaaggtgctaaccgatatcaaagccgataaggatcaggctaacgatgggttgagctccgcgctactcattctgtatctggatagcgccaggaacctgcccagcgggaaaaagatcagctctaaccctaatccagtggtacagatgtctgttggacacaaagcccaagagtctaaaatacgatataagactaatgagcccgtatgggaggaaaacttcacattttttattcataatcctaagagacaggacctcgaagttgaggtccgcgatgagcagcatcaatgctcactgggcaacctgaaagtacctctctctcagctactgacgtccgaagatatgaccgtgtcacaacgtttccaactctctaattcgggtcctaacagcacaataaaaatgaaaattgccttgcgagtacttcatctcgaaaaacgcgagagaccccccgaccaccagcattccgctcaggtcaagaggccatctgtctccaaggagggaaggaagacgtctattaagagtcacatgtctggaagcccaggtcccgggggctccaatacggccccagccacatctcagtcaaggtcaagacctcccgcctctcctagaacgtcacggtgtccgtccccccccaggagttgtggcaagggctag

SEQ ID NO: 47058 - DNA, 987 bp, Artificial Sequence
  Description of Artificial Sequence: Synthetic coding sequence
atgcccgtgttccccccctgcgtgctgcaggtgcgggacgagcagcaccagtgtagcctcggcaacctgaaggttccactctctcagctccttacctctgaagatatgaccgtgtctcagcggtttcaactgtccaacagtggccctaacagcaccatcaagatgaaaatagcattgagagtcctgcacctggagaaacgcgaaagaccacccgaccatcagcattccgcccaggtcaagaggcctagtgtctccaaggagggccggaaaacgtcaatcaaatcccatatgagcggaagcccgggcccaggagggtcgaacactgctccctcgacacccgtgatcggaggctctgataagcctggtatggaggaaaaggctcagccgcctgaagcggggcctcagggcctgcacgacctcggacgcagctcgtcctccctcctggcctctccaggccatatttcagtgaaggagcctaccccctcgatcgcaagtgacatttcattgcccatcgccacccaggaattgagacagaggcttagacagttggaaaacggcacaaccctgggacaatctcccctggggcaaatccagcttacaatcaggcatagtagccagaggaataagctgattgttgtggtccacgcctgtcgaaatttaatcgcattcagcgaggatgggagtgacccttatgttagaatgtacttgctcccagataagcggcggagtggacgtcgtaagacgcacgtgagtaagaaaactcttaacccagtatttgaccagtcttttgacttcagcgtatctctgcccgaggtccaaaggagaacattagatgtagctgtgaagaatagcggcgggtttttgagcaaggacaagggtctgctcggaaaggtgcttgtagccctggccagtgaggaattggcaaaagggtggactcaatggtacgacttgaccgaggacggaaccaggccacaagctatgacttag

SEQ ID NO: 47059 - DNA, 2487 bp, Artificial Sequence
  Description of Artificial Sequence: Synthetic coding sequence
atggccggccggggctggggcgccctgtgggtgtgcgtggccgccgctactctgctgcacgccggaggcctggctagagctgactgctggctgatagagggagacaaagggtttgtctggctcgctatctgctctcaaaaccagcctccttatgaggcgatcccgcagcaaatcaatagtactatcgttgacttgcgattaaacgagaaccggatacgttccgtccagtacgcttctctgtcacgctttggcaatttgacatatctgaatcttactaagaacgagatagggtacatcgaggatggggcatttagtgggcaattcaaccttcaggtcctgcagctggggtacaaccgcttaaggaatttgaccgagggaatgctgcgtggactaggaaagctggagtacttatacctgcaggccaatctgatcgaggtggtcatggccagcagtttctgggaatgcccgaatatcgttaacatcgatctatctatgaatcggatccaacagctgaattccggcaccttcgcaggcctggctaagcttagtgtgtgcgagttgtacagtaaccccttctactgcagttgcgaactcctggggttcctgagatggcttgcggcgttcacaaatgccacccagacctatgatagaatgcagtgtgagtcaccacctgtgtactccggctactacttgcttgggcaggggcgaagagggcacaggtctattctttccaagctgcagtctgtgtgcactgaggactcttacgccgccgaggtcgtgggccctcctcgcccagcctcaggccggtcgcaaccagggcgctctccccccccaccacccccccctgagccatcagacatgccctgtgcagacgatgaatgcttctccggcgacggcaccactcctctcgtggccttacccactttggccacgcaggccgaagctcgtcctttgatcaaggtgaaacagctgacccaaaactcagccactatcacagttcagcttccaagcccctttcaccgtatgtacaccttggaacatttcaataattcgaaagcaagcactgtgtctcggctcacaaaggcacaggaggagatcagattgactaacctgtttaccctcaccaattatacatattgtgtcgtaagcaccagtgctggcctacggcacaatcacacctgtctcactatctgcctgccacggctcccctccccacctggacccgtgccctcaccatctacggccacgcactatattatgacaatcctgggttgtttgttcgggatggtgctggtgttgggcgcggtttattactgtctccgtcgcaggcgccgccaggaggagaagcacaaaaaagccgcctctgcagccgctgccggaagcctgaagaaaaccattattgaacttaagtatgggcccgaactcgaggcccccggattggccccactgagtcagggaccgttactgggaccagaagcagtaactcgcataccatatctgccagcggccggtgaggtcgaacagtacaagctggtcgagagcgcagatacgcccaaggcaagcaagggttcgtacatggaggtacgaacgggcgaccccccagagagacgggactgtgaattgggacgcccaggacccgattcacagtcaagcgtcgctgagatctcaaccatcgcaaaggaagtggataaggtcaaccaaattataaacaactgtatagacgcactcaaaagcgagtccacctcctttcagggcgtgaagagcgggccagtctccgtggcagaaccacccctcgtgttgctttccgaacctttagccgctaagcatgggttcctggcccccggatataaggacgcgttcggccacagcttacagaggcaccatagtgtagaagccgccgggcctccgagggcaagcaccagctcctccgggtccgtccgatcacctagggcctttagagccgaggccgtcggcgtacataaagcggccgcagctgaagccaagtatatcgaaaaggggtcacctgccgcagatgccattctgacagtgactcccgcggccgctgtgcttcgtgcagaggccgaaaagggaagacagtatggcgaacaccgccattcctatcccggatcacacccagccgaaccccctgctcctccaggcccgccccccccgccaccacacgagggactaggcagaaaggcctctattctggaaccactgacacgcccccgccctcgagatctggcatattcacagctgtccccacaatatcattcactgagctatagcagcagcccggaatatacctgcagggctagtcagtccatctgggagcggttcaggctttcccggaggcgtcacaaagaggaggaagagtttatggcggcaggccacgctctgcgcaagaaggtacagttcgctaaggatgaagatctgcatgacattctagactactggaaaggcgtctccgcccagcacaagtcatag

SEQ ID NO: 47060 - DNA, 2487 bp, Artificial Sequence
  Description of Artificial Sequence: Synthetic coding sequence
atggccggccggggctggggcgccctgtgggtgtgcgtggccgccgccaccttgctgcacgctggcggattggcgagggccgactgctggctgatcgagggtgataaaggattcgtgtggttagcaatttgctcccaaaatcagccgccatacgaagcaataccccaacagataaatagcaccattgtcgatctgaggctgaacgaaaatcgtataaggtcggtgcagtatgccagcttatctaggtttggcaacctgacatacctgaacctgacgaaaaatgaaattggatatattgaagacggcgcctttagtggccagtttaatctgcaggttctccagctaggctataaccgactgagaaatctgacagaggggatgctccgcggcttggggaaactggagtacctttacttgcaggcgaatctgatagaggttgtgatggcctccagtttctgggagtgccccaacatcgtgaacatagacctgagcatgaacaggattcaacagctcaacagcggcaccttcgcggggttagctaagctgtccgtgtgtgagctctactccaatcctttctactgctcttgcgaacttctagggttccttcgatggctcgccgccttcaccaatgccacccaaacatacgataggatgcagtgtgagagcccaccggtgtattctgggtattatctacttggccagggaaggcgtggccacaggagtatcctctctaaactgcagtccgtctgcaccgaggactcttacgccgccgaggtagtcggcccgcctaggccagcaagtggcagaagtcagccaggccggagtccccccccccccccaccacccgaaccatctgacatgccttgcgcagacgatgagtgtttctctggagacggaaccacccccctcgtcgcgctacctacactcgcaactcaagcagaagcgcggccactcataaaggtgaagcaattaactcagaattcagcgacaataacagttcagttgcccagtccctttcatcgaatgtacacactggagcacttcaataattccaaggcgtctactgtgagccgtctgaccaaagcgcaggaggagatacggcttactaacctgtttaccttgacaaattatacttactgtgtggtttctacgtccgccggattgaggcacaatcatacatgtctgacgatatgcctcccaagactcccatcaccaccagggcccgtgcctagcccaagcacagccacccattatatcatgaccatcctgggatgtctttttggaatggtgttagtattgggtgccgtgtattattgcctgaggcgccggcgccgccaggaagagaaacataagaaggctgcgtctgccgcggccgcgggtagtctgaagaaaactattatcgagctgaagtacggccctgagctcgaggccccggggcttgcccccctgtcacagggaccccttctggggcctgaggcagtgactcggattccctacctccctgccgctggcgaggtcgaacaatataaactggttgagtcagccgacactccaaaagcctccaaggggtcttacatggaagtgagaactggcgatccaccagagaggagggactgcgaactaggacggcccggaccagattctcagtcaagcgtggctgagattagcactatcgctaaggaagttgacaaggtgaatcaaatcatcaataactgtattgacgcactgaagtccgaatctacaagttttcagggcgtcaagagcggcccggtttctgtcgcagagccacctctcgtgctgctctccgaacccttggccgccaagcacggatttctcgcgccagggtacaaggacgcgttcggacactctctccagagacatcacagcgttgaagccgccgggccaccccgggcctccacatcctcttcgggttctgtgagatctccccgcgccttccgagctgaggcagtcggcgttcataaagccgctgcggctgaggccaagtacattgagaaagggtccccagcagctgatgccatactgaccgtgacccctgccgcagctgtcctccgggctgaggctgagaaaggtcgacaatatggcgaacataggcattcctaccccgggtctcaccccgctgaaccccccgcaccccccgggcccccacctcccccacctcacgaagggctcgggcggaaggcatctattttggagccactgacccggccccggccgagagatctggcgtattctcagctttcaccgcagtaccactccctgagctactcaagctcacctgagtatacctgccgagccagtcagagcatctgggagagattcaggttaagccggaggcgacacaaagaagaggaggaatttatggcggctggacatgccttgaggaaaaaggtgcagttcgccaaggatgaggaccttcacgatatcctggactactggaaaggtgtgtcagcccagcataagtcctag

SEQ ID NO: 47061 - DNA, 495 bp, Artificial Sequence
  Description of Artificial Sequence: Synthetic coding sequence
atgctgcagcaggacagcaacgacgacaccgaggacgtgagcctgtttgatgccgaagaggagactacaaatcgcccacgtaaggctaaaatcagacacccggttgcaagcttttttcatctgttttttcgagtctccgctataatcgtgtgtttactctgcgaacttctctcaagttcttttataacatgcatggttacaatcattcttctcctaagttgcgatttttgggccgtgaaaaatgttactggccgcttgatggtcggcctgagatggtggaatcacatcgatgaggatggtaagagccattgggttttcgaatctaggaaagaaagcagtcaagagaataagaccgtctccgaagccgaaagccggatattctggctgggtcttattgcctgttcggtgctgtgggtgatctttgccttcagcgctctgttcagctttacagtgaagtggctggaatccgaacctgtgatgctccgcaatcagtag

SEQ ID NO: 47062 - DNA, 534 bp, Artificial Sequence
  Description of Artificial Sequence: Synthetic coding sequence
atgagcgtgaacatggacgagctgaagcaccaggtgatgatcaaccagtttgtactgacagcgggatgtgcagccgaccaggctaagcagcttctacaggccgcccattggcaattcgaaaccgcactgtccgcgttcttccaggagaccaatattccatatagccatcatcaccaccaaatgatgtgcaccccagccaatacccccgccacgcctcctaactttccagatgccctaactatgtttagtcgcttgaaggccagcgagtcctttcactcagggggaagcggaagcccgatggcggccacggctacatccccaccaccacacttcccacacgcagccacaagcagtagtgcggcaagcagctggccgactgcagccagtccacctggcggaccccagcatcatcagccgcagccccccttgtggacccccacaccccccagtccagcatctgactggcctcctctggccccacagcaggctacttctgaacctcgtgcccaccctgccatggaggcagagaggtag

SEQ ID NO: 47063 - DNA, 495 bp, Artificial Sequence
  Description of Artificial Sequence: Synthetic coding sequence
atgagcgtgaacatggacgagctgcggcaccaggtgatgatcaaccaattcgtgctggccgcgggctgtgctgctgatcaagccaagcagctgttacaggctgcgcattggcagtttgagacagctcttagtaccttcttccaggagacaaacattcctaactctcaccaccaccaccagatgatgtgtactccatctaacacccctgccacccctccgaatttcccagacgctctcgccatgttttcgaaactaagggccagcgagggactgcaatctagtaactcaccaatgacggccgccgcctgtagccctccagccaacttttcacccttttgggctagctcgcccccaagccatcaggccccctggattccaccgtctagtccgactacatttcatcacctccatcgaccccaacccacctggcctccaggggcacaacagggaggcgctcaacaaaaggccatggcagccatggatggtcagagatag

SEQ ID NO: 47064 - DNA, 435 bp, Artificial Sequence
  Description of Artificial Sequence: Synthetic coding sequence
agccccgccagcctgcccctggcccccggctgcgccctgcggctgtgtccactttcctttggagaaggggttgagtttgatcccctgcccccaaaggaggttagatacacaagcctggtcaaatatgattccgaaagacatttcatcgacgacgtgcagctgccactagggctggctgttgcgtcttgttctcagactgtcacatgtgtgcccaatgggacatggaggaactacaaggctgaagtgagatttgagccccgtcaccgccccacccggttcctgtcgacaaccatcgtgtaccctaaatatcctaaggcagtgtacaccacgaccctggactataactgccgaaagaccctccgtcgatttctcagctccgtagagcttgaagcagcagagttacccggctcagacgacctttccgacgagtgttag

SEQ ID NO: 47065 - DNA, 408 bp, Artificial Sequence
  Description of Artificial Sequence: Synthetic coding sequence
atgcggccccggatgctgcccgtgttcttcggcgagagcatcaaggtaaatcctgaacccacccacgagatccgttgtaacagcgaggtgaagtacgctagtgaaaaacattttcaagataaagtcttttacgcaccagtgcctacagtgactgcttactcagaaacaatagtcgctgcgccaaattgcacctggaggaattaccgctcccagctgactctcgaacctagaccgagggctctgcggtttcgttccaccaccatcatctttccaaagcacgcccgctccactttccggacaacactgcactgttccttaggtaggcctagccgctggtttaccgcctctgtccagctccagttatgccaggatcccgcaccttcactgctcggaccggctacactgtag

SEQ ID NO: 47066 - DNA, 408 bp, Artificial Sequence
  Description of Artificial Sequence: Synthetic coding sequence
atgcggccccggatgctgcccgtgttcttcggcgagagcatcaaggttaatcccgaaccaacgcacgaaattcggtgcaactccgaagtcaagtatgcaagtgagaaacattttcaggacaaagtcttctatgcgcctgtgccaaccgtaacagcttactccgaaacaatcgtggcagctcccaattgcacctggcggaattaccgctcacaattgacactggaaccgagaccaagagccttgcggtttcggagtaccacgatcatctttcctaagcatgcacggagtacctttcgaactactctccattgttctctgggccgcccttccagatggttcacagccagcgttcagctgcaactgtgtcaggaccccgccccctccctcctgggccctgccactctgtag

SEQ ID NO: 47067 - DNA, 651 bp, Artificial Sequence
  Description of Artificial Sequence: Synthetic coding sequence
atggtgggccacctgcacctgcagggcatggaggacagcctgaaggagcagggcagggaaggtctcctggactctcccgactctgggttgcccccctcaccctccccctccccacccttttactctttggccccaggtattctggatgcccgtgcaggaggggccggggcttcttccgagcccccgggcccgtctgaggccagagccccaccatctcagctcccgaatcctcccgcatctgaaatgcgtcctcgaatgctgcctgtgtttttcggcgaaagcatcaaggttaaccctgagcctacacatgagatcagatgcaatagtgaggttaagtacgcatcagaaaaacattttcaagataaggtgttctacgcccccgtgccaactgtaaccgcttacagcgagaccatagtggctgccccaaactgtacgtggagaaattacaggtcccagctgacactggaacccaggccaagggcgctccgctttcggagtaccacaatcatattccccaaacatgcacgatcaacgtttcgaactaccctacactgctccctggggcggccttcgagatggttcacagcgtccgtccaattgcagctgtgccaagaccctgcaccttctcttctaggcccggcaacattgtag

SEQ ID NO: 47068 - DNA, 369 bp, Artificial Sequence
  Description of Artificial Sequence: Synthetic coding sequence
atgcggccccggatgctgcccgtgttcttcggcgagagcatcaaggtgaacccagagcccacccacgagatcagatgtaattccgaggttaaatatgcttctgaaaaacatttccaggacaaagtgttttacgcccctgtccccaccgtgacagcttattctgaaactatcgtggccgcacccaactgcacttggcggaattacaggtcaagatggtttaccgcctccgtccagctgcaactttgccaggaagcaggccgtgaagcggcaaggccacgcaccagagtggaaggtggaggaagtcctctgccagccctgacctataggctgggaggggggttgttggttctggtgtctcggacccaatag

SEQ ID NO: 47069 - DNA, 408 bp, Artificial Sequence
  Description of Artificial Sequence: Synthetic coding sequence
atgcggccccggatgctgcccgtgttcttcggcgagagcatcaaggtgaatcctgagccaacacatgaaatccggtgtaattcggaggtgaagtacgcgagcgagaagcattttcaagataaggtgttttatgcgcccgttccaaccgttacagcatattccgagacaatagttgccgcccctaactgtacctggcgaaattaccggagtcagcttactctcgagcctagacccagggctctacggttcaggtcaactactatcatctttccaaagcatgcgcggagtacattcagaaccactcttcactgcagcctcggccgacccagccgctggtttacagcatctgtgcagctccagctgtgccaggaccccgcccctagtctcctgggccctgctactctatag

SEQ ID NO: 47070 - DNA, 435 bp, Artificial Sequence
  Description of Artificial Sequence: Synthetic coding sequence
agccccgccagcctgcccctggcccccggctgcgccctgcggctgtgtccgctatcatttggagagggtgtcgagtttgaccctctgccaccaaaagaggtacgttacacttctcttgtgaagtatgactcagagaggcacttcattgacgacgttcagctgcctctcggcctggcggttgccagttgctcacaaactgttacttgtgttccaaacggcacttggcgcaactacaaagcagaggttcgcttcgagccaaggcaccgccccaccagattcctgagtaccaccattgtatatccaaagtacccaaaggccgtgtacaccaccactctggactacaattgcaggaagacattaaggagatttctctcaagcgtggaacttgaagcggcggaactgccaggatcagatgatctttccgacgagtgctag

SEQ ID NO: 47071 - DNA, 1083 bp, Artificial Sequence
  Description of Artificial Sequence: Synthetic coding sequence
atgatgaagaagaagaagttcaagttcaaggtggacttcgagctggaagaattgtcctcagttccattcgtgaatggtgttctgttctgtaagatgcggctgctcgatggcggatcattcacagctgagagtagtcgagaagtcgtccaggccaactgcgtgcgctggcgcaaaaagtttagtttcatgtgtaagatgtctgcgtcggccgccaccggtattttggatccttgcatctatagagtcagtgtgcgcaaggaacttaaaggaggaaaagcctacgccaagttgggctttgccgatcttaacctggccgaatttgctgggtctggcaataccacccgccggtgcctgctagaaggctacgacacaaagaacacccgacaagacaattctatcttgaaggttctcatctctatgcagctgatgtccggtgacccttgtttcaaaaccccaccctctacctctatgagtattccaattgccggcgagagtgaaagtttgcaggaggatcgaaaggggggggaaacgctcaaggtgcacctgggtattgccgacttgagtgcaaagagcgcgagcgttcccgatgagctgggggcatgcgggcattcaagaactagctcttatgcctcgcagcagtctaaagtttccggttactccacatgtcattcccgctcctcaagcttcagcgaactgtgtcacaggcgtaataccagcgtgggctcaacctccaccggggtcgaatcgatattggagccatgcgacgaaatagaacagaagatcgcggaaccgaatctggacaccgcggataaggaggatacagcctctgagaagttatccaggtgcccagtgaagcaagatagtgtggaaagtcaacttaaaagggtggatgatacaagagtagatgcagacgatatcgtggagaagatccttcagtctcaggatttctccctggatagtagtgctgaggaagaaggtctgcgcctcttcgtgggacccggtggaagcactacctttggttcccaccatctaccgaaccgagtcggttctggtgcttacgagcaggtggtaattaaacgttag

SEQ ID NO: 47072 - DNA, 1068 bp, Artificial Sequence
  Description of Artificial Sequence: Synthetic coding sequence
atgatgaagaagaagaagttcaagttcaaggtggacttcgagctggaagaactgagtagtgttccttttgtcaacggcgtgctgttttgcaagatgagacttctagatggtggcagttttactgctgagtcaagtagagaggtggtgcaggccaattgtgttagatggcgcaagaaattttcttttatgtgtaaaatgagcgcaagtgcggcaacaggtattctggatccctgcatatatcgagtgtcagtgcgaaaggagctaaaggggggtaaggcctatgctaaactgggattcgcggacttgaatctggccgagtttgcgggctccggcaacacaacccgacggtgtctcctggaagggtacgacacgaaaaataccaggcaagacaatagcattctgaaagtactgatctcaatgcagttaatgagcggagacccttgctttaaaacgccaccaagcacttccatgtccattccaattgcaggggagtcagaatcccttcaggaggatcgaaagggtggcgagaccctgaaagtgcatcttggcattgcagatctgagtgccaagagtgcaagtgttccggatgagttaggagcttgcggacacagtcggaccagctcttatgcaagccagcaatctaaagtcagtggctacagtacatgtcactccagaagttcaagctttagcgaactgtgccatcgccgaaacacatcggttggcagtacatctactggcgtcgaatcgattctggaaccctgcgatgaaattgagcagaaaattgccgagcctaatcttgataccgccgacaaagaggatactgccagcgaaaagctctctcgttgccctgtgaaacaggattccgtggaatcccagctcaagcgtgtagacgacacgcgtgtggatgccgacgatatcgtcgaaaaaatcctgcagtctcaagatttttccctggattcttctgccgaggaagagggtctcaggcttttcgtgggtccaggaggctctactactttcgggtctcaccacctgccgaattcctttctgaatagcggaagtctgatttag

SEQ ID NO: 47073 - DNA, 357 bp, Artificial Sequence
  Description of Artificial Sequence: Synthetic coding sequence
atgaccgacaccgccgaggccgtgcccaagttcgaggagatgttcgcatccagattcacggagaatgacaaagaataccaggagtatctaaagcggcccccagaatctcccccgattgttgaagaatggaactcgcgagcaggtggcaaccagcggaaccgcggtaaccgtctgcaggataatcggcagtttcgaggccgggacaatcgttggggttggccgtcagacaaccggtccaaccaatggcacgggaggtcatggggtaataactaccctcagcacagacaagagccgtactaccctcaacagtacggacattacgggtacaatcagcgtccaccgtatggatattactag

SEQ ID NO: 47074 - DNA, 141 bp, Artificial Sequence
  Description of Artificial Sequence: Synthetic coding sequence
atgggcggctgccccgtgcggaagcggcggcggaacggcagcaaggaaggtaaccaccacagcacccagcccaaacggaataagcgcaacccaatcttccaagactctcaagacaccgaagttgccatattcatggaatag

SEQ ID NO: 47075 - DNA, 339 bp, Artificial Sequence
  Description of Artificial Sequence: Synthetic coding sequence
atgacctgccggaagcggcggcggaacggcagcaaggagggcaaccaccactccacgcagcccaaacgcaataaaaggaatccaatattccaggatagccaagacacagagtttagctggtccgataacgagcgatcctccagccgtatcaatattcctgagcgagctagcggccctgaaggtaacttaaatcagattgtgacggaacccgatgcaaacttcccgcagttccttcacgagggctacgttccatgccaggggctctactcacacattaatcagacccttaaagaagcacatttcaattccctccagcaacgaggccaggcacctacttag

SEQ ID NO: 47076 - DNA, 345 bp, Artificial Sequence
  Description of Artificial Sequence: Synthetic coding sequence
atgctggtgctgtggctgaagcggcggcggaacggcagcaaggaggggaatcaccactccactcagccgaagcgaaacaaacgaaatcctatatttcaggattctcaggatacggaattttcttggagcgacaacgaaagaagcagcagtcggatcaatattcccgagcgggcaagcggaccggaaggaaatctgaatcaaatcgtgaccgagccggatgctaattttccacagtttctgcacgaaggctatgttccatgtcaaggcctgtacagtcacatcaaccagactcttaaggaagcccactttaactctcttcaacagagaggacaagcgcctacttag

SEQ ID NO: 47077 - DNA, 561 bp, Artificial Sequence
  Description of Artificial Sequence: Synthetic coding sequence
atgggcggccggggcgccgacgccggcagcagcggcggcaccggccctacagagggatacagtccacctgcagcttccaccagagccgccgctcgagctaaagcgcgcggaggtggccggggcggccgacgcaataccaccccctcagtcccatcacttagaggcgctgcaccccgttcctttcacccaccagccgcaatgtcggaaaggctgcgacctaggaaaagacgtcgcaatggtaacgaagaagacaaccatctgcctccacagaccaagaggagtagccgtaaccctgtattccaggattcctgggacactgaatccagtgggtcggatagcggcggaagcagcagctcaagctcatcctcaattaattcaccggacagagcatcggggcccgagggctcactctcacagaccatggccggatcctcccccaacacaccccagccagttcccgagcagtctgctttgtgtcagggattgtatttccatattaaccagaccctccgggaagctcacttccactcactgcagcacagaggcaggccacttacctag

SEQ ID NO: 47078 - DNA, 624 bp, Artificial Sequence
  Description of Artificial Sequence: Synthetic coding sequence
atgggcggccggggcgccgacgccggcagcagcggcggcaccggccccacagagggctattctcctcccgccgcgtctactcgggctgccgcgcgcgccaaggcccggggtggaggaagagggggcagacgtaatacgactcccagtgttccatcactccggggagcagcacctaggtccttccatccgcccgccgccatgagtgagcgccttaggccgcgaaaacggcgccgtaatgggaatgaggaagataatcacctccccccccagactaaacggtcctcacgcaaccctgtctttcaggactcctgggacaccgagaccgtcccagtgatgagaaatagtaaagagaacaggctgcgggggaataaagcattttgtgcctcctcgggtagtgattcgggcggaagttcatcctcatcgagcagttccattaactctccggatcgggccagcggacccgaggggagtctttcccagaccatggccggatctagccctaacacccctcagcctgtgcctgaacagtccgcgttatgtcagggcctgtacttccatatcaaccagacattgagggaggctcactttcactcattgcagcaccggggacgacccctcacctag

SEQ ID NO: 47079 - DNA, 351 bp, Artificial Sequence
  Description of Artificial Sequence: Synthetic coding sequence
atgggcggctgccccgtgcggaagcggcggcggaacggcagcaaggaggggaaccatcacagcacccagccaaagcgcaataagcgaaaccctattttccaagattctcaggatacggaagtgttctcatggagcgacaatgaaaggagtagctcccggattaatatccccgaacgtgcttcaggtccggagggcaacctgaaccagatcgtcaccgaacctgatgccaactttcctcaatttctccatgaggggctctcaaagccagtatatgttatcaattggtttatgagttttgggccagagatcaagctcaacacaagccaacagggccgcaaccaggcagtctag

SEQ ID NO: 47080 - DNA, 348 bp, Artificial Sequence
  Description of Artificial Sequence: Synthetic coding sequence
atgggcggctgccccgtgcggaagcggcggcggaacggcagcaaggaaggcaaccaccacagcacacagccaaagcggaacaagcggaatcctatatttcaggactctcaggataccgagttctcttggtccgataatgaaaggagtagctcccggattaacatcccagagagagctagcggtcctgagggcaatctcaaccagattgttaccgagccagatgccaattttccccaatttctgcatgaggggctgtctaaaccagtgtacgtgatcaactggttcatgtcctttgggcccgaaattaagctaaatacgtcccaacagggtcgcaatcaggcagtatag

SEQ ID NO: 47081 - DNA, 351 bp, Artificial Sequence
  Description of Artificial Sequence: Synthetic coding sequence
atgggcggctgccccgtgcggaagcggcggcggaacggcagcaaggaaggcaaccaccacagtacccagcctaaacggaataaaaggaatccaatcttccaagatagccaggataccgaagtcttcagctggagcgataacgaaagaagtagctctaggataaacatccctgagagagcgagtgggcccgagggaaacctgaatcagatagtaaccgagccggacgccaattttccccagttccttcatgagggttacgtgccttgccaggggctttacagtcacatcaaccaaacattgaaggaagctcactttaattcgcttcagcagcggggtcaagctcctacatag

SEQ ID NO: 47082 - DNA, 1071 bp, Artificial Sequence
  Description of Artificial Sequence: Synthetic coding sequence
atggccgccacccggagccccacccgggcccgggagcgggagcggtctggtgcacccgccgctgggtcagaccaggtgcattcctggatgttggccacgtctcaagccctggacaccgtctggaggatggcaaaaggctttgttatgcttgctgtttcttttctggttgctgcaatctgctactttagaagactccacttatattctggccacaagctcaagtggtggatcggctatctgcaaaggaaattcaaaaggaacttaagcgtggaggctgaagtggacttactctcatactgcgcgagagaatggaaaggcgaaactcctagaaataagttgatgaggaaggcctatgaagaattgttttggcggcaccacattaaatgtgtaagacaggtgagaagagacaactacgacgccctgaggagcgtgctcttccagatattttcacagggtatcagctttccaagttggatgaaagagaaagacatcgttaagctgcccgagaaattgctctttagccagggatgcaactggatccagcagtactcgttcggaccagagaaatacaccggatcaaatgtttttggaaaactgcgcaagtacgtggaactgctgaagacgcagtggaccgaatttaacggtatccgcgattaccataaacggggatctatgtgcaacaccctcttttccgacgcaattctcgagtacaagttgtacgaagctctgaaattcattatgctttaccaagttactgaggtgtacgaacagatgaagacaaagaaagttataccctctctattcagattgctgttctctcgcgaaacctcttcagatcctttgagcttcatgatgaaccaccttaactctgttggtgatacttgcggattggagcagatcgacatgtttattctgggttatagccttgaagtgaagattaaagtttttcggttgtttaagttcaatagtcgagacttcgaagtctgctatccagaagaacctctccgagactggcccgaaatctccctgttgactgagaatgatcgtcattaccatatcccggtcttctag

SEQ ID NO: 47083 - DNA, 1059 bp, Artificial Sequence
  Description of Artificial Sequence: Synthetic coding sequence
atgagccggggcaccatgccccagcccgaggcctggcccggcgcctcctgcgccgagacccccgcccgggaggcagcggcaaccgcccgggacgggggcaaggcagcggcctctggacaacctcggcctgagatgcagtgccccgccgaacacgaggaggacatgtatcgcgctgcagatgagatcgagaaggaaaaagagttgctaattcatgagaggggagcctccgaaccacggctgagcgttgcccccgaaatggacatcatggactactgcaaaaaagaatggagaggcaacacccaaaaggcgacatgcatgaagatgggctatgaagaagtatcacaaaagttcacaagtataaggagggtaagaggcgacaattactgcgcactccgagcaaccctgttccaagccatgagccaggcagtgggcctccccccttggttgcaggaccccgagctgatgctgctgccggagaagctcatctccaaatataactggatcaaacagtggaaactcggtctaaagttcgacgggaagaatgaggacctggtggataagatcaaagaatctttaactctcttacgcaagaagtgggcaggattggcagagatgcgcacagcggaggcccggcagatcgcttgtgatgaactgtttaccaatgaggctgaggagtacagtctgtacgaggcggtgaaattcctaatgctgaatcgggcgatcgagctttataatgataaagaaaagggtaaagaagtgcccttctttagcgttttgttatttgctagagatacatctaatgacccgggccagctcctaagaaaccatttaaaccaggttgggcatacaggagggcttgagcaggtggagatgtttcttctggcatatgctgttcgccataccatccaggtgtataggctgagtaagtataacacagaggaatttataacggtgtatcctactgaccccccaaaggattggcccgtagtgacgctgatcgcagaggacgaccgacattataatattccagtaagagtgtgcgaggaaaccagcctatag

SEQ ID NO: 47084 - DNA, 510 bp, Artificial Sequence
  Description of Artificial Sequence: Synthetic coding sequence
atgctgcccagcaccatgttcctggtgcacctgcccctgagcaccaatcgtctgcattgtctgaggaacaccagccttgagagttacctttgctcgttcgtacatctgaaccacccgcttcacatttccgatcgggtgattctgataagccttcacgaggccgtccgcttctccttcgctttttccttcccacgtggaactctcagcattgcctactgcctcatgtccagcgtgtctacttcgtccgaagccatcatgtctacagaactgttggcaaactactgccactccagcttacatgtgtgcatctgcatttcttctttccccaatgaaactggcaaccacgattccttccccggagccgtagtgagcatcagcgatcagcctacagaccagtgcaagctggcggcaaaggagctgcccctgcggaacctgttggaatgccgcttcttcgattgcatgggtgaggaggatctgattaatctgggggtcatcgggacagagaggtag

SEQ ID NO: 47085 - DNA, 510 bp, Artificial Sequence
  Description of Artificial Sequence: Synthetic coding sequence
atgctgcccagcaccatgttcctggtgcacctgcccctgagcaccaaccggctgcattgcctgcgtaatacatctttagaaccatgcctttgtagtttcgtgcacctgaaccaccccttgcacatctctgatcctgtcatcttaatctcgctgcatgaggccgtgagattctctttcgcattctccttccctcgcggtacactcagcattgcttattgtctgatgtccagtgtgtctaccagtagcgaggcaataatgagcacagagttgcttgcaaactattgccactcaagcctgcatgtttgcatttgcatctccagttttccaaatgaaacagggaaccacgattcatttcctggcgctgtggtttccatctctgatcagccgactgaccagtgcaaactagccgccaaggagcttccgctgcgcaacctactagagtgtcgcttcttcgactgcatgggcgaggaagatctaattaatttgggcgtgataggcaccgagagatag

SEQ ID NO: 47086 - DNA, 921 bp, Artificial Sequence
  Description of Artificial Sequence: Synthetic coding sequence
atgagcacctggaaggcccggctgaccaagcggctgaagagcccctcacggtccatgcatccctttccctgctcagccttgctcgcctgctttgggaacacaagggagagcgcatctttcaaccagagcggcgttgcagatacgcattcaacggtccgagtacaaccagtggcaaaagctggcaggcagccccgccacccatcagcagaaggggcccccgaaaagagacaggactctagcacacacgccgaacgaaacggaagcgctaaccggaattctagtcatcggacagctgcacagccagccgagacacctgaggacgttccaggtagcctcgacgacggagcagactgcgaagcggtagtctttcatgccagcatcccaagaccttccattatcgacacacccaaggaggaagagttccgggaagaacccaagtgcttggagctggagcaaaaaatgacgtctgatagcccccccgaggatatcgatcacaaagacagctatctgattaccagatcgatcatggctgaacctgactacattgaagacgataatccagaactgatcaggccacagaaactgataaatcccgtgaagacatcacggaatcatcaggatcttcacagggaactcttgatgaaccagaagagggggcttgcccctcaaaacaaacccgagttacagaaagtgatggagaagagaaagcgagaccaggtgattaaacagaaggaggaggaggcccagaaaaagaaaagtgacttagaaatcgagctcctgaagaggcagcagaagttggagcagttggaactggaaaaacagaaactgcaggaagagcaggaaaacgcccctgagttcgttaaggttaaagggaacctcagacgcaccgggcaggaagttgctcaagcccaggagtcttag

SEQ ID NO: 47087 - DNA, 396 bp, Artificial Sequence
  Description of Artificial Sequence: Synthetic coding sequence
atggccgagcccgactacatcgaggacgacaaccccgagctgatcaggccgcaaaagctgattaaccccgtaaagacaagtcgaaaccaccaggatctgcacagggaattgctcatgaatcagaaacgaggattggcgccccagaataaacctgagctgcaaaaggtgatggaaaagcggaaacgcgaccaggtgatcaagcagaaagaggaggaggctcagaaaaagaaaagtgatcttgagattgagctgctaaaacggcagcagaagttggagcagttggagctcgaaaagcagaagttacaagaggaacaggaaaacgcacctgagtttgttaaggtgaaaggcaacctgcggcgtacgggccaggaggtggcccaggcccaggagagctag

SEQ ID NO: 47088 - DNA, 396 bp, Artificial Sequence
  Description of Artificial Sequence: Synthetic coding sequence
atggccgagcccgactacatcgaggacgacaaccccgagctgatccgtccccaaaagctcataaatccagtcaaaacttctaggaaccatcaggacttgcatagggaactgctaatgaatcagaaaagaggtctggctccacagaataagcctgagctgcagaaagtgatggaaaagaggaagcgcgatcaggtcatcaagcaaaaggaggaggaagctcagaaaaagaagtctgacctggaaattgagctattaaaaaggcagcagaagctggagcagttggaactggaaaagcagaagctccaagaggagcaggaaaatgctccagagtttgtcaaggttaaagggaacctgcgcaggacaggtcaggaggtcgcacaggctcaggagagttag

SEQ ID NO: 47089 - DNA, 396 bp, Artificial Sequence
  Description of Artificial Sequence: Synthetic coding sequence
atggccgagcccgactacatcgaggacgacaaccccgagctgatccggccgcagaagctgatcaatccagtgaagacaagcaggaatcaccaggacctacatcgtgaactgctgatgaatcagaagcgcgggctggcccctcagaacaaacctgagctgcagaaagtcatggagaagcggaagagggaccaggtgatcaagcagaaggaagaagaggcacagaaaaaaaagagcgacttggaaatcgagctgttgaaacgacaacaaaagctcgaacagctggagctggaaaaacaaaagctccaggaggagcaggagaatgctcccgaattcgtgaaggtgaaagggaatttgagacggactggtcaggaagttgcccaggctcaggagtcctag

SEQ ID NO: 47090 - DNA, 396 bp, Artificial Sequence
  Description of Artificial Sequence: Synthetic coding sequence
atggccgagcccgactacatcgaggacgacaaccccgagctgatcaggcctcagaaactgattaatcctgtaaaaacttcccgcaaccatcaggacctgcaccgggaactgttaatgaatcagaaaagaggcctagccccccagaacaaaccagagctccaaaaggtcatggagaaaagaaaacgtgatcaggtgattaaacagaaggaagaagaagcacagaaaaaaaagagtgacctagagattgaattactgaagcgccagcagaagctggaacagttagaactggaaaaacagaaactgcaggaagagcaagagaacgcacccgaatttgtgaaggtaaaaggcaatctccggcgaaccgggcaggaggtggcccaggctcaggagtcctag

SEQ ID NO: 47091 - DNA, 396 bp, Artificial Sequence
  Description of Artificial Sequence: Synthetic coding sequence
atggccgagcccgactacatcgaggacgacaaccccgagctgatcaggccccaaaagctcatcaatcccgtgaaaactagtcgcaaccaccaggacttacacagggagttgttgatgaaccaaaagcgcggcctcgctccacagaataagccggaacttcagaaggtgatggaaaagagaaagcgggatcaggtgatcaaacagaaagaggaggaagcccagaagaagaagtcggacctggagatcgaactgctcaagagacaacagaagctggagcagctggagttggaaaagcagaaactgcaggaggagcaggaaaacgccccagaattcgtgaaagtgaaaggcaacctaaggagaaccggccaggaagtcgcgcaggctcaggagagctag

SEQ ID NO: 47092 - DNA, 396 bp, Artificial Sequence
  Description of Artificial Sequence: Synthetic coding sequence
atggccgagcccgactacatcgaggacgacaaccccgagctgatccgcccacagaaactaattaatcctgtgaagacttcacgtaaccaccaggacctgcatcgggaacttttgatgaatcagaaacgtggtcttgcaccacagaataaacccgaactacagaaggtgatggagaagcgcaagcgcgatcaagttattaaacaaaaggaggaagaggcccagaagaagaagtccgacctggaaattgaacttctcaagcgtcagcaaaagttagagcagctggaactggaaaagcagaaacttcaggaagagcaggaaaacgcccccgaattcgtgaaagtgaaaggcaacctaaggaggaccggccaggaggtggcccaagcccaggaatcctag

SEQ ID NO: 47093 - DNA, 273 bp, Artificial Sequence
  Description of Artificial Sequence: Synthetic coding sequence
atggccgagcccgactacatcgaggacgacaaccccgagctgatccggccccaaaagctgatcaacccggtgaagaccagtagaaaccatcaggacctgcacagggaactacttatgaatcaaaaacgcgggctagcccctcagaacaagcctgaactccagaaagttatggagaaacgcaaacgtgatcaagtgatcaagcaaaaagaggaagaggctcagaagaaaaagagtgaccttgaaatcgagttactcaaaaggcaacagaagtag

SEQ ID NO: 47094 - DNA, 387 bp, Artificial Sequence
  Description of Artificial Sequence: Synthetic coding sequence
atggccgagcccgactacatcgaggacgacaaccccgagctgatccgtccccagaaattgattaatccggttaaaacaagtaggaatcaccaagatctccatagggagcttctcatgaatcaaaagcggggcctggccccacaaaataaacccgagctgcagaaagtgatggagaagaggaagagggaccaggtgattaagcagaaggaggaagaggctcagaagaagaagtccgatctcgagatcgaactactaaagcgccaacagaaactagaacagttggaactggagaaacagaaactacaggaggagcaagaaaatgctcccgaatttgtgaaggtcaaggggaatttacgcaggactggtcaagaagtagctcaggcctag

SEQ ID NO: 47095 - DNA, 396 bp, Artificial Sequence
  Description of Artificial Sequence: Synthetic coding sequence
atggccgagcccgactacatcgaggacgacaaccccgagctgatccggccacagaaactgattaatcctgtgaagacctcacggaaccaccaagacttgcatcgggagctgcttatgaatcagaaacgcggcttggcccctcagaacaagccagagttacagaaggtcatggaaaagcggaaacgcgaccaagtgatcaagcagaaagaggaagaggcccagaaaaaaaagagcgatctggaaatcgagctcctgaaacgccagcagaagctcgaacaactggaattagagaaacagaaactacaagaagaacaggagaacgctcctgaattcgtgaaagtgaagggaaatctgaggcgcactgggcaggaagtggctcaggctcaggaaagttag

SEQ ID NO: 47096 - DNA, 396 bp, Artificial Sequence
  Description of Artificial Sequence: Synthetic coding sequence
atggccgagcccgactacatcgaggacgacaaccccgagctgatcaggcctcagaagctaataaacccagtaaagacaagcaggaaccatcaagacctgcacagggagctgctgatgaaccagaagagaggtcttgctccccagaataaaccggaattgcagaaagtgatggagaaacgcaagcgcgatcaagtgatcaagcagaaggaggaagaagcacagaagaagaagtctgacctggaaatcgagttgctgaaaagacaacagaaattggagcaactcgaactcgagaaacaaaaactgcaggaagagcaggaaaatgcgcctgaatttgtgaaagtcaagggcaacctccgccgcacaggtcaggaagtggcccaggcacaagagagttag

SEQ ID NO: 47097 - DNA, 204 bp, Artificial Sequence
  Description of Artificial Sequence: Synthetic coding sequence
atggccgagcccgactacatcgaggacgacaaccccgagctgatcaggccacagaaacttattaatcctgtgaagacttctcgaaatcatcaggatctgcatcgcgagttgcttatgaaccaaaaacgcggtttggccccccagaacaagccggagctccagaaggtgatggaaaaacggaagagggatcaggttatcaaatag

SEQ ID NO: 47098 - DNA, 306 bp, Artificial Sequence
  Description of Artificial Sequence: Synthetic coding sequence
atggccgagcccgactacatcgaggacgacaaccccgagctgatcagaccccaaaagctcattaatccagttaagacgtcaagaaatcatcaggatttacacagagaattgcttatgaatcagaaaaggggtctcgctccccagaataaaccagagctccagaaggttatggaaaagcgcaagagggatcaggtgataaagcagaaggaagaagaggcacagaagaaaaaaagtgacttggaaatagagctgttgaaacggcaacaaaaactcgagcagttggaactcgagaaacagaaactgtag

SEQ ID NO: 47099 - DNA, 396 bp, Artificial Sequence
  Description of Artificial Sequence: Synthetic coding sequence
atggccgagcccgactacatcgaggacgacaaccccgagctgatcaggccccaaaagctgatcaaccctgtgaagacctcgagaaaccaccaagatcttcaccgggagctgttgatgaatcagaaaagaggcctcgcccctcaaaataaacccgagcttcaaaaggtcatggagaagaggaagagggaccaggtcatcaaacagaaggaggaagaggcccaaaaaaaaaagagcgatttagagatcgagttactgaaacgtcagcaaaaactggagcagctcgaactggaaaagcagaagctgcaggaagagcaggagaacgcgcctgagttcgtgaaggtgaaaggcaacctgagacggaccgggcaggaagtcgcacaagcacaggagtcctag

SEQ ID NO: 47100 - DNA, 396 bp, Artificial Sequence
  Description of Artificial Sequence: Synthetic coding sequence
atggccgagcccgactacatcgaggacgacaaccccgagctgatcaggccacagaaattgataaatcccgtgaagacctctaggaatcaccaggacctgcacagggagctgcttatgaatcaaaaacgaggactcgctccacagaacaaaccagagctccagaaggtgatggagaagagaaagcgcgaccaggtgattaagcagaaagaagaggaagctcagaagaagaagtcagacttggagatagagctcctgaaaaggcagcagaagctagagcagctggagctggagaaacagaaacttcaggaagagcaagaaaacgcacccgagttcgtgaaagtgaagggcaatttacgaaggacaggacaggaggtcgcacaggctcaggagtcgtag

SEQ ID NO: 47101 - DNA, 255 bp, Artificial Sequence
  Description of Artificial Sequence: Synthetic coding sequence
atggccgagcccgactacatcgaggacgacaaccccgagctgatcaggcctcagaagctgattaatccagtgaagactagccggaaccaccaggacttgcatcgagagcttctgatgaaccagaagcgaggtttggctcctcagaacaaacctgagctacagaaagtgatggagaaaaggaaaagagaccaggtgatcaaacagaaagaagaggaggctcagaagaagaaatccgacctggaaatagagctttag

SEQ ID NO: 47102 - DNA, 282 bp, Artificial Sequence
  Description of Artificial Sequence: Synthetic coding sequence
atggccgagcccgactacatcgaggacgacaaccccgagctgatccgaccacagaagctgatcaatcctgtgaaaacgtctcggaaccaccaggatctgcaccgggagttactgatgaatcagaagaggggtttagccccacagaacaaaccagaactgcagaaggtgatggagaagcggaaacgagatcaggttatcaagcagaaagaggaggaggcccagaaaaaaaagagtgaccttgagatcgaactgctcaagcgccaacaaaaactggagcaatag

SEQ ID NO: 47103 - DNA, 381 bp, Artificial Sequence
  Description of Artificial Sequence: Synthetic coding sequence
atggccgagcccgactacatcgaggacgacaaccccgagctgatccgaccacaaaagcttattaatcccgtgaagacgtcccgcaatcaccaggacctccatagggaactgctcatgaatcagaagcgtggactcgcaccacagaacaagccagagctccagaaagttatggaaaaaagaaaaagagatcaggttatcaagcagaaggaagaagaggcccagaaaaaaaagtccgatctggaaatcgagctcctcaaacggcagcaaaaactcgagcagttggaactggaaaagcagaagctgcaggaggaacaggagaacgctcccgagttcgtcaaagtgaagggaaatctgcggagaaccggccaagaggtggcatag

SEQ ID NO: 47104 - DNA, 378 bp, Artificial Sequence
  Description of Artificial Sequence: Synthetic coding sequence
atggccgagcccgactacatcgaggacgacaaccccgagctgatccgacctcagaagttaatcaacccagtgaagacatcccgcaatcaccaagatctccaccgggaactacttatgaatcaaaagcgcggcttggccccccaaaataaaccagagctccagaaagtaatggaaaagcgcaagagagatcaagtaataaaacagaaagaagaagaggcccagaagaagaaatctgatctggagatcgaactgctcaagcggcagcaaaagcttgagcaactcgagctagagaaacagaagctccaggaagaacaggaaaatgcaccagagttcgtgaaggtgaagggcaatctgcgtcggactggacaggaagtatag

SEQ ID NO: 47105 - DNA, 396 bp, Artificial Sequence
  Description of Artificial Sequence: Synthetic coding sequence
atggccgagcccgactacatcgaggacgacaaccccgagctgatccggccacagaaactaattaatccggtgaaaactagccgtaatcaccaagacctgcatagggaattattaatgaaccaaaaacgtggcttagcccctcagaacaagcctgagctccagaaagtcatggaaaaacgaaagcgtgaccaggtaatcaaacagaaggaggaagaagctcagaagaagaaatcagatctagagatcgaacttcttaagcgacaacagaagctcgaacaactcgagcttgaaaaacagaagctgcaggaggaacaggagaatgccccggagtttgtgaaagtgaagggcaaccttcgcaggacaggacaagaggtggcgcaagcccaagagagctag

SEQ ID NO: 47106 - DNA, 990 bp, Artificial Sequence
  Description of Artificial Sequence: Synthetic coding sequence
atgcccgagcccggcccccggatgaacggcttcagcctgggcgagctttgctggttattttgctgtcccccttgcccatctaggatagccgccaaattggctttcttaccccctgaacctacctatactgtgctagctccagagcaacgtggggccggagccagcgctccagcccctgcccaagcaactgcagctgcggccgccgcacagccagccccccagcaaccagaagagggggcaggggcaggacccggtgcctgtagcctgcacctcagcgagcgagcagactggcagtactcccagagagagttggatgctgtagaagtgttttttagccgcactgcaagggataatcgcctgggctgtatgttcgttcggtgtgcgcccagcagccgctacacactgctgtttagtcacggcaatgcagtggacctaggacagatgtgtagtttctacatcggattgggctcaagaatcaattgtaatatcttctcgtacgattacagtggctacggcgtctccagcggaaaaccaagtgagaagaatctttacgccgatattgatgctgcttggcaggccttgcgcacacgatatggcgtcagtcctgagaatattatcctctacggtcagagcatcggaaccgtcccaaccgtggacctggcttcaaggtacgagtgcgccgccgtcattctccattcacccctgatgagcgggttgagagtggcatttcccgacacaaggaagacatactgctttgacgctttcccgagtattgacaagatatccaaagtgaccagtcctgtcttagtgatacatggaaccgaggacgaagtgattgatttttctcacggactggctatgtatgagaggtgccctcgggctgtcgagcctctgtgggtggagggggctggccataacgacattgagctgtacgcccagtatctggaacggctgaagcagtttatcagtcatgagctgcccaacagctag

SEQ ID NO: 47107 - DNA, 888 bp, Artificial Sequence
  Description of Artificial Sequence: Synthetic coding sequence
atgcccgagcccggcccccggatgaacggcttcagcctgggcgagctctgctggctattctgttgccctccgtgcccgagccgaatagccgcaaagttggcattcctccccccggaacctacttacacggtgctggcaccggagcagcggggggccggagcgtccgccccagcaccagcccaggccaccgctgcagcagccgccgcccaacccgcacctcagcaacccgaagaaggagccggcgccggaccgggcgcatgttctctgcatctcagcgagagggcagactggcagtactcacagagggaactggatgctgtggaggtgtttttctcgcgcaccgcacgtgacaaccgcctaggatgcatgttcgtcagatgcgctccctcaagcagatacacgctgctgttcagccacggtaatgccgtagatctggggcagatgtgctccttttacattgggctgggttcacggattaactgcaatattttcagctacgactactcaggatatggagtgtcaagtgggaaacccagcgagaagaatctgtatgccgatattgacgcagcatggcaagctctgaggacgcgttacggcgtgtcccccgaaaatattatactgtacggccagtctatcggtactgtgcctaccgtcgatttagcctcttcaattgataagatttccaaagtgacgtctcccgtcctggtcatccacggtacagaagacgaggtgatcgattttagccatgggctagctatgtacgaacgttgtcccagagctgtcgaacctctgtgggtcgaaggggcagggcataatgacatcgagctctacgcccagtatctagaacggctgaaacaatttatctcacatgaactacctaatagttag

SEQ ID NO: 47108 - DNA, 816 bp, Artificial Sequence
  Description of Artificial Sequence: Synthetic coding sequence
atgctgctggccccccccagcacccccagccggggccggaccccctcagcagtagaaaggctggaagccgacaaggctaagtatgtgaagactcaccaagtcatcgcacggaggcaggagcccgcactaagaggtagcccagggcccttgacgccccatccttgtaacgaactgggccctcccgcaagccccaggactccaaggccagtgcgtcgcggtagcggacgcaggctgccaagaccagacagcttgatcttttatcgccagaaaagagattgcaaagcttctgttaacaaggaaaatgccaagggtcaaggccttgtaaggaggctatttctcggcgccccccgcgatgccgcaccatcttctcctgcctctacagagagacctgcagcctctgggggatgggctgcacctcaggatgcgcccgaggctgcgggcaaaagagcactctgtcctacatgctctttaccattatcagaaaaggaacggttcttcaactactgtggtctggagagagcactggtggaggtactgggagccgagaggttttccccacagagttggggcgccgacgcctctccgcaggctggcacatccccacctcctggcagcggcgatgcatccgactggacatcttccgatcggggagtggacagtcccggcggagcaggagggggcggcggatccgaggccgccggcagcgcccgcgatcgccgtccacccgtatccgtcgtggagcggaacgctcgcgtgatccagtggttatacggctgtcagcgtgccaggggtcctcctcgggagtcggaggtgtag

SEQ ID NO: 47109 - DNA, 1836 bp, Artificial Sequence
  Description of Artificial Sequence: Synthetic coding sequence
atgagctgcaagaagcagcggagccggaagcacagcgtgaacgagaagtgtaacatgaagatcgaacactacttctcccccgtgtcaaaggagcagcagaacaattgtagcacaagcctgatgaggatggaaagccgtggggatccacgggctacaaccaatactcaggcccagaggttccatagtccaaaaaaaaaccctgaagatcagaccatgccccagaaccgcacgatttacgtgactttgaaagtaaaccaccggagaaatcaggatatgaagctcaagctgacccacagtgagaactcaagcttgtacatggcccttaacactctgcaggcagtgcgcaaagagatcgagacccatcaggggcaagaaatgctcgtgagggggacagaagggatcaaggaatacataaacctgggcatgcctctgtcgtgctttccggaagggggacaggttgtcataactttcagccaatccaagtccaagcagaaggaagacaaccacatcttcgggagacaggacaaggcttctaccgaatgcgtgaaattttatatacacgctattgggatcgggaagtgtaagcggcggatcgtcaaatgtggcaaacttcacaaaaaggggcgcaagctgtgcgtgtatgcttttaagggcgaaacaatcaaggatgcactgtgcaaagatggacgcttcctcagttttctcgaaaatgatgattggaagctgatcgaaaacaacgatactatcctggaatcaacccagcctgtagacgaactggagggccgctatttccaagtggaagttgagaagaggatggtgccttctgcagcagcttcccagaatcctgagtctgagaaacgtaatacatgcgtgctaagagaacaaatcgtggcccagtatccctcactcaagcgcgagtccgaaaaaataattgagaacttcaaaaagaaaatgaaggtgaaaaacggcgagaccctctttgagctgcacaggactaccttcggtaaggtgaccaagaacagttcctccatcaaggttgttaagctgctcgtgcgtctcagtgactcggttggctatctgttctgggatagcgctaccaccggttacgccacatgttttgtctttaaaggactgtttatccttacatgccgccacgtgatcgactcaatagtgggagacggaattgagccctctaaatgggctactattattggtcaatgtgtgcgggtgacattcggttatgaagaattaaaggataaggaaacaaactactttttcgtggagccctggttcgaaatccataacgaagagctcgactatgcagtgcttaaacttaaggagaatggacagcaggtgccaatggagctgtacaacggaattacccccgtgcccctgagcggattgattcacataatcggccatccttacggtgaaaagaaacagatcgatgcctgtgccgtcatccctcaaggacagagagccaagaagtgtcaagagagggtgcagagtaaaaaggccgaaagccccgagtatgtccacatgtacacacaacgatcattccagaagattgtgcataacccagacgtcataacctatgacaccgagttttttttcggcgcctctgggagcccagtgttcgactccaaaggcagccttgtggctatgcatgctgccgggttcgcgtacacctaccaaaatgagacccggagcataattgagtttggaagtacaatggagagtatactactggatattaaacagaggcataaaccttggtacgaagaggtgtttgtgaatcagcaggatgtggaaatgatgagtgacgaagatctgtag

SEQ ID NO: 47110 - DNA, 1836 bp, Artificial Sequence
  Description of Artificial Sequence: Synthetic coding sequence
atgagctgcaagaagcagcggagccggaagcacagcgtgaacgagaaatgtaatatgaagatcgaacattatttttccccggtttctaaggaacaacagaacaactgtagtacttctcttatgaggatggagtctagaggcgatcctagagctactactaatacgcaagcccagaggttccatagccctaagaagaaccctgaagatcaaacgatgcctcagaatcgtacaatttacgttaccttgaaggttaatcaccgaagaaaccaggacatgaagctcaagctgactcactccgagaacagtagcctgtatatggcactgaatacgctgcaggctgtgcgtaaggagattgagacgcaccagggacaggagatgcttgtgcggggtacggaggggatcaaggaatacattaatctgggtatgccattgagttgttttcccgaaggcgggcaagttgtaataaccttctctcagtctaaaagcaagcagaaagaagacaatcacatcttcgggaggcaagacaaggcctctacagagtgtgtgaaattttacattcacgccatcggcataggcaaatgtaagagacggattgtcaagtgcggaaagttgcataaaaaagggcgtaaactgtgcgtgtatgcttttaaaggggagacgataaaagatgccttgtgcaaagatgggcgctttctgtcctttctcgaaaatgacgattggaagctgattgagaataacgacaccattctggagtctacccagcctgtggatgaactggagggccggtacttccaggttgaggtcgagaagcggatggtgccgagcgcggcggcctctcaaaatccagaaagtgagaaacgcaatacttgcgtacttagggaacaaattgtggctcagtatcctagcctaaagcgggagtcagaaaagattattgaaaacttcaaaaagaaaatgaaggtgaagaatggtgaaacactgttcgaactccatcggactacatttgggaaggttactaagaactccagctcaatcaaggtagtgaagttgctggtcaggcttagcgacagtgtgggatatctgttctgggactcggccacgaccgggtatgcgacttgttttgttttcaaaggactgtttattctgacctgtcgccatgtgatagatagcatcgtgggtgatggtattgaaccctccaagtgggcgactatcatcggacagtgcgtcagggtgacatttggttacgaagagctgaaggataaggagaccaattatttttttgtagagccatggttcgagatccacaacgaggaactcgactacgccgtgctaaagctcaaagaaaatggacagcaggttccaatggagctgtataatgggataacaccggtgcctctgtcaggcctgatccacatcatcggccacccatacggtgaaaaaaaacaaatcgacgcctgcgctgtgattccccagggacagagagctaagaagtgtcaggaacgagtccagtctaaaaaagcagagtcccctgagtacgtacatatgtatacacagagatccttccagaaaatcgtgcacaaccccgacgtgatcacatatgacaccgagttcttttttggagcttcaggctccccggtgttcgacagcaaggggtctctggtggcgatgcatgcggcaggattcgcctacacctaccagaacgagactaggtctatcatcgagttcgggagcaccatggaatctattctcttggatatcaaacagcgccacaaaccctggtacgaggaagtgtttgtgaaccagcaagatgtcgagatgatgagtgatgaagacttatag

SEQ ID NO: 47111 - DNA, 552 bp, Artificial Sequence
  Description of Artificial Sequence: Synthetic coding sequence
atgagctgcaagaagcagcggagccggaagcacagcgtgaacgagaagtgcaacatgaaaatagagcactacttctcaccagtatctaaagaacagcagaataactgctctaccagccttatgaggatggagtctcggggcgatccacgcgctactaccaacactcaggctcagcgattccattcccccaagaaaaatccagaagaccagactatgccgcagaaccggacgatttacgtgaccctcaaggtgaatcaccgaagaaatcaagacatgaaactgaaactcacccattccgagaactcttcgctttatatggcccttaacactctccaagcagtacgaaaggaaattgagacccatcaggggcaggaaatgctggtccgcgggaccgagggcatcaaagaatacatcaatctgggaatgcccttgagttgcttcccagagggcgggcaggtggtaattactttcagccagagcaaatcaaagcagaaggaagacaatcatatcttcggtcggcaggacaaggctagcactgagtgcgtcaagtag

SEQ ID NO: 47112 - DNA, 1836 bp, Artificial Sequence
  Description of Artificial Sequence: Synthetic coding sequence
atgagctgcaagaagcagcggagccggaagcacagcgtgaacgagaaatgtaatatgaagatagagcattacttcagccctgtgtctaaggagcagcagaataattgctcaacaagtctgatgagaatggaatcgaggggcgatcccagagccacgaccaacacccaagcgcagcgctttcacagccctaagaaaaaccccgaggaccagacaatgccccagaatcgcacgatctatgtaacccttaaagtgaatcaccggagaaaccaagatatgaaactgaagctgacccattctgaaaatagtagtctgtacatggcgctgaataccctccaggccgtccggaaggagatcgagacacatcaaggacaagaaatgctggtccgtggaaccgaggggatcaaggagtatatcaacctcgggatgccattgtcatgtttccccgaaggaggtcaagtcgtcatcactttcagccagtccaagtcaaaacagaaggaggacaaccatattttcgggcgacaggataaggcttcaaccgagtgcgtgaagttttatattcatgctattggcatcgggaagtgtaaacgtcgcattgtcaaatgtgggaaacttcataagaaggggagaaagctgtgcgtctatgcattcaagggcgagacaattaaggacgcattatgcaaggatggacgcttcctgtccttccttgagaacgacgattggaagctaattgaaaataacgacaccatactcgagagcacacagcctgtggacgaactggaaggccgttatttccaggtagaggtagagaagagaatggtccctagtgccgcagcaagccagaatccggagtctgaaaaacggaacacatgtgtgctgcgtgagcagatcgtggcccagtatccgagtttgaagagagaaagtgaaaaaatcatcgagaatttcaaaaagaaaatgaaggttaagaacggcgagacattgtttgaattgcatcgcacaacgttcggtaaggtcactaaaaatagctccagcatcaaggttgtgaagttactggtcaggctctctgactccgtgggatatttgttctgggacagtgccacgacgggctacgcgacctgcttcgtgttcaaaggcctgttcattttgacatgccggcatgttattgattccattgttggcgacgggatcgagcccagcaagtgggcaacaatcattgggcaatgtgtgcgggtgactttcgggtacgaagaactgaaggataaggaaactaattacttcttcgttgagccctggtttgagatccacaacgaggagcttgattacgcggtcctaaagctgaaggagaatggacaacaggttcccatggagctatacaatggcatcaccccagtgcctctatctggtcttatccacatcattggacacccatacggggagaaaaagcagatcgacgcctgcgccgtgataccacagggtcaaagggctaaaaagtgtcaggagcgggtccaaagcaaaaaagctgaatcccctgagtatgtgcatatgtacacacagcggtccttccaaaagatcgtccataacccagatgttattacttacgatacggagttctttttcggtgcaagcggctctccagtattcgattctaaaggaagcctggtggcgatgcatgctgccggatttgcttacacttaccagaacgaaaccagatccatcatcgagtttggatccacaatggagtccatactcttggacattaaacagcgccataaaccatggtatgaggaggttttcgttaaccagcaggacgttgagatgatgtcggatgaggatctttag

SEQ ID NO: 47113 - DNA, 1836 bp, Artificial Sequence
  Description of Artificial Sequence: Synthetic coding sequence
atgagctgcaagaagcagcggagccggaagcacagcgtgaacgagaagtgcaacatgaaaatcgagcattattttagccctgttagtaaggagcagcagaacaactgctcaacaagcctgatgagaatggaaagcaggggagacccaagggccacgacgaatacccaggcgcagcggttccactccccaaaaaagaacccggaagatcagaccatgccacagaatagaactatttacgtgaccctgaaagtcaatcacaggcgcaatcaggacatgaagctaaaactgacccactcagagaattcaagcctgtatatggcactaaacacactgcaagctgtacgcaaagaaatagagacccatcagggacaagaaatgctggttcgcgggaccgaggggattaaagagtacatcaatttgggtatgcctctgagttgctttcccgaaggcgggcaggtcgttatcacctttagtcaatcaaaaagtaagcaaaaggaagataatcatatcttcggaaggcaggacaaggccagcacagagtgtgttaagttctatatccatgcaatcggcatcgggaaatgcaaacggagaatcgtcaagtgcggtaagttacataaaaaaggtcggaaattatgcgtgtatgcttttaagggcgaaaccataaaggacgccctgtgtaaggatggaagattcctcagtttcctggagaacgacgactggaagctgatagagaacaacgacaccatcttagagagcacccaacccgtagatgagctggaaggtcggtattttcaggttgaggtggagaagaggatggtgccgtcagccgccgccagccagaatccggaaagcgagaagaggaatacctgcgtgctgcgagagcagatcgttgcccaatatcccagtctgaaaagagaatcggagaagatcatcgagaactttaaaaagaaaatgaaggttaaaaacggtgagacactgttcgaactgcacagaactacctttgggaaggttactaagaattcatcttcaattaaggtagtgaagttactcgtcaggctgtccgacagcgtcggttatctgttctgggattcggccaccacaggatacgcaacttgtttcgtgttcaaagggttgttcattttgacttgccgccacgtgatcgattccattgtcggggacggcattgagccttctaaatgggctaccatcattggccaatgcgttcgggtgacattcggatacgaagagttaaaagacaaggaaaccaactacttttttgtcgaaccttggttcgaaattcacaatgaggagcttgactatgccgtcctgaagcttaaagaaaacggacagcaggttcctatggaactgtacaacggtatcacacccgtaccacttagcgggcttatccacattattgggcacccttatggcgagaaaaagcagattgacgcctgcgccgtgattccacaagggcaacgggcaaagaagtgtcaggagcgggtccagtccaagaaagcggagtctccagagtacgtgcatatgtacacccagcgatccttccagaaaattgtccacaatccagatgtcattacatatgacaccgagttcttcttcggagcaagcggctcaccggtatttgacagtaaaggttcactagtcgctatgcatgctgctggcttcgcttacacttatcagaacgagacacgatccattattgaattcggatccacaatggagtctattctcctggacatcaagcagcgccataaaccctggtatgaggaggtgtttgtcaatcagcaggatgtggagatgatgtctgacgaagacctttag

SEQ ID NO: 47114 - DNA, 291 bp, Artificial Sequence
  Description of Artificial Sequence: Synthetic coding sequence
atgagctgcaagaagcagcggagccggaagcacagcgtgaacgagaaatgtaatatgaaaatcgaacactatttttcccccgtgtcaaaagaacagcaaaataactgctccacctctctgatgcgtatggagagtagaggcgatcccagggccactaccaatactcaggcccagcggtttcatagtcctaagaagaaccctgaggatcagacaatgccccagaatcgaacaatctatgtcaccctgaaggtaaatcatcgtcgcaaccaggacatgaagctgaaactgtag

SEQ ID NO: 47115 - DNA, 1836 bp, Artificial Sequence
  Description of Artificial Sequence: Synthetic coding sequence
atgagctgcaagaagcagcggagccggaagcacagcgtgaacgagaaatgtaatatgaagatcgagcattacttctctcccgtgagtaaagagcaacagaataattgctctacatctctgatgcggatggagtcgcgcggcgatcctagggctaccacaaatacacaggcccagcggttccacagtccgaaaaaaaatcctgaagaccagacgatgccccagaaccgtaccatctacgttacgctgaaggtgaaccatcggcgtaatcaagatatgaaactgaagttaactcattctgaaaactcttccctgtatatggcgctgaacacgctccaggctgtacgtaaagaaatcgagacacaccagggtcaagagatgctcgtccgcggaaccgaaggaatcaaagagtatataaacctcgggatgcctctgagttgcttccccgagggaggtcaagtagtgattacatttagccagtccaagagcaaacagaaggaggacaatcatatcttcggaaggcaggacaaggcctcaaccgagtgtgtcaagttctatattcatgctatcgggatcggaaagtgcaagcgaaggatcgtcaaatgcggcaaactgcacaagaaaggcagaaaactatgcgtgtatgcatttaaaggagagactatcaaagacgcactttgcaaggatggccggtttctgtccttcttggagaacgatgactggaaactgatagaaaacaacgacacgatcctggagtctacccagccggtcgacgagttggagggacggtactttcaggttgaagttgagaagagaatggttccttccgccgcagcatcacaaaaccctgagtccgagaaacgcaatacatgcgtgctccgcgaacagatcgtcgcgcagtaccccagcctaaagagggagagcgagaaaattatcgagaattttaaaaaaaagatgaaagtcaagaatggcgaaactctgtttgagctgcaccgaacaacgttcgggaaagtgaccaagaattcaagttcaatcaaagttgtgaaactcctggtcaggcttagtgattccgtcggctacctcttctgggattcagcaacaacaggttatgcgacttgttttgtcttcaaaggattgtttattttgacttgtagacacgtgatcgactccattgtaggagacgggattgagccttccaaatgggcaactattataggccagtgcgtccgggtcacctttgggtacgaggagcttaaggacaaggaaactaactacttctttgttgaaccctggttcgaaatccacaacgaggagcttgattacgccgtcctgaagctcaaagaaaacggacaacaagtcccaatggagctctacaacggtatcaccccagtccccttgtctgggctgatccacattatcggccacccctacggcgagaaaaaacaaatagacgcctgcgctgttattccacagggccagagagctaaaaagtgtcaggaaagagtccagagcaagaaagccgagtcgccagagtacgtgcatatgtatacacaacgaagcttccagaaaatcgtgcacaacccagacgtgatcacttacgacactgagtttttcttcggcgcctcagggagcccagtctttgacagtaagggttccctcgtcgccatgcacgccgcgggttttgcatatacgtatcagaatgagactaggagcatcatagagttcggctccacaatggaatccattctcctagacatcaagcagcggcataaaccctggtatgaggaggtctttgtgaatcagcaagatgtcgagatgatgagcgacgaggacctgtag

SEQ ID NO: 47116 - DNA, 2205 bp, Artificial Sequence
  Description of Artificial Sequence: Synthetic coding sequence
atgaacagcatgaagaccgaggagaacaagagcttcagcgccatggaagatgatcagcgcactcggccggaagtcagcaaagacaccgtaatgaaacagacgcatgcagacacccctgtagatcactgtctgagtggtatcaggaaatgtagctctactttcaaactcaagtctgaggtgaacaaacacgagacagctctggaaatgcagaacccgaacctgaacaacaaagaatgctgtttcacatttactctgaatggcaactctcggaagcttgatcgctcagtattcacagcgtatggaaaaccttccgaatcaatatactcagcactatccgcgaacgactatttcagcgaaagaatcaagaaccagtttaataagaacatcatagtgtacgaagagaaaactatagacggacatatcaatctgggaatgccactgaagtgcctgcccagcgactcacatttcaagataactttcgggcagaggaagagcagcaaggaggatggccatattcttcgacaatgcgagaacccaaatatggaatgtatcttatttcatgtggtggctatcggccgtacacgaaaaaagatagtgaagatcaatgagcttcatgagaagggatcgaagctttgtatctacgcattgaagggcgagacaatcgagggggcactgtgcaaagacggaagattccgctcagacatcggtgagtttgagtggaaactgaaagaagggcacaaaaaaatatatgggaaacaatcaatggtcgatgaagtatccggcaaagtgttggagatggacatttctaaaaagaaggctctacagcaaaaggatatccacaagaagattaagcagaatgaaagtgcaaccgatgaaatcaatcaccagtccctgatccagagcaagaaaaaagtgcataaacccaaaaaggatggagaaacaaaagacgttgaacatagtagagaacagatcctgcctccccaggacctgtcccactacataaaagacaagacacgacagacaattcccaggatccgaaattactacttttgcagcttgccgcgaaaataccgtcagatcaacagtcaggttcggcgccggccacacctggggagaaggtacgccattaatttggacgttcagaaggaggccattaacctgttgaagaactaccaaacactgaatgaggccatcatgcaccagtatcctaatttcaaagaagaggctcaatgggtcaggaagtatttccgtgaagagcaaaagaggatgaacctcagccctgctaagcaattcaatatatataaaaaagacttcgggaagatgactgctaacagcgtgtcggtggcaacctgtgagcagctaacctattatagcaagagtgttggttttatgcagtgggacaataacggcaacaccggcaacgccacctgcttcgttttcaatggaggctatatcttcacttgccgccacgtggtgcacctgatggtaggaaagaacactcacccaagcctgtggcctgacatcatatcaaagtgtgcgaaagtcaccttcacttacacagagttttgcccgaccccagataactggtttagtatcgagccgtggctcaaagtgtctaatgagaacctcgactacgctattttgaagctaaaggagaacggcaatgcctttcctccaggcctgtggcgtcagattagtccacaacccagcacaggcttaatctatcttatcggacatcctgaaggccagatcaaaaaaatagatggctgcaccgtgatccctctgaacgagcggctgaaaaagtatcccaatgattgccaggatggcctggtagacctctacgatacgacatccaatgtgtactgcatgttcactcagcgatcctttctttctgaggtgtggaatacgcacactctgtcatacgatacttgtttcagtgatggatcctctggaagtcccgtttttaatgctagtgggaagctggtagcgctgcatactttcggactcttctaccagagagggttcaatgttcacgcactgatcgagtttgggtacagcatggactcaatactttgcgatatcaaaaagaccaatgaaagcctgtacaagtctctgaacgatgagaaactcgagacttacgacgaagagaaggggaagcaagagtcaagcctacaagatcatcagattgaaccaatggagtgttag

SEQ ID NO: 47117 - DNA, 2115 bp, Artificial Sequence
  Description of Artificial Sequence: Synthetic coding sequence
atgaagcagacccacgccgacacccccgtggaccactgcctgagcggaattcgaaagtgtagcagtacatttaaactgaaatcagaggtgaataagcacgagaccgcactggagatgcaaaaccccaatttgaataataaggagtgctgtttcaccttcacactcaatggaaattccagaaagctggaccgatccgttttcaccgcatatggcaaaccaagtgaaagcatttatagcgccctcagcgcaaacgactacttcagcgagagaatcaaaaatcagtttaacaaaaatattattgtgtatgaggagaagaccatcgatggccatattaacctcggcatgcctcttaaatgcttaccatccgattcccactttaagatcacgtttggtcaacgcaaaagtagcaaagaggacggacatatccttcgccaatgcgagaatcctaacatggaatgtattctgttccatgtcgtggcgatcggccggactcgcaagaagatagtgaagatcaacgagctccatgagaaggggagtaagctgtgcatttatgccctgaaaggagagaccatagagggcgctctatgtaaagacggtcggtttagaagtgacattggcgaattcgagtggaagttaaaggagggccataagaagatttatggaaaacagtctatggtcgacgaagtgagcggcaaggtgctggaaatggatatatccaagaagaaggccctgcagcagaaagatattcacaagaagataaagcagaatgaatctgcaaccgacgaaatcaaccatcagtcactgatccagagtaagaaaaaggtccataaaccgaaaaaagatggggaaacaaaagatgtagaacatagccgagagcagattctgccaccacaggacctgagtcattacatcaaagataaaacccgccaaacaattccccggattcggaactactatttttgcagtctgcccagaaagtaccgccagatcaattcgcaggtccgacgtcggccccacctgggccgccgttatgcaattaacttggacgtgcagaaagaggccatcaacctgttgaagaactatcagacactcaacgaagccattatgcaccagtacccaaactttaaagaagaagcccagtgggtgagaaagtactttcgagaagagcagaagagaatgaatttgtcccctgccaagcaatttaatatatacaagaaggactttggcaaaatgacagccaattccgtcagtgttgcaacttgtgagcaattgacttattactccaaaagtgtcgggtttatgcagtgggacaataacggcaacaccggtaacgccacctgcttcgtctttaacggaggctatatttttacgtgtaggcacgtggtacacttgatggttggtaagaatactcacccaagcctctggccagacattatctcgaaatgtgccaaggtcacttttacatacactgaattttgccctactccagacaattggtttagcattgaaccatggttgaaagtatcgaacgagaacttggactatgccatcttgaagttgaaagaaaacggaaatgccttccccccgggtttatggcggcagatatctcctcagccctcgaccggcttgatttatcttattggacaccccgaaggacagattaagaaaatcgacggatgcacagtgattcccctgaatgagaggttgaagaagtatcccaacgactgccaggacggcctggtggacctatacgatacgacatcaaacgtgtattgcatgtttacccagcgaagtttcctatcagaggtctggaatacccatacgctttcttacgacacatgtttttctgacggatcttccggatcacctgtgttcaacgcttcaggcaagttggtggccctccacacgttcggtttattttatcagcggggttttaacgtgcatgctttaattgagtttggctactctatggattctatcttgtgtgacataaagaaaactaatgaatccttgtataagagcctaaatgatgagaaactagagacttacgatgaagagaaaggaaagcaggagtccagcctgcaagaccatcaaatcgagcccatggagtgctag

SEQ ID NO: 47118 - DNA, 2115 bp, Artificial Sequence
  Description of Artificial Sequence: Synthetic coding sequence
atgaagcagacccacgccgacacccccgtggaccactgcctgagcggcataagaaagtgttcatccacctttaagctcaagtccgaggttaacaagcacgagaccgccctagaaatgcagaacccaaacctgaacaacaaggaatgttgctttaccttcactttaaatgggaactcaaggaaactggacaggagtgtgtttaccgcgtatggaaaaccgtctgaatccatctattctgcactttcagctaacgactatttctcagagaggattaagaatcaatttaacaaaaacatcattgtgtatgaggaaaaaactatcgacgggcatatcaacctcgggatgccactgaagtgcctcccgagtgattctcatttcaagatcactttcggccaacgcaagtccagcaaggaagatggacacattctcaggcagtgtgagaatccgaacatggagtgcatattatttcacgttgttgctatcggacggacaaggaagaaaatcgtgaagatcaatgaactccatgaaaaagggagcaaactgtgtatatacgccctgaagggggaaacaatcgaaggggccctgtgcaaggatggccggtttaggtcggatatcggtgagttcgaatggaagttgaaggaggggcataaaaagatctacggaaaacaaagcatggtcgatgaggtcagcggaaaggtactcgaaatggacattagcaaaaagaaagcactgcagcagaaggatattcacaaaaagataaagcagaatgaatcggccactgacgagattaaccatcagtcgttgattcagtcaaaaaagaaagtgcacaagcctaagaaggatggggaaacaaaggatgtagagcacagtagagaacagatacttcctcctcaggacctatctcactatatcaaggataagacccgccagactatacctcgaattaggaactattacttctgtagcttgccccgcaaatacaggcaaattaatagccaggtgaggagaaggccacatctgggaagacgatacgctattaatctagacgtccaaaaggaggcaattaatctgcttaaaaattatcagactctcaacgaggcaattatgcaccagtacccaaatttcaaggaagaggcccagtgggtccgtaagtactttcgggaggagcagaagcgcatgaatttgtcgcctgcaaaacagttcaatatctacaagaaggattttgggaaaatgacagccaacagcgtttcagtggccacatgtgagcagctcacttactattctaagagcgtgggattcatgcagtgggacaacaatgggaatactggtaatgcgacttgctttgtgtttaacggggggtacatttttacctgcagacatgtggtgcacctcatggtgggaaaaaatactcacccgtccctctggccagacattattagcaagtgcgcaaaagtgactttcacatacaccgagttctgccctacacccgataactggttcagtattgaaccttggctgaaagttagcaatgagaatctggattatgcaatcctgaaactgaaggaaaacgggaatgctttccccccaggactatggcggcagatttctcctcaacccagcacaggtctgatatacctaattggacacccagaagggcaaattaaaaaaatagatggatgtaccgtgataccccttaacgagcggctgaagaaataccccaacgactgccaagatggactggtcgatctctacgataccaccagcaatgtttactgtatgttcacccagcggagctttttgagtgaggtttggaatactcatactctgagttacgacacttgcttcagcgacgggtcgtccggaagcccagtgtttaacgctagcggcaaactcgttgcgctacatactttcggtctgttttaccagcgtggctttaacgtgcatgctctcatcgaatttggctattccatggactctatcctgtgcgatattaaaaaaacaaatgaatccttgtataaatcccttaatgatgagaaactggagacctacgacgaggaaaagggcaagcaggaatcttcgctgcaagaccatcaaattgagcccatggaatgttag

SEQ ID NO: 47119 - DNA, 489 bp, Artificial Sequence
  Description of Artificial Sequence: Synthetic coding sequence
atgaagcagacccacgccgacacccccgtggaccactgcctgagcggcatcaggaaatgttccagcacgttcaagcttaaaagcgaggtcaacaagcacgagaccgccctggaaatgcagaatcccaacctcaacaataaagaatgctgcttcacattcaccctaaacggaaactcaaggaagctggatagatccgtattcactgcctacgggaagccatctgagagcatttattcagctttgagcgccaacgattacttttcggagcggattaaaaatcagtttaacaagaatataatcgtgtatgaggagaaaactatagacggccacattaatttgggtatgcctctgaagtgcttaccttctgatagtcacttcaaaattaccttcggacaacgaaagagctccaaagaagatggacatatcctccgtcagtgtgagaacccgaatatggagtgcatcctctttcatgtggtcgccatcgggtag

SEQ ID NO: 47120 - DNA, 1212 bp, Artificial Sequence
  Description of Artificial Sequence: Synthetic coding sequence
atggtgttctgcctgagcagcgaggagccccggcggcccctgcggtctgacatggtgcacttccaagcatctgaggtacagcagctcctgcacaacaagtttgtcgtgattctaggcgactccatccagcgggccgtttacaaggacctggttcttttactccaaaaggacagtctgttaaccgcagcgcagctgaaagcgaagtatctggaggacgtgctggaggagctcacctacgggcctgctcccgacctggtcatcatcaatagctgcctgtgggatctgtcacggtacggcaggtgctcgatggagtcatacagagagaacctggagagggtcttcgtacggatggaccaggtgctccccgattcttgtttattggtgtggaatatggctatgccactgggggaacggatcacaggagggttcctgctgcctgaactgcaaccgctcgccggatccttaaggagggatgtggtagaaggcaacttctacagtgctacccttgccggcgatcactgttttgacgtgctggacctgcacttccacttcaggcatgcggtccagcatcgccaccgcgatggggttcactgggatcagcacgctcatcgccacctaagccacctgctgctcactcacgtcgccgatgcgtggggagtggaactgcccaagagaggctaccctcccgacccctggattgaggattgggccgaaatgaaccatcccttccagggctctcatcgtcagacgcccgactttggcgaacatctcgccttgctcccgccgccgccatcatctctccccccccctatgccattcccgtaccctttacctcagccttctccccccccgctctttcccccacttccccaggatactcctttttttcccgggcagccattcccaccgcatgaatttttcaactacaaccccgtcgaggatttctcaatgccaccccacctgggatgcggtcctggcgtgaattttgtccctgggcctttaccacctcccatacccggtcctaatccacatggccagcattggggtccggtggttcatagaggtatgcccagatacgtacccaacagcccttatcacgttcgcaggatgggtgggccatgtcgccagaggttgcggcattcagagagactgattcacacctacaagctcgatagaaggccgcctgcccattccgggacctggccagggtag

SEQ ID NO: 47121 - DNA, 1365 bp, Artificial Sequence
  Description of Artificial Sequence: Synthetic coding sequence
atggtgttctgcctgagcagcgaggagccccggcggcccctgcggtctgatatggtgcatttccaggcctcggaggtccagcagcttctccataataaatttgtggtcatcctgggcgacagcatccagagggcggtgtacaaggatctggtgctgctgctccaaaaggattcacttttgaccgcagcacaactcaaggctaagggcgagttgagtttcgaacaagatcagcttgtcgcgggtgggcagctcggggaactgcacaatggcacccagtaccgggaggtgcgtcagttctgcagcgggtctggtcatcatcttgtcaggttctactttctgacacgtgtgtacagtgaatatctggaagacgtgctggaggaactcacgtacggccccgccccggatctggtgattataaactcctgtctatgggatttgagccgctacgggaggtgcagcatggagtcttatagagagaatctggaaagggtctttgtgagaatggaccaagtcctgcctgactcatgtctgctggtttggaatatggcgatgcccctgggggagaggataactgggggatttcttttacccgagcttcagccccttgctggctctctacggagggatgtggtggaaggcaatttctactccgccacacttgctggagaccattgctttgatgtcctcgatctacatttccactttcgccacgccgtgcagcaccgccacagggatggggttcattgggaccagcacgcccatcggcatctgtctcatttgctgttaacacacgtcgccgacgcttggggcgtggaactgcccaaacgaggatatccccctgatccatggattgaggactgggccgagatgaatcatccattccagggctcccaccggcagaccccagactttggggaacatctggctttgctgcctcccccccccagttctctccctccgccaatgccgtttccttatcctctgccccagccgagccccccccctctgttcccgcctttgccacaggacacccccttctttcctggtcagcctttcccaccccacgagttcttcaactataaccccgtggaagactttagcatgcccccacacctgggctgcggtccaggggtgaatttcgttccaggcccactaccccctcccattcccggcccaaatcctcatggccagcactggggtcctgttgtccatcgtggcatgccacgctacgtgcccaattcgccttaccatgttagaaggatgggaggcccatgccgtcagcgactgcggcacagtgaaaggttgatccatacttacaagctggatcgaaggccgcccgctcacagcggaacctggccagggtag

SEQ ID NO: 47122 - DNA, 465 bp, Artificial Sequence
  Description of Artificial Sequence: Synthetic coding sequence
atggtgttctgcctgagcagcgaggagccccggcggcccctgcggagcgatatggttcacttccaggccagcgaagtgcaacagctgctccataataagttcgttgtgatcctgggtgattctatacagcgtgcggtgtataaagacctggtgttgctgttgcagaaggacagcctgctgaccgctgctcagctgaaagccaaaggcgaactgtccttcgaacaggaccaattagttgcggggggacagttgggcgaactgcataatggcacccaataccgggaggtccgacagttctgctccggtagcggccaccacttggtgagattctacttcctgactcgggtgtattcggaatacttggaggatgtacttgaggaattgacatacggggcctcgccctctcaccccatgaactcatccaccatcattcagtggcgaacttctaggtgccaccccacttag

SEQ ID NO: 47123 - DNA, 843 bp, Artificial Sequence
  Description of Artificial Sequence: Synthetic coding sequence
atggtgttctgcctgagcagcgaggagccccggcggcccctgcggtctgacatggtacattttcaggcgagcgaggtccaacagctcttacataacaagtttgtcgtcatcctgggggattcgatacagcgagccgtctacaaagacctagtcttgctcctgcagaaggactcattactaacagccgcccagctgaaagcaaaaggggaactgagctttgagcaggaccagcttgttgccggaggacaactgggggaattgcacaacggaacccaatatcgggaggtgcgccagttctgcagtggaagtgggcaccacttggtgagattctactttttaaccagagtctactcagagtatttggaggacgtccttgaggaactcacgtacgggcccgccccggacctagttatcattaatagctgcctgtgggatctcagcagatatggaagatgttcaatggaaagttaccgggagaacctggaacgggtgtttgttcgcatggaccaagttctgccggatagttgtttattggtgtggaatatggctatgccactcggtgaaaggatcactggcggatttctgttaccagaacttcagcctttggcggggagcctaagacgtgacgtcgtggaaggcaacttctactcagccactttagcgggcgatcattgcttcgatgtcctggacctgcacttccacttcaggcatgctgttcagcaccgtcacagagacggagtacattgggatcaacatgcacatagacatttaagccacctactccttacccacgtagctgacgcatggggcgtggaactgcccaagcgagggtacccgccttag

SEQ ID NO: 47124 - DNA, 690 bp, Artificial Sequence
  Description of Artificial Sequence: Synthetic coding sequence
atggtgttctgcctgagcagcgaggagccccggcggcccctgcggtctgatatggtgcacttccaggcatcggaggtacagcagcttttgcataataaatttgtcgtgatactgggcgacagtatccagcgggctgtatacaaggacctagtcctgttactacagaaggatagtctgctgaccgcagcccagcttaaggccaagtatctagaggacgtgctggaagagctgacatatggacccgcccctgacttagttattatcaactcatgcctttgggacctgtccagatacggcaggtgctcaatggaatcctatcgggagaatctagaacgcgtgttcgttagaatggatcaggtcctgcccgatagctgcctgctagtgtggaacatggcaatgcctctcggcgaaaggattaccggcggcttcctgctcccggagctccagccactcgctggcagcttacggagagatgtagttgaaggtaatttttattcagcgacccttgccggggaccactgtttcgatgtgttagacctgcacttccatttcagacacgccgtccaacatcgacatcgcgatggagtgcattgggaccagcacgctcaccggcacctgagtcatctactcctgacacatgttgcggatgcctggggcgttgagctgccaaagagaggctaccccccatag

SEQ ID NO: 47125 - DNA, 840 bp, Artificial Sequence
  Description of Artificial Sequence: Synthetic coding sequence
atgaacagctgcctgtgggacatcagccggtacggccccaacagctggaggtcatatctggaaaacttggagaacttattccaatgcttaggacaggttctgcctgaatcgtgcctattagtgtggaacacagcgatgcccgtgggggaggaggtcaccggaggtttcttgccccccaaactgcggcgccaaaaggctaccttcttaaaaaatgaagtcgtgaaggcaaactttcattccgccacggaggcaagaaaacacaacttcgacgtactggatcttcattttcacttccgtcacgcgagagagaacctgcattgggatggtgtccactggaacggacgagtgcatcggtgcctgtcccagttattgctggcccatgttgccgatgcatggggcgtagagctgcctcaccggcatcctgttggggagtggataaagaaaaagaaaccaggcccacgcgtcgagggccccccacaagcgaatcgtaaccatcctgccctccctctgtcccccccccttccatcgccgacatatcgaccgctgctgggatttccaccacagaccatcctaagctctcgaataaactctatcgcgatccagatgagcccccaccaacctatgcaggtgtcaagttccaaaaccattctatggttggtcctgtcctgtctgtgcccaagctcaccgcacccagtcatttctggactccctcaatggtatattggggtgctggcaggcattgtacccgtggctccgattaggcccggtgattctggtcttgaccttcagcgtgaagggcctcaaccaatcttgagtcaggggctaaaccgcaggacatag

SEQ ID NO: 47126 - DNA, 1299 bp, Artificial Sequence
  Description of Artificial Sequence: Synthetic coding sequence
atgatcctgctgcgggccagcgaggtgcggcagctgctgcacaacaaattcgttgtcatccttggcgacagcgtacaccgggcagtgtacaaagacctggttcttctcctccagaaagacaggcttctaacaccagggcagctgagggcaagaggggaactgaacttcgagcaggacgagttggtggacggcgggcaaagagggcacatgcacaatggcctgaactatcgtgaggtgcgtgagtttcggtctgaccatcacttggtcaggttctacttcctgaccagggtctactcagattacttacaaacaattttgaaagaactgcagtccggagaacacgcccccgacttggtgattatgaactcctgcctgtgggatatttcccgttacggcccgaactcttggcggtcctacctggagaatctcgagaacttgttccagtgtttgggccaggtcctgcccgagagttgcctccttgtgtggaatactgcaatgcctgtcggtgaagaggtcaccgggggttttctgccaccaaagttgcggcggcagaaagcaaccttcctcaagaatgaagtagtaaaagctaactttcactcggcaaccgaagcacgaaagcataacttcgacgtcctggacctccacttccattttagacatgctcgcgagaatctccactgggatggggttcactggaacggtcgggtgcaccgctgcctcagccagctactcctcgcacacgtcgccgatgcctggggagtcgagttgccccataggcatcctgttggggaatggattaaaaaaaagaaacccgggcccagagtggaaggtccaccacaggccaaccggaatcatccagctctgcccctcagcccgccactgccctcacctacttacagaccccttctaggatttccgccgcaacgcctcccacttcttccgttactgtccccccagccccctccgccgatccttcaccaccagggtatgccgaggtttccccagggcccaccggacgcttgtttcagttctgatcataccttccagtcagaccagttctattgtcacagcgacgttccatcaagcgctcatgccgggttttttgtggaggacaattttatggtgggaccgcagcttcctatgccctttttccccacccctcgataccagagacctgcccctgtggtgcataggggattcgggcgttatagaccccgtggtccctacacaccatggggccagcgccccaggcccagcaagcgaagagcacctgctaatcctgagcctcggccgcaatag

SEQ ID NO: 47127 - DNA, 1299 bp, Artificial Sequence
  Description of Artificial Sequence: Synthetic coding sequence
atgatcctgctgcgggccagcgaggtgcggcagctgctgcacaacaaattcgtcgtcatcctgggtgattccgtgcatcgcgctgtatacaaggatctagtgcttctcctgcagaaagatcgactactcaccccgggccaactccgggctcgcggagaactgaactttgagcaggacgaattagtagacgggggccaacggggacacatgcacaacggactcaactatagggaggttcgcgagttccgcagcgatcaccatctagtccgcttctacttcttgacccgtgtgtactccgattacctccagaccattctgaaagagctccaatcaggtgagcacgctcctgaccttgtgattatgaactcctgtctttgggacattagcagatacggaccaaacagctggcggtcatatctcgaaaatctcgaaaacctgttccagtgtttgggccaggttctgcccgagtcatgtttactcgtctggaacaccgctatgcccgttggggaggaggttacaggaggattcctgccacctaagttgcggagacaaaaagccacatttctgaagaatgaagtcgtgaaagccaatttccacagcgcaacagaagcccgtaagcacaactttgacgttctggacctacacttccactttcgacatgcacgggaaaacctccactgggatggagtgcattggaacggacgtgtgcaccgctgcctttcccaattgctgttggcccacgttgcagatgcttggggagtagagttgccacatcgccaccctgtgggggaatggataaagaaaaagaagcccggcccccgcgtagagggcccacctcaggcgaacagaaaccatcccgctcttcccctcagcccacctctgcccagcccaacctacaggcctttgctgggttttccaccccaacgtctgcctctcctgccactgctgagcccacaacctccccctcctatcctccatcaccagggcatgcctaggtttccccaagggcctcctgacgcatgcttcagtagtgatcacacctttcaatcagatcagttctactgtcattcggacgttccaagttcagcccatgcggggtttttcgttgaagataactttatggttggtccccaactgcccatgcccttctttccaacacctcgttaccaacgaccggcgcccgtggtgcatcgggggttcggcaggtacagaccgagaggcccctacacaccatggggacaaagaccacggccatccaagcggcgcgccccagctaatccagagccaaggccacaatag

SEQ ID NO: 47128 - DNA, 504 bp, Artificial Sequence
  Description of Artificial Sequence: Synthetic coding sequence
atgatcctgctgcgggccagcgaggtgcggcagctgctgcacaacaagttcgtggtgatcctaggggatagcgtacacagagccgtgtacaaagacctcgtgctgctcttgcagaaagacaggctcctgacccccgggcagctgcgggcccgtggtgaacttaattttgaacaggatgagctagtggatgggggtcagcggggccacatgcacaatggactgaattatcgggaagtgagagagttcagaagcgaccaccaccttgtgaggttttactttttaacccgagtttattccgactacctgcaaacgatcctgaaggaactgcaatccggggaacacgcaccggatctggtgattatgaactcatgtctctgggacatcagtcggtacgggcctaatagctggaggtcctatctcgagaacctggaaaacctgtttcagtgtttgggacaggtattgcctgaaagctgcctcctggtttggaataccgcgatgccatag

SEQ ID NO: 47129 - DNA, 507 bp, Artificial Sequence
  Description of Artificial Sequence: Synthetic coding sequence
atgatcctgctgcgggccagcgaggtgcggcagctgctgcacaacaaattcgtggtgatattaggagacagtgtacacagggcagtgtacaaagacctggtgcttttgctacagaaggaccggctcttaacacccggtcagcttcgcgcccggggggagcttaactttgagcaggatgagctagtggacggtggccagcgtggacatatgcacaacggtttgaattatcgagaggtgcgcgagttccggtctgatcaccacttagtgcgtttctactttctcacaagagtttacagtgattatctccaaacaattctgaaggagctccagagcggcgaacacgcccctgacttggtgattatgaactcctgtctttgggacatctcacgttacgggcccaactcctggcgctcctacttggaaaacctcgaaaatctgtttcagtgcttgggacaggtgctccccgaaagctgtttactggtctggaataccgcgatgcctgtgtag

SEQ ID NO: 47130 - DNA, 177 bp, Artificial Sequence
  Description of Artificial Sequence: Synthetic coding sequence
atgatcctgctgcgggccagcgaggtgcggcagctgctgcacaacaaattcgtcgtgatcttgggtgatagcgtgcacagggcagtttataaggatctggtccttctgctgcagaaggacaggttgctcactccgggccagttgagggcccgaggcgagctgaattttgaacagtag

SEQ ID NO: 47131 - DNA, 1518 bp, Artificial Sequence
  Description of Artificial Sequence: Synthetic coding sequence
atgagcgacaaggacgacatcgagacccccctgctgaccgaggccgcacctattctcgaggacggaaattgcgagcctgcaaagaattctgaatccgtggaccagggtgccaaaccagaatcaaagtcagaacctgtggtcagcacccgtaaacggcctgaaacaaaaccctccagcgacttggagacatctaaggttctgcccattcaggacaatgtgtcaaaagacgtgccacaaactcgatgggggtactggggatcatggggtaaatccatcctgagctcggcaagtgcaaccgtggcaacagtcgggcaaggcatctcaaacgtaattgagaaggcagaaacctctctgggtattcccggcccctctgaaatcagtaccgaggtgaagtacgttgcgggggaaacaaatgccaaggagaacgagaacagctcacctgttgccggtgcctttggggtttttagcacaattagtaccgccgtgcaatcgactggcaagagcgtgatctccggtggtctggacgctttagaattcattggcaagaagactatggacgttatagcagagggggatccagggttcaagcgaacgaaagggctaatgaaccgcaatgcaacactatctcaggtactgcgagaggcaaaagagaaggaggaaattcggacctctaatgaagtgacagtggaaactgataagaaaacacactatgggcttctttttgatgaattccagggactgtcccacctcgaggcattagagatgcttagccaggaatccgagatcaaggtcaagagtatcctgaactcccttagcggcgaggagctggaaacgctgaaggttgaattggagcagctgaaagaaacattttccttagcggagttctgcgaagaagaagaagaggagaaaaaaggggatgaggattttaccaaagacatcaccgaactgtttagtcaactgcacgtgagctcgaaacccgagaaactcgctagagccaggaatacggcgcatgagtggatcagaaagagcctgacaaagccactcgctgaaaacgaagagggcgagaagcaatccgaagcggaaaataccgagcaggttaacaagaactctatcgaggatatccacgcctttgccatccgcagcttagccgagctgacggcttgttcaatcgagctcttccacaagaccgccgcgcttgtgttacacggtcgcaagcaggaggtcactgcaatagaacgttctcagactctgtcccagatgactatcgtcctgtgcaaggagctctcctccttgtcaaaggagtttacaacatgcctgacgaccgcgggagtgaaggagatggctgatgttcttaacccactgatcacagccgtattcctggaagcttctaatagtgcctcttatatccaggacgcatttcagctattactacccgtgttagagataagtctgatagaaaacaagattgagagtcatagacacgagcttcagggtcagaagccactcctggaacactag

SEQ ID NO: 47132 - DNA, 750 bp, Artificial Sequence
  Description of Artificial Sequence: Synthetic coding sequence
atgagcgacaaggacgacatcgagacccccctgctgaccgaggccgcccccattctggaggatggcaactgtgaaccagccaaaaacagtgagagcgtggatcagggagctaaaccagagtcaaagagtgagccggtcgttagcaccagaaaaaggcccgagaccaagccttcatcagacctggagactagtaaagtcctccctatccaagacaacgtctccaaggatgtcccgcagacaaggtggggctattggggtagctggggcaagagcattctgagttccgcttcggcaaccgtggcgactgtgggccagggcatctccaacgttatcgagaaggccgagacctccctaggaatccccggaccctctgaaatttccacagaggttaaatatgtggccggcgagactaacgctaaggagaatgaaaattcgtcccccgtcgctggggcattcggagttttttcaaccatcagtactgcagtgcagtcaaccggcaaaagtgtcatctccggtggcctcgacgcgcttgaatttataggcaaaaagactatggacgtaatcgccgagggtgacccggggtttaagaggacgaaggggctcatgaaccgcaacgccacattgagccaggtgctgcgggaagcaaaggagaaagaagagatcagaacgtctaatgaggtgacggtagagacagataagaaaacccattatggcttacttttcgatgaatttcaagggttacacatttag

SEQ ID NO: 47133 - DNA, 195 bp, Artificial Sequence
  Description of Artificial Sequence: Synthetic coding sequence
atgagcgacaaggacgacatcgagacccccctgctgaccgaggccgccccaatcctggaagacgggaattgtgagcctgctaagaactcggaatcagttgaccaaggggccaagcctgaatctaagtcggagcctgttgtgtccacacgcaaacgccctgaaacaaaaccaagctcggatctggaaactagttag

SEQ ID NO: 47134 - DNA, 312 bp, Artificial Sequence
  Description of Artificial Sequence: Synthetic coding sequence
atgagcgacaaggacgacatcgagacccccctgctgaccgaggccgctcctatcctggaagacggaaactgcgaacccgcgaagaactccgagtcggtggatcagggagcaaaacctgaatctaaaagtgagccagtcgtctcaaccagaaaacgccctgagaccaagcccagcagtgacttggagacatccaaggtgctccccatccaagataatgttagcaaagacgtcccacagacaagatgggggtattggggttcatgggggaagtcaatcttgtcaagtgcgtccgctactgtggcaacagtgtag

SEQ ID NO: 47135 - DNA, 378 bp, Artificial Sequence
  Description of Artificial Sequence: Synthetic coding sequence
atgagcgacaaggacgacatcgagacccccctgctgaccgaggccgcccctatcttggaggatgggaactgtgagcctgccaagaactccgagtccgtggatcagggggccaagccagagtctaaatctgagccggtggtcagcactcggaagaggccggaaaccaagccaagctccgacttggagacatcaaaggtccttccgattcaggacaatgtctccaaggatgtgccacagacaagatggggatactggggatcgtggggcaaaagcatcctctcaagcgcaagtgcaaccgttgcaaccgtgggccagggaatcagcaatgtgatcgaaaaggccgagaccagtctgggcatccccgggccttccgaatag

SEQ ID NO: 47136 - DNA, 1518 bp, Artificial Sequence
  Description of Artificial Sequence: Synthetic coding sequence
atgagcgacaaggacgacatcgagacccccctgctgaccgaggccgccccaattctggaggacggcaattgcgagcccgcaaagaatagcgagtctgtggaccagggcgccaagcctgagtcgaagagtgagccagtcgtgtctactcgcaaacgcccagaaaccaagccaagctctgatctcgaaacttccaaggtgttacccattcaggataacgttagtaaagatgtgccccagaccagatggggctactggggtagctggggcaagtctatcctgtcatccgcgtcagcaactgtggcgacagtgggccagggaattagcaatgtgatcgagaaggcagaaacatcgctgggcattccaggtcctagcgagatttcaactgaagtcaaatatgtggcgggcgaaacaaacgctaaagaaaacgagaacagtagccctgtggccggagccttcggcgtgttttcaaccatctccacagccgtgcagtcaacgggaaaatcagtgatcagcggagggctagacgccctggagtttattggtaagaaaacaatggacgtgattgctgagggggatccgggcttcaagcgaaccaaaggcctcatgaaccgaaatgccactctctctcaagttctcagagaagcaaaggaaaaggaggagatacggacctcaaacgaagttacagtggaaacggataagaaaacgcattatgggctcctatttgatgaatttcagggcctgtctcacttggaagctctggagatgctcagccaagaaagcgagattaaggtgaaatcaatactgaattccctgagtggcgaggaactagaaacccttaaggtggagttagagcagctcaaagagaccttctcccttgcagagttttgtgaagaggaggaagaggaaaagaagggtgatgaggatttcaccaaggacatcactgaactatttagccaactgcatgtgagttctaaaccagagaaactggcccgggcccgaaacactgctcacgagtggatccggaaatcactcaccaaacccttggccgagaacgaagagggtgagaaacaaagcgaggccgaaaataccgaacaagttaacaagaattcaatcgaagatatccacgcgtttgcaattcgctccctagcggagcttactgcctgctccattgagttgttccacaaaaccgcagccctggttctacatgggcgaaaacaagaagttacagccatcgaacgcagccagactctgtcccagatgaccatcgtactgtgtaaggagttgtctagtctgtcaaaggagttcacgacttgcctgactaccgcaggagtaaaagaaatggcagacgttctcaacccgcttataacagctgtgttcctggaagcgagtaattctgccagttacatccaggacgcttttcaacttctactgcccgtattagagatctctctgattgaaaacaagatcgagagtcaccgtcacgaactgcagggccagaagcccctgcttgaacactag

SEQ ID NO: 47137 - DNA, 633 bp, Artificial Sequence
  Description of Artificial Sequence: Synthetic coding sequence
atgagcgacaaggacgacatcgagacccccctgctgaccgaggccgcgcccatcctcgaagacggaaattgcgaacccgccaagaattcagagtcagtcgatcagggggccaaaccagagtccaaatccgaacctgtggtatccaccagaaagagacctgaaactaagccttcctctgatctggaaaccagcaaggtgttgcccattcaggataacgtgtcgaaggatgtccctcagacgagatggggctattgggggtcatggggcaagagcatcctgagtagcgcttcagctaccgtggccacagtcggtcagggcataagcaacgttattgagaaagccgagacctcattggggatcccagggccaagcgagataagtaccgaggtgaagtacgtggcgggagagaccaacgctaaggaaaacgaaaactcctcacccgtagctggagctttcggggttttttccactatctccaccgccgtacagagcactggcaagtcagtgataagcggggggttggatgctctagagtttatcggcaaaaaaacaatggatgtgatcgctgagggagatcccggatttaagagaactaagggacttatgaacaggaacgcaacactctctcagtag

SEQ ID NO: 47138 - DNA, 240 bp, Artificial Sequence
  Description of Artificial Sequence: Synthetic coding sequence
atgagcgacaaggacgacatcgagacccccctgctgaccgaggccgcaccaatccttgaagatgggaattgcgaacctgccaagaatagtgagtctgtggatcagggggccaaacccgagagcaaatcggagccagtggtctccacacgtaagcgtccagaaaccaagccctccagtgatctggagacgtccaaggtgctccctattcaggacaacgtgtctaaggacgtcccacagtag

SEQ ID NO: 47139 - DNA, 1518 bp, Artificial Sequence
  Description of Artificial Sequence: Synthetic coding sequence
atgagcgacaaggacgacatcgagacccccctgctgaccgaggccgcgcccatcctggaagatggcaattgtgaacccgctaaaaattctgagtcagtggatcaaggggcaaagccggagagcaaatctgaacccgttgttagtaccaggaagaggcccgagaccaaaccaagttctgacctcgaaacctctaaagtactgcccatccaggacaacgtgagcaaagatgtgccccagactaggtggggttactgggggtcttggggcaaatccatactttcaagtgcttctgctaccgtagccacggtcgggcagggcatctccaatgtgatcgagaaagcggaaacctcgttgggaattcctggtccaagcgaaatttcaacggaggttaagtatgtggctggcgagacaaatgctaaggagaacgaaaattcctcacctgtcgctggggccttcggggttttcagcactattagtacagccgttcagtcgaccggcaagagtgtcatttcaggcggtttggatgcattggaattcataggcaaaaagacaatggatgttattgcagagggcgaccctggtttcaagcgaactaagggcctcatgaacaggaatgcaaccctcagccaggtactcagggaggccaaggagaaagaggagatccggacaagcaacgaagtgaccgtggagaccgataagaaaacgcattatggtttgttgttcgatgaatttcaggggctgagccacttagaagccctagaaatgctcagccaggagagcgaaattaaggtgaagagcatattgaattcactgagtggggaggagttagagacactgaaggttgaactggaacagctgaaagaaaccttctcattagcagaattctgcgaggaagaagaagaagagaagaagggcgatgaagacttcaccaaagacatcactgagctgttctcacaactacacgtcagcagcaagcctgaaaagctcgcccgagcccgaaacacggcccatgaatggattaggaaaagcctgacgaagccccttgcagaaaacgaagagggagagaagcagagtgaggccgagaataccgaacaagtcaataaaaactcaatcgaagatatacacgctttcgccatccggtcccttgccgagctgacagcctgcagcatagagctatttcacaaaactgctgcgctcgtactgcatggtcgcaagcaagaggttaccgcaatcgagcgatcacagacattatcacagatgacgatagtcctttgcaaggaactctcttctctcagcaaagagtttacaacatgtctgaccacagcaggagtgaaagaaatggcggatgttttgaatccattgattacagccgtgtttcttgaggcttccaatagcgcttcctacatccaggacgcctttcagcttttactgccagtcctagagattagcctcatcgaaaacaaaatcgaaagtcatcggcacgaactgcaaggacaaaagcccctgctcgagcactag

SEQ ID NO: 47140 - DNA, 501 bp, Artificial Sequence
  Description of Artificial Sequence: Synthetic coding sequence
atgagcgacaaggacgacatcgagacccccctgctgaccgaggccgctccgatcctggaggacggtaactgcgagccagcaaagaacagcgagagtgtggatcagggggccaagcccgagtcgaaatctgagcccgtggtttctacaagaaagcgccccgagaccaagccatcttccgatttagagacctcgaaggtgttaccgatccaggataacgtgtcaaaggatgtgcctcagaccaggtggggatactggggttcttgggggaagtccatactgagctcggctagcgcaaccgtcgccacggtgggtcaggggatttcaaacgtgattgaaaaggctgaaactagcctcggtattccgggtccgtctgagatttctacagaagtgaaatacgtagcaggcgagacaaatgctaaggaaaacgaaaactccagccccgtcgccggagctttcggtgtattctccaccatctccaccgctgtgcagtccaccggctag

SEQ ID NO: 47141 - DNA, 48 bp, Artificial Sequence; identical to SEQ ID NO: 20843
  Description of Artificial Sequence: Synthetic coding sequence

SEQ ID NO: 47142 - DNA, 2760 bp, Artificial Sequence
  Description of Artificial Sequence: Synthetic coding sequence
atggccacccccagcgccgccttcgaggccctgatgaacggcgtgacaagttgggacgtgcccgaggacgcggtaccctgcgaattactgctcataggtgaagcatccttcccagtgatggtgaacgacatgggacaagtgctcattgccgctagttcctatggcagaggacggctagtagttgtgagccacgaggattatttggtcgaggctcaattgacccctttcttgcttaatgccgtgggctggctttgctcttcaccaggagccccaatcggcgtccacccaagcctggcaccattggccaaaattctggagggaagtggcgtggacgcaaaagtggaaccagaggtgaaggatagcctgggggtctattgcatcgacgcttacaatgagactatgaccgagaaattagtgaaattcatgaagtgtggcggagggttgctaattggaggccaggcctgggactgggctaaccaaggagaggatgagagagtcctctttacattccccggcaatctggtgacatccgttgcgggaatctactttactgacaataaaggcgatacatcgttcttcaaagtaagcaagaaaatgcccaagattccagtccttgtatcctgcgaagatgacctttctgatgatcgcgaggaattgttacacggtataagtgagctagacattagtaattccgactgtttcccttcccagctcctggtccatggtgctctagctttcccgctgggcttagattcataccacgggtgtgtgatcgcagccgccagatatggccgcggaagagtcgtcgtgaccggccacaaagtcctgttcaccgtgggcaaactcggtcctttccttttgaatgccgttaggtggctggacggcggccgtcgggggaaagtcgtcgtgcagactgagcttagaactctttccggcctgctcgccgtaggtggcatcgacacttcaatcgaacccaacttgacgagtgacgcctctgtgtactgctttgaacctgtgtcagaggtgggggtgaaggagttacaagagttcgtcgctgaaggcggcggccttttcgtgggcgcccaggcctggtggtgggcctttaaaaatccaggtgtgtctccactcgctagattccccggaaatctgctgctgaacccctttggtatttcaatcacctcccagagtctgaaccctggtcccttcaggacgccgaaagcaggcatccgcacctatcactttcgcagtactttagccgagttccaagtcatcatgggacggaagagaggcaacgtcgaaaagggttggctcgccaagctcgggcccgacggtgcagccttcctgcagatcccagccgaggaaattcccgcttatatgagtgttcatagactgctgcgaaaacttctgagcagatatcgtctgcctgtggccacaagggagaatcccgtcatcaatgattgctgcagaggagcaatgctgtctttggcgactggacttgcccactctggaagcgacctgagtctgttagtcccggagattgaagacatgtatagctctccctacttgagaccttcagaaagtcccatcacagttgaggtgaactgcaccaaccccgggacccgctactgctggatgtctacggggctgtacattcctgggcgacagattattgaagtgagcctcccggaggcggccgctagtgctgacctaaaaattcagataggatgccacaccgatgacctgacccgagcaagtaaactgttccggggaccgttggtgattaatcgttgttgcctggataaacccactaagtcaattacctgcctgtggggcgggctcctctatatcatcgtccctcagaattctaaactggggtcagtgccagtgactgtgaaaggtgctgttcatgctccatattacaaactcggagagaccaccctggaggaatggaagagaaggatacaggagaacccagggccatggggagaactcgccactgacaatatcatcctcacagttcccacagcaaacctgagaaccctggagaacccagaaccattgttaagactatgggacgaggtcatgcaagctgtggcccgtctaggcgctgaaccgtttcctctgcgtctcccccaacgtatcgtggctgacgtgcagatctccgtgggttggatgcacgccgggtacccgatcatgtgtcatctggaaagtgttcaagagctcattaatgaaaagctgatccgaacaaaggggctgtgggggcctgtgcacgaactgggcagaaaccagcagcgtcaggagtgggagttccccccacataccactgaggccacttgcaacctgtggtgcgtgtatgtgcacgaaactgttctggggattcccaggtcccgagccaatattgccctctggccgccagtaagggagaaacgcgtgaggatctatctgagtaaggggccgaacgtcaaaaactggaatgcgtggactgctctggagacttacctgcagcttcaggaggccttcggctgggaaccatttattaggctgtttaccgagtaccggaatcaaaccaacctgccgaccgagaacgttgataaaatgaacctttgggttaagatgtttagtcaccaggtacagaagaatttagcacctttctttgaggcatgggcctggcccatccagaaggaagtcgctacgagccttgcctaccttcctgagtggaaggagaatattatgaagctttacttgctgactcagatgtag

SEQ ID NO: 47143 - DNA, 504 bp, Artificial Sequence
  Description of Artificial Sequence: Synthetic coding sequence
atggccacccccagcgccgccttcgaggccctgatgaacggcgtgacctcgtgggacgttccagaagacgcagtgccttgtgagctccttctcatcggcgaggcgtccttccccgtcatggtaaacgacatggggcaggtgcttatcgccgctagctcttatggcagaggcagactcgtggtggtctcccacgaagattacctagttgaagctcagttaacacctttcctcctgaacgccgtgggttggttatgcagttcaccgggtgcaccaatcggggtgcacccttccctagcccccctggccaagatcctcgagggcagcggcgtggacgccaaagttgaaccggaggtgaaggatagcctcggggtatattgcatagacgcttataacgagacaatgacagaaaagcttgttaagtttatgaagtgtggaggggggctgctaatcggcggccaggcttgggactgggctaatcagggcgaggacgagagggtcctctag

SEQ ID NO: 47144 - DNA, 441 bp, Artificial Sequence
  Description of Artificial Sequence: Synthetic coding sequence
atggccacccccagcgccgccttcgaggccctgatgaacggcgtgacatcctgggatgtgccggaggacgccgtgccgtgcgaactgctgttgatcggagaagcttcttttccggtgatggtgaacgatatgggacaggtcctgatagccgcgagtagctatgggagaggcaggcttgtggtcgtctcacatgaggattacctcgttgaggcccagcttacacccttcctgctgaacgccgtcgggtggttatgttcctctccaggagccccaatcggcgtgcacccgagcttagcacccctggccaaaattctggaaggatctggggtcgacgccaaagtagagccagaggtcaaggattccctgggagtgtactgcatcgacgcctacaatgaaacaatgacagagaagctggttaaattcatgaagtgcgggggctag

SEQ ID NO: 47145 - DNA, 2766 bp, Artificial Sequence
  Description of Artificial Sequence: Synthetic coding sequence
atggccacccccagcgccgccttcgaggccctgatgaacggcgtgacttcttgggacgtgcctgaggatgccgtcccctgtgagctattgctgattggcgaggcctcttttcccgtgatggttaatgacatgggacaggtcttaatcgcagcatcctcctatggacgtgggcggctcgtggtcgtatcacatgaagactacctcgtggaggctcagctcactcctttcctgctgaacgccgtagggtggctatgtagctctcctggcgctcctatcggagtgcaccccagtctggcacccctcgcgaagatccttgaagggtcaggcgtggacgccaaagtggagcctgaggtgaaggattctctcggcgtctactgtatcgacgcttacaacgaaaccatgacagagaagttggttaaattcatgaagtgtgggggaggcctccttatcggcggccaagcttgggattgggcaaatcagggtgaggacgaacgagttctgttcacgttccccggaaatttggtaacatctgtggcaggcatctatttcacggacaacaaaggcgacacctcctttttcaaggtgtctaagaagatgcctaaaatccccgtattggtgagctgcgaagacgaccttagcgacgacagagaggagctcctccacggcattagtgaattggatatttctaactctgactgcttccccagccaactgttagtacacggcgctctcgccttcccactaggccttgattcctatcacggctgtgtgatcgcggcggccaggtacgggcgcggtcgcgttgtagttacggggcataaggtcctgttcactgtgggcaaactgggcccgtttctcctcaatgcggtaagatggcttgatggggggagaagaggtaaggttgtcgtccaaactgagcttcggactctgagcggtctgttggcggtgggaggcatcgatacaagtatagagcccaacctgacctccgatgcctccgtgtattgcttcgagccggttagcgaggtcggcgttaaggaacttcaggaatttgtcgctgaaggtggagggctgttcgtcggagcccaggcctggtggtgggctttcaaaaaccctggtgtctctcccctcgcacgctttcccggaaatctgttgctgaacccattcgggatcagtattacgagccagtccctgaacccaggcccattcagaactccgaaagcaggtataaggacatatcatttcagatccacactggccgagttccaggtcatcatgggacgcaaacgaggcaacgttgaaaagggctggttggcaaagctgggccctgatggggccgccttcctccagatccctgctgaggaaatcccagcctacatgtcagtacacaggttgcttcgaaagctgctgtcccgttaccgattgccagtggcaacccgcgaaaatccagtgattaatgattgctgccgtggggcaatgctctctctcgccacaggccttgcacacagtggcagtgacctgtccctgctcgtgcccgagattgaggatatgtacagttcgccctacctgcggccaagcgagtcacctatcactgtagaagtgaactgtacgaatccaggtactcgctattgttggatgtccactggcctctacattccaggacggcagatcattgaggtgtctctaccagaagcagcggcctccgccgatttaaagatccaaattggatgccatacggatgacttgacccgggcttcaaagctgttccgggggcctctggtgatcaaccgttgttgcctcgataagcccactaaatccatcacatgcttgtggggcggactgctttacataatagtgccacagaactccaagctcgggtcagttcctgtgactgtgaagggcgccgttcatgccccctactacaagctgggagaaacaactttggaggaatggaagcgccggatacaagaaaatccggggccctggggggagctcgccacggataatataatcttaacggttcccacagcgaatcttcggacactcgagaatcccgaacctcttctacggctttgggatgaggttatgcaggcggtcgctaggctgggggccgaaccattcccgctccggctcccccaaaggatagttgcggatgtgcaaatctctgtgggctggatgcacgccggttaccccattatgtgtcacctcgagtccgtgcaggaactgatcaatgagaaattgattaggactaaaggtttgtggggaccagtgcacgagctgggtaggaatcagcagagacaagagtgggagtttccgcctcacactacagaggcaacttgtaacctgtggtgcgtctacgtccacgagacggtcctcggcatccccagatcccgcgccaacatcgctttgtggcctcccgtgagggagaaacgcgtgcggatctacttatctaaggggcccaacgtgaagaattggaacgcatggaccgccctcgagacatacctacaactgcaggaggcttttggttgggagccattcataagactgttcaccgaatatcgaaaccagaccaacctcccaactgagaatgtggacaaaatgaatctatgggtcaaaatgttctcacatcaggtgcagaagaatcttgctccctttttcgaggcatgggcctggccgatacaaaaggaggttgctacctcactcgcttacctgcccgaatggaaagaaaacataatgaagctttacctgctcacacagatgccacactag

SEQ ID NO: 47146 - DNA, 228 bp, Artificial Sequence
  Description of Artificial Sequence: Synthetic coding sequence
atggccacccccagcgccgccttcgaggccctgatgaacggcgtgacctcttgggacgtgcccgaggacgccgtcccttgcgaactcctgttgataggggaagcttcctttcccgtgatggtcaacgacatgggacaagtactcatcgccgccagcagttacggcagaggaaggctcgtcgtcgttagtcatgaggactacttagtggaggcacagctgactccatag

SEQ ID NO: 47147 - DNA, 453 bp, Artificial Sequence
  Description of Artificial Sequence: Synthetic coding sequence
atggccacccccagcgccgccttcgaggccctgatgaacggcgtgactagttgggacgtaccagaagacgctgtgccatgtgaactcctcctcattggcgaagcttcattccccgttatggttaatgacatgggccaggtgctcattgcagcatcctcctacggtagagggcgactcgtggtggtatcacacgaggactacttggtggaggcccaattgactccttttttgctgaatgccgtggggtggttgtgcagcagcccgggggcacctatcggagtgcaccccagcctggcccccttggctaagatacttgagggttccggagtggatgctaaggtggaaccagaggtgaaagattcactgggagtgtattgcattgatgcttataacgaaaccatgaccgagaagttggtgaaattcatgaaatgcgggggaggactgctcatatag

SEQ ID NO: 47148 - DNA, 2538 bp, Artificial Sequence
  Description of Artificial Sequence: Synthetic coding sequence
atggccaccatcgccgccgccgccttcgaggccctgatggacggcgtgacgtgctgggacgtcccccgcggacccattccgagcgaattactgctgatcggcgaagctgccttccctgtcatggtaaatgacaaagggcaggtcctcatcgccgcctcatcttatgggagaggacgcctggtggttgtttcacacgaaggctacttgtcacataccggattagccccatttctgttgaacgccgtaagctggctgtgcccatgcccaggcgcacctgtaggagttcacccatccctggcacctctggttaacattctccaggacgctggcctggaagcccaggtgaagcccgaacctggtgagcctctgggcgtatattgcatcaatgcgtacaacgacacactgactgctacactgatacagtttgtaaagcacggaggcggtcttctcataggcggacaagcgtggtattgggcatctcagcacggacctgacaaggtgttatcccgatttccaggcaacaaggtgacttccgtggctggcgtgtattttacggacacctacggcgacagggaccgcttcaaagtcagtaagaaggtgcctaaaatcccactccacgttaggtacggcgaagacgttagacaagaccagcagcagctgttggagggcatctctgagctcgacattaggacggggggggtcccatctcagcttttagtacacggggccctggcgtttccactgggtctggacgcctctttgaactgcttcctggccgcagcccactatggccgggggagggtcgtattggccgcccatgagtgcctgctgtgcgccccgaaaatgggccccttccttctcaacgcggtcagatggcttgctcgaggccagactgggaaggtgggagtcaatacgaacctcaaagatctctgccccctgctgtcagagcacggcctccagtgcagcttggaacctcacctcaatagcgatctgtgtgtttactgctgcaaagcctacagcgacaaggaggctaaacagctgcaggaattcgttgcagagggcggcgggctgctcattggtggacaggcttggtggtgggcttcccaaaatccaggccactgccctctggcagggtttccggggaacatcatcttgaactgtttcggactaagtatcctgccacaaaccttaaaagcgggttgctttcctgtacccacccccgagatgcggagctatcatttcagaaaagcactatctcaatttcaagccattctcaatcatgagaacgggaatcttgagaagtcatgtctcgcaaagctgagagtggacggcgcagccttcttgcagatcccggcagagggcgtccctgcctatatttctctgcatagactgctgcgcaagatgctgcggggcagcggactgccagccgtgtcccgggaaaaccctgttgcctctgacagctatgaggcagctgttctgtccttagccacaggcctggctcactcgggtaccgactgctcacagttggctcagggcctgggcacctggacgtgctctagctcgctttacccaagcaaacatcccatcaccgtcgaaattaatggcataaaccccggaaataatgactgctgggtcagcactgggctgtatttattggagggccaaaacgcagaggtgtctttgagcgaagccgccgcgtccgcaggacttcgcgtccaaatcggctgtcacactgatgacttgaccaaggctagaaaactgtctcgcgcccccgtcgtgacccaccagtgttggatggatcggactgagcggtcagtgtcctgcctgtggggagggttgctttacgttattgtcccaaaaggctcccagctcgggcccgtaccagtgaccatccgaggcgccgtgccagctccttattataaactgggcaaaacttctctcgaggaatggaaaagacagatgcaggagaatttggccccatggggagagttagcgacagataatattattctgaccgtgcctactactaatcttcaagcactgaaggaccccgaaccagtattgaggttatgggacgagatgatgcaggcagtcgctaggctcgcagcggagcctttcccattccgccggccagaacgcattgtagcggatgttcaaatttccgcaggctggatgcatagcggttacccaatcatgtgccatctcgagtccgtgaaggagattatcaacgagatggatatgcgctccaggggcgtatggggaccaatccacgagctcggccataaccaacagagacatgggtgggaatttcccccacataccacagaagccacatgtaacctgtggagcgtctacgtgcacgagaccgttctggggatccccagagcgcaggctcacgaggctctgtccccacctgaaagggaaaggcggatcaaagcccacctaggaaaaggcgcacccctgtgcgattggaatgtctggacggcgctggagacctacctgcaagtgttatcccggaacagcggcaggcgaggttag

SEQ ID NO: 47149 - DNA, 2448 bp, Artificial Sequence
  Description of Artificial Sequence: Synthetic coding sequence
atgaagatcttccagaaggagttcaagttcatcctgaagaagtgcacgcccattcaaaagtaccgagaggagaacggtaacagttcaagcagtccccaccatcagttgcaatcacatgcctcaggccccaggtacggagaggacgttaggcaagatcaacagcaactactggaaggaatctccgaattagacattagaaccgggggtgtcccatctcaactgttagtacatggcgcactggcgtttcccctcggccttgacgccagtctgaactgttttctggccgccgctcactatggtcgaggacgcgtggtacttgcagctcacgagtgcctgctgtgtgcgcccaagatgggcccatttttgttaaacgctgtacgttggcttgctagaggacagacaggtaaagtaggcgtgaacactaatctgaaggacctgtgtcccctactctcagagcacggattacagtgcagcctggagccccatttaaatagcgacctgtgtgtgtattgctgcaaagcgtacagcgacaaagaggctaagcaacttcaggaatttgttgcagaaggagggggtctgcttataggaggccaagcctggtggtgggccagccagaaccctggccattgccctctagcaggattccctggaaatatcatactgaattgtttcgggctatcgatcctcccccagacactcaaggcgggttgtttccccgttccaaccccagagatgcgctcctaccactttcgcaaggccttgagtcagttccaagctattctgaatcatgagaacgggaatcttgaaaaatcgtgtctggcaaagctgcgggtggatggcgctgcatttctgcagatcccagcagaaggcgtacccgcttatatatctcttcaccgtctccttcgaaagatgctgaggggatccggtctgcctgcggtgagtcgagaaaacccagtggcgtctgactcctacgaggccgcagtgctgtccctcgccacaggcctggctcacagcggcacagactgtagtcagctggctcagggtcttggcacgtggacttgcagctccagtctatatcccagtaaacatcctataactgtggagataaacgggatcaatccggagagccattctgtgattcaagtgggaatgcagtggcgtgacctgtcatcctgcaacctccatctcttggggctaagcaatagctccttgagcgcttcatgcgtcgcaggcacaacgggaaccagacatcatgcttggctgatctttgtgtttttggtggaaagagagtttcaccggaaaggcaacaacgactgctgggttagcactggattataccttctagaaggccagaacgccgaggtttcactcagcgaagccgcggccagcgccggcctccgcgttcagatcggttgccacaccgatgatctaaccaaagcacgtaaactgagccgggcgcccgtagttactcatcagtgctggatggaccgaaccgaacgctccgtgtcttgcctgtggggcggccttctctacgtgatcgtgccgaagggctcccaactgggacccgtgccggttaccattagaggagccgtccctgccccatattacaagctggggaagacaagtctcgaggaatggaagcgacagatgcaagaaaacctggctccatggggagaactggccacagacaatataatcctgactgtgccaaccacaaatctgcaggccctcaaggatccagaaccagtcttacggctctgggacgaaatgatgcaggccgtagcacggctcgccgcagaaccttttccgttcagacgaccagagcggatcgtggccgacgtacagatctctgccggttggatgcacagtgggtacccaattatgtgtcacctagagagcgttaaggagatcattaatgagatggatatgagatctagaggagtttggggccctattcatgaattaggacataatcaacagagacacggatgggaatttccccctcacactacagaggctacctgtaacctctggtcagtctacgtgcacgagactgtcctgggaataccgcgcgcacaggctcacgaggctctgagccctcccgaaagggagaggcggattaaggctcatctcggtaagggggccccactctgtgactggaatgtgtggacagccctggagacctacttgcagttgcaggaagcatttggttgggaaccctttacacagctctttgctgaatatcaaacgttaagccacctgcctaaggataatacagggcgaatgaatctctgggtgaagaaattcagcgagaaggtgaagaaaaatctggtgcctttttttgaagcctggggctggccaatacagaaggaagtggcagactcactggcaagcctgccagagtggcaagaaaacccgatgcaggtctatctgagggctcgcaagtag

SEQ ID NO: 47150 - DNA, 1695 bp, Artificial Sequence
  Description of Artificial Sequence: Synthetic coding sequence
atgggccccttcctgctgaacgccgtgcggtggctggcccggggccaaacaggaaaagtgggcgtgaacaccaacctgaaggatttgtgccccctgctgtccgaacatgggctgcagtgctcgcttgaaccacatttgaacagcgatctctgtgtgtattgctgcaaggcatattccgacaaagaggccaagcagctgcaggagttcgtagcagagggcggaggacttctaattggcggacaagcctggtggtgggcctcccagaatccaggtcactgccccctggcagggttcccaggaaatatcattttaaattgttttggtctgtccatcctgccacagacattgaaggcaggatgttttcccgtgcccacaccagagatgcgctcctatcacttcaggaaggccctctcccagttccaggctattctcaaccacgagaatggcaaccttgagaagtcttgcctcgccaagctacgggtggacggggctgcttttctgcaaattccagccgagggcgtgcccgcctacatttcgctgcataggttgctacgtaaaatgcttaggggttctggtttgcctgctgtgagccgcgagaatccagtcgcatcagacagttacgaggccgcggtgctgagcctcgcaactggcttggctcattctggaaccgactgttcacagttggcgcaaggtcttgggacttggacttgttccagtagtttgtacccctctaaacaccctatcactgtggagatcaacggtattaaccccggcaataatgattgctgggtctccactggcctgtatctgctggagggccaaaatgcagaagtaagcctttccgaagcagctgcaagcgccggtttacgcgtccaaattggatgtcacaccgatgatttaacaaaagcccggaaactgtcccgggctcccgtggtgacgcaccaatgctggatggataggacagaacgctcagtgagctgtctctggggcgggctcctgtatgtcattgtgcccaaggggtcacaactagggcccgttcctgtcactataagaggcgctgtcccggctccttattacaagctgggaaagacttcattggaagaatggaaaaggcagatgcaggaaaacctggcaccttggggcgagctggcgactgacaatatcatcctgaccgtcccaactaccaatcttcaagcgctgaaggacccggagcccgtgcttcgtctttgggacgagatgatgcaggccgtcgccaggctggccgctgagccttttcctttcaggaggcccgaaaggatcgtagccgacgtgcaaatctcagccggatggatgcattccgggtatccaatcatgtgccaccttgaatccgtgaaggaaatcatcaatgaaatggacatgcgctccagaggggtctggggacctatccacgagctgggacacaaccagcagcgccatggatgggaattccccccccatacgacggaggctacgtgcaacctgtggtccgtatatgtccacgagaccgtgttgggcatccctcgggctcaggcccacgaggccctgtcaccaccggaaagagagagaaggatcaaagcccatttaggcaagggtgcacccctgtgcgattggaacgtctggaccgctctggagacatacctgcaggtactgtcccgcaattcaggtagaagaggttag

SEQ ID NO: 47151 - DNA, 1695 bp, Artificial Sequence
  Description of Artificial Sequence: Synthetic coding sequence
atgggccccttcctgctgaacgccgtgcggtggctggcccggggccagactgggaaggtcggggtaaacactaacttaaaggatctgtgtcccctgctgagtgaacacggcctccaatgctcattggagccgcacctcaacagcgacttgtgtgtatattgctgcaaggcttattccgataaggaagccaaacagctccaggagtttgtagcagaaggtggcggcctgctcattggcgggcaagcctggtggtgggcttctcagaaccctggccactgtcccctcgcgggtttccctggtaatattattcttaactgcttcgggctgtccattttgccccagaccctgaaggcgggctgctttcccgtgcctacacccgagatgaggagctatcacttccgcaaggctctgtcgcaatttcaggcaattctgaatcacgagaatggcaacctggagaaatcctgcctggccaaactgcgagtcgacggcgccgcctttctgcagattcctgcggaaggagtccctgcctatatctccctgcaccgcctactcagaaaaatgctccgcggttccgggctgcctgcggtttctcgcgagaaccctgtggccagcgactcatatgaagcagctgtgctgtctttggctacgggcctggcacacagtggtacagattgctctcagctcgcccagggcctaggaacgtggacttgttcaagctcgctttaccccagtaaacatcctattacagtggaaattaacggtatcaatccaggaaataacgactgttgggtgagtactggactgtatctcttagaaggtcagaatgccgaagtgtcactgtccgaagcggcggcgagtgcgggccttcgagtccaaatcgggtgtcacactgacgaccttacaaaggcccggaagctgtctcgcgccccagtcgtgacccatcagtgctggatggacaggacagagcgtagcgtcagctgtctgtggggggggctcctgtacgtcattgtgcccaaaggtagtcaactcggccccgtacctgtgacgatccggggcgctgtgccagcaccctattacaaactcggcaagacaagcttggaggagtggaaacgccaaatgcaggaaaacttggcaccttggggcgaactcgcaacagacaatataatacttacagtgcccacgacaaacttacaggctctaaaagacccggagcctgttctccgtttgtgggacgagatgatgcaagctgttgcgcggctcgctgccgaaccattcccctttaggaggcccgaacggatcgtagctgatgtccagatttccgccggatggatgcattcagggtaccctatcatgtgtcatttggagtctgtgaaagaaatcatcaatgaaatggatatgcgttctcggggcgtttgggggccgatccacgaattagggcacaaccagcaaagacatggatgggagttcccaccccatacaaccgaggccacgtgcaacctctggtccgtctatgtgcatgaaaccgtgctcgggataccacgggctcaggcccacgaagctctctcaccaccagaacgggagcgacgtatcaaggctcacctcggaaagggagcccccctgtgtgactggaatgtgtggacagccctggagacgtatctgcaagtgctgtcacgcaactcaggacgcagagggtag

SEQ ID NO: 47152 - DNA, 2760 bp, Artificial Sequence
  Description of Artificial Sequence: Synthetic coding sequence
atggccaccatcgccgccgccgccttcgaggccctgatggacggcgtaacctgctgggacgtacctaggggacccattccctccgaactactgctgatcggcgaggctgcatttccagtcatggttaacgataagggtcaggtgctgatcgcggcctcctcctatgggagaggaaggttagtcgtggtttcgcacgagggctacctgtcacacactggcctggctccttttttgttaaatgctgtctcatggttgtgcccttgccctggggctcctgtgggcgtccacccgtccttggctccccttgtgaatatattgcaggatgcgggcctcgaagcgcaagttaagcccgaaccaggtgagcccctcggcgtttactgtataaacgcttacaacgataccctgacagccacactgattcagttcgtcaagcatggcgggggactgctgatcggcggacaggcttggtactgggcaagccagcacggtcctgataaggttctctcaagattcccagggaacaaagtgactagcgtagcgggcgtatattttactgatacctacggcgaccgcgaccggtttaaggtgtctaaaaaggtcccgaagattcccctccatgtccgctatggggaggacgtcagacaggaccaacaacaactgttagaggggatctccgaattggatatcaggacaggtggagtccccagccagctgttggtgcacggtgctttggcattccccctcggcctggatgctagtctgaactgcttcctcgccgcggcacattatggccggggcagagtggtgttggcagcccatgagtgtctgctctgcgcgcctaagatggggcccttcctccttaatgctgtaagatggctggcaagggggcagactggcaaggtcggcgtcaacaccaatttgaaggacctgtgtcccctgctgtctgagcacggtttacaatgtagcctagagccacacctgaactccgacttatgcgtatattgctgtaaagcctattctgacaaggaggccaagcagctccaggaatttgtggccgaaggcggcggcctgctgattggtggacaggcctggtggtgggcaagccagaacccgggccactgccctttggcaggcttcccaggcaatattatcctgaactgtttcggcttatccattctgccccagacactcaaggctggctgcttccccgtccctacacctgaaatgaggtcttaccacttccgcaaagctctgagccagtttcaagccatcttgaaccacgagaacggaaatttggagaagtcttgtctggcaaagttgcgcgttgacggcgcagccttcctgcagatccctgcagagggcgttcctgcttacatcagcctgcacaggctcttgcgtaagatgttgcgcggctccgggcttcctgccgtcagtagggaaaatcctgtcgcttccgattcttacgaagcagccgtgctgtccctcgcgaccggacttgcccattcagggaccgattgctctcagctagcccagggtcttggaacctggacctgctcgtccagtctgtaccccagtaaacacccaatcactgtagagataaacggaattaatccaggcaacaatgattgctgggttagtaccgggctataccttctggaaggacaaaacgctgaggtgagcttatccgaagcggcagctagtgccgggctgcgggtacagatcgggtgtcacacagacgacctgactaaagcaaggaagctgtctcgcgcaccagtggtgacacaccagtgttggatggacagaacggaaagaagcgtgagctgtttatggggggggctgctttatgtaattgtgcccaagggcagtcagctcgggcccgtgcctgttaccatccgcggagccgtgccggctccctattataaactgggcaagacatcactggaagaatggaaacggcagatgcaggagaacttagcaccgtggggcgagctggccactgacaacatcatactgacagttcctacaacaaatctgcaggctttgaaagatccagagcctgtgctcaggctctgggatgagatgatgcaagctgttgctaggctggcagccgagccatttccttttcgaagaccagagaggattgtcgccgatgtgcagatctcagcaggctggatgcactctggctaccccattatgtgccaccttgagagcgtgaaagaaatcatcaatgagatggacatgagatctcgcggagtgtgggggcctatccacgagttggggcataatcagcagcggcacggatgggagtttccacctcatacaacagaagcgacttgcaatttgtggtccgtgtatgtgcatgaaactgtgctgggtattcccagagcacaagcccacgaagcactcagcccgcctgaaagggagcgcagaataaaagctcatctagggaagggtgctccactgtgtgattggaatgtgtggaccgctttagaaacttatctgcagctgcaggaggccttcgggtgggaaccgtttactcagctcttcgccgagtaccaaactctcagccatttgccaaaggacaacacaggaagaatgaatctttgggtgaagaagttttctgagaaggttaaaaaaaacctggtgccctttttcgaggcgtgggggtggcctattcagaaagaagtggctgattccctcgcaagcctacccgagtggcaggaaaatcccatgcaagtctatcttcgcgcacgcaaatag

SEQ ID NO: 47153 - DNA, 2538 bp, Artificial Sequence
  Description of Artificial Sequence: Synthetic coding sequence
atggccaccatcgccgccgccgccttcgaggccctgatggacggcgtcacctgctgggatgtgccgagaggaccgattccttccgaattgttgctaataggagaagccgcattccctgtgatggtgaacgataagggtcaggtgctgattgctgcctccagctatggacgtgggcgtcttgtagtggtgtcacatgaagggtaccttagtcacaccgggctcgcacctttcctgctaaatgctgtgtcatggctgtgcccctgtccaggggcccctgtcggtgtccatccctcactggcacccctggtaaacatcctgcaagatgcaggtctggaagcccaggtcaaacccgaacctggggaaccactgggtgtgtactgtattaatgcctataacgacacactgactgccacacttattcaattcgtgaaacatggtgggggtcttctgattggcggacaggcttggtactgggctagtcagcatggaccagataaggtacttagtcgctttcctggtaacaaagtgacaagtgtggccggtgtgtattttaccgacacttatggcgacagggacaggttcaaagtgagcaagaaagtgcccaagatcccgctgcacgtgaggtacggagaagatgtcagacaagaccagcagcagctcctcgagggaatttcagagctggacatcagaactggcggcgtgccttcacagttgctcgtacacggtgccctggcttttccgctgggattagatgcaagcctcaattgtttcctggcagcagcccactacgggcgcggacgtgtcgtgctcgccgctcatgagtgtcttttgtgcgctcctaaaatggggccatttcttctgaatgctgtccgatggttggccagaggccaaaccggtaaagtcggggtgaataccaacctgaaagacttatgcccccttctgtccgagcacgggctacagtgtagccttgaaccacatctgaatagtgacctgtgcgtgtattgttgcaaggcttactcagacaaagaggcgaagcaacttcaggagttcgtggcagagggaggagggcttctaatcggcgggcaggcctggtggtgggcgtcccagaacccaggccattgtcctctcgccggattccccggaaatatcattctgaactgctttgggctgtcaattctgccccagacattaaaagctggctgttttcccgttcccacgcctgaaatgcgctcttaccatttcaggaaggcactgtcccaattccaggccatcctgaatcacgagaacgggaacctagaaaaatcatgccttgcgaagctgcgcgtggacggcgcggcttttttgcagattcccgcagaaggcgtcccggcttatataagcctgcatcgccttctgaggaaaatgttacggggcagcggtttgcctgctgtatctcgggagaatcctgtggcttctgattcgtacgaggctgcagtccttagcctggcaactggcctggcccattccggcacagattgctcccaattagcccaggggctcgggacttggacatgctcttcttctttgtatcccagcaagcaccccatcactgtggaaatcaatgggattaaccctggtaacaacgattgctgggtgagtacaggactctacctacttgagggacagaacgctgaagtatctctctcagaagccgctgcttctgcaggcctgcgtgtccaaatcggatgtcacactgatgacttgaccaaggcccgcaaactctctcgcgcacccgtagtgacacaccagtgctggatggaccgtacagagagatcggtgagttgtttatggggcggtttgctatacgtgatagtcccaaagggaagccaactgggtcctgttcctgtgacaatcagaggcgccgtgccggccccgtattacaagctcggcaagacttccctagaggagtggaaaaggcaaatgcaggagaatctcgccccatggggagaactcgctacagacaatattatcttgaccgttcctactaccaacttgcaagccctcaaggatccggaacccgtcttacggctctgggatgagatgatgcaggccgtggcacggttggccgcggagcctttccctttccgaagacctgaaaggattgtggctgatgtacagataagcgcgggttggatgcactctggataccctatcatgtgccacctggagtccgtgaaagagatcatcaatgagatggacatgaggtccagaggtgtctgggggcctattcatgaactcggccacaatcagcagcgccacggctgggagttcccaccccatacgaccgaagccacgtgtaatctctggtctgtgtatgttcatgaaactgtactcggtatccccagagcgcaggctcacgaggcgctgtcccctcccgaaagagagcggcgcatcaaagcacatctcgggaaaggggcaccgttatgcgattggaatgtgtggacagccctcgagacctacctgcaagttctgagccgaaatagtggacgtaggggttag

SEQ ID NO: 47154 - DNA, 1827 bp, Artificial Sequence
  Description of Artificial Sequence: Synthetic coding sequence
atggccctgcggggccccgccggcctgggccccggcagccggcggcccctcgatgaggcggtcgcaggggctgaggggcgtgaggctcccgctctggttgccgctgggggcgcccccgaagatgatgaagaagacgacggtagggggaggggcctcctcagatgggattctttctccgcatggctacattgtgtgtgtgtggtcggttttgacctcgagttagggcaagctgtggaggttatttatccccagcattcgaaacttacagatcgggaaaagaccaatatctgctatttgagtttcccagactcgaacagtggctgcctcggtgatacccaattttgttttcgatttagacagagttcagggcgacgcgtgtccttacactgtttgctggatcagttcgataaggatctgccggtgtacctaaagaaagacccagcttatttttacggatacgtttacttcagacaggtacgggacaagactttgaagagagggtattttcagaaatctctggtcttaatatcaaagttgccatatattcactttttccatactgtgctgaagcagatcgcaccagaatatttcgagaagaacgaaccctaccttgaggctgcctgtaacgatgttgaccgttggccggcaccagtgccaggcaaaactctgcacctccccataatgggtgtggttatgaaggtccgcatccctacttgtcacgacaaaccagggacgacgcagatcgttcagctgacgcagcaagttgacaccaacatctctgtgattttacctaccgtgcatgaagtggatatattcaggtgcttttgccctgtgtttctccacagtcaaatgctgtgggagctcgtgttactcggagagcctcttgttgtgatggctcccagtccttccgaatcatccgaaactgttctcgctctggtgaattgtatttcacccttaaagtacttctcggatttccggccttactttacaattcacgattcagaattcaaggaatatacgacacggacccaggccccacccagcgtcatcctcggggtaacaaaccctttctttgcaaagacactgcaacactggcctcatataatccgcataggagatcttaaaccgacgggggaaataccaaaacaggttaaagtgaagaaactgaagaatctgaagaccctggattcgaaaccaggtgtgtatactagttataagccatatctcaaccgtgacgaggagattatcaagcaactccagaagggagtgcagcagaagaggccctctgaagcccaatccgtgatcctccggaggtacttcttggaactgacccagagctttattattccactggagcgctatgtggcaagcctgatgccattacagaaaagtatatcaccttggaagtccccaccccagctaagacagttcctgccggaagagtttatgaaaacactggagaaaaccgggccgcagctgacatcacggattaagggtgattggattgggctgtaccggcatttcctcaagagtccaaattttgatggttggttcaagacacgtcgcaaggaaatgacccagaaactcgaggcccttcacctagaagcgttgtgtgaagaagacttattgctgtggatccaaaaacatactgaagtggaaacggtggacctggttctgaagttgaaaaataagctgttgcaggcagacagagagcacctacctgtgaagcccgacaccatggaaaaacttcggacccatattgacgcaatcattcttgccttgccagaggatctccagggcatactccttaagacaggaatgacttag

SEQ ID NO: 47155 - DNA, 1758 bp, Artificial Sequence
  Description of Artificial Sequence: Synthetic coding sequence
atggacgccctgctgggcaccggcccccggcgggcccggggctgcctgggtgctgctggtccaacctcgtctggccgcgccgcccggaccccggcagctccttgggcacgattctcggcatggctcgaatgtgtgtgcgtggtgacttttgatctcgagttaggccaggctctggaactcgtttaccctaatgactttcgtttaactgacaaagaaaagagtagtatatgctatctgtctttcccagactcccactccggttgcctcggggacacccagttctcctttcgcatgcggcaatgcggtgggcagaggagcccttggcatgccgatgataggcactataattcgcgtgctcctgtggcactgcagcgggaacccgcccattacttcggctacgtttacttccgacaggttaaggattcgagcgtaaagagaggttactttcagaagtctcttgttctcgtgtctcggctgccattcgtccgcctgttccaggcattactctcactcatcgcacctgagtatttcgacaagctggctccctgcctcgaagccgtgtgctcagagattgatcaatggcccgctcccgcccctggacagaccctgaaccttccagtgatgggtgtggtggtgcaggtccgtattccatcccgcgtcgataagtctgaaagttccccgccaaagcaatttgaccaggaaaatctgctgccagctcccgttgtgcttgcttccgttcatgagcttgacctctttaggtgctttagacccgtgctgacacacatgcaaacgctatgggaattgatgctgctgggcgagcctctcctcgtgctggctccttctccagatgtgagttcggaaatggtattggctcttacgagctgcctccagccattgagattttgttgcgacttccggccctatttcactatccacgactccgagttcaaagagttcactactaggactcaggccccccccaacgtggtgcttggggtcactaaccctttcttcatcaagaccttgcagcattggccacacatccttagagtgggcgagcccaaaatgtctggggatctgcccaagcaggttaaactgaagaagcctagccgccttaagacacttgacacaaaaccagggttatacactgcttatactgcacatctacatcgcgacaaggctctgttgaagagacttctgaagggggtacagaagaaacgaccctccgacgtgcagtccgctctcttgcggcgccatctcctggaactcacgcaaagcttcattattccacttgagcactatatggcatccctgatgccccttcagaaaagcattactccatggaaaacaccccctcagattcagcccttttcccaggatgactttctgagaagcctcgagcacgccggtcctcagctcacttgcattttgaagggtgattggctgggtctgtacagaagattttttaaaagccctcacttcgacggctggtaccggcagaggcataaggaaatggccttgaaactagaggctcttcatctcgaagccatctgtgaggcaaacatcgagacctggatgaaggacaagagcgaggtagaagtcgtggatcttgtattgaaactgcgggaaaagctcgttagggcccaaggccaccagctgccagtgaaagaggcgaccttacaacgggcgcagctgtacatcgaaacagtgatcggtagcctaccgaaggacctccaggctgtgctgtgcccgccctag

SEQ ID NO: 47156 - DNA, 1362 bp, Artificial Sequence
  Description of Artificial Sequence: Synthetic coding sequence
atggccggcgccgccgccggcggccggggcggcggcgcctggggcccagggagaggaggcgctggaggcctgcggagagggtgctcacctcccgcccccgcaggctcacctcgggccggactacaacccctgcgggccacaatcccatttcagctgcagcagccacaccagagacgcgacggtgggggtcgagccgcttcggttccatgttcagtcgcacctgaaaaaagcgtctgtcggccacagccgttacaggtgcgtcgtacattcagcctggatacgatcctctctagctacctgctcggacagtggcctagggatgcggacggggcttttacatgctgcacgaatgacaaagccactcaaaccccccttagctggcaggaactggaaggcgagcgagcatctagctgtgcccataaaaggagcgcaagctggggctcaacagaccaccggaaggaaatttccaagctgaagcaacaattgcagaggaccaagcttagccgctccggaaaggagaaggaacgagggagccccctgcttggtgaccacgccgttcggggagcccttagagcatctccaccaagttttccctctggatcaccagtgttgaggctgagcccatgtctgcatagatcgcttgaagggcttaatcaggaactcgaggaggtcttcgttaaagagcagggcgaggaggaactgttaagaatattggacatacctgatggccaccgagcgccggcgcctccccaatcgggatcttgcgaccaccccctgctgcttctcgagccaggcaatttagcatcatccccatcaatgtccctcgcaagccctcagccatgcgggctcgccagccacgaggaacatcgcggggcagctgaggaacttgccagcactccaaacgataaggcctcttctcccggccatcctgccttccttgaagacggcagcccctctcccgtactggccttcgccgcctccccacgccctaatcactcctacattttcaaacgggaaccaccggaaggctgcgaaaaggtgcgggtatttgaagaagccacgtcacccgggcccgacctggccttcttgacaagctgccccgacaagaacaaggtacattttaatccaacgggctcagccttctgccccgtcaacttgatgaagcccctgttcccgggcatgggctttatcttcagaaattgcccttccaatccaggcagcccgcttcccccagcttcaccacgccctccgcctagaaaggacccagaagcatccaaagctagcccccttccctttgagccctggcaacgaacccctccttctgaggaaccagtgctgttccaatccagccttatggtgtag

SEQ ID NO: 47157 - DNA, 1038 bp, Artificial Sequence
  Description of Artificial Sequence: Synthetic coding sequence
atgcgggacaaggccacccagaccgagagcgcctgggccgaggagtattcagagaaaaaaaaagggtcccataagcgttcggccagctgggggagtacagatcaactaaaggagatcgccaagctaaggcagcagctgcagcggtctaaacactcttctcgccatcaccgggacaaagaaaggcaatctccgtttcacggcaaccatgccgcaattaatcaatgccaggctcccgttccaaagtctgccctaattcctgtcattccaatcacgaagtctacaggctccagattccgtaattctgttgaagggctcaaccaagagatagagatcatcatcaaggagaccggtgagaaagaagaacagctcatcccccaggacatccctgacggtcacagggcccctccaccgctcgtgcagaggtccagttcaaccagatcaattgacacacagacccctggcggagccgatagaggaagcaataatagtagtcgttctcagtcggtctcacctacctcattcttgacaatatctaacgagggatctgaggaaagcccctgcagcgcagatgatctgctggtggacccgcgagacaaggaaaacgggaacaatagtcctctgcctaagtacgctacttcccctaagcctaacaattcttacatgtttaagcgcgagccccccgagggatgcgaacgcgtaaaggtcttcgaggagtgctcgccaaaacaactccatgagataccggccttttactgtccagacaagaacaaggtgaatttcattccgaaatctggctccgccttctgtctggtcagcatactgaagccactcctgccaaccccggaccttactctcaaagggagcggacacagtctcacggttaccactggcatgacaactactctgctgcagcccatcgcagtcgcctccttgagcactaacacagagcaagacagagtgtcacgcgggacaagcactgttatgcccagcgcatcccttttgcccccaccagagcccatcgaagaggcagaaggatag

SEQ ID NO: 47158 - DNA, 1770 bp, Artificial Sequence
  Description of Artificial Sequence: Synthetic coding sequence
atgagccagcgggtgcggcggaacggcagccccacccccgccggcagcctggggggtggagctgtggcaacagccgggggcccggggagccggctccaaccaatgagggccactgtgccattccagttgaaacagcaacagcagcagcagcatggctcgccaactagaagcggagggggcgggggtggcaacaataacggcgggtgctgcgggggcgcctctggcccagccggtggaggcggcggagggggcccaagaactgcaagccgcagtacatcacccaccaggggaggaggaaatgcggccgctcgaacctctcctaccgtggctacacagacaggggcttccgctaccagcactcgggggacctcaccaacgcggagtgcagcgcccggggccaggggctctccaccgagacctcccccgcctccgcctcttctcgggaccgtgagcagcccatcaagctccccgacccacctctggaccggtgaagtgtccgctgctccccctcctgcacgagtccgtcacagacggagatctccagaacagagcaggtcctcacccgagaaacgcagcccttcagctccggtctgtaaagccggtgataaaacaaggcagccttcgtcctctccatctagcatcatcaggagaacgtcctccttggatacactagccgctccctatctcgccggccactggcctcgtgattcacatggccaagcagcaccctgcatgagggacaaggccacacagaccgagagtgcttgggctgaggagtatagcgaaaaaaagaaaggaagccacaagcggagcgcttcctggggcagtaccgaccagctgaaggagatagcaaagctgcgccagcagctgcagcgcagcaagcacagctcccgccatcatagggataaagagagacaatctccgtttcacgggaaccacgcagcaatcaatcagtgccaggccccagtgcctaagtcagccctcataccagttatccccataactaagtccacaggcagcagatttcggaattccgtcgaaggcctcaaccaggaaatcgagatcattataaaggaaacaggcgagaaggaggagcaactgatcccccaggatatcccggatggccaccgcgccccccctccactcgtccagcgttcctctagcacccgctcgatcgacacacaaacacccgggggagctgatcgcgggtctaataacagcagcaggtctcagtccgtgtcccccacaagttttctgaccatatctaatgaaggatctgaggaaagtccttgctcagctgacgacctgttagtcgaccctcgcgataaagagaatggcaataattcacccctgccaaaatatgctacctcacccaagccaaataattcatatatgtttaagcgagaacctcctgagggctgcgaacgcgtcaaagtctttgaagagtgcagcccaaagcagctgcacgagattccagctttctactgtccagacaaaaataaggtgaactttattccgaagtccggttccgccttttgcctggtttcgatcctcaaaccactgctcccaacacctgatctcaccttaaaggggagtggtcattcattaacagtcacgactggtatgaccaccaccctgcttcagcccatagccgtcgcctcactctcaactaataccgagcaggatcgcgtctccagaggaacctcaaccgtcatgccatcagcgagccttctgccaccacctgagcccattgaggaggctgaaggttag

SEQ ID NO: 47159 - DNA, 1056 bp, Artificial Sequence
  Description of Artificial Sequence: Synthetic coding sequence
atggccagcaccggcagccaggccagcgacatcgacgagatcttcggtttttttaatgatggcgagcctccaactaagaagcctcgcaagttgctgccttctctcaaaacgaaaaagccgagagaactggtgctggtcattgggacgggaatcagcgcagcggtggcccctcaggtgcccgcccttaagagttggaaggggcttatacaggccttgctggacgctgccatcgattttgaccttctggaggatgaggagagcaaaaaattccaaaagtgtctccacgaggataagaatctggtacacgtggcccacgacctgatccagaaactctcaccgaggactagcaatgttcggtctacattcttcaaagattgcctttatgaagttttcgacgacctcgagagcaagatggaagactcggggaaacagctgttacagagtgtgctgcacctcatggagaacggtgccctggtgctcaccacgaattttgacaacctgttggaactgtacgcggccgatcaaggcaaacagcttgaaagccttgacctgacagacgagaagaaagtgctcgagtgggcacaggaaaagcgcaagttaagcgtcctccatattcacggtgtgtatacaaatccctctggcatcgtattacatcccgccgggtaccagaacgtcctgagaaatactgaagtcatgcgggagattcaaaagctgtacgagaataagtccttcctgttcctgggctgcggttggacggttgatgacactacctttcaggctctgtttttggaggccgtgaaacacaagtccgacttggagcattttatgctagtccgcagaggtgatgtggacgaatttaagaaattgagggaaaatatgcttgataagggtatcaaggtaattagctacggcgatgactacgccgatctgccggaatatttcaaacgcttaacttgtgagatatcaacacgaggaacttccgctgggatggtgagggagggccagttaaacggctcctcagctgcccatagcgaaattcgaggttgctccacttag

SEQ ID NO: 47160 - DNA, 222 bp, Artificial Sequence
  Description of Artificial Sequence: Synthetic coding sequence
atgcggctgatcctgaacctgtgccggggcgccggctgcaaccggcaagccgtcgcaggtcagcttctacccagtacatggagtctacatgcccacgggctggctaaagaggcacccatcctccccgtcaaaaaaatatctagaagttgttccgttaacaataaggtgtccaaaaaaaccacgaagccacccacattgcggagtttcctgtctcccatttag

SEQ ID NO: 47161 - DNA, 771 bp, Artificial Sequence
  Description of Artificial Sequence: Synthetic coding sequence
atgggcaagaccaaggacatcggcgacgacgacaccgtggccagcgagttctggtctggggctctgagtcagcccagctccgtaccaactcgaccccggacccctaatagagatagctggaggcgtgcctgggctgctcgcggactccaccctagaccgtccattctccagccaggtcccgccaggctgtcccgtgcgcgggctggcggaacccgctgcccccagcggaggcacggccgcgcgactttttgcgctctcgggcgggggattggggtccgaagaggaccaggcccacgaccagcacgaatacctggtctgaccctgacttggaagagaatgtccgcgcgaaggatgcagtgggcgatgcagactgggggacggaaccagacttttggtggtggagttcctctcttctggacctggcttacaatctgctgcgccgtgtggcgatctttaccttgccggctgacacactcctgcagccgcgcgttttcgtctgccccattgaagaagacgaagtcctcaatgctgcctcccaagcaagcgcttgccagcgcggcccgtaacttatgccgcggagccgggtgcaaccgccaggcagtagccgggcagttgttgcccagcacctggagcctacacgcacatggcctggctaaggaagcacccattctgccagtgaagaagatttccaggtcttgctccgtaaataataaggtgtcaaagaagacaactaagccaccgaccttgcgatctttcctctctcctatctag

SEQ ID NO: 47162 - DNA, 816 bp, Artificial Sequence
  Description of Artificial Sequence: Synthetic coding sequence
atggcccaggagaagatggagctggacctggagctgccccccggcaccggcggttcacctgccgaagggggcggatcagggggcgggggcggccttaggcggtcaaactcggctccgctgatccacggtctgtccgacacatctcccgtgttccaggctgaggctcctagtgctcggaggaactcaacaacattcccatcaagattgcaccagatcaaacaggaggagggcatggatcttattaaccgagaaactgtgcacgagcgcgaagtacagacagctatgcaaatttcacattcttgggaggaaagcttctccttgagcgataatgacgttgagaaatctgcaagccccaaacgcatagacttcatccctgtgtccccagccccctctccaaccaggggcattggcaagcaatgtttctcaccaagcctgcagtcctttgtgtcatccaacggattgcctccctcccccataccgtctccgacaaccagattcacaacccgacgtagtcagtcgcctatcaactgtattaggccaagcgttctgggtccacttaagcgcaagtgcgagatggagaccgagtatcagcctaaacggttttttcaagggatcactaacatgcttagtagtgacgtcgcacaactgtcggatcctggcgtttgtgtgagcagcgacactctcgatgggaattcatccagtgcaggatccagctgcaattctccagccaaggtctccacaaccaccgatagtcctgtctctcccgcccaggcagcctcacctttcatccctctggacgaactctcctccaaatag

SEQ ID NO: 47163 - DNA, 864 bp, Artificial Sequence
  Description of Artificial Sequence: Synthetic coding sequence
atggcccaggagaagatggagctggacctggagctgccccccggcacaggaggatccccggccgagggagggggttctggggggggcggcggactgcgccgaagcaacagcgcgccactgattcatggacttagcgatacaagccccgtattccaggcggaggccccgtctgcgcggcggaattctacaacctttccgtccagacatggcctgttattgcctgccagccctgtgcgaatgcattcttcccgcctccaccagattaagcaagaggaagggatggacctcataaatagggaaacggtccacgagcgcgaagtgcagaccgccatgcagattagccactcttgggaggaatcctttagcctaagcgacaacgatgtcgagaagagtgcaagccctaaacgcattgactttatccccgtctccccagctcctagtcctacacgaggcataggaaaacagtgtttctcccctagcctgcaatcttttgtcagctcaaacggtctacccccaagcccaatcccttcccctaccactaggttcactacccgtcggtcccagtctcctattaattgcatcaggccgtccgtgctaggaccacttaagcggaaatgcgagatggagactgagtaccagccaaaacggtttttccagggtattaccaatatgttgtccagcgacgtggcccaactgtccgacccgggagtgtgcgtgagttctgacacgctggacggcaactccagttcagcaggctccagctgtaacagcccagccaaagtctcgaccactacagacagccccgtgagccccgcacaagcagcaagtccctttatcccactcgacgagctgtcttctaaatag

SEQ ID NO: 47164 - DNA, 726 bp, Artificial Sequence
  Description of Artificial Sequence: Synthetic coding sequence
atggcccaggagaagatggagctggacctggagcccgacaccagctacgggggtaccttgcggaggtcatcgtctgcgccactgatccatgggttatcagacctttcacaggtttttcaaccttacactctccggacgaggcgaaacagcacaacaattatgtcaagacactcgctccttctgagcagctctcccaacaggatcccctcatccaggctgcaccagattaaacgtgaggaaggcttggacatggtgaatagagagaccgctcatgagcgagaaatgcaaacggccatgcaaatctcacagagttgggacgaatcgctctctctgagcgacagcgactttgacaagccagaaaagctgtactcaccaaaacgcatagattttacgcccgtgtcccctgcgccatctcccacacggggctttggaaagatgtttgtctcctcctcaggtctgccgccctctcccgtgccgagcccgcgaagatttagcagacgctctcagtcccccgttaaatgcatccggcctagtgtgcttgggcccctcaagcgaaaaggggagatggagactgagtcacaacccaagcggctcttccagggaaccacgaacatgctcagccccgatgcagcccagctgtcagatctgtcttcgtggtggtgctaccagggagaggagatccctgccctgactagatgtgtggaacatctgcagatgaacgaatag

SEQ ID NO: 47165 - DNA, 801 bp, Artificial Sequence
  Description of Artificial Sequence: Synthetic coding sequence
atggcccaggagaagatggagctggacctggagcccgacaccagctatggagggacactgcgccggtcaagctcggcacctcttatccacggactgtcggacctcagccaggtgtttcagccgtacacactacggacccgacgtaattctaccacgatcatgagtcggcacagccttctgctttcgagctctcccaaccgcatccctagctcccgactccaccagataaagagggaggaagggctcgatatggtgaaccgggaaactgcacacgagagagaaatgcaaacagccatgcagatctcacaaagttgggatgagagcttgagtctttcggattccgatttcgacaagcccgagaagctttatagtcccaaacggatagactttacacctgtgtcaccagcgcccagcccaacgcgcggatttggcaaaatgtttgtttcgtcctctggactcccgccatctcccgtgcccagcccccgacgctttagcagaagaagccagtctcccgtcaagtgcattagacctagtgtgcttggcccacttaaacggaagggcgagatggagacagaaagccaacctaagcgcctgttccaagggacaacaaacatgttgtccccggacgcagcccagctgtcagatctgagctcctgctcagacatccttgatggatctagctcctccagcggcctctctagtgacccgctggcaaaaggatctgcgactgctgagagccccgtggcgtgtagcaattcatgctcctcattcattcttatggacgatctgagccccaaatag

SEQ ID NO: 47166 - DNA, 198 bp, Artificial Sequence
  Description of Artificial Sequence: Synthetic coding sequence
atggcccaggagaagatggagctggacctggagcccgacaccagctacggcggaaccctgcgaagatccagctccgccccactaattcacggcttgagcgatctgagccaggtctttcagccgtacacactccgaacccgtcgaaatagtactaccattatgtcccgacattcactcttgcatatttggcacttttag

SEQ ID NO: 47167 - DNA, 744 bp, Artificial Sequence
  Description of Artificial Sequence: Synthetic coding sequence
atggcccaggagaagatggagctggacctggagcccgacaccagctacggaggcacacttaggcgctcttccagcgcccccctcatacacggacttagcgacctgagccaggtgttccagccatacactctgcgcacaaggcgcaacagcactactatcatgagcaggcatagtttggaagaaggcttggacatggtcaatagagagacggcacacgagcgcgagatgcagaccgctatgcaaatttcacagtcttgggacgagtctctgtctttaagcgattctgattttgacaagcccgaaaagctctactctcctaaaaggatcgatttcaccccagtgagcccggccccaagtccaacccggggctttggtaaaatgtttgtatccagctccggactacctccgtcgccggtgccaagtcccagaagatttagcaggaggtcccagagccctgtcaagtgtattcgaccttcagtcctgggacctttgaagcgcaaaggggagatggaaaccgaatcacagcccaaacggctctttcaaggcactacaaatatgctgagccccgacgccgcccaactttcggacctatcttcatgctcggacatccttgacgggagtagcagctcctctggtttgagctcagatccattggctaagggttcagccaccgccgaatcccccgtcgcttgttctaatagctgctcatcattcatcttaatggacgacctgagtcccaagtag

SEQ ID NO: 47168 - DNA, 336 bp, Artificial Sequence
  Description of Artificial Sequence: Synthetic coding sequence
atggcccaggagaagatggagctggacctggagcccgacaccagctacggtggtaccctgcgacggtcatccagcgcacccttaatccacggcctgtctgacctttcccaggtgtttcagccatataccctgaggacaaggagaaattcgactacaatcatgagccgacacagcctgctcctggtcccaaaaggatacatggaaagggtcgacaaaatatacaagagacaccaggaggagggattggacatggtcaaccgggagactgctcacgaaagggagatgcagacagcgatgcagatcagccagtcttgggatgagtcacttagcctgtag

SEQ ID NO: 47169 - DNA, 747 bp, Artificial Sequence
  Description of Artificial Sequence: Synthetic coding sequence
atggcccaggagaagatggagctggacctggagcccgacaccagctatggcggcacacttaggcggtcatcgtcagcgccactgatccacgggctttctgacctgtcccaggtgttccagccctacacgctgagaactcgtcgtaattccacaaccattatgtcacggcacagcctggaggagggcctcgacatggtcaaccgcgaaaccgcccacgaaagagagatgcagaccgccatgcagatttctcagtcctgggacgagagtctgagcctgagcgacagtgactttgacaagcctgagaaattgtacagtcctaagagaatcgacttcacccctgtctcccccgccccatcccccacccgcggttttggcaagatgtttgtgagcagtagcggtttgcccccttcccctgtgcctagtccgaggaggttttcaagtcgcagatcccaaagtcctgtcaaatgtattcggccatctgtgttgggaccattgaagagaaagggggagatggagacagaatctcagccaaagcgccttttccaggggactacaaatatgttatccccagatgcagctcagctgtctgacctttcctcatgctccgatatcttagatgggtccagttcttcttcagggctgtcatctgatccgctagccaaggggtccgcaaccgcggagtctccagtggcctgttctaacagctgctcctcatttatcttgatggatgacctgagccccaagtag

SEQ ID NO: 47170 - DNA, 588 bp, Artificial Sequence
  Description of Artificial Sequence: Synthetic coding sequence
atggcccaggagaagatgaagctgggcttcaagagcctgcccagctctaccacagcggacggcaacattctccgaagagtgaattcggctccattaatcaatggactcggctttaactcccaagtgcttcaggctgacatgctcagaatcagaaccaatcgaactaccttccgcaataggcggtctctgctcttgcctcccccaccttttcatgggagtatctccaggctccaccaaatcaaacaggaagaggcaatggatctgataaatcgtgagaccatgagcgaatggaaactccagagcgaaatccagatctcccactcgtgggaagagggcctgaagctggttaagtggcatttcaacattaatcaaaagcgtttctcaaaggcgcaacccacctgttttttgcttatcctaccgaactgccaaaaaattatgtgtatttattttcaactgctgcttatggagacaactgccatgttagatctactggtgatacgacagctcaagtccgctctgtctcagacactcctgtgccatcttctgatcttggttttaatctgcagttcacggcagaccttcaattag

SEQ ID NO: 47171 - DNA, 459 bp, Artificial Sequence
  Description of Artificial Sequence: Synthetic coding sequence
atggcccaggagaagatgaagctgggcttcaagagcctgcccagctctacgactgccgatggcaatatcctcaggcgagtgaacagtgcccccttgatcaatgggttgggattcaactcccaagtcctgcaagctgacatgctaagaatccgcactaatagaacaactttccggaaccgtagatcactgctactgccccctcccccatttcacggttccataagccgtttgcaccaaataaaacaggaagaagctatggatctgattaatcgagaaaccatgtctgagtggaaactccagtctgagatccagatttcacactcatgggaggagggccttaagctcaacgataatggactccagaaatcatctagtcttaagtgcatcgaccttactccagtgagctcaatggcgtcatccatcaagaagaccgggaagtccacatcttcatatttttag

SEQ ID NO: 47172 - DNA, 348 bp, Artificial Sequence
  Description of Artificial Sequence: Synthetic coding sequence
atggcctacttccccggcaccggccggaccgaccaggagacccagttggacctgagcttgtgtggtagggagccagagtccctggaaaatctatttctagacccagatatggcccaggaaaaaatgaagctggggtttaagagcctgccatcttccactaccgctgatggaaacattctccgaagggttaacagcgcgccgctgatcaatggcctcggtttcaattcacaagtcctccaggcagatatgctacggattaggaccaacagaactacattccggaacagaaggagcttagaaatcaccagccctacgtccgttgaacagaagcccaaagatctgttttag

SEQ ID NO: 47173 - DNA, 558 bp, Artificial Sequence
  Description of Artificial Sequence: Synthetic coding sequence
atggacctgatcaaccgggagaccatgagcgagtggaagctgcagtccgaaattcagatatcccactcgtgggaggagggcctcaaactcaatgacaacggactccagaagtctagctctctgaaatgcatagacctgacccctgtaagtagcatggcctcaagtatcaaaaaaaccgggaaacagtgtttctctccttcccttcagacttgtgtgagctgtactggatcccctagctctcccatccccagtcctatgcagcagtatattattagatctcagaatcccacaaacattattcggcctagcatcctaggccctcttaagagaaaaggcgaaatggcattccagtatcaaccaaagaaaattttccagggcactacgaacatgctgagcagcgatacatcacaactgagtgaaaacaatgtgtatctcttgcctgccacgtttgatgggaacgatagcaatgcaggatcaagtggaaacagctcagctgagattggcacagtgaccaatagcccggtgtctcccagtgataccggttcccatctgttttag

SEQ ID NO: 47174 - DNA, 1659 bp, Artificial Sequence
  Description of Artificial Sequence: Synthetic coding sequence
atggagaccagccggagccggggcggcggcggcgccgtgagcgagcgtggtggcgcaggtgcctctgtgggagtttgtagacgtaaagccgaagccggcgccggaacgggcaccctagctgccgacatggatctgcactgtgattgtgctgctgagactccagcagctgaacccccctcaggcaaaattaacaaggcggcgttcaaactcttcaagaagagaaaaagcggcggcaccatgccaagcattttcggtgtgaaaaacaagggcgatggtaagtcttctgggcctactggcctggtgcgcagccgcacccatgatggactggccgaggttctggtgttagagtctggtcggaaagaagagcctcgcggaggaggcgattctgggggtggcggtggtggcagaccgaacccaggacctcctcgcgccgcaggaccgggtggaggaagcctggcctcatcttccgtggcaaaatcacactctttcttttcactcctgaaaaaaaatggtcgatctgagaatggcaaaggggagcccgttgatgcatctaaagccggcgggaagcagaagagaggcttgagaggcctctttagcggcatgaggtggcacagaaaggataaacgtgctaaggcggaggcggcagaggggcgagcacccggcggcggactgatcctgcctggtagcctgaccgcctctctcgagtgtgtcaaggaagaaactccccgagccgccagagagcctgaggaaccaagccaggatgctccccgcgatcctgcggggtgcggcgatatcatcgcagatcaagaggaggaggcagggccctcctgtgataaacacgtccccggccctggaaagccagccctgtccaaaaagaatccaggggtcgttgcataccaggggggcggggaagagatggccagtcctgatgaggtggacgatacttaccttcaagagttctgggatatgcttagtcaaaccgaggagcaggggcccgagccccaagaaggtgccgccaaggtagcagccgctcttgagacgaaggtagtccccgagacacccaaagatacaagatgtgtggaggccgcgaaggacgcatcatctgtgaaaaggcgcaggctgaaccgaatccccatcgagccccaccccaaagaggagccgaagcatccagagaaagagcagcaggaaggcgtgcctaactctgatgaaggctactgggatagtacaacccctgggcctgaggaagacagttcatcgtctggcaagaaggcaggcatccctcgcgattcctacagcggagatgctctttatgacctctacgctgaccccgacgggagccccgctactttaccaggcggaaaagataacgaggagacatcatctctgtcacgtcttaaacctgtttctccaggcacaattacatgtcctctgagaacccccggatccttacttaaggatagcaagattcctattagtattaagcacttgaccaacctccccagttcacaccccgtggtgcaccaacagcccagtagatccgagatgccacgtacaaagatcccggtgtcaaaggtcctggttagacgcgtcagtaatcgcggtttagctggcactacgatccgtgcgaccgcgtgtcatgattctgcaaagaaactatag

SEQ ID NO: 47175 - DNA, 1659 bp, Artificial Sequence
  Description of Artificial Sequence: Synthetic coding sequence
atggagaccagccggagccggggcggcggcggcgccgtgagcgagcgggggggggccggggccagcgtgggagtgtgcagacgtaaggccgaggctggcgccggcactggtactcttgccgccgatatggaccttcattgcgactgtgcggccgagaccccagccgctgaaccaccctcgggtaagataaataaggcagcatttaaactgttcaagaaacgaaaatctggtggcactatgccttcaatcttcggtgttaaaaataagggggatgggaagtctagcggacccacaggcttggtgcggtcacgcacgcacgatgggctggctgaagtccttgtgttggaaagcggtagaaaggaggaaccccgcggaggcggagatagtgggggcggagggggcggtaggcccaaccctgggccaccaagagcagcagggcctggcggaggtagcctcgcctctagtagtgtggccaagtcccatagctttttctcactgctgaagaaaaatggtagaagtgagaatgggaaaggtgagcccgtggatgccagcaaggccggtgggaaacagaaacggggcctgagaggcctgttcagcggcatgagatggcaccgtaaggataaaagggcaaaggccgaggctgcagaaggcagagctcccggcggtggcctgatcctgcccggatcactcactgcatcattggagtgcgtgaaagaggagaccccaagagcagcccgcgaacccgaagagccatcccaggacgcgcctcgggatccagcagggtgcggagatatcatcgccgatcaggaggaggaggcaggcccttcttgcgacaaacatgtccccggtcccggaaagcccgccttgagcaaaaagaatcccggtgtggtcgcctatcagggtggcggcgaggagatggcctcacccgatgaagtggacgatacttacttacaggaattttgggacatgctgagccaaactgaggaacagggaccagagcctcaagagggtgccgcaaaggttgccgccgcactagaaacaaaggttgttcctgagactcccaaggatacaaggtgcgtcgaagcggcaaaagatgcttcctcagttaaaagacgacgcctgaatagaattccaatcgagccccaccccaaggaagaaccgaagcatccagagaaagaacagcaggaaggggtgcccaactcggacgaaggctactgggatagtacaacacccggcccagaggaagattcttcttcaagtggtaaaaaggccggaatcccaagggactcgtacagcggggatgccctttatgatctctatgctgaccccgatggttcgcccgctaccttgccaggcggcaaagacaacgaggagacatcctctctctctcgcctcaaacctgtaagcccaggaaccataacttgcccactcagaaccccaggcagtctgttaaaggactccaaaatacccatttctataaagcacctgacaaacttgccctcttcccaccctgttgtacatcagcagcctagtcggagcgagatgccccgcaccaagataccagtgagtaaggtgctcgtaagacgtgtttctaatagaggactggccggcaccaccattcgggcgacagcttgtcacgattctgccaaaaaactttag

SEQ ID NO: 47176 - DNA, 2016 bp, Artificial Sequence
  Description of Artificial Sequence: Synthetic coding sequence
atggagaccagccggagccggggcggcggcggcgccgtgagcgagagaggaggtgccggagcgtccgtcggggtctgccggcggaaagctgaggcaggcgccggaactggcactctggccgccgacatggatctgcactgcgattgtgcagcggaaacacccgccgctgagccacctagcgggaagattaacaaggccgctttcaaactgttcaagaagcgtaagtctggaggcacaatgccatctatttttggggttaagaataagggtgatgggaagagctcaggacccacaggcttggtaagatcacggacccacgacggactggctgaggtcctggtgctggagagtgggcgaaaagaagagcctcgaggagggggagactctggcggaggtggaggcggacgtccaaacccagggcctccaagagccgcaggtcccggtggtggcagcctggcatcgagttccgtggcaaagtcccattcttttttctcactgctgaaaaagaatggacgaagcgagaacggcaaaggcgagccggtggatgcctctaaagctggaggtaagcaaaagcggggcctacgaggactgtttagcggaatgcggtggcaccggaaagataagcgagcgaaggcagaagccgccgagggacgggccccaggaggcggccttattttgcccggttctctaactgcttcattggaatgcgtgaaggaagaaacaccccgggctgcacgcgagcctgaggagccaagccaggatgctcccagagatccggcaggagagcctgctggtggagaggaggtgcccgctccagccgatcgagcccccgcaaggagctgccgtgaggcagaggggctggcccatcccggtgacaccggagccagaggcgaggacgctgccggacataggagagccgagccgggcccaggtgaggtgcgaacagccgaagacgcttctagaaccggggccgtccccgtgaagactgtgccactggtagattccgaaggcggatccggcagagcacctgccgcccctgacccggcctcagtggaccccccttcagaccccagtgccgaccggatttgtctaatgttctccgatgtgacctccctgaagtcatttgatagtctgaccggctgcggggatattatcgccgatcaggaagaggaggccggaccctcatgcgacaaacacgtccccggacctggtaagccggctctgtccaaaaaaaatccaggagtggtggcctatcagggaggaggcgaagagatggcatcaccagacgaggtcgatgacacatatctccaggagttttgggatatgctgagtcagacagaggagcaggggcctgagcctcaagagggggctgccaaggtggctgcggccttagagaccaaggtggtaccagagacccccaaggacactcgatgcgtggaggctgcaaaagacgccagcagcgttaagcggcgccggcttaaccggattcctattgaaccgcaccctaaggaagaaccaaaacacccggagaaggaacagcaggagggcgtgcccaacagcgacgaaggctattgggacagcacaacacccggacctgaagaggactcctcctccagcggcaaaaaggctggaattcctcgcgactcttatagcggcgacgctttatatgacttatacgctgatccagacgggtctcctgcaaccttgcccggcggcaaggataatgaggagactagcagcctgagtagattgaaacctgtgtcaccagggaccattacgtgtccattacgaacccccggcagcctgctcaaagatagcaagattccaatttccattaaacatctgaccaatcttccaagctcacaccctgtggtgcatcagcagccatcaagatcagagatgccacggacaaaaatcccagtctcaaaagtgctagtacgacgggtgtctaatagagggctcgccgggactaccatcagggcgaccgcatgccacgactctgctaagaaactctag

SEQ ID NO: 47177 - DNA, 2586 bp, Artificial Sequence
  Description of Artificial Sequence: Synthetic coding sequence
atggagctgaagcggggcaagaccttcatcaagagcagcctgcaggtaagtcacgagaaacctcccgaccctgcagcggtggctgcagctcgagagggcaccgggccctggagtgtgctgccaggggggcagcaacgtccccacagcgaaaaggggccccaagcctcaccctctgcccaagaatatgatagatgtcccaataaaggggcacagctggacccaaagggaggaccagctgcattatgtggcgccacgttcaaacccgtgaggaaatgcaaaacccacgacagtatgtctggcgctgggcgcgccactgcagccaccgggcagctggtcgggtctgcatcttttcctggaagccctggttctaggcggatgatagactaccgacacttcgtgccccaaatgccctttgtcccggccgtggcgaagtccatccctcgaaaaagaatatccctgaagagacccaaaaaatgctttagaaatctctttcacattcgccggaataaaaccgaagatttggcatcgctggctgccgagggaaaaagcctcccctctccaggggacccatccgacccaggtggccggcggagcaaggctttcctgccaccaggtgaggggccaggcctggacggactgtgtcaggatctgcttgactccgagctcttggctgatgctagcttcggtttgtgtagggccctgtgtgaggatgtggcttcccttcagagcttcgattctctgaccggctgcggtgaagtcttcgccgacgagagttcagttccaagcttagagctgaatgaggggcctgagagtcctacccaagctgcccaggggttagagtccaaggtaccaaggggcccactgcaaggttcggtagagcagctagcaagcccagcccagaatgaggcttccgattttactcggttttgggactcagtcaatcggtcagttagacagcaacagcgggcgttgctgggaccttggttaagcgggcctcagggcactgatagagaccagagtcggcttgataccgccggcctggccgagctccccctgtgcccatgtcgcgatccgcggagcggatccaaggcttcatcgattgacacagggacgcctaaaagtgaacagccagagagtgtgtccacgtccgatgagggttactatgactccttctctcccggcctggaagaggacaaaaaagaggccgagagcccagggacgcccgccgcaacatttccccgggactcgtacagtggagatgctttgtacgaactgttccacgatcctagcgaaggcccgttaggccctagccccgacgatgacctgtgcgtaagcgaaagtctcagcggccctgccttaggaactccattgagcatatgctcctttcgggtgggagcagaagagaacttagctcccgctccggggcctgacctgttatcacagggtttcttgcagtcttcttggaaggggaaggagtgtctgctgaaactgtgcgacaccgagctggccataactatgggcattgttagctggttacgccggggacctactccccgcgcgccaccaactcccggccagcctgccgctccccccggttctcagggggctcccagggcccccaccgaaaagcttggcggtagagagggattggcctctgacgccggtggggctactgtgtgctcagccccctcgaggcaggaactgtgggcccatcctggtacaacagggctgctcgccggagaatccaaagctttaggcggcgcaacgcagggcactggtaccctgagcagagatgcaagccgggaagaggaaacacggggacactccgaagggctgtttagcagtatggaatcggctgcaacttctactacggacacatccgggaaaaacaaggccccagtcccatccacctggccttgctcacagaaagagcctggaccccctggggtgctggggtgttttagaggaccatggaggcctggacatggaggcgacaccctggacgctgagcctatgctggcaggatgcgtagcgcgcgtggccgcattaaagatctcttctaacgaacagcctcccgcggcttggcctccacgccaggatatggggtctggcctgttcgggcaacgctgggctcgggggcccgacatgctcgagcagaagcagagcagctccagcccctccatgacaaccattcatggtcttccctatagcgccagtacgcaggatcagagatgtcgggacagggttcaagacttgtcttggcttcgagtggagcccacaggtctcggcgttcaggcctgggcctcagtggaagaccagcccctacagctcagtaccgaggcagtggagcaggtggcccatgggagccaactcgattcagagccccgaagtgcccccgccgcaaggtggagttcccagggtcatcaccccgaaagccttggccttaccctcaactctcagcaagaggggggcgtctccgcctctgctccggagtgcaggtgtagcttgctggcaagagaggggctgctatgcggccagcccgaggtgggggcctctggtccagctatggccgaaccccacttatag

SEQ ID NO: 47178 - DNA, 2586 bp, Artificial Sequence
  Description of Artificial Sequence: Synthetic coding sequence
atggagctgaagcggggcaagaccttcatcaagagcagcctgcaggtcagtcacgaaaaaccccccgaccctgccgctgtagcagccgccagggaaggaacaggtccatggtctgttctgcccggtggccagcagcggccgcactcagagaaaggccctcaggcaagtcccagtgctcaggaatacgatcggtgtccaaataagggcgcacaactggacccaaagggcggcccggccgccttatgtggagctacgttcaagcccgtgcggaagtgcaaaacacatgacagtatgagcggggccggcagggcaactgcagcaacgggacagcttgtgggaagcgcctctttcccgggctcacccggctcccggaggatgattgactaccgccatttcgtcccacagatgcctttcgtgcccgccgtcgctaaatccatacctcgcaaaagaatttctttgaaaaggcctaaaaagtgttttagaaacctgttccatattcgacgcaataagaccgaagacctcgcctccctggccgcggagggaaagagtctcccttctcccggagatcccagcgatccagggggcagacgtagcaaggcctttcttcccccaggagagggaccaggcctggacgggctctgtcaggaccttcttgacagtgaactgctggctgacgctagcttcggattgtgtcgtgccctgtgcgaagatgtggcctctttgcagagttttgactcccttacaggctgtggcgaggtcttcgctgatgagtccagtgtgccatctttagaactgaatgaaggtccagagagtccaacccaggccgcccagggactggagtccaaagtgccccggggcccactgcaaggaagcgtggagcagttggcaagtcccgcccagaacgaggccagcgatttcacgcggttctgggactcagtcaaccgtagcgtgcgccagcagcagcgcgctcttctcggtccttggcttagtgggcctcaaggaacagacagggaccagagtcgtctcgacactgctgggctggctgaactgcctttgtgtccttgccgcgaccctcggtcaggatctaaggcgagttcaattgatacagggacgcccaagtctgaacagcctgaatcggtgtcaaccagcgacgaagggtattacgactccttctctccaggtttggaggaggacaagaaggaggctgagagtccggggacaccagccgctacatttcctcgtgactcctacagtggtgacgccctgtacgaactctttcatgacccttcggagggccctttgggcccaagtccagacgacgatctttgtgtgtccgagtcactgtccggtccagctctcggcacacccctgtccatctgctcttttcgggtaggggccgaagaaaaccttgccccagctcccgggcccgatctcttgagtcaaggcttcttacagtctagttggaaaggaaaggagtgtcttctaaaactgtgcgacaccgagctagcaatcactatgggcattgtgagctggctgcgacgcgggccaacaccgcgcgcacctcctactcccggccagcccgctgcacctcctggttcccagggcgctcctagagcacccactgagaagctgggcgggagagagggccttgcttccgacgcaggcggagctaccgtttgttctgcgcctagtaggcaggaattgtgggcccacccaggtacaactggactgttggccggagaaagtaaggccttaggaggagctacacaagggaccggcacactgagtcgggacgcctcccgcgaggaagagacacggggccatagtgagggcctgttctcaagcatggaatctgcagctacatcaaccaccgacactagtggaaaaaacaaagcacctgtcccctctacttggccttgttctcagaaagagcctggcccacctggagttctcggatgctttcgcgggccgtggcgtccaggacatggcggcgataccctagacgcggaaccaatgctggccggatgtgttgctagagtcgccgctctgaaaatatcaagcaatgaacaaccccctgctgcctggccaccgcggcaggatatggggtccggtctttttggacagcgctgggcccggggacctgatatgctcgagcaaaaacaatctagcagttccccgtctatgactactatccacgggttgccatactcagcaagcacacaggatcagcgctgtcgcgatcgcgtgcaggatttgtcgtggctgagagtggagcctactggcctcggcgtgcaggcttgggcgtctgttgaagatcaacctctccagctgagcacagaggcagtggagcaggttgcacacggatcccagctggattctgaacctcgttccgctcctgctgccagatggtctagtcagggtcaccaccctgaaagtctgggactgacactgaacagtcaacaagaaggtggcgtaagcgcttccgctcccgagtgtcgatgcagtctgcttgccagggaaggactgctgtgcggccagccggaagtgggggccagcggccctgcaatggcggagccgcatctgtag

SEQ ID NO: 47179 - DNA, 429 bp, Artificial Sequence
  Description of Artificial Sequence: Synthetic coding sequence
atggagctgaagcggggcaagaccttcatcaagagcagcctgcaggtgtctcatgagaaacctcctgatccagctgccgtggcggcagcacgagagggtacggggccttggagcgtcctgcctggaggccagcaacgcccccactcggagaagggcccccaggcaagtcctagtgcacaagaatacgatcggtgccccaataagggggcccagttggacccgaaaggaggacctgcggcactgtgcggagctacatttaaacccgtccgcaagtgtaagacccatgattcaatgtcgggcgctgggagagccaccgcagcgaccggacagctggtcggatctgccagctttcccgggtcgccgggatctaggaggatgatcgattataggcatttcgtacctcagatgccatttgtccccgccgtctag

SEQ ID NO: 47180 - DNA, 543 bp, Artificial Sequence
  Description of Artificial Sequence: Synthetic coding sequence
atggagctgaagcggggcaagaccttcatcaagagcagcctgcaggtctcccacgagaaaccacctgaccctgctgccgtggcagccgctagggagggtacgggaccatggtcggtgttgcccggaggacagcagcggccccatagtgaaaaagggccacaggctagcccatcagcccaagaatacgataggtgcccaaataagggagcacagctagaccccaagggcggtcctgcagccctttgcggagctacattcaagccagtacgcaaatgcaagacacacgactcaatgtccggcgctggccgggccacagctgccacaggacagctggtgggatcggcctcttttcccggttcacccggatcccgacgtatgattgattatcgacacttcgtgcctcagatgcctttcgtgccagcagttgcgaaatcaataccccgcaaacgcattagtttaaaacgacccaagaagtgttttcggaatctgttccacattcggcgcaataaaacagaggacctggcttctctggctgccgagtag

SEQ ID NO: 47181 - DNA, 1749 bp, Artificial Sequence
  Description of Artificial Sequence: Synthetic coding sequence
atggaccccaaggccggcggcggcggcgaggaggacgactgcgtggactcaggtgccgagaccggaggctccgattattctcacctctcttctacgtctaacgggttcagcacttggagaatgccctgctgtctcttcctgtactgcacacacggagacaaggagaagggcagatggtccctgcaggtggagcacacctggccatcaggcgaacttagtgttgaggaggcccaggatcctttcctcgtgtccatacatattatcgcggatccgggcgagtctcagccgctgcaggaggcgattgataacgtccttgcgtggatccacccagacctgccactcttccgagtctccgaaaggcgggcctcaaggcgcagacgcaagccacccaagggtgcacagcctgcccttgcagtggttctgttcctgcaggaagagtatggagaagagcaaatacttcagctgcatcgcactctgcaacagcccccctggcgacaccaccatactgaacaggtacacgggaggtttctgccatacctcccctgctctcaagatttcttcactttagccccgggcactcctctgtgggccattagacccgttcattacggcaaagagattgtacgctttaccgtttattgtcggtacgacaattacgcagattctcttagattctatcagctgatactacgcaggtctcccagccaaaagaaggctgacttctgtatttttcccatattctctaatctggatgtcgacatccagttctccctgaaacgattgccttgcgatcagtgtcctgtgcccacggattccagcgtgctggagtttagagtccgagacataggtgagctggtaccccttctgccaaacccttgcagtccaattagcgaagggagatggcagacggaagaccatgacgggaataagatccttctgcaggcgcagcgcgtgcacaaaaagttcccaaagccgggacgagtacatcatgccagcgaaaaaaagaggcacagcactcccctcccaagcaccgcggtgccgagccacaccccggggtcctcacagcaaagccccttaaacagcccccaccctggaccgatccggacgggtctgccaccaggccaccagcaggagttcgctgggagagctaactccactcctaatcccccctggtctttccaacggtccaagtcactgttctgccttcctactgggggcccgagtttggcctcctccgccgaaccccagtggttttcaaatacaggcgcccccggccaccgtgccagcgagtggcggcacgggcatctcctgtccatagatgacctggagggtgcccaggaaacagatgtcgacaccggactgcggctctctagcagtgatctgtctgtggtatccgcgtacagcgcaccgtcacgattttgctctaccgtggaaacaccattgccatccgagcgatgcagtagccactgggcggcacacaaagactcccgcgaaggaccgttgcctacagtcagtagggtgacgactgaagcctcttgggcctctctgccctttttcacaaagagatcctcatcctcatcagctacagcaagagccgcaccgccagcaccctctacctccactctgacggactcttccccccaactcccctgtgatactccgaaagtgaagcaaaccgatggcgatatgcctcccccgcctggatccgccggtcctggggacaacgatatggaagagttctacatatag

SEQ ID NO: 47182 - DNA, 1641 bp, Artificial Sequence
  Description of Artificial Sequence: Synthetic coding sequence
atggaccccaaggccggcggcggcggcgaggaggacgactgcgtggactcgggggctgagaccggaggcagcgattactctcatcttagcagcactagcagcgagctgagtgtggaagaggcccaggatcccttcctggttagcattcacatcatcgctgaccctggggagtcacagcctctgcaggaggcgatcgacaacgtcctcgcttggattcatcctgacctcccactctttcgcgtctccgaacggagagcgagccgaagacgtcgcaagccccccaagggggcccaacctgctctggcagtggtgttgttcctccaggaggagtacggagaagagcaaattctacagcttcatcggaccttgcaacagccgccctggcggcaccaccacacagagcaggtgcacggcaggtttctgccctacctgccgtgttcacaggatttcttcacgctggcaccaggtacccccctgtgggccatcaggccagtccactacggaaaggagatcgttcgcttcacagtttactgccgatacgataactatgccgacagcctgcgcttctatcagcttatcctgaggcggtcgcctagtcagaaaaaagccgacttttgtattttccctatcttcagtaaccttgatgtggacatccagttttctttgaagcgactaccgtgcgatcagtgtcctgttcctaccgactcctcagttctggaattccgagtcagggacatcggagagcttgtgcctctcctaccgaatccgtgcagccccatatccgaaggtagatggcagacagaggatcacgacggaaacaagatcctgctgcaggcacagagagtacataagaagtttcccaaacctgggcgggtacaccatgcttctgagaaaaagcgacatagcactcctctaccatccaccgctgtgccttcccatacacccggatcctctcaacaatcccctctgaactcccctcaccccggacccattcggactggattgccaccaggccatcagcaggagtttgctggtcgcgccaactctaccccgaatcccccatggtccttccagcggagcaaatctctcttctgcctccctaccggcggaccttccttggcctcaagcgctgagccccagtggttttccaatacgggagcgcccggacatcgtgccagcgaatggaggcacgggcatctgctatcaatcgatgacctggaaggtgctcaagagaccgacgtagataccgggcttaggctgtcttcctctgacctgagtgtggttagtgcgtacagtgcccccagtcgattctgttccacggtcgagacccctctgccttccgagagatgctcctcacattgggctgcccataaagactctcgggaaggtcctctccctacggtcagccgggttaccacggaggccagctgggcttccctaccattttttaccaagcgctcatctagtagtagcgccactgctagagctgctcccccagctcccagcaccagcactctgacggattcctcccctcaattaccgtgcgatacacctaaggtaaaacagactgacggggatatgccaccaccgccgggcagtgccgggcccggggataatgacatggaagaattttatatctag

SEQ ID NO: 47183 - DNA, 819 bp, Artificial Sequence
  Description of Artificial Sequence: Synthetic coding sequence
atggacgagacccagggccccctggccatgaccgtgcacctgctggccaattcaggtcacgggtctttgctgcagcggacactggatcaattgttggattgtatttgtcccgaagtgcggctgtttcaggtatcagaaagggcatctcctgtgaaatactgcgaaaaaagccacagcaagcggtcacggttccccggtatgtcagtgctgttatttctccatgaatctcccggtgaagaccgactgttcagagttttggactccctgcaacatagcccttggcagtgctatccaacccaggataccagagggagactgtgcccctacttttttgccaaccaagaattctatagtctggattcccagctaccaatctggggcgtgaggcaggtacattgtgggtccgagattttgagagtgacactgtattgctccttcgataactacgaggacgcaattcgcctttacgagatgatcctgcagcgagaagccactttacagaagtcaaacttttgcttttttgtgctatacgctagtaaatctttcgcccttcagctgtccctgaagcaactgccccccgggatgagcgtggacccgaaggaatcaagcgttctacaatttaaggtgcaggaaatcggacagctggtcccccttctcccgaacccatgcatgccaatctcttctacacgctggcaaacccaggattacgatggaaacaagattctgttacagcgctgggaaagctcttcagtggcacagactcgggtccgatggtgtcatcatagctcactccgctctagcccatctgggttcaaatag

SEQ ID NO: 47184 - DNA, 819 bp, Artificial Sequence
  Description of Artificial Sequence: Synthetic coding sequence
atggacgagacccagggccccctggccatgaccgtgcacctgctggctaattccggacacggttcccttttgcaacgcactctagaccagctacttgattgtatatgtcctgaggtccgtctgtttcaagtctcagagcgggccagcccagtcaagtactgcgaaaagtcccactcaaaaagatcaaggttccccggaatgagcgtgctactgttccttcacgagagccctggagaggacaggctttttcgggtactagatagcctgcagcattccccgtggcagtgctatccgacacaggacacgagggggagactgtgcccatactttttcgcaaaccaggagttttattcacttgattctcagcttcccatttggggggtacggcaggtacattgcggctccgagatcttgcgcgttaccctgtactgcagtttcgacaattacgaggacgcaatcaggttgtacgagatgatattgcaaagggaagccacccttcagaagtccaatttttgcttcttcgtgttgtatgcgtctaaatcttttgcgcttcagctatccctgaagcagctaccccccggcatgtctgtggaccctaaagagtcatccgttctgcaatttaaagtgcaagaaattggccaactcgtgcctttgctccctaacccttgcatgcccatctctagtacgagatggcagacacaggactacgatggtaataaaatcttgctgcagcgctgggaatccagtagcgtcgctcaaacaagagtaagatggtgtcatcacagttctctgcgatcttccccatcgggctttaaatag

SEQ ID NO: 47185 - DNA, 1368 bp, Artificial Sequence
  Description of Artificial Sequence: Synthetic coding sequence
atggacgagacccagggccccctggccatgaccgtgcacctgctggctaattccgggcatggaagcctgctccaaaggaccctggatcagctgctggattgtatatgcccagaagttcggctgttccaagtctctgagcgagcctccccagtcaaatattgtgaaaaaagccattctaaaagaagtaggttccctggcatgagtgtcttactcttcctgcacgaatcccctggcgaagaccggctgttccgggttctggactcactacagcacagcccctggcaatgctaccctactcaggacactaggggccgcttatgcccctattttttcgccaatcaggagttctactctttggatagccagctccccatctggggcgttcggcaagtgcactgtggtagcgaaattctaagagtcaccctatattgcagtttcgacaactatgaggatgccatcaggctttatgagatgattctccagcgcgaagcgacactgcagaagtccaatttctgcttcttcgtgctgtacgcctcaaaatcatttgcactgcagctgtcattaaagcagctcccccccgggatgtccgtcgatcctaaggaatcaagtgtactgcagtttaaagtgcaggagataggacagctggtgcccctgcttcccaatccctgtatgccaatatcttctactagatggcagacgcaggactacgacgggaacaagatcctgctgcaggtccagttgaacccagagctgggggtgaagaacggcatactcggcgctggcatgttacctctggggagtcggttgacaagcgtgtcggctaaacggacttcagagcccagatcacagcggaaccagggtaagcgatcccaggggcactcactcgagcttcccgaaccgtcaggtagcccaacatcagatcggtgcgctggaacctcttggaagtctcccggacgctcgttccaggtgagttcacccgccatgggggcccatctccacctgtcctctcaccacctggagtccggggctaggatgaaggtcctgaaccgggaaaattcattccaaaagttggaggcagaaaccaacgtggacacagggttgaccatcattaacagcgaaccccggcagacatatttcgggggcttcccaagggacctgcagacaagccaaccccctttctgcttacccgcgtctagcctgggggttgcgacgtccaagaataatagcgtactgaaagagcgggtaagtccactgccccttgctggccagcgggatctcgggaccagaaaaacgatttccgagtgccttctgcacctgcaggtgcagggtgaagaaaaggaagaggatgaggaagaattttttatctag

SEQ ID NO: 47186 - DNA, 1593 bp, Artificial Sequence
  Description of Artificial Sequence: Synthetic coding sequence
atgctgggcaccgaccggtgcgtggtggaggagtggctgagcgagtttaaggcccttccggacacacaaatcacgagctatgccgctacactgcacagaaaaaaaaccctcgtgccggccttgtacaaggtcatccaggactctaacaatgagctccttgagcccgtttgccatcagctcttcgaactttaccggtcatccgaggtgcgactcaagcgcttcacgctgcaatttctgcccgaactcatgtgggtgtatctgcgcctgactgtgagcagggaccgccagtcaaatggctgtatcgaagccctcctccttggaatctataatctggagatagctgacaaggacggcaacaacaaagtgctttctttcaccattccctccctatccaagccgagcatttaccacgagccatctacgattggctcaatggctctaacagagggggccctgtgtcagcatgatctcattcgggtggtatacagcgacctgcatccacagagagagacctttactgcccagaaccggttcgaggtgctcagctttctgatgctgtgttataattcagccattgtctacatgccagcatcttcctatcaatcactctgccggatggggtctagagtctgcgtttctggcttcccccggcaacacgagaaacactggaaagagttgtgcggccggatagtcctggatcctgagtttatggtccaactgttaacaggcgtgtactatgccatgtacaacggacagtgggacctgggccaggaggttttggatgatatcatttaccgcgcccaactggagctgttctctcaacccttgctggtggctaatgctatgaaaaactccctccccttcgatgccccggactcgacccaggaagggcaaaaagtgttgaaagtggaggtgacacctacagtaccacgcatttctaggacagcgataacaactgcatccattcgtaggcatcgatggagaagggaaggagctgagggcgtgaatggaggcgaagagtctgtgaatctcaacgacgctgacgaaggcttctcttccggcgcgagcctgtcctctcagcccattggcacaaagcctagttcctcttctcagaggggatcacttcgaaaggtcgctaccggccgtagcgcaaaggacaaggagaccgccagcgccatcaagtcttcagagagcccaagggatagcgtagttcgaaagcagtatgtgcagcagccaacagatctgagcgtggattccgtcgagcttactcccatgaagaaacacctgtcactgcccgctgggcaggtggtccctaagatcaactctcttagcttgatcaggactgcttccgctagtagttcaaaatctttcgattacgtcaacgggagccaagcgagcacaagcatcggtgtgggcactgaaggagggacaaatctggccgcaaacaatgccaacagatacagtaccgtgagtcttcaggaagacaggctgggacaggccggagagggtaaggagttgctgtctcctggcgcacccctgacgaaacagtcaaggagccctagcttcaacatgcagttgatttctcaggtgtag

SEQ ID NO: 47187 - DNA, 627 bp, Artificial Sequence
  Description of Artificial Sequence: Synthetic coding sequence
atgctgggcaccgaccggtgcgtggtggaggagtggctgagcgagttcaaggcactgcccgatacacaaattacatcgtatgctgcaaccttgcaccggaagaaaacgctggtacccgcactctacaaggttatccaagattccaataatgaacttctggagccagtttgccatcaactgttcgaattgtacaggagctctgaggtcaggctcaagcggttcacgctgcaatttcttcccgaattaatgtgggtttacctcagactaacagtgtcaagggatcgacagagtaatggttgtatcgaagctctgctgctcgggatttataacctcgagatcgctgacaaggacgggaataacaaagtgcttagtttcactataccaagtctcagcaagccctcaatttaccatgaaccctctactattggtagcatggctctgaccgaaggagctttgtgccagcacgacctcatccgcgtggtctactccgatctgcatcctcaacgagagactttcactgcacagaaccggtttgaggttttgagttttctcatgttgtgttacaattcggcgatcgtgtacatgccagcaagctcctaccagtcattgtgtagaatgggaagctag

SEQ ID NO: 47188 - DNA, 264 bp, Artificial Sequence
  Description of Artificial Sequence: Synthetic coding sequence
atgctgggcaccgaccggtgcgtggtggaggagtggctgagcgagttcaaggcactgcctgacacccagatcacttcttacgccgctacccttcaccggaaaaagacgctggtccctgctctgtacaaggtcattcaggatagcaacaatgagctgctagagcctgtgtgccaccaattgtttgaactgtacagaagctcagaggtcaggttaaagcgcttcactttgcagtttttacccgaattgatgtgggtttacctgtag

SEQ ID NO: 47189 - DNA, 342 bp, Artificial Sequence
  Description of Artificial Sequence: Synthetic coding sequence
atggacggccgggtgcagctgatgaaggccctgctggccggccccctccgaccagcggctaggaggtggcgaaaccctattccatttccagagacttttgacggagacactgaccgcctcccagagttcattgtgcagacttcaagctatatgttcgtggatgaaaatacttttagcaacgatgccttgaaagtgaccttcctcatcacccgacttacaggacccgccctgcagtgggtcattccttacattcgcaaagagagccctctgctgaacgactacagaggctttttggcagaaatgaaaagagtgtttgggtgggaggaagatgaggacttctag

SEQ ID NO: 47190 - DNA, 342 bp, Artificial Sequence
  Description of Artificial Sequence: Synthetic coding sequence
atggagggccgggtgcagctgatgaaggccctgctggcccggcccctacgccccgcagcaagaaggtggaggaaccctatcccctttcccgagacatttgatggagacactgacagactcccagagtttatcgtgcagactagttcatatatgtttgtcgacgaaaacacgttctccaatgacgcacttaaggtaacatttttgattactcggctgacgggacccgctctgcaatgggtgattccgtatatcaaaaaagaaagccctttgttatcagattatcgggggttcttggccgagatgaaaagggtttttggctgggaagaggatgaagatttctag

SEQ ID NO: 47191 - DNA, 627 bp, Artificial Sequence
  Description of Artificial Sequence: Synthetic coding sequence
atgggcggcggccggggcctgctgggccgggagaccctgggccccggagacaggtgctctggaaaaggacccctgtgctattggcctccgcccggtagtccgccagccccaagtctgcgcgcgagtcttccccttgagccaccacgctgtccactccgctcgtgtcccctcccaagatcggcttgtctgtgctctaggaacagtgcccccggctcctgctgtagaccatgggcctcattatggtcagggcttcctcctccatcgcgagcaagttctgctccacccatgcacatctggacattatcctgtgcccctgtggctcaggctgaactgttactccatacagacaggcctctcccaccattacctacccctctcctgctgacccgattacctgatgattacatcatgttacctactgaccttcgatgccactgtcatcggcacccgtcccacagcacagacagattgcttctgctggttatctgcacacacttaggtggaatatgggcagggcactctccatggaccatgattcagaccgcaggatgcccctcccgagacctgctgccttctgcccgtccaatatcgtctccaattcccgagactttctgtgcgccagcctag

SEQ ID NO: 47192 - DNA, 1782 bp, Artificial Sequence
  Description of Artificial Sequence: Synthetic coding sequence
atgggccccgaccggaaggaggtgcccctgagccggggcacccaggcagtggttgtgggcaagggcagaggcgcccccggggacgattccagtatgggggggcgccctagctcaccgctggataagcagcagcgtcaacacctccgcggtcaggtcgatacgctccttcggaactttctgccttgttatcgagggcaacttgcagcctccgtgttacgacaaatctctcgcgagctcggtcctcaggagccaaccggctctcagcttctgcgctccaaaaagctgccgagggtgagagagcacagaggccctttgacacagctgcgtggccacccccctagatggcagcctattttctgtgtgctccgtggagatggcaggctggagtggttctcccataaggaggagtacgaaaacggcgggcactgtctgggctccaccgcgctgaccggctatacactgctgacttcccaacgggagtatcttaggttacttgacgccctttgtcctgagtctctcggggatcatacacaggaggaaccggactccctgctcgaggtgcctgtgagcttccctctgttcctccagcacccctttcgtcggcacctgtgcttcagcgcagcgacaagagaagcccagcacgcctggaggttggctcttcaggggggcattagactgcagggcatagtgctccagcgatctcaggctcctgctgcaagagctttcttggatgcagtgcgcctgtatcgccagcaccaaggccactttggagatgacgacgtgacattgggaagcgacgccgaagttctaacggccgtgctcatgcgagaacaattgcccgccctgcgcgcccagaccctgcccggtctgcgtggcgccggacgtgcccgtgcgtgggcctggaccgagctattggatgccgtacacgcagccgtgctggccggagcaagtgcggggctgtgcgccttccagccagagaaggatgagctgctggcttcacttgagaaaactattaggcccgatgtggatcagctgctaagacagcgggcccgcgtcgccggccgattaaggacggacattaggggccctcttgagtcttgcttgcgacgcgaagtggaccctcagctaccgcgagtggtgcagaccctcttgagaactgtagaagcgtcgttggaggccgtacgcactctcctggcccagggtatggaccggctttcccacagactacgccagtcccctagcggtactcgtctgagaagggaggtatatagctttggtgaaatgccctgggatctggctcttatgcagacctgctatcgcgaggctgagcggtccaggggtaggttaggccagcttgcagcccccttcggctttctgggtatgcaaagtctcgtgtttggtgcccaagacctcgctcaacagttaatggctgacgccgttgctacattcctacagttggccgaccagtgtctgactacagcactgaattgcgatcaagcagcacagaggctcgagcgggtgcggggccgggtcctgaagaagtttaagagcgattcaggtcttgcacaaagacgatttattcgcggatggggattgtgcatctttctgccgtttgtactttctcaactagaacctgggtgcaaaaagactgaatcacacagcgtcgcccaggctgtagtccagtggtgtgatctgggaagtctgcagccacccccaccccgctttaagcgttcatctcacctctcgttgccgagctcctgggattacagacaccctctatag

SEQ ID NO: 47193 - DNA, 1956 bp, Artificial Sequence
  Description of Artificial Sequence: Synthetic coding sequence
atgggccccgaccggaaggaggtgcccctgagccggggcacccaggcagtggttgtggggaagggacgcggtgcccccggcgacgactcgagtatggggggacggccttcgtcccctctggataagcagcagagacagcatctgagaggacaggttgatacacttctacgcaattttctgccgtgctatagggggcagctcgccgcatctgtgcttagacagattagcagggagttgggaccccaggagcccactggaagccagctcctgcggtccaaaaagttgccccgcgtccgggaacacaggggaccactgactcagttgcggggtcaccccccccgctggcagccgattttctgtgtattgaggggagacggccgcttggagtggttctcccacaaggaggagtacgagaacggcgggcactgcttaggctccaccgccctcacaggctatacattattgacttcccaaagagaatatttgagacttcttgacgccctgtgcccagagtctctgggcgaccacacccaggaggaacccgattccctcttggaggtgccagtgagtttccctttgttcctccagcatccgtttaggagacacctctgtttctcagcagcgacccgcgaggcccagcatgcttggaggctcgccctgcaagggggcatccggctccagggaatcgtgttgcaaaggtcacaggctcctgcagccagagcatttctggatgctgtgcgtctatatagacagcaccagggtcacttcggagacgacgacgtgactctgggctctgacgccgaggtactaacagcagttctgatgcgagagcaactgccagccttgcgggcgcaaaccctcccggggttgcgtggtgcagggcgcgcgcgcgcctgggcgtggactgagctattggatgctgttcacgccgccgttttggccggggctagcgccgggctgtgcgcctttcagccagagaaggatgagctgctcgcgagtctcgagaaaaccatccggcccgacgtagatcagctgctccgccagagagcaagggtggcaggacggctacgtacggatataagggggcctttggagtcatgtcttcgtagagaggtagatccacagctgcctagagttgtccagactttactgcgaacagtggaagccagtcttgaagcagtgcgaactttgctggctcaagggatggatcgactttcccaccgactccggcagtcgccctctggcactcgactgagacgagaagtgtacagcttcggggaaatgccctgggatctggccttaatgcagacatgctaccgcgaagctgagagaagccggggccgcctcggccagctggctgcaccgttcggtttcctaggtatgcaaagcctggtattcggagcccaggatctggcccagcagctgatggcagacgccgtcgctaccttcctccagctggccgatcagtgccttaccaccgcattaaactgtgaccaagcggctcagcgcctggagagggttaggggtcgggtactcaaaaagttcaagagcgactccggcttggcacagaggcgctttattagaggatggggcctgtgcattttcctgccctttgtgctgagccaactagagcccggttgcaaaaaagaactgccagaattcgagggggacgtgctggcagtgggtagccaggcccttaccaccgaaggaatctacgaagatgttattagaggttgtttactccagcgcatagatcaggagttaaaaaagaccctgggcgccaacgacgttagttgtacacttgatggatgcctggaggtcccctgggagcaggagggtgcagatgaggagaccgaagccgagagggagggaggggcatgcccccggcagccagattccggtgcccaaatccagcctctctgcccacctccttcccctggcacgttccgcagctag

SEQ ID NO: 47194 - DNA, 2094 bp, Artificial Sequence
  Description of Artificial Sequence: Synthetic coding sequence
atgggccccgaccggaaggaggtgcccctgagccggggcacccaggcagtggtcgttggcaaggggaggggagcacctggtgacgattcttctatgggtggcaggccaagctcacccctggacaaacagcagcggcagcacctgaggggtcaagttgacacgttgctgaggaactttttgccatgctaccggggccagctcgccgcgtccgtgttacgacagatcagtcgagaactaggtccccaggaacctactggtagccagctactgcgctctaagaagcttcctcgcgtcagagagcacaggggcccattgacgcaactgcgcgggcaccccccgcgttggcagccgatattttgcgtgcttcgcggagacggccgactggaatggttcagccacaaggaagaatacgaaaatggaggccactgcctgggttctactgctttgactggttacaccctgctaaccagccagagagaatatctgcgcctactggacgcattatgtccagagtctctcggagatcatacccaggaggagccagactccctgctggaagtgcccgtcagttttcctttgttcctgcagcatccttttaggaggcacctctgcttttccgccgctaccagagaggcacagcatgcttggaggctcgcacttcaggggggcatcagactccaggggattgttctgcagaggtctcaagcccccgctgccagggcctttcttgacgctgtcagattgtatcgccaacatcaaggtcatttcggagacgatgacgttacccttggaagtgatgccgaagtcttgaccgcagtgctgatgagagaacaactccccgcccttagagcacagacccttccaggactgcgcggagcaggacgggcgagggcatgggcatggactgagcttctggacgcggttcatgcagcagtcctggctggggcatctgccggactgtgtgcgtttcagccagagaaggatgaattgctcgcatccctggagaaaactataaggcctgacgttgatcagctgctgcggcagagggctagagtggctggcaggcttcgcactgacatcaggggtcctctcgaatcttgccttcgacgcgaggtggatcctcagctgcctcgtgtcgtgcagactctgctcaggactgtagaggcgtcgctcgaagccgtgagaacgctgcttgctcaggggatggacagactatcacaccggttaaggcagtcccctagcggtacaagacttagacgtgaagtgtatagtttcggtgaaatgccctgggatttggccctgatgcaaacctgctaccgcgaggcagagagaagtcgcggaagactcgggcagctcgctgcgcccttcggcttcctaggcatgcaaagtctcgtgttcggggcacaggacctggcccagcagctcatggccgatgccgttgcgaccttccttcagctggcggatcagtgcctgaccaccgctctgaattgtgatcaggcggcccagcgtctggagcgggtcaggggaagagtcctgaagaaattcaaatcagactccggccttgctcagaggaggtttatccggggctggggattgtgtattttcttgccatttgttctgagtcagttagaacccggttgcaaaaaagagctgcccgagtttgaaggggacgttctggctgttgggtcgcaggcattaaccactgagggcatctatgaagatgtcattagaggctgcctgttgcagaggattgaccaagagctgaagaagaccctcggcgctaacgacgttagttgtacactcgacggctgtctggaggtaccctgggaacaggaaggtgcagcacctaacctgaacctggtcagctctttcttggccggcaggcaagcatttaccgacttcctgtgccttcctgcgaaaagcagtgcgaattggattctcgcggccagtctgctaagttgctcttgtttccggtcaggattccacagagacagtagggtgttcctggttcagcttgccgaagggctgtcccattccctcgaaactgtgagcagccattcggtttggagtttcagacccacacccagacagtag

SEQ ID NO: 47195 - DNA, 1848 bp, Artificial Sequence
  Description of Artificial Sequence: Synthetic coding sequence
atgggccccgaccggaaggaggtgcccctgagccggggcacccaggctgtcgtagttggcaagggcaggggagcccctggggatgattcctcaatgggggggcgcccatcatctcccttggacaagcagcaacggcagcatctcaggggacaggttgataccctccttcgaaatttcttgccatgttatagggggcagcttgccgcaagcgtcctgaggcagattagccgggaactcgggccacaggagcccactggcagccaactgcttcgctccaagaagctaccgcgagtgcgcgagcatcgtggtccccttacacagctaagagggcatccaccgcggtggcagcccatcttctgtgtgcttaggggggacgggcggcttgaatggttcagccataaggaggagtatgaaaacgggggacattgcttgggaagcacagcactgaccggctataccttgctgacaagccagcgcgaatatctgcgacttctcgacgcgttatgtcctgagagtttgggggaccatacacaggaagagcccgattccctgttggaggtgcctgtgagctttccactgttcctgcagcacccatttcgtcgtcacctctgtttcagcgcggccactagagaagctcaacacgcctggaggttagctcttcagggggggattagattgcaggggattgtcctccagcgcagccaggcacccgcagcccgggccttccttgacgctgttcgactctacaggcaacatcagggccacttcggagacgacgatgttaccctaggctctgacgcagaggtgcttaccgctgtactaatgcgcgaacaacttccagctctgagggctcagactctgccaggtctgcgaggtgccggcagggcccgtgcttgggcctggacggagctgttagatgcagtccatgcggccgtgcttgctggtgccagcgcaggattgtgtgcttttcaacctgaaaaggacgaactgctcgccagcctggaaaagaccattagaccagacgtggatcagttactgcggcaacgagcccgcgtcgccgggaggctgcgcaccgacatcagaggaccgctggaaagctgcctacggagggaggtggacccacagctgccccgagtggtgcagacccttctgcgtacagtggaggctagcctggaagcggtcagaaccttactggcccaggggatggatcggctgagtcataggctcaggcagtccccatcagggacccgtttaaggagagaagtgtacagcttcggagagatgccttgggatctggccctgatgcagacctgctatcgggaagcggagcgctcgcgtgggcgcttgggtcagctggctgcccccttcggcttcctgggcatgcaaagcctggtctttggagcccaggatctggcacagcaactgatggccgatgccgtggctacgttcctgcagctagccgaccagtgcttgaccacagcattgaactgcgatcaggctgcccagaggctagaacgcgtgcgaggtcgggtactaaaagagctgccggaattcgaaggcgatgtgctcgcagtgggcagtcaagcactaaccaccgaggggatttacgaggacgtgataagaggctgtctgcttcaaagaatagaccaggagctcaagaaaaccttaggcgccaacgacgtttcatgcactttagacgggtgtctggaggtgccttgggagcaggagggagccgacgaggagacagaagccgaacgcgagggaggagcatgcccgcggcagcctgattctggggcacaaatccagcccttgtgtcctcccccaagcccaggcaccttcagatcctag

SEQ ID NO: 47196 - DNA, 1710 bp, Artificial Sequence
  Description of Artificial Sequence: Synthetic coding sequence
atgggcggccggcccagcagccccctggacaagcagcagcggcagcacctgcgcggccaggttgacaccctcctgaggaacttcctgccgtgttacaggggtcagctcgccgcgtctgtgcttcctcgagtgcgcgaacaccgtggtcccctgacgcagttaagaggtcacccccctcgctggcaaccgattttttgtgtactgcgcggggacggacggctggagtggttctcccataaggaagagtatgagaacggaggccattgcctcggtagcactgccctgacggggtataccttgctgactagccaaagagaatatctgagattgctggacgctctgtgccctgaatcactgggcgatcatacccaagaagagcccgactctctcttagaagttcctgtgtccttccccttattcttacaacacccgtttcgcaggcatctttgctttagcgcggcaacgcgggaggcacagcatgcttggcgtctcgcccttcaagggggcatccgattacaggggatcgtcctgcagagaagccaggctcctgccgctcgggcattcctcgatgcggtccgattgtaccgccagcaccagggtcattttggcgacgatgacgtgaccttggggtccgatgccgaagtgctcaccgcagtgcttatgcgcgagcagctgcctgcgttgcgcgcccagacactgccagggctgagaggtgccgggcgcgcgagggcctgggcttggacagaattattggatgcagtgcatgccgctgtgctggctggggcatccgcgggcctttgcgcatttcagcctgagaaggacgaactgctcgcaagcctggagaaaaccataaggcccgacgttgaccaacttctgaggcagcgcgcgcgtgtcgcgggacgcctacgaaccgatatcaggggccccttagagtcgtgcctgcgtcgcgaagtcgatcctcaattaccaagggtggtacagactttgctccggaccgttgaggcaagcctggaagctgtcagaactctgctagcccaaggaatggatagactttcacacagactgcgacagagtcctagcggcacccgtctcaggagggaggtttacagttttggtgaaatgccctgggaccttgctttgatgcagacatgttaccgagaagcagaaagatcacggggacgattaggacagctggcggccccctttgggttccttgggatgcagtcactggtgtttggcgctcaggatcttgcccagcaattgatggccgatgccgttgcaaccttcctccagctcgctgaccagtgcctgacgaccgccttgaattgtgatcaagcagctcagcggttggaaagagtgcgtggtcgagtgctgaaaaagtttaagtcagatagcgggctggcccagcggcgcttcatacggggttggggtctgtgcatctttctccctttcgtgctttcacagctggaacctggatgtaagaaagagctccccgagttcgagggggacgtcctggccgtgggcagccaagcactgaccaccgaaggaatctacgaggacgtaattaggggatgcttgttgcagcgaatcgatcaggatgaggagactgaggcggagagggagggcggtgcctgccccagacaaccagacagtggcgcccagatacagcctctgtgtccacccccgagcccgggcacattccgcagttag

SEQ ID NO: 47197 - DNA, 1272 bp, Artificial Sequence
  Description of Artificial Sequence: Synthetic coding sequence
atgcgggagcagctgcccgccctgcgggcccagaccctgcccggcctgagaggagcagggagagcccgagcatgggcgtggaccgaactcctggacgccgtccatgctgctgtgctggcaggggcctctgctggcctttgtgcattccaacccgaaaaggacgagctcctggcttcgcttgagaaaacaatccgtcccgatgtagaccaactactgcgccagagggctcgcgtcgcaggacggttgagaaccgacatacgggggccactcgagtcctgcctgcgcagggaggttgacccccagcttcccagggttgtgcagactctgctaaggacagtcgaagcctccctggaggccgtgcggacattactggcccagggtatggatcggctttcccatcgcctgaggcagtctccctcaggcactagattgcggcgcgaggtgtatagctttggcgagatgccctgggacctcgccctgatgcagacttgctacagggaagctgaacgctctcggggccggcttgggcagctggctgcaccgttcggatttctgggcatgcagtctttagtctttggagctcaggatttggcccagcagttgatggctgacgctgtggccacatttctacaactggccgatcaatgtttgaccacagcacttaactgtgaccaagcagcccaaaggctcgagagagtcagggggcgggttttgaaaaaatttaaaagcgactcgggtctcgcccaaaggcgatttattaggggatggggtctgtgtatctttttgcccttcgtgctctctcaacttgagcctggatgtaagaaggagctgcctgagttcgaaggagatgtgctcgccgttggcagccaggctctgactaccgaggggatatatgaggatgtaatcagaggctgtcttctccagaggatcgaccaggaacttaagaaaaccctgggcgctaatgatgtcagctgcactttagacgggtgcctggaagtcccatgggaacaggagggcgccgcacctaacctgaatctggtgtcctcatttctcgcaggccgccaagcttttacagactttctatgcctccccgccaagagttccgccaattggattctcgcagcatctcttttgtcctgctcttgcttcaggagtggcttccaccgcgactccagagtgttcctggtccagctggcggagggtctatcccattcgttagaaaccgtgtcttctcacagcgtgtggtcctttcgtccgaccccccgtcaatag

SEQ ID NO: 47198 - DNA, 2748 bp, Artificial Sequence
  Description of Artificial Sequence: Synthetic coding sequence
atgcggaagagcagcagccccagcctgagcaactgcaacagcgtgctagcgaacaaaatattcggcatcccactcgatgaattacagcaaggaggccaccctgacaacgaggtcccttttatagtcagacacgtggtggactacattgaggagcacggcggcctggagcaacagggactctttcaggtaaacggcaatgccgagacagtggaatggctgcgccagaggtatgattctggcgaagaggttgatctcgtgaaagaagccgatgttccctccgctattagcctgctcagattttttcttcaagagttgcctgaacccgttatacctggatctctgcacatccacctgatgcagcttagccaagattataataatgaggacgagttcgggaggaagcttagattcctcctacagcagttgcccccagtcaattattctttgttaaaattcctgtgtagatttttggcaaatgttgcttcccaccatgaggagatctggagtgcaaatagcctcgctgctgtgtttggccccgacgtttttcatatttacactgatgtggaagatatgaaagagcaggaaattgtgagtcgaatcatggctggactgctcgaaaactattacgagtttttcgaaaacgaggaagaggatttcagctcaaacgaccttagcagcataaccgaacaagtgaatgaattaagtgaggaggaggaggaggatgaaaagctagaacacatagaagagctgcccgaagagggagcagagaagtcgaatgatatgcccgaagtcgtgcaacttcgaatgactgagaatatcctagagtccaattccgttaccgccacttctacccatattagtcccattagtattctaccagctagcacagacatcctagaaagaactatccgggcggcagttgagcaacacttgtttgacctccagtcatccatcgaccacgatctgaagaacctgcagcagcaatccgttgtctgcaataatgaagccgagtctatacactgcgatggcgaaggttctaataatcagatcgatatcgctgacgacattataaacgcaagcgaaagcaatcgcgattgttctaagccagtcgcctctaccaacttggataatgaagcaatgcagcaggattgcgtgttcgagaatgaagaaaacacacagtcagtaggaattctcctagagccctgtagcgatcggggcgattcagaggacggatgcctcgagcgggaggaatatctacttttcgactctgacaagctatcacatctgatcctggatagtagttcgaagatctgtgacctgaatgccaacacggagagcgaagtccccggtgggcaatccgtcggagtgcaaggcgaagctgcttgtgtgtcaatccctcatcttgacctgaaaaacgtgagcgatggcgacaagtgggaggagccgtttcctgcattcaagagctggcaggaggacagcgagtccggggaagcacagctctcaccacaggctgggaggatgaatcatcaccctctcgaggaagattgtccccccgtcctgtcgcatcggagccttgattttggccagagccagagattcctgcacgatccagaaaagctggactcatcctctaaagccctaagctttactcgaatcagaaggtcttctttcagctcaaaggatgagaagcgtgaagacaggacgccctaccagttggtgaagaagctgcagaagaaaatcaggcaattcgaagagcagtttgagcgggagaggaattctaagccaagctattctgatatagctgccaaccccaaggtcttgaaatggatgacagagcttactaaactcaggaaacagattaaagacgcaaagcataagaatagcgacggcgaatttgtgcctcagacccggccccgctctaataccctccccaagtccttcggttcctctcttgatcacgaagacgaggaaaacgaggatgagccgaaggtgatacagaaagagaagaagccgagcaaggaagccacattagagcttattctcaagcgactgaaagagaagagaatcgaacgctgcctcccagaggacattaagaagatgaccaaagaccatttagttgaggagaaggcatcgctgcaaaagagcctcttatattatgagagtcagcacggcaggccagtcacaaaggaggaaaggcacatcgttaagccactgtacgacaggtatcgcttggtcaaacagatgctcaccagagctagcataacgcctgtcttggggagcccttctactaaacggagggggcaaatgctacaacccattattgaaggcgagaccgcgcatttctttgaagaaataaaagaagaagaagaggacggggttaacctttccagtgaactgggggatatgttgaagaccgccgtccaggtgcagagcagtctcgagaacagcgagagcgacgtggaagagaaccaggagaagctcgctcttgatcttaggctgtcatcctcccgcgccgcaagcatgcccgagcttctggaacaattatggaaagcccgtgccgaaaaaaaaaagttgcggaaaaccctcagggagttcgaggaagccttttatcaacagaatgggcggaacgcccagaaagaggatcgcgtgcccgttctggaggaatacagagagtacaagaaaatcaaggcgaaacttcgactgctggaggtgttgatcagtaagcaggattcctcgaaatccatatag

SEQ ID NO: 47199 - DNA, 2664 bp, Artificial Sequence
  Description of Artificial Sequence: Synthetic coding sequence
atgcggaagagcagcagccccagcctgagcaactgcaacagcgtgctcgccaacaagatttttggcattcccttagatgagctgcagcagggcggccacccagacaacgaagtaccgtttatagtgcgccatgttgtagattatatcgaggaacacggtggattagagcaacaggggctctttcaggttaatggcaatgccgagaccgtggaatggttgcggcagaggtatgattcaggagaggaagtggatctggtaaaggaggcagatgtcccatccgccataagtctcttgcgcttcttcttgcaggagttgcccgagccagtcatcccgggctccctacacattcatctgatgcaactgtcccaagactacaacaacgaggacgaattcggccgcaaactaaggttcctgctgcagcagctcccccctgttaactattccttattaaagttcctctgtcgctttctggctaatgttgcttctcatcacgaggagatttggtcagctaactccctcgctgcggtgtttggcccggacgtatttcatatctatacagatgtcgaggacatgaaggagcaggaaatcgtgtcccggataatggccgggctgctggaaaattactatgaatttttcgaaaacgaagaggaggatttttctagcaatgatcttagtagcattactgagcaagtcaacgagcttagcgaagaggaagaagaggatgaaaaactggagcatattgaggaactacctgaagagggcgcagagaaatcaaacgatatgccggaagtggtgcagctccggatgaccgagaatatcctcgagtcgaacagtgttactgccactagcactcacattagccctattagtattctgccagcatccactgatatactcgagaggactattagggctgccgtcgagcaacatctgttcgaccttcagtccagtatcgaccacgacctgaagaacctccaacagcagtctgtggtgtgtaataacgaggccgaaagcatccattgcgacggagagggctctaataatcaaattgacattgctgacgatatcataaatgcctccgaatcgaacagggactgctcaaagcctgtagcatccaccaatctggataacgaagccatgcaacaggattgcgtgttcgagaatgaggaaaatactcagtcggtgggcatcctactggaaccgtgctccgatagaggtgactctgaagatggctgtctggagagagaggagtacctgcttttcgattctgataagctttctcatctcatactcgattctagcagcaagatctgtgaccttaatgccaatactgaatcggaggtaccaggcggccagtcagtcggcgtacaaggcgaggctgcttgtgtctccattccacacctcgacctcaaaaacgtatcagatggggataagtgggaagaaccttttccagcttttaaaagctggcaggaagactccgaaagcggcgaggcacaactatctccccaggccgggcgcatgaaccaccaccccttggaagaggactgtccgccagtgcttagtcaccgctcactggattttggacagagccagaggtttctccatgaccctgaaaagttagatagcagctccaaagccttgtcattcactcgaatcagaaggagctctttcagtagtaaggacgaaaagcgcgaagacaggaccccatatcaattagtgaaaaagcttcagaagaagattaggcaattcgaggagcagtttgaacgggagaggaatagcaaacctagttacagcgatatcgcagctaaccccaaagtgcttaaatggatgacggaactgacaaaactgcgcaaacagattaaggatgccaagcacaaaaactctgatggagagtttgtgccccaaacgcgtccccgcagcaacactttgccaaagtctttcggctcatctctggaccatgaggatgaagagaacgaggacgagcctaaggtgatccaaaaggaaaaaaaaccctcaaaggaggctacattagagctcatcctgaaaaggcttaaggaaaaacggatcgaacgctgtctgcctgaagacattaaggtcacaaaagaggaacggcatatcgtgaagccgctgtatgaccgctacagacttgttaagcaaatgctcacaagagcttctatcacccccgtgctgggcagtcccagcactaaaagaagaggacagatgttgcagcccattattgaaggggaaactgcacacttcttcgaggaaatcaaagaggaggaggaagatggagtcaacctctcaagcgagctgggcgacatgctaaaaactgctgttcaggtgcagtcctcgttggagaacagcgaaagtgacgtggaggagaaccaggagaagctagccctggatttgcggctctcctcgtcccgggccgcctctatgcctgagcttctagagcaactgtggaaggcacgcgccgagaaaaaaaaactgcgcaagacattaagggagtttgaagaggccttttaccagcagaacggaaggaacgcccagaaagaggatagggtgcccgtgctcgaggagtaccgcgagtacaagaagatcaaggcgaagctgaggttacttgaagtgttaattagcaaacaagactcttccaagtctatctag

SEQ ID NO: 47200 - DNA, 2376 bp, Artificial Sequence
  Description of Artificial Sequence: Synthetic coding sequence
atgcagctgagccaggactacaacaacgaggacgagttcggccggaaactgaggtttctcttgcagcagctgcctccagtcaactactccctgttaaaatttctatgtagatttcttgccaacgtggctagtcaccacgaggaaatctggtccgcaaattccctggccgcggtgttcggcccggatgtgttccacatctatacagacgtggaggacatgaaggaacaagaaattgtcagccggatcatggcggggcttctggaaaattactatgagttctttgaaaatgaggaagaggatttctcttcaaatgatctgagttcaattactgagcaggtgaacgagctttctgaagaggaggaggaggacgaaaagcttgaacacattgaagaattgcctgaggagggggccgagaagagtaacgacatgccggaggttgtccagctccggatgacagagaacatcctggagtccaatagcgtaacagcaacatcaacgcacatttcaccaatatctatactccctgcaagtactgacattctggaaagaactatccgggcagctgtagagcagcatctgttcgatctccagtcctccatcgaccacgaccttaagaatctgcagcagcaatccgtcgtgtgtaataatgaagctgagagcatccattgtgacggtgagggttcgaataaccagattgatatcgcagatgacattattaatgctagcgagagtaatagggattgttcaaagccggtggcctccaccaatttagataacgaagccatgcaacaagactgcgtgtttgagaacgaagagaacacgcagagcgtgggaatcctcctagaaccctgcagcgacagaggtgacagtgaagatggttgtctggagcgcgaagagtaccttctttttgacagcgataagctaagccacctgatcttggactcaagttccaagatctgcgaccttaatgcaaacactgaatctgaggtgcccggaggacagtctgttggagtgcagggggaggccgcctgcgtcagcatcccacacctcgatctcaagaacgtcagcgacggagataagtgggaggctagctgccccattacatttcctctcatcgatttcaagacaatgcacctgcaacgagatggggaggaaccgttccctgcctttaagagttggcaggaggatagtgagtctggggaagcccagctcagtccccaagccggccgcatgaaccatcatcccctggaggaggattgcccacccgtgttgtcccaccgaagcctcgatttcgggcagagtcagcggttcctccatgacccggagaagctcgattccagttccaaagcactctccttcacacgcatcaggaggtcctcattcagcagcaaagatgaaaagcgcgaggacaggactccatatcagctggtcaaaaagctgcaaaaaaagatccggcagttcgaggagcagttcgaaagagaacgaaattctaaaccgagttactccgatatagcagctaaccccaaagtgttgaaatggatgacggaactgaccaaactcagaaagcagatcaaagatgctaaacataagaatagcgatggagaatttgtcccccagaccagaccacggagtaacactctccctaaaagcttcggttccagcctggatcatgaagacgaagagaatgaggacgagcccaaagtgattcagaaagagaaaaaaccttctaaagaggccaccctcgagttaattcttaaaagactcaaggaaaagagaatagagcgctgtcttcctgaggacattaaggtgaccaaagaagagaggcatatcgtgaaaccactttatgaccgataccgactagtcaaacagatgcttacccgcgcatctatcacacctgttcttggcagcccaagcacaaagcgaaggggacagatgcttcagccaatcatcgaaggagagaccgcccatttttttgaggaaattaaagaggaagaagaggacggggtgaatctctcgagcgagttgggcgacatgctgaagaccgcagtccaggtacaaagcagcctggagaactcagaaagcgacgttgaggagaatcaggagaaactggcccttgacttgcgcctgtcaagctcaagggctgcaagtatgcctgagctactggagcagctatggaaggccagggccgaaaaaaagaaactgcgcaaaaccctgcgcgaattcgaagaagccttctaccagcagaatggaagaaacgcccagaaggaggatcgagtgccggtgctggaggaatacagagagtacaaaaagattaaggccaaattacgactgttggaggtgcttatctcaaaacaggattctagcaaatctatctag

SEQ ID NO: 47201 - DNA, 288 bp, Artificial Sequence
  Description of Artificial Sequence: Synthetic coding sequence
atgcggaagagcagcagccccagcctgagcaactgcaacagcgtgctcgctaacaagatctttggcatacccctggatgagctgcagcagggcggtcaccccgataatgaagtgccattcatcgtgcgacatgttgttgactacattgaggagcacggcggcctggagcaacagggcctttttcaggtgaacggcaatgccgagacagtggagtggctccggcagcgctacgatagcggagaagaggtcgatctggtgaaagaggccgacgtcccttctgccatttag

SEQ ID NO: 47202 - DNA, 159 bp, Artificial Sequence
  Description of Artificial Sequence: Synthetic coding sequence
atgcggaagagcagcagccccagcctgagcaactgcaacagcgtgctggccaataagattttcggaatcccactggacgaattgcagcaggggggtcatccagataatgaagtaccctttatagtgcggcatgttgttgattacatagaggagcactag

SEQ ID NO: 47203 - DNA, 195 bp, Artificial Sequence
  Description of Artificial Sequence: Synthetic coding sequence
atgcggaagagcagcagccccagcctgagcaactgcaacagcgtgttagccaataaaatcttcgggatccctctggacgagcttcaacagggagggcatccagacaatgaagtgccatttatagtaaggcacgtggtcgattatatcgaggagcatgggggcttagaacagcagggtttgtttcaggtgaattag

SEQ ID NO: 47204 - DNA, 264 bp, Artificial Sequence
  Description of Artificial Sequence: Synthetic coding sequence
atgcggaagagcagcagccccagcctgagcaactgcaacagcgtgctcgccaataagattttcggaattccactggacgagctccagcagggtgggcacccagacaacgaggttcctttcatcgtgcgacatgtcgttgactatattgaagagcatgggggcctggagcagcaaggtttgttccaggtgaatggcaacgctgaaacagtggagtggttgcgccagaggtatgattctggcgaggaggtggacttagttaagtag

SEQ ID NO: 47205 - DNA, 429 bp, Artificial Sequence
  Description of Artificial Sequence: Synthetic coding sequence
atgcggaagagcagcagccccagcctgagcaactgcaacagcgtgttagcaaataagatttttgggatcccactggacgagttacagcagggtgggcacccggacaacgaagttccattcatagtcagacacgtagtggactacattgaggagcacggcggacttgagcagcagggcttgttccaggtcaacggtaacgctgagacagtggagtggttgaggcagagatacgacagcggcgaagaggtagacctggtgaaggaagcagatgtgccatctgcaatttccctgttgaggttcttcttgcaggaactcccagaacccgtgatccccgggtccttgcacatccacctaatgcaattgtcacaggattacaacaacgaagatgaatttggccggaagctcaggttcctgctgcagcaactctag

SEQ ID NO: 47206 - DNA, 1506 bp, Artificial Sequence
  Description of Artificial Sequence: Synthetic coding sequence
atgggcaacttcaagagccggaagcccaagagcatcttcaaggccgagagcgggagatcccatggggaatctcaggaaaccgagcacgttgtgagttcccagtctgaatgccaggtgcgggctggaactcccgcccatgagtcaccccaaaacaacgcgtttaagtgtcaagagactgttcggctgcagccaagaatagaccagagaactgctatttctccaaaggacgcgtttgagacgagacaagacttgaatgaggaagaggcggcgcaagtgcacggcgttaaagacccagccccagcgagcacccagagtgtgctcgccgatggcactgatagcgccgacccctctcccgtgcacaaggatggccagaatgaggcagactctgcccctgaagatctgcatagcgtagggacgagccgactgctttaccatatcactgatggcgataatcctttgctgtcaccccgatgctcaattttctcacagtcccaaagatttaatcttgacccagaatctgccccctctcctccaagtacacagcaattcatgatgcccagatcgtcctccagatgtagctgcggagatggcaaggaacctcagactatcacccaacttaccaagcacatccagtctctcaagcgaaagattcggaaattcgaggaaaaattcgagcaagagaaaaagtatcggcccagccacggagacaaaacatcaaaccctgaagtgctcaagtggatgaacgatttagccaaggggcggaagcagctgaaggagctgaaactgaaactttccgaagagcaagggtcagctccaaaaggtcctcctaggaatctcctctgcgaacagccgaccgtcccccgagaaaacggcaagcccgaggcagcgggtccggaaccctcttcatccggcgaggagacaccagacgccgccctaacctgtcttaaggagagaagggagcagctgcccccgcaagaggattcaaaagtgactaagcaagataagaacctgattaagcctttgtatgaccggtatcggatcattaaacagatcctgtccactccctctcttattcccactatcgaagaagaggattcggacgaggaccgcccgcaggggtcgcaacaacctagtctggccgatcccgcgtctcacctccccgtcggcgatcatcttacttactccaacgagacagagcccgtgcgggctctcctccctgatgagaaaaaggaagtaaaaccacctgcactgagcatgtctaacctgcatgaggctactatgccagtgctactggatcatctccgcgaaaccagggcagacaaaaaacgtttaagaaaagctctgagggagttcgaggaacagttcttcaagcaaaccggcaggtcccctcagaaagaggaccgaattcctatggcagatgaatattatgaatataaacatattaaagcaaaactcaggcttctggaggtgctgatctccaagcaagatgtggccaagactatttag

SEQ ID NO: 47207 - DNA, 1758 bp, Artificial Sequence
  Description of Artificial Sequence: Synthetic coding sequence
atgttcagctgcttctgcttcagcctgcaggacaacagcttcagctccacaaccgttaccgagtgtgatgaggaccctgtctcattgcacgaggatcagacagattgctcaagcctgcgggatgaaaataataaggagaactacccagatgcaggcgcactggtcgaagagcatgcaccaccttcgtgggaaccccagcagcagaacgtggaggccacagtgctggtagacagcgtgctgaggccgagcatgggaaactttaaatcacggaagccgaaatcaatcttcaaagcagaaagtggtcgatcccacggagaaagccaggagaccgaacatgtggtctcttctcagtccgagtgccaggttcgcgccggcacgccggcccacgaatcaccacagaacaatgcctttaagtgccaggagactgttagattgcagccacggatcgaccagaggacagccattagtccaaaggatgccttcgagacgagacaagacctgaacgaggaagaagcagctcaagtccacggagtgaaggatcctgccccagccagtacccaatccgtactggccgatggcaccgactcagctgaccccagtccagtgcacaaggacggccagaacgaagctgattcagcgcctgaggatctgcattcagttggaaccagtaggctgctttatcacatcacagatggcgacaacccattgttgagtccacgttgtagtatcttttcccaatcccagcggtttaatctggaccctgagtctgccccatcgcccccttccacccagcagttcatgatgccaagatcctcttcgcggtgtagctgcggggatgggaaggaacctcaaacaataactcagctgacgaagcacattcagagcctcaaacgcaaaatccggaagtttgaggagaaattcgaacaggagaaaaaataccggccctcacacggagacaagacaagcaaccccgaagtattgaagtggatgaacgatctggccaaaggtaggaagcaactgaaagaactgaagctaaagctgtccgaggaacagggttctgcaccgaagggcccacctagaaacctgttatgcgaacagcccaccgttcctcgcgagaacggcaagccggaggcagcagggccagagccaagctctagcggcgaggagacacctgacgccgccctcacatgcctgaaggagcgcagagagcagctgcctccacaggaagattctaaggtcacaaagcaggacaaaaaccttatcaagccgctgtacgaccgttacagaatcatcaagcaaattctaagcacaccctctctgattcccaccatacaagaagaagaagactctgacgaagaccgcccgcagggttcccagcagccctcactggctgacccagcttcacatcttcctgtgggggaccacctcacttactcaaacgaaacagagcctgtgagagcactgttgccggatgaaaagaaggaagtaaaaccacctgcattgagtatgagtaacctccacgaggccaccatgcccgtcctgctcgaccacctgcgggagacaagagctgataagaaaagactgaggaaggccctgcgggaattcgaggaacaattcttcaagcagactggccgctcgcctcagaaggaagataggattcctatggctgacgagtattacgaatataagcacatcaaagcaaaactgcgactcctggaggttctgatatcaaaacaggacgtggcgaaaaccatttag

SEQ ID NO: 47208 - DNA, 1464 bp, Artificial Sequence
  Description of Artificial Sequence: Synthetic coding sequence
atgttcagctgcttctgcttcagcctgcaggacaacagcttcagctccacgaccgtcaccgaatgcgatgaagaccctgtgtctttgcatgaagatcagactgattgttctagtctgagagatgagaataacaaggagaactaccctgacgccggggccttggtagaagagcacgccccccccagctgggagccacaacaacagaacgtcgaggcaacagtgctcgtcgactctgtcttaagacccagtatgggtaatttcaagagccgcaagccaaaaagcatcttcaaagccgagtccggaagaagccacggcgagtcacaggaaaccgaacatgttgtttcctcccaatccgaatgtcaggtgcgtgcgggtacacccgctcatgagagtccacagaataatgcctttaagtgtcaagagacggtgcggcttcagccaagaattgaccagcgcacagcaatatcccctaaggacgccttcgaaacccgtcaggacctcaacgaagaggaggcagcccaggtacacggcgtcaaagacccagctcccgcttccactcaatccgtgttagcagatggaacagactcggctgacccttcaccagtgcacaaagatggacagaatgaagccgatagtgcgccagaagacttacactcagttggaacgagccgcctgttataccacatcactgacggggacaaccccctgctgtctcctcgctgctcaatcttctctcagtcccagaggttcaacttagatccagaatccgctccttcaccacccagtacacaacagttcatgatgcctaggtccagcagcagatgttcctgcggcgatggtaaggagccacagaccataacacagttgacgaagcacatccagtccctgaagcggaaaattagaaaatttgaagagaagttcgaacaggagaaaaagtacagagtaaccaagcaagataaaaatctgatcaagcccctgtacgaccgataccgaatcatcaagcagatcctgtcgacccctagcctcattcctaccatccaggaagaggaagactcggacgaagaccgcccccaaggctcgcagcagcccagcctcgctgacccagcctcacatcttcccgtaggcgaccatctgacctactctaatgagacggagcctgtgagggccttgctacctgacgagaagaaggaggtgaagcccccagcactcagcatgtctaatttacacgaagccacaatgcctgtgctgctggaccatctgcgagagacgagggcagacaaaaaaaggctgaggaaggccctgagagaatttgaagaacaattttttaagcaaactggcagatcaccccagaaagaagaccgaattcctatggcggatgagtattatgagtacaagcacattaaagcaaaactacggctgcttgaagtcctaatcagcaagcaggatgtagccaaaacgatctag

SEQ ID NO: 47209 - DNA, 1377 bp, Artificial Sequence
  Description of Artificial Sequence: Synthetic coding sequence
atgttcagctgcttctgcttcagcctgcaggacaacagcttcagcagcacaaccgttaccgaatgtgatgaagacccagtgagcctccacgaggatcaaactgactgtagctccctgcgggatgagaacaataaggagaactaccccgatgctggcgccttggtggaggaacatgctccaccctcatgggagccccagcaacaaaatgttgaggcaactgtgcttgtcgactctgttctgcggccatctatgggcaattttaagagccgcaagccgaagtctatcttcaaagccgaatcgggccggagccacggcgagagccaggagactgagcatgtggtgtcaagtcagtccgagtgccaagtgcgtgcaggcactcctgctcatgagtctcctcagaacaatgccttcaaatgtcaggagacagtccgcctgcaacctcgtatagaccagcgtacagcaatctctccgaaggacgccttcgaaacccgtcaggacctgaacgaagaggaggcggcccaggtgcacggagtgaaggacccggcaccggcctcaacccaatcagtgctggcagacggaactgacagtgctgaccctagccccgtgcacaaagacgggcaaaacgaggcagatagcgcacctgaggatcttcactctgttggaacttcaagactcctttaccacattaccgacggcgataatcctctgctgagccctcgctgctcaatcttttcccagtctcaaaggtttaatttagatcctgagtctgctccttcccctccgtccacacagcagttcatgatgccacggtccagcagcagatgcagctgcggggatggtaaggagcctcaaaccataacacagctcacaaaacacattcaatcccttaagcggaagattcggaaatttgaagagaagtttgagcaggagaagaagtacagaccaagccatggcgataagacttctaatcccgaagttttaaaatggatgaacgatctcgctaagggcaggaaacaacttaaagagctgaaactgaagctttccgaagaacagggatccgccccaaaagggcccccccgcaacctgctctgtgagcaacccaccgtcccgagagagaatgggaagcccgaggccgcagggcctgagccttcatcatctggagaagagaccccagacgctgctttgacctgtctaaaagaacggcgggagcaactgccaccacaggaagattccaaggtgactaaacaagacaagaatttgattaagcctctttatgatcggtatcgtatcatcaaacagatactctctactccctctctgattcccacaattgtaagccaagacacctgtatgctcctgctctgtacggatgtgtag

SEQ ID NO: 47210 - DNA, 1509 bp, Artificial Sequence
  Description of Artificial Sequence: Synthetic coding sequence
atgggcaacttcaagagccggaagcccaagagcatcttcaaggccgaatctgggcggagccatggcgagagccaggagacagaacacgtcgtcagtagccagtccgagtgtcaggtgcgagcgggcacaccagctcacgagtccccacagaacaacgcttttaagtgtcaggaaaccgtgcgcctccaaccacggatcgatcagcgcactgccatttcaccaaaggacgctttcgaaacccgacaggacctgaacgaggaggaggcagcgcaggttcatggagtgaaagacccggcaccggcgtctacacagagtgtgctcgcggacggtacagattctgcagacccctcacctgtgcacaaagacggccagaacgaagccgacagtgcccctgaggacctgcactccgtgggcactagccgcctgctgtatcatatcacagatggcgataatcctctcctgtctcctagatgttcaatctttagtcaatcacaaagattcaatctcgaccccgagtccgcgccttccccaccctccactcaacaatttatgatgccacgcagctccagccgatgttcatgcggggacgggaaggagccccaaacaatcacacagctgaccaaacatattcaatcgctgaaacgcaagatacggaaattcgaggagaaattcgagcaagagaagaagtatagaccctctcatggagacaaaacctctaatccagaagttctgaagtggatgaacgacttagcgaaaggacgcaaacagcttaaagaactgaagctaaaactgagcgaagaacaaggttctgcccctaagggcccaccgcgcaacctcttatgtgagcagcccaccgttcctcgggagaatggtaagccagaagctgcgggccctgagccctctagctctggagaagagacaccggacgccgcgctgacctgccttaaggagagaagggagcaattacctccacaggaagatagcaaggtgacaaagcaggataaaaatctcatcaaaccactgtacgaccggtatcgaatcataaagcagattctctccactccctccctgattcctacaatccaggaagaggaggacagtgatgaagataggcctcagggctctcagcaacctagcctggccgatcccgcgagccatcttccagttggtgatcacctgacgtattctaatgagaccgagccagtacgagctctcctgccagacgagaagaaagaagttaaaccccccgctctgagtatgtctaatctgcacgaggcaactatgccagtactgcttgatcacctcagggagacgcgtgccgacaagaagaggctacgcaaagctctgcgggagtttgaggaacaattctttaagcagaccgggaggagtccccagaaagaggataggatccctatggctgatgaatactatgagtataaacatatcaaagccaaacttaggttgctggaggtgctcatctcgaaacaggatgtggccaagaccatctag

SEQ ID NO: 47211 - DNA, 18 bp, Artificial Sequence
  Description of Artificial Sequence: Synthetic coding sequence
atgggcaacttcaagtag

SEQ ID NO: 47212 - DNA, 78 bp, Artificial Sequence
  Description of Artificial Sequence: Synthetic coding sequence
atgggcaacttcaagagccggaagcccaagagcatcttcaaggccgaatcagggcgcagccatggggaaagtcagtag

SEQ ID NO: 47213 - DNA, 999 bp, Artificial Sequence
  Description of Artificial Sequence: Synthetic coding sequence
atggacagcaccagcagcctgcacggcagcagcctgcaccggccctctacagagcaaacccgaacagacttctcctgggatggaatcaacctgagcatggaggacacaacctccattctgccaaagctgaaacgtaactctaatgcttatggaatcggagctctggcaaaaagttctttctcagggatatctcgtagtatgaaagatcatgtcacaaagccaactgcaatggggcagggccgtgtggcacacatgatcgaatggcaaggttggggcaaaacgcctgccgtgcagcctcaacactcccatgagagcgtgcgtagagataccgatgcatacagcgatctgtccgacggcgaaaaagaggcaagattcctcgctggagttatggaacagtttgcgatcagtgaagctacactgatggcctggtcaagcatggacggcgaagatatgtcagttaattcgacccaggagcctttgggttgtaactattctgataattatcaagaacttatggatagtcaagacgctctggctcaggccccaatggatgggtggccgcacagctatgtttctcaggggatgtactgcctgggttcatctgatgcctgggaagctagtgatcagtcccttatcgcaagccccgctacaggcagctatctgggccccgctttcgacgactcccagccatcacttcacgaaatgggcccatcccagcctgccagtgggtactcggcattggagccacctccactccttgggggcgacacagactgggccccgggagtgggggctgtggacttggcccgaggtcctgccgaggaagaaaaacgcccgctggctcccgaggaggaagaggatgctggatgtcgtgatctggaatctctctcaccaagagaagatcctgagatgtctaccgccctgtccagaaaggtgagtgacgtgaccagcagtggcgtgcagtctttcgatgaggaggaaggcgaagccaataattag

SEQ ID NO: 47214 - DNA, 999 bp, Artificial Sequence
  Description of Artificial Sequence: Synthetic coding sequence
atggacagcaccagcagcctgcacggcagcagcctgcaccggccctctacagagcagactcgaacagacttctcctgggatggaatcaatttatccatggaagataccaccagcattttacctaagctgaaacggaacagcaacgcctacggtatcggtgctttagctaagagctctttctcaggcatctcccgttcaatgaaagatcatgtgactaagcctactgccatggggcaaggtcgcgtggcccacatgattgaatggcaagggtggggaaagacgcccgcggttcagcctcagcactcgcacgaaagtgtgcggcgagatacagacgcctacagcgacctgtcagacggtgaaaaagaggctcgcttcctcgcgggcgtgatggaacagttcgccatatccgaggctacactaatggcctggtcgagtatggatggggaagacatgtcagttaacagcacacaggaacccctcggatgtaactactctgacaattaccaggagctaatggatagccaggacgcactggctcaggctcccatggatggatggccccacagctatgtcagccagggtatgtattgtctgggtagttctgacgcctgggaggcatctgatcagagcctgatcgctagccccgcaacagggagttacctcggccccgcgttcgacgatagtcaaccttccctgcatgaaatggggccctctcaaccagcaagtggatatagtgcactggaacccccacctctgctaggtggcgacaccgactgggcacctggggtgggggcggtggatttggctagagggcccgccgaagaggaaaaacgtccactcgcccctgaggaagaggaagatgctgggtgcagagacctagaaagcctctctccacgggaagaccctgagatgagtaccgctctctctaggaaggtgtcggacgtgacatccagcggagtacagtcattcgatgaggaggagggcgaggctaacaattag

SEQ ID NO: 47215 - DNA, 999 bp, Artificial Sequence
  Description of Artificial Sequence: Synthetic coding sequence
atggacagcaccagcagcctgcacggcagcagcctgcaccggcccagcacggagcagaccagaaccgactttagctgggatggcatcaaccttagcatggaggacacaacgagcattctgccaaagctgaaaagaaactccaatgcctacggtatcggagctctcgccaaatcttcattctctggtatcagtaggagcatgaaggatcatgtgaccaaacccacagccatgggtcaaggcagggttgctcacatgattgagtggcaggggtgggggaagacacctgccgtgcagccacaacatagccacgaaagtgtgagacgtgacactgatgcatattcagatctttcggacggcgagaaagaggccaggtttcttgcaggggtgatggaacagttcgccatctccgaggccaccctcatggcatggtcctcaatggatggagaagatatgtctgtgaattcaacccaggaacccctggggtgtaactatagcgataactaccaggagttaatggatagtcaggacgccctggctcaggctcctatggacggctggcctcactcttacgtttcccagggaatgtattgtctgggcagttctgatgcctgggaggcctctgaccaatctttaattgctagtccagctactggatcctacctgggcccagccttcgatgatagccagccgtccctgcatgaaatgggaccttcacagcccgcctccgggtattccgccctggaacctccgcccctgctgggaggcgacacagactgggccccaggtgtgggtgccgtggatctcgcccggggaccggcagaagaggagaagaggcccctagccccagaggaggaagaagatgccggatgtagggatctcgagtccctctctccccgggaggatcccgagatgagtaccgctttaagtcggaaggtgtccgacgtgacctcttctggcgttcagtcatttgacgaggaagagggcgaggctaacaattag

SEQ ID NO: 47216 - DNA, 1083 bp, Artificial Sequence
  Description of Artificial Sequence: Synthetic coding sequence
atgggctgcatcggcagccggaccgtgggcaacgaggtgatcgccgtagattggaagggtctcaaagacgtcgatcagattaacatggacagtactagcagcctgcacggatcctcccttcacagacccagcacggaacaaacgcggacggacttttcctgggatgggattaatctgagtatggaagacacaactagcatactgcccaagcttaaacgcaatagcaatgcctatggcattggggcattagcaaaaagttccttctcagggattagccgatcaatgaaggaccatgttacgaaaccaaccgccatgggccaaggcagagtggctcacatgattgaatggcaagggtggggaaaaacccctgctgtacaacctcagcatagccacgagtcagtgaggagagataccgatgcctactccgacttatctgacggcgaaaaggaggcccggttcctggcaggcgtcatggagcagttcgccatttctgaggccaccctgatggcatggtcgtctatggacggcgaggacatgtccgttaacagcactcaagaacccctggggtgtaactactccgataactatcaagaactgatggactcgcaagacgctctcgctcaggcacctatggatggctggcctcactcctatgtttctcagggaatgtattgtcttggatcaagtgacgcctgggaagcctctgaccaatctctgatcgcatctcctgcaactgggtcttatctgggccctgcttttgatgattcccagcctagccttcacgaaatggggccctcacaaccagcgtcaggctattctgcactggaacccccacccctactgggaggcgatacggactgggcaccaggcgttggggcggtcgacttagcaagagggccggctgaggaagagaaaagaccactggctcccgaagaagaggaggacgccggatgcagagatctggaaagcctgtctcctcgcgaggatccagagatgtccacagcccttagccgaaaggtgtccgacgttacatcgtcaggagtgcagagctttgatgaggaagagggtgaagccaacaattag

SEQ ID NO: 47217 - DNA, 1011 bp, Artificial Sequence
  Description of Artificial Sequence: Synthetic coding sequence
ttcctgctgggccggcaccagcggaccgtgagcacccacgtgctgaacctgtgtccgagcttcccagagcactggggatacatacctccatgggactcctggctttctatggaggacacaacaagtatcctccctaagctcaagaggaattctaacgcgtatggaatcggcgcgctggcaaaaagttctttctcgggtatctctcgttcaatgaaggatcatgtcacaaagcccaccgctatgggacaggggagagtggcccatatgatcgaatggcagggctggggaaagacccccgccgtccagcctcagcatagccacgagagcgtcagacgggatacagacgcttacagtgatctttcagatggcgagaaagaggcccggtttcttgccggtgtgatggaacagtttgctatttcggaagccaccctcatggcgtggtcgtctatggacggtgaggatatgtcagtcaatagcacacaggaacccctgggttgcaactatagcgataattaccaggaacttatggattcccaggatgcccttgcccaagcccccatggacggttggcctcattcctatgtttcccagggtatgtactgcttggggtcttctgacgcctgggaggcatcggaccagtccctcattgccagtccagccacaggcagctaccttggaccggcttttgatgatagccagccaagcctgcatgagatgggtccgagccaaccagcttcaggatattcggccttggagcctccccctctgctaggcggcgacaccgactgggcgcctggggtgggagccgtggatctggccagggggcccgctgaggaagagaagaggcccctcgcccctgaggaagaagaggacgccgggtgtcgggatctcgagtccctcagcccccgcgaggaccccgaaatgtccactgccctgtcaaggaaggtcagcgatgtcactagttctggcgtgcagtccttcgatgaggaggagggtgaggcaaacaactag

SEQ ID NO: 47218 - DNA, 843 bp, Artificial Sequence
  Description of Artificial Sequence: Synthetic coding sequence
atgggcagctgcgtgagccgggacctgttcaccagcgcccacaagaactgcccaatgcctcagggagcagaccccttaaatcctgacctcccttcaggcagaacacctactgtggctccagattgtgtcatcgggaaagacaagcagatggacttctgttgggatccttggcagcgctgctttcagaccacaaacgggtatctcagcgatagccgatcccgacccgggaattacaacgttgcagccttagcaaccagcagtttggtcggagttgttcagtcgatcaaagaccacatcacaaagcccaccgccatggctaggggccgagtagcccacctgatcgaatggaaagggtggtccgctcagcctgccggctgggagcttagtccagccgaggatgaacattactgctgccttcctgatgaattgcgggaagcacgcttcgccgccggagttgcggaacaatttgccatcacagaggccaccctgagcgcatggagtagtctcgatgaagaggaactccatccagagaacagtccacagggtattgtccaactccaggacttggagtccatatatctgcaggatagcttgcctagtgggccgagccaggatgattcactgcaggctttctcctccccaagtccaagcccggactcctgcccctcaccagaggaaccgccatccacggccggaattccccagccaccttcaccggaacttcagcaccgccgtaggctgcccggtgcgcaggggcctgagggcggcacccatcccccaggatccctgccttcgatggattcagggtcactatgggaagaagacgaggttttctacaactag

SEQ ID NO: 47219 - DNA, 747 bp, Artificial Sequence
  Description of Artificial Sequence: Synthetic coding sequence
atgggcaagcgggacaaccgggtggcctacatgaaccccatcgccatggcacgctggaggggccctacacagagtgttggacctacaatccaagattatctaaaccggcccaggcctacatgggaggaggtgaagaaacagctggagaacaaaaagactgggtctaaggctctcgctgagtttgaggagaagatgaacgaaaattggaagaaagaactcgagaagtctagagagaagctgctgagtggtaatgagagctctagtaaaaagcgggaaaggaagaagaaacgcaaaaaaaaatcatgtcgctcttctagtagctcaagctcttctgactccagttcatcatcttccgattcagaggacgaggaaaaaaagcagggaaaacggaggaagaaaaaaaaaaaccggtcttataagagcagccaaagttccacccacgagtcagaaagtgagtctaaggaatccgtcaagaaaaagaaaaagtccaaggacgaaaccgaaaaagagaaggacgtgaggagcctcagcaagaagcggaaaaaaagttacccagatgacaaacctttgtcctcggagtcatccagcgaaagtgactacgaggaggatgtgcaagccaagaaaaagagacgctgcgaggagcgcgagcaggccaaggaaaaagtgaagaagaagaaaaaaaaacagcataagaagcactccaagaaaaagaaaaagaaaagcggcagcagtcacaagagcaggtag

SEQ ID NO: 47220 - DNA, 747 bp, Artificial Sequence
  Description of Artificial Sequence: Synthetic coding sequence
atgggcaagcgggacaaccgggtggcctacatgaaccccatcgccatggctcgatggcgggggccaactcagtcggtcggccccaccattcaggactatctgaatcgtccacggccaacctgggaggaggtgaagaagcagctggaaaataagaagactggatctaaggctctggcggagtttgaagaaaaaatgaacgagaattggaagaaagagctcgaaaagagcagggaaaagctgctaagcggtaacgagagtagctcaaagaaaagggaacgaaaaaagaagcgcaagaagaagagttgccgatcttcctcgtcctcctctagctctgactctagcagcagttctagtgattctgaggacgaagagaagaaacagggcaaaagacggaaaaagaagaaaaataggtcctacaaatcatcccagtcttctacccacgagagcgagtcggagagtaaggagagcgtgaaaaagaaaaagaaaagcaaagacgagactgaaaaagagaaagatgttcgctccctgtccaaaaaacgaaaaaagtcttacccggacgataaacccctgagctctgagagctcgagtgagagcgattatgaggaagacgttcaggcaaaaaagaagcgcaggtgtgaggagagggaacaggccaaagagaaggtcaagaagaagaaaaaaaaacaacataaaaaacactctaagaagaaaaaaaaaaaatccgggtcaagtcacaagagccgctag

SEQ ID NO: 47221 - DNA, 747 bp, Artificial Sequence
  Description of Artificial Sequence: Synthetic coding sequence
atgggcaagcgggacaaccgggtggcctacatgaaccccatcgccatggctagatggcgaggtcccacccagtccgtgggcccaaccatccaggactatcttaatcgaccgcgacccacctgggaggaagtaaaaaaacaactggaaaataagaaaaccggatcgaaggcgctggccgagttcgaagaaaaaatgaatgaaaactggaaaaaggaactggaaaagagtcgggaaaagcttctgagcgggaacgaaagttcatccaaaaaacgcgaacggaaaaaaaagcggaagaaaaagagctgcagatccagctcatcgtccagctcctccgatagtagtagcagcagcagtgacagtgaggatgaggaaaagaaacaggggaagagacgaaaaaagaaaaagaacagatcctacaagagcagccagtccagtacccatgagagtgagagcgagtcaaaggagtctgtgaaaaaaaaaaagaagagcaaggatgagaccgagaaagagaaggatgtacggtccctcagtaaaaagcggaagaagagctatcccgatgataagcccctatccagtgagtcaagctctgagtccgattatgaagaggacgtacaggctaaaaaaaagcgaaggtgtgaggagcgggagcaggcaaaggagaaagtgaagaagaagaaaaaaaagcagcataaaaagcacagtaagaagaagaagaagaagtcggggtcatcccacaaatcccgctag

SEQ ID NO: 47222 - DNA, 747 bp, Artificial Sequence
  Description of Artificial Sequence: Synthetic coding sequence
atgggcaagcgggacaaccgggtggcctacatgaaccccatcgccatggctcgatggagaggccccacccagagtgtaggtcccactatccaagactatctcaatcgtccaagaccaacttgggaggaggttaaaaagcagctagaaaacaagaagacaggcagtaaggcactggctgagtttgaagagaaaatgaacgaaaactggaaaaaagagctggaaaaatcacgggaaaaactcctctccggcaacgagagctcgagcaaaaaaagggagcggaagaagaagagaaagaagaagagctgcaggagctcatcctcctccagtagtagcgattcctcgtcttccagcagcgactccgaggatgaagagaagaagcagggaaagaggcggaagaagaaaaagaaccgatcttacaaaagctctcagtcctcaactcatgaatctgaaagtgagagcaaagagtcggtcaagaaaaagaagaagtccaaagacgagactgagaaggaaaaagacgtgcgctccttgtcaaaaaagcgcaaaaagtcctaccctgatgacaagcctctgtccagtgaatcctcctccgagtcagattacgaagaggacgtccaggcaaagaagaagcgccgctgtgaggaaagggaacaggcaaaggaaaaagtaaagaagaagaagaagaaacagcataaaaaacactccaagaaaaaaaaaaaaaaatctggctcttctcataagagtagatag

SEQ ID NO: 47223 - DNA, 714 bp, Artificial Sequence
  Description of Artificial Sequence: Synthetic coding sequence
atgaaccccatcgccatggcccggagccggggccccatccagagctcaggacccacgatccaagactatctgaataggccccggcctacatgggaggaagtcaaggagcagttggagaagaaaaagaaaggttccaaagcattggctgaattcgaagagaaaatgaacgaaaactggaagaaggaactcgagaaacaccgcgaaaagttgctgtccggcagcgagtctagtagcaagaaaagacagagaaagaagaaggagaagaagaaatccggcagatatagctcttcatcctcaagttcttctgactctagctcctccagttctgattcggaggatgaggataaaaaacaggggaaacgccggaagaagaagaaaaatagaagccacaaaagttccgagagcagcatgtctgaaaccgagtccgattccaaggacagcttgaaaaaaaagaagaagtccaaagacggcacagaaaaggagaaggacattaaaggtctgtcaaaaaagcgaaaaatgtattcagaagacaagcccctgagcagtgagtctctaagtgagtcagaatatattgaagaggtccgtgctaaaaaaaaaaaatcatctgaggagagggaaaaggcaactgaaaagacgaagaagaagaaaaaacacaaaaagcattccaagaagaagaagaaaaaagccgcatcttcctctcctgatagtccgtag

SEQ ID NO: 47224 - DNA, 714 bp, Artificial Sequence
  Description of Artificial Sequence: Synthetic coding sequence
atgaaccccatcgccatggcccggagccggggccccatccagagctcaggacctaccattcaagactacctgaaccggccacgaccaacttgggaagaggttaaggagcaacttgagaagaagaagaagggcagcaaagccctggctgagtttgaggagaagatgaacgaaaattggaaaaaagaactcgaaaagcatagagagaagctcctcagcggctcagaatcttcatccaagaagagacaacggaaaaaaaaggagaaaaagaagtcaggccggtattcctccagttcttcctcatctagtgactcgagttcgtcttcaagtgactcagaggacgaagataaaaagcagggcaaacgcagaaagaagaagaagaaccgtagtcataagagcagcgaaagctccatgtccgaaacggaatccgacagcaaggacagcttgaaaaaaaagaaaaaatccaaagacggaaccgagaaagaaaaggacatcaaaggactgagcaagaagcgtaagatgtattccgaggataaaccgctgtcaagcgaaagtctgtccgagagcgaatatatagaggaagttcgggctaagaagaaaaagagcagtgaagagcgtgagaaggccacggaaaagacgaagaaaaaaaaaaagcataagaagcatagcaaaaagaagaagaagaaagcggcttcctcctctccagactctccttag

SEQ ID NO: 47225 - DNA, 744 bp, Artificial Sequence
  Description of Artificial Sequence: Synthetic coding sequence
atgggcaagcgggacaaccgggtggcctacatgaaccccatcgccatggcaagatcgcgtggccccattcagtcttctggacccacaatacaggattatcttaaccgccctcggccgacatgggaggaggtgaaagagcagctggagaagaaaaaaaaaggcagtaaggctctcgccgagttcgaagagaaaatgaacgaaaactggaagaaggagctcgagaagcatcgagagaaattgcttagcggcagcgagagtagctcaaaaaagaggcaaaggaagaagaaggaaaagaaaaaaagcggacggtattcctcttccagcagcagctcttcagacagttcttccagttcaagcgacagcgaagacgaggataaaaagcaaggcaagagaaggaaaaaaaagaaaaaccgctctcataagtcttctgagtcatccatgtccgaaacagaatcagacagcaaggacagtttgaagaagaagaagaaaagtaaggatgggaccgaaaaggagaaggacatcaagggtctctctaaaaagcggaaaatgtacagcgaagacaagccattgagttccgagtccctgtccgagtccgaatatatcgaggaagtccgagccaagaaaaaaaaaagttccgaggagagagaaaaggccaccgaaaagaccaagaagaagaagaagcataaaaagcactctaagaagaagaaaaagaaggccgcgagctcaagtcccgacagtccctag

SEQ ID NO: 47226 - DNA, 93 bp, Artificial Sequence
  Description of Artificial Sequence: Synthetic coding sequence
atgaaccccatcgccatggcccggagccggggccccatccagagctctggcccgacgattcaagactaccttaatcggccacgacccacctag

SEQ ID NO: 47227 - DNA, 258 bp, Artificial Sequence
  Description of Artificial Sequence: Synthetic coding sequence
atgctgctgaccatcgagaccaagagccactacgtggcccaggccggactggagctgctggcaagctccgatcccccgaccagtgcaagccaatcagtgggaattattgacatgtcgcactgcacttggcctaccttaggcaagttcctgaacccgagcaaaccacacttctcccccatcaccaagggtaaagacggtaatatcttccccactaagtttttgagtgacgccctgaccgagcttaggctgtgtacctag

SEQ ID NO: 47228 - DNA, 225 bp, Artificial Sequence
  Description of Artificial Sequence: Synthetic coding sequence
atgctgctgaccatcgagaccaagagccactacgtggcccaggccggcctcgaacttctggcttcatccgacccaccaacttccgccagtcagtcagtaggaataatagacatgtctcactgcacctggccgactctcggtaaatttcttaacccgtcaaaaccccatttcagtcccataacaaagggaaaagacggaaacatcttccccaccaaattcctgtag

SEQ ID NO: 47229 - DNA, 258 bp, Artificial Sequence
  Description of Artificial Sequence: Synthetic coding sequence
atgctgctgaccatcgagaccaagagccactacgtggcccaggccggcctggagttactggcatcctccgacccaccaacaagcgcaagccagtcggtcgggatcattgacatgtcccattgtacctggcccaccctggggaagttcttgaatccaagtaagcctcacttctcacccatcaccaaaggcaaagacgggaacatattcccaaccaaatttctttctgacgcactcaccgagctaagattgtgtacttag

SEQ ID NO: 47230 - DNA, 258 bp, Artificial Sequence
  Description of Artificial Sequence: Synthetic coding sequence
atgctgctgaccatcgagaccaagagccactacgtggcccaggccggtctggaattactggctagctccgatcccccaactagcgcctctcagtccgtagggattattgatatgtcccactgtacctggcctactctgggcaagttcttgaaccccagtaagcctcacttcagtcccatcacaaagggaaaagacggaaacatattccctacgaaattccttagtgatgctctgactgagctgcgcctctgtacatag

SEQ ID NO: 47231 - DNA, 1287 bp, Artificial Sequence
  Description of Artificial Sequence: Synthetic coding sequence
atgaaccggcagggcaaccggaagaccaccaaggagggcagcaacgatctcaagttccagaatttctccctcccaaagaaccggagttggccgaggatcaactcagcgacgggacagtatcagcgcatgaataagccactgctagattgggagcgaaatttcgctgcagtgctcgatggtgccaaagggcatagcgatgatgactacgatgacccagaactgagaatggaggaaacttggcaatccatcaagattttgcctgcaagaccaattaaggaaagtgagtacgctgatacccattactttaaagtagccatggacacccccctgcccttggacacaaggactagcatctccatagggcagccgacatggaatacgcagacaagacttgaaagagtagataagccgattagcaaggacgtgcggtctcagaatattaaaggggatgcatccgtgaggaagaataagatccctctcccaccccccagacccctcattaccctgccaaaaaaataccaaccccttcctccagagcccgagagtagtcggccccctctgtctcagcgtcatacttttccggaagttcaaagaatgccttcccagatcagtctgagagacctctcagaggtgctagaagctgagaaagtgccacacaaccagcggaagcccgaatccacacacctattggagaatcagaatacacaggaaatacccctcgcaatcagcagtagctcgtttactacctctaaccacagtgttcagaacagagatcaccggggagggatgcagccatgctctcctcagcgctgccagccgcctgcatcctgttctcctcatgaaaatattctgccttacaaatataccagttggaggcccccgtttcccaagcgctctgatcgcaaagatgtccagcataacgaatggtatattggagaatattcacgccaggccgtcgaagaagcgtttatgaaggagaataaagatggatctttcctagtacgagattgtagcactaaatcaaaggaggaaccgtacgtattagcagtcttctacgaaaataaggtctacaatgtgaaaattcgctttctagagaggaaccagcagttcgccctaggaacaggcctgcgcggggatgagaaattcgactccgttgaagacataatagaacactacaagaacttcccgatcatactcattgacggaaaggacaaaaccggagtccacagaaaacagtgccatctgactcagcctctccctctcactcgtcatctgctgcctctctag

SEQ ID NO: 47232 - DNA, 2322 bp, Artificial Sequence
  Description of Artificial Sequence: Synthetic coding sequence
atgaaggccgccgtgctggacctgggcagcctgctggccaagctgttcgagactagtaccgccccccctgccggaccttcttctcgaccctccggaggtgctgccgctgcaggaagcggaggttctagggccggaactcccctgggaacagctccaactctactcagagccctggcaccggattcaccatctgcgagcaggcgctcaccagcaccgcttctgagcagcccctacagtagaggcagtgcggcttcccgagccgctggtgcggttggaactctcttatcctggcccagctctccaagggcggggaaagctccaccccagccaccaactcctagtggaggtggctgctcacccgccaggctggtggtcccagcgagaccgccaagcggccctggtggcgtgtgggccgctttgcctcgaaatcccctgcagcccggtcctggcgaacgggagctgggagcatgcgttgcccctggtgctggcccccgcacattattcctaacgctccctgacatcggcgaagaaggagcttccgatggcgacagcggcgacggagaagcgcggggtctctccgaggggcgacggcgacacgggtttacagtgaggagcaaggattcgctgcctactcacttcactagaaacgtccagaaagcaatagataagtacacatgtaagtcactttcctccttttcttcaagtggcagccatacacctacaggcgcccatactagctggagcgggtctgccacccagtcatcgactacagggtcatcaaccgagagggggtccgtgtactcctggagggacgacgagtttgacgaggcgagctcccagagcgtgcagagactcttatgggaagttgaagagatgttgttcgaaggcaaagtgaatccccaaacacagtcacttctggccgagtgtggcgagtggacccgaagaagtctgcatctgcgggtgctggggagacagttgattctgcctaccgataaaggagtacagcactttcagggcagcacacctgcctccgcagtacaccgcccacctctgagtgcatgtggacacagttctaacattagagaactgtgcattagtggaagccagatagtgcctgctgcgctgagcgcctcagctttacctggcccagacgacacgggtgtcgctgacctgactgctcggtcctccctggaagaagaagtgtaccacgtagacggcaaaattgaggagtacttcgcgttcgacagaaaggaggacgatgatgaatgtctggaacaaaaacccgctcagccagggaggaaatggagaaagttagggttgccaccagtgtcccctagggactgcgtgaaagatgcagttgcagcagaagtgtttgaccacgtatggactaacatggtcgaacttctggaagagcttatacgcaaacattgggagacaactctgactgagggcaagaaacagcgagagactctcaaagtggccggaaataggttcccgcatgttttggtgcctcacgcacacgctgacggcgcttcgggacctccctccgggcatgcagaagctcatggaatttccctggccagtagattaaatccgccccagattcatcatttttctagcagcttttattcagacatgaacggcgtgatgaccatacaggcgaaacctctgcaaaggagacctgcatacttcgcagatcgtacacagaacgaaaaagaggacaaagcgtccggcgggggggctggagccctgagttcagccccccaccggttgggacgagcttcagatactcatggcctttcaccctcagccaaaaaaacccccgtcccgtggcggttgccctctctcgcttctgatagtcagagactcaaaacccctaacatttatagcgacgaggttctcagggggacgaagctgcccaccggcgtggatcacatggcctctccgttagtccagactagtcggtcacgttttccaccgttggtcacagagacaaggggccagaatacggccgtaccaggatgtagactcgtgagttatcggggtcgccacctccaaaacagggtgctctctgccatgccggatgggacagaaagatcacgtttgcgggagcggaccgcaactctggagcggctgtcccgcccttccaccactcatacctttcggcagtctgatacgccaagaaagtccagcctgactcaaatggaattcgctgcccatacctggaccggccagtctattctcaccgggtcacagtacgttccgaagtccttccagcgcacaactctgacttttaaaaggaggtttcaggtgacatcatag

SEQ ID NO: 47233 - DNA, 1449 bp, Artificial Sequence
  Description of Artificial Sequence: Synthetic coding sequence
atgctgttcgagggcaaggtgaacccccagacccagagcctgctggctgagtgcggagaatggactcgtcgctccctgcatctgcgcgttctgggcagacagctcatcctgccaactgataaaggagttcagcactttcagggctctacacctgcgagtgctgtgcacagaccgcctctctcagcctgtggacactcttctaatatacgggaactttgcatcagcggaagtcagattgtacccgccgcgctgagcgcctccgcgctgccggggcccgacgacacgggcgttgccgacttaactgcacgctcctcactggaagaagaagtctatcatgttgacggcaagattgaggagtactttgccttcgatcgaaaagaagatgatgacgaatgcctcgagcaaaaacccgctcagcctggcaggaaatggagaaagctagggttgcctccagtttctcctagggattgcgtcaaggatgccgtggcagccgaagtgtttgatcatgtgtggactaatatggtcgaactgttagaagaactgattcggaaacattgggaaacaactctcacagaaggtaaaaagcagagggaaaccctcaaagtcgccggcaataggttccctcatgtgctggtgcctcacgctcacgccgatggagcttccggcccgccctcagggcatgccgaggcacacggcatatctttagcatctagattaaaccctccacagatacatcatttctcttccagcttttactccgatatgaacggagtcatgaccatccaggctaagccactgcaaagaagacccgcctacttcgcagacagaacccaaaacgagaaggaggacaaagcatcaggaggcggcgccggtgcactgtctagtgctccccaccgcttgggcagagcctcggacacccacggtttatcgccctcagcgaagaagacccctgtgccctggagactcccgagcctggctagtgattcccagagactcaagaccccgaacatatatagcgacgaggtgctccgcggaaccaagctgcctacgggtgtcgaccacatggcctcccctttagtccaaacatccagaagccgcttcccacccttggtaacagagaccagaggccagaataccgccgttccagggtgtaggttagtctcttatcgcggtaggcatttacaaaaccgggtgctgagcgccatgcctgatggaactgagcgttcaagacttagggaacggacagccactttagagcgcctgagccgaccctctacaacacacacattccggcagagcgatacccctcgcaaatcttcactcacgcagatggaattcgcggctcatacatggacggggcagagcatcttaacaggcagccagtacgttcctaagtccttccaacgcactactttaacattcaagcgtcgcttccaggtaacctcatag

SEQ ID NO: 47234 - DNA, 1449 bp, Artificial Sequence
  Description of Artificial Sequence: Synthetic coding sequence
atgctgttcgagggcaaggtgaacccccagacccagagcctgctggctgagtgtggggagtggacacgccgttccttgcatctccgcgtcctgggcagacaattgatcctaccgacagataaaggcgttcagcatttccaggggtctacacccgcaagtgcggtgcacagacccccacttagcgcctgtggacactcaagtaacatccgtgagttgtgtataagcgggagtcagatcgtacctgccgccctgtccgccagcgctctgcctggtccagacgacaccggcgtggccgaccttaccgcgcgttctagcctagaagaagaggtgtaccacgtggatggcaaaatcgaagagtacttcgcctttgacagaaaggaagatgatgatgaatgcttggaacagaaaccagcacagcctggcagaaaatggcgtaagctgggccttccaccagtgtcaccgagggactgcgtgaaggacgcagttgcagcagaggtcttcgatcacgtctggacaaacatggtagagctcctggaggagctaatccgaaaacattgggagaccaccttgacagagggcaagaaacagagggaaacgctgaaagtggccggtaaccgcttcccacacgtgctggtccctcatgctcatgccgatggggcatctggcccacccagcggtcacgccgaagcccacggtataagcctggcttccaggctcaacccacctcagatccaccacttctcaagttccttttatagtgacatgaacggagtgatgaccatccaggcaaaaccattgcaaaggcgacctgcttacttcgccgacagaacgcagaacgaaaaagaggataaggcttcgggaggcggggccggtgccctctcaagtgcgccgcatagattggggcgcgccagcgatactcatgggttatcacccagtgcgaaaaagactccagttccctggcggctgcccagcctggcatccgactcccagaggctcaaaacgcctaatatatactccgacgaggtgcttcgggggacgaagcttccaacaggggtggaccacatggcctccccattagttcagacaagtcgaagtcgctttcccccgctcgtaaccgaaactagaggacagaatactgccgttccagggtgtagactggtgtcttatagaggacgacatctgcagaaccgggtgttatccgcaatgcctgacggtacagaaaggtcaaggctcagggagagaactgcaactctggagcgactaagccggccttctactactcacacctttcggcaatcagataccccgagaaagagcagcctcacgcagatggaattcgctgctcacacatggacaggtcagagtattctgactgggagtcagtatgtccccaaaagtttccagaggactacacttaccttcaagagaagattccaagttacttcatag

SEQ ID NO: 47235 - DNA, 186 bp, Artificial Sequence
  Description of Artificial Sequence: Synthetic coding sequence
atgctgttcgagggcaaggtgaacccccagacccagagcctgctggcagaatgtggcgagtggaccagacgaagtctacatctccgcgttctaggcagacagcttatcctgcccaccgataagggcgtgcagcatttccaaggttcaactcctgctagcgctgtacacagaccgcctcttagttag

SEQ ID NO: 47236 - DNA, 1749 bp, Artificial Sequence
  Description of Artificial Sequence: Synthetic coding sequence
atgatcagccggtacacccggaaggccgtgccccagagcctggagctgaaaggcattacaaaacatgcacttaatcatcaccctccacctgaaaagttagaggagatctcccctactagcgattctcatgaaaaagatacatcatcccagtctaaaagtgatattacccgcgaaagtagttttacttccgccgatacaggcaattctcttagcgcttttccgagctatactggcgcgggcatctcaaccgagggctcctccgatttttcctggggatatggcgaactggatcagaacgccaccgagaaagttcagaccatgttcacagctatcgatgaactattgtatgagcagaaactttccgtccataccaagagtttgcaggaggagtgccagcagtggactgcaagttttcctcacctgcgtatcctgggtaggcagatcatcactccatcagagggataccgcctgtacccccggtctccaagcgccgttagtgcctcatatgaaactacactcagtcaggaaagagacagcaccatcttcggcattcgcggaaagaagctgcacttctccagcagctacgcacacaaagcaagtagcatcgccaagtctagtagcttttgctctatggagcgggatgaggaggatagcatcattgtctccgaagggattatagaagaatatttggcgtttgatcacattgacattgaggagggcttccacggcaagaaaagcgaagccgcaacggagaaacagaagctgggttatcctccaatagcccctttttattgtatgaaggaagacgttttggcctatgtcttcgattccgtgtggtgcaaggtggtttcatgtatggagcagctgactcgaagtcattgggaaggtttcgccagtgatgatgagtccaatgtggccgtcactcgacctgattcagagagttcttgcgtgctgtccgagcttcatccccttgtgcttccacgggtcccccagtctaaagtcctctacatcacaagtaaccctatgagcctgtgccaggcttcgcggcaccagcccaacgtcaacgacttactagtgcatggcatgcccctgcagccaaggaacttaagtctgatggataagttgctcgatctagacgacaagctgttgatgcggcctgggagcagtaccatcctgagcactcgtaactggcctaaccgtgccgtcgaattctcaacatcaagcctgtcctacacagtccaaagcactaggcgcagaaacccaccaccaaggacgcttcatcctatttctacatctcactcctgcgcagaaactcccagatccgttgaggaaattttacgcggagctcgtgtacctgtagcgccggatagcctctcttctcccagccccacacctctttctcgaaataacttattgccgcctattggcacagccgaggtcgagcatgtctccacagttgggccccagcggcagatgaagcctcacggcgactcaagtagagcacagagcgcggtagtagacgaacccaattatcagcaaccccaggaaaggctgcttcttcccgacttctttcctcggcctaataccacacaatcctttctcctggacactcaataccggcgatcgtgtgccgtggagtacccccaccaggctcgacccggcaggggaagcgcagggccccagctccacggtagtactaaatctcagtcaggaggaagacctgtctccagaacgcgacagggaccctag

SEQ ID NO: 47237 - DNA, 1410 bp, Artificial Sequence
  Description of Artificial Sequence: Synthetic coding sequence
tgattcaccagcgccgacaccggcaacagcctgagcgccttccccagctatacaggggccgggatctccactgagggatcttcagacttctcatggggctatggggaactggatcagaacgccaccgagaaggttcagacaatgtttactgccatcgatgagcttctatacgagcaaaaactgtcagttcacactaaatctctacaagaggaatgtcaacagtggacggcgtcatttccacacttacgaattttggggaggcagatcatcacaccttccgaaggctaccgcctctacccccgatccccctctgctgtgagcgcatcctacgagaccaccctgagccaagagcgcgactctaccattttcgggatcagagggaagaagttgcactttagcagctcgtacgcacacaaggcgtccagtattgctaagagtagctcattctgtagcatggagagagatgaagaagactcgattatagtctctgagggcataatagaagaatacctcgcatttgatcatattgatattgaagaaggcttccatggcaaaaagtccgaggccgccactgaaaagcagaaactgggctacccgccgatagctcccttttattgcatgaaggaagatgtgttggcttatgttttcgatagcgtgtggtgtaaggtcgtgtcgtgtatggaacaactgactcggtcgcactgggagggatttgcatctgatgacgaatctaatgtcgccgtgacccgtccagattcagagtcctcttgcgtgttgtcagagcttcatcccctagttctccctcgcgtgccccaatcgaagatgtccctatgccaggccagccggcatcagcccaacgttaacgacctgctggtgcatgggatgcccctccagcctcggaatctcagcctgatggacaagttgttggacctggatgacaaattacttatgaggcccggttcatctacaatcttgtctacgaggaactggccaaatcgcgctgtggaattttcaacttcatctctttcttacacagtgcaatctacccgtcggcgtaacccacccccccgaacacttcacccgatctctaccagccacagctgtgccgagacaccccggagtgtggaggaaatcctgaggggagcacgggttcctgtcgcccctgattctctgtcctctccctctccaacacccctgagccgcaacaacctcttgccacccatagggacagcagaggtggaacacgtgagtacggttggccctcaaagacaaatgaagcctcacggggattcttctcgggcacagtccgccgtggtggatgagccaaattatcagcagccccaggagcgactactactccccgatttctttccacgtcctaatacaactcagtccttcttggtggagtag

SEQ ID NO: 47238 - DNA, 993 bp, Artificial Sequence
  Description of Artificial Sequence: Synthetic coding sequence
atggagcgggacgaggaggacagcatcatcgtgagcgagggcatcattgaggaatatctggcatttgatcatatcgatattgaggagggctttcacgggaagaagtcggaggccgctacagaaaaacagaaactcgggtacccacctattgccccattttactgtatgaaggaagacgttttagcctacgtttttgacagcgtttggtgcaaggtggtgtcgtgtatggagcagttaacgagaagccactgggagggttttgccagtgacgacgagtctaatgtcgctgtgacccggcctgacagcgaatcgtcatgcgtgctctcagagcttcaccccctggttctgccacgagtgccccaatctaaagttctttatatcacctctaaccccatgtcattgtgccaagctagcaggcaccagccaaacgtgaacgacctccttgtgcacggtatgcccttacagcctcgaaatcttagcctgatggataaactgctggacctggacgacaagctactcatgaggcctgggtcatccaccattctctctaccagaaactggcccaaccgggccgtggaattttctactagctccctgagctacactgtacagtcaactcgacggagaaacccgccaccacggacattgcaccccattagtacaagtcattcttgtgcagaaacaccccgcagtgtcgaagagatactgagaggcgctagagtgcctgttgccccggatagtttgtcttccccttcacccactccattgtccagaaacaatctcttgccaccaataggtacagcggaagtggagcatgtctcgaccgtgggacctcagcgccaaatgttggacacacagtaccggaggtcatgtgcggtggagtacccccatcaggcaagaccaggacgcgggagcgcaggtccacagttgcacgggtccaccaaatctcagagcgggggcaggccagtcagtcgaaccaggcaaggtccatag

SEQ ID NO: 47239 - DNA, 1008 bp, Artificial Sequence
  Description of Artificial Sequence: Synthetic coding sequence
agcagcttctgcagcatggagcgggacgaggaggacagcatcatcgtatccgaaggaattatcgaagaatacctagcatttgaccatattgacattgaagagggctttcatggcaagaagagtgaggctgccaccgagaagcagaagctgggctatccacccatcgctccattctactgcatgaaagaggacgttctagcatacgttttcgattctgtttggtgcaaggtagtgtcctgcatggaacaactaacacgctcgcattgggaaggattcgcatctgatgacgaatcgaatgttgccgttacgcgcccagatagtgaatcatcctgtgtcctcagcgaactgcaccctctggtgctccccagggtgcctcagagcaaggttctttacataacaagtaatcccatgagcctatgccaggcatctaggcaccaaccaaatgtaaacgacctgttggtgcacggcatgccccttcaaccgcgtaacttgtctctcatggacaagctgctggacttagacgataagctcctgatgcggccagggtctagtactattctgtccaccaggaattggcccaacagggcggttgaatttagcacgtccagcttgagctacaccgtccagagtaccagacgcagaaacccacccccaagaaccctgcaccctatctcgactagccactcgtgcgctgagaccccaaggagtgtggaagagattctgaggggggcacgcgtgcccgtcgctcccgattccctgtccagtcccagccctacaccgctgtccaggaataacctgctgccacccattgggacagcagaggttgaacatgtgagcactgtggggccgcagagacagatgttggatacacagtaccgtagatcatgcgcagtcgagtacccccatcaagcacgaccgggcagaggaagcgcaggaccacaacttcatggctccaccaaatcacagtctggcgggaggcccgtatcaaggactcgccaggggccatag

SEQ ID NO: 47240 - DNA, 831 bp, Artificial Sequence
  Description of Artificial Sequence: Synthetic coding sequence
atggccgccagcgccggcggccccggcagctggagcgagaacatcttagaatattttctgcggaacagtcagattactgcggaggacggagccgagatcacctggtatcacgctgcaaatcataaggctcagacaaatgaggctttgaagagtacagcacacatgatcgaagcagatgttctgttgccatctgatggtagtgagcatagtcagcccatcatggcccatccaccagaaaccaacagcgacaatacacttcaggagtggctaacggaggtgatgaagtctaataagggcatcaaacttgactttaaatcattagccgtggtcgaaccctccatgatgctcctggagaacgtcaaaaggcacctgaaaagacctgtctggatcaacgccgacattttacctggccccaacggaaactccaaggtaatcgacgcgaagccattcctggatactgtgatctcctttttccctgacgtgacattcagtctggggtggactactggctggcatccagagaaggtgaatgagggatatagctggactatggtgaaggaaatggagtacatttgcaacgagcttagccagcccgtaaccttccccgtgagagctgctttagtgaggcagagttgttcccagctactgtggctgctgaagaagtcaaaccgttatagtcttacaatttggaccggcaaaaatgataactattccgtggaggacctgttgtatattcgggaccactttgataagaagcaagtgttttatgacatcctcgaaccacagaatcacgagtttaagcaggctatcggcatcaaagtcaatctatag

SEQ ID NO: 47241 - DNA, 435 bp, Artificial Sequence
  Description of Artificial Sequence: Synthetic coding sequence
atggtggacaaggacaccgagcgggacatcgagatgaagcggcagctgcgtagactgcgggaactgcacctgtattccacatggaaaaaataccaggaggcgatgaaaactagcctgggagtcccccaacgaggggacctggaagaccttgaggaacatgttcccggtcagacagtgtccgaggaagcgactggtgttcacatgatgcaggtcgaccccgcaacactggctaaacagcttgaagattccaccatcaccggctctcaccagcagatgtctgccagtcctagcagtgcccccgctgaagaggccaccgagaagaccaaggtcgaagaagaagtgaagaccagaaagcctaaaaagaaaacaaggaagcccagtaaaaagagccgatggaatgtcctgaagtgctgggacatatttaacatcttttag

SEQ ID NO: 47242 - DNA, 1164 bp, Artificial Sequence
  Description of Artificial Sequence: Synthetic coding sequence
atgggctgcgtgtacagctgctgcctggaggtgtgctgcggcgaggatgaaatcgtataccctcgcatgcccggtgaatccaccgtatgtcaccgtgagcgggagaagcccatcacttatcattggtaccattggcatccgggacacatctatccccggatcgcttccatggaggactatgatgaggatctggtgcaggaggcatcctccgaagacgtcctgggcgtccacatggtggacaaagatacagaacgggatattgagatgaaacgccagttaaggaggcttagggagctccatctgtacagtacttggaaaaagtatcaggaagctatgaagaccagtctgggcgtgccgcaatgcgaacgcgacgagggcagtcttggtaagccgctctgccctcccgaaatactgagtgaaacactgcccggcagtgtaaagaagcgagtttgttttccatcggaagatcacttagaggaatttatcgccgagcatctgcctgaggcctctaatcagtctttacttaccgtagctcacagtgagcgcggcatctccttctcttgtgatctggaggatctagaagaacacgggccaggtcagacagtatctgaagaggctaccgaggtgcacacaatggagggcgaccccgacaccctcgccgagtttttaatcagagacgttctgcaggaactatcctcatacaacggcgaagaggaggatcccgaggaggtgaagacctctctaggggtgccccagagaggcgacttggaagatctggaggagcatgtacccggacaaactgtgagcgaagaagcaacaggggtccacatgatgcaggtggatccggcaaccctcgctaagagcgacctcgaggatctggaagagcacgtccctgaacagactgtatctgaagaagccactggggtgcacatgatgcaggtggatcctgccaccctcgctaaacagttggaagacagcacgattaccgggtcccatcaacagatgtccgctagccctagtagcgcgcctgctgaggaagctaccgagaagacgaaagtggaagaggaggtcaagacccgaaagccaaagaagaagacgcgtaaacctagcaagaagagccgttggaacgtgctcaagtgctgggatatcttcaacattttctag

SEQ ID NO: 47243 - DNA, 1164 bp, Artificial Sequence
  Description of Artificial Sequence: Synthetic coding sequence
atgggctgcgcctacagctgctgcctggaggtgtgctgcggcgaggatgaaatcgtgtaccccagaatgcccggagagagcacagtttgccacagagagagagaaaaacccatcacctatcactggtatcattggcaccctggacacatttacccgagggtcgcttcaatggaggattacgatgaagatctcgtgcaagaagcctcaagtgaagacgttctgggcgtgcatatggttgataaagataccgaaagagatatcgaaatgaagcggcaactgaggcgcctccgggagttacacctgtactctacatggaaaaaatatcaggaagcaatgaaaacgtccctgggcgtgcctcagtgtgagagagatgagggaagcctgggcaagccgctctgtccaccggaaattttgagtgagacactcccagggtccgtgaagaaacgcgtgtgcttccctagcgaggatcacttggaagagtttatcgccgagcacctgccagaggcctccaaccaaagtttactaacagtcgcccatgcagacaccggcatccaaacgaacggcgacttagaggaccttgaggagcacgggcccgggcaaacggtttctgaggaggccactgaagtccatatgatggagggagaccccgacaccctggccgagctgctgattcgcgatgtgttgcaagaactgtccagctacaatggagaagaggaggaccccgaagaagtgaagacttctctcggcgtgccacagcgaggggacctggaggatctagaggaacacgtaccaggacaaaccgtgtccgaggaggccactggagttcacatgatgcaggtggaccctgccacacccgcaaagtcggacttagaggatctggaagaacatgtgcccgggcagacagtgtctgaggaggctacgggtgttcatatgatgcaagtggatccagcaactctggccaagcagctcgaagattcaacaatcactggcagccaccagcagatgtccgccagcccttcttcagccccggcagaggaggctactgagaagacaaaagtggaagaggaagttaaaacgagaaaaccaaagaagaaaacccggaaacctagcaaaaagtcccgctggaacgtgctgaagtgctgggatatttttaatattttttag

SEQ ID NO: 47244 - DNA, 933 bp, Artificial Sequence
  Description of Artificial Sequence: Synthetic coding sequence
atggtggacaaggacaccgagcgggacatcgagatgaagcggcagttgaggcgactgcgagagctgcatctttactctacatggaagaagtatcaggaggccatgaagaccagtctcggcgtcccccaatgcgagagggacgaaggcagcctgggcaaacccctgtgcccgcctgaaattttaagcgagacccttccagggagtgtcaagaagagagtgtgttttccgtcggaggatcatttggaagagtttatagccgaacatctgcccgaggcttccaaccagtccctcttaacggtagcccatgctgacacagggatccaaacaaatggcgatctggaagacctcgaggagcacggaccagggcagaccgttagcgaagaggccactgaggtccacatgatggagggcgaccctgacacactggccgagctcctgattagggatgttctccaagagctgagttcctacaacggcgaggaggaggatccagaagaagtaaagacaagcctcggagtgcctcagcggggagacctggaggatctcgaggagcacgtccctggacagacagtctctgaagaggcaacgggggtgcatatgatgcaagtcgatccagctaccccagccaaatcagacctggaagacctggaggaacacgtgcctggacagactgtcagtgaggaggccacaggggtgcatatgatgcaggtggaccctgctacgctggccaagcaactcgaagactcaaccattacaggtagccatcagcagatgtcagcaagcccatcgtccgctcccgcagaggaagcaacagagaaaaccaaagtagaggaggaggtgaagacacgcaagcctaaaaaaaagactcgcaagcctagcaagaagtccagatggaacgtgctcaaatgttgggatatattcaacattttttag

SEQ ID NO: 47245 - DNA, 933 bp, Artificial Sequence
  Description of Artificial Sequence: Synthetic coding sequence
atggtggacaaggacaccgagcgggacatcgagatgaagcggcagctgaggaggctcagggaactgcacctgtatagcacctggaagaagtatcaagaggcaatgaaaacgagtttgggcgttccccagtgtgagcgcgatgaaggctccctgggaaagcccctctgtccccccgagatcttatctgaaacactccccggctcagtaaagaagcgggtctgttttccatccgaggatcacttggaagagtttatcgctgagcacctccccgaagcatcaaatcagagcttgctgaccgtggcccacgccgacacgggaattcagaccaacggggacctggaggatctagaggaacatgggccaggacagactgtcagcgaagaggccacggaggtgcacatgatggagggcgaccctgacacactggcagaattactgattcgtgacgtccttcaggaactttcgtcatacaatggagaagaggaagaccccgaggaggtgaagacatcattgggcgtacctcaaaggggcgacctggaggaccttgaagagcacgttcccggacagaccgtgtctgaggaagccactggggtgcatatgatgcaggtggacccagctactcctgctaagtccgatctggaggacctggaggagcacgtacccggccaaactgtcagcgaagaggcgacaggggtgcacatgatgcaggtggatcctgccactttagcgaagcaactcgaggactctacgattaccggcagccaccagcagatgtcggcttctccgtcttcagctcccgccgaggaggccaccgagaagacaaaggtggaggaagaggtcaagaccaggaagcctaaaaaaaagacacggaagccctcaaaaaaatctagatggaacgtgctgaagtgttgggacatcttcaatatcttttag

SEQ ID NO: 47246 - DNA, 345 bp, Artificial Sequence
  Description of Artificial Sequence: Synthetic coding sequence
atggtggacaaggacaccgagcgggacatcgagatgaagcggcagcttcgccgcctccgtgaattacacctttatagtacctggaagaagtatcaggaggccatgaaaacctctctgggtgtgcctcagcgtggggatcttgaggacctcgaggagcatctaccagggcagacggtgtcggaagaagcaaccggggtgcatatgatgcaggttgacccggccacccctgctaagaagttagaggactcaaccattacgggctcacaccagcagatgtccgcctccccgtcaagcgccccagccgaggaggcgacggagaagacaaaggtcgaagaggaggtgtag

SEQ ID NO: 47247 - DNA, 120 bp, Artificial Sequence
  Description of Artificial Sequence: Synthetic coding sequence
atggtggacaaggacaccgagcgggacatcgagatgaagcggcagcttcggcgcctaagagagctgcacctgtatagcacgtggaagaaataccaggaagccatgaagacatccctctag

SEQ ID NO: 47248 - DNA, 435 bp, Artificial Sequence
  Description of Artificial Sequence: Synthetic coding sequence
atggtggacaaggacaccgagcgggacatcgagatgaagcggcagctgcggcgcttgagggaactccacctatactcgacctggaagaaataccaagaggctatgaagaccagtcttggcgtgccgcagagaggagatctcgaagatctggaggagcatctgcccggacagaccgtgtcagaagaggccaccggcgtccatatgatgcaagtcgatccagcaaccccagcgaaaaagctggaagatagcaccattacaggctcccaccagcagatgagtgcctccccctcatcagctcccgctgaagaggcaactgagaagacaaaagtggaggaggaagtgaagactcgcaagcctaaaaaaaagacgaggaaaccctcaaagaaatctcggtggaatgtcctgaaatgctgggatattttcaacatcttctag

SEQ ID NO: 47249 - DNA, 1425 bp, Artificial Sequence
  Description of Artificial Sequence: Synthetic coding sequence
atgaagaccaagtgcatctgcgagctgtgcagctgcggccggcaccactgcccacatctgcccactaagatttacgacaagactgaaaagccctgcttactttctgagtatactgaaaattaccctttctaccacagctacctgccaagagaaagtttcaaaccccgaagagagtaccagaagggccccatacccatggagggactgacgacgtcacggcgggactttggtcctcataaggtggcacctgttaaagtgcatcaatatgaccagtttgttccctcagaagaaaatatggatttactgaccacctacaagaaggactacaatccatatccagtctgcagggtcgaccccattaagccgagagatagtaaatatccctgttccgataaaatggagtgtcttccaacatataaggccgactatctcccctggaaccagcccaggagggaacccttacgactcgagcacaagtatcaacccgcgagcgtccgattcgataatcgaaccacccaccaggacgattaccccattaaaggactggtcaagaccatatcctgcaagccgttggcgatgcctaaactctgcaatatccctctggaggacgtaaccaattacaagatgagttacgtcgcccaccccgtggagaaacggttcgttcacgaagctgaaaagttccggccttgcgaaattcctttcgagtctctcacaacccagaaacagagctataggggcctaatgggcgaacctgcaaaatccctaaaaccccttgcccgccctcctgggctggacatgccattttgcaacacaacggagtttcgtgacaaataccaggcttggcccatgcctaggatgttttccaaggctcccattacatacgttccacctgaggatcgcatggacctgttgaccaccgtgcaggctcactacacttgcccaaagggagctcccgcccagtcttgccgccctgcccttcagatcaagaaatgtggtaggtttgaaggatcctctaccaccaaggacgactataagcaatggagttccatgcggacagaacccgtgaaaccagtgcctcagctagaccttccgacagagccccttgactgtttgacaaccacgagagctcattacgtgccacacctgcccattaacactaagagttgtaaaccccattggtccggccccagaggcaatgtgccagtggagagccagacgacctacacaatctcttttacccctaaagagatgggtcgctgcctggccagttatcccgaaccccctggctataccttcgaagaagtagatgcactcggacatcggatctacaagccagtttcacaagctggaagccagcagtccagtcacctgtcagtggacgacagcgagaatcctaaccagcgggaattagaggtattagcctag

SEQ ID NO: 47250 - DNA, 849 bp, Artificial Sequence
  Description of Artificial Sequence: Synthetic coding sequence
atgcccaagctgtgcaacatccccctggaggacgtgaccaactacaagatgagctacgtggcccaccctgtggagaaacgatttgtccacgaggccgagaagttcaggccatgcgaaattccattcgaatcactgacaactcagaagcagtcttacaggggcctgatgggagaacctgctaaatccttaaagcctctcgcaagaccccctgggcttgatatgcctttttgcaataccaccgagtttagagacaaatatcaggcttggccgatgccacgtatgttttcaaaggcaccgattacttacgttccacccgaggatagaatggatctgttgacgacagtccaagcgcattacacctgtcctaaaggcgcccccgctcagtcctgtcggccagccttgcagattaaaaaatgcggtcgatttgagggctcttcaaccacgaaggacgattacaagcagtggtcatccatgagaactgagccggtcaaacccgtgccccagctcgatcttcctacagagcccctggattgtctcaccaccactcgggcccactatgtgcctcatctgccaattaacacaaagtcatgtaaacctcactggtctggccccagaggcaacgtgcccgtcgagtcccaaactacttacaccatcagtttcacaccaaaagagatggggcgatgtttggccagctaccccgaacccccaggctatacctttgaggaagtagacgcactcgggcaccgaatttataaaccggtgtcccaagccgggagccagcagagttctcacctcagcgtcgacgactccgagaacccaaatcagcgggaactggaggtgctggcctag

SEQ ID NO: 47251 - DNA, 1197 bp, Artificial Sequence
  Description of Artificial Sequence: Synthetic coding sequence
atgggcgccaagagcatgcggagctggtgcctgtgccagatctgcagctgcgggtcagactactgcccttacgagatcgtcaagcagccacgccacgtgcctgaggagtataaaccgaagcaggggaagattgacttgggtacaacctataagagagatctgaattcatataaggtccagcctgttgccatagtcagacccctcgaaagacaggtgaaaaaggggaaactggacacagttcctacttacaaggatgattatcgcgcctgggatctgcacaaatcagagctctacaagcctgagcagacatatcacccccctactgtcaaatttggcaattctacaacattccaggacgattttgtgccacaggaaataaagccacgacagagcttcaaaccttcaagtgtcgtgaaacgctcaacggcccctttcaacgggatcacctcacacaggttggattatatcccgcaccagctggaactcaagttcgaacggcctaaggaggtttacaagcccactgatcaaagattcgaggatctgactacccaccggtgcgatttccagggactgatcggagaaactgccaaactgtgccgccctgtccacactcgcgtcacccagaacgccctgtttgagggcagtaccgaatttcgggagtccttccaaccttgggagattccgcctcccgaggtgaaaaaggtccccgaatacgtccctcctaccggcagcatgttactgaatagcacttcgcatttagattatgtgccctaccaggctaatcacgtggttccaattagaccggtaagccaaaaaagaagcaataatttccctttccaagggaagtctattatgaaagaggactttccagcctgggaatcatgtcgccagggcttaatcaagaaacagcagcagatccctaacccctctggcaaatttgatgggctctctactttccggtctcattacgtcccccacgagctgattcccacagagtcctgtaaacctctgaacatcgcctttaagagttccgtaccatttgatgacgtcactatgtattctgttgagtacacccctaaacgccaggagatttgtcccgcttcctacccctcaccacctggatatattttcgacaacaccaactctcaaggacataagtttttcagaaaaataatcccggctgtaaaggccttctag

SEQ ID NO: 47252 - DNA, 1152 bp, Artificial Sequence
  Description of Artificial Sequence: Synthetic coding sequence
atgccctggagcgactactgcccctacgagatcgtgaagcagcccagacacgtgcctgaagagtacaagcccaagcagggcaagatcgaccttggcacaacatacaagcgtgacttaaattcgtataaagtgcagcccgtagccatagttcgtcccctggaacgacaggtgaaaaaaggtaagctggacactgtgccgacatacaaggacgactatcgcgcctgggaccttcacaaaagcgaactctataagcctgagcagacgtatcacccgcccacagtaaagttcggcaactcaacaaccttccaagacgattttgtaccacaggagattaaaccccgtcagagtttcaaaccttcaagtgtcgtcaagcgcagtaccgcacccttcaacggaattacgagtcaccgactggattacattcctcatcagctggagcttaagtttgagagaccaaaggaggtgtataagcccacagaccagcgcttcgaagatctcactacccaccgttgcgactttcagggcctgattggcgagacggctaaactgtgtagacctgtgcatacacgcgtgacccagaatgctttgtttgaaggatctaccgagttccgtgaatcctttcaaccttgggagatccccccaccggaagtgaaaaaagtgccagagtatgtcccccccacagggtccatgttgctaaactctacttcccacctcgactacgtgccctatcaggccaatcacgtggtgcccattcgccccgtctcacagaagcgaagcaacaactttccatttcaaggtaagtctattatgaaagaggactttccagcgtgggaatcttgtcggcaaggactgattaagaagcagcagcagatccccaacccaagcgggaagttcgacggactctcgaccttccgctctcactacgtgccccatgagctgatccctactgagtcatgcaagccactgaacattgccttcaagtctagtgtgccgtttgacgatgtcacaatgtattctgtggaatatacccccaagcgccaagagatttgtccagcttcatacccgtccccgcccggctatatttttgacaatacaaactctcagggacacaaattcttcaggaagattatacctgcggtaaaggcgttttag

SEQ ID NO: 47253 - DNA, 1152 bp, Artificial Sequence
  Description of Artificial Sequence: Synthetic coding sequence
atgggccccctgttcaccaccatccccggcgcccacagcggccccatgcgccccttacctaagaaacatgtagaaccaatggctgttaggcagctcctactagggaactctactatgataaggcacacctgtcccatgtctgttccgctgagtcgtcaggtgaaggaggttgctgcacagaagccctctgaggacatatataagaattggcagcagcagcagcagcagcagcaacaacaacagcagcagcaacttgaccttttgtttcatcagaggattcagatctctctctggccacggaagcaaaaacgcaggaagacagagcagcacagtcatccttttgtgaagaaggcctttagattctctgccggctcaggctgtggccgcccatccagtaataaaatgttgcggtctatgggtggcgggcagaggcctactggtctcgggtccgagttctttcgcctgctgcatgaccttcacttgcttgcatttgctatgaagaggatctggatccatcgtagaggagaagctacggctaggccacgggctcctgaacaccccgctcctccagccacagccgtgagaggccgagacgctgccagccagaatctgaagcgtcggccagggtcaggcaccgatggcctccggcttcaaggcgcggagccgagcagactcctgaggacttacgccggtggagcagtcatccccactggtacccccgagcgagctcagccgcctcccccccaagatcctctcggcaggcgaagatggctgtctcgaaatacctggggtccatggccaggaactactcaacccccttcaccccagctgctgaggaacgactgggggtcttgtggttttatggtcccagaggccgctagaggaaaagttttccaggactcccaggaaggggcccatattagacgggagacagtgtcaaaaagtgtgtgcgccgaaccgtggagacatcaaagggcgcgggatcccgcgcctaccaacttccccctgaggtgccaaaagcagagaggggcctctgcttcttcaggccagcatgagggcagggtgaacctggtgttttttatcgggagccccaccgtgatagccgttcctgacttgcagtgtcccactaaatatagcggtatgctctactag

SEQ ID NO: 47254 - DNA, 954 bp, Artificial Sequence
  Description of Artificial Sequence: Synthetic coding sequence
atgttccaggccgccgagcggccccaggagtgggccatggagggccccagggatgggctcaaaaaagagaggttgttggatgaccgccacgactccggactcgacagtatgaaagatgaggagtatgaacagatggtgaaggagcttcaggagatcaggctggaacctcaggaagtcccacggggtagcgagccttggaaacaacaacttaccgaggacggtgactccttcctgcatctcgccatcatccacgaggaaaaagccctcactatggaagttattagacaggtgaaaggcgacctggccttcctgaattttcagaataatttgcagcagactccccttcacttggccgtcatcaccaaccagcccgaaatcgctgaagccctcttaggagcgggctgcgaccccgaactgcgtgatttcaggggaaacacacccctccatctagcgtgcgagcaggggtgtttggcgagcgtcggtgtgctcacccagtcttgcacgaccccacacctacactcaatcttgaaggccactaactacaacggccatacatgcctacatctggcctcaattcacgggtaccttgggattgtggagcttctggtcagtctgggagccgatgtgaatgcccaggagccctgcaacggacggacagctttgcatctggccgttgatctccaaaatcccgacctcgtgtctctgttactcaagtgtggtgccgatgtgaacagggtcacctatcaggggtattcgccataccagctaacctggggaaggccatccacgcggatacaacagcagctcggacagctgaccctcgagaacctgcagatgttacccgagagcgaggatgaggaatcctacgacacagagtcagagttcaccgaattcaccgaagacgagttaccctacgacgattgtgttttcggcggacagcgattaaccttgtag

SEQ ID NO: 47255 - DNA, 627 bp, Artificial Sequence
  Description of Artificial Sequence: Synthetic coding sequence
atgggcgaggtggagatcagcgccctggcctacgtgaagatgtgcttacatgccgccagatacccccacgccgcagtgaacggtctttttttggccccagctcccagatccggcgagtgcctgtgcctgacagattgcgtcccgttgtttcacagtcacctggcactgtccgtgatgcttgaagtggcgttaaaccaggttgacgtatggggagcgcaggccgggcttgttgtggcaggttattaccacgccaatgccgccgtgaacgaccagtccccaggaccattggcacttaagattgccggcagaattgccgagttctttccagatgcagtcctcattatgcttgataatcaaaaactcgtcccacaacccagagtgccccccgtaattgtcctcgagaaccagggactgcgctgggtcccaaaggacaaaaatctcgtgatgtggcgcgactgggaggaaagtaggcaaatggttggagccctcctggaggatagagcacaccagcatctagtggatttcgattgccacttggatgatatcagacaggactggaccaaccaaagattgaacacccagatcacccaatgggtcggacctactaatgggaacgggaacgcctag

SEQ ID NO: 47256 - DNA, 483 bp, Artificial Sequence
  Description of Artificial Sequence: Synthetic coding sequence
atgagcgaggccagccggctgtgcagcggctactacagcctgaaccagagctttgtggaaccattccagtgccctcgtagaggcgagggggccgcactgcagtattgctgcggatttgcggatctgaagtattgttgctctgaaccggggtcgtacttcccgtacaaacactcttatatgtggtccctttcgattggcgcactgattgggctggggattgcggctctagttctgctagcttttgtgatatctgtgtgtgtcctttgttatctgttcctgtacactaagccacagaggctagacaccggcctgaagcttcaacatcttgaagccagttctacccaggagggaaagagcaatgggaagaccaaggcattgaatagcaacgcagcatccaatgccacaaatgaaacatattatgaggctgacgacataatccaggaaaaaacaatggatgcgacacagattcacattgcatactag

SEQ ID NO: 47257 - DNA, 3123 bp, Artificial Sequence
  Description of Artificial Sequence: Synthetic coding sequence
atgatgagcagcgtgagcaccgagagcaagctgcagcaggccgtgtctttgcagggagttgacccagaaacctgtatgatcgtgtttaaaaaccactgggctcaggtggtgaaaatactggagaaacacgacccgctgaagaacactcaggcgaagtacgggtccataccgcctgatgaagccagcgcagtccagaattatgtggaacacatgctgttcctgcttattgaggagcaggcaaaggatgccgcaatgggccccattctggaatttgttgtgtccgagaacatcatggaaaagctgtttttgtggtccctacgccgggagttcactgatgagactaaaattgaacagcttaaaatgtacgaaatgttggttacccaatcacatcagcctttgctgcaccacaaacccattttaaaacctctgatgatgctactctcttcatgttctgggactaccacacctacggtggaggagaagcttgttgtactacttaaccagctgtgtagcattttagcaaaagatcctagcattctggagctatttttccacacatcagaagaccagggggctgctaattttttgatatttagcctcctgataccattcattcatagagaaggaagcgtgggtcaacaggcacgcgacgcactcctgtttattatgtctctgtccgcagaaaacacgatggtggcgcaccacattgtcgagaacacttacttttgccctgtcctggctacaggactgtccggtctatatagttccctgccaaccaagctggaggaaaaaggtgaggagtggcattgtctcctcaaagacgattggttactgctgccatctctggtacagttcatgaactcccttgaattttgcaatgccgtcattcaagtggctcatcccttgattcggaatcagctggtcaactatatctacaacggatttttagtgcctgtgctagcacctgccttgcacaaggtgacagtagaggaggttatgacaacgaccgcttatctggacctgtttctgaggagcatctcagagccagctttactggagatcttcctacgcttcattctactccatcaacatgagaacgtccatatcctggacacccttacttcccgcataaacaccccttttcgactctgcgttgtgagtcttgctctgttccgcacattgatcgggttacattgtgaggatgtgatgctgcagctggtcttaagatatttaattccttgtaaccacatgatgctcagtcagaggtgggcggtgaaggaacgcgactgctactccgtgtcggccgcaaaattattggccctgactccagtgtgctgttcatctggaatcacactgactctcggcaaccaagaacgggactatatcctgtggtcaaaatgcatgcacgacacaagcgggcccgtggagcggcccttcccagaggcattctccgaaagcgcctgcatcgtcgagtacggaaaagccttggacatcagctatctgcaatacctgtgggaggctcatacaaatatccttagatgtatgcgcgattgtagggtgtggtctgcactgtatgacggtgacagtccagaccctgagatgtttctgcagtctctgacagaggaaggctccgtcagcagcgcctgccccgttttcgggttgccacaacagctgcccaggaagacaggaccccagcttgccccacggaaggataagagccagacagagctggagtgggacgacagctacgatactggcatctcctctggcgcggacgtgggcagtccaggaccctacgatgatttggaagtttcaggtccccctgcacccatcgatcctcccaaacatatccaagagatgaagaagaatgctctgctgttgtttaagggaagttacattgaagaaagcgattttcaggacgacgtaatggtctatcgactgtgcgccgagaaggattctgaggacatgaaagactctcaggaggaggctgcccgcccaccagccgaggcacaggccgaagtccagtcagtccctattaataacggacctctcctctcaactcagcccgagactgattcggaagaagagtggaatcgcgataacagtgatccattccatagcgagcctaaggaaccgaagcaagagcgcgaacccgaagctgctccagagagcaattctgagctcgcctctccggcgcctgaagctgagcattccagcaacctgaccgccgcccatccggaatctgaggagcttatagcgcagtacgaccagattatcaaagaactagactccggcgccgaaggcctgatggaacagaactatcctacccccgacccactactcctcactaaagaagaggaaggcaaggaagagagcaagggagagaaggaaaaggaggggaaaaaggagctagaggatgaggaggatgacttcgactctttcatcgccgagatgcctgccgtagaaacagtgccatccccattcgtcgggcgggacgaggcggcctttgcctcccggcaccctgtgcgaacacagagcactcccttcaccggcccattcatttctgtggtactttctaagctcgagaacatgcttgaaaacagtctgcatgtaaatctcttgctgattgggataatcacacaacttgcttcctatccacagcctctactccggtcattccttctgaatactaatatggtgtttcagccctctgtgagaagtctgtatcaggtgttagccagtgtgaagaataaaatagagcagttcgccagcgtggagagggacttcccgggccttctgatccaggctcagcagtacttactctttcgcgtagacatgagcgacatgacccccgcagcccttaccaaggatccaatccaagaggctagccggactgggtcaggaaaaaaccttcttgatggtccccctcgagtgcttcagcccttcttgacacacagaaccaaggtggctgaagctccaccgaatctgccactgccggttcgaaacccaatgttggccgccgctcttttcccagagttcctgaaagagctggctgcactggcccaggaacatagcatcctgtgttataagattctgggcgacttcgaggattcttgttgttag

SEQ ID NO: 47258 - DNA, 123 bp, Artificial Sequence
  Description of Artificial Sequence: Synthetic coding sequence
atgatgagcagcgtgagcaccgagagcaagctgcagcaggccgtgtctctccagggggtcgatcccgaaacctgcatgatcgtttttaagaatcactgggctcaagtggtcaaaatcctctag

SEQ ID NO: 47259 - DNA, 3123 bp, Artificial Sequence
  Description of Artificial Sequence: Synthetic coding sequence
atgatgagcagcgtgagcaccgagagcaagctgcagcaggccgtgtccctgcagggcgtcgacccggagacttgtatgatagtttttaagaaccactgggcccaggttgtgaagattcttgagaaacacgatcctttgaagaatactcaggctaaatatgggtcaataccgcctgacgaggcctccgctgtgcagaattacgtggagcatatgctcttccttctgatagaggagcaggccaaagatgcggctatggggcccattcttgaatttgtcgttagcgaaaatatcatggagaagctttttctgtggtctctgaggcgggagtttaccgatgagactaagatcgagcagctgaaaatgtacgaaatgctagtgacgcagtcccaccagccactgttacatcacaagcccatactgaagcccctcatgatgctgctttcgtcctgctctggaaccacaactcccactgtggaggaaaagttggtggtcctgctaaaccagctgtgctctatccttgccaaagatccgtcaatattggagttatttttccacacgagtgaggatcaaggagctgctaacttcctgattttcagtttgctgatcccttttatccaccgcgaaggttcagtagggcaacaagctagagacgctctgctgttcattatgtcactgtctgctgaaaatactatggtggcccatcacatcgtagagaacacgtacttttgtcctgtcctggccacaggcctttccggattatatagcagcctcccgaccaagctggaggagaaaggcgaagaatggcattgcctgctgaaggatgattggctgcttttgcccagcctggtacagttcatgaattccctcgagttctgtaacgcagttattcaggttgctcatcctctgatcagaaatcagctagtaaactatatatataacgggttcctcgttccagtccttgcccccgcgctccataaggtcactgtcgaggaggttatgacgacgactgcctatctggacttattcctgcggagtatatctgaacccgccctgctggagattttcctgaggttcattctgctgcaccagcacgagaacgtccacatcctagatacgctgacctctaggatcaatacgccctttcgcttgtgtgtggtctccctcgcccttttccggacgctgataggacttcattgcgaagatgtcatgctccaattggtgctgcgatacctgatcccatgcaatcatatgatgctgtcccaacgctgggctgtcaaagaaagggattgctactctgtctcagccgccaaactgctggccttaacccctgtctgctgtagttctgggatcacactcactctaggcaaccaggagcgcgattacatcctgtggtcaaagtgtatgcacgatacttcaggtcccgtcgagcgacctttccccgaggcattctccgaatcggcctgtatcgtggaatacggaaaggcgctggatatcagctacctccagtatctctgggaggcgcatacaaatattctgaggtgtatgcgtgactgccgtgtctggagcgcgctgtacgatggagatagccccgatccagaaatgttccttcagagtctgaccgaagaaggttctgtgtccagtgcatgccctgtgttcgggctgcctcaacagcttcctcgaaagacgggtccccaactggccccacggaaagataaatctcaaactgagttggagtgggacgacagctatgacacaggcatctccagtggcgctgatgtcggctcaccaggaccctatgacgaccttgaagtgtcaggcccgcctgctcctatcgaccctccaaaacacatccaagaaatgaagaaaaacgctctattactcttcaaaggtagttatattgaggagagcgactttcaggatgacgtgatggtgtaccgtttgtgtgcagagaaagatagcgaagacatgaaagactcacaggaagaggcggctaggccccctgctgaggcacaagctgaggtgcagagcgtccctatcaataacggtcccctgctctccactcagcccgagactgattcagaggaagagtggaaccgagataatagtgacccttttcactctgagccaaaagagcccaagcaggagagggaaccagaagccgccccagagagcaatagcgaacttgcctcaccagccccagaggcggaacacagctcaaatctcactgccgcccacccagagagcgaggagctgatcgcacagtatgatcagataattaaggagctggattctggcgctgaaggcctgatggagcaaaactatccaacaccagacccccttctgctgacaaaagaagaggaaggcaaagaggaatcaaaaggcgaaaaggagaaggaaggcaagaaggagctagaggacgaggaggatgactttgactctttcatcgcagagatgcccgccgtcgagaccgtgcccagccctttcgttggcagggatgaggcggccttcgccagccggcaccccgttagaacacagagcacccccttcacgggcccgttcatttctgttgtgctctcgaaactcgagaatatgctcgaaaatagtctgcacgtgaacttgcttctcatcggcatcattactcagctggccagctatccacagcctttgctgcgatccttccttctgaacactaatatggtcttccagccatcagtacgatctctgtaccaagtcctcgctagtgtgaagaacaagatcgagcagtttgccagcgtcgagagagattttcccggcctgctcatccaagcacaacagtatctgttatttagggtggacatgtctgatatgacccctgctgctcttaccaaagacccaattcaagaagcaagcagaacagggagcggaaagaatctcctggacggacctccccgggtgctgcagccttttctaacacatcgaaccaaggtggccgaggcacctcctaatctccctctgcctgtgaggaacccaatgctagcagccgccctcttcccagaattccttaaagagcttgctgctctggcccaggagcattcgattctgtgttataagatccttggtgattttgaggattcatgttgctag

SEQ ID NO: 47260 - DNA, 183 bp, Artificial Sequence
  Description of Artificial Sequence: Synthetic coding sequence
atgatgagcagcgtgagcaccgagagcaagctgcagcaggccgtgtctttacaaggcgtcgacccagaaacttgcatgattgtatttaaaaatcactgggcacaggtcgtgaagatcctggagaaacacgatcccctcaagaatacccaggccaagtatggctctattccccccgatgaatag

SEQ ID NO: 47261 - DNA, 42 bp, Artificial Sequence; identical to SEQ ID NO: 20963
  Description of Artificial Sequence: Synthetic coding sequence

SEQ ID NO: 47262 - DNA, 129 bp, Artificial Sequence
  Description of Artificial Sequence: Synthetic coding sequence
atgatgagcagcgtgagcaccgagagcaagctgcagcaggccgtgtcccttcaaggggtggaccctgaaacttgtatgatcgtcttcaaaaaccattgggcccaagtcgttaagattctggaaaaatag

SEQ ID NO: 47263 - DNA, 306 bp, Artificial Sequence
  Description of Artificial Sequence: Synthetic coding sequence
atgttcagcaagttcaccagcatcctgcagcacgccgtggaggcccttgctcctagtcttcccctgcaagaggactttgtttaccactggaaggctatcacacactattatatagaaaccagtgacgacaaggcccctgtaacagataccaacatcccaagtcatctggagcagatgctggacattctcgtgcaggaagagaacgagagggagagcggagagacagggccatgtatggagtatctgctgcatcacaaaattcttgaaaccctgtatactcttggcaaagccgacgtctcttcttag

SEQ ID NO: 47264 - DNA, 2298 bp, Artificial Sequence
  Description of Artificial Sequence: Synthetic coding sequence
atgttcagcaagttcaccagcatcctgcagcacgccgtggaggccctggctccaagtctgccactgcaagaagatttcgtgtatcactggaaagcaataacccactactatatcgagacaagtgacgacaaagcgccggtgaccgatactaatattcctagccatttggagcaaatgttggacatactggtgcaggaggagaacgaacgagaaagtggagagacagggccttgtatggagtatctcctgcatcataaaatcctggagacgctctatactttaggaaaggctgactgtccacctggaatgaaacagcaagttctggtcttttacactaagctgctcggtaggatcagacagccactactgccccatatcaacgtgcacaggcccgtgcaaaagcttatacgtctctgcggtgaagtgttggcaacccccactgagaacgaagaaatccaattcctgtgtattgtatgtgccaagctgaagcaggatccttacctggtaaacttctttctagagaataaaatgaaatccctggcgtctaagggcgttccaaatgtcatttcggaggacacactaaaaggacaggactcgctgagcaccgatacaggacaaagtagacagcccgaagaactgagtggagcaacaggaatggagcagacagagcttgaggacgaaccgccccatcagatggaccaccttagcacctcgctcgataatctgagtgtcacctctctgccagaggcttcagtggtctgcccaaaccaggactataacctggtcaactccctgttgaatctcacccgttcacccgacggcagaatcgccgtcaaagcctgcgagggactgatgcttcttgtgtctttaccagagcccgcagctgctaaatgcctgacacaaagtacgtgtctctgtgagcttttgacggaccgcctagcctctttatataaagccctgcctcagtcagtggatccactcgacatagaaactgtggaggccattaactggggcttggacagctactcccacaaagaggatgcctcggcctttcccggaaagagagcgcttatctccttcctctcatggttcgactactgcgatcagctcattaaggaagcccaaaagaccgccgcggtcgccctcgctaaggctgtacacgagaggttcttcataggagtcatggagccacagttaatgcagacgtcagaaatggggatactcacctctaccgcactccttcataggatcgtgaggcaggtaacatcagacgtgctgttgcaggaaatggtgttcttcattcttggggaacagagagagcctgagactctagcggaaatctcccgacatcccctaaggcaccgtttgattgagcactgcgatcacatttcagatgaaatttctattatgacattacgcatgtttgagcatctgctgcagaaacccaatgagcacattctgtataacctagtccttcggaacctggaggaacggaactatacagaatacaagcccctgtgtcctgaggacaaagatgtggtggagaacggtctgatcgcaggtgcagtcgacttagaagaggatcccctgttcacagatatttcccctgagaacaccctgccaaaccaggagtggttatcgtccagtcctccagccacgcctgatcatccaaagaacgacggaaagacagaagtgcataagatcgtgaattcttttctatgtttagtgcccgacgatgccaaatccagctaccatgtagagggcacgggctacgacacctaccttcgggacgctcaccgccagttccgcgattattgtgccatctgcttacgctgggaatggccggggtccccaaaggctttggagaagtgtaatcttgaggcggccttcttcgaaggccacttccttaaggtgttattcgatcgcatgggcaggattctcgaccaaccttatgacgtgaaccttcaggtgacaagtgtgctatcgcggctgtctttattccctcatccccacatccacgagtatctgctcgatccatacgtcaaccttgcccctggctgtaggagcctcttctccgtcatcgtgcgggtggtgggcgatctgatgctgcggatacaacggatacaggatttcaccccaaaacttctgttggtgaggaagcgcctgctaggcctggaacccgagggcccaatcatcgatcatattactttgctggagggagtgatagtgttggaagaattctgcaaggaactcgccgcaatagcttttgttaagtatcacgccagctccacaccctag

SEQ ID NO: 47265 - DNA, 2217 bp, Artificial Sequence
  Description of Artificial Sequence: Synthetic coding sequence
atgttcagcaagttcaccagcatcctgcagcacgccgtggaggccctagcccccagtctccccctgcaggaagattttgtgtaccattggaaggccattacacattattacatcgagaccagcgatgataaggctcctgttactgacacaaatatcccttcacaccttgagcagatgctcgatatcctggtgcaagaggagaacgaaagggagagcggggaaactgggccctgcatggagtatttgttacaccacaaaatcttggagaccctgtacacactggggaaggcagattgtcctcccggaatgaaacagcaggttcttgtgttctacacaaaactactcgggcgcatccgccaaccattgctaccccatataaacgttcaccgcccagtgcagaaactgatccgtctttgcggtgaggtgctcgcaacgccgacagagaacgaagaaatccagttcctttgcatcgtgtgtgccaagctcaaacaggacccttatctggtcaacttctttctggagaataaaatgaagagtctggcaagcaagggggtgcctaatgtgatctccgaggatacactgaagggacaggatagcctcagtacagacacagggcagtctaggcagccagaagaactcagcggcgctacgggaatggagcagactgagttggaggatgaacccccacatcagatggaccacctgtcaacttccttggacaacctgagcgtcactagcctgcccgaggcgtccgtggtctgccctaatcaagactacaatctcgtcaacagcctgctaaatctcactcgaagccctgacggcaggatcgccgtgaaagcatgcgagggcttgatgttgttagtgagcctccccgagccggctgctgctaaatgtctaacccagtctacatgtctgtgtgagttgctcacagatcgcctcgctagtctttacaaggctctccctcagagtgtcgaccccctggacatcgaaacagtggaagctatcaactgggggttggactcttactcacacaaagaggatgcctccgccttccccgggaagagagccctgatcagctttcttagctggtttgactattgcgatcagctgataaaggaggctcaaaagacagccgctgtggccctggctaaggcagtccatgagaggttctttattggagtcatggagccacagctgatgcagacatccgagatgggaattctgactagtacagcactgctacaccgaatagtgaggcaagtgacaagtgatgttttgctgcaggagatggtgttctttatcctcggcgaacagagggaacctgagactttagccgaaatttctcgccatccactaagacaccggcttattgagcactgcgatcacattagcgatgagatatccattatgacactgcgcatgtttgagcatctactccagaaacctaacgagcatatcctctataacctggttctaagaaatctcgaagagcgaaattacacagaatacaaacccttgtgtcccgaggataaggacgtggtggaaaacgggcttattgcaggcgctgtggatttggaggaggatcctctgttcacagacatttcccccgagaatacactgccgaaccaggagtggctctcctccagtccgcctgctactcccgatcacccaaagaatgatggtaagactgaggtgcacaagatcgtaaactcattcttgtgtctcgtgcccgatgacgccaaatctagttatcacgtggaaggcacaggatacgatacctacctccgcgacgcccataggcagtttagagactattgtgcaatttgtcttcggtgggagtggccgggatcccccaaggccctcgagaagtgtaatctggaggcagcattcttcgaggggcacttcctcaaagtactgttcgacaggatgggcagaatcctagaccagccctatgacgtcaacttgcaggttaccagtgtactgagcagacttagtctgtttccacatcctcacatccacgaatacctcttagacccatatgtgaatctagccccaggatgtcgaagtctattttccgtcatagtgcgggtggtcggcgaccttatgttgaggattcagcgaatacaggacttcactcccaagcttttactcgtgagaaaaagactcttaggcctggaaccagaaggaccgatgcagacgctgcctagctggtggtag

SEQ ID NO: 47266 - DNA, 252 bp, Artificial Sequence
  Description of Artificial Sequence: Synthetic coding sequence
ctgagcctgttcccccacccccacatccacgagtacctgctggacccatatgtgaacctggccccaggttgccgctctctgttcagcgtcatagttcgagtggttggtgatctgatgctgcgtattcagcgcatacaggatttcactccaaagctcctgctggtaaggaaacggctccttggactagaacctgaggggcccatatccgacctggaacctgtcgaggcacttaccgtcagtagcatctgctag

SEQ ID NO: 47267 - DNA, 2232 bp, Artificial Sequence
  Description of Artificial Sequence: Synthetic coding sequence
atgctgagccggctgggcgccctgctgcaggaggccgtgggcgcccgtgagcctagtattgatctactccaggctttcgtcgaacactggaagggaatcactcattactacatcgaatctactgacgagtccacgcctgctaaaaaaactgacattccttggcggctgaagcagatgctggatatcctggtctatgaagagcagcaacaggcggccgccggagaagccggcccgtgtctggagtatctccttcagcacaagattctcgagacattatgtacactcggaaaagcagagtaccccccaggcatgcgccagcaagtgtttcagtttttctccaaggtccttgcgcaagtccaacatccattactgcattatttgtcggtgcataggcctgtccagaagttgctccgtctgggcggcacagcaagcgggtcggtgacagagaaggaggaggtgcaatttaccacggtgctgtgctcgaagatccagcaagaccccgaattactggcatacatcctggaggggaaaaagattgtcggcaggaagaaggcgtgcggagagcctaccgcgctgcctaaggacaccacgtctcacggggacaaagactgtagtcacgacggcgcgccagcgaggccccagctggatggcgaatcatgtggcgctcaggccttgaacagccacatgcctgcggagactgaggaattagacggaggtacaactgagagtaacctgattacaagcctgctaggcctatgccagagcaaaaaaagccgtgtggccctgaaggcgcaagaaaacctgctgcttcttgtgtcaatggccagccctgccgccgcaacctatcttgttcagtctagcgcttgttgtccagcaatcgttcgacatctgtgtcagctgtaccggagcatgcccgtgttcctggaccccgctgacatcgccacactcgagggaatctcctggcggctgccatctgctcctagtgacgaggcatccttccccgggaaggaagctctcgcagcttttttgggttggtttgattactgtgaccacttgatcaccgaagcacacacagttgtggccgatgcccttgcgaaagcagttgccgagaactttttcgtggagactctccagcctcagctcctgcatgtgagcgagcagagcattctgacttctacggccctgctaacagcgatgttacgccagctccgcagccccgctctgctccgggaggctgtcgccttcctcctggggaccgacaggcagcctgaggcacccggagacaatcctcacacgctgtacgcacacctcattggccactgcgatcatctcagtgacgagatatcaatcacaacactgcggctgtttgaggagctgctacagaagccccatgaaggtatcatccactccctggttttgcgcaatctcgaaggccgtccctacgtggcatggggaagcccagagccagagtcttacgaggatacccttgatctcgaagaagatccctattttaccgattcttttctggactcgggctttcagactccggcaaagccgcggcttgcccccgctacaagctatgacggcaagacggcggtaaccgagatcgttaacagctttctttgtctggtgcccgaggaagctaaaacaagcgcgttcttagaggaaaccggctacgacacctacgtgcacgacgcttacggacttttccaggagtgctcctcaagggtggcgtcttggggctggcccctgaccccaactccccttgaccctcatgagcccgaaagacccttctttgaaggccattttttgcgtgtgctgttcgatcgaatgtcacgaatcctggaccagccatattctttgaacttacaggttacatccgtgctaagccggctggccttattcccccacccacacatccatgaatacctgcttgacccttacatcagtctggctcccggatgcagatccctcttctctgttcttgtgcgcgtcatcggcgatctaatgcaaagaatccagagggtgccacagttccccgggaagctcctgcttgttcgcaaacagctaaccggtcaggctcctggggagcagctcgatcatcagaccctgcttcagggtgtagtggttctggaggagttttgtaaggaactcgccgccattgcattcgtgaaatttcccccccatgatcctaggcagaatgtaagtcctgcgcctgagggccaggtttag

SEQ ID NO: 47268 - DNA, 486 bp, Artificial Sequence
  Description of Artificial Sequence: Synthetic coding sequence
atgctgagccggctgggcgccctgctgcacgagcccgagcggccctttttcgaaggccacttcctcagagtcttgtttgatcggatgtctagaatcttggatcagccctactcacttaatttgcaggtgacaagcgttctgtcaaggcttgcactcttcccacacccccacatacacgaatacctgcttgacccttacatttcattagcgccaggatgccgctcgctgttcagcgtgctggttcgagtgataggtgatcttatgcagcgaatccagagagtcccacagttcccaggcaagctgctgttagtgcgcaagcagctcaccggccaagcccctggggagcagttggatcaccagactctgttgcagggtgtggttgtcctcgaggagttttgtaaagagctcgcagccatcgcattcgtgaaatttccacctcacgacccaaggcaaaacgtgagtcccgcgcctgaaggacaggtttag

SEQ ID NO: 47269 - DNA, 2133 bp, Artificial Sequence
  Description of Artificial Sequence: Synthetic coding sequence
atgcggggcgagaaccggcccatcggcaagcggaccctgcccccccgagctggctggattggtggatgcccaggcagccagcctgatgctaaggcacgtaagggatggactttggctccccattccagcagatgccatcggtgctgtcactaccgttgccattgcagatgctgcttgtgtcccgccgagatgaccgtagggcgccccgagggagctccaggcggcgctgagggcagccgacaaatctttcctccagagtcattcgccgacacggaagccggcgaagagttaagtggggacggcctggttctgccaagggcctcaaaactggacgagttcctgtctcctgaagaggagatcgactcaactagcgatagcaccgggtctatttaccagaatttgcaggagttgaagcaaaaaggacgttggtgtctgctcgagagcctgtttcagtcagaccccgaaagcgacgagaatttgagtgaagacgaagaggatctagaatcattcttccaggataaagatcgtggaatggttcaggtgcaatgcccccaggctctgagatgtggcagtactagacggtgtagcagcctgaacaacctgccctctaatatcccaaggccccagacacagccccccagcggatctcggcccccaagccagcaccgaagtgtcagctcatgggcctccagcatcactgtgcctcggccatttcgaatgacgttgagagaggccaggaagaaggctgagtggctgggttcccccgcatcatttgagcaggagcgacagagagcacaaagacaaggtgaagaagaggcggagtgtcaccgccaatttagagctcagccagtgcctgctcacgtttacttgcctctctaccaggaaattatggaacggagcgaagcccgtcggcaagctggaatccagaagagaaaagaattgcttctcagctccctcaagcctttctcattcctcgagaaggaggagcaactaaaagaagctgccagacaacgcgatcttgctgctaccgccgaggccaagatctcaaaacagaaagccacaagaaggattcctaagtctattctcgagcctgccctgggagacaagcttcaggaagctgagctgttcaggaaaataagaatccagatgcgggccttggacatgctgcagatggcttcctcaccgatcgcctcctcttctaatagggctaatccccagccgcgaaccgcaaccagaacacagcaggagaagctgggattcttgcacactaatttccgctttcaacctcgagtcaatcctgtggtccccgactatgagggactgtataaagcttttcagaggagagccgccaagcgaagagagacccaggaggccacccgcaacaaaccgtttctcttgaggaccgccaatctcagacacccacagcgcccatgcgatgccgcaactacagggcgaagacaagactcaccccaacctcctgctacacccctaccacgaagccgcagcctgagtggcctcgctagcctgtcggccaacacgctgccggtccatatcaccgacgccacaaggaagagggagagcgccgtccgctccgcgctagaaaaaaaaaacaaagccgatgagagtattcagtggctcgaaattcataagaaaaaatcccaggctatgagcaagtccgttacactgagagccaaagccatggacccacataaatctctggaggaggtgttcaaggctaagttaaaagaaaatcggaataacgaccggaagagagctaaagaatacaaaaaggagctagaggaaatgaaacagcggatacagacacgcccttacttgttcgagcaggttgccaaggatttagcaaagaaggaggccgagcagtggtacctggacactctgaaacaagccggactcgaagaggacttcgtgcggaataagggccagggaaccagagccgtccaggagaaggaaactaagatcaaagactttccccgcttccaagaaacaactaagctctccattagagatccagagcagggcctggaaggaagcctggaacagcctgctagcccccggaaggtcctagaggagctttctcatcagtcccccgaaaatctcgtgtctctggcttag

SEQ ID NO: 47270 - DNA, 1944 bp, Artificial Sequence
  Description of Artificial Sequence: Synthetic coding sequence
atgaccgtgggccggcccgagggcgcccccggcggcgccgagggctcacgtcagatctttcctccagaaagctttgctgacactgaagcaggggaggagctctctggtgacgggctagtgctcccacgcgcttcaaagctggatgagtttctgtcgcccgaggaagagatcgattcaacctccgatagcacaggctccatctaccagaacctgcaggaacttaaacaaaaaggccgatggtgtttactggagtcactctttcaatcggacccagagtccgatgagaacctttctgaggatgaagaagatctggaatctttttttcaggacaaagatcggggcatggttcaggtgcagtgtcctcaggcactgaggtgtggctccactcgtcggtgctcatcattgaataaccttccctctaatatcccccgaccccagactcagcccccctccggttccagacccccctcccagcatagatcagtcagttcctgggccagctccattacggtccctcggccctttagaatgactctgcgggaggcacgcaaaaaagctgagtggctgggcagccccgcaagcttcgaacaggaacggcagagggctcaacgacagggagaggaggaggctgagtgccaccggcagtttagagcgcagcccgttccagctcatgtgtacctccctctataccaggagataatggagcgaagcgaggcccggagacaggctggcattcagaagagaaaggagctgctcctgtcaagtctgaaaccattttcctttctggagaaggaagaacagttaaaggaagctgcgcgtcaaagggatctcgcagccaccgccgaggctaagattagcaagcagaaggcgactagacgaatacccaagtcaattttggaaccagcgctcggcgacaagttacaggaggccgagctgttccgtaagattcggatccaaatgcgcgcactcgacatgctgcaaatggcctccagtccaattgcttcaagcagcaaccgcgcaaatccgcagccacgtaccgccactaggacacaacaagagaaactggggtttttacatactaatttcaggttccagccacgcgtcaatccagtggtgcccgactatgagggtctgtataaagcatttcagagacgggcggctaagagacgagagactcaggaagccactcgcaataagccgttcctcctgcggactgctaacttgcgccaccctcaaagaccatgtgacgctgcaactactggaagacgccaagacagccctcaacccccagcgaccccactgccccggagtcggagcttgagcggcctggcaagtctttccgccaatacactgccagttcatataaccgatgctaccaggaagagggagtcagctgtgaggagcgcgctcgagaagaaaaataaggcagacgagtccatccaatggctcgagattcataagaagaagagccaggctatgtcaaagtccgtcacactgagggctaaggcgatggacccccacaaaagcttggaggaagtcttcaaagctaagctgaaggagaatcgcaacaatgatcggaagagagccaaagaatacaaaaaagagcttgaggaaatgaaacagagaatccagacccggccttatttatttgagcaggttgctaaagatctggccaagaaagaagctgaacaatggtatctggacactctcaaacaggcaggtctcgaggaagattttgtgaggaataagggccagggaaccagggctgtacaggaaaaggagacaaagattaaagatttcccaaggtttcaagagacaacaaaattaagcattagggatccagagcagggactcgaaggcagcctggagcaaccagcgtctccaaggaaggtactcgaggaactgtcacaccagagcccagagaacctcgtgagtctcgcttag

SEQ ID NO: 47271 - DNA, 978 bp, Artificial Sequence
  Description of Artificial Sequence: Synthetic coding sequence
atggagggcctggaggagaacggcggcgtggtgcaggtgggcgagttgctcccatgcaagatctgtggccggaccttttttccagttgcccttaagaaacacggacccatatgtcagaagaccgcaactaagaagcggaaaacgtttgactcatctcggcagcgagcggaaggaactgacattcctactgtgaaaccactgaagcccagacctgagccaccaaaaaaaccgtcaaactggagaagaaaacatgaggaatttatcgcaaccattcgcgctgctaaggggctcgatcaggcattgaaggaggggggtaaactcccacctccaccccccccatcctacgacccagactacatccaatgcccttattgccagagacggtttaacgaaaatgccgctgaccgccacattaatttttgtaaggaacaagctgcccggatttcaaacaaaggaaagttcagtactgacactaaagggaaacctacctcgcggacccaggtctacaaacctccagcactcaaaaagagcaattcaccggggaccgcttctagcgggtcctctagactcccccaaccgagcggagctggcaagacggtggtgggagtgccaagcggtaaagtttcgtctagttcctcctcactgggaaacaaactgcagactttgtcaccttcccacaagggtattgccgccccccacgctggggcaaacgtaaaaccacggaacagtactccgccttcccttgccaggaatcccgctcccggagttttgacaaataaaagaaagacatacaccgaatcttatatagcccgccctgacggggattgcgcctcttctctaaatggaggaaacattaagggtatcgaggggcattctcccgggaatttgccaaagttctgccatgagtgtggaactaaatatcctgtagagtgggctaaattctgctgcgaatgtggtattagaagaatgatcctgtag

SEQ ID NO: 47272 - DNA, 828 bp, Artificial Sequence
  Description of Artificial Sequence: Synthetic coding sequence
atggccggcctgcagcggctggccagccacctgcccgtgggcgtgatgctcccacataatacgacagaggcccctggccctcattctgctaagcaggattcatatgaacaaggtgatagtagccagcaatctctgaagggtcacctgagaaataatttccaaaagcagctgctaagtaataaagaactgattttggacaaagtgtatacccacccaaaatggaacacccaaacgaaagcacgttcatacagttacccccactgcacaggaatatcacagcaggatccagagagcgacagtcaggggcagggaaacggactattctattcatccgggcctcagtcctggtaccctaaggcaaataaccaggatttcataccatttactaagaagagagtgggagttgaccgagcgtttccccttaagccgatggtccatcgcaaatcctgctcaactggtgaagccggcactgacggtgatcataatgtctaccctcgccccccagaaccaagagagttttcgagccgcaacttcggagttagaaaccaggggaatttctcagttgtgggaactgtgctggcagctacacaagcagagaaggccgtggctaactttgaccgcacagagtgggtgcagatcaggcgtctggaggccgccggtgagtcgctcgaggaagagattcggcgaaagcagatccttttgagagggaaactgaaaaagactgaggaagagctgcgccgaattcaaacacaaaaggaacaagcaaaagagaatgagaatggagagcttcaaaagattatcctcccgaggtccagagtaaagggttag

SEQ ID NO: 47273 - DNA, 1371 bp, Artificial Sequence
  Description of Artificial Sequence: Synthetic coding sequence
atggccggcctgcagcggctggccagccacctgcccgtgggcgtgatgctcccacacaataccacggaggcacctggtccccatagtgccaagcaggattcatacgagcagggggattcatcccaacagagcctgaaaggacaccttcggaacaacttccagaaacaactactgtctaacaaagaactgatcctcgataaagtatatacacaccctaaatggaatacccagacaaaagcaagaagttattcttacccacactgtacaggcatctctcagcaggaccctgagagtgactcccaaggacagggcaacggtctgttttattcctctggcccccagtcttggtaccccaaggctaacaaccaggatttcattcctttcactaaaaagagggtcggagtggatagggccttccctctaaaaccaatggtccacagaaaatcatgctctacaggtgaagcaggaactgacggcgatcacaacgtttatcctcgacctcccgaaccaagggagtttagttctcgaaacttcggagttaggaaccagggaaacttctccgtggtaggaaccgtgctggcagcgacccaagcagagaaagccgttgccaattttgaccgcaccgagtgggtgcagatcaggaggttggaggcagccggagaatcattggaggaggaaatccggcggaaacaaattctgttaagagggaagctgaaaaaaaccgaggaggaattgcggaggatacaaacacagaaagaacaggcgaaagaaaacgagaatggcgaattacaaaagataatcctccccaggtctagagtaaaagggaataagtctaacacgatgtataaacccatatttagccccgaatttgagtttgaggaggaatttagccgggataggagagaggacgagacctggggaagatcccaacaaaacagcggacctttccagttttccgactaccgtattcagcgtctgaaaagagagcgcctggtggcttccaataacaagatccgcgatcctgtctcagagccttccgtagaaaaattctcccccccaagtgagacccccgtgggggccctccagggatcagctcggaatagtagcctgtctatggcacccgatagctctgggtcatctggaagcatcgaggaaccccaattgggcgaatgctctcattgtggacggaagttcctttcctttcggcttgaaagacactcaaatatttgcagcaggatgagaggatccaagagaaaggtgtttgattcttcccgagctagagctaagggcacagagctggaacaatacctgaattggaaaggtcctgcttccgccaaggccgagcccccgcagaaatcaaattggcgctag

SEQ ID NO: 47274 - DNA, 279 bp, Artificial Sequence
  Description of Artificial Sequence: Synthetic coding sequence
atggccggcctgcagcggctggccagccacctgcccgtgggcgtgatgctgccccacaacaccaccgaggccccaggccctcactccgctaaacaagactcttacgaacagggcgattcatcccagcagtctcttaagggtcatctgcgaaacaatttccagaagcagctcctgtctaataaagagttaatcttagataaggtatatacacaccccaaatggaatacccagacgaaagcccgcagttattcttaccctcattgtacgggcatctcctag

SEQ ID NO: 47275 - DNA, 516 bp, Artificial Sequence
  Description of Artificial Sequence: Synthetic coding sequence
atggccggcctgcagcggctggccagccacctgcccgtgggcgtgatgctaccacataataccacagaagcccctggcccccacagcgccaagcaggactcttacgagcaaggggacagctctcagcaaagcctgaaaggccacctgagaaataatttccagaagcagctgttgagcaacaaggaactgatcctagataaagtgtatacacacccaaagtggaacacacagactaaggctagaagttacagctaccctcactgcacaggtatctcacagcaagacccagagtccgatagccaggggcaagggaatggcctgttttattcctctggacctcagtcctggtatcccaaagctaacaaccaggactttatcccatttacaaagaagagggtgggggtggaccgggccttcccccttaaacccatggtgcatagaaaaagttgttccactggcgaggccgggactgatggagatcacaacgtgtacccacgaccaccagaaccgcgatag

SEQ ID NO: 47276 - DNA, 282 bp, Artificial Sequence
  Description of Artificial Sequence: Synthetic coding sequence
atggccggcctgcagcggctggccagccacctgcccgtgggcgtgatgcttccgcacaataccacagaggcaccgggaccgcactccgcaaaacaggacagctacgagcagggcgactccagtcagcagtcattgaagggacaccttcggaacaacttccaaaaacagttgctgagtaataaagaattgatcctcgataaagtttacacgcacccgaagtggaatacacagaccaaggcacgttcatattcctaccctcactgtactggaatctcacagtag

SEQ ID NO: 47277 - DNA, 486 bp, Artificial Sequence
  Description of Artificial Sequence: Synthetic coding sequence
atggccggcctgcagcggctggccagccacctgcccgtgggcgtgatgctcccacataacacaaccgaagctcccggtccccatagcgcaaagcaagattcctacgagcagggggattccagccaacaatctcttaaagggcacctccggaataacttccagaaacagctcctgtccaacaaagaattgattctggacaaggtgtacacccaccctaagtggaatacacaaaccaaagcccgtagttacagctatcctcattgtactggcatttcacagcaagatccggaaagtgacagccaaggccaggggaatggccttttctactcgtctggcccacagagctggtatccaaaggcaaacaatcaggactttatcccgtttaccaagaaacgcgtcggggtcgacagggcgttccctctcaagccaatggtgcataggaagtcgtgctccacaggcgaggcaggcaccgacggcgatcattag

SEQ ID NO: 47278 - DNA, 828 bp, Artificial Sequence
  Description of Artificial Sequence: Synthetic coding sequence
atggccgtggccagcaccttcatccccggcctgaacccccagaacccacattatattcccgggtatacaggacattgccccctgttacgattttccgttggtcagacctacgggcaagtgaccggccaactgctgaggggcccgccaggcctcgcttggcccccggttcacagaactctgctaccaccaatcagacctccgcgatccccagaagtgcccagagaaagccttcctgttaggcgaggtcaggagcgtctgagctcatcaatgattccggggtataccggattcgttccaagagcacagtttatttttgcaaaaaattgtagtcaagtttgggccgaagcgctcagcgacttcactcaccttcacgaaaagcaaggctcagaagaactgcctaaagaggccaaaggaaggaaagacacggagaaggatcaagtgccggagcccgaagggcagttggaagaaccaacgttggaggttgtcgagcaggcaagcccttattcaatggacgatagggatccgcgcaagttctttatgtcaggtttcacaggatatgtgccgtgcgcaaggttcctctttggatcttctttccctgtgctcaccaaccaagcactgcaggaatttgggcagaaacactcaccggggtctgcccaggatcccaagcatctgcctcctctcccacggacatatccccagaacctgggcctcctacctaattacggcggatacgttcctggttacaagtttcagtttggtcacacatttggacatctaacccacgacgctctgggactgagtacctttcaaaagcagctgcttgcatag

SEQ ID NO: 47279 - DNA, 651 bp, Artificial Sequence
  Description of Artificial Sequence: Synthetic coding sequence
atggccgtggccagcaccttcatccccggcctgaacccccagaacccccactatataccaggatatacggggcactgtcccctcctcaggttctcagtcggtcagacttacggacaggtcactgggcagctgctgcgtggcccaccgggtctggcatggcctcccgtgcaccggacacttctcccacccattagaccacccagatcccccgaggttcccagagagtccctgcccgtgaggcgaggacaggaaaggctgagcagttccatgatacctggatacaccggtttcgtgccacgggcacagtttatattcgccaagaactgtagccaggtctgggccgaagcactgtcagatttcacccacctgcacgaaaagcaggggtccgaagaactccccaaagaagccaaaggccgtaaggatacagaaaaggatcaagtccccgaacccgagggacagctggaagagcccactctggaagtcgtggagcaggcgagtccttactcaatggatgatcgcgatccacgcaagtttttcatgtcaggaaccgcagggatttgggcggaggcactgaccaggcagtgcccgggccctcagacttctccaccaacctcccagaacataccctctgagcccggcagcttcacatag

SEQ ID NO: 47280 - DNA, 954 bp, Artificial Sequence
  Description of Artificial Sequence: Synthetic coding sequence
atgaccaccacccagaagcacgacctgttcacccccgagccccactatgtcccagggtacgctggattttttccgcagttaaggtatcaggtgggtaatacctacggaagaactaccgggcagttactaacagatccatcagtgcagaagtccccatgtagcgtgctcagtccaatgagcaagcccaagtttatcgaggacttttcccaatccaaaccacctagggtgccatgccaggacctgacagaaccttatattccgcactacacatctctcaagccttccaaaaatttcgagatcctgggccagctgccaccactggaagtggatgcacaggagcctcccggggtggagaacatacccagacagattctcctgccagccggcttcacgccagatactccacaccccccttgccctcccgggcggaagggagacagtagagatctgggacaccccgtgtacggcgaagaagcttggaaaagcgctacccctgtctgcgaagcacctaggcagcaccagctataccactgccaacgggacgagtatcccccacccgcccggcgccagcaggagaccctggatgtcggtagtttccagcgtcttccccagctggaccatcccaatctgatacagcggaaggctatcagcggctatgctggctttattccacgtttcacctgggtgatggggttaaattatcgagacggcgtgatgcaggccatggacgaattcgacaagagccaatttttatttaggaacccacactgtgatctgggcgaaaagctgcctggcacgcactggccctctaaccacatttatagctctcaagggctgatcccgttctacatgggttttattccagctatgcaggataactatgccctgactttcggcaactcgacacgccgtgcctactggaaggagtgggctaaacgcaatcataccctatag

SEQ ID NO: 47281 - DNA, 816 bp, Artificial Sequence
  Description of Artificial Sequence: Synthetic coding sequence
atgaccaccacccagaagcacgacctgttcacccccgagccccactacgtgccaggatatgccggatttttcccgcaattgagatatcaggtgggaaatacttatggacgcacaacaggccagctcctgactgatccctcagtgcagaagagcccatgcagcgtgctctctcccatgagcaagcccaaattcatcgaggatttctcacaatctaagccaccacgggtgccatgtcaggatctgacggagccgtacattccccattataccagtctaaaaccaagcaagaatttcgaaattctggggcagctgccccccctggaagttgacgctcaggagccacccggcgtcgagaacataccacgacagatcctcctccccgctggattcacccctgataccccgcacccgccatgtccccccggcagaaaaggcgactcccgagatttaggccaccctgtctacggggaggaagcttggaagtctgctactcccgtgtgtgaagccccgcgtcaacaccagctgtatcactgccagcgggatgaataccctccgccagcacggcgacagcaggaaactctggacgtgggaagtttccagcggctcccgcagctggaccatcctaatttgatccagcgcaaggcaatctcggaacaagcctccgggctgggcggccccccactaccaccatcatgttttcaggagccatcgttctcacaagacgaagccgtaccctgtctgcctgtgccaatctggcctcaccagacagtcgccaacgtgcagggcacgaaggggtccttggcttggctgccatag

SEQ ID NO: 47282 - DNA, 780 bp, Artificial Sequence
  Description of Artificial Sequence: Synthetic coding sequence
atggccgtggccagcaccttcatccccggcctgaacccccagaacccccactacatcccgggctatactgggcattgccccctgttgcgcttctccgttggccagacctatggtcaggtgactggtcagctgttacgaggacctccaggactggcttggcctccagttcacaggaccctcttaccccccatcagacccccccgtagtcctgaagtgcctcgcgagagtctgcctgtccgccgtggacaagagcgcctcagttccagtatgattcctggctacaccggttttgtcccccgcgcacaattcatctttgctaagaactgctcacaggtctgggcggaggctcttagcgatttcacgcatctgcatgaaaaacagggcagcgaggaactcccaaaggaagctaaaggaaggaaggacaccgaaaaggatcaggtacctgagccagagggacagctggaggagccaactctagaagtcgtggagcaagcctctccctattcgatggatgaccgtgatccgcgcaagttttttatgagtgcattcttgtgttcaccaacaaggcactgccgaaatctcggcagatccacccatcaggccgtgccacggaccccaaacatatcacctcactttcccgagcacacactgcggacttgggtattttacaactatggcggctacgtcccagggtataagttccaatttggccataccttcggccacctgacgcatgacgctctgggcttatcaacgttccaaaagcagctactggcctag

SEQ ID NO: 47283 - DNA, 492 bp, Artificial Sequence
  Description of Artificial Sequence: Synthetic coding sequence
atgagcctgggcctgctgaagttccaggccgtgggcgaggaggacgaggaggatgaagagggtgagtcactggactccgtaaaggctctcaccgctaaactgcagctacaaacaaggcgcccaagctacctggagtggacggcgcaagtgcagtctcaggcctggcggagggcgcaggccaagccaggccccggcggaccaggcgacatttgtggctttgattctatggattctgccttagaatggctccggagagaactgagagaaatgcaggcccaagataggcagcttgctgggcagttgctgcggctccgggcgcagctccatcggctcaagatggaccaggcgtgccatcttcaccaggaactcctggatgaggccgagctagaattggagctggaacccggcgctggactagccctggcccccctgttaagacatcttggcctgactcgaatgaacatttctgcccggagatttaccctgtgctag

SEQ ID NO: 47284 - DNA, 735 bp, Artificial Sequence
  Description of Artificial Sequence: Synthetic coding sequence
atgaaccccgtgtacagccccgtgcagcccggcgccccctacggcaatcccaagaatatggcgtatacaggctatcctacagcttatcctgcagcggctcctgcctacaacccctctctataccccactaactctccttcttacgcccccgaattccagttcctgcatagcgcctacgcaaccctcttaatgaagcaagcctggccccagaactccagcagctgtggtacagaaggtacctttcatctgcctgtggacactggcacagaaaatcgcacgtaccaggcaagctcggctgcatttcgttacacagccggtactccatacaaagtaccccccacgcaaagcaacacggccccacctccatactcaccaagccccaacccataccaaacggctatgtacccgattcgttccgcctacccccagcaaaatctgtatgctcagggtgcttactacacacagccagtgtatgctgcccaacctcatgttatacaccatactaccgtagtgcagcctaacagcatcccctccgccatatatcccgctccagtcgccgcaccaagaactaacggggtggccatgggaatggtggctggcactacaatggcgatgtccgcggggaccttgctgactacaccacaacataccgcaatcggggcccaccccgtaagcatgcctacatatcgggctcagggcacccccgcatacagttatgtgccaccacactggtag

SEQ ID NO: 47285 - DNA, 708 bp, Artificial Sequence
  Description of Artificial Sequence: Synthetic coding sequence
atgaaccccgtgtacagccccgtgcagcccggcgccccctacggcaatcccaagaatatggcttatactggataccctacagcatacccggcagccgcacctgcctataacccttccctttaccccaccaactcaccgagctatgcccccgcgaccctcctgatgaagcaagcctggccacagaactcatcttcatgcgggactgaggggacctttcatttgccagtcgacaccggcacggagaacaggacatatcaagctagctccgcggcctttagatatactgccggaacaccgtataaggtcccccccactcagagcaataccgccccaccaccctatagcccgtcacctaatccataccagacggccatgtatccaatccggagtgcctatccccagcagaatctttatgcccagggggcttattatactcagcctgtgtacgcagcccagccccatgtgattcaccataccaccgtggtgcagccgaacagtattcctagcgccatctaccctgcacctgtggccgcaccgcggacaaacggtgttgctatgggcatggtcgcggggaccacaatggccatgtccgcggggacactcctgacgaccccccagcacacggcgataggcgcacacccagtcagcatgccgacctatagggctcagggtacccccgcgtattcctacgtgcctccccattggtag

SEQ ID NO: 47286 - DNA, 390 bp, Artificial Sequence
  Description of Artificial Sequence: Synthetic coding sequence
atgaaccccgtgtacagccccgtgcagcccggcgccccctacggcaaccctaagaatatggcatacactggttacccaactgcctacccggcagctgcccctgcctataacccctctctttacccaacaaattccccatcatacgcacccgctactttactcatgaagcaagcctggccacagaatagtagctcctgtgggaccgaaggaaccttccacctgccagtcgatactggaaccgaaaaccgcacatatcaggcaagctccgctgcgttctcaacattgctcaccaccccacagcacaccgccattggcgcacaccccgtgagcatgcccacttatagggcccaaggaactccggcctacagctatgttcctcctcactggtag

SEQ ID NO: 47287 - DNA, 372 bp, Artificial Sequence
  Description of Artificial Sequence: Synthetic coding sequence
atgaaccccgtgtacagccccggcagcagcggcgtgccctacgccaatgcgaaaggtattggatatcccgcgggcttccccatggggtatgccgccgcagcgccagcgtacagcccaaatatgtaccctggggctaatcctacgttccaaacaggctatacacctggaaccccctataaagtatcatgctcacccacctccggcgccgtaccaccctatagctctagcccaaatgcggttcctatgtctccctgtgcagaccagtgggcaaggcagcttgggcagatctccggacagcctttcgttctgctggctgggctgctgtgttggccgcacggggaggctctcgagtcgctgatggactgcaactag

SEQ ID NO: 47288 - DNA, 588 bp, Artificial Sequence
  Description of Artificial Sequence: Synthetic coding sequence
atgaaccccgtgtacagccccggcagcagcggcgtgccctacgccaacgccaagggcatcggctatcccgccggattccccatggggtacgccgccgctgcaccggcctacagccctaatatgtaccctggcgctaaccctacattccagacaggctacacccctggcaccccatataaggtctcatgcagcccaacatcaggggcagtgcccccctactcctccagccccaatccttatcagactgccgtgtatcccgtgcgctccgcgtacccgcagcagtcgccttatgctcaacaaggcacgtattatacgcagcccctctacgcagccccaccacacgtgatccatcatacaaccgtcgtgcagccaaacgggatgccagccacggtgtatccagcaccgatcccacctcccagggggaacggagttaccatggggatggtggccggcacgactatggctatgtccgctggaactctccttactgcacactctccaaccccagttgcaccacaccccgtaactgttcccacgtacagagccccagggactccgacatacagctatgttcccccacagtggtag

SEQ ID NO: 47289 - DNA, 588 bp, Artificial Sequence
  Description of Artificial Sequence: Synthetic coding sequence
atgaaccccgtgtacagccccggcagcagcggcgtgccctacgccaacgccaaaggaataggataccccgccggattccctatgggctacgcggccgctgccccggcctattcccctaatatgtacccaggagcgaaccccacatttcagacagggtacacgccaggaacgccctataaagtttcttgcagtcctaccagcggcgcggtgccgccatattcctccagccctaatccctatcagacagccgtatacccagtgagaagcgcctatccacaacagagtccctatgctcagcaggggacctactacacacaacctctatacgcagcaccccctcatgtaatccaccacaccaccgtagtgcagcccaacggaatgccagctaccgtttatcctgcaccgattccgccccctagaggcaacggggtgacaatgggcatggttgcgggaacaactatggcgatgagtgccggcaccctactcactgcccactccccaacgccagtcgctccccacccagttaccgtccctacctacagggcaccaggcacccctacctacagctatgtgcctcctcagtggtag

SEQ ID NO: 47290 - DNA, 384 bp, Artificial Sequence
  Description of Artificial Sequence: Synthetic coding sequence
atggccttccccgtggacatgctggagaactgcagccacgaggagctcgagaattcagcagaggattatatgtcagatttacgctgtggagatcctgagaatccagagtgcttctccctgctgaacattaccattccgatctccctttctaatgtgggcttcgtcccactctacgggggtgatcagactcaaaaaattcttgctctgttcgcaccagaggattccttgaccgccgtggccctgtacctcgcagatcagtggtgggcaatcgacgatatcgtaaagacgtccgtaccatcccgtgagggacttaagcaggaggcatacgtccccttatttctgcccaaggttacaaattgccagttcctgattcagtgtttttag

SEQ ID NO: 47291 - DNA, 2013 bp, Artificial Sequence
  Description of Artificial Sequence: Synthetic coding sequence
atggccttccccgtggacatgctggagaactgcagccacgaggagctagagaattcagccgaggactacatgtcggacttgcgctgtggcgatccagagaaccctgagtgttttagcctactaaatattacgatccctatctccctgtccaatgtgggcttcgtgccactgtacggaggggatcaaacacagaagattttagctctgttcgctcccgaggacagtttaactgctgtggccctgtatctcgctgaccaatggtgggctattgacgatattgtcaagacctcagtcccatctcgggagggcctaaaacaggtctctactctcggtgaacgagttgtgctgtatgtcttgaaccgtatcatctatagaaaacaggagatggagaggaatgagatacctttcttgtgccatagctccacggattacgcaaagattctgtggaagaagggtgaagccatcggattctattcagtcaagccgactgggtcaatttgtgctagttttttaacccagtcctaccagttgccagttctggacacgatgttcctgaggaaaaaatataggggtaaagacttcgggttgcacatgctggaggactttgttgactcattcaccgaggatgccctcgggctgaggtacccactgagtagcttgatgtacacggcgtgtaagcagtactttgaaaagtatccaggtgatcatgaattgctgtgggaagtggaaggcgtgggtcactggtaccagcgaatcccagtgacacgagcccttcaaagggaagccctcaaaatcctggcgctctcgcaaaacgaacctaaacggccaatgtccggtgaatacggccccgcaagcgttcccgagtacgaagccagaaccgaagataaccagtcctcggagatgcaactgactattgattccctgaaagacgcatttgcatccaccagcgagggccatgacaaaacttccgtttccactcatacgcggtccggcaacttgaagcgacccaagattgggaagaggttccaggattctgagttctccagttcgcagggtgaggatgagaagacatctcagaccagcctgacagcgagtatcaacaagttggaaagtaccgcacggccatccgagtccagcgaggagttcctcgaagaagaacccgaacagcgcggcatcgaattcgaggatgagtcctctgatagagacgcccgaccggctttagaaacacagccacagcaggagaagcaggatggagaaaaagaatctgaactagagccaatgaacggcgagatcatggacgattccttgaaaacctccttgatcactgaggaagaggactctacctcagaggtgctggacgaggagctgaaactccagccttttaacagctcagaagactccacaaatttggttcccctggtcgttgagtcatccaagcctcccgaggtagatgcccccgacaaaacaccccggattccggattccgaaatgctcatggatgaaggcactagcgatgaaaagggtcacatggaggagaagttgtctcttctcccccgcaagaaagcccatctcggatcatctgataacgtcgccaccatgtcaaatgaggagcggtcggacgggggctttcccaattctgtcattgctgaattttcagaggagcccgtctcggagaacctgtctcctaataccacaagttctttggaagaccagggcgaagagggcgtgagtgaaccacaggagacgagcacggcgctgccacagtcatcgctgatcgaagtggagctggaagatgtccccttcagtcaaaatgccggacagaaaaatcagtctgaggagcagagcgaggcctcttcggagcagttggatcagtttacgcagagcgccgagaaagcggtagattcctcatccgaggaaatagaggtagaggtgccagtggtggatcggcgcaacctgcgtcgtaaggccaaaggacataagggccccgctaaaaagaaagctaagctgacctag

SEQ ID NO: 47292 - DNA, 261 bp, Artificial Sequence
  Description of Artificial Sequence: Synthetic coding sequence
atggccttccccgtggacatgctggagaactgcagccacgaggagctggaaaattctgcagaggactacatgagcgatttgagatgcggcgaccctgaaaatcccgaatgctttagtctgctcaatataacgatacccatctccctgagtaacgtcgggtttgtcccactctacggcggggaccagacacagaagatactggccctgtttgccccagaagacagtcttaccgctgttgccctgtacctcgctgaccaatag

SEQ ID NO: 47293 - DNA, 672 bp, Artificial Sequence
  Description of Artificial Sequence: Synthetic coding sequence
atggccttccccgtggacatgctggagaactgcagccacgaggagctagagaattcagccgaggactatatgagcgacctacgatgcggggaccccgaaaaccccgagtgtttctcattgcttaatatcacaattccaatctcactgagtaatgtcgggttcgtgccgctgtacgggggcgaccagacgcagaagatcctggcactgtttgcccccgaggactccctgaccgccgtggccctctatctcgccgatcaatggtgggcaatcgacgacatcgtgaaaacttcggttccctcccgcgagggactgaagcaagttagtaccctcggagaacgtgtggtgctatacgtcctgaataggatcatttatcgcaaacaggaaatggagcgaaatgaaatcccatttctgtgtcacagcagtactgattatgccaagattctgtggaaaaagggtgaggctatcgggttctactccgtgaaacctactgggagtatctgtgcaagttttttaacccagtcttaccaactacctgtcctggacaccatgttcctgaggaagaaataccggggcaaggacttcgggctccacatgttggaggacttcgtcgatagctttacagaagatgctctgggcctccggtaccctttgtcatcactgatgtatacatag

SEQ ID NO: 47294 - DNA, 528 bp, Artificial Sequence
  Description of Artificial Sequence: Synthetic coding sequence
atggccttccccgtggacatgctggagaactgcagccacgaggagttagaaaacagcgccgaagactacatgtcagatctcaggtgtggggatcctgaaaatcctgagtgcttttctctgctcaacattacaatacctatctcgctgagcaacgtcggtttcgtgcccctctatgggggtgatcagacccagaagatcctggcactttttgcaccagaagactccctaaccgccgtggctctgtacctggctgaccagtggtgggccattgatgacatcgtcaagaccagcgtcccctctagagaaggacttaagcaagtttctaccctgggtgaacgagtggtgttgtatgtactaaatcgcataatatatcggaaacaggaaatggagagaaatgagatccccttcttgtgccattcctccaccgattacgctaagattttatggaaaaaaggtgaagctatcggcttctacagtgttaagcccacaggctcaatctgtgcgtcgttccttactcagtcctattag

SEQ ID NO: 47295 - DNA, 579 bp, Artificial Sequence
  Description of Artificial Sequence: Synthetic coding sequence
atgaaggtgcagagcttcggcgagcgggtggtgctgttcatcctgaatgcaatcatatttgggaggcttgaacggaaccttgatgacgacgatatgttcttcctcccgcactctgtcaaagagcaggcaaaaatactgtggcgccgcggcgcagcggtgggcttctatacaacgaaaatgaagggccgcctctgcggagacggaaccggcgcgtgctatctcctgccagtgttcgacactgtttttatccgtaggaagcactggcaccggggcctcggtacagccatgctgagagatttttgtgaaactttcccagaagatgaggcgttaggagtcagctgcagcatgtctcctgccatgtaccaggcccaccccggcaacagtgaggacgtgtcacggcatgcaagaacatctcagaatgatcggcctcggcagcctgccccgggagacggatccaaagagaggatgtgtggagaagagctcgaagatacaaaggacgatccagagtgtggggtcgaagaagaggacgctggcctggccggtcaaccacctggaaagttgactcgaagtagcccctag

SEQ ID NO: 47296 - DNA, 579 bp, Artificial Sequence
  Description of Artificial Sequence: Synthetic coding sequence
atgaaggtgcagagcttcggcgagcgggtggtgctgttcatcctgaatgccatcatcttcggtcggcttgagcgcaatctggacgatgacgatatgttttttctgccccactcggtcaaggagcaagccaagattttatggcgccgaggcgccgccgtaggtttctacaccacaaagatgaagggccgtctgtgcggcgatggtacaggcgcatgctacctattgccagtgtttgacacagtgtttattaggaggaagcactggcaccgcggcctgggaaccgccatgttaagagacttctgcgaaacctttccagaggatgaggcactgggtgtcagctgcagcatgagtcccgctatgtatcaagcccatccaggaaacagcgaggacgtgtcaagacatgccagaactagccagaacgacaggcctagacagccggcaccgggagatgggtccaaggagaggatgtgtggggaggaactggaggacaccaaggacgacccggagtgtggcgtggaggaggaagacgccggacttgcagggcaacccccgggcaagctcacgcgatcaagcccttag

SEQ ID NO: 47297 - DNA, 990 bp, Artificial Sequence
  Description of Artificial Sequence: Synthetic coding sequence
atgaagcggcggcagaagcggaagcacctggagaacgaggagagccaagaaacagcggaaaaaggaggaggaatgtccaaatcacaggaagacgctcttcagcccggctcgacacgcgtggccaagggctggtctcaaggggtgggggaggtgacaagtacaagcgagtactgtagctgtgtctcttccagtcgcaaactgatacattctgggatccagagaatccatcgagacagcccccaaccacagagtccacttgctcaggttcaggaaagaggggagacccctccacgatcacagcacgtgtcattatccagttattcaagttacaaaacatgtgtgagttctctgtgtgtaaataaggaagaacgcgggatgaaaatttattatatgcaggtgcaaatgaataaaggggttgctgtatcctgggagactgaggaaacactggagtctttggaaaaacagccgcggatggaggaagttacactgtccgaggtcgtgagagtgggaacccctccgtcagacgtgagcacgagaaatctgctttccgattccgagccgagcggcgaagaaaaggagcacgaggaaagaacagagagtgactcgctgcctgggagccctacagtggaggatacgccacgggcaaagacccccgattggctggtgaccatggaaaatggattccgttgtatggcatgctgtagggtgtttactactatggaagcattgcaggaacacgtacagttcgggattcgtgaaggcttcagctgccatgtctttcacctgacaatggcccagctgaccgggaacatggaatccgagtcgactcaagacgagcaggaagaggagaacggcaatgagaaggaggaggaggagaagcctgaggccaaagaggaagaaggccagcctacagaggaagacctagggctgcggcgctcgtggtcacagtgtcccggttgcgtcttccactctccaaaggatcggaactag

SEQ ID NO: 47298 - DNA, 849 bp, Artificial Sequence
  Description of Artificial Sequence: Synthetic coding sequence
atgaagcggcggcagaagcggaagcacctggagaacgaggagagccaagaaacggctgagaagggcggcggcatccagagaattcaccgagattcacctcagcctcaatcccctcttgcgcaagtccaggagaggggagagacacctccccgctcccaacatgtttcgctgtctagctactcctcatataagacatgcgtgagctccctctgtgtgaataaagaggaaaggggaatgaagatctactatatgcaggttcagatgaacaaaggagtggctgtgtcatgggaaaccgaggagacccttgagagcctcgaaaagcaacctcggatggaagaagtaactctttcggaggtggtgcgagtcggcacccctccttctgatgtgtctactaggaatctcctctctgatagtgagccatccggagaagaaaaggaacatgaggaaagaacagaaagcgacagtcttcctggttcacctacagtcgaggatactccccgtgccaaaactcccgattggctggtgaccatggagaatggctttcgctgtatggcttgctgccgggttttcacaaccatggaagcgttacaggaacatgtacaatttgggattcgagagggcttttcctgtcatgtgttccaccttaccatggcacaattgactggcaatatggagagtgagtccacccaggacgaacaggaggaagaaaacggcaatgaaaaggaggaagaagaaaagcctgaggccaaggaagaagaggggcagcccaccgaagaggacttaggcctgagaagaagctggtcgcagtgccctggctgcgtgttccattcaccaaaagatcggaactag

SEQ ID NO: 47299 - DNA, 735 bp, Artificial Sequence
  Description of Artificial Sequence: Synthetic coding sequence
atgaagcggcggcagaagcggaagcacctggagaacgaggagagccaggagacagcggagaaggggggaggcatacagcgtatccatcgcgacagccctcagccacagtcccccctggctcaggtgcaggaaagaggagaaacaccaccaagatctcagcacgtctccctcagtagttactcatcgtacaagacttgtgtttctagcctctgtgtgaataaagaagagcggggcatgaagatatattacatgcaggtgcagatgaataagggcgtcgccgtgtcctgggagacagaggaaactctagaatcccttgaaaaacaaccaagaatggaggaagtgaccttaagtgaagttgtgcgcgtcggaacccccccgtcagatgtctctacacggaatctcctttcagattccgaaccatcaggcgaggagaaggaacacgaagagcgcacagagagcgatagcctgcccgggagccctacagtcgaggatacacccagggctaagacccccgactggctcgtgaccatggagaatggctttagatgcatggcatgttgtcgtgttttcacgactatggaggccttacaggagcacgtgcagttcgggatcagggagggctttagctgccccaagatgagcaggaggcgaaagatggaaatgagacgtaggcggaagcggaaccagaaacagcggagacggagaggcagtccccaaaagaaaacactggcgtag

SEQ ID NO: 47300 - DNA, 993 bp, Artificial Sequence
  Description of Artificial Sequence: Synthetic coding sequence
atgaagcggcggcagaagcggaagcacctggagaacgaggagagccaagaaactgccgaaaaaggcggtggcatgtcgaagtcccaggaggacgcactacagccgggaagtactagagtggccaaaggctggagccagggagtgggcgaggtaaccagcacttcagaatactgctcatgtgtgtcttcatcacggaaattgattcatagcggcatccagcgcattcatcgcgatagcccacagccacaaagcccattggcccaagtgcaggagaggggcgagactcctccccgaagtcagcatgtgagcttgagctcctatagctcctacaagacctgtgtttcatcgctgtgcgtcaacaaggaagaacgcgggatgaaaatttattacatgcaagtgcaaatgaacaagggcgtggctgtgtcatgggaaacagaagagacactggagtctctggaaaaacagccgcgcatggaggaagtaactctgagcgaggtcgtgcgcgtgggcactcccccaagtgacgtgtctacccgtaacctgctgagtgacagcgaaccgagcggggaagaaaaagagcacgaagagcgaaccgagagcgattcgcttcccggctctcctacggtggaggatacgccccgggctaagacgccggattggttggtaacaatggagaacgggttcaggtgcatggcctgctgtagggtgtttactaccatggaagccttgcaagagcacgtacagtttggaattcgagagggtttctcctgtcatgtgtttcatttgaccatggcccagctcacgggcaatatggagtcagagtctacgcaagacgaacaggaggaagaaaatggcaacgagaaggaagaagaggaaaaacccgaggcgaaagaggaagaaggccagccaaccgaggaggatttgggtctcagacggtcctggtcccagtgcccaggctgtgtgttccacagccctaaagaccgcaatagctag

SEQ ID NO: 47301 - DNA, 852 bp, Artificial Sequence
  Description of Artificial Sequence: Synthetic coding sequence
atgaagtgctacttcaccgaccaccggggcgagcagagccccaccgacgggacaacattgtcattaacgtctccagagtcgacggaggaaagtgtggaagttttttggcccgggaccatacagagagagggaagctcaccgcgccctggccctgccatccctcgggaagagggactgtactttgctgctagagaccgtggcatgagggactggtcttcctcccccagttcagaatcaagcgaataccagtcctacagccaataccaatcctgctgcagttgtatgtgcgatgaggataatgccgcgccccaaagcgtgtgcgcattttatactcacgttcagacggtgcgtggcgtggccgtagcatgggagaccgaggccggtttcgagccagtaacccgaaagcctcggatccacgaagcacagttcattaagcggcagcgctggaacggcagctcctttgaaatggcctccaacactgatatgcggtgggacctggaggcctgcaagagcaattgctccccagaacccgaggatatcgatctcttggagtgttgcctgcaggagcttcgcgagccccccgattggctcgtgacaacaaactacggagttcgctgcgtggcatgctgccgggtcctcccgagtctcgatgcactattggagcatgcccagcatggcatccgcgaaggctttagttgtcagattttttttgaagagatgctcgaaagacgccgcgcacaggggcaggcccatgatcagcagctggaggaggaacagtcgccatccgacaatagcgagtgctcgcggccacaaggcgaggtactgtccgctcagcagcaggagaagcagtag

SEQ ID NO: 47302 - DNA, 498 bp, Artificial Sequence
  Description of Artificial Sequence: Synthetic coding sequence
atggacgccccccggcgggacatggagctgctgagcaacagcctggcagcctacgcacatattcgcgccaacccagagagctttggtttatacttcgtcctgggagtctgttttggtctattattgaccttatgtctcctagtgatatctatctcttgggctccaagaccacggccaagaggccctgctcagagacgcgatcctagatctagcaccttggagccagaggatgacgacgaggacgaggaggataccgttactcggctgggacccgatgatacactccccggccccgagttgtcagcggagcccgatgggcctcttaatgtgaacgtgtttacctcagccgaagaacttgagagagcccagcgtcttgaggagagggagcgcatattgagggagatttggagaaccggtcagcccgacctgctgggaactggcactctggggccctcccctaccgccaccgggacactcggccggatgcattactactag

SEQ ID NO: 47303 - DNA, 711 bp, Artificial Sequence
  Description of Artificial Sequence: Synthetic coding sequence
atggaggtgggcctgcccgccatcaccctgttcctgaccagcgcctccagcccagtggtggccacaactatggaccaggagcccgtggggggagttgaacgcggagaggccgttgctgcaagtggagccgccgctgccgccgcttttggagaatccgccgggcagatgtctaacgaaaggggttttgaaaacgtcgagctgggagtgatcggaaaaaagaagaaggtcccaagaagggtcatccattttgtttcaggtgagacaatggaagaatacagcactgatgaggatgaagtggatggcttggaaaaaaaagatgtcctccctacagttgacccaactaagctgacctgggggccctacctctggttctacatgctgagggctgcaacatccaccttatcagtatgtgatttcctcggcgagaaaatcgcatccgtattgggaatcagcacccccaaataccaatatgctattgatgagtactatcgtatgaagaaagaagaggaggaggaggaggaagagaaccggatgtccgaggaagccgagaagcagtaccagcagaacaagctgcagaccgacagtatcgtacagacagaccagcctgaaactgtgatctcatcatcgttcgtgaatgtgaacttcgagatggagggggactcggaagtgattatggagtccaaacagaatcccgtgtctgtacctccctag

SEQ ID NO: 47304 - DNA, 642 bp, Artificial Sequence
  Description of Artificial Sequence: Synthetic coding sequence
atggaccaggagcccgtgggcggcgtggagcggggcgaggccgtggccgcctctggcgccgcagcagccgccgccttcggggaatctgccggacagatgtcaaatgagcgtgggtttgaaaacgtggaacttggtgtgatcggaaagaaaaaaaaagttccccggagagtcatccacttcgtttccggcgagacgatggaggagtatagcacggatgaggacgaggttgacggattggaaaagaaggacgtattgcccaccgtagacccgaccaaactgacctggggaccatacctatggttttacatgctgagagctgccacatccactttgagtgtgtgtgatttccttggggagaaaatcgcctccgtgctgggcatcagcacccccaagtatcagtacgccattgacgaatactatcgcatgaagaaggaggaagaagaagaggaagaggaaaatcggatgagcgaggaggctgagaaacagtatcaacagaataagcttcagaccgactcgattgtacagaccgatcagccggagacagtgattagtagctcttttgtgaatgtcaattttgaaatggaaggagatagcgaggttatcatggaatctaagcaaaatccagtgagcgttccaccatag

SEQ ID NO: 47305 - DNA, 642 bp, Artificial Sequence
  Description of Artificial Sequence: Synthetic coding sequence
atggaccaggagcccgtgggcggcgtggagcggggcgaggccgtggcagcaagtggagccgccgctgccgcggccttcggtgagagtgccggtcagatgtccaatgaaagaggcttcgaaaatgtggagctgggagtaattggtaaaaagaagaaagtgcccaggagagtgatccacttcgtgtccggagagacaatggaggaatattctacagacgaagatgaggtagacggactggaaaagaaggacgtcctacccactgtggaccctactaaacttacatggggaccatatctatggttctacatgttaagagccgctacaagcacgctttcagtgtgcgatttccttggtgaaaagatcgcctcagtacttggcatatctacccccaagtaccagtatgcaattgatgagtactatcgcatgaaaaaggaagaggaagaggaagaggaagaaaatcgcatgtcagaggaagcagagaaacaatatcagcagaacaagctgcagacagactctatagtacagactgaccaacctgagactgtgatctcatccagtttcgttaatgtcaattttgaaatggagggggattcagaggtcataatggagtccaaacagaaccccgtaagcgtaccgccttag

SEQ ID NO: 47306 - DNA, 231 bp, Artificial Sequence
  Description of Artificial Sequence: Synthetic coding sequence
atggaccaggagcccgtgggcggcgtggagcggggcgaggccgtggccgcaagcggggccgccgctgccgccgccttcggtgagtctgccgggcagatgtcaaatgaacggggattcgagaatgtcgaactaggggttattggaaagaaaaaaaaagtccccagacgggtgatccatttcgtctccggggagacaatggaggagtatagcactgatgaggatgaagtctag

SEQ ID NO: 47307 - DNA, 477 bp, Artificial Sequence
  Description of Artificial Sequence: Synthetic coding sequence
atggagatcgacggcttccagcagctggacctggagaagagcgtgccctctaagaaaactacccccaaaagaattatccacttcgtggacggagatataatggaggagtacagcacagaggaggaagaggaggaagaaaaggaggaacagagcacaaatagtactctcgacccatctaaattgtcttgggggccctatttaagattctgggccggtcggattgccagcacctccttttccacctgtgaattcctcggagggagattcgccgtgtttttcggtctgactcagcccaaatatcaatacgtcttaaacgagttctatagaatacaaaacaaaaaatccgataacaaatctgagcgcagaggatccaaggcacaggcggcagaagtgccaaatgagaaatgccatctagaagctggagttcaggaatacgggacaatccagcaagacgtaaccgaggctattccccaatag

SEQ ID NO: 47308 - DNA, 303 bp, Artificial Sequence
  Description of Artificial Sequence: Synthetic coding sequence
atggagatcgacggcttccagcagctggacctggagaagagcgtgcccagcaagaaaactacccctaaaaggataatccacttcgtggatggcgacataatggaggaatatagcactgaggaagaggaggaagaagagaaagaagaacagagcacaaacagtaccctggacccgagtaagttgtcctgggggccttacctgaggttctgggcggggagaatcgcttccactagtttcagtacttgcgagttccttggtgggaggttcgccgtattctttggtctgactcagccaaagtactag

SEQ ID NO: 47309 - DNA, 477 bp, Artificial Sequence
  Description of Artificial Sequence: Synthetic coding sequence
atggagatcgacggcttccagcagctggacctggagaagagcgtgccgtcgaaaaaaaccaccccgaagcgtattattcattttgttgacggagacattatggaggagtattccaccgaagaggaggaggaggaagagaaggaagaacagtctacaaactctacgctcgatccttccaagctgagctggggcccctacttacgcttctgggccggtagaattgccagcacatcgttctccacatgcgagttcctggggggccgcttcgctgttttttttgggcttactcagccaaagtatcagtacgttctcaacgagttctatcgcatccaaaacaagaagtccgacaacaaatcagagcgccgcgggtctaaggcccaagctgccgaggtccccaatgagaagtgtcatcttgaggccggcgtgcaggaatatggcacaattcagcaggacgtgaccgaagccattcctcaatag

SEQ ID NO: 47310 - DNA, 300 bp, Artificial Sequence
  Description of Artificial Sequence: Synthetic coding sequence
atggagatcgacggcttccagcagctggacctggagaagagcgtgcccagtaaaaaaactactccaaagaggatcattcatttcgtggacggggacatcatggaagaatactctactgaagaggaggaagaagaggaaaaggaggaacagtcaacaaactccactcttgacccctcaaaactatcctgggggccttacctcagattttgggcagggcggattgcgtctacctctttcagtacatgtgaattccttggcgggcgcttcgccgtgttttttggactgacccagcccaaatag

SEQ ID NO: 47311 - DNA, 1944 bp, Artificial Sequence
  Description of Artificial Sequence: Synthetic coding sequence
atggccggcccccaggagaccgtgctggccctgcccctgcgggagggggtgcaggcagccgccacggtgcccatactcttgtataatctcgaagacggcttaagcgaccaccctctcgaccagggcccacggtgtccggcaaggcgaccttgcagccccgcaagcgccccagcgccgaccagccctaagaaacccaaaatccaggcgcccggcgagacctttcccaccgactggagtcctccccctgtggagttcctaaacccgagagtgcttcaagcttcacgcgaggcgcccgcgcaaaggtgggtaggggtcgttggtccacaagggctcagaaggcttgccggtgagcttccagaagaattggagcaggaacacctcgacctcgacccaaaacgtggcctagctctccctgagaagctgttttggaacacgagcggcctgtcccaacaggcggccgcccctgagtttagctggggaggctcggggagctactttaacaacttggattatttgctccaggaaaagagagaacaagccctggagcaggagagagagcgacttttgttgcaagaatgcctgaatttaaattcattggacctggacgaggaggaagttcccttaacgccagaacatcgaatgcttgtcgaaaaatactcggttagcttacaaaccatcccacccgtccacccaggggaaacggttttcctgccgcggtgccatcccttaccttgtatactggactccagtctccttaaaccacgctcgcacctggagggcctgttccttagctccccaccggcacaacagctctcttttctgcggagcggccttctgaacatactgtaccttcatatgccggattgtcctgtgagccttctgcagtggctgtttcagctcctgacctggcctccggaaacttctctaggcgccttcggactgttatgggacctgatcgtcgacggcatctttttgcaaccagacgaggataaacacctctggtgcccatcactccaagaagttcgggaagccttccattccctaggcgcccattccccagccctgtacccacttggacctttttggcacggcgggcgcgtcttacccggggaagcaggcctgaatgaaaacgaggagcaggatgccccacaggaaatcgcactcgacatcagtctcggacatatctacaagtttctagccctttgcgctcaagcacagccgggggcgtataccgacgagaatctgatggggcttatcgaattgctgtgtcgtaccagtttggatgtgggtctcaggctacttcccaaagtggatctgcagcagctgctgttgcttctccttgaaaatatcagagaatggcctggtaagttacaagaactctgctgcacactgagttgggtgtccgaccatcaccacaacttactggctctggtgcagtttttcccagatatgacctcccggagcagaagactacgtagtcagctatctcttgttgtcattgctcgaatgcttggtcagcaggagatgctgccactgtggcaggaaaagacccagctgtcatcactgagtcggctcctcggtctcatgagaccgtccagcctgaggcagtacttggacagcgttccactacccccgtgtcaggaacaacagcctaaggcaagtgcagagctcgatcacaaagcttgttatctttgtcactccctcctcatgctcgcaggcgtggtcgtgtcctgccaggacataaccccggaccagtggggcgaacttcagctgctctgcatgcaacttgatcggcacatctcaacacagattcgagaatctccacaagcaatgcaccgcaccatgcttaaagatctggctacccagacgtacatccgatggcaggagctgctgacccattgccagcctcaggcccagtacttcagtccatggaaggatatctag

SEQ ID NO: 47312 - DNA, 360 bp, Artificial Sequence
  Description of Artificial Sequence: Synthetic coding sequence
atgcggcccagcagcctgcggcagtacctggacagcgtgcccctgcccccctgccaggagcagcagcctaaggcgagcgctgagctcgatcacaaagcatgctacctgtgccattccctcctgatgttggccggagtggtggtttcttgccaggacatcacaccagatcaatggggcgaactgcaactgttgtgcatgcaactcgaccgtcatatatctacgcaaatccgggagtcaccacaggcaatgcatcgcacaatgttgaaggatctggccacgcaaacatacatcagatggcaagagcttctgactcattgtcagccacaggcccagtacttcagtccctggaaggacatctag

SEQ ID NO: 47313 - DNA, 2484 bp, Artificial Sequence
  Description of Artificial Sequence: Synthetic coding sequence
atggcccacgagcgggagatcctgaagggcatgtacgaggagctgaaagagaaatcccataaaccagacgtggagctgattcagcaccgagcatggagaatagacatggtcagcaccgagctggagtcatttagaaaggcatcttacattgagtccgggccagaggagttttatcaaaggttcaaaaaatgcttctcagcgacccacattttcatctcaattaagggtaaagactcacaaaacacagcccatgggtatttgatactgaatcgaacactgcaccagcagctgaaaatcaagaacccatttctggcacctagcagtgaggccgtcaggattcccgctactctgccacatcccggagctctgccttttcctccttatgtagctaaagcatcgagcgacgagctgctgaacttgcagaagccacttcagtcagccctagggtttgtgattctgagatcttcccagaactggaactccaaaaatcgccagaggtggtcacgcacaaaggccggacaaatgtcccacggtctccagatggctgggcctcaggagactgttctggccctaccactgagagagggtgtacaagccgctgcaaccgtgcctatcctgctatataacctggaagacggcttgagcgatcatcccctggaccaaggcccccggtgtcctgctcgtcgcccttgctcgcctgcctcagcacccgcacctacctctccaaagaaaccaaagatccaggcccctggggaaactttccctactgactggtctccaccaccagttgagttcctgaacccccgcgtcttacaggcaagtcgcgaagcgcctgcccagcggtgggtcggagtagtcggcccacagggattacgcagactggccggcgagctgcccgaagaattagagcaggagcatctagacttggaccctaagcgtgggctagccctgcccgaaaaactattctggaacacatccgggttatcacagcaggctgccgctcccgaattctcctggggcggctctggcagctactttaacaacctggattacctattacaggaaaaaagagaacaggcactcgaacaggagcgggagaggcttttactgcaggaatgtttaaacctgaatagccttgacctggacgaggaggaagtccctttaacaccagaacataggatgctagtggaaaagtactctgtcagtttgcaaacaataccaccagtgcaccctggtgagacagtgtttttaccaaggtgccatcctctgccatgcatcctggattcttcgttgctcaagcccagatctcatctcgaaggtcttttcctcagcagcccaccagcgcaacagcttagcttcctgcgctccggactgttgaacatcctgtacttacacatgcctgactgcccagtctctctactccaatggctgtttcagttactgacatggccacctgaaacttccctgggagcctttggattgctgtgggatctcatcgtagacgggatctttctccaacccgacgaagacaagcacctgtggtgtccatccttgcaggaggtccgggaagcatttcactctctaggcgctcattctccagcactgtaccctctgggaccattctggcatggcggacgggtcctgcctggagaggcaggcctcaatgaaaatgaagaacaggacgcccctcaggaaatcgcactagacatttccttggggcatatttacaaatttctggctttgtgcgcgcaagcgcaaccaggcgcctatacagacgagaacctcatgggcctgattgagcttctgtgcaggaccagtcttgatgtggggctgcgtctcctgccaaaggtcgaccttcagcaactgttgcttctgcttttggaaaatataagagaatggcctggaaagctgcaagaactgtgctgtaccctgagctgggttagtgatcatcatcacaatcttctcgctctggtgcaattcttccctgacatgacttcaaggtcccgacgcctcaggtctcagctctcattagtggtgatcgcgcgaatgctggggcaacaggaaatgctgcctttatggcaggaaaaaacacagctgtcaagtctctctcgcttgctggggctgatgcggccctcgtctctgagacagtatcttgacagcgtacccctgcccccatgtcaggaacaacagcctaaggctagtgccgagctagatcacaaggcctgctacctatgccattccttgctgatgcttgctggagtcgtcgtttcctgccaagacataacgcctgatcagtggggagaactgcagttactctgcatgcagctggacaggcacatttcaacgcaaattagggaaagtccccaagcgatgcaccgtaccatgctgaaggacctggcaacacagacttatattaggtggcaagagctcctgacgcactgccaacctcaggcgcagtatttctctccgtggaaagatatatag

SEQ ID NO: 47314 - DNA, 2040 bp, Artificial Sequence
  Description of Artificial Sequence: Synthetic coding sequence
atgtggccccggctgcccggcgccggcctggccccccagctgcggcgccaggatcaaagattgcacttcacaggccagatgtctcatggcttacaaatggccggcccacaggagacagtattagcactccctctccgcgaaggggtccaggcggcagccacagttcccatactcttatacaacctggaagacggtcttagcgatcacccgctcgaccagggcccccggtgcccagcacgccggccttgctccccggcaagcgcacctgccccaacctcgccaaagaagcctaagatccaggctcctggagaaacttttccaaccgattggagtcctcctcccgtggaattcctgaaccctcgggtcttgcaggccagccgggaagctcctgcccagcggtgggtaggggtcgttggcccacagggcttgcggcggctggccggcgagctgcccgaggagctggagcaggagcatttagaccttgacccgaaacgcgggcttgccttgccagaaaagctgttctggaacacctcaggcttaagccagcaggctgcagctcccgagttctcctggggcggtagcggcagctactttaacaatctcgactacctgttgcaggaaaaaagggaacaggccctggagcaggaacgcgaaagactgctgctgcaggagtgtttgaacctcaacagcctggatctggatgaagaagaagtgccactaacccctgaacacagaatgttggtggaaaagtactcagtatcactgcaaactataccccccgtgcaccctggagaaacagtcttcttgccaagatgccaccctcttccctgtatcctcgattcaagcttgttaaagccgcgatctcatcttgagggactgtttctgtccagccccccagcacagcagctctcatttctgcgctcaggcttgttgaacatcctctacttgcatatgccagattgccccgtttccctgctacaatggctgttccagttattgacttggcctcccgagacaagcctcggtgcttttggattgctttgggacttgatcgtggatgggatctttctgcagcctgacgaagacaagcatctgtggtgtcctagcctacaggaggtgcgagaggccttccactcccttggggcccactcacctgccctgtatccactcggtcccttctggcacggcggccgtgtcctaccgggcgaagctggtctcaatgaaaatgaagaacaggacgctccccaggagatcgccctggatattagcctggggcacatatacaagtttcttgccctgtgcgcacaggcgcagccaggagcatataccgacgaaaacctgatgggactgatagaacttttgtgcaggacaagtcttgacgttgggttgcgccttctgcctaaagtggaccttcagcagttgttgttgcttctgctcgagaatatcagagaatggccgggtaaactgcaagagctgtgctgtacactttcctgggtgtcggaccaccatcacaacctcctggcgctggtacaattcttcccagacatgacctccagaagccgtcgcttaagaagtcagctgagtctggtagttattgcccgcatgctcggacaacaggaaatgctgccactctggcaggagaagacacaactttcgtcactttccaggcttctgggactgatgcgacccagctctctgcgccagtatctagatagtgtgcccctccccccatgtcaggagcagcagccgaaggctagtgcggaactcgaccataaagcatgttatctgtgccacagtctcttaatgctggctggcgtggtggtgagctgccaggacatcactccagaccaatggggtgagctgcagctgctgtgcatgcagctcgacaggcatatctccactcaaatccgagaatctcctcaggccatgcaccgtactatgctgaaggatctggcgacgcagacatatatacgttggcaggaattactgactcattgtcagcctcaggctcaatatttctccccttggaaggacatttag

SEQ ID NO: 47315 - DNA, 3060 bp, Artificial Sequence
  Description of Artificial Sequence: Synthetic coding sequence
atgggcacccgggacgacgtgcccgaggccaaggtgctggtgcccgtggccgtgtattgcggaagtatcccccggacctccgcaggaccgagggtgctccctcctggaagcattaatagctctctgcctcatggcgagggcagcctgcagccggagcccagagcactgttaaataatgaggaaccttcacagttattgagagggctgggacagctgggcggcctgaagctggatactccgagcaaaggttggcaagctcgcaacggccaccccagaaaccttagagccctgtccttgggggatcagcctttggtcctattgcctagccctgagtccgaggcaaacagtgtggctcgagataccattcagattaaggacaagctcaagaagcggcggctttcagagggcctggcagcatcctcccgggcatctttggacccagggggaggcccccagggggtccccctccatagcaccataccaagggccacatcacagcgactgctgcgggtgcctcgaccaatgcctcttatccagagcatccccaccacgcctgaggccagtggggtgaaggagaagggtctggacctgcccggatccatccccggtccccacgaacttagacccggcgctcaggaggctcagatctcctggcagtatctgcactgtaatgatgagaaaatgcagaaatccttgggggcaatcgtcattcctcccattccgaaggcgcgcactgtggcagcaacaccttcaagggtccctgggagtcttccctcgccactgcctcctgggcagggtgtgctgaccggactaagagctccaaggactcgactcgccagagggagcgggccccgcgagaaaacaccagcctcactggaaccaaagccccttgcctcccccatccgcgatcgacctgccgctgccaaaaaaccagccctccccttttctcagagcgccccaaccctgaccgcattttctttcgactgtgcacgcgaggcctgccctccactgaaagaggaagatcagaaggaaatcggcacaaagattcaggtgacgatttctaagagtgccagagagaagatgcagcttaaacaaatgaaggagatggagttgctaagaagactggaggaaccaaggacagggcaggaacttacatcgcagtgtctgggtagccagagggccttcatgaaggaaggactgctgcccttgcggggatctggcaccttgtcggttcccacccggctaagtggaccctgtcgcaacgatgtttctattatactacgcaagtgggcttcccgcgctagtctgccaagcatccccatcagtcggcaagaacctcgatttgcacgccacgcgtccgccaatagtcttccagccgtcctaactctaggaagtcctgagtgggaggaagaagaggagatggacttgcgggcttgtaaggagctgcgcccctttagtaacccagaactggggctccgagacgccctgcagtgtctgaacagcagcgactggcagatgaaagagaagggcctagtgtccattcagcgcttggctgcatgtcacagcgaagtgctgactggcaagcttcatgatgtgtgtctcgtggtcacaggtgaagttacaaatttgaggtccaaggtcagccaccttgctatttctacactcggagacctgttccaggccctaaaaaagaacatggatcaagaagccgaggaaatcgcacgctgccttttgcagaaaatggcggatactaacgagtttatccagagagctgccggccagagcctcagggcaatggttgagaacgtgacgctggcccgctctctggtggtgctgacgagtgctggagtgtatcacaggaaccccttgataaggaaatatgccgctgagcatttgagtgccgtcctggagcaaataggcgcagaaaaactgcttagcggcacaagggatagcaccgacatgctggtgcacaacctggtgaggctcgctcaagactctaaccaggatacccgattctatggaaggaagatggttaacattctcatggcgaataccaaattcgacgctttcctcaaacagtccttacctagctacgacctacaaaaggttatggccgcgatcaagcaacagggcattgaagataatgacgagcttcccagtgcaaaaggacgcaaggtgctacgcagtctggttgtgtgcgaaaacggtcttcccattaaggaaggactcagctgcaatgggccccggctcgtgggcttgaggtctacactgcagggaaggggcgaaatggtcgagcagttaagagagctgacaaggttactggaagccaaggactttcggagtaggatggagggggtggggcaactgttggaactgtgtaaagctaaaacagagctggtgacggctcatctagtacaagtcttcgatgcctttactcctaggctgcaagattcgaataagaaagtaaatcaatgggctctggagagctttgccaagatgattccgctgctcagggagtccttgcaccctatgttactgtctataattatcaccgttgcagataacctcaacagcaagaattctggtatatatgccgccgccgttgctgtcttggacgctatggtggaaagtctggacaatttgtgtttactgcctgcactggccggaagagtgcggttcctgtccgggagagccgttctcgatgtgacagatagactggcagtgctcgtagcgtccgtctaccctcgcaaacctcaggccgttgaaaggcatgtgctacctatcctgtggcacttcttaaacacagctactcgtaatggaactctcccaggcccatctggtaatatacggggtgtggtgtgtcgcttgtcaaggagcttacaggaacacatgggctcaaggctgcttgattttgcagcttcacagcccaaacacgtcttgaaaaccctacaggagctcttggatagcgagagcctggggggcagcagaaaagccacagaccggggcgttgctcctgactctaagacaaccggatcttcatacccattccagctggactag

SEQ ID NO: 47316 - DNA, 2895 bp, Artificial Sequence
  Description of Artificial Sequence: Synthetic coding sequence
atgggcacccgggacgacgtgcccgaggccaaggtgctggtgcccgtcgctgtttattgcggctctataccaagaacatccgcgggcccacgagtgctccccccggggagtatcaacagctctttacctcacggggagggatctttgcaacctgaacccagggcgctgctcaataacgaagaaccttcccagctgctgcgaggccttggacaactaggagggttaaaactggacacaccgtctaagggttggcaagcccggaacggacacccacgaaatctcagagccctctctctgggggaccagcctcttgttctgcttccgtcacccgaaagcgaagcaaactctgtggcgcgggacacaatccaaatcaaagataaactgaagaaacgaagactatctgaagggctggctgcaagctccagggccagtctggatcctggtggcggcccccagggggtaccgctgcacagtaccattcctagggctaccagccagaggctacttcgcgttcccagacctatgccattaatccagtctattccaacgaccccggaggcttccggcgtgaaggagaagggcctggacctgccaggaagcattcccggtccccatgagcttaggcctggcgctcaggaagcccagatatcctggcagtatctgcattgcaacgatgagaaaatgcagaaaagcttaggtgcaatagtgatccctcccatcccaaaagcgaggacagtggcagcaacgcccagtagggtcccgggaagcctgccctctccacttccaccaggccagggagtgctcactggcctgagggctccgcgaactcgcctggcaagaggcagcgggccgagggagaaaacaccagcctcattggaacccaaacctctcgcatccccaattcgggatagacccgctgctgcaaagaaacccgctctgccattttctcagagtgctcctaccctgacagcattcagtttcgattgcgccagagaagcttgtcctcctttgaaagaggaagatcagaaagaaatcggcaccaaaattcaggtaacaatctccaagtctgctcgcgaaaagatgcagctcaagcagatgaaagaaatggaactacttcggaggcttgaagagccccgtaccgggcaggaactgactagccagtgtctcggttcccaaagagcctttatgaaagaggccaattctttgcctgcagtgctcaccctggggagtcccgaatgggaggaagaggaagaaatggacctgagggcatgtaaagagctgagacccttcagtaatcctgagctcgggctgagggatgcccttcagtgtttgaattcttccgactggcagatgaaggaaaaagggctcgtgagcatacagagactggctgcgtgccactctgaggttctgacgggcaagttgcatgatgtctgtctggtcgtgactggggaagtcacgaacctacggtcaaaggtgtctcacctggccattagcaccctgggcgatctcttccaggcgttgaaaaaaaatatggaccaggaggccgaggaaatcgcaagatgtctcctacaaaagatggctgacacaaatgagttcattcagcgagccgcaggacagtcgttgagggcgatggtggagaatgtcacgctggccagatctttggttgtgttgacctctgccggagtgtatcaccgaaaccctttgattaggaagtacgccgccgagcatctgtccgccgttctcgagcagattggggccgagaaactgctgagtggaacgcgggactctacagatatgttagtgcataatcttgtccggttagcacaggatagcaaccaggacactaggttttatggccgtaaaatggttaacattttgatggccaacactaaattcgacgcctttctaaagcagtctcttccttcctatgatctccagaaggttatggcagccataaaacagcagggtatcgaggataacgatgagctcccctccgccaaagggcgaaaggtccttagatcccttgtcgtttgcgaaaacgggctaccaattaaggaaggtctcagctgcaatggtcctagactcgtcggtctccgcagcacgctccagggccgcggcgagatggtggaacaacttagggagctgacacgcttgttagaagcaaaggattttaggagtcgaatggagggggtggggcagttgttagaactgtgtaaagcgaaaacagaactggttactgcccatcttgtccaagtttttgacgctttcacacctagactccaggattccaataagaaggtgaatcagtgggccctggagtcttttgccaagatgatccccctcctgagggagtccctgcacccaatgctcctctcgataataatcaccgtggcggataacctcaactccaaaaacagtgggatctacgctgccgctgttgctgttttggacgctatggtcgaatccctcgacaatttgtgcctgttgcctgccttggccggacgagttcgtttcctaagtgggcgggctgtgcttgacgtgacagacaggctggctgtattagtggcaagcgtgtatccacgaaaaccacaggcagtggagaggcatgtcttgcccattctgtggcattttttaaacacggctactcggaatggcactcttcccggccccagcggaaacatacggggcgtggtctgtcgactgtcaaggtcactgcaggagcacatggggtcacggctgctggatttcgccgcgtctcagccaaagcacgttctgaaaaccctccaggaacttctggatagcgaaagcctcggtggttccagaaaggctacagataggggggtggctcccgacagcaagacaaccgggagttcatatccatttcagttagattag

SEQ ID NO: 47317 - DNA, 210 bp, Artificial Sequence
  Description of Artificial Sequence: Synthetic coding sequence
atgggcacccgggacgacgtgcccgaggccaaggtgctggtgcccgtcgcggtgtattgtgggtccatacctcgtaccagtgctgggccccgcgtcctcccccccgggtcaatcaattcctctcttccacacggcgaaggatctctgcagcctgagccgcgcgctctgttaaacaatgaggagccatctcagctcctcagggggctctag

SEQ ID NO: 47318 - DNA, 5163 bp, Artificial Sequence
  Description of Artificial Sequence: Synthetic coding sequence
atggccgccgcccccagcgccctgctgctgctgccccccttccccgtactatcaacttacaggctgcagagccggtctcggccgagcgcccccgaaactgacgattcaagggtggggggaataatgagaggcgaaaagaattattacttccgcggcgctgctggggaccatggttcctgccctacaactacaagtcctttagcatccgctcttcttatgccttctgaggccgtgtcctcctcttggtcagagagcgggggcggattgtccggcggcgacgaagaggacacgagactgttgcaactgttgcgtaccgcgagagatccgtcggaggccttccaggctctgcaagcagcactccctcgcagagggggtcggttaggctttcctagacggaaagaggccctctaccgggcgctgggccgcgtgcttgtagagggcggaagcgacgagaagcggctgtgcctgcagttgttgtctgatgtgctacgtggtcaaggcgaagcgggacagcttgaagaagccttcagcctggcactgttaccccagctggtggtgtccctgcgagaggagaatcccgcactacggaaagacgcactgcagatcctgcatatctgcttgaaaagaagcccaggagaagtactgcgaaccctgattcagcagggacttgagagcaccgacgcaagactccgagcttccaccgctctgctgttacccatcttgctgaccactgaagacctgctgttggggctggacctcaccgaggttatcatttctctggcccgtaaactgggagatcaagagactgaggaggaaagtgaaactgccttcagcgcccttcagcagattggcgagcggctgggccaggatcgcttccaatcctacatctcacgtctgccttcggccctgcggcgacactacaaccgcagactggagagccagttcggatctcaagtgccttactatcttgagttagaggctagcggtttccccgaagacccattgccctgtgcagttactctgtcaaactccaatctcaagtttggaatcatcccacaagaactgcattcccggctcttggaccaggaggattacaagaaccgtactcaggccgtggaggaattgaagcaggtgttgggcaagtttaacccaagctccacgccacatagcagcttagtgggttttatcagtcttctgtacaatctcctggatgattctaattttaaggtcgtgcatggtaccttagaagtgttgcacctccttgttattcggttgggagaacaggtgcagcagtttcttgggccagtaatagcagcttccgtgaaagttttggcggataataaactggtgatcaagcaagagtacatgaagatcttcctgaagcttatgaaagaggtgggaccccagcaggtgctttgtcttctgcttgaacacctcaaacataagcacagtagagtccgggaggaagtcgtgaatatttgcatatgctcattgttaacgtatccatctgaggacttcgatctccccaagctgtccttcgacctcgctcccgctctggtggatagtaagcgacgcgtcagacaggcagcactcgaggctttcgccgtccttgcatcatctatggggtccgggaagacaagcattctgttcaaagctgtcgataccgtggaacttcaagacaacggtgatggggtgatgaacgcggttcaagctcgattagcgagaaagacacttcctcgtttgaccgagcagggctttgtggaatatgctgtactgatgccctcatcggcaggaggccgcagtaaccatttagctcacggcgctgacacagattggctccttgccggcaacagaacccagagcgcccactgccactgtggcgaccacgtccgagactccatgcacatttacggatcctactctccaactatctgcacccgcagggtgctttccgcaggaaagggcaagaataagttaccctgggagaacgagcaacctggcatcatgggcgagaatcagacttccacctccaaagacatcgagcaattctccacctacgacttcatcccctccgccaaactgaaattgtcccaggggatgcctgttaacgatgacctgtgttttagccggaagcgcgtctccaggaacctatttcagaatagccgggactttaatcccgactgtctgcctttgtgtgccgccggaacaactgggacgcaccagactaacctgagcgggaaatgtgcccaactcggcttttcacagatctgcgggaagaccggtagcgtggggtctgacttgcagtttctggggactactagcagccatcaggagaaggtgtacgcctcactgaacttcggttccaaaactcagcagacgttcggtagccagaccgagtgtacgagctcaaatggacagaacccatctccaggcgcttatatcttaccatcgtatcccgtgtcatcccctagaacatcaccgaagcatacttccccactgattattagtcctaagaagagccaagacaatagtgtcaatttcagcaactcttggcccctgaaatcttttgagggactcagcaagccatcccctcaaaaaaagctggtcagccagaaaagctcagaccctacaggccgcaatcacggagagaactcacaagagaagccccctgtgcagctcactcccgcactggtgcgctccccctcttctcgtcggggtctaaacggaacaaagcccgtgccacccatcccaaggggtatctccctcctgcccgacaaagccgatttatctaccgtcgggcacaaaaagaaagagccagatgacatctggaaatgtgagaaggacagtctgcccatcgacttatccgagcttaatttcaaggacaaagacctcgaccaggaggagatgcactcgtccctgcgaagcttaaggaactctgcagccaaaaagcgcgcgaaattatccggatcaacgagcgacctggagtctcctgattctgcaatgaaacttgacctcaccatggattcaccatcattgagtagctcccccaatataaacagctactccgaatcaggagtgtactcacaggagtctctcacatcatccctgagcacaactcctcagggcaaacgtataatgtcggatatctttccaacatttgggtcaaaaccatgtcctaccaggctatcttccgctaaaaagaaaatctctcacatcgcagaacaatctcccagcgcagggtcaagcagcaacccacagcagatctctagctttgatttcacaaccacaaaagcgctgagcgaggactccgtggtggtcgtcgggaagggcgtgttcggatctctgtcaagcgcacctgccacgtgctcccaaagcgttatctcttctgttgagaatggggacacgttctctattaagcaatcaattgaacccccaagtggaatttacggtagaagcgttcagcagaacatctcttcttacctggatgtggagaacgaaaaggatgccaaagtgagcatttcgaagagcacctataataaaatgagacagaaaaggaaagaggaaaaggaactcttccacaacaaagactgcgaaaagaaagagaagaattcctgggagcgcatgaggcatactgggaccgagaagatggcaagcgagagtgaaaccccaacaggggccatttcacaatacaaggagagaatgcccagcgtgacccactccccagagatcatggacctgtctgaacttcggccgttctccaagccggagattgcactgaccgaggcattgaggctcctggcggatgaggattgggaaaaaaagatcgaggggctgaatttcattcggtgcctggccgcattccattctgaaattctgaacaccaaattgcatgagactaattttgccgtggtccaggaggtgaagaatcttagaagcggagtgtccagggcggcagtagtgtgtctgagtgacctgtttacatatctcaaaaagagtatggaccaagagctagacaccactgtgaaggtcctgcttcacaaggctggcgagagtaatacgttcataagggaggatgtggacaaggctctgagggccatggtaaataacgttacccctgcccgcgccgtggttagtttgatcaacggaggccagcgatattatgggagaaagatgctattctttatgatgtgtcaccccaactttgaaaagatgctcgaaaaatacgtgccctcaaaagatctgccctacattaaagatagtgtcaggaatctccagcaaaagggcctcggagaaatcccgttggatactcccagtgctaagggccgcagatcgcatacaggctcagtgggcaatactagaagcagtagtgtctcaagggatgctttcaacagtgctgagagagctgtgaccgaggttcgggaggtgacacgaaagtcggttcccagaaactcccttgagagtgcggagtacttaaaactgatcaccggtttgctcaacgcaaaagatttcagggaccggatcaacggtattaaacagcttttatccgatactgagaacaatcaggacctggtggtcggcaacattgtgaagatcttcgatgcgtttaagagccgcttgcatgattctaactctaaagtgaacctcgttgcattggaaaccatgcataagatgattcctctgttgcgcgaccacctctcaccaatcatcaacatgctgattccagcaatcgtcgataacaatcttaacagcaaaaacccgggcatctatgctgccgcaacaaatgtggtgcaggccctctcacaacatgttgacaactacttgctgctccagcccttctgtaccaaggcccagtttcttaacggcaaagccaaacaggacatgacagagaaactggccgacatcgtgaccgaactctaccagcgaaagccccatgctaccgaacaaaaggtactggtggtgctgtggcacctgttaggcaatatgaccaatagtggaagcctcccaggagccggcggcaacatacggaccgctaccgctaagctctctaaggcattgtttgcacaaatgggacaaaatctgctcaatcaggccgctagtcagccacctcacattaaaaagtctttggaagaattgctagacatgaccatccttaatgagctgtag

SEQ ID NO: 47319 - DNA, 2988 bp, Artificial Sequence
  Description of Artificial Sequence: Synthetic coding sequence
atggccgccgcccccagcgccctgctgctgctgccccccttccccgtgctgtccacataccgcctgcagtcacgctcccgcccctctgcgcctgagacagatgatagtcgggtgggcgggatcatgaggggggagaaaaattattacttcaggggggccgcgggcgatcacggctcatgcccaacgacaacctctcctcttgccagcgccctactcatgccgtcagaagccgtatcaagtagttggagtgagagcgggggagggctcagcggtggggatgaggaggacaccaggctgctgcagttgttgagaactgccagggacccttcagaagcttttcaggccttacaagctgcactgcctcggcgcggtgggcggttgggattccctcgccgtaaagaagcattataccgagcgctaggaagagtcctggtcgagggtgggtccgatgaaaaacgcttgtgtctccagctgctttccgatgttctgcgcggccagggagaagcaggacagctggaagaggctttcagtttggccctgcttcctcagcttgtcgtttcactgcgcgaagaaaaccccgctctgaggaaagacgctctgcagatcctccacatctgtttgaaacggagtcccggcgaggtgcttcgaactctaatacaacagggactggaatctacagacgctaggttgagagcaagcacagctctgttgttaccgatccttctgacgactgaagatttactgctcggtctggatctgacagaggtgattatcagcctggctcggaaactaggcgaccaggaaaccgaagaggaatctgagacagcgttttctgcactgcagcaaatcggagaacgccttggccaggacagattccagtcctatatcagcaggctgccatccgctctcagaagacactacaatagacggttggagtctcagtttggcagccaggtcccttattacttagagttggaggcctctggttttccagaggatcctctgccttgcgctgtcaccttgtcaaactctaatctaaaattcggcataattccacaggaactgcacagccgcctcttggatcaggaagattacaagaatcggacccaagccgttgaggagcttaagcaggtcctgggaaagttcaaccccagctcaactcctcacagttccttggtagggttcattagtctgctgtacaatctcctagatgactctaacttcaaggtggtccacggtactttagaggtgctgcacctgctggtgattagactcggtgagcaggtgcagcagttcctggggcctgtgatcgctgcatctgtcaaagtgctcgccgataataagttggttatcaagcaagagtacatgaagattttcttaaagctgatgaaggaggtaggcccacaacaagtcctgtgcctactcctcgagcacctaaagcataaacacagccgcgtgagggaggaggtcgtaaatatctgcatatgttcgttgttaacatacccatccgaggactttgatctccccaagctgtcctttgatctcgctccagcattagtagattccaaacgcagggtgaggcaggcagcattggaggcctttgccgtgctcgcaagtagtatgggctctggcaagacctccattctcttcaaggcagtcgacaccgttgaactacaggataatggggatggggtcatgaatgcggtgcaggcccgcttggctcgtaaaacactacccaggctcaccgaacagggttttgtggagtatgctgttctgatgccctcaagcgctgggggcagaagtaaccacctggcgcatggcgcagataccgactggttgctggcaggaaacagaacacagagtgcgcactgtcattgtggagatcacgtgcgagactctatgcatatctacggctcctattctcccactatctgtacgcggcgggtactgtccgcaggtaaagggaagaacaaactcccttgggagaacgagcagcctggcataatgggcgagaatcagactagcaccagtaaggatattgagcaattttcaacatatgatttcattccaagcgccaagctgaagctttcacagggtatgcctgttaatgatgacctatgtttttctaggaaacgcgtgagtcggaacctattccagaattcgcgcgatttcaacccggattgtctgccgctgtgtgccgcagggaccaccgggactcaccagactaatttgtctgggaaatgcgctcagttgggcttcagtcaaatatgtggtaaaaccgggagcgtagggtcagatctgcagttcctcggcacaacatccagccaccaagagaaagtctatgcctccctgaatttcggcagtaaaacccagcagacattcggctctcaaaccgaatgtacatctagtaacggtcaaaatccttctccaggcgcctacatattacccagttaccccgtgtcctcaccaaggacatcgcctaaacacacatcaccactaatcatctcacctaagaaatcccaagataatagcgtgaatttctccaatagctggcccctcaaatcctttgagggtctttctaagcccagtcctcagaagaagttagtatcccagaagtcctctgaccccactggcaggaaccatggagagaactctcaagaaaaacctcccgtccagttgacccccgcccttgtgcgcagcccttctagtcgccgagggctgaatggcaccaaaccggtcccacccattcccagagggatttcgctgttgccagacaaggccgacctttctacggtgggccataagaagaaggagccggatgatatttggaagtgcgagaaagattctctgccgatagatctcagtgagcttaatttcaaagacaaggacctagatcaagaagaggttaggcacatcagcaatatttgggtcaagactctgagcaacaaaacctttttttgtaaagaaaaaaatttttcttattgctag

SEQ ID NO: 47320 - DNA, 3483 bp, Artificial Sequence
  Description of Artificial Sequence: Synthetic coding sequence
atggccgccgcccccagcgccctgctgctgctgccccccttccccgtattatccacttatcggctccagtcccggtcccgaccgtctgccccggaaactgacgattccagagttggcggtataatgcgaggcgagaagaattattatttcaggggggccgccggagaccatggtagctgtcccaccactacgtcaccgcttgccagtgctttacttatgcccagtgaagcagtgagttcttcctggtccgagtctggaggcggtttgtccggaggagacgaagaggacacacgactgctgcaattactgcgcacagctcgggacccatcagaagccttccaagcattgcaagccgcgctgccaagacgcggtggcaggcttggatttccacgcaggaaggaagcactatatagggcgctgggacgtgtactcgttgaggggggttcggatgagaaacggctatgtctgcagctcttgtccgacgtgttgagaggacagggtgaagccggacagctagaggaggctttttcgcttgctcttcttccccagctggtggtgagcctgcgagaggagaatcccgcactgagaaaggacgcacttcagattctccatatctgccttaagagaagccctggggaggtcctacggacattaatccaacaggggcttgagtccactgacgcccggctgcgcgcaagcacagctcttctgctgcctatcttgttgaccaccgaggatttgttactcggcttagatctcactgaggtgattatcagtttggcccgcaagctcggagaccaggagacagaggaagaatcggagactgccttcagtgccctgcaacagatcggagaacgcttaggtcaggatcgatttcaatcctatatcagtcgcctcccaagcgcactgcggcgccattacaatagacgattagagtcccaatttggttcacaagtaccatactaccttgaactggaagcctccggcttcccggaagacccactcccctgcgctgtcaccctctccaactctaacctgaaatttgggatcattccgcaggagctccattcacggctgctagaccaggaggattacaagaatcgaactcaggccgttgaggaacttaagcaggtgcttggaaaatttaatccgagcagtaccccccacagctcactcgtcggattcataagcctgctgtacaatctcttggacgactcgaacttcaaagttgttcacggtactcttgaagtgttacatctcctggtaataagactcggtgagcaagttcagcagttcctgggcccagtgatcgcagcatctgttaaggtcctggccgataataaactggttatcaaacaggagtacatgaaaatctttctgaagctcatgaaggaagtgggacctcagcaggtgctttgtctcctcttagaacacctgaagcataagcatagtcgggtgcgggaggaggtggtgaatatctgcatctgtagcttgctcacctatccatccgaggacttcgatttaccaaaactgagctttgatctggcgcctgctctggttgattccaagagaagagtccgccaggccgccctggaggccttcgccgtcctcgcatccagcatgggatccggaaaaaccagtatcctctttaaagccgtcgacactgtcgagttacaggataatggcgatggcgtcatgaacgcagtgcaagcccggctggctcgtaaaaccctcccaagattaaccgagcaaggcttcgtcgaatatgctgtgttaatgccatcctccgcggggggaaggagtaatcatttggcacacggagcggacactgattggctgctggccgggaatagaacccaatccgcccattgtcactgcggcgaccatgtgagagactctatgcacatctacggctcctactctccaacaatttgtacgagaagggtcctgtctgcaggaaagggaaagaacaaattaccctgggaaaatgaacagccagggatcatgggagagaaccagacgtccaccagcaaggacattgagcagtttagcacatacgattttattcccagtgcaaagttgaaattgagccagggaatgccagtgaatgatgatctgtgcttcagtcggaaaagggtgtctcgaaatttgttccagaattcgagggatttcaatccagattgtctgcccttgtgtgctgcaggaacaaccggaactcaccagacaaacctaagtggaaagtgcgcccagctaggattctctcagatctgcggaaagaccgggagcgtaggatcagatctgcagtttttaggaactacatcatcccaccaagaaaaggtttacgcttcactgaactttggctcaaagacacaacagacttttggctctcagaccgagtgtactagtagcaatggccagaatccctcaccgggggcatacattctgccgtcgtatccagtgtcttctcctcgaacttctcctaaacacacttctcctttaattatttctcccaagaagtcacaggacaacagcgtcaacttttcaaattcctggcccctgaaaagtttcgaggggctctctaagccatcaccccagaaaaagctggtgagccagaagtctagcgaccctactggccggaatcatggggaaaactcccaggaaaagcccccggtgcagctgacacctgctctggtgcgcagcccttcttctcgccggggtctgaatggcacaaaacccgtgccccccatcccgaggggtatctcactgcttcctgacaaggccgatctctccactgtgggccacaagaaaaaggagccagacgacatatggaaatgtgaaaaggattcattaccaattgacctgtctgaacttaatttcaaggacaaggacttggaccaggaagagatgcatagcagtctgagaagtctgcgcaattcggcggccaaaaagcgagcaaagttgagcggttctacgtctgacctggagtcgcccgatagcgccatgaaattggatctgacaatggattcaccatccctttcgtcctctcccaacatcaattcctacagcgagagcggtgtgtattcccaagaaagcctgacaagtagcttgtccactaccccacaggggaagcggatcatgagtgatatttttccaaccttcgggtctaaaccttgccctacacggctctcaagtgcaaaaaagaagattagccacattgctgaacagtccccttccgcgggctccagtagcaatcctcagcaaatctcaagctttgatttcactaccactaaggcactctctgaggattccgtggtggtagtgggaaaaggggtcttcggcagcctatccagcgccccagctacctgcagccagtccgtcatctcctccgtagagaatggagacaccttcagcattaagcagtctattgaacctccttctggaatctatgggcggtccgtccagcagaatttcatcattagctag

SEQ ID NO: 47321 - DNA, 1032 bp, Artificial Sequence
  Description of Artificial Sequence: Synthetic coding sequence
atgaagctgctgcagatgctgctgcggggcaacccctgctgcccccaaccagaaatctcaccacagggttcatccgttcccttcctaggtgctgcaggccatcagcaaagcttgccatcatcttggaaagcatcttgcagcggccctctggttatggccagcgatagtgatgttaagatgttactgaactttgtgaacttagcgtctagtgatataaaagccgccttggataagtctgccccctgtcgtcggagcgtggatcaccgcaagtaccttcaaaagcagctcaagcgctttagtcagaaatattccagactgccacgcggactccccgggcgagccgctgagccctacttgaagagaggaagcgaagatagaccgcgaagactcctgctagacctcggtcccgacagcagccccggaggcggggggggatgcaaagagaaagtcctgaggaacccataccgcgaagaatgtctcgccaaagaacagctaccccagcgccagcaccccgaggctgcccaaccaggacaggtacctatgaggaagcgccagttaccggcaagcttctgggaggaaccgaggcccactcactcctatcacgtaggccttgagggaggcctgggtcctagggagggaccaccttatgagggtaaaaagaactgtaaggggcttgaacccttgggtccggaaactaccctggtgagtatgtcacccagggccttagccgaaaaggagcctctgaagatgcctggggtgtcactggtcgggcgcgtgaacgcatggtcttgttgtcccttccagtatcacggccagcctatataccctggcccacttggggccctcccgcaatcccctgttccttccctcggactgtggcggaaatcacccgctttccccggcgaactcgcccacttatgcaaagatgttgatgggttaggccaaaaggtctgtcgtccggtcgtgctgaagccaatcccgacaaagcctgccgtgccaccgccaatcttcaacgtgttcggttatctttag

SEQ ID NO: 47322 - DNA, 1065 bp, Artificial Sequence
  Description of Artificial Sequence: Synthetic coding sequence
atgcccctggaggagcggcggagcagcggcgagcggaacgacgccgcacctactaaccatcgccggccaggggagaaaagagcaagcaccgctaagcaggtgagtagcgttcctttcctaggggcagccggacaccagcaaagcctccctagctcttggaaagcctcatgctccggtccccttgtcatggcatccgactccgatgtgaaaatgctcttaaatttcgtgaaccttgcctccagcgacatcaaagccgcactggataaatctgccccctgtcgaagatcagtggaccaccgaaagtacctccaaaaacagctcaagcgttttagccagaaatatagccgactgccgagaggtctccccgggcgggccgctgaaccttatcttaaacgcgggtcggaggatcgcccgaggcgtctgctcctggacttgggacccgactcctcccctggcggggggggtggatgcaaagagaaagtgctaagaaatccttaccgggaagagtgtctcgcaaaagagcagctgcctcagagacagcacccagaggcagctcaaccagggcaggtccccatgaggaagcgacagcttccggcaagcttctgggaagaacctcgccctactcattcttatcatgtcggcctagaaggtggcctcggaccgcgcgagggacctccttacgagggtaaaaaaaactgtaaggggctagaacctctgggtcctgagaccactcttgtgagtatgagccctcgggcacttgccgagaaggaaccgttgaaaatgccaggcgtgtctttggtgggaagagtaaatgcttggtcctgttgccctttccaatatcatggtcaaccaatatatcctggcccactgggggccctgccccagtcgcctgtcccgtcactgggcttgtggcgtaagtcccctgcgtttccaggagagctcgcccatctctgcaaagacgtggacggcttggggcaaaaagtctgcaggccagtcgtgctaaaaccaatccctacaaagcctgcagtgccaccccctatatttaatgtctttgggtatctgtag

SEQ ID NO: 47323 - DNA, 699 bp, Artificial Sequence
  Description of Artificial Sequence: Synthetic coding sequence
atggccagcgacagcgacgtgaagatgctgctgaacttcgtgaacctggcttcttctgacattaaagcagcactggacaagtctgcaccctgcaggcggtctgtggatcatcggaagtatctgcaaaagcagctcaaacgatttagtcaaaagtattcccggctcccccgagggctcccaggaagagccgcagaaccctatttaaaacggggtagcgaagatcgccctcgcaggcttctcctggatctaggcccggacagttcacctggaggcgggggaggatgtaaggagaaggtgcttcgaaacccttatcgggaagaatgcctggcaaaagagcaactgccccagaggcagcatcccgaggccgcccaacctggtcaggtgcccatgagaaagcgccaactccccgcttctttctgggaagagccacggccgacccactcgtaccacgtgggccttgaaggcggactcgggcccagagagggaccaccatacgagggtaaaaagaactgtaagggactggagcctctgggaccagagacaaccctagtctcgatgtcccccagagcactggccgagaaggagcctctgaaaatgccaggcgtttccctggtgggccgtgtgaacgcttggtcttgctgcccatttcagtaccacggacagccaatttaccccggccccctcggcgcactcccatag

SEQ ID NO: 47324 - DNA, 879 bp, Artificial Sequence
  Description of Artificial Sequence: Synthetic coding sequence
atggccagcgacagcgacgtgaagatgctgctgaacttcgtgaacctcgcctcctctgatattaaagctgcactcgacaaaagtgccccttgccgccggtctgtcgatcatcgaaaatatcttcaaaagcagctgaaaaggttttcacagaagtattcacgcctgcctagaggtctacctggacgcgcagccgagccatatctcaaaaggggcagcgaggacaggccacgcaggctgttattagatctaggtccggattccagtcctggtggcggcggtggatgcaaggagaaggtactgaggaacccttaccgcgaggaatgtcttgctaaggaacagttgcctcagcgccagcacccagaggctgcccaacccggtcaggtccccatgcggaagcgccagctgcctgcctccttttgggaggaacctcggccgacccacagttaccatgtcggactcgaggggggtctgggtcctcgtgagggacccccttacgaagggaaaaaaaattgtaagggcctcgaacccttaggacccgaaaccaccctggtgagcatgagtccccgtgcacttgctgaaaaggaacctctgaagatgcctggcgtgtccttggtgggcagggtaaacgcttggtcctgctgcccctttcagtatcatggccagcccatatatcctgggccattaggcgccctgcctcagtcgccagtgccctcactgggcctttggaggaagagcccagcttttcctggcgagctggcccacctgtgcaaggacgtggatgggctgggccagaaagtttgtagacctgttgtgctaaagcccatccccactaagcccgccgttcccccgccaattttcaacgtgtttggatatttgtag

SEQ ID NO: 47325 - DNA, 879 bp, Artificial Sequence
  Description of Artificial Sequence: Synthetic coding sequence
atggccagcgacagcgacgtgaagatgctgctgaacttcgtgaaccttgcctcaagcgacatcaaggccgccctggacaagagcgcaccttgtcggcggagtgtagaccatcgcaaatacctgcagaagcagttgaagcgattctcccagaagtatagccgactgccacgaggcctgcctggtcgggctgccgagccgtacctgaagcgcgggtccgaggaccggccccgcaggttgctccttgatctgggccctgacagtagcccaggcggcgggggtggatgtaaggagaaagtcctcagaaacccatatcgggaagagtgcctggccaaagagcagttgccccagcggcaacatcccgaggcggcgcaaccagggcaggtccccatgcgtaaaagacagctgccggctagtttttgggaagaaccacgccccactcacagctaccatgtcggattggagggcggcttgggcccgcgtgaggggcctccatatgaagggaaaaagaactgtaagggactggaaccattagggcccgaaactacacttgtttcgatgagtccccgcgccttagctgaaaaagaacccctgaaaatgcctggagtgtccctcgtcggaagggtaaacgcctggagttgttgtcccttccagtatcacggacagccaatatatcccggcccactgggtgcattaccacagtcgccagtacccagcctcggactgtggcgcaagagtcccgcatttcctggagagctcgcacacctatgtaaagacgtcgacggcctgggccaaaaagtctgtaggcccgtggtattgaagcctatccccacgaagcctgctgttccacctcccatctttaacgtcttcggttatctgtag

SEQ ID NO: 47326 - DNA, 1281 bp, Artificial Sequence
  Description of Artificial Sequence: Synthetic coding sequence
atggccgtgcaggccgccctgctgagcacccaccccttcgtgccctttgggttcgggggaagtccagacgggctagggggtgcttttggggctctggacaaaggctgctgttttgaggacgatgaaactggggccccagcaggtgccctactcagtggcgccgagggaggagacgtacgagaggctaccagggatctgttatcctttatcgattcagcctctagcaacatcaagttggccttggataaaccagggaagtctaagagaaaggtaaatcacaggaagtatcttcagaaacagatcaaacgctgtagtgggctaatgggcgccgctccacccgggccccccagccccagtgcagctgatacaccagccaagcggcccttagctgctcctagtgcccctactgtcgcggctcccgcacacggtaaagctgcaccgcggcgcgaggctagtcaggcagcagctgccgcatccttgcagtcccggtcactcgctgcacttttcgacagcctccggcatgtgcccgggggagccgagcctgctggtggcgaagtggccgcccccgcggctggcctcggcggagcggggaccgggggtgcggggggtgacgttgccgggccagctggtgccaccgccatccccggcgctcgcaaggtacctttgcgggctagaaacctgccaccaagtttctttacggagccaagcagggccgggggaggaggctgcgggccctctggacccgacgtgtcattgggcgatctggaaaaaggtgcagaggccgtagaatttttcgagcttttggggccagactacggagctggtacagaggcggccgtgctgctggccgccgaacccctggacgtattccctgccggcgcttcagtgcttagaggtccacccgagctcgaacccggactgtttgaaccccccccggcagttgttggcaaccttctgtaccctgagccttggtctgtgccaggctgttcaccgacaaaaaagtcaccactgaccgctccaaggggaggtctaaccctcaatgagcctctatcccctttgtatccagccgccgccgactcgcccggaggcgaggatggacgggggcacttagcttcattcgctcccttttttcctgattgcgccttacctccacctccccctccccaccaggttagttacgactactcggcaggttacagccggacagcatattcctctctgtggagatcggatggggtgtgggagggtgccccgggcgaggagggcgctcatagagactag

SEQ ID NO: 47327 - DNA, 465 bp, Artificial Sequence
  Description of Artificial Sequence: Synthetic coding sequence
atgcagggcatcgaccggtggatccccagcatcccccccctgcagaaccactcggccgtgaaccggcgtcatttcagcgcaccccagaagcttcacgctgattgcgagaaggaaatgttggatggaggtgtccctggaacaaccgtccgagtgtcttttgatttcagttgcttagagatggtgagggagctttggatgtggaatgttgaggaagaggagcacgaggtagggatctcaacgtggggaggccagcattgcgggtgccctgcaaagtcgttgcccggccctcacccagggggcgtttcagcaccccaaagcgcttcacagcttatggtgaagctccttgtatggcagaagtctgtgcacaagttgcgcaagatagctgcacaatcagaggagtggtcctgtgtccttaacaagatatctacacacccctttgtctctaaggagcatgatggcacctag

SEQ ID NO: 47328 - DNA, 234 bp, Artificial Sequence
  Description of Artificial Sequence: Synthetic coding sequence
atggtgcgggagctgtggatgtggaacgtggaggaggaggagcacgaggtaggtatcagtacatggggcgggcagcactgtgggtgcccagccaaatccttacctggtccccaccctggaggagtatccgcgcctcaatctgcctcacaactcatggtgaaactcttggtatggcagaaatctgtgcacaaactgcggaagaacagaaatgcgtacagttgtggaccgctgtag

SEQ ID NO: 47329 - DNA, 234 bp, Artificial Sequence
  Description of Artificial Sequence: Synthetic coding sequence
atggtgcgggagctgtggatgtggaacgtggaggaggaggagcacgaggtgggcatctgtacctgggggggccagcattgcggttgtcccgcaaagtctcttcctgggccgcaccccgggggagtctccgcaccccaatctgcttcacagctaatggtcaaactgctagtgtggcaaaagtccgtgcataagttgagaaaaaatcggaatgcctattcatgcgggcccttgtag

SEQ ID NO: 47330 - DNA, 405 bp, Artificial Sequence
  Description of Artificial Sequence: Synthetic coding sequence
atggccggccaccccaaggagaaggtgatccccgacgaggtgcaccagaatcagatactgcgggagttgtatctcaaggagctccggactcagaagttgtacacccagtaccacgtgaacccattgaggaagatccacacagtaacccgcaaaccgatgagttggcacgacaacctggaagagcctgcagacgctagattcttaaaccttatccaccatgcagctcagggcccacggaaaaaataccccgagacccaaaccgaaaaccaggaggtaggctgggatttggagccactaattaacccagagcggcatgacaggcgactcaatcacttcagggtgtgttcggatattactctgtacaaggcaaaaacttggggcctgggcgatgaccaccacaaatag

SEQ ID NO: 47331 - DNA, 3423 bp, Artificial Sequence
  Description of Artificial Sequence: Synthetic coding sequence
atggccacccccggcatgagctggcagcagcactactacggcggctctgccgcaaaattcgccccttcaccagccactgcccagctcgcaggtcactcaatggactactctcaggaaatgcacctgaagatgtctaagaaaatcgcccagctgactaaagtcatttacgccttgaacactaagaatgacgaacatgagtccgctatacaggcgctgaaggacgcacacgaagaagagatacaacagatcctggcagaaaccagggagaaaattctgcagtacaagtccaaggtcactgaggaactggaccttaggcggaaaattcaagtactggagtcttctctggaggaccatatcaaaatgaaacagcaggccctgactgagttcgaggcttacaagcatagggtcgaggacatgcagctgtgtgctgaggcacagcacgtgcagcggattgtgacaatgagtagggaggttgaggagattcgccggaagtttgaggagaagttaagaagctttggtcagctgcaggtgcagtttgagaaagacaaacgcctagcccttgaggacctgcaagccgcacaccgcagagagatacaagagctgctgaagagccagcaggatcactctgccagtgttaataagggtcaggagaaagctgaagaactacatagaatggaggtcgaaagcctgaacaagatgctggaggaattaaggcttgagcgcaagaagctaatcgaggattatgaaggaaaactcaataaggcgcagtctttctacgagagagagctcgataccctgaagagaagtcagctcttcactgccgagtccttacaggccagtaaagagaaggaggctgatttgcgaaaagagttccagggacaagaggccatcctccgaaaaacaatcgggaagctgaagactgaattacaaatggtgcaggacgaggctggctctctactggataaatgtcagaagctccaaaccgcgctggcaatagctgagaacaacgttcaggttttacagaagcagctggatgatgctaaagaaggggaaatggctcttctgtcaaaacacaaagaagtggaaagcgagctggccgccgcaagggagcggctccaacagcaggctagtgacctcgtgttgaaagccagccatatagggatgcttcaggccacccagatgacccaagaagtgacaattaaggacttagagtccgaaaagtctagggtaaacgagcgtctgtcgcagctggaggaggaacgggcctttctgcggtccaagactcaaagtttggatgaagagcaaaagcagcagatcctggagctagagaaaaaggtgaacgaggctaagaggactcagcaggagtactatgaaagggaactcaagaatctgcagagccggctggaagaggaggttacccagctgaatgaagcacatagtaagacgctagaggaactggcgtggaagcatcacatggctatcgaggctgtgcattcaaatgcaatcagggataaaaagaaactgcaaatggacctggaggaacagcataataaggacaagcttaacctggaggaggataagaaccagctgcagcaggagctggagaacctcaaggaagttctggaggacaagttgaatacggctaaccaagagatcggccacttacaggatatggttagaaaaagtgagcagggccttggaagcgctgagggactcatcgcctctctgcaggactctcaggaaaggcttcagaacgaactggatctgactaaagactctctgaaggaaaccaaggatgccctgctgaatgtcgagggggaactggagcaggaacggcagcagcatgaagagacaatagccgctatgaaagaagaagaaaagctgaaggtcgataagatggcccatgacctggagatcaagtggacggaaaatcttcggcaggagtgcagcaaactgcgcgaggagctaaggctgcagcatgaagaagacaagaaaagcgccatgtcgcaactattgcaacttaaggacagagaaaaaaacgcggcccgcgattcttggcagaagaaggtcgaggacctgctgaaccagataagcctgctgaaacagaatctcgagattcaactgagccaaagccaaaccagcttgcagcaactccaagctcagttcacacaggaaagacagagattgacacaagaactcgaagaacttgaggagcagcaccagcagcgtcacaagtctttaaaagaagctcacgtcctcgctttccaaactatggaggaggagaaagagaaagaacagagagcacttgaaaatcacctgcagcagaagcactccgccgaacttcagtcactgaaggacgctcatagggaaagcatggaggggttcaggatagagatggaacaggagctgcaaactctgaggttcgagctggaggacgagggtaaagcaatgctagcctctttaagaagtgagttgaaccaccagcacgctgctgccatcgatttactacgtcacaaccaccaccaagagttggctgctgccaagatggagctagaaagaagcatcgatatctcgcggaggcagagtaaggagcacatttgccgtatcacggatctgcaagaagagctgcgtcaccgggaacaccacatttcggaacttgacaaagaggtccagcatctgcatgaaaacatcagcgcacttaccaaagagttggagttcaaaggcaaggagattctgagaatccgtagcgagagcaatcagcagatccggttgcatgaacaggacctgaataagaggctagaaaaggaactggacgtcatgacggctgaccatctccgcgagaaaaatattatgcgtgccgacttcaacaaaactaacgagctcctcaaggaaataaatgccgccttgcaggtgagtctcgaggaaatggaggagaagtacctgatgagggaatccaaaccagaagatattcaaatgatcacggagctcaaggccatgctgacagaacgagatcagattataaagaagctaatcgaggacaacaagttctaccagctcgagctggtcaatcgtgaaaccaacttcaacaaagtattcaatagcagcccaaccgtcggcgtaatcaatccactggccaaacaaaagaaaaaaaatgataaaagtccaacaaatagatttgtgtctgtgccgaacttatctgctctggaatctgggggggtcgggaacgggcatcccaatcgtttggacccaattcctaatagcccagttcacgacatcgagtttaacagttctaaaccacttccacagccagttcctcccaaaggccccaaaacctttctctctcccgctcagtctgaagcaagtcctgtggccagcccagacccacaacgccaggagtggtttgctcgatatttcaccttttag

SEQ ID NO: 47332 - DNA, 2916 bp, Artificial Sequence
  Description of Artificial Sequence: Synthetic coding sequence
atgaagcagcaggccctgaccgagttcgaggcctacaagcaccgggtggaggacatgcagctttgtgccgaagcacagcacgtgcagagaatcgtaacgatgtcaagggaggtggaagaaattcggcgcaaatttgaggaaaagctgcgctcttttggacagctacaggtgcagtttgagaaggacaaacgtctggcactagaagacctgcaagccgctcacagacgcgaaattcaggagcttcttaagtctcagcaggaccatagcgctagtgtgaataaagggcaggaaaaagcggaggagttgcatcggatggaagtagaaagcctgaacaagatgttggaagaactgagactggaacgaaagaagctgatcgaagactatgaaggtaagctgaataaagcgcagagcttctacgaaagggagctggataccctgaagcgatcccagttatttaccgctgagtccctgcaggctagcaaggaaaaagaggccgatctgaggaaggaatttcagggtcaggaagccatcttgaggaagacaatcggcaagctgaaaactgagctgcagatggttcaggatgaagctggctctcttctggacaagtgtcagaaattgcagacagcgctggccatcgctgaaaacaacgttcaggtgttgcagaagcaactggatgacgctaaagagggggagatggcgcttcttagtaagcacaaagaggtagagtccgaactggctgccgcacgcgaacgcctccaacagcaggcaagtgacctggtgctgaaggcgtcccatatcggcatgctgcaggctactcagatgacccaagaagtgactatcaaagacctcgagagcgagaaaagtagagtcaacgagcggctgtcccagctggaggaagaacgcgctttcctgaggagcaaaacccagtccctcgacgaagaacagaagcagcagatcctggagcttgagaaaaaagtcaatgaagcaaaacgaacccaacaggaatattatgaacgggaacttaaaaacctacagtcccgcctagaagaggaggtgacacaactgaatgaagctcactcgaaaacattggaggagctggcgtggaaacatcacatggctattgaagcagtgcactcaaacgccattagagacaagaagaaactccagatggacttagaagaacagcataacaaggacaagcttaatcttgaggaggacaaaaaccaactgcaacaggaacttgaaaatttgaaggaagtccttgaagacaagctgaataccgccaaccaagagattggtcatctgcaggatatggtacgaaagtcagagcaaggcctagggtccgcagagggccttattgcttctcttcaggactcacaggagcgccttcagaacgaacttgatttaacaaaagactctttgaaggagaccaaagacgcccttctgaatgtggagggggaactggagcaggagaggcagcaacatgaagagacgatagcagccatgaaagaggaggagaaactcaaagttgacaaaatggctcacgacctcgaaatcaaatggaccgagaatctgcgtcaggaatgttccaagcttagggaggaactgaggctccagcacgaagaagacaagaaatcggccatgtcccagctcctccagctgaaggacagggagaagaatgcagcaagggacagttggcagaagaaagtggaagacctgctgaaccaaatttcgttgctgaagcagaacctggagatacagcttagtcagtctcaaacaagcctacaacagctgcaggcacaattcacccaggaaagacagcgtctaacacaggagttagaagagttggaagaacaacaccagcaacggcacaagtccttgaaggaagcccatgttttagcttttcagactatggaggaagagaaagagaaagaacagcgcgccctggagaatcacctgcaacagaaacactctgcggaattgcaaagtttgaaagacgcccacagagaatctatggagggtttcaggatagagatggagcaggagctacagacactccgcttcgagttagaagacgaagggaaggctatgttagcctctctgcgaagcgagctcaatcatcagcatgcggccgctattgacctgctgaggcacaatcaccatcaagagcttgcagccgctaaaatggagcttgaaagatcaatcgacatatccaggcggcagtctaaagaacacatttgtagaattactgacctccaggaggagctaagacaccgggagcaccatatctctgagttggacaaggaggtacaacacttacacgaaaatatatcggccttgacaaaagaacttgagtttaagggcaaagagatcctgcgcatccggtctgagtctaatcaacagattcgcctggaggagatggaggagaagtacttaatgagggagagtaaacctgaagacatccaaatgattactgagctcaaggctatgctcacggaacgggaccaaataattaaaaaattgattgaagacaacaagttctaccagcttgaacttgtaaaccgcgaaactaattttaacaaagtgttcaacagctcccctacggtgggtgttataaaccctctggcaaagcaaaaaaaaaaaaacgataagtcccctaccaaccggtttgtgagcgttcccaatctgtccgctctggaaagcggcggagtgggaaacggccacccaaataggttggatcctattccaaatagccccgtccatgacatagaatttaattcctctaaacccctgccccagcctgtaccgccaaagggccctaagactttcctcagccccgcccaatcggaggccagtcccgtcgctagcccggacccacagcgtcaggagtggtttgcacgctactttactttttag

SEQ ID NO: 47333 - DNA, 3183 bp, Artificial Sequence
  Description of Artificial Sequence: Synthetic coding sequence
atggccagcgccctgaacagcaagatcaacccccccggcacctgccaaggttctaaagctgatggcggcgctggctggcggatggattgtgaccctcagatgcacgtgaaaatgtgcaaaaagatagcccagctcactaaggtgatttatgcattgaacacacggcaggacgaagccgaggcatcaatggaggcccttcgcgaagcccatcaggaggagctgcagaatgctgttgcggagaccaaggctagactcctgcaggaacagggctgtgccgaagaagaggcgctcctgcagagaatccaagcactggaaagcgctttggagttgcagaaacgattaacagaagaagctcttgctgaatccgcatcatgtcgcctagaaacaaaggagcgtgagctccgtgttgaggcggaacatgctgaacgcgtgctcaccttgagccgcgaaatgctcgagctcaaggccgattacgaaaggcggctgcagcacctgacatctcacgaagcaacacctcagggacgactgccccaggagtctcccgagaccaaatcggagccaggccagggcccagagatgcaagaggtgttgctcgaggtgcagagacttcgcgtggaaaaccagcagctcagtaaagattacgccaggaaagctgaggagctccaagctacctatgaacgagaaaatgaggcaatccgtcaggctatgcagcaatccgtatctcaggctctgtggcagtggcaagagaaagagagcgatctgcggaagaattttcaggtgcaggaaagtgcactccaggcccaggtgcgtaaattggaaggtgatctggagcatcggggccgcaagatctctgatttgaaaaaatacgcccagaagctcaaggagcgcattcaggatctcgacgttcaactgaaagaagcacggcaggagaactccgaactgaaaggaacggccaagaaattgggagaaaaactagctgtggctaaagaccgcatgatgctacaggaatgtcggggtacacagcagacagatgcaatgaagacagaactcgtgtccgagaacaaagtgctgcgcgaggagaacgacctagaggccggtaacctgcaccctcagcaggatcagtcctgcctgaaagaatgcccttgcatgaaagggggaactgatatgcagacaaagaaggaggcctccgctgagaccgagtatatgaaacagcagtacgaggaagacttacgaaagatcaagcaccaaacagaggaagaaaagaagcatctaaaggaccagctggtgaaacgcttagaggacttagtgaaaaaacataccgtcgaaatcaagagcgtaaggtcttcagtggaagccgagcggaaaaaattgcaaagagaggtggaggcacaactggaggaagttcgaaagaagtccgagaaagaaatcaagcagctggaggaggaaaaagctgccctgaacgtgaagcttcaaaattccctgctggaggtcttgaggttagaggagttcattcaacaaaacaagacacggccgaccggcgcggaggaatcgccacaggaactcggtagacagcattgcagcattctggagacacaggatccgtgcctgaaattggacgaaacctctccacgaggcgaggagtatcaggataagctggccgcagaagagggcacgtccagtgacgaggaagaaagaacgaaggtcctccttaaggagggctcagatcctcagccacccctcggctcactgctcaaggagaagacatctaagattcagcgcctagaggaagactggcagagtcagaaagccaagttgcaggcccaggtctcgcagatgcagcaggccttagaacagtgcacctccaattacagagaggacttgcaggccctgaagcagttgagcgacttagagcgagagaaactgcagagagagctgcaggaaaccactcagcagaatcatgctatgaaggcacagctcgaggccagccaccagagggccctgcgcatgctggaaaaagcccgacaccaggaactcaaagccaccgaagagcgactgaaaaaggaatcaagccactctctgcagatccaacaccagactcacaggttagagctgcaggccctggaagagaaagcgagacaggaactgcaagaggaacgtgaacgcatgcaggcccaacaggccctcctactcgaatccctccggcaagagctttctgagcagcaagccgcctgttctgggcaccaaaaagatcttgaagctctgcaagccgagctgagggcactcggcagacagcaagcttccagccaatgtcctggcgactcaaaagaccacatcattgcaaccgaggaaagaggcggaccaggtcaggccgggagtccgcccggagcagccgggcagggttctggcgaaggctgtgggttatgggaggagaacgcccagctgcaggatgccgtgcggcggctgagggcagaagtcgagcagcaccagcaggaggcacagaaactaagggaccagcgccgttttttagaggagactcagcaggcccagagggcaagagaggtagagactttacgtcaggaacacagaaaggagatgcaggcaatggtagccgattttagtagtgcccaagcccagttgcaggcacgtctggccgctctggaggcagaattgaaggattccggcgaaaaaccaggtaagggcgccagtagacccgaggacctccagttgatcggacggctgcagacacgactgaaggagcgcgaggacattatcaagcagttgacagaggagagacgctttcactacgcagcattcccaagcgccatgtcccataggaatcgcagcttctctttcaatccccaccctggctacctgacaccgtccatgaagaagaaaaaggtggaagacgttccaagtcgcgtggtaagcgtgcccaatctcgcttcgtacgccaaaaatttcctctccggagacctctccagccgaatcaatgctcctcctattacgacctccccatctctggaccctagcccttcctgcggcaggacatacaagcccaaccagtccaccgacgcgaaaaccgcaactcggacgcccgacggtgagactgcccaggcaaaggaagtgcaacaaaaacagggcagtcctcaccaggaatggttcacgaaatattttagtttctag

SEQ ID NO: 47334 - DNA, 828 bp, Artificial Sequence
  Description of Artificial Sequence: Synthetic coding sequence
atgctggccccctgcagcggctgggagctgggctgcttccggctgtgtctccggcaggtaaggctgtgggccggtgcgggccggtgggcctgctgggcttgccaggcccggccttattcatctggaggcagcgagagatggcctggtagcgagacagaagtacctcctcctggcccaggacgaagaacgctgaaggaatggaccttgcagggccagaagctgcacgtccagacaaagggcgggaaggtgatttgcctaggaacagtgtacgggaatattgacatccacgcttcagacaagagtgcagtcactatcgacaaactgcaaggttcaagcgtaaccgtgtcaacagaggacggcctactcaaagccaagtacctgtacacagagtcctcctttctgagctccgccgccggagatatcacccttgggagtgtccatggcaacatcaccctccaaagtaaaatgggtaatattactgtcgactcctcaagcgggtgtttgaaagcgagtacaaaccagggtgcaatcgacgtttacgtgtcccagctgggcaaggtcgagctaaaaagccacaaggggtctatcattgtaaaagtgccatcctctctccaagctcacctccagctttccggcaaagaagtggatgttaacagcgaggtccacgtgcaggagatggcggaggtgagaaaagacgatgtagttactgtcaccgggctgatgaaccaggcttccaagcgcgaaaaatggatcaaggccgacgctcctaagggcacggtctccttcagacggcagtcctggtttcaaagtctgaaactgcaggactag

SEQ ID NO: 47335 - DNA, 1179 bp, Artificial Sequence
  Description of Artificial Sequence: Synthetic coding sequence
atgctggccccctgcagcggctgggagctgggctgcttccggctgtgcctacgacaggtgaggctgtgggctggcgccgggagatgggcttgctgggcctgccaggcacgtccctattcctccggcgggtcggaacgctggccgggatccgaaacagaggtccccccacctgggccaggccggaggactctcaaggaatggaccctgcaggtttcaccgtttggacgactgcgggcaaggctgccctgtcacctagctgtcagaccactggacccactaacataccctgacggtgatagagtgttggtggccgtgtgcggtgtggagggcggagtccgtggactggacggcctgcaggtcaagtacgacgaggaccttgaggagatggctatcgtgtctgatacaatccacccgcaggcaagtgttgaggtgaacgcccctctaaagttcggcctagacataaaatcttcaggcagtggctgcgttaaggtccaatctatcgagggggacaactgcaagatagaaacggagcatggaactagtattctccaaagtgttaaaggtcagaagctacacgtacagactaaggggggtaaggttatctgtctcggtacagtctatggtaatatcgatatacatgccagcgataaatccgccgtcacaatcgacaagcttcagggctctagtgtcaccgtgtccacagaagacggtctgttgaaagccaagtatctatacaccgaatcctccttcctgagttcggccgcgggagacataacactgggaagcgtgcatggcaatattacacttcaatctaagatgggaaatattacagtcgacagctcaagcggctgtctgaaagcttctactaatcagggcgccatcgatgtatacgtgtcccagttgggaaaagtggagctgaagtcccacaaagggtccataattgtgaaagtcccgtcatccctgcaggcacatctccaacttagtggaaaggaggtcgacgtgaatagtgaggtgcacgtgcaggaaatggctgaagtacggaaagatgacgtagtgactgtgacaggtctgatgaatcaagcctcaaaaagggaaaagtggattaaggcagacgcacctaagggcaccgtgtcttttagacgccagtcctggtttcagtctcttaaactgcaggattag

SEQ ID NO: 47336 - DNA, 900 bp, Artificial Sequence
  Description of Artificial Sequence: Synthetic coding sequence
atgttccggacccccagccaggccaaccggctggccctggtgagcgcgaatcctgacttacggctgctgtttgaccttagaagacattccgggcaggttgactggccgtggcaagtgaccctcccggtagccgagggtgttgacacggcgggcctggacataaaaagctcagggtctggctgcgtgaaggtgcaatctatagagggcgacaattgcaaaatcgaaaccgaacacggcacctccatcctccaatccgtcaagggccagaaactccacgtccagacgaagggcggaaaagtcatttgtctgggcacagtttatggtaacatcgacatccacgcaagcgacaagtccgctgtcaccattgacaagctgcaagggagctcagtgaccgtgagcacagaagatggactactgaaagccaagtatctgtataccgaatctagttttctgtctagtgctgcgggagatataacgctgggaagtgtccacggaaacattacacttcagagcaagatggggaacattaccgtggatagctcctcgggatgtctgaaagcaagcacaaaccaaggggccattgacgtgtatgtgagtcaactcggtaaggttgagctcaagagccacaagggaagcattatcgtcaaagtcccaagttcactgcaggcacacctgcaattgagcggtaaggaagtggacgtgaactctgaagttcacgtacaggagatggccgaagtgcgcaaagatgatgttgtgacagttactggcctgatgaaccaagccagtaagagagaaaaatggataaaggccgacgcaccaaagggaactgaatggtccagatctcacattttgctctcccaggcttcccggtgcttggcggcttcaacctttagcccttag

SEQ ID NO: 47337 - DNA, 7056 bp, Artificial Sequence
  Description of Artificial Sequence: Synthetic coding sequence
atgttcttcaagatgaagaacgagatcgacaacgaccccgagagcgagaagtgtatcaaagacagcaccataatgcggcgcgaaccacagaatatccttagtccactgatgctaccaaatctggaaatacctttctcggtgaaggacataatttccagaatcgagagagcccagctgcacagagcccgcgaagacattgacatgcagctgagcgagatcatgaacaatgtgcaccggatcatgactaggtacacactggtattcaatagttcctcagaacggaacgtcagcctcacagaacacaaaaaaaagcagagaaccaatttcctggaaaaaatggcaacctacgccaaaacaattgagattagggaaaagacgcttgcgaatattttagcttggctcgaagaatggaatgacgtgttgagtgagatgacactgatggacgtggatgagcatcatcattggatcgcccagatggagctactgcccgatacattgaaggccatcgaaaacaatgtcaaaatcctgtctcggttcagtacatccttcctggacgagaagaagaaacaaaagaaaaagatactttcccgcgggactctatggaaatcgtggaaggaaagggtgatcaagcgcccatcaaccgcccgggcgcttaggccagatcagatgatctctgaccagttggcgaccaataccaaagtgtccgagatccaggggatgttacaggagctgataggcacgacgatgttttctactctggaaaacaatgctattaaatacatctcatccactattgtcaacctgagcacagctctctccatgttaaatgacgaattaaaatgcgtaaatttccagtccagcacggtctatgcacacgagacttcagaggctgagaaagagctgagcctgaaaatcatccgagatctcagtaacgagaacgaaatgctccaacagaaactgcaggatgcggaggaaaaatgcgagcaacttattagaagcaaaatagtgatcgagcagctgtatgcaaagttgagcacttctagcacactgaaagttctccccggaccttcacctcagagcagtagggctatcatcaaagtgggagatactgaagacaatatggacaacattcttgataaagagctggaaaatatagtggacgaggttcagagaaaggagaccaaagacagcgggatcaaatgggactcaacgatctcttatacggcccaggccgagagaactccggatctgactgagctccgacagcagcctgtggcatcagaggacatcagtgaggacagtaccaaagataacgttagcttgaagaagggagacttctaccaggaagatgagaccgacgagtaccagtcctggaagaggtcccataagaaagctacctatgtgtacgagaccagtggccccaatctgtccgataacaaaagcggacagaaggtcagtgaggcgaagccaagtcaatactatgagcttcaggtgctcaaaaagaaaagaaaagagatgaaaagcttctcagaagacaagagtaagagtcccactgaagctaaaagaaaacatctgagcctaactgaaacaaaatcgcaggggggcaagtcaggtacgtctatgatgatgctagagcagtttagaaaggtgaagagggagtccccgtttgacaagaggcctaccgctgctgagatcaaggtggaacctactactgaaagtctagacaaggaaggaaagggtgagattcgttcattggtggagcctctcagcatgatccagtttgacgacaccgccgaacctcagaaagggaaaatcaagggcaagaaacaccacatttcctcgggaaccattacatccaaggaggagaaaaccgaggagaaggaagaactgaccaagcaggtgaaaagtcaccagctggtcaagtctctcagcagagtggcaaaagagaccagtgagagcacccgggtgctggagagccctgacggcaaatctgagcaaagcaatctggaggaattccaagaggccatcatggcctttctgaaacagaagatcgacaatattggaaaggcatttgacaagaagaccgtgccaaaggaggaggagcttctgaagcgtgctgaagctgaaaaactggggattattaaggccaaaatggaggagtattttcaaaaagtggccgagacagtgaccaagatcctccgtaaatataaggacactaagaaggaggagcaggttggagaaaaaccaattaaacagaagaaagtcgttagtttcatgcctggtcttcacttccagaaatccccaatcagcgccaagtccgagtccagtacattactgtcctatgagtctacagatcccgtgatcaacaatcttatacagatgatacttgcggagatcgagtctgagagggacatccctaccgtcagcacggtgcagaaagaccacaaggaaaaggagaagcagagacaggaacagtacctccaggaaggccaggaacagatgagcgggatgtctctgaaacagcagctactgggagaacggaacctcctcaaagagcattacgagaaaatctccgagaattgggaggaaaagaaggcgtggctgcagatgaaggaaggcaaacaggaacagcagtcgcagaaacagtggcaagaggaagagatgtggaaggaagagcagaagcaggccacccctaagcaggcagagcaggaagagaagcagaagcaacgcggtcaggaagaggaagagcttcctaagagttccctgcagcggctggaggagggaacccagaaaatgaaaacacagggactgctgctcgaaaaggagaatgggcagatgaggcagattcagaaagaggctaaacatctgggcccacaccggcgccgggaaaaagggaaggagaagcagaaaccggagcgcggcctggaagacctagaaagacaaattaagaccaaggaccaaatgcagatgaaggaaacacagccgaaagaacttgagaagatggtaatccagacgccgatgactctcagcccccgctggaaaagcgtgctcaaggacgtgcagcgtagctatgagggcaaggaatttcagaggaacctgaaaacgctcgaaaatctccctgacgagaaggaaccgatctcaattacaccacccccgtctttgcagtattcactcccaggtgctttgccgattagtggacagcccctgaccaaatgtatccacctcaccccccagcaggctcaggaggtcggaatcactttgactcctcaacaggcacaggcacaaggtataacattaacattacagcaagcacaggagctgggcattccactcacaccgcagcaggcccaggctttagagatactgtttaccccgcagcaggcccaggccctgggaatcccactcacccctcaacaaacacaggttcaagggattacactaactccccagcaggaccaggccccggggatttccctgacaacccagcaggcccagaagctggggatcccattgacgcctcaacaggcacaggcccttggtatccctctcacacctcagcaggcgcaggagctgggaatcccactcactccgcagcaggcccaggctctgagagtgtctctgacccctcagcaggcgcaggagctgggtatacctctcaccccccaacaggcacaggcactgggtataactcttacgctgcagcaggcacagcagctggggatccctctgacccctcagcaggctcaggctctgggaattacgttaacacccaagcaggtccaagagctgggcataccacttaccccccagcaggcccaagctttaggaatcacactcacacctaagcaggcccaggagctcggcattcccctcaatccgcaacaggcacaaacactggggatacctttgactcccaagcaggcacaggctctgggtatccctttcacacctcagcaggctcaggcgttgggaatacctcttaccccacagcaggcccagactcaggagatcacactgactcctcagcaggctcaggccctgggcatgccgctgactacccagcaagcacaggagctcggcatccctctgacaccccaacatgcccaagctttgggcatgccgctgaccacccagcaggcacaggaactaggaattcccctgactccacagcaggctcaggcactcgggatgccactgacaacacaacaggctcaggagctgggcatccctttaacaccccagcaagcccaggaactgggcatccctttcactcctcagcaggctcaggcccaggagatcacactaactcctcagcaagctcaggctctagggatgcctctgacagctcaacaggcccaggagctgggaatcacactgacccctcagcaggcacaggagctgggcataccacttactccccagcaggcacaggcactcggtatccctctgataccccctcaggcccaggaactgggcattccactcacccctcaacaggcccaggctcttggaatcctcctgattcccccgcaggcccaggagctgggcatcccactcaccccccagcaggcgcaggccctggggatccccctcattcctccacaagcacaggaactcggcatccccctcacaccacagcaggtgcaggccctgggtattcccttgatccctcctcaagcacaggagctggaaatccccctcaccccacagcaggctcaagccctgggcattcctttgacaccgcagcaagcccaggaacttggcattccactgacaccacagcaggcgcaggagctgggtataccgctgacaccccagcaggcccaggcgcaaggcataccacttactcctcagcaggcacaggcgcttgggatcagtttgacgccacaacaagcacaagcccagggtataacattgacaccccaacaagcccaggcactgggcgtccccattacacccgtgaacgcttgggtgtccgccgttacccttaccagcgagcagacacacgctctggagtcacctatgaatttggagcaggctcaagagcagttgctgaagctgggcgtgcccctcacgttagacaaggcccacactctggggtctcctctgacactgaagcaggttcagtggagccacaggccattccagaagagcaaagcctcattgcctacaggccaatcgatcatctcacggctttctcccagcctgagactctccctggcctcttcggccccaacagcggagaagtccagtatttttggcgtgtcctctactccgttgcagattagccgggtacccctaaatcagggaccttttgctcccggaaagcctctcgagatgggaatcctgtcagagcctggtaagctgggagccccacagaccctgcgttccagcggtcagaccttggtctatgggggtcagtccacatcagcacaatttcctgctccacaggcccctccgtctcctggccagctccccatctctcgagcccccccaacacctggacagccctttattgctggcgtgccccccacaagcggacagattccatccctgtgggcacccttgagccccggacagcccctggtgcctgaggcctcctccatccccggggatctgctggagtcggggcccctcacctttagcgagcaacttcaggagtttcagccccctgccacagctgagcagtcaccctatctccaggcaccttccaccccagggcagcacctggcaacatggacactgccaggccgagccagtagcctgtggattccccccacctccagacatccacctactctgtggccgtcccccgctcctggaaaaccccaaaagtcctggtccccctccgtggccaagaaacgcttggctatcatcagctctctgaagtccaagagtgtgctgattcatcccagcgcccccgacttcaaggtcgcgcaggttccattcactaccaaaaagttccagatgagcgaggtcagcgacacatccgaggaaactcaaatcctgcgggatacttttgcaattgagtccttcaggacatttcaaagccacttcacaaagtatcgaactcctgtttatcaaactccatatactgatgagagagctctactaacactaatgaagccaactacctccccctcgagcttgacgacacttttgcggaccagccaaatttcccctctggaatggtaccagaaaagtagattcccccccattgataagccctggatccttagttctgtgagcgataccaaaaagccgaaggtgatggtgccaccatcttctccccaggagctcgaggagaaaagatatttcgtcgatgtggaggcacagaagaagaacctgattctgcttaaccaggctataaagacatgtggcctccctagccaactacacacaatggccagaacccttatcatagaaattctgcatatggacaccgtacagctggggtacctcttccggaaatacatcgcataccgtctcattcagcacgcgcgcaataacatcatgaaacgactaaaagccatccaaaatactggcaaaggctacgaggctagaaaccttcacatgatgctgtcccgtcttgatgattatggaaaaaaagttatgcaagtgtggaccgagaaacaaaagagcctagggcaaaaacggaatcagtgtttgaaaaagatgattcacgtctttaatcagctgaaaaaaatccacgagctcaacctgagtcaacccatccccctcattatcgaagaaaagcagattcctgcatctaccacttttgtccagaagccatttttgaaactcttgatggaagaggaccgcacttccgatatatgcaaaaagttccgccagcaagaggatcagaccgaggcaatctggaacgtggatcttagtacaagttcataccctattgccgagaaaacatctatgcactccctgtgggctcaattgggcggttaccccgatattcccaggctgctgcagctggaggttcagtctaccttcaggaagtccctcgctagcctacaatcgcgcgttaaaaagataccaaaatag

SEQ ID NO: 47338 - DNA, 1080 bp, Artificial Sequence
  Description of Artificial Sequence: Synthetic coding sequence
atgagcgaggtgagcgacaccagcgaggagacccagatcctgcgggatacttttgctatcgaatctttccgtacatttcagtctcatttcacaaagtacaggacaccggtgtaccagactccatacaccgacgagagggcactcctgacattaatgaaaccgacgacctctcccagcagcctgaccactctcctgcgcactagtcaaatatcccctttagagtggtaccagaaaagtcggtttcccccgatagacaagccctggatcctcagttccgtgtcagatactaagaaaccaaaagtgatggttcccccttcctcgccccaagaactggaggaaaaaaggtatttcgtcgatgtggaggctcaaaagaagaatcttattttgcttaaccaggccattaagacatgtggtttgcctagtcagctgcacacgatggcgcgaacactgataatagaaatcttgcacatggacactgtgcagcttggataccttttccgaaaatatatcgcataccgcttgattcagcatgccaggaataatattatgaagagactcaaggctatccagaataccgggaaagggtacgaagcccggaatctgcacatgatgctgtccagactcgatgactatggcaagaaggtaatgcaggtctggactgaaaaacagaaatcattaggccaaaagcgcaatcaatgtcttaagaagatgatccacgtgttcaatcagctgaagaaaattcacgagctgaatctgagtcaaccaattcctctgatcatcgaggaaaaacagattcctgcaagcacaacctttgtccagaagccctttttgaagctgttgatggaagaagaccgcacgtcggacatttgcaagaagtttaggcagcaggaggatcagacggaagccatatggaacgttgacctcagcacatcctcatacccaatcgcagaaaagaccagtatgcattcgctctgggctcagttgggtggctaccctgacattccgcggctgctccagctggaggtgcaatcgacattccgcaagtctttagcgagcctgcagtctcggagctcagggtag

SEQ ID NO: 47339 - DNA, 2682 bp, Artificial Sequence
  Description of Artificial Sequence: Synthetic coding sequence
atggagaaggacgaccccccccagctggtgacccccaccagcgtgaaagcgattattctgcggatcgaggccgcccagctgactcgggcacaagaagacatctcaacccaactatcagacattctggataacgttaactgcgtgattaatagattccaggaggagctcggatacgaccttaaggagaacgctaaaagccagcagcgagaccctaaggggaaaaagagatttatactattggaaaagatcgcctccttcagcaaggacgccatgatgaaggaaaaacacctgtacgacattctgcggtggctgggggattggggcgataccctcacttatgagattggaccgagaaaatccgaagaggaagccgcggctctggacgagtggatcgaagtaacagaaaaggtgctgcccttgtcactgattgccaccaaacgtggcatcgaatctctgacagctctctgcagtacacttattgagggccaaaaaaaacgctctcaagtgtccaaaaggacgttttggcagggatggcagggccgtagtcctcaaaccagcccttcacatccccagccactgtcgcctgagcagatgctccaggatcagcataccatgaatacaaaagctagcgaggtgaccagcatgttacaagagctgctggattcaactatgttcagcaagggggaagtaagggcaattagatacatggctacagtagtcgaaaatctaaataaggcccttatactgcaacataaggagaaccgatctctggagactaagtaccgccacctgcagatgcaggcaaccaaggagctgagttcacagcgacttcatttccagcagttcatggaagtgctagagtcacggagagatgcactacttaagcaggtggagatcctgggtggtcgctatcatgacctgttgttgatgaagcaagcgttggaatttcagttgaaaaaggcgcaaaacgccactgggcaggccgaagatcttgccgaagtcagcgttgatagccctggaccaagtgaaagagagacacttcctcggaaggagaccgtgatggaagaaagtcagcaggagccaatgaaggaggagcaattgttttcacctctaccaccttccccaatggcaatgataagggacagtggggctatcgcagccggccaccaaccgctctccacaatgaccgtacgcagtcgggtggctgacgtattcggttctaaagatacagaatcgctggagccggtcttgctccctctggttgatagaagatttcccaaaaaatgggaaagacccgtcgctgagtccttagggcacaaggataaagatcaggaggactacttccagaagggcggattgcagattaagttccactgctcaaaacagctctccctagagtcaagcaggcaggtgaccagtgagagccaggaagagccctgggaagaagagttcggtagggagatgagaagacagctgtggttagaagaagaagagatgtggcagcaaagacaaaaaaagtgggcactgcttgaacaggagcatcaagagaaattacgccagtggaatctcgaagacctggctagagagcagcagcggaggtgggttcagctggagaaggaacaggagtcaccccgtcgcgagcccgaacaactgggcgaagacgtggagaggcggattttcacaccgaccagccggtggagggacctcgagaaggctgagctgagcctcgtgcctgcaccttcccgtactcaatccgcgcatcaaagcagacggccacacctgcctatgagcccttccactcagcaacccgccttaggtaagcaaaggccaatgtctagcgtggagttcacctatcgtcctagaacccgacgcgtcccaaccaagccaaagaaatcagcaagcttcccagtgactggtacatcaatacgcaggttaacgtggccttctctgcagatctcacccgcgaacataaagaagaaggtctatcacatggacatggaggctcagcgcaagaacttacaactcctgtccgaagagagcgaactgcggcttccgcactacctacggagcaaggcactcgagctgaccaccactaccatggagttgggggctctaaggctccagtacctctgccataagtacatcttctacagaaggctccagtctctacggcaagaagccatcaatcacgtgcaaattatgaaagagaccgaagcctcgtataaagcccagaacctctatatctttctggaaaacatcgacagactgcagagtctgcggctgcaggcatggacagataaacaaaagggacttgaagaaaaacatagagagtgtctttccagcatggttacaatgtttccaaaactgcagttggagtggaatgttcatctgaatatcccggaggtaactagccccaagcctaaaaaatgtaagcttccggcagcatccccgcggcacataaggccctccggcccgacctataagcagccttttctgagccgccatcgcgcttgcgtgccactacaaatggcacggcagcagggtaaacagatggaagcagtttggaagactgaagtggcttcaagttcgtatgctattgagaaaaaaaccccagcctcgctcccccgcgaccagttacgcggccaccctgatattccaagactgttgaccctcgatgtgtag

SEQ ID NO: 47340 - DNA, 1521 bp, Artificial Sequence
  Description of Artificial Sequence: Synthetic coding sequence
ggccaccagcccctgagcaccatgaccgtgcggagccgggtggccgatgtttttggctccaaggacaccgaatctctggaacccgtcctgctgcctctggtggacagacggttccccaaaaagtgggaaagaccggtcgccgagtccctgggtcataaggataaagaccaagaggactattttcagaagggaggactgcagattaaattccactgctcgaaacagctcagcttagaatcctctcggcaggtgacatctgaatcccaggaagaaccgtgggaagaagagtttggccgggagatgcgacggcagctttggctggaagaagaagagatgtggcagcagcggcaaaagaaatgggccttgttggagcaggaacatcaggagaaactcaggcagtggaacctggaggatctagctcgggagcagcagaggaggtgggtgcagcttgagaaggagcaagagtccccacgccgggagccagagcagctcggggaagacgtggagcggcgaattttcacccctacgagcaggtggcgagacttggaaaaagccgaattatccctcgtacccgccccttctcgcacacagtcagcccaccagagtagacgccctcaccttcctatgagcccaagtacccagcagccggccctggggaaacagcggccaatgagcagcgtagagttcacttatcggccgaggacaaggcgcgtgccaaccaagcctaagaaatctgcttccttccctgtgacaggaacttctattcggagattaacttggccttccctgcagatctcccctgcaaatatcaagaagaaagtgtaccatatggacatggaggcccagcggaagaatctgcagttgttaagcgaagagagcgagctcaggctcccccactaccttaggagtaaagcactggaacttaccaccaccacaatggagctgggcgccttgagactgcaatacctttgtcataaatacattttttacagacgcttgcaatccctccgacaggaggccatcaaccatgtgcagatcatgaaggagacagaggcctcctataaggcccagaacttgtacatttttttggaaaatatcgatcgcctccagtctctgcgccttcaggcttggactgataaacagaagggtctggaagagaagcaccgtgaatgtctctcctccatggtgaccatgtttccaaagctgcagctcgagtggaacgtgcatctgaacattccagaggtcaccagtcctaaacctaaaaaatgtaaactgcccgctgcatccccacggcatatcaggccatccggaccaacttataagcagcccttcctctcccggcaccgcgcttgcgtgccactccaaatggcgcgccagcaaggaaaacagatggaggccgtttggaagacagaggtggccagttcttcctatgccattgagaagaagacccctgcctcactcccccgcgaccagctaagaggccaccctgatatacctcgccttctcactttggacgtctag

SEQ ID NO: 47341 - DNA, 2346 bp, Artificial Sequence
  Description of Artificial Sequence: Synthetic coding sequence
atgatgaaggagaagcacctgtacgacatcctgcggtggctgggcgattggggtgatactctgacatacgagattggtccacgaaagtcggaggaggaggctgcggccctcgacgagtggatcgaagttaccgagaaggtgcttccgctgtctctgatcgctactaagcggggaattgagagcctgacagctctgtgctccaccctgatcgaaggccagaaaaaacggtcccaagtctctaagcgcactttttggcaggggtggcaaggccgatcaccccagacctctccctctcatccgcagccactcagtccggagcagatgctgcaagaccaacacactatgaatacaaaggctagtgaggtgacctccatgctccaggagttactagattccactatgtttagtaaaggagaggtgcgcgctattcgctacatggcaactgtagtggaaaacttaaacaaggccctgattttacagcataaagaaaaccggtcccttgaaacaaagtaccgtcaccttcagatgcaggccactaaagaactctccagtcagagactacattttcagcagttcatggaggtgttagagagcagaagagatgccctgctgaagcaggtggagatccttggggggcgttaccatgatttgcttctaatgaagcaagctttagaattccagttaaagaaggctcagaacgccactgggcaggcagaagacctcgcggaagttagcgttgactcccctggccctagtgagcgtgagaccctgcccaggaaagaaactgtgatggaggaatcccagcaggaacctatgaaggaagagcagcttttcagcccgcttcccccttcccccatggcgatgatcagagacagcggtgctatagccgcaggtcatcaacccctcagtactatgacagtgaggagtcgagtggcagacgtttttggtagcaaggacacggagagcttagagcccgtgctgctgcctcttgttgaccgcagattccctaagaagtgggagcgcccagtggccgaatccttgggccataaggacaaagaccaagaagattactttcaaaagggtggcctccagattaaatttcactgttcaaaacaactgtcccttgaatcctcccggcaggtgactagcgagagtcaggaggagccatgggaggaggagtttggtcgtgaaatgaggcggcagttgtggcttgaagaagaggagatgtggcaacagagacagaagaagtgggcgttgcttgaacaggaacaccaggaaaaactccgacagtggaatcttgaagatttggccagggagcagcagaggcgctgggtacagcttgaaaaggagcaggagtctcccagaagagaaccagagcagctcggagaggatgtggaacggcgaatctttacccctacatcccgttggagggacctggagaaggcggagctcagcctcgtgcccgccccttcccgcacccagtccgcacaccaaagtaggaggccgcaccttcctatgtcccccagtacgcaacagccagccctaggtaagcaaaggccaatgtcaagcgtggaatttacatatagacctcgaactcgacgggttcccactaaacccaaaaaatccgcttcattccctgtgaccggtacatcaatccgaagattgacctggccaagtctgcaaatctcacctgcgaacatcaaaaaaaaagtatatcacatggacatggaagcgcagcgaaaaaatctgcagctgctcagtgaagagtccgaattgcgactgccgcactacctgaggtcaaaggcgctcgagctcaccaccactaccatggagttgggcgctctcaggctgcaatatctttgccacaaatacatcttttacagacgactgcaatctctccggcaggaagcaataaaccatgttcagatcatgaaagagacagaagcctcgtataaggcccagaatctttacatattcctagagaatatcgatcgactccagtcactgcgcctccaggcctggacagataagcagaagggccttgaggagaagcacagagaatgtctctctagtatggtcaccatgtttcctaagctacaacttgagtggaatgttcatctcaacatccccgaggtgactagtccaaaaccaaagaaatgtaaactgccggccgcctccccaaggcacattcgcccctccggccccacatacaaacagccctttctctctcggcaccgggcctgcgtgcctctgcagatggctagattgctcgctttgtgtctgagagggctagtggccgagctggccctcgtgatggaggacttcgatttgttgcacgtgctctag

SEQ ID NO: 47342 - DNA, 354 bp, Artificial Sequence
  Description of Artificial Sequence: Synthetic coding sequence
tgatgcctgagcagcatggtgaccatgttccccaagctgcagctggaatggaacgtacatcttaatatcccagaagttacaagccccaaaccaaaaaagtgtaagctgcccgccgcatctccccgccacatacggccatctgggcccacctacaaacagccctttctcagccggcaccgcgcctgcgtgccgttacagatggcccgccaacaggggaaacagatggaggccgtctggaagacagaagtcgcttcttcctcttatgctatcgagaagaaaacaccagcgagcctgccccgagatcagctgagagggcaccccgacatcccacgcctcctgacccttgacgtttag

SEQ ID NO: 47343 - DNA, 1242 bp, Artificial Sequence
  Description of Artificial Sequence: Synthetic coding sequence
atgcacctggccctgaccaccgtgctgctgtgggcctggggcctgcaggcattcgaaatcgtggaaaaggagaatatatttcagaggactccatgtcccgccttcctgatgtttgagaacgctgcctatctcgccgacatgtcttttgaacttccgtgccattgtaagccagaagaagttcccgccgtggtgtggttttatcagaaacacctgggttcaagtcacaccaaagtgttaaccgactttgatgggagggttctgaccgaagcagcccaggttcgcgttggaagtgatatgttaactcgattttccattagaatgtttagccttctggtcttcagggcacagagcgaggattcaggattgtatttctgcggtactagaaaaggcgactacttctatgcctacgatgtggatatccagaactctgaaggcatggttgccactttccaggacaagggtcaggaaccgtttgccgacgagtactacggccatctgcacgtcttcaccaccttctgggagtggacaccttgcgaccgatgtggagtgcgcggagagcagtggcgaatcggattgtgctatctgcaatccccagatctcagcccccggtacctgaaggccgttcctgacgtcgtatcatgtggatcccgcgcggtgccacgcaagttgagaacaaaagccagggatcatacccccgaggttttggtgagaagctgtctggtgccttgcgagaagaccaagacgatcagggagggggtgctcgccattatcaattacgtgtctaaggtcggctctcgcccttgggtaccacaggttcccattcagtttcatcagcagagactgggccacggcctaatcataagctgtccaggtgcacggcccgaacatgccgtggcctgggacaaggacagacagcatttgtaccgtacccagtatctgaaaggagttaatagaagtatgcgcgtatttattgatcacggaaatcagctgcatatcagattcacgcagcttgacgataggggcatctactactgctggcggcagggcgtccttgtggccggatttcggttgggagtcacctcacacggacactatccagcctctttttctgacccggagacaagaagtgcggtggaattaaccctgattggttaccttcttatcacagctgttttcgttaccattcatttctgccgctgctgttgttacttgtttcattgttgtccaagcttctctccatag

SEQ ID NO: 47344 - DNA, 1242 bp, Artificial Sequence
  Description of Artificial Sequence: Synthetic coding sequence
atgcacctggccctgaccaccgtgctgctgtgggcctggggcctgcaagcgtttgagattgttgagaaggagaacatcttccagagaaccccttgtccagcattcttgatgtttgagaatgccgcatatctcgccgatatgtcatttgagctcccatgtcactgtaagcccgaggaggtccctgccgttgtgtggttttaccaaaagcacctgggctccagtcacactaaggtgcttacggatttcgatggaagagtgctgaccgaagccgcgcaagttagagtgggaagtgacatgctgactcggtttagcatcagaatgttctcactcctggttttcagagcacaatcggaagattccggactttatttctgtgggactcggaagggggactacttctatgcttacgatgtggatatccagaactccgaagggatggtcgcaacatttcaggataagggccaggaaccattcgccgatgagtattacggccacttgcacgtctttactacgttctgggaatggaccccctgcgacagatgtggggtccgtggagagcagtggcgtattggtctgtgttacctacagtccccggatctttctccacggtatcttaaagctgtgccagatgtggtgtcttgcggatcccgggctgtgccgcggaagcttcgcacaaaagcaagagaccacactccagaggttctggtccggagttgcctggttccctgcgagaagactaaaacaatccgtgagggcgtgctcgctattattaactacgtctcaaaggtgggcagcagaccatgggtcccccaggtgccaatacagttccatcagcagcgcctgggtcatggcctcatcatttcctgccctggggctcggcctgagcatgctgtggcatgggataaggatagacaacacctgtatcggacacagtatttgaagggcgttaaccgcagtatgcgcgtgttcatcgatcatggcaatcagttacacattaggtttacgcagctggatgatcggggtatatactactgctggcggcagggagtgttggtcgcaggatttagactgggtgtcacttcccatggacactatcctgctagtttctcagatccggagaccaggagtgcagtggaactcaccttaatcggctatctgctgattactgcagtgtttgtgactattcatttttgccggtgttgctgttacctgttccactgttgcccatcctttagtccctag

SEQ ID NO: 47345 - DNA, 2274 bp, Artificial Sequence
  Description of Artificial Sequence: Synthetic coding sequence
atggacagcctgttcgtggaggaggtggccgccagcctggtgcgggagttcttatcaagaaagggtctcaaaaaaacgtgcgtgacaatggaccaggagcggccccgctctgacctgtcaataaacaatcggaacgacctacggaaggttcttcacctggaatttctctacaaagaaaacaaagctaaagagaaccctttgaagacttccctcgagttgatcactagatactttctggatcattttggcaatacagccaataacttcacacaggacacccctattcctgcgctgtcagtacctaaaaaaaacaacaaggtgcccagccgctgtagcgaaactacgctggtgaatatctacgacctgagcgacgaagacgctggatggaggacatcactgtctgagacgagtaaagcacgccacgacaacttagatggcgatgttctgggcaacttcgtgagctcaaagaggccacctcataaaagcaaaccgatgcagacagtgcccggagagactccagtactaaccagtgcttgggagaagatcgacaagttacactcggagcccagcttagacgtgaagagaatgggagagaactcacgtccgaagagcgggttaatagtgcgcgggatgatgagtggaccaatcgcatctagcccccaggactcttttcaccgtcattacctgcggaggtcttctccctcatcctcctctacgcagccccaggaagaaagtagaaaggtgccagaactgtttgtgtgcacacagcaggatatattggcttcctccaactcttctccttcaaggacatccctgggtcagttgagtgaactcactgtcgagaggcaaaagaccaccgcctccagtcctcctcatctcccatcaaagcggctacctccttgggaccgcgcccgtcctagggacccatccgaggacacgccagccgtcgacggcagcaccgatacagatcgcatgcccttgaaactttacttgcccgggggcaacagtcggatgactcaggagcgcctggagcgggccttcaagcggcaggggtcacaacctgctcctgtccgtaagaaccagctgctcccctccgacaaagtcgatggagagctcggcgcactgaggctggaagatgtagaagatgagctgatcagggaagaagtcattctcagcccagtccctagcgtactgaaactacagaccgcatccaagccaattgacctcagcgtggctaaggaaataaaaacgttgttattcgggtcctctttctgctgttttaacgaggagtggaaactgcagagtttctcattttcgaatacagccagtctgaagtacggaatcgtgcagaacaagggggggccgtgcggagtgttggctgccgtgcaaggctgcgtccttcagaagctgcttttcgaaggtgattcaaaagctgactgcgcccaggggcttcagcctagtgatgctcaccgaaccagatgtctggtgcttgccctcgcagacatagtctggcgggcggggggcagagagcgggcagttgtggctcttgcctcccggacgcagcaattttcgcccacaggaaagtacaaggcggatggagttctggaaactctcaccctccattccttaacctgctacgaggatctggtgacattcctgcagcagagtatccatcagttcgaggttggcccatatggctgcatcttactaaccctgagcgcaattctatcgaggtccaccgaacttatccggcaagattttgatgtgcctacgtcacacttgatcggagcccatggttactgtactcaggagctggttaatcttctcttaactggtaaggctgtatcaaacgtttttaacgacgtggttgagcttgatagcggtgacgggaacataacgttactgagaggaattgcagccagatcagatattggctttttgtccttgttcgagcactataatatgtgtcaggtcggctgttttttaaaaacgcccaggtttccaatctgggtggtctgctccgagtcccatttttccatcctcttttcgctgcagccaggtcttctgcgggactggcggacagaacggcttttcgatttgtattattatgatggcctagccaatcaacaagagcagatcaggcttacgatcgacaccacacagactataagcgaagacaccgataacgatctcgtgcctcctctggagctatgtattagaaccaaatggaaaggcgcgtctgtgaactggaacggatccgaccccattctctag

SEQ ID NO: 47346 - DNA, 1953 bp, Artificial Sequence
  Description of Artificial Sequence: Synthetic coding sequence
atgatgcccagccccagcgacagcagccggagcctgaccagccggccttccacaaggggcctcacccatctgaggctccaccgaccgtggctccaggccctacttactctcggccttgttcaggttctactgggcatcctggtagtgacgttctcaatggtcgcctcttcagtgaccaccacagagtccataaagcgaagttgccctagctgggcgggattctctataagtttcttttcgctcctgtcagtgctctgtgtaatgctgtctatggctggctcagttctcagctgcaaaaacgcccagcttgctcgtgatttccagcagtgtagcctcgaaggtaaggtgtgtgtttgctgcccaagcgtgccccttctgcgaccatgcccagaatctggccaagagctgaaagtggcacctaacagcacttgtgatgaggcgaggggagcgctaaagaacctgttgttttctgtatgtggtctgaccatctgtgcagcaatcatttgtacattgagcgctatcgtctgctgcatccagatattctctttggacctggttcatacgcaattagcgcctgagcgctcagtcagcgggccactgggccccctggggtgtactagccctccaccagctcccctgctccatactatgctcgacctcgaagaattcgtccctcctgtgcccccacctccttactatccacctgagtacacatgctcctcagaaactgacgcccagtctataacatacaatggttcaatggactccccagttccactgtaccccacagactgccccccatcatacgaagccgtgatgggactgcggggggactcacaggctaccttgttcgacccccagctccacgacggctcgtgcatatgcgaaagagtggcgtcaatcgtggatgttagcatggattctggatccttggtgctcagtgctatcggcgatctccctggcggatcttcaccatcagaagattcctgcctgttggagctgcagggttctgtccgcagcgtggattatgtccttttcagatctatccaaagaagtagggccggctactgcctgtcgttagactgtggcttacggggcccttttgaggaaagtcctctgcctagacggccccctagggctgctcgctcttatagttgtagcgcgccagaggcccccccacctttaggggccccaacagccgcccgctcttgtcacaggctagaagggtggcccccttgggtgggcccatgtttcccagagctgcgtagacgagtgcctcgcggcggcgggcggcccgcagccgctccaccaacccgggcgcccacccgccgttttagcgacagttcaggaagcctcacaccccctgggcatcgtcctcctcacccagcctctccacccccactattgctgccgcggtcccattccgacccagggatcacaacatcatcagacacggccgatttcagggacctctacactaaggttctggaagaagaggccgcaagcgtgtcatcagccgatactggcttgtgcagcgaagcctgcctgtttcgtttggcccgttgtccatcacctaaattgttgcgcgcgcgtagcgcggagaaaagacggcccgtacctacctttcaaaaagttcccttaccaagcggaccggcgcctgcccactcactgggtgacctgaaggggagctggccgggaaggggcttggtcaccaggttcctacaaatttctcggaaagctccagaccccagtggcacgggggcccacggacataagcaggtgccccgaagcctgtggggaaggccaggccgtgagtctctccatctgagaagctgcggcgatctgtcatctagttccagcctgcgcagactgctgtcaggacggagactcgagcggggcacccgcccgcatagcctctctctgaacggagggtcacgggaaaccgggttatag

SEQ ID NO: 47347 - DNA, 2703 bp, Artificial Sequence
  Description of Artificial Sequence: Synthetic coding sequence
atgggcgacagcggcagccggcggagcaccctggtgagccggctgcctattttccgccggagtattaaccgccggcacgacagcctaccctcaagcccgagctcttcgaacacagtgggcgtgcactccagctcccccagcagtaccaacagcagctcaggttccaccggcaagcgtaggagcatattccggaccccgagtatttcctttcatcacaagaaaggttcagagcctaaacaggagcctaccaatcaaaacttgtctatatctaacggagcacagcctgggcattccaacatgcaaaaactctcattggaagagcacatcaaaactcgagggcgccactctgtagggttttctagtagccggaataaaaagatcaccaggagtctcaccgaggactttgagagggaaaaagagcacagcactaataagaacgtatttatcaactgtctgtcgtctggcaagagcgagggagatgatagcggcttcacagaagatcagacacgacgctcggtaaagcagagtacccgaaaacttctgcctaagtcttttagttcacactacaagttttccaaacccgtgctccagtcacagtccattagcttggtgcaacaaagcgagttctctttagaggtgactcagtaccaggaaagggaacctgtgttggtgcgcgcttctccgagttgctcagtggatgtgacagaacgcgccggaagttctcttcagagcccactgctgagcgcggacttaactactgcacagacaccatctgagtttctggcactgacggaggacagtgtcagcgagatggatgcatttagcaagtccggcagtatggctagtcattgtgataatttcgggcataacgatagcacgtcgcagatgagtctcaactcagcagctgtgacaaaaactactactgagcttaccggcactgtaccttgtgccattatgtcgcctggcaagtacaggctagagggacagtgttctacagagtcaaattcactgcctgaaacctctgctgcgaaccagaaagaagtgctcctgcaaatagccgagttgcctgccacctcggtctctcattccgaatcaaatctgccagctgactccgagagggaggaaaacattggactccagaacggagagactatgttaggaacaaatagtccgcggaagcttggtttctacgaacagcacaaagccattgctgagcatgttaagggaatccacccaatttctgattctaaaattattccaacatccggcgatcaccacatcttcaacaagacatcccacgggtacgaagctaatcccgcgaaagtgctagctagcagcttatcgccattcagagagggcagattcattgaacgacgcttgagatccagcagtgaaggcaccgcagggagttccagaatgatcctcaagcctaaagatggaaacatcgaggaagttaattccctgcggaaacagagagctggatcatctagcagcaagatgaactctctcgacgtccttaataaccttggttcctgtgagctggacgaggacgacctgatgttggacctcgagtttttggaagagcagagcctacatccaagtgtttgccgtgaggattcttatcacagcgtggtctcttgtgccgctgtggtgctgacacccatggagcccatgatagaaatgaagaagagagaagagcccgagttcccggagccctcaaaacaaaatttatctttgaaactgaccaaagatgttgatcaagaagcccgttgcagtcacatatcccggatgcccaattcgccatcagcggattggcccctacagggggtcgaagagaacggtggcattgattccctcccatttaggctcatgctccaggactgtacagctgtgaagacccttctgcttaagatgaagcgagttctccaggagagcgccgacatgagcccagcatccagtactacctccctgcccgtgtctccactcactgaagagccggtaccgtttaaagacataatgaaagatgaatgttctatgctaaagctgcaactgaaggagaaggatgagctcatctctcagttgcaggaggagctcgggaaagtgagacatttgcagaaggcatttgcttctcgagtggacaagtccacccaaaccgagctgctgtgctacgacggcctgaacctgaagaggttagaaactgtccaggggggacgggaggctacctacagaaacagaattgtgtcccagaatcttagtaccagggataggaaggctattcataccccaaccgaggatcggttccggtactccgctgcagaccaaactagtccctataagaacaaaacatgtcaattgcctagcctctgcctttcaaacttccttaaggacaaagaactggccgaggttattaagcattcgcggggtacatacgagacgctgacttcagacgtcacacagaatctgcgtgcaacagtcggccagagttcactcaagcccaccgcaaagaccgagggcctgtccacattcctcgaaaagcccaaggaccaagtggccacagctcgccagcactctaccttcacaggccggttcggccaaccccctcgtggcccgatttctctgcatatgtatagccgaaaaaacgtattcctgcaccataacctacactccaccgaactgcagactctgggacagcaggatggttag

SEQ ID NO: 47348 - DNA, 2034 bp, Artificial Sequence
  Description of Artificial Sequence: Synthetic coding sequence
atgggcgacagcggcagccggcggagcaccctggtgagccggctgcccatcttccggcgctcaatcaatagacggcacgattctttaccatctagtccatcctcaagtaacaccgtcggagtccactctagtagccctagctccactaactctagttcaggtagtacaggaaaacgccgcagcatctttcgaaccccctccatcagcttccatcacaagaaaggcagcgaaccgaagcaggagcccaccaatcagaacctttccatttccaatggcgcccagcccggccacagtaatatgcagaaattgtccttagaagagcacatcaaaacgcgggggcggcactccgtggggttttcttcctcccgcaacaagaaaattactcggtcactgacagaggacttcgaaagagaaaaggaacattcaacaaataagaatgtttttattaattgcttgtcttctggaaagagcgaaggcgatgattcggggtttactgaggatcagacaagaagaagcgtgaaacagtccactaggaaattgctgcctaaaagcttcagctctcactataagttttccaagcccgtactgcaatcccagtcaatttcactggtgcagcagagcgagtttagccttgaggttacacagtaccaggaacgagaaccagtcctagtgagagccagtcctagttgctctgtggacgtcacagagagagccggttcatctcttcagagtccactgctgtctgcagacctcacaactgcccagacgccgtcagagttcttagcactaaccgaagattcagtgagtgagatggacgcctttagcaaatcaggaagtatggccagccactgtgacaatttcggacacaacgactcaacctcacagatgagcctgaactctgccgccgtgaccaagactaccacagaactgacaggcaccgtgccatgtgcaataatgagtccagggaaataccggctggagggacagtgctccactgaatctaacagcctccccgaaaccagcgcggctaaccagaaagaagtactgctacagatcgcggagttacctgccacaagtgtgagccatagcgaaagcaatcttcctgccgattctgaacgggaggagaatattgggctccaaaacggagaaaccatgctgggaactaacagcccgcggaagttggggttctatgaacagcataaggccatcgcggaacatgtcaaggggatccaccctataagcgactccaaaatcattccgacctcgggagaccatcatatctttaacaaaacatctcacggatacgaagctaaccccgccaaagttctggctagttcgctttctccatttagggagggccggttcatagaacggcggttacggagtagctctgaggggacggccgggtcaagtaggatgattctcaaaccgaaagacggaaacattgaggaggtaaactcccttagaaagcagagagccggatcttcatcctctaagatgaattccttggatgtgctgaacaacctgggctcctgtgagctggacgaagatgatctaatgctcgaccttgaatttctcgaagaacagagtctccaccctagcgtgtgtcgcgaggattcttaccactccgtggtctcgtgtgccgccgtagtccttacaccaatggagccaatgattgaaatgaaaaagcgagaggagcccgagtttccagagccttctaagcagaatttgagcctgaagctcactaaagatgtggaccaggaggctagatgcagccacattagtcgtatgcctaacagcccatcggccgactggcctctgcagggcgtggaggaaaatgggggcatagactcactgcccttccgtctgatgttgcaggactgtaccgcagtgaagactctgcttctgaaaatgaagcgggtcctccaggaaagcgccgatatgagtccagcttcgagtactacatcactgcccgtgagcccactgacagaagagccagtgccttttaagaccacctatccgagggaattctag

SEQ ID NO: 47349 - DNA, 2034 bp, Artificial Sequence
  Description of Artificial Sequence: Synthetic coding sequence
atgggcgacagcggcagccggcggagcaccctggtgagccggctgccaatcttcagaagatcaatcaatcgaagacacgattccctgcctagtagcccctcctcctccaacacagtgggcgtgcattcgtccagcccttcatctaccaatagctctagcggtagcactggcaagcggcggtctatctttagaactccttcgataagctttcaccacaagaagggctccgaaccgaagcaggaaccgacgaatcagaatttgtctatatccaacggcgctcagcctgggcacagcaacatgcagaaactgagcttggaggaacacataaagacccgaggaaggcattcggtcgggttttcgtcctctcggaacaagaagattacaagatcccttaccgaagacttcgaacgcgaaaaagagcactccaccaacaagaatgtgttcattaactgtctcagttctggtaagtctgaaggtgacgactcagggttcacagaggaccagacccggagatccgtaaagcaatctacacgtaagctcctccctaagtctttttccagtcattataagtttagcaagcccgtgctgcaatcccagtcaatcagcttagtgcaacaatcagagtttagtctggaggtaacacagtaccaggagcgagagccggtccttgttcgggcctctcctagctgttcggtggatgtgacagagcgagccggaagctcacttcaatctcctctcttgagcgctgatctgaccacagcccagacgccctctgagttcctggctttgaccgaggacagcgtgtcagaaatggacgccttctcaaagtctggatccatggcttcacattgcgataacttcggccataacgactcgactagccagatgtccctaaacagtgccgctgttaccaaaaccaccactgaactgacaggcaccgtgccatgcgctataatgagcccgggcaagtaccggctggaagggcaatgttcgaccgaaagtaattcattgccggagacaagcgccgcgaatcagaaagaggtgcttctgcagatcgccgagctgccggcaacttcagtcagccactcagagtccaacttgcccgccgatagtgaaagagaggaaaacatcggccttcagaacggagagaccatgctcggaacaaattcccccaggaaacttggcttctacgaacaacataaggccatagctgagcacgtgaagggtattcaccccattagcgactccaaaataattcctacttccggcgaccaccacatctttaataaaacaagtcacggttatgaggccaaccctgccaaggtgttggcaagctcactttccccgtttcgggagggcaggtttatagagcgcaggcttcgcagcagcagcgagggaaccgccggaagtagccgaatgatactgaagcctaaagacgggaatatcgaagaagtgaacagcctacgcaagcagcgcgccggaagctcttcgtctaagatgaactccctggacgttcttaataatctcggctcttgtgagcttgacgaggacgacctgatgctcgacctagagtttttggaagagcagagtcttcatccctccgtctgtcgcgaagacagttaccattccgtggtaagctgcgcggccgtcgttctgacaccaatggagcctatgatcgagatgaagaaacgggaggagcccgagtttccagaaccttccaagcagaacctcagcctaaaattaacaaaggatgtggaccaggaggccaggtgtagccacattagccgcatgcctaacagccccagcgccgattggcctcttcaaggggtcgaagagaacggaggtatcgactcactgccgtttcgactgatgctccaggactgtactgccgttaagactctccttctgaagatgaaaagggtgctccaggagagtgcagacatgtcccccgcttctagtaccaccagcctgcccgtttcacccctgacagaggagcctgtccctttcaaagactactacaaacgcccattttag

SEQ ID NO: 47350 - DNA, 2703 bp, Artificial Sequence
  Description of Artificial Sequence: Synthetic coding sequence
atgggcgacagcggcagccggcggagcaccctggtgagccggctgccgatatttcgccggagcatcaaccgccggcatgacagtttacccagctcaccttcaagctctaataccgtaggtgtgcactcatcttcccccagttctaccaatagttccagcgggtcaactggtaagaggcgtagcatctttaggaccccgtctatatcatttcatcacaagaaagggtcagagcccaagcaggaaccaaccaatcagaatctgtcgatctcaaatggggcacagccaggtcatagtaacatgcagaagttgagtctggaagagcacatcaagacccgcgggcgtcactcagtgggctttagttcatctcgtaataagaagattactcgaagcctcacggaagacttcgaacgtgaaaaagagcacagtaccaacaaaaacgtctttatcaactgcctgagcagtggcaagagtgaaggcgacgactcaggttttacagaagatcagaccagaagatccgtaaaacagagcacccggaagctgcttcccaaatcattcagttcccattacaaattttcaaagccagtcctgcaatctcagagcatatccttagtgcagcagagcgagttctctcttgaagtcacgcagtaccaagaaagggagcccgtgctcgtgcgcgcgtcaccatcatgttccgtcgacgtaactgagcgtgccggctcgtccctgcagtccccactactgtctgctgatctcaccacagcccaaaccccttctgagtttctggcccttactgaagatagcgtttcagaaatggacgcattcagtaagtccgggagcatggcctcccactgcgacaactttggccataatgactccacctcgcagatgagtctgaactccgccgccgtgactaagactacaactgagctaaccgggactgtcccatgcgcaatcatgtcgccagggaaatatcgcctagaaggccagtgcagtacagaaagcaatagcctgcccgaaacatctgccgccaatcagaaggaggtgctcctgcagatagccgaacttccagccacctccgtgtcccattcggagtccaacttacccgctgattcagagcgcgaggagaacataggtctacagaacggtgagaccatgctgggtactaattcccctcggaaactcgggttttacgagcagcataaagcaattgcagagcatgtcaaaggaatccaccctatcagcgatagcaagatcattccaacatctggggatcaccacatattcaacaaaacttcccatggttacgaggccaaccccgcaaaagtccttgcaagcagtctgagccccttccgggaaggtaggtttatcgaaagaagactgagatcctcgagcgagggcaccgcaggctcttcacgcatgatcctcaagccaaaagacggcaatatcgaagaagtgaactccctcagaaagcagagggcaggatcctcaagctcaaagatgaattcactggacgtcctgaacaatttgggaagctgcgagctggacgaggacgacctcatgctggatctggagttcttagaggagcagtccctccacccctcagtctgccgcgaagatagttaccatagtgtcgttagttgtgccgctgtcgtgcttacccccatggagcccatgatcgagatgaaaaaaagagaggagcctgaatttcctgagccaagcaagcagaacctgtccctcaaactgactaaggacgtggaccaggaggcacgatgcagccacattagccggatgcccaattctcctagcgccgactggccgctgcaaggcgtggaggaaaatgggggaatcgatagcctcccattccggctcatgctccaagattgtactgccgtgaaaaccctgctgctcaaaatgaaacgtgttcttcaggagtccgctgacatgagcccagccagctctacaacaagccttcctgtgtctccgcttaccgaggaacctgtgccatttaaagatattatgaaagacgagtgtagcatgctgaaattgcagctgaaagaaaaagacgaactgattagccaattgcaggaagaactggggaaggtgcgacacctgcagaaagcattcgcaagtcgggtggataaatctactcaaaccgaactgctatgttatgatggcttgaacctgaaacgactcgaaactgttcaaggcggccgtgaagcaacctatagaaaccgcatcgtctctcagaacctgtccacgcgggatcggaaggccattcacactcctactgaggaccgcttcagatatagtgcagccgaccagacctctccctacaagaataagacatgtcagctgccttcactgtgcttgagcaattttctcaaggacaaagaactcgccgaggtgattaaacattctcggggaacatatgaaactctgacatctgacgtgacccaaaatctgcgggcaactgtcgggcagagctccctgaagcccacagcaaagactgaagggttaagcactttccttgagaagcccaaggatcaggtcgccacagcccgccagcattctacctttacgggccgtttcggccaacccccacgtggcccaatcagcctccacatgtactcgcggaaaaacgtgttcttgcaccacaatctgcactccactgaactgcagaccttaggacagcaggatggatag

SEQ ID NO: 47351 - DNA, 10074 bp, Artificial Sequence
  Description of Artificial Sequence: Synthetic coding sequence
atgggccggcacgtggccaccagctgccacgtggcctggctgctggtgcttatctcagggtgctggggccaagtaaacagacttccctttttcaccaatcacttctttgatacctatctcctcattagtgaggacacaccagtggggtcaagtgtgacccagctgctggctcaggatatggacaatgatcccttggtttttggcgtcagcggcgaagaggcctccaggtttttcgcggtggagcctgacacaggggtcgtatggctacggcagccccttgatagagagacaaagtccgagttcaccgttgagtttagcgtgagcgaccatcagggggtgattacacgcaaagtcaacatccaagtgggtgacgtcaatgataacgccccaacttttcataaccaaccttattcagtccgtatccccgaggtgggtgctactggcaatactcctgtgggcacccccatctttattgttaatgccacagaccccgacctgggggcaggagggagcgtgttgtactccttccagccaccctcccagttctttgccattgactcggcacggggaatagtgactgtgattagagaattagattatgagactacccaagcctaccagctcacggttaacgcaactgatcaggacaagacacgcccactgtctactctggcaaacctcgccataatcatcaccgacgttcaggacatggatccgatcttcattaatctcccatactccacgaacatctacgagcactctccacctggcacgacagtcagaattataaccgccatcgatcaggacaagggtaggcctcgggggataggatataccatcgtctccggcaacactaactccatctttgccttggactacatttccggagttctgactcttaatggtctactggacagggaaaacccactttactcacatggattcattctgacagtgaagggtacagaactgaacgatgatagaactccctctgacgctactgtgactacaacctttaatattcttgtcattgacattaatgataacgcacctgagtttaactcttccgagtatagcgtggctatcaccgaattggcacaagtgggctttgccctacccttatttatccaggttgttgacaaagacgagggattgaattcaatgtttgaagtttacctggtggggaataatagtcaccacttcatcattagcccaaccagtgtgcagggaaaggcagacattcgtattcgggtggcaatcccactcgactatgaaactgtggaccgatacgatttcgatttatttgccaacgagtctgtgccagaccacgtgggatacgccaaagtcaagattactctgattaacgaaaatgataataggcctatattctctcagcctctctacaatatcagcctttacgaaaatgtaactgtggggacatcggtgcttacagtcctggcgactgacaatgatgccggtacctttggcgaagtaagttatttcttctcagacgatcctgaccgcttctccctggacaaagacaccggtcttatcatgcttatcgcacgccttgactacgagctcatacagaggttcactctaacaattatcgcaagagatggtgggggcgaagagactacagggcgcgtgaggataaacgttctggatgtgaacgataatgtcccaaccttccagaaagacgcctatgttggagctctccgagagaatgagccatccgtcacgcagttggtgaggctgcgggcgaccgatgaggactcaccccctaacaatcagataacctatagtattgtgtcagccagtgcgttcgggagctattttgatattagcctatatgaagggtatggggtgatctcagttagcaggccgttagattacgagcagatctccaatggcctgatttatcttacagtgatggcgatggatgccggcaaccctcctcttaatagcacggtgcctgtgaccatcgaggtgtttgacgagaatgataaccctccaaccttctctaaacccgcatacttcgtgtcagtggtggagaacattatggccggcgccactgtcctgttcctgaatgccacagatctcgaccgttccagagaatatgggcaggagtccattatctactccctcgagggttcaacacagtttcgaattaatgccaggagtggtgaaatcacaactacatcccttttggatcgagagacaaagagcgagtacattctgattgtgcgggctgttgatggcggcgtcggccacaaccagaaaacaggaattgccactgtcaacattacactgctggatatcaatgacaatcaccctacatggaaagacgcaccatactacataaatctggtcgagatgaccccacccgattccgatgtgaccaccgtggtggccgttgaccccgacttgggagagaacggcacgttagtctactcgatacagccacccaataaattctattcactgaacagcaccacgggtaaaatcaggacgactcatgccatgttggatcgcgaaaatcccgatccccatgaggcggagctgatgagaaagattgtggtgagcgtgactgactgcggccgcccgccactgaaggcgacatcttctgcaactgtcttcgttaaccttctcgacttaaacgataacgatcccacctttcagaatctgcccttcgtcgccgaagtccttgaaggtattcccgccggagtgagtatttaccaagtagtggccattgacctagatgaagggcttaatgggctagttagttatagaatgcccgtgggtatgccccgaatggattttttaatcaactcttctagtggagtggtcgtaacgactacagaattggatagagaaagaatcgcagaataccagctgcgggtcgtggcctcggacgccggaacccctaccaagagttctacctctacacttacaatccacgttctggatgttaacgacgaaacccccactttttttccagcagtctacaatgtttccgtatccgaggatgtgccaagggagttccgagtggtgtggctgaattgtacagataacgacgtggggttgaatgcggaactttcctacttcatcaccggtgggaatgtggatggcaagttttccgtgggctatagagatgccgtggttcgcaccgttgtcggcttagatagagagacgactgctgcctacatgctgatcttagaagcaatcgataatggtccagttggaaaaaggcacacaggaaccgctacagtgtttgttactgtgctagacgttaatgacaatcgtcccatttttctgcaatcttcgtatgaggcctctgtccccgaggacatcccagaaggccactcaattctgcagctaaaagccactgacgcagatgaaggcgaatttggaagagtgtggtatagaattcttcacggaaaccacggaaataacttccgaattcatgttagcaatggcctgctgatgcgcggcccgaggcccctcgatcgcgaaaggaactccagtcacgttttgatcgtggaagcctacaatcacgacctggggcccatgcggagtagcgttagggtcattgtctacgtcgaggacatcaacgacgaagcccctgtgttcacgcaacaacagtattcaaggctgggtctgagagaaaccgccgggattggcaccagtgtgatagtcgtccaggcaactgacagggattctggggacgggggcctggtcaactacaggatcctttccggcgccgagggtaaatttgagattgacgagtcgacgggcctcatcattactgtgaactatctagattacgaaaccaaaacctcatacatgatgaacgtgtcagcaactgatcaggcccctccctttaatcaaggtttctgttctgtgtacattaccctgctgaacgagctggacgaagcagtacaattctccaatgcatcctacgaggccgctatcctggagaatttggctctcggcactgagatcgtgcgtgtgcaggcttattccattgacaatttgaatcagatcacttatcgatttaatgcttacacatccacacaagccaaggccctgttcaagattgacgccattactggtgtgatcaccgtccaaggactggttgaccgcgagaaaggcgatttctatacactgaccgtggtcgcggacgatggcggtccaaaagtagactcgactgtaaaggtatatattacagtgctggacgaaaatgataattctccaaggtttgatttcacaagcgactcagcagtgtcaattcccgaagactgtcccgttggccagagagtggcaactgtgaaagcttgggatccagacgccggttctaatggacaggttgtgttcagtcttgccagcggaaatatcgctggggcgttcgaaatcgtgactaccaacgacagtatcggagaggtgttcgtagcgcgccctctagatcgcgaggagcttgaccattatatcttgcaagttgttgccagtgacagggggaccccccccaggaagaaagaccacatcctgcaggtgactatcctcgatatcaatgataatccgccggtgatagagtcaccgtttggatataacgtatcggtaaacgagaacgtaggcggtgggaccgccgtggtgcaggtgcgagcaacagatcgagacataggaattaacagtgttttgagttactacattaccgaaggaaacaaagatatggcatttcggatggaccgcatttctggggagattgctaccaggcccgccccccctgaccgggagcgccaaagcttttaccacttggtggccacagtggaagatgagggtacacccactttatcagcaaccacacacgtctatgtgacgattgttgacgaaaatgataacgcccctatgttccagcaaccacactacgaggtcctgctggatgaggggcctgatactctaaacactagcctaatcacaattcaggcactcgacctagatgaaggtcccaatggtacagttacatacgcaatcgtggccggtaacattgtcaacacctttagaattgatagacacatgggcgtgattacggccgccaaggagttggactacgagataagccacgggcgatacactctgattgtgaccgcaactgaccagtgtcctattctctcacaccgcttgaccagtaccactaccgtactagtcaatgtaaatgatattaatgataatgtacctaccttcccccgtgattacgaaggaccgttcgaggtgaccgaaggacagccgggtcccagggtgtggacttttctggctcatgacagagacagcggcccgaatggacaagtggaatactctatcatggacggcgacccgctcggagagttcgtgatatcaccagtagagggagtactgagggtgagaaaggacgtggaactggatcgggaaacgattgcattttacaatctgacaatttgtgcacgagatcgcggaatgccaccactgagtagcacaatgctcgtgggcatcagagtcttggacatcaatgacaatgacccagtgctgctcaacctccctatgaatatcactattagcgaaaatagccccgtctcttcgtttgtagcccacgtgctcgccagcgacgccgattcgggctgcaatgcccgcctcaccttcaacatcacggcaggcaatagagagagggcttttttcattaatgcaaccactgggatagtgacggtaaatcgacctctggacagagagagaattcctgagtacaagctgaccatttcggtcaaggataacccagaaaacccacggatagcccgccgggattacgacctcctcctgatctttttgtctgacgaaaacgataaccaccccctgtttaccaagtcaacttaccaggccgaggtgatggagaatagccctgcggggacacccttgacagtgctgaacgggccaattctggcattagatgccgaccaggacatttacgccgtcgttacctatcagctgctgggagcccagtcaggactgtttgacattaatagcagcacaggcgtggtgacggtccgctccggcgtcatcatagaccgcgaggctttctcacctcccatccttgaactgctgctcctggctgaggatatcggactccttaatagtaccgcccaccttctcataaccatcttggatgacaacgacaatagacctaccttcagcccagcaactctgacagtgcacctgttggagaactgcccccctggtttctctgtactccaagtcaccgctaccgacgaggattctggcttgaacggcgagctggtctaccggattgaggccggcgcacaagatcgcttcctgatccacttggtgacaggcgtgattagggttgggaacgccacaatcgaccgtgaggaacaggaatcataccgcttgactgtggtggcaaccgatcgcggaacagtgcctctgtcaggcacagcaatcgtgaccatcctgattgatgacataaatgacagcaggccagagtttctgaacccgattcagaccgttagcgttctggagtcagctgaacccgggaccgttatcgcgaatatcactgcaatcgaccacgacctcaacccgaagctagaatatcacatcgtgggtatcgtcgccaaggacgataccgacaggctggttcctaaccaggaggacgcattcgctgtgaacatcaataccggatccgtgatggtcaaatcccccatgaatagagagcttgtggctacttacgaagtgactttgtctgtgatcgataacgcgagcgatcttcctgagcggagtgttagcgtacccaatgccaagctcacggtgaacgtgctggacgtaaacgataataccccacagtttaaaccatttggaattacatattatatggagaggattctggagggagccacccccggtaccaccctgatcgctgtcgccgccgtggaccccgacaagggtcttaacggtcttgtgacctacaccttactcgatctcgtcccaccggggtacgtgcagctggaggatagttctgctggaaaagtgattgcaaaccgaaccgtagattacgaagaagtgcattggttaaacttcacggtacgcgcatctgacaatggaagcccacctagggcagctgagatacccgtatatctcgaaattgtcgacattaacgataacaatcccatattcgaccagccatcttaccaggaagccgttttcgaagacgttcctgtgggcacgattatccttacagtgactgctaccgatgcagatagtggaaatttcgcactgatcgaatatagcctgggggacggggagtccaagtttgccatcaatcccacaactggagatatatatgtgctgtcaagcttggaccgggagaaaaaggatcactacatcttgacggccctcgccaaggataatccaggcgatgtggcgtctaaccgacgtgaaaactcagtacaggtagtcatacaggtacttgacgtcaatgattgtcggccccaattcagtaaacctcagtttagcacctcagtctacgaaaatgaacccgcggggacatcagtaatcacgatgatggctacagaccaggacgaaggtcctaacggtgagttaacatatagcctggagggccctggagtcgaggccttccatgtggatatggactccggattggttactacccagcgccccctgcaatcatacgagaaattcagcctcaccgttgtggccaccgacgggggtgaaccacccctttgggggactaccatgttgctcgtggaagtcatagacgtaaacgacaatcggccagtctttgttcggccacccaatggtaccatcttacacatccgggaggaaatcccactgcggtctaatgtctacgaagtttacgccactgacaaggacgaaggcctgaacggggctgtgagatacagcttcctgaagaccgccggcaaccgagactgggaattctttatcatcgatccaatctcgggacttatacagaccgcccaacgtctggaccgggagtctcaggcagtgtacagtctcatcctggttgcgtcggacctgggccagcctgtcccctacgaaactatgcagcctcttcaagtggctctggaggatatcgacgataatgaaccacttttcgtcaggccacctaagggaagtcctcagtatcagctgctgactgtgccagaacacagtcctcgagggacgctggtggggaacgtgacaggagccgtcgatgcggacgagggccctaacgccattgtctactattttatcgccgctggaaatgaagagaagaatttccacctgcagcccgacgggtgcctccttgtcctgagagacctcgaccgagagcgcgaagctatcttctcttttatcgtcaaagcgtcctccaacagaagttggacccccccccggggcccctccccaaccctggatctggtggcagatcttactctccaggaggtgcgcgtcgtcctcgaggatatcaacgatcagcctccccggtttaccaaggccgaatatactgcaggtgttgccacagatgccaaggttggttccgaattaatccaggtcctggctctcgacgctgacattgggaataactcactggtgttctactccatcttggctattcactacttccgagcccttgcgaacgattccgaagatgtgggccaggtgttcacaatgggcagcatggacggcatcctgaggacattcgacctgttcatggcatactcgcctggatatttcgttgtggacattgtggctcgggatctggctggccacaatgatactgcaattataggcatttatattctgagagacgatcagagagtcaaaattgtgatcaacgaaattcctgatagagtccgtgggttcgaggaagagtttattcacctgctgtctaacataaccggggcgatcgttaacactgacaatgtccagtttcacgtggacaagaagggtagggttaatttcgcgcagaccgaattgttgattcacgtcgtaaatagggatactaataggattctggatgtggatcgggtgatccaaatgatagacgaaaataaagagcagctcagaaatttgtttagaaactacaacgtgctagacgttcagccagcaatcagtgtgaggttgccggatgatatgtcagcgctgcagatggccatcattgttctggcaatactgctgttcctcgctgctatgctgttcgtactgatgaactggtactatcggaccgtgcataaacgcaaactcaaagccatagtcgcaggctcggcaggtaatcgtggatttatcgacatcatggacatgccgaacaccaataagtactcgtttgatggggctaaccccgtttggttagatcccttctgtcggaacctggagctggctgcccaggcagagcacgaggacgatctgccggaaaatctatctgaaattgcagatctctggaatagtcccacgagaacccacggtaccttcggaagggaacccgcagccgtcaagcctgacgacgacaggtacttacgtgctgctatccaggagtatgataacatcgccaaactcggacagatcatccgcgagggcccgatcaagggttccctcttgaaagtggtcctggaggactacctgcgactgaaaaaactgtttgctcagaggatggttcagaaggcctcgtcctgccatagctccataagtgaattgatccagaccgaactggacgaggaacccggcgaccacagtccaggacaggggagcttgagatttcgtcataaacccccggttgaattgaagggccccgacggaatccatgtggtgcacggttcaaccggaaccctgcttgccaccgatctcaatagcctacccgaagaggatcagaaagggctgggtaggtccctggagactcttaccgcagctgaggcgacggctttcgagcggaatgctcggacggagagcgcaaaaagtacacctcttcataagcttagagatgtgatcatggagactccactggagattacagaactgtag

SEQ ID NO: 47352 - DNA, 3144 bp, Artificial Sequence
  Description of Artificial Sequence: Synthetic coding sequence
atggaggagaagacccagatcaagaccttcctgggcagcaagctgcccaagtacggaacaaaaagtgtgaggagtaccctgcagccgatgccaaatggaacgcctgttaacctgttaggaacaagtaagaactctaacgtcaaatcctatattaaaaacaacggcagcgattgccctagcagccattcattcaattggcgcaaggccaacaagtatcagctgtgtgcccagggagtggaagagccaaataacacacaaaactcgcatgacaagattattgatcccgagaagagggttcccacccagggcatgttcgacaagaatggtattaagggcgggctgaaatccgtgagcctgtttacgtccaagctcgcgaaaccctccactatgttcgtttcgtcaaccgaggagttgaaccagaagtcattcagtggaccatctaacctaggtaagttcaccaagggcaccctactagggcgcacatcatatagcagtataaatacacctaagagccagctgaatggattttacggtaataggtcagccggtagtatgcagcggcccagggcaaactcatgcgctactcggagctcctcgggtgagtctctcgcgcaaagtcccgactctagcaagtctataaattgtgagaagatggtgcgtagtcagtctttttcccattcgattcagaactctttcctgccgccctcgtcgatcacgaggtcccactcatttaaccgagccgtggatctcactaagccctatcaaaatcagcagcttagtattcgagtacctttgcgttccagtatgcttactagaaactctcgccagccagaagtgctcaatgggaacgagcacctcggctatggctttaatcggccttacgcagcgggaggcaagaagcttgcccttcctaacggccccggcgtcacaagcactctgggataccggatggtgcatccctctctcctgaaaagctccagatcaccattttctggtaccatgaccgtcgacggcaacaagaattctccagcagatacatgcgtggaggaggacgcaaccgtgttggccaaagatagggccgctaacaaagaccaggaactgatcgagaacgaaagctatagaactaaaaacaaccagactatgaaacacgatgctaagatgaggtatctgagtgacgatgttgacgatataagcctgtcctctctgtccagctccgacaagaacgacctgtccgaagacttttcggacgatttcatcgatattgaggactcgaaccgcacaagaataacaccagaggagatgtcactcaaggaggagaaacatgagaacgggcccccacaggacatgttcgatagccccaaagaaaacgagaaggctttctctaagaccgacgagtggatagacatatcagtgagtgacaggagtgagtgcaccaagcacacatctgggaacaatctggtgagtcctgatactgattacagggcagggtcatctttcgaactgtctcccagtgactcatcggatggcacttacatgtgggatgaagaaggcttggaacccattggaaacgtgcaccccgtgggatcttacgagagctcagaaatgaacagtatcgatattctcaataatttggagagttgcgatctcgaggacgacgacctgatgctggatgtagatctgcctgaggacgccccgcttgaaaacgtggagtgcgacaacatgaaccgtttcgataggcccgatcggaacgtgcggcagccgcaggagggattttggaaacgcccccctcaacgctggtccggccaggagcattaccatttatcccacccggatcattatcatcatcacggaaaaagtgacctatctagggggtccccgtatagggaatccccattaggtcacttcgagtcctacggcggcatgccgttttttcaggctcagaagatgtttgtcgacgttcccgagaacacagtgatcctggacgagatgaccttgcggcacatggtgcaggactgcactgcagtgaagacccaattattaaaacttaagcgcctgttgcatcaacacgacggctccggaagtttacatgacattcagctgtctctcccttcttcgcctgagccagaggatggcgataaagtctataaaaatgaagacctgctgaacgaaatcaagcaacttaaggatgagataaagaaaaaggatgagaaaatccagctgcttgaacttcagttggcgacacagcatatctgtcatcagaagtgcaaggaggagaaatgcacgtacgctgacaagtatacccagactccatggcgacgcatcccgccacaggtgctgcagccctctagcagtttacctagacctaccgaccatacccaagggaagctcattaaaccgcagaggatagaagccaggtccgagtgttccatacaggacatgcaccagggcggcgcgcacccagaggaaagcttcacccacgtactgcaccaggaaagcaattacggcctcgaggagcagccatttagcagtggaccgcagctaacaatggacgtggccaagtctactccctctgaagcaaacctgaatattaccgtgaatgcgcaagaaccctatcacctggccaacaaccagatctccgatatgcagttcatccctacaagcctccagacccctcctgagtcatctaccgtggaccaggcaaagagagtgggcaggaaccagtcccccccagttggatacatgtcacagcctaagagccttcagttgcttaaaccatctatacttagttcgctcgtccccccacctgtgtctgaatcatccccatcccgaacgcctacatgcaaaaaaagtccaattataaccacctgcaactctgcaaagctacaaccaaccagcagccaaacgaatctcgctaataatcaaaacctgaaggcctccaagctgcggcccccgagcggcagcttcaagcagaaacagacgaacagtccgcagttggagcctcagagtttccaggctaaaaccagtataccaagacccttaacacagcgcaaggagattatgcagaacccgaacggcaaccttcacagcggcgattgtctggcctctaaccgctactcccgtctgcctaaacctaagattcattag

SEQ ID NO: 47353 - DNA, 786 bp, Artificial Sequence
  Description of Artificial Sequence: Synthetic coding sequence
atgaaccggttcgaccggcccgaccggaacgtgcggcagccccaggaaggcttttggaaacgaccaccgcagagatggtctggccaggaacattatcacctctctcaccccgatcactaccaccatcacgggaagagtgatctgagcagaggttccccatatcgagagtcccccctgggtcacttcgaaagctacggcggcatgcccttcttccaggcccagaaaatgtttgtggatgtcccggagaataccgtgattctcgacgagatgacacttcggcatatggtgcaagattgtacggcagtaaaaacgcagctgctaaaactgaaacggctcctgcaccagcatgatggctccggcagcttgcacgacattcagctcagtctccctagcagtcccgagcctgaagatggtgacaaggtttacaaaaacgaagatctccttaatgaaatcaaacagctgaaagatgagatcaagaaaaaggatgaaaaaatacagttgctggaactgcagcttgccacccagcatatctgccatcagaagtgcaaagaggaaaagtgtacctacgctgacaaatatactcagaccccttggaggagaattcctgggggttacagtgctccctctttttccccttggcagggtagcttccagggcatccccagaaccgtaccgcctcaccgcaggcagacaagctctaccacagcctttcaacagccctctcaaactcacaggtcacacccaggaaagaccaataaagccacaacgtatcggggccctcagtag

SEQ ID NO: 47354 - DNA, 3741 bp, Artificial Sequence
  Description of Artificial Sequence: Synthetic coding sequence
atgaaggtgcggctgctgcggcagctgagcgccgccgccaaggtgaaagctccctcaggcctgcaaggtcccccacaggctcaccagttcattagcctcttattagaggagtacggtgccctgtgccaggcagcacgtagtatcagtaccttcctcggcaccctcgagaatgaacatctcaaaaaatttcaggtaacatgggaactccacaataagcaccttttcgagaacctggtattcagcgagcctctgctgcagtctaatttgcccgctctggtgagccagattcggctcggaacgacaacccatgatacctgttcagaggatacatacagtacactgctccagaggtaccagaggtctgaagaagagttgcgccgcgtagccgaagagtggctcgagtgtcagaaacgaatcgacgcctacgtcgacgagcaggacctgcaaacatccgtgaacaagagcattgacaccggaactctagtgcagtcctggctgcgaggagcggccatgactatgaaaactaaacaaaggatgttgacagaggattgggaactgtttaagcagcggcggttcattgaagagcagcttaccaacaagaaggctgtgaccggcgaaaacaatttcactgatacaatgcgacatatgctgtcctcccgcctgtctatgccagactgcccaaactgtaattataggcgccgctgcgcctgtgacgactgtagtttgtcacatattcttacttgcggcatcatggatccgcccgtgaccgatgatattcatatacatcagctccccctgcaggtggacccagcccctgattacctggcagagaggtcacctcctagtgtcagcagcgccagctccgggtccggctcgagcagccccataacaattcaacagcaccctcgcctgatactgaccgacagtggatccgcgccaacatttgatgatgaggatgtcgcccctttgtccgctaagttcgccgatatctatcccctctctaactacgatgatacagaagtggttgccaatatgaacggtatccatagtgaactgaatggtggtggtgagaatatggcactgaaggatgagagtccccagatctcgtccactagttcttcgtcctcagaagctgatgatgaagaagcggatggagagagcagtggggagcccccaggagctccaaaggaagatggcgtcttggggtcaagatctccccgcaccgaagagagcaaagcagattcaccaccccctagttatcctactcaacaggccgaacaggcccctaatacgtgcgagtgtcatgtctgtaaacaggaggctagtggactgactccttcagccatgacagctggagcattgccgccaggccatcagtttctgtcgcccgagaaaccaacccacccggctttgcacttgtacccccatattcatggccacgtcccgctgcataccgtcccgcacctgccccgtcccctgattcacccgaccctctacgccaccccgccatttacccactctaaggccctaccaccagctcctgtgcagaaccacacgaataagcaccaggtgttcaacgcgtctctgcaggaccacatctacccatcatgctttggaaacaccccagaatggaactcaagtaagtttatttcgctctggggttcagaggtgatgaacgacaaaaactggaacccggggaccttcctgcctgatactatctccggatcagaaattctgggcccaacccttagcgagactaggcctgaggctctgccaccgccaagtagtaatgagactccagcggtctcggacagcaaagagaaaaagaacgctgcaaagaagaaatgcctttacaacttccaggacgccttcatggaagcaaataaggtggtcatggctacctcctccgccaccagctctgtctcgtgcactgcaaccacagtgcaaagtagcaattctcaattccgggtttcatctaagaggccgccctccgttggggacgtatttcacggaatatcaaaagaggatcatcgccactctgctcctgccgcaccaaggaacagcccaacaggccttgcccctctgccagctctgtctccagctgccctctctcctgctgctctgtctcccgcctcaacccctcaccttgccaatctcgctgctccatctttccctaaaaccgccactaccacaccaggattcgtggacacgcgcaaatctttctgccctgcgcctctcccccctgctacggacggttctatctccgccccaccttctgtttgcagcgatcccgattgcgaaggtcatcgatgtgaaaatggtgtgtacgatcctcaacaggatgacggggacgaatcggcagatgaggatagttgttcagagcacagcagctccaccagcacatccacaaatcaaaaggaaggtaagtactgtgactgttgttattgtgaattctttggacacggtggacccccagccgctcctacatcaagaaactatgctgaaatgcgagagaagctcagactcaggctgacaaagaggaaggaggagcaacctaaaaagatggaccaaatatctgaacgcgaaagcgtcgtggatcatagaagggtggaggaccttctgcaattcatcaacagttctgagacaaaaccggtgagttctaccagagctgcaaaacgagcacgacataaacagcggaagctggaagaaaaggcaaggttagaagcagaagctagggctcgcgaacatttacatctccaggaggaacagaggcgacgcgaggaagaggaagacgaagaggaggaagaagatcggttcaaggaagagtttcaaagactccaagaacttcagaagctccgggctgtgaaaaaaaaaaagaaggagcgtccgagcaaagactgccctaaactggacatgttgacccgaaatttccaggccgcaactgagagcgtgcccaactccggcaacatccacaacggatccctcgagcagacggaagagcctgaaactagctcgcactcgcccagtaggcacatgaaccactccgaaccccggccaggattgggcgctgatggggacgccgccgatcccgtggataccagggactccaaatttctgttacctaaggaggtgaacggcaaacagcatgagcccttgagctttttcttcgacatcatgcagcaccacaaggaaggaaatggcaaacagaagctccgacaaacctctaaggcaagctccgaacctgcaagacgtccaaccgagccccccaaggccacggagggccagagtaaaccacgggcacagacagagagcaaagctaaagtggtcgatctcatgtccattaccgagcaaaagcgcgaggagcgcaaggtaaacagcaacaataataataagaaacagttgaaccacatcaaagatgagaaatcaaacccaacacccatggagcccacatccccaggtgaacaccagcagaactccaaactcgtgttagcagagtcaccacagcctaaaggtaaaaataagaaaaacaaaaaaaaaaagggcgaccgagtaaacaactctattgatgatgttttcttgccaaaggatattgatttggattccgtcgatatggacgaaactgaacgcgaggtggagtattttaagcggttctgcctggattcagcgcggcaaaccagacagcgactgtctattaattggtctaatttcagccttaaaaaggccacattcgcagcacactag

SEQ ID NO: 47355 - DNA, 3636 bp, Artificial Sequence
  Description of Artificial Sequence: Synthetic coding sequence
atgaaggtgcggctgctgcggcagctgagcgccgccgccaaggtgaaggcaccaagcggactccaggggccaccccaggcgcaccagttcatttctttgctcctagaggagtacggggctctatgccaggcagctcgcagtattagcaccttcctggggacgctcgagaacgagcacctcaaaaagtttcaggtgacttgggaactgcataacaagcacctgtttgagaatctagtcttctccgagccattgctgcagtctaacctgcctgcactagtatcccagattaggctgggcacgacaacccacgacacatgtagtgaagacacatactcaactctgttacagaggtaccaaagaagtgaggaggagttgcgaagggtggcagaggagtggctagaatgtcagaagcgcatcgatgcatacgtggatgagcagatgaccatgaaaactaagcagaggatgttaactgaggactgggagctgtttaagcagcgcaggttcattgaggagcagctaaccaacaagaaagctgtgacaggtgagaataacttcactgataccatgcgtcatatgctgagttctcgattgagcatgcctgactgcccaaattgtaattaccgaaggcgttgcgcctgtgatgactgcagcctcagccacattctgacgtgcggcatcatggacccgccagtaacagacgacatccacatccatcagttgcctctacaagtggacccggcccccgattatctagctgagcggtctcccccctcagtctcctcagcgtctagcggctccggatcctcttcccccatcactatacagcagcacccccgcctgatcttaacggacagcgggtccgctccaacattctgttctgacgacgaggacgtcgccccactctcggctaagtttgcagacatttatcctctgagcaattatgatgataccgaggtcgtagcgaacatgaacggtattcattctgaactcaatggcggtggcgagaacatggccctgaaagacgagagtccccagatatctagcactagctctagcagtagcgaagccgatgatgaagaagccgacggcgagagttccggtgaaccccccggcgctcctaaggaagatggcgtgctcggcagccggagcccaagaaccgaagaatccaaagctgactcccctccaccaagctaccctacccagcaagccgagcaggcgcccaatacctgcgaatgccacgtctgcaaacaggaggcatcaggccttaccccctcggccatgaccgccggcgctctgccacccggtcaccagtttctgtcaccagaaaagccgacccacccagccctgcacctgtacccacacatccatggccatgttccgttgcatactgttccccatctgcctcgccccctgattcatcctactctgtacgccacaccacctttcacccactccaaagccctgccccccgccccagtgcaaaatcatacaaacaagcatcaggtgttcaacgcgtccctgcaggatcatatatatccgagctgttttggaaacacccccgaatggaacagctccaagttcatatctctctgggggtctgaagtcatgaatgacaaaaactggaaccccggcacattcctcccagacactatcagcgggtctgagatcttgggaccaacactgagtgagactaggcctgaagctctcccgccaccatcttcaaatgaaacaccagctgtgagtgactccaaggagaagaagaacgccgctaaaaagaagtgtctctataacttccaagatgccttcatggaggctaacaaggtggtcatggccacatcttcagctacctcatccgtctcttgtaccgcaaccacagtgcagtcatcgaactcgcagtttcgggtctcatcaaaacgacccccatccgtcggggacgtgtttcacggcatcagtaaagaggatcacaggcactctgcaccagcagcgcctcgcaactccccgactgggctggcccccctgcctgccctttctcctgctgcgctgagccctgccgctctgtcccctgcgtccaccccacacttggccaaccttgctgccccatcgtttcctaagacagccaccaccacccctgggttcgttgacacccggaagtccttctgccctgcccctctgcctcccgccaccgacggttccatttcagcacctccaagtgtgtgctctgacccagattgtgagggccatagatgcgaaaatggagtgtatgacccccagcaagatgatggagatgagtctgccgatgaagattcttgttctgagcattccagtagcaccagtacctccacaaaccaaaaggagggcaagtactgtgattgttgctactgtgagttcttcggccacggaggaccccccgcagcacccacttcgcgaaactacgccgaaatgagagagaaacttagactgaggctgaccaagcgcaaagaagagcaaccgaaaaaaatggaccagattagcgagagagaatccgtggtggatcatagacgagtcgaggacttgttgcagttcataaatagtagcgagactaagcctgtgtcttcgactagggccgctaagcgagccagacacaaacagagaaagctggaagaaaaggctagattggaggcggaagctcgggcccgcgaacatctgcatttgcaggaggagcagaggcgtagggaggaagaggaggacgaggaagaagaagaggatcgtttcaaagaagagtttcagcggttgcaggaactgcagaagctcagagctgtgaagaagaagaaaaaggaacgcccttctaaagattgccccaaactcgatatgctgactagaaattttcaggcggccacggagagcgtaccgaatagcggaaacatacataacggcagtctagagcagacggaggaacctgagaccagtagtcacagtccttctaggcatatgaaccactccgaacccagacctggtcttggcgccgatggggacgctgccgaccccgtggacactagggacagcaagttcctcctccctaaagaggtcaacggcaagcaacatgagcccctgagtttcttcttcgatataatgcaacatcataaggagggcaatggcaagcagaagctgcggcagacctccaaggcttcctctgagcctgctcgacgccccacggagcctcctaaggccactgaggggcaatctaaaccgagagctcaaactgagtcaaaagctaaagtcgtggatttgatgtctattactgagcagaagagagaggaacgaaaagtcaactctaataacaacaataaaaagcagctaaatcatatcaaagacgaaaagtccaacccaacccctatggagccaaccagccccggcgagcatcagcagaatagcaagttagtactggctgagagcccacagcctaaaggcaagaacaaaaaaaacaagaaaaagaaaggtgaccgggtcaataacagcattgacgatgtattcttgccgaaggacatcgacctggacagcgttgacatggatgaaacggagagagaggtcgagtacttcaaaagagatggagtgtctccccactgccctgggtggagccgaactcccggtttaaaatag

SEQ ID NO: 47356 - DNA, 2469 bp, Artificial Sequence
  Description of Artificial Sequence: Synthetic coding sequence
atgacccggcggcggagccggcccagcggcggcgccggccggcgggaaagggccagggccgccgggccacagaagccccaggctccagaacctcctcccccgccctcactcgaagcgggggccggggccggaccacctgaagcacccgccgagccagaccacgacggacctcgcgaagatgatgaacccaaccttgtccctgggcctcaggtgcctcctgcaagtagtcaacccgtgcaaacctgctgtttgttgtgccacagggaacggaaaggctgggaagagggaccttcccagaacggcttagtgctccaaggcgagaaactccctcctgatttcatgcctaaattggtaaagaacctgctgggagagatgccactgtgggtctgccagtcctgccgtaagtcaatggaggaagacgagaggcagacagggcgagagcatgccgtggccatttctctgagccacacaagctgtaaatctcagtcctgcggcgacgatagccacagcagcagctcatcctcgtcctcatcaagctcttctagctcttcttcctgtcctgggaattcaggggattgggacccttcttcctttctctcggcacataaacttagcggattgtggaattctcctcactcatctggggcgatgccgggctccagccttggctcaccgcccactatccctggtgaagcattccccgtgagcgagcaccaccagcattccgatctaactgccccccctaactccccaacaggccatcacccacaacccgccagtttgatcccttcccaccccagctctttcggctctcctccacacccgcatttgctgcctactacccccgcggcaccgtttccagcccaggctagtgaatgcccagtagctgcggccacagctccacacactcccggcccatgtcagtcgtcgcatctgccgagtacctccatgcctctgctgaaaatgcctccacccttctccggttgctcacacccttgcagcggccactgcgggggtcattgttcaggtcccctccttccgccaccttcttcccagcccctcccatctactcaccgcgatcccgggtgtaaaggacataagttcgcgcactccggattggcgtgtcagctcccacagccatgcgaggccgacgaagggcttggggaggaggaagattcgtcatctgaacggagcagctgtaccagcagctccacccatcaaagagatggaaaattctgtgactgctgctactgtgaatttttcggccataacgcggaaaaagagaaggcacagctcgccgccgaggcactgaagcaagcaaatcgtgtcagcggatcaagggagccccgtcccgcccgggaaagactcctggaatggcccgatcgagaacttgacagagtgaacagcttcctgtcatccaggctgcaggaaataaaaaacacagtgaaggattcaatacgggcaagcttttctgtttgcgaactctccatggactctaacggttttagcaaggaaggcgccgccgagccagagccgcagagcctgcctccctccaacctgtctggttcttccgagcaacaaccagatatcaatctggatctcagccccctgaccctgggcagcccacagaaccatacactgcaagccccaggagagcctgcccccccttgggctgagatgcgcggacctcaccctccctggaccgaggtccggggccctcctcctggcatcgtgccggagaacgggcttgtacgccggctgaacacagtccctaatttgtctcgagtaatttgggtaaaaacgcctaaacccggttaccccagtagtgaggagccttcttctaaagaggtgccatcttgtaagcaggaacttcccgagccagtgtcatccgggggcaagcctcagaaagggaagcgacagggttcgcaggccaaaaaatctgaagcctctcctgccccacggcctcccgcatccctggaggtcccaagtgcaaaaggtcaggtcgctggccccaagcagcctgggcgcgtgctcgagctgcctaaagtggggtcttgcgccgaggcaggtgaagggtcccgaggttcaaggccggggcctgggtgggccggaagcccaaaaactgaaaaggaaaagggcagttcatggcgaaactggcctggagaggccaaggccaggccccaggagcaggagtcagtacagccctccgggcctgccagaccacagtcactgccacaggggaaagggaggtcacgcaggtctagaaataagcaggagaagcctgcatcttctcttgatgacgtgtttctgccaaaggatatggatggggtggagatggatgaaaccgaccgagaagtagaatatttcaagagattctgcctcgattccgccaaacagacccggcagaaggtggcggtgaattggacaaattttagcctgaaaaagacgaccccatccaccgcacagtag

SEQ ID NO: 47357 - DNA, 3798 bp, Artificial Sequence
  Description of Artificial Sequence: Synthetic coding sequence
atgaaggtgcggctgctgcggcagctgagcgccgccgccaaggtgaaggcgccgagcgggctgcagggtccgcctcaggcacaccagtttatctctctgctgctagaggagtacggcgctctatgccaggccgcgcggtctatctccaccttcttgggcacactagagaatgaacacctgaagaagttccaggtgacctgggaactccataacaagcatctgttcgagaacctggtattttcagagcccttattacagagcaacctccccgccctggtgagccaaatccgtctcggcactactacacacgacacatgttccgaggacacttactcgacactcctgcagcgataccaaagatcagaagaggagctaagacgcgtcgcagaggagtggttagagtgccagaaaaggatagacgcttacgtggacgaacagatgacaatgaaaactaaacagagaatgcttacagaagactgggaactgttcaaacagaggaggttcatagaagagcaactgaccaacaagaaggcagtaactggggaaaataattttaccgacacaatgcggcacatgctctcctcccgactatccatgcccgactgtcccaattgcaactacaggcgcaggtgcgcgtgtgatgactgttcattgagccatatccttacctgtggtatcatggacccgcctgtgaccgatgacattcacattcaccagctccctcttcaggtggacccggccccagactatctcgccgagcgcagtcccccctcggtgagctccgcctcgtcaggctcgggttcctccagtccaatcacaatccagcagcatccaaggctgatcttgaccgactccggttctgcccctaccttctgcagtgatgatgaggacgtggcccctttatccgcgaagttcgctgacatataccccctcagcaattacgatgataccgaagtagtggctaacatgaatggtatccattccgaactgaacggcgggggcgagaacatggccctcaaagatgaatcacctcagatttctagcacgagctccagctccagcgaagccgatgatgaggaggcagatggggagagctctggggaaccaccaggcgcacccaaggaggacggcgtgcttggttctcggagtccacgaaccgaggaatccaaggccgatagtcctcctccgagctaccctactcagcaggctgagcaggcacccaatacttgcgaatgccatgtttgtaagcaggaggcctcggggcttactccgagcgccatgaccgcaggtgcgctgccacctggtcatcagtttcttagtccagagaagccaacacaccctgctctgcatctgtacccccatattcatggtcatgtccccctgcacaccgtgccgcatctgcctagacctctgattcatccaactctgtacgcaaccccacctttcacccatagcaaggcgcttccccctgcccccgtgcagaaccacaccaacaagcaccaggtgttcaatgcaagcttacaggaccatatctacccttcctgctttggcaatacaccagaatggaactcttctaagttcatttccctgtgggggagcgaggtgatgaacgataagaattggaaccccggcactttcctgccagataccatctccggctctgagatattgggtcctacattaagtgagacgcgcccggaagctttgcctccccccagctccaacgagacacctgcagtttcagattcaaaagagaagaaaaacgctgctaaaaagaaatgcctgtataatttccaggacgcttttatggaagccaataaggtggtaatggctaccagctccgccaccagctcggttagctgcacggctacaacagtgcagtcgagcaacagccaatttagagtctccagcaagcggcccccgtccgtcggtgacgtatttcacggcatttccaaggaggaccaccgtcactctgcccctgccgccccgcgcaactctcccacagggctcgccccactccctgcgctgtcccccgctgctctgagtccagctgctctctcacctgcctcaacccctcacctcgctaatctcgctgcaccttctttcccaaagaccgccaccactacaccaggtttcgtggatacgcgcaagagcttctgtcctgcccccctgcctcctgctaccgatggctcaatttctgccccgccctctgtgtgttccgatccagattgtgagggccataggtgtgagaacggagtgtatgatccacagcaggatgatggagacgagtctgccgacgaagattcctgttctgagcacagctccagcacaagcacatcaactaaccagaaagagggaaagtactgcgattgttgctactgcgaattttttggccacggtggtccaccagccgccccaacctcccggaattacgccgaaatgcgggagaaactgcggctaaggctgacaaagagaaaagaagaacagccaaagaagatggaccaaatatctgagagggagtctgtggtagaccacagacgcgtggaggacctgctacagtttatcaatagttccgagactaagcctgtctcgtctacccgcgccgccaaacgggctcgccacaaacagaggaagctagaagagaaagcgcggctggaagccgaggccagagcgcgggaacacctgcaccttcaggaggagcagagacggcgggaggaagaggaggacgaagaggaagaggaggatagattcaaagaggaattccaaagactgcaggagctgcagaaactgcgggctgtcaaaaaaaaaaaaaaggagcgcccgagcaaagactgcccaaagctggatatgttgactagaaatttccaggccgcaactgagtctgtgcccaatagcggcaacattcacaacggcagccttgagcagacagaggagccagaaacaagttctcactcaccaagccggcatatgaatcacagcgaacccagacccggacttggtgcagacggagatgcagcagaccctgttgatacaagagatagtaagttcctgctccccaaggaagtcaatggcaaacagcacgaaccactgtctttcttttttgatataatgcaacatcataaagaagggaacggaaaacagaagttacggcagacttctaaagctagctcagagcccgctcggagacctacggaacctcccaaagctacagagggccaatcgaagccacgggcccagacagaatccaaggctaaagtcgttgatctgatgtcgatcaccgaacagaaacgggaggagcgcaaagtaaatagtaataataataacaaaaagcagctgaaccatatcaaggacgagaaaagtaatcccactcccatggaacctacttcacctggagagcatcagcagaattccaagctggtcctcgccgagtcacctcagcccaagggtaaaaataagaagaacaagaaaaaaaaaggggaccgggtcaacaactctattgacggcgtgtcattactcctgcccagcctcggatacaatggcgctatactggcccactgtaacctgagactgccaggctcctccgattgtgctgctagcgcctctcaagtagtcggtattacagatgatgtcttcctgccaaaggacattgacctggactcagtcgacatggacgaaacggaaagagaggtggagtattttaagcggttctgtctggactcagccagacagacacgccagcgtctgtccatcaactggtccaatttttctctgaaaaaggcaacgtttgccgctcactag

SEQ ID NO: 47358 - DNA, 3675 bp, Artificial Sequence
  Description of Artificial Sequence: Synthetic coding sequence
atgaaggtgcggctgctgcggcagctgagcgccgccgccaaggtgaaagcaccctcgggtctgcaagggcccccccaggcccaccaattcatctccctgctacttgaagagtatggcgcactgtgccaggccgctcggtccatcagcactttcctgggcacgctagagaacgaacatcttaaaaagttccaagtcacctgggagttgcataataaacacttattcgagaatctggtcttcagcgagcccctgctgcagagcaatctcccagcactcgtgtcccaaattagactggggacaaccacccacgatacttgttctgaggacacttactccacgcttctgcaacgctatcagagaagcgaggaagagttgcggagagtggccgaggagtggctcgaatgtcagaaaagaatcgatgcttatgtggacgagcagatgactatgaagacaaaacagagaatgctgacagaagactgggagctcttcaagcaacgtcggttcatcgaggaacagctgacaaacaagaaagccgtcaccggcgagaataatttcaccgacactatgcgccacatgctgtcatcacggctgagtatgcccgactgccctaactgtaactaccgaagaagatgcgcctgtgatgattgttccctctcccatatactgacctgtgggataatggatccacctgtgacggatgatattcacatccaccagttgcccctccaggtggaccccgcccccgactatcttgccgagcgatcacctcccagcgtgtcatcggccagttctggctcgggaagtagttctcccatcaccatccaacaacacccccggctgatcctgaccgacagtgggagcgctcctactttttgcagtgatgatgaggacgttgccccactgagtgccaaatttgcagatatctacccgctatccaattatgatgatacagaagtggtagcaaacatgaatgggattcattctgagttgaacggaggcggtgagaacatggccctcaaagacgagtctccccaaatatcctcgacttcatctagttcaagtgaggcagacgatgaggaggccgacggggagtcctccggagaaccgcctggcgccccgaaagaagatggggttctgggctcacggtcaccacgcacggaagagtcaaaagccgattctccaccccccagctaccctactcaacaggctgagcaggctcccaacacctgtgaatgtcacgtctgtaagcaggaagcttctggtcttaccccgtccgcaatgacagccggggctttgccaccagggcatcagtttctgtctcctgaaaaacctacacaccctgcgctgcacctgtacccgcatatccacggacatgtccctctccatacagttccacatttaccccgccccctgattcaccctaccttatacgctacgcctccattcactcactccaaagctcttccacctgccccggtgcagaaccatacgaataagcatcaggtcttcaatgcgtccctccaagatcacatttatccaagctgtttcggcaacacacccgaatggaattcaagcaagttcatcagcctatggggcagcgaggtcatgaatgataagaactggaatcccgggacttttctccctgataccatatcgggatcagaaatactaggcccaacactatccgagacccgaccagaagctctccctccccctagcagcaatgaaacacctgccgtgtcggattccaaagagaaaaagaacgcagcaaaaaagaaatgcctttataatttccaggacgcttttatggaagcaaacaaagtcgtgatggccactagttcagcaacaagctctgtgagttgcacagccacgactgtccaaagttctaattcacaatttcgcgtgtcaagtaaacgtccacccagcgtgggggatgtttttcacgggattagtaaagaagatcaccgtcattccgcacctgcagccccgcgtaactctcctacaggactggcgcccctgcccgcgctgtcccccgccgccctttctcccgcagcactgtcccccgcctcaacccctcatctggccaatctggccgcccccagtttccctaaaaccgcaacgactactccaggtttcgttgacacaaggaaatccttctgcccagcacccctgcctcccgctacagacggaagcatctctgcccctccctcggtgtgctccgaccccgattgcgagggacataggtgcgaaaatggcgtatacgaccctcagcaggacgacggcgacgagagtgcggacgaggactcctgcagtgagcattcttcttcaacctcaacatccaccaaccagaaagaaggcaagtattgtgactgttgttattgtgagttcttcggccacggcggcccccccgcagcccccacttctcgcaactacgctgaaatgagagagaagcttcgcttgcggctcactaagcggaaggaggagcagcccaagaaaatggaccaaatttcagagcgggaatctgtggtggaccaccgccgcgtcgaagatctgctccagttcatcaactccagcgagacgaagccagtcagcagcactagggctgctaagcgagctcgacataaacaaagaaagctggaagaaaaggcccgcttagaggcagaagccagggctagagagcatcttcacctgcaggaagagcaacgacgaagagaggaggaggaggacgaagaggaagaagaagataggtttaaagaggagttccaacgcttgcaggagctccagaaactgcgggcagtcaagaagaaaaagaaagagagaccgagtaaggactgtcccaagttggacatgttaactcggaactttcaggcagccacagagtctgtccctaacagcgggaatattcacaatggctctttagagcagacagaggaacccgaaacaagcagtcatagcccttctcggcacatgaaccacagcgaaccccgccctgggttaggagccgatggggacgcagccgaccccgtcgacacccgcgattcaaagtttctactccccaaggaagtcaacgggaaacagcatgagccgctcagcttctttttcgacatcatgcaacaccacaaggaggggaatggcaagcagaagctaagacaaactagcaaggcaagcagtgaacccgcccgtaggccgaccgaaccacccaaggccaccgagggccagagcaaaccaagggctcagaccgaatcaaaagcaaaggtggtggacctgatgagcattacagagcaaaaaagagaggaaaggaaggtcaacagcaacaacaataataaaaagcagcttaaccatattaaagacgagaaatctaaccccaccccaatggaaccaacgtcacccggcgagcatcagcagaactcgaagttagtgctcgctgagagtccgcagcctaaaggcaagaacaagaagaacaagaaaaagaagggagacagggtcaacaactccatcgacgatgtctttcttcccaaagacattgacctggactccgtagacatggacgagactgagcgggaggtggagtactttaagcggttctgcctggactctgctaggcaaacccgacaacggctcagcattaactggagtaatttcagtctgaagaaggcaacttttgcagctcattag

SEQ ID NO: 47359 - DNA, 132 bp, Artificial Sequence
  Description of Artificial Sequence: Synthetic coding sequence
atgaaggtgcggctgctgcggcagctgagcgccgccgccaaggtgaaagcgccatccggactgcagggacccccccaggcacatcaattcatttccttgctgcttgaggaatacggtgccttgtgccagtag

SEQ ID NO: 47360 - DNA, 3021 bp, Artificial Sequence
  Description of Artificial Sequence: Synthetic coding sequence
atgaccatgaagaccaagcagcggatgctgaccgaggactgggagctgttcaaacaacggcgcttcattgaggaacaattgaccaacaaaaaggcggtcacgggtgagaataatttcaccgataccatgaggcatatgctaagttcgcgtttgtccatgccagactgcccaaattgtaactaccgacggagatgcgcctgtgacgattgttcactgtcccacatcctcacttgtggcattatggacccccctgtgactgatgatattcatatccaccaacttcctctgcaggttgatccagccccagattacctcgctgagaggagtccaccttcagtttcatccgctagttccggatctggctcctcaagcccaatcacaatacagcaacacccccgacttattctgacggatagtggaagcgctcctaccttctgttcggatgacgaggacgtggcccctttgtccgcaaagtttgccgatatctaccccctgtcaaactatgacgacaccgaggtagtagctaatatgaacggcatccactcggaactgaatggaggcggcgagaacatggccttaaaagacgagtctccccaaatcagcagtacaagtagttcgtcatctgaagcggacgatgaagaagcagatggagagagcagtggagagcctccgggagcccccaaagaggatggcgttctcggctctcggtcgccacgcaccgaagagtccaaggcggacagtccaccaccatcctacccaacccagcaggctgaacaagcacccaacacttgcgaatgccatgtgtgtaagcaggaagccagtgggctgactcctagcgccatgactgccggcgccctgccacctggtcatcagttcctgtccccggagaagcccactcatccagcgctgcacctctacccccacatccacggacacgtcccgttgcataccgttccgcacctcccccgacccctgattcatcccaccctctatgcaacgcccccattcacccactcgaaggcactcccaccggctcccgtccagaaccataccaataagcaccaggtgttcaatgcaagcttgcaagatcacatttaccccagttgcttcggcaacaccccagagtggaacagttctaaatttatttctctgtgggggtcggaagtcatgaatgacaagaactggaaccccggtactttcttgcccgatactatcagcgggtcagagattctgggaccgaccttaagtgaaactagaccagaggccttgcctcctccttctagcaacgaaacccctgcagtgtccgacagtaaagagaagaagaacgccgccaagaagaaatgtctctataatttccaagatgccttcatggaagctaacaaggtggttatggctacatcatccgccacatcatctgttagctgcacggccaccacagtccagagttcaaatagccaattcagggttagttccaagagacccccctccgtgggagatgtgttccacggcatctccaaggaagaccaccgacatagcgcccccgctgcgccgaggaactcaccaaccggcttggcgcccttgcctgcccttagcccagccgcattaagccccgctgcactcagcccagctagcacccctcatctggctaacctcgctgctcctagcttccctaagaccgccaccactacaccaggctttgtggacacgcggaaaagtttctgcccagctcctttacctcccgctaccgatggttctatctctgcccctccctctgtctgcagcgatcccgattgtgaaggccatagatgtgagaatggtgtgtatgatccgcagcaggacgatggtgacgagtccgccgatgaagatagctgctccgaacacagttctagcactagcacatcgacaaatcaaaaggaagggaagtattgtgattgttgctactgtgaatttttcgggcacggcggtcccccagcagccccaacctccaggaactatgccgagatgcgcgaaaaactgcggctcaggttaactaagagaaaagaagagcagcctaagaagatggaccaaatttccgaacgtgagtccgtagtagaccataggagagtggaggatctcctgcaattcattaactcctcagagactaagcctgtcagcagtacaagggcagccaagagggcaagacacaaacagaggaaactggaggagaaggcccgcctggaggcagaggctagggcacgcgaacacctgcatctgcaagaggaacagaggcgtagagaagaggaagaagatgaggaggaggaagaggatagattcaaggaggagtttcagaggttacaggagctgcagaagcttcgggcggttaagaagaaaaaaaaggagcgcccctctaaagattgtccgaagctcgacatgctcaccaggaattttcaggctgctaccgagagtgtgcccaattcaggcaatatccacaatggttccttagaacagacagaggaaccagagacatcaagtcatagtccatcccgccacatgaaccactccgaacccaggcctggactgggcgcagatggcgatgccgccgatcctgtcgacacacgcgacagcaagttcttactccctaaagaagtcaatgggaagcaacacgagcctctgtccttcttttttgacatcatgcagcatcataaagaaggaaatggcaagcagaaattgcgtcagacttctaaggcgtcatcagaacccgcacgtagaccaaccgagccacctaaagcaaccgagggacagagcaaaccccgggctcagaccgaatccaaagccaaagtggtcgacctcatgagtattactgaacaaaagcgagaggagaggaaggttaatagcaacaataacaacaagaagcagctgaaccacatcaaagacgagaaaagcaatccaaccccgatggaacctacatccccaggggagcatcaacagaactcaaaattggtgctggctgaaagcccccaacctaagggcaaaaacaagtag

SEQ ID NO: 47361 - DNA, 3636 bp, Artificial Sequence
  Description of Artificial Sequence: Synthetic coding sequence
atgaaggtgcggctgctgcggcagctgagcgccgccgccaaggtgaaagctcctagtggcctgcaggggcccccacaagctcatcagttcatcagcctactgcttgaagaatatggggctttatgtcaagcggctcgatctatttcaacatttctgggcactctagaaaatgagcacctgaagaaattccaggtgacttgggagttgcataacaagcacctgttcgagaatttggtctttagcgaacctctgttgcagtcaaatctgcccgctctcgtgagccagatacgcctcgggacgacaacccacgacacatgttctgaagatacctattccaccctgctgcaacggtaccaacggtcagaagaagagttgcggcgtgtggctgaagagtggctggaatgccagaaaaggatcgacgcctacgtggatgagcagatgactatgaagaccaagcagaggatgttaaccgaagactgggagctcttcaaacagaggcggtttatagaagagcagctcaccaacaagaaagctgtgactggcgagaataatttcacggacaccatgcggcatatgctgagtagtcgactgtctatgcctgactgccccaattgcaattaccgccgccggtgcgcttgcgacgactgcagcctgagccacattctgacctgtggtatcatggatcctcctgtgacagacgacatccatatccaccagctgcccctgcaggtcgatcctgctcctgattacctagcagagcggtccccaccctccgtttcctccgcttcatcaggtagcggttccagtagccccatcactatacaacagcacccaaggctcatcctgactgactccggcagcgctcccacattttgctctgatgacgaggatgtggcgccgttaagcgcaaagtttgccgacatatatcctctgtctaactatgatgacaccgaagtggtcgcaaacatgaatggaatccattcagagctcaatggaggaggcgaaaatatggcgctgaaagacgaatccccacagataagcagcacaagttcttcttcaagcgaggctgatgacgaagaggctgatggagagtcctccggagaaccgcccggcgccccaaaagaggacggggtattagggagcaggtccccccgcaccgaggaatctaaagccgacagccccccaccatcctaccctacccaacaggccgagcaggccccaaatacatgtgagtgccacgtgtgcaagcaagaggctagcggacttactccctcagctatgaccgccggagcgcttcccccaggtcatcaattcctctccccagagaagccgacacaccctgctctgcacctgtacccccatattcacggacacgttccgttacacactgtgccccaccttcctcgccctttaatccatcctactctctacgccacccccccgttcactcacagcaaagctctgccacctgcgcccgttcagaatcataccaataagcaccaagtgtttaacgccagcctgcaagatcatatttatccgtcttgctttggcaatacaccagaatggaactcttctaagtttatttcattatggggcagtgaagtgatgaatgataaaaactggaatcccgggacatttctgcccgatacaattagtgggagcgagatcctgggacccactttgtcagagactcgtcccgaggctctgccccctccaagctctaacgagacccctgcagttagtgattcaaaggagaagaaaaacgctgctaagaaaaagtgcctgtataactttcaggacgccttcatggaggccaataaggtcgttatggcaacgtccagtgccaccagttctgtaagttgcaccgccactaccgtccagagttcaaatagtcaattccgagtgagttcaaagcgtccaccctctgttggagatgtgtttcacgggatcagcaaagaggaccaccgacacagcgccccagctgcccccaggaactcccctacaggactggccccactccctgcgctatctcctgcagctctatctccagctgccctaagcccagctagcacacctcacttggcgaatctcgctgcaccttctttccccaagacggccacaacgaccccagggtttgtcgacacccgcaaaagtttctgtcctgcacccctaccacccgctactgatggatcaatctcagcccctccttccgtctgctctgatccagattgcgaagggcaccgatgtgagaatggagtctatgatccccaacaggacgatggcgacgagagtgctgatgaggatagttgttcagagcatagctccagcacttccacatctactaatcaaaaggaaggcaagtattgtgactgttgttactgcgagttcttcggtcatgggggcccccccgccgcccctaccagtaggaactatgcggagatgagggagaaactcagattgaggctcaccaaacgcaaggaagagcagccgaagaaaatggatcagatcagcgagcgcgagagtgtggtagatcaccgaagggttgaagaccttttacagttcatcaatagttcggaaacaaaaccagttagcagcaccagggccgcaaaacgcgcaaggcataagcagaggaaacttgaggagaaagccagattggaggccgaagcacgagcccgggaacaccttcacctgcaggaggaacagaggcgacgagaggaagaggaggatgaagaagaggaagaggaccgattcaaagaggaattccaaaggctacaggaactgcagaagttgcgcgccgtgaaaaagaaaaaaaaggagcgcccctccaaagattgtccaaaactcgacatgctgaccagaaatttccaggcggccacagaatcagtacccaactccggtaatatacataacggtagcctagaacagaccgaggaacctgagacaagcagccactccccatcaaggcacatgaatcactccgaaccgaggccaggattgggagcggacggcgacgcagcagatcccgtagacactagagactctaaattcctgttacctaaggaggtgaatggcaaacagcacgagcccctgtccttttttttcgacatcatgcagcatcacaaggaaggcaatggcaagcagaagctgcggcaaacaagcaaggcgtcatccgagcctgcacgccgtccaacggagccccccaaagccacggaggggcagtcaaagccccgggcacagaccgagtcaaaagctaaagtggtagacctgatgtccataactgagcagaagcgggaagaacgcaaagtgaatagtaacaacaacaataagaaacagcttaatcacatcaaggacgagaaatcgaacccaacgcccatggagcctacctcacctggcgagcaccagcagaactctaaattggttctggccgagagtccccaacccaaaggaaagaataaaaaaaacaagaaaaagaaaggcgatcgcgtcaataattctatcgacgacgtgttcctccctaaggatatcgacctggacagcgttgacatggacgagacagaaagggaagtagaatacttcaagagggacggtgtgtcaccccattgcccaggttggagcaggacaccgggattgaaatag

SEQ ID NO: 47362 - DNA, 1347 bp, Artificial Sequence
  Description of Artificial Sequence: Synthetic coding sequence
atgaagggcggcaccctgggcggcatccccggcgagcccgccgtggaccacagagacgtagatgaactgctggagtttatcaattcaaccgaaccgaaggttccaaacagtgctcgcgcagcaaagcgcgcaagacataagctgaagaaaaaggagaaggaaaaagcacaactggcggccgaggcgcttaaacaggcgaatagggtcagcggttcccgggaacctaggcccgcacgcgagaggctgctggaatggcccgatagggagcttgatcgcgttaatagctttttaagtagcagactgcaagaaatcaagaacaccgtgaaagatagtatcagagcttccttcagcgtctgcgagctgagtatggactctaacggcttcagtaaagaaggcgctgcagaacccgaaccacagtctctccccccatccaatctcagcggaagcagtgaacagcaaccagatatcaacctggacctgagtcctttaacactgggaagcccacagaaccacactctgcaggcccccggggagcccgccccaccatgggccgagatgaggggaccgcaccccccgtggaccgaggtaaggggacccccaccaggaattgtgccagaaaatgggctggtgagaagactgaataccgtgcctaacctttctagggtcatttgggtaaaaacaccaaagcctggctacccttccagtgaggagccctcctctaaggaagtgccgagctgcaagcaggagttacccgagccggtaagcagcgggggcaagcctcagaaaggaaagcgccaaggctcccaggcaaagaagtcggaagcttcccccgctccccggccacctgccagcctggaggtaccgagcgccaagggacaggtggcaggcccaaaacagccgggacgtgtgttggaactgcctaaggtgggatcttgcgctgaagcaggcgagggcagtagaggatcaagaccagggccaggatgggccggttcccccaaaacagaaaaagaaaaaggctctagctggagaaattggcccggcgaggccaaggcccgcccccaagaacaggagtctgtccagccttctggacccgcgcgccctcaaagtctgccccagggaaaaggaagatcaagacgcagcaggaacaagcaggaaaaaccagcgagttctctagacgacgtgtttttgcctaaagacatggatggtgtggaaatggacgagactgatcgagaagtagagtactttaaacgcttctgtctggatagcgcaaagcagactcggcaaaaagttgctgttaattggacaaactttagcttgaaaaagaccacgccatccacggcacagtag

SEQ ID NO: 47363 - DNA, 2370 bp, Artificial Sequence
  Description of Artificial Sequence: Synthetic coding sequence
atgcccaagctggtgaagaacctgctgggcgagatgcccctgtgggtttgccagagttgtaggaagtccatggaagaggacgagaggcagacaggccgcgagcacgcggtggcgatttcactctctcacacctcctgtaagagtcagtcatgtggcgacgactcccattctagctcttccagctcttcgtcatcctcctcaagttcctcctctagttgccctgggaattccggagactgggacccttcttctttcctctccgcccacaagctttccggattatggaattccccgcactcgagtggtgcaatgccagggtcctctctcgggtcgccaccgacaatacctggggaagcattcccagtgagtgaacaccaccagcatagtgatcttaccgcgccccctaacagcccaacagggcaccaccctcagcccgcatcactcattccttctcatccctcgagctttggcagcccgcctcatccacatctcctaccgacaaccccggctgctccatttccagcccaagcgtcagaatgcccggtagccgccgccacggcgccacacacaccaggaccttgccagtcaagccacctgcctagcaccagtatgccgctcctgaagatgccccccccattctcaggttgctcacacccctgttcaggtcattgcggaggtcactgtagcggacccctacttccaccacctagcagccaacccctccctagcacacatcgcgatcctggctgcaaaggtcataaatttgctcactcggggctggcctgtcagctcccgcagccatgtgaagccgacgaagggctcggcgaggaagaggactccagcagtgaacgatctagctgcacctcttcaagcactcatcagagagacgggaagttttgtgactgttgttactgtgaattcttcgggcacaatgcaccgccggcagcccctacaagccggaattataccgaaatacgggagaaactgaggtctagactcacccggcgtaaagaggagctcccaatgaagggcggaacactaggagggattcccggtgaacccgcggtggatcacagggatgtggacgagctgctggagttcattaattctactgagcctaaggtcccaaacagcgcgagagccgcgaaaagagccagacataagctgaagaagaaggaaaaggagaaagcccagttagcggctgaagcgctgaaacaagctaacagggtgagtggtagcagagagccacggcccgctagggaaagactactggagtggccagaccgggaactcgaccgcgttaatagttttctcagtagcagactacaagagatcaagaatactgtaaaagatagtattcgggcatcattttccgtgtgtgaacttagcatggactctaatgggttctctaaggaaggcgccgctgaaccagagccacagtcccttccgccttcaaatttaagtggctcatcagagcagcagcctgacattaatctagacctgagccctctcaccctcgggtctccccagaatcacacacttcaagcgcccggagagcccgcacccccatgggcagaaatgcggggcccccatccaccatggacagaggtccgagggcccccaccaggcattgtgcctgaaaacggtctcgtccgccgactcaacacagtccccaatctctcgagagtgatttgggtgaaaacgcctaaacctggataccctagttccgaggaacctagctccaaggaggtgccaagctgtaaacaagaattgccagagccggtgtccagcggcgggaagccacagaagggtaagagacaaggctcacaggccaagaagtctgaagcctcccctgcacctcgcccccccgctagcttggaggtcccatctgcgaagggccaggtggctggaccaaaacagcctggacgcgtactggagctaccaaaagtgggcagctgtgccgaagccggagagggctctagggggtcaagaccaggtcccggatgggccgggagtcccaagacagaaaaggaaaaaggaagctcctggcgcaattggcccggcgaggctaaagcccgcccccaagagcaggagtctgtccagccctcaggacctgcccgtccacaatctttgcctcagggcaaggggcgtagccggcgaagtaggaacaagcaggagaaacccgctagctccttggacgatgtgttcctgcctaaggacatggacggcgtcgaaatggacgaaaccgacagagaagtggagtacttcaaaaggttctgtctggacagcgccaagcagacccggcagaaagtggccgttaactggacaaacttcagtctgaaaaagactacaccctctactgctcagtag

SEQ ID NO: 47364 - DNA, 1992 bp, Artificial Sequence
  Description of Artificial Sequence: Synthetic coding sequence
atggcccacctgcggagccccagcggcttcggcgaccccggcaagaaagatcagaaggaatccgaggaagagttagaggaagaagaagaagaggaagaagtggaagaagaggaggaggaggttgaggaggaggaggaggaggttgaagaagaagaagaggaggtcgtggaagaggagctggttggtgaagagcaggagctggaggcccctgagactttcagtgaagaatacctctggaaagtgactgatatcggagattatgatgatgatttcccggacgtgcggccccggctggcttctatcgtgagcccgagcctcaccagcactttcgtacctagtcagagcgcaacctccacagagaccccttcggcctcccctccctcttctaccagcagtcataaatcattccccaagatcttccagacgttccgtaaagatatgtccgaaatgagcatcgaccgaaacatccaccgaaatttgtctcccggcattccggtgtcggttcaaactgaagagagttggctgcaagacctgagcgacaaggtccaatccagaaaaaaggccagcaaggaaaaggccgagcccgaatgtctggcatccaaactccgcgaaaagtgggtgatcaatcctgaggagtcaaagctcaatatcctctatgagctggagtttaaggaggactttatcaccttatttgagccatccctgcggactctacccagcatcggcccgccgagcatcctcgcttacaaggaggaaagttcaaatctaggtataaactttaaggatgaggaggaagagacatcgcccaagtgtgagttctgtgggtcagacctgcgtgcttttttcagcaatgttgatgtttcgtcggagcccaagggacatgctagttgttgcatagcctttcaaaacttgatcgactatatttacgaagagcagatcaaaaccaagccacccaaggccgagcttatcgctatcgatccgcacgcagcacacggctctgaagtagacaggcttaaagccaaagagaaagccctgcagcgcaaacaagaacaaagaatggcacgacatttcgcaatcatttccagagagcagacacatttttccgaagacgatagcaagaggctgaagacgatttcataccagctctctgtagacattccggaaaaacaaatcatcgatgacatcgtttttgactttcagctccggaactccaacatgagtattatctgttgcgatagcagaattgcctgcggaaaggtggtgagaaacgagttactagaaaaacattataaacatgggtcgaagttcttgacctccttccccgacggaactacacagattttctacccctctggcaacttggccatcattagggttcccaacaaggtgaatggttttacgtgcattgtccaagaagatatgccgacaaatcccgccatactggctgtgctagactcatctggtaggtcctcttgctatcaccctaatggcaacgtgtgggtgtacattaatattctcggaggtcagtactctgatcaggccgggaacaggataagggcgtggaactggtccaatagcattacctccagtcccttcgtgtccttcaaacctgtctttctggccctgaaccgttatatcggcgtgcgtatcttggaacaggataagatctcaataactttcctagctatgggacagcaggctaggatctcagtggggactaaggtaaagctcccgaacccggaagaaattccaatcttgagatatgtgagtggagacgatctgctgctcttagctagtttgataaagatccggcggctctttcataaactagagggttgcgtgaactttccttcatcgcaggtatgggaaaagctgaaacaaccctcatatttaagttcattgagcctgaagcttattgctttgtgtcattctagcgggatcaagcaggatatcatgaaaaccatacgcaacatcatcaacgaggaaatctag

SEQ ID NO: 47365 - DNA, 1866 bp, Artificial Sequence
  Description of Artificial Sequence: Synthetic coding sequence
atggcccacctgcggagccccagcggcttcggcgaccccggcaagaaagaccagaaagagagtgagcaggagttggaggcccccgagaccttttccgaggagtatctgtggaaggttaccgatattggggactatgacgatgatttccccgacgtgcgaccccgcctggcctcgattgtgtcaccaagcttgacctctacttttgtgccctctcaatcggcaacctcaacagaaactccaagcgcaagtcccccgtcatctacatcgtctcataagtccttcccaaaaatctttcagacatttaggaaagacatgagcgagatgtctatcgataggaacattcaccgaaacctgtctccaggaatccctgttagcgttcagaccgaggaatcttggctgcaagatctttcagataaggtgcagtctcgcaagaaggctagtaaagagaaagctgaacctgagtgcctagcttctaaacttcgtgaaaagtgggtcataaaccctgaagagtcaaagctgaacatcttgtacgagctagaatttaaggaggattttattacgttgtttgaaccctctctgcgaaccctcccctcgatcggcccacccagcatactggcctataaggaggaaagttctaacctcggcatcaactttaaggatgaggaggaggaaaccagtccgaagtgcgagttttgcggaagcgatctcagggcgttcttctctaatgtggacgtgtcttctgagccgaagggccacgcctcctgctgtatcgcctttcaaaatcttatcgattatatctacgaggagcagataaagactaaaccccccaaggctgaactaattgctattgatccccatgcagcccacggatctgaggtcgatagactcaaagcaaaggaaaaagccctccagcgcaaacaggagcagcggatggcaaggcattttgctattatctctcgggagcagacacactttagtgaggacgatagcaagaggttaaagacgattagttaccagttatctgtggacattccagagaaacagataatcgatgatatcgtctttgacttccagctgcgcaatagcaacatgagcataatctgctgtgatagtaggatcgcgtgtgggaaggtggtccgcaacgagctgcttgaaaaacactataagcatggatccaaattcctgacatcatttccagacggcacgactcagatcttttatccttcgggaaatttggccattattcgtgttcctaacaaagtgaacggcttcacctgtattgtgcaagaagacatgccaaccaaccccgcaattcttgccgtgctggattcatctggaaggagctcttgttaccaccctaatggcaacgtgtgggtgtacattaatatcttgggggggcagtactcagatcaggccggaaatagaattagggcatggaactggtctaattccattacaagcagcccattcgtcagctttaaacctgtattcttagccctgaatcgctacatcggcgttcgcattctcgagcaagataagatttctattacctttctggctatgggccaacaggctcggatcagcgtgggtacaaaggtgaagcttcccaatccagaagaaatccccatcctgcgatacgtcagtggtgatgatctgctgctgctggccagcctcattaaaatcaggagactgttccacaagcttgaaggctgcgtaaacttcccctctagtcaagtttgggagaagttaaaacagcctagttatctctcttccttaagtctgaagctcatcgccctctgtcacagttctggcatcaaacaggacatcatgaagaccatcagaaatattattaatgaagagatatag

SEQ ID NO: 47366 - DNA, 2091 bp, Artificial Sequence
  Description of Artificial Sequence: Synthetic coding sequence
atgagcgccgagaacaaccagctgagcggcgccagccccccccacccccccacaaccccgcagtatagtacgcagaacctgcctagcgagaaggaggacactgaggtcgagctggatgaggagtctctgcaggacgagagtccattctccccagaaggtgagagcctcgaggataaagagtatctggaagaagaagaagatttggaggaagaggagtaccttggtaaagaggaatatctcaaggaagaggaatatctggggaaggaagagcatctcgaggaggaagagtacctcgaaaaagctggatacctcgaggaggaggaatatattgaggaggaagaatatctcggcaaggagggctacctcgaggaggaagagtacctgggcaaggaagagcacctcgaggaggaggagtatctgggtaaggaaggatacctagaaaaagaagattatattgaagaagtggactaccttgggaagaaagcttacctggaggaagaggagtacctcggtaagaagagctatctggaagaggaaaaggccctggaaaaagaagaaaatcttgaggaggaagaggctttagagaaggaagaaaacctcgacggaaaagaaaacctctataaaaaatacctgaaggaacctaaggcgagctacagctcccaaaccatgctgctgcgcgacgctcgtagccctgacgcgggcccaagtcaggtcaccacgttcctcactgttccattgacctttgctacacctagccccgtgagcgagtcagctactgagtcgagcgagttacttctgactctctatcggcgttcccaggcgtctcagaccgactggtgttatgaccggacagcagttaaatctctgaaaagcaaaagtgagaccgaacaggagaccacgacaaagctggccccagaagagcacgtcaataccaaggtccagcagaaaaaagaggagaacgtgttggagttcgctagcaaggaaaatttctgggacgggatcaccgatgagtccattgataagctcgaggttgaagatctcgacgaaaacttcctgaactccagctatcagactgtcttcaagacgatcattaaggagatggcggcacacaacgagctggaggaagactttgacatcccactaactaaacttctggagtctgaaaatcgctggaagctggttataatgttgaaaaagaactacgaaaaattcaaagagaccatcctccgcataaagagaaggagggaggctcagaagctgacagaaatgaccagcttcacttttcacctgatgtcgaaaccaacgccagaaaaacctgagaccgaggagatacaaaagccgcagagggtggttcatcacaggaagaagctcgagcgagataaggaatggattcagaaaaagacagtggtccaccagggggacggcaaactgatcctatatccgaataaaaacgtttaccaaattctctttccagacggcacaggtcagatccattacccctcagggaatctcgcaatgttaatcctgtatgccaagatgaaaaagttcacgtatatcatccttgaggactcccttgaagggagaatccgagcgctcatcaataactcagggaacgcaacgttttacgatgaaaattcagatatatggctgaacttaagtagcaacttgggttactactttcccaaggacaagcgccagaaagcctggaactggtggaacctgaacatccacgtgcacgccccgccggtgcagccaataagtctgaaaattaatgaatacattcaggtgcagatccgatctcaggacaagattatcttttgttttacctacgagcagaagcaaatttgcctgaatctgggcacacgatataagttcgtgatacccgaggtgctgtcggaaatgaagaagaaaactattctggaggccgagcccgggcctaccgcccagaaaattcgcgtgctactaggcaagatgaacaggctattaaattacgctacaacacccgacctcgagaatttcatcgaagccgtgtcaatcagcctcatggacaataagtacctcaagaagatgcttagcaagctctggttctag

SEQ ID NO: 47367 - DNA, 483 bp, Artificial Sequence
  Description of Artificial Sequence: Synthetic coding sequence
atgtacaccatcaccaagggccccagcaagctggtggcccagcggaggaccgggcctactcagcagcaggtggaaggtagactgggggaactgctgaaatgccgtcagcctgctccacccacgtcacagccaccaagagcccagccatttgcccaaccgccaggaccttggcccttgagtagccctggtcccagactcgtattcaacagagtgaatgggcgaagagcaccatcaaccagcccatcattcgaaggaacgcaggagacatataccgtggctcacgaggaaaatgttagattcgtgtcagaggcctggcagcaggtccagcaacaactggatggcggaccggccggcgaggggggcccacgacccgtccaatacgtggagcgaaccccaaatccaaggctacaaaacttcgtgccgatcgatctggatgagtggtgggcccagcaattcttagcaagaattacatcctgtagctag

SEQ ID NO: 47368 - DNA, 585 bp, Artificial Sequence
  Description of Artificial Sequence: Synthetic coding sequence
atgtacaccatcaccaagggccccagcaagctggtggcccagcggagaactggccctacccagcagcaggtggagggaaggttgggcgaacttcttaaatgccggcagcctgcaccccccacatcacagcctccacgagcccagccgttcgcccagccaccaggcccctggcctctatcgtcacccggacccagattggtgtttaaccgggtcaatggtcgacgcgctccttctacaagcccctccttcgagggaactcaggagacgtatacagtggcccatgaggaaaatgtgcgcttcgtgagcgaagcatggcaacaagtccagcagcagctggatgggggcccagctggtgaagggggaccccggcccgtgcaatatgtcgagcgcacccccaacccccggctccagaacttcgtaccgattgacctggacgagtggtgggctgctgtcccaggagaaaaccaccaactgttcctggttgctgcgggccgcggacgctgctatacagccgatttgtcccctggggaaaaacatggagccctgcctactcattgcgcctggctcggggccgggcacacatag

SEQ ID NO: 47369 - DNA, 294 bp, Artificial Sequence
  Description of Artificial Sequence: Synthetic coding sequence
atgaccagcagccccgtgagccgggtggtgtacaacggcaagcggacttcctccccaagatcccctccttcttccagcgagattttcaccccggcccacgaggagaacgtacgctttatttatgaagcctggcaaggggttgagcgagacctgcggggccaggttccggggggagagagggggctggtggaagagtacgtcgaaaaggtaccaaaccctagcttgaaaacctttaaaccaatcgacctgtcagacctgaagcggaggagcactcaggacgctaagaaatcatag

SEQ ID NO: 47370 - DNA, 294 bp, Artificial Sequence
  Description of Artificial Sequence: Synthetic coding sequence
atgaccagcagccccgtgagccgggtggtgtacaacggcaagcggacctcttctccacggagccctccatcgtcttccgagattttcactccggcacacgaggaaaacgtaaggttcatctacgaagcttggcagggggtcgaacgggacctgcgcggccaggtcccaggaggcgaaagaggactggttgaagagtatgtggaaaaagtacccaacccttcactcaaaacctttaagcctatcgatctgtccgatctgaagaggagatctacacaggacgctaagaagagctag

SEQ ID NO: 47371 - DNA, 1440 bp, Artificial Sequence
  Description of Artificial Sequence: Synthetic coding sequence
atggtgagcaaggacaccggcaagtgcatcctgaccaccagcgagtcggaggtcgagccagccgcttgcctggctttagaaatgaaatacgcacttgatcctaaccgtcagatcaagaagcggaacaaggccttacaggtgagatttaaggacatctgcgaagcacagaatgagcagcgggacacacagttgtcctccggacagcttggtgaaaaacgagaggctaagcccgtttcatgcagggcagcctacagaaagtatatgaccgttcctgcgagacgatcaattcctaacgtcacgaagtccaccggggtacagacctctccagacttgaaaaaatgttaccaaacgttcccgctggaccgtaaaaaagggaacttaaagtcactgccggccgctgatccattcaagagccaaaataacggattcctgaccgacgcgaaagagaaaaacgaggcagggcccatggaagaagcaaggccttgtggcgctgggcgggtgcacaagacaacagcgctggtgttccatagtaaccagcatatgaacacagtcgatcagcccttaggggtaaattgtaccgagccatgtaaatcccccgagccattgtcctacggcgaagcagcactgcagaactctacccggccccctagtgaggagccagactaccagctgttggggagagcaaaacaggacaggggacggcccaattcagaggagcccgctcctccagccctgaggcgggtgtttaaaactgaagtggccaccgtctatgcaccagcactctcagctagagcccctgagcctgggctgagtgatagcgccgcagcatctcagtggagcttgtgtcccgccgacgatgaacggagacgggccacccatcttaatggcctccaagccccctctgaaacagccttagcctgttccccgccgatgcagtgtctgtccccggagtgtagcgagcagccctctcagacacacacgcccccaggacttggcaaccagcctagcccaaccgccgtcgcagcgggcgaagagtgccagcgcatcgtaccccatactgaagtggttgacttgaaggctcaactccagatgatggagaatctaatatcatccagtcaggaaacgatcaaggtcctactgggagtcattcaggagctcgagaaaggggaggcgcacagggagggactaagttaccgcactggacaggatacggccaactgcgacacctgccgcaactcagcctgcatcatttactccgtcgagctagattttaaacagcaggaagataaactacaacctgtgcttcgcaaactgcatcctatcgaagaaacacaggtgataccctcgccctattcgcaggagacgtactctagcacccctaaacagaaatccaagactgagagtaagaagcatggcaggtggaagctatggtttttgtag

SEQ ID NO: 47372 - DNA, 1608 bp, Artificial Sequence
  Description of Artificial Sequence: Synthetic coding sequence
atggcccagcagaacatgaaggtgcggcccgtgctgctgaagcggaattctttggagtctgtcgagttcgtaaagcagccccaccatagacgcagcaagagccaacaagtgcgattcaaggaagatgggacaaccaagaaccctacagggctggcagaggttgatgtccaaactcccgaggatccagcagtgatgggtaaaacacaggcaactcgccatcatttgccgcctacatactcgttgagcttcccccgcagccaaaaggcaggtggcttcagaaacattgctattcaaaccagcccctcactgcgcaagcatttccctgtcttcaaaagaaagcgcctgacagccagcaagtctcttgttgaaatgccaactgcaagccagtccgctatccaagtgaatgggaatctctctgagcaggatatcgtttcttccgacttagcttatctgagactcgctcaacacctagaggacggccctagacgtgtaaaagtctctcatgccttcctccctcgtgtgcccaaggtccaatctaacgggcctgtctcgatttgcctggaggctggtacctggaggagtcttgagaaggcaacagcagccatacaggttccagatgacatttatcattctccgtcttgggaggcccgggagtccgccctctcaccggatagatccgccgaagtttccaacagtatccaccctctggacgacacccgaccaggtgatggccgccgcgtgactcccctggattccgagaagtccacatcctgcctaaacgcgacctccgtggctagtcatacaccaggaacggaagaattaaagccggagctcctgctgcccaaggataacagtgacgataaagacctcggctcactgtcttcacaatctaaggagacatgtgtcccttccagccccaggactcattcttctccaagccaaggctcccactcccagccggcccaccccggaagagcttccgactgtccctcctcaagcaataatcatcagaatctcgtcagtctgaaaacgaactccgcctccaagtccgcaccggggtgccaggagcagacagccaacaacccgaccgagagtgataccctggaattccccaattgccctggctccaaccacttgccctccagcttaagtcggagcgaaacaaaactgcaaagcaatagggagatctccgatatcaaccagatacatctggcccgcggtgagttatgtgatcttcagggcagactgcagtcagtggaggagtcccttcatagcaaccaggaaaagatcaaggtgttgcttaacgtaattcaggacctggagaaggctcgggccctcactgaaggcagaaacttctataggaccggccaagatttgaacaattgctctacttgccaaaacacagcctgcatcatctatagcgtcgagtacgacttccgccaacaagaggggaggtttcacgaggtgttacagtccctggaggaggctgagcccgtagaagaggcctctccacctcctaaatccccagctgagcccccagctcctgaaaagcaggatctgcgcaggaaaaccaaaaaagtcaagaagaaatgtttttggtggatttag

SEQ ID NO: 47373 - DNA, 1167 bp, Artificial Sequence
  Description of Artificial Sequence: Synthetic coding sequence
atgagcgacgaggccagcgccatcaccagctacgagaagttcctgaccccagaagaacccttcccgctacttgggcccccacggggggtgggcacttgcccgagcgaagagccaggctgcctggacatatcggacttcggctgccagctatccagctgtcaccggaccgatcccctccaccggtttcacaccaaccgatggaatctcacttcgtgcggaacatccgtggcgtctagcgagggctctgaagaactgtttagttctgtgtctgtaggagatcaagatgattgctattccttactcgacgatcaggactttacttcctttgacctgtttccggagggcagcgtgtgctcggatgtctcctcctctatttctacctactgggattggagtgacagtgagtttgagtggcagctgcccgggtctgacattgcaagcggcagcgatgtgctgagtgacgtgatacccagtatcccttctagcccatgtttactgcccaagaagaaaaataagcaccggaacctagatgaactaccatggagtgccatgaccaatgatgaacaggttgaatatatagagtatctcagtcggaaggtctcgactgagatggggctacgggaacaattagacataattaaaatcatcgacccaagcgcccagatcagccctaccgattctgagtttattatcgaactcaattgcctgacagacgagaagctgaaacaagtcagaaattatataaaagagcacagcccacgccaacggccagcgcgtgaagcctggaaacgaagcaacttcagctgtgcttccacatcaggcgtgagcggcgcctcggcctctgcctcatctagttcagcgtctatggtaagctctgcctcatcctcgggcagcagtgtaggtaattccgcctccaatagcagtgctaatatgtcacgggcgcactccgatagtaatctttcagccagtgctgccgagcggattagggacagcaaaaaaaggtcaaagcagcggaagctgcagcagaaggccttcagaaaacgtcagctcaaggaacagcgtcaagcccggaaagagcgcctcagtggactgtttctgaacgaggaggtattgtccctgaaagtgaccgaggaagaccacgaagctgacgttgatgtcctgatgtag

SEQ ID NO: 47374 - DNA, 1974 bp, Artificial Sequence
  Description of Artificial Sequence: Synthetic coding sequence
atggaccacttcttcatcaagcggaagcggaacagcgaggtgaagtatacagaagcgtgttcctcaagctctgtggagtccgggatcgtaaattcagataacatagaaaagaatactgacagcaatctgcagacgagtacaagctttgagcctcatttcaaaaagaaaaaagtgtcagctcgaagatacaacgaagactacttgaagtatggctttattaagtgcgagaagccgttcgaaaatgacagaccacagtgtgttatatgtaacaatatcttggctaatgagtcccttaaaccctctaagctgaaacgccacttggagacacagcatgcggaacttattgacaaaccactagaatactttcagaggaagaagaaggatatcaagctaagcacgcagttcttatcatgctctaccgctgtatctgaaaaggccctactgtcctcgtacctcgtcgcatacagggttgcgaaggagaagatcgctaacactgctgccgagaaaattatcctcccagcctgtttagatatggtgagaactatcttcgacgacaagagtgccgacaagcttaaaacgattcctaatgacaataccgtgtctctgagaatctgcacgattgctgagcaccttgagactatgttgattacccgtttgcagagcggaatagattttgcaatacagctggacgagtccacagatattggaagttgcacaactctcctggtatacgtccgctatgcatggcaggacgacttcctggaagatttcctatgctttctcaatctgaccagccacttgagcgggttggacatctttacagagctcgaaaggagaatcgtcggacaatataaattgaactggaaaaactgcaagggaattacatcagatggaacagctacgatgactggaaagcacagtcgtgttatcaaaaaattgttggaagtgaccaataatggagccgtgtggaaccactgctttatccatagggaaggtcttgcatcccgcgaaataccacaaaacctgatggaggtcctgaagaacgcagtgaaagtggtgaacttcattaagggaagctctctcaacagccggctcctggagaccttttgctccgaaatcggtaccaatcacacgcatttactttaccatacgaagattcggtggctgtcccagggaaagatccttagtcgggtctatgaattacgcaacgaaatacacttctttctcatcgaaaaaaaatctcaccttgcgagtatctttgaggacgatacttgggtgactaagctggcatatttgaccgacatcttctccatattaaatgagctcagcctgaaactacaaggcaaaaacagcgatgtgttccagcacgtagagcggatccagggtttcagaaaaactttactgttgtggcaggttcgtttaaagtccaaccgcccgtcctattacatgttcccccgtttcctgcagcacattgaggaaaacattattaatgagaatattctcaaagaaattaagctcgaaatcctcctgcatttgacctctcttagtcagacctttaatcatttctttcctgaagaaaagtttgagacacttcgcgagaattcctgggttaaggacccatttgcattccgacatccggagtctataatcgagctgaacctcgtacctgaagaggagaacgaacttctgcaactttcttcttcgtataccctgaagaacgactatgaaacactgagcctgagtgctttttggatgaaggtgaaggaggatttccccttgctgagtcgaaagagcgttctgcttctgctgccttttactacaacctcactgtgcgaactgggcttctccattctgacacagctgaagactaaggagaggaacggactgaattgcgcagccgtcatgcgcgtggctctgagttcatgtgtgcccgattggaatgagctgatgaaccggcaggctcacccctcttag

SEQ ID NO: 47375 - DNA, 468 bp, Artificial Sequence
  Description of Artificial Sequence: Synthetic coding sequence
atgggcctgcgggccggcagccggtgccgggccgaccacctggcccaaccccagccccaagggcacctggcacctgtgttgaggtgtggtgaatgttggcgcgccaggggcctgcctggcgggtgttgtctgcataccgaagggggatgttctttgggagcacaggcagggtggcgcaccgcagggtgggaggcgagggggcgccgagatctggggctggaaacaacgagcgcacattcaaggtctctcctccatctctccagttggagacgccctgacgttggagaagccgcaggcgccgagcttctgcagagagcccctcttcaacagcctgatcccgcgcaggcagccgtcgaggggggcctgctggcccgtttgcctcgcccacaggatcaaggctgtggacagcataggccccactcgcccagactcgtggatatcgcactcccgggaggcggctggacctag

SEQ ID NO: 47376 - DNA, 1173 bp, Artificial Sequence
  Description of Artificial Sequence: Synthetic coding sequence
atgggcgaggccggcgccggcgccggcgccagcggcggccccgaggcatcccccgaggcagaggtggtgaagctactgccattcctcgcgcccggagcacgtgctgaccttcaggccgcagccgttcggcacgtcttagctcttacaggatgtggtccaggtagggctctactggctggccaggctgctctccttcaggctttaatggagctggcacctgcctcggcaccagcccgggacgctgcacgggcattagtgaatctggccgctgatccaggtctgcatgagacacttcttgctgccgaccccgggctgcccgctagactgatggggcgagccttggatccgcaatggccttgggcagaggaggcagctgccgcacttgctaatcttagtcgggagcccgctccgtgtgccgccctcatggcggccctagctgctgcagagcccgctgattctggccttgagcgcctggtacgcgcactctgtacgccagggtataacgcacgcgctcccttacactacctcgctccattgctcagcaatttgtcacaaaggcccgccgcacgcgcctttcttctcgatcccgaccgatgcgtcgtgcaaaggctcctccccctcactcaataccccgactcctccgtgagaagaggaggagtggttggcacacttcgcaattgctgcttcgagcatagacatcacgagtggctgctaggaccagaggtggatatcctgccattcctcctgctgccacttgccggtcccgaggatttctcggaggaggagatggagaggctgcctgtagacctgcagtacctacctcccgacaaacagagggagcctgacgctgacattcggaaaatgctagtagaagccatcatgctcctcaccgcaacagcccccggcaggcagcaggtaagggaccagggagcctacctcattctgagggaactacattcctgggagccggaacctgacgtgcgcaccgcctgtgagaaactgatccaggtgttgattggggacgaacccgagcggggtatggaaaatctgttggaagttcaggtcccggaggacgtcgaacagcagctccagcagctggattgtcgagagcaggaacaacttgagcgtgagctggccccggaaccgtgggtggagcgcgcaactcccacctag

SEQ ID NO: 47377 - DNA, 1173 bp, Artificial Sequence
  Description of Artificial Sequence: Synthetic coding sequence
atgggcgaggccggcgccggcgccggcgccagcggcggccccgaggctagtccagaggccgaggtcgtaaaactgttgccatttctggcccctggggctcgcgcggacctgcaggccgccgctgtgcgccacgtattggccctgactgggtgcggccccgggcgtgcactgcttgctggacaagccgctctgctgcaggctctgatggagctcgcaccagcctccgcccctgcccgggatgcggcacgggccctggtcaaccttgcagctgatccaggactccacgagaccctgttggctgcagaccccggactccccgctcgcttgatgggcagagctctggacccacagtggccttgggcagaagaggccgccgctgctctagccaatctgagtcgagaacctgccccgtgcgccgcactaatggcagccctggcagctgcggaaccagctgatagtgggcttgagcggctagtgagggctctgtgcacccccgggtataatgcccgggcccctctacattacctcgcccccctgctcagtaacctatcacaacggcctgccgcaagagcatttctgctggaccctgaccgatgtgtagtgcaaaggctcctgcccttgacccagtatcctgattctagtgtgcggaggggcggggtggtagggactctcaggaactgctgcttcgagcatcgccatcacgaatggctgctgggcccagaggtggatatattgcctttcctactcctcccattggctgggcctgaggatttcagcgaagaggagatgcagcgactgcccgtggatctgcaatacctgccccccgacaagcagagggaaccagacgcagatatcaggaaaatgctggttgaggccataatgctgcttacagccaccgcccctggtcgtcagcaggtgcgagatcaaggcgcatatctgatcctgcgggagctccattcctgggaacctgagcctgacgtccgtactgcctgcgagaagttgatccaagtgctaattggggatgagccggaaagaggaatggaaaatctccttgaggtgcaagtgcctgaagacgttgaacaacagctgcagcagttggactgcagggaacaagagcaactagagagagaattggcaccagaaccctgggtggaaagagccacacctacatag

SEQ ID NO: 47378 - DNA, 456 bp, Artificial Sequence
  Description of Artificial Sequence: Synthetic coding sequence
atgtggagcggcctgctgccccccggcctgaacgagagcgacgccgaaagtaacagcgaagatgaggctaccctggagaatagcggactgaacttacaggaagataaagaagacgagtccattagaaaaacggagataatcgacttttcaacagacgagccaaaaaccgagactgaatctaatgtgaatgcttacgaggaatgtccctctggaatccccatagacatgtggaacaagttccaggaactgcacaaaaaacactccgaacaaaaaagcacaacaagtcgcttccgaggtaaaaggcgtaaacggtcacgaaaagataagctgaagaatgaaaaagagctgcactcagagccttcatcaaatgagacgcagtggaaagagctcacacagtatttcggggttaatgaccgctttgacccgcccgttaaacgcaagaaggtggagaagtag

SEQ ID NO: 47379 - DNA, 702 bp, Artificial Sequence
  Description of Artificial Sequence: Synthetic coding sequence
atgtggagcggcctgctgccccccggcctgaacgagagcgacgccgaaagcaattccgaggatgaggccacccttgagaatagcggcttaaatctgcaggaggacaaagaggacgaatccatacgaaagacggaaatcatcgacttcagtaccgatgagccgaagactgaaactgaatctaatgtgaatgcctacgaagaatgcccttccggcattccaatcgacatgtggaataagttccaggagctacataagaagcactccgagcagaaatccacgacatcccgcttccgggggaaacgcagaaagaggtcccgaaaggataaacttaagaatgaaaaggaactgcattccgaaccaagctccaatgagactcagtggaaggaactcacacagtatttcggcgtgaacgatcggttcgaccctcccgtaaaacgtaaaaaagtggaaaaatccggactggaaaagaggattgatcaggcggttgaggaatggaatattgaaaaggccgaagagctaagcaatcagcttgccacacgcgaactcggagtcaagatcgcaaaagccgtcgcttgccacaacttcgtcaaggccaagaaggaggtcgaaaatagccaagccgctaggaaaaagaagaagctggcatgggggttcgaggccaagaaacgctgggagaccaagtcaaatatgggatacatgtag

SEQ ID NO: 47380 - DNA, 702 bp, Artificial Sequence
  Description of Artificial Sequence: Synthetic coding sequence
atgtggagcggcctgctgccccccggcctgaacgagagcgacgccgaatcaaattctgaagatgaggccaccctggagaactccggcctgaacctccaggaggacaaggaagacgagagcattcgaaagactgaaatcatcgacttcagcactgatgagccaaagaccgagaccgaatcaaacgtcaatgcctatgaggagtgtccgagtgggatccccattgatatgtggaataagttccaggaactgcacaaaaagcatagcgaacaaaaatcaactacgtctcgattccggggaaaacgacggaaaaggagccgcaaagataagctgaaaaatgagaaggaactccacagtgaacccagttctaacgaaacacagtggaaggagctcacccagtactttggtgtaaacgacaggtttgatcctcctgtgaagaggaaaaaggttgagaagagcggactcgaaaaacgcatagaccaggcggttgaagaatggaatattgaaaaagccgaagaactgagcaaccagctggctacccgggaactaggcgtgaaaatcgcaaaggccgtggcttgccataactttgttaaggccaaaaaggaggtggagaacagccaagcagcacgcaagaagaagaagctagcatggggctttgaggctaaaaagaggtgggaaacaaagagcaacatgggttacatgtag

SEQ ID NO: 47381 - DNA, 417 bp, Artificial Sequence
  Description of Artificial Sequence: Synthetic coding sequence
atgctgagccccaccttcgtgctgtgggacgtgggctaccccctgtacacttatggctccatcttcattgtcatcgtaattatatggcaggttaaacgcagtcaccacgagctgaacctggaggtcgagagatcttgctgttggcgccatcagaaggtcaggcaaagggcccgcgacgctgctagtacggcgcggcgactgtctcaggaggaggatcagaaaccacaggagctgttttccgttatgaaaagagcaggtttcccacagcgggaagtatgcggcgaatcctacgtgcagatccctgtcgcaaaattcgcgatgctatggctgtggaggtttagctcctgctggcggatgaggatgacgcggagccctcagctctgccgtggcgtgcaccaccgtagtccactcgcatag

SEQ ID NO: 47382 - DNA, 693 bp, Artificial Sequence
  Description of Artificial Sequence: Synthetic coding sequence
atgggcaaggtgcggggcctgcgggcccgggtgcaccaggccgccgttcgacccaaaggagaagctgctcctggcccagctcctccagccccggaagccaccccccccccagcttctgccgctggcaaagactgggcgttcatcaataccaacatcttcgctagaaccaagattgatccctccgcacttgtgcagaaactcgagctggatgtacggagcgtgacctctgtgcgtcggggagaagccggctccagcgccagatctgtgccttcaataagaaggggagcagaggccaagaccgtgctgcccaagaaggagaagatgaagctacgccgggaacaatggcttcagaaaattgaggccatcaaactggccgagcagaagcatcgagaagagaggcgacgaagagccacggtggtcgtcggtgacttgcaccctctccgcgacgccctcccagagctgttggggcttgaggctggctccaggcggcaggccagaagccgagagtctaacaaaccacgcccgtccgaactgtctcgaatgagcgccgcccaacgtcaacagctgttggaggaagaacgcacaagattccaggaacttttagcgtccccagcctatagagcttctcctttagtagctattggccagactctggcccgccagatgcagctcgaagatggtgggcagctgtag

SEQ ID NO: 47383 - DNA, 648 bp, Artificial Sequence
  Description of Artificial Sequence: Synthetic coding sequence
atgggcaaggtgcggggcctgcgggcccgggtgcaccaggccgccgtccggcctaaaggagaagcggcacccggccctgccccccctgccccagaggcaactcctccgcctgcttcagctgctggaaaagactgggccttcataaacacaaacatttttgctaggaccaaaatcgacccctctgcactggtgcaaaagcttgaactggatgtgcgttccgtcacctccgtgcgcaggggggccgaggcaaagactgtgctccccaaaaaggaaaaaatgaagttgaggcgagagcagtggctccaaaaaatcgaggccattaagctcgccgaacagaagcaccgggaagaacgccgccgcagggctaccgtggtggtcggcgatctccacccacttagggatgctctgcccgagttgttgggccttgaggctgggtcacgcaggcaggcgaggtcacgcgagagcaataagcctcggcccagcgagttgtccaggatgtccgcagctcaacgacagcaacttctagaagaagagcgcacgcgattccaggagttgctggcctctccagcttaccgcgccagccctctggtggctatcgggcagacccttgcaaggcaaatgcagcttgaggatgggggccaactctag

SEQ ID NO: 47384 - DNA, 4539 bp, Artificial Sequence
  Description of Artificial Sequence: Synthetic coding sequence
atggccaccgccgtggagaccgaggcctgccagcccaccgacgcctcttgggagagcggcggcggaggcgacgacgaaatgaagcaagcactcccagagctcgaatccagccagcagaacggaggagggggcgggttaaatatcgcggaaccttctggcggggctggccgggaggagaacgccggtgctgaagcagcccagagcctgagtcacgaacagccacaggactcaagcgaagccggtgcagccgccctccctcgcggacccgaagaaccagagagacccgtccgccgctctttccagatccctcggaagagccgcgagaagaaggccctctttcagcctctgacacctggttcccgagaatttgaagatgttgttaacattctccatagctcatacttggaaccaacgagcgtgactaattttaattacagacgggcttgcctggttcacaatgagttgctggaaaaggagttcacagagaagcgtcgggagcttaaattcgatggcaggttagacaaagagttgtccgaatcgtacgcatttctcatggtggaccgttaccaggtccagacaatttgcgaaaaagggctgcatgtgggccaatcaaagatcaccatactggggagtccttcgatgggtgtgtacttatcgcgctacgccgacctgctgcaggcgaaccctttggataccggcgcgatgggagatgtagtcatctttaaaataatgaaggggaagataaagagcatatatgatcccatgggagttaagagtcttgagtctatgctgaataaatcagccctggatcctaccccaaaacacgagtgtcatgttagtaaaaatgctaaccggatcacaagtttactcgcctatcgtgcatatgagctgactcagtactatttctacgagtatgggtttgacgagcttcggagacggcctcggcatgtgtgtccatatgctgtcgtctccttcacgtacaaagatgacatccagacgcccaagttcgtgcctagctcccggtctaatagttttaatacggacagaaatatcgacaagtataactacacactttggaaagggcaattattaaataagggaaagcttctttgttatatttctttgagaagcgcaacccgtgcattcctccctataaagctgccggagaaactcgacgtagagacagtcatgtctatagaccatttgaagcagaaaattcctcctgctctgttttacaaggaaacttatctcggaccgaatgaagtcctaaaaaatggaatgtactgtagcctgtacgaagtcgtggagaaaacacgaatcggcagtaacatggagtccttgctccaaaagttggatagggagaagctcgtgctcgttaagcctttgggggatcgtggttacttattcctgctttccccctaccaaatggtccccccctatgaatatcaaactgctaagtcaagagttctgcacgccctctttctttttcaggagccaaggtctattgttacgagccagaaaggaagtactaacgcagcaccccaggagagacatgagtctatgccagatgtgctaaaaatcgcccagtttttgcagttctccctgattcagtgccgaaaagaatttaagaatatttcagcaattaatttccacagtgtagtagaaaagtatgtgagtgaatttttcaagagaggatttgggagcgggaaaagggagtttattatgttcccttatgactctagactggatgataagaaattcctgtacagcgcacctagaaataaatcccacatagacacatgcttgcatgcctatatttttaggccagaggtttatcaattgcctatctgcaaactaaaggagctgtttgaggagaaccgaaaactccagcagttctcgccacttagcgactacgaagggcaggaggaagagatgaacggcactaagatgaaatttgggaaacgaaacaacagcagaggagaggccataatctcaggcaaacagaggagcagccatagcctggactacgacaaggaccgtgtgaaagagctcatcaatctcatacagtgccgaaagaagtcagtcggcggggactctgatacagaagacatgaggagcaagaccgttctgaagcgaaaactggaagatctgccagaaaatatgcgtaagctggccaaaacatctaatctgagtgagaactgtcatttgtatgaagaatcacctcagcccatcggctcattgggccatgatgcagacctgaggagacagcagcaggatacttgtaatagcggaattgcagatatccacaggctgttcaattggctttcggaaactctcgctaacgcccgtcatagcgacgcttctctgacagacacagtgaacaaggcattaggtctgagtactgacgatgcatacgaagagttgcgccagaagcatgaatacgaactcaacagcacgccggataagaaagactacgaacagcccacttgcgctaaagtggaaaatgcacagttcaagggaacccagtccctgctgctggaagttgacgccacaagcaaatactctgtggcaatcagcaccagtgaagtgggaacggaccataagctgcatctgaaggaagatcccaacctgatctcagtcaataattttgaagattgttcactgtgcccaagcgttcccatcgagcacgggtttagaaggcaacagagcaaatcaaacaatgttgaagagactgagattcattggaagctcattccaattaccggagggaacgcaaggagccccgaagatcaattaggcaagcacggcgaaaaacagacaccgggcatgaagtctcccgaggaacagctggtctgcgttcctccgcaagaagccttccccaacgacccaagggtgatcaacagacagcgctccagcgactatcagttccccagctcccctttcacagatacactcaaaggaaccactgaagacgacgtgttgaccggtcaggtggaggaacagtgcgttccagcagctgaggccgagccccccgcagtaagtgagaccactgaacgcacagtcctcggtgagtacaacctgtttagccgaaaaatcgaagaaattcttaagcagaaaaatgtgtcctacgtctcaaccgtttctacacctatctttagcactcaggagaaaatgaaacggctctctgaattcatatattctaagacatccaaggcaggcgtacaagaattcgtcgatggcctgcacgagaagctcaacaccattatcatcaaagcttccgctaaggggggcaatctgcctccagtctctcccaacgacagcggagccaaaattgcatcgaacccgttagaacgccacgtgattcctgtgagctcctcagacttcaacaacaaacacctgctggaaccactgtgtagcgaccctctgaaagacactaattctgatgagcaacatagtacctctgctttaaccgaggtggagatgaatcagccacagcatgcgacggagctgatggtgacatctgatcatatcgtccctggcgacatggcccgggaaccggtggaagaaacaacgaagagtccttctgacgtgaacatctcggcacaacctgccctttccaacttcatctctcagttggagccagaggtattcaactccctagtgaaaataatgaaagacgtgcagaagaacactgttaaattctatattcacgaggaggaggaatctgttctctgcaaggaaataaaggagtatcttatcaagctggggaatacagaatgtcatcccgagcagtttctcgaacgcagatcaaagctagataagctgctgataattatacaaaatgaagatatcgccggattcatccataagatccctgggctggtgacactgaagaagttgccctgcgtatctttcgccggcgtggacagtctggatgacgtgaagaatcacacatataacgaactgtttgtgtcgggagggtttatcgtctcagacgagtctatcctcaacccggaagtggtcaccgtcgagaacctgaagaattttctgacattcctagaagaattgtcgacgccagaaggcaaatggcagtggaaggtgcattgtaaattccagaagaaactgaaagagctaggccggctgaatgctaaagctctcagcctgttaacccttctgaatgtgtatcaaaagaagcatctggtggagatcttgagttaccataactgtgattcacagactcgcaacgcacctgagctggattgcctgataagactacaagcccagaacattcagcagcgacacatcgtgttcttgaccgagaaaaacatcaagatgctcagtagttacaccgataacgggatcgtggtggcaaccgcagaagactttatgcagaattttaaaaacctcgtgggctatcacaactctattaccgaggaaaacctgccgcaactgggagctaatgaaaacctcgaatcccagtccgatgccgtgctgaccctgactcctctcgagctcggagtcggtattagtcagcactag

SEQ ID NO: 47385 - DNA, 4830 bp, Artificial Sequence
  Description of Artificial Sequence: Synthetic coding sequence
atggccaccgccgtggagaccgaggcctgccagcccaccgacgccagctgggagtccggcgggggcggtgatgacgagatgaagcaggcgctgcctgaactcgagagctcacaacaaaacggcggaggaggtggattgaacatagctgaaccaagtgggggcgccggccgagaagaaaacgctggcgccgaagccgctcagtccctaagtcatgagcagccacaggatagttctgaagccggagctgccgccttacctcgggggcccgaagagcccgagaggcctgttaggcggtcattccaaataccgaggaagtctcgggagaagaaagctctgttccagcctctgacccccggatctagggaatttgaggatgtcgtgaacattctgcatagcagttacttggagcctacctctgtgacaaactttaactatcggcgggcctgcctggtgcacaatgagcttcttgagaaggaattcactgagaaacgcagggagctcaagttcgacggcagactggacaaagagctgagcgaatcctatgccttcctgatggtagaccgataccaagtacaaactatttgtgaaaaagggttacacgtcggccaatcaaagataaccatcctgggcagcccttccatgggagtgtacttgtctcgctatgcagacctcctgcaggcaaatcccctcgacactggtgcaatgggcgacgttgttattttcaaaattatgaaaggtaagataaagagcatctacgacccaatgggcgtcaagtctctggaatcaatgttgaataaatcagcgctcgatcctacacctaagcatgagtgtcatgtctcaaagaacgctaataggatcacaagcctcctcgcctacagggcttatgaattgacccagtactatttttatgaatatggtttcgacgaattaaggaggagacctcggcacgtgtgcccctatgcagtcgtttcctttacgtacaaagatgatatccagacacccaaatttgttccctcatctagatcaaattctttcaatacagacagaaatatagataaatacaattacacactgtggaagggacagctgctgaataagggtaagctgctgtgttatatttctctgcgcagcgctactcgagcgtttcttccgatcaaactgcctgagaagttggacgtggaaacggtgatgtctattgaccatctaaaacagaagattccacccgcactgttttataaggagacttacctgggtccaaacgaagtgctgaaaaacggcatgtactgctcactgtatgaagtcgtggaaaagacaaggatcgggtctaacatggagagtctcctgcaaaagcttgatcgggagaagctcgtgctggtcaaaccactcggtgatcggggctatcttttcctcctgagtccctatcagatggtgcctccatacgaataccagactgcaaaatctagagttcttcacgccttatttctgtttcaagaaccaagaagcatcgtaacctcccagaaggggagcaccaacgccgcaccccaggagcgccatgagtctatgccagacgttcttaaaatcgcccaattcctgcaattcagtctgattcagtgccgcaaagagttcaaaaacatttccgcgataaatttccactctgttgtggagaaatatgtgtctgagttttttaagaggggattcggatccggaaaacgagagtttattatgttcccatacgattctagattggacgataagaaatttctgtacagcgctcctagaaataagtctcacatcgatacctgccttcacgcatacatctttaggccagaggtttatcagttgcccatctgcaagctgaaagaactgtttgaggaaaatcgcaagctgcagcagttttcccccttgtccgactacgaggggcaggaggaggagatgaacggcaccaagatgaagtttggcaaacgaaataactctcggggcgaggctatcattagcggaaagcaaaggagttcccacagtctggactatgataaggatcgggtgaaggagcttatcaatctaatacaatgtcgcaagaagagcgttgggggcgacagcgacactgaggacatgagaagtaagacagtgctcaagagaaagttagaagatttgcctgagaacatgcgaaaactcgcaaagacaagcaacctcagtgaaaattgtcacctctacgaggagagtccacagcctattggctccttaggacacgatgcggatttacggagacagcagcaagacacttgtaactcagggatcgctgatatacaccgcttattcaattggctgagcgaaacactagctaacgcacgccacagtgacgcaagcctcacggacactgtgaacaaagcactggggctctctacagatgacgcttatgaggagctgagacagaagcacgagtacgagttgaattccacacccgataaaaaggactatgagcagccaacctgcgccaaggtggaaaatgcccagtttaaaggcacacagtcactcctcctggaagtggacgccacatctaagtattcagtcgccatctctacctcagaagtaggaactgatcataagctgcatctgaaggaggaccccaacctgatatcagtgaataattttgaagactgttctctttgcccctccgtgcctatcgagcacggatttagaaggcagcagagcaaatctaacaatgtggaggagacagagatccattggaagctcatccctattacagatactctgaaagggacaaccgaagatgatgtcttaaccggccaggtcgaggagcagtgtgttcctgcagccgaggccgagccaccagcagttagcgaaacgacagagaggacggtgttaggagaatacaatctcttttccagaaaaatagaagaaatcctgaagcagaagaacgtctcctatgtctccacagttagcacccccattttttctacccaagagaagatgaagagactttccgagtttatatattctaaaacttctaaggccggagtgcaggaattcgtggacgggctccacgaaaaactgaacactattatcatcaaggcctctgctaaggggggaaacttacctccagtcagtcctaatgactcgggagccaagatcgctagtaatcccctggagcggcatgtcattcccgtgagcagctctgacttcaataacaaacacttgctggaaccgctttgttctgacccgctaaaggacaccaattccgatgagcaacactctactagcgcactgactgaggtcgagatgaatcagccacagcatgccactgagttaatggtgacctctgatcacatagtccccggagatatggctcgagagcccgtggaggaaactacgaagagcccttctgacgtaaatatctccgcgcagcctgctctgagtaattttatttcacagctggaaccggaagtgtttaacagtctagtcaagattatgaaagacgtacagaagaacaccgtgaaattttacatccacgaggaggaagagtctgtgctctgcaaagagatcaaagagtacctcattaaactgggcaatactgaatgtcatcccgagcaattcctggagcgtcggtcaaaacttgataagctgcttatcattatccaaaatgaggacattgctggattcattcacaaaatcccagggttggttactctgaagaagctgccctgcgtgtctttcgcgggcgtggattctctggacgatgtgaagaaccatacttataacgagctgttcgtgagcggtggcttcattgtgtcagatgagagtatcctcaaccccgaggtagtgaccgttgaaaacctgaagaacttcctcacatttttggaagaattgtcaacacctgagggcaaatggcaatggaaagtccactgtaaatttcagaaaaaactcaaagagctcggacggttgaacgccaaggccctgagccttctgacactgctaaacgtatatcagaagaagcacctggtggagattctgagctaccacaattgtgactcccaaacacggaacgctcccgagttagactgcctgatcaggttgcaggcacaaaatatccaacagcgtcatatcgtttttcttactgaaaaaaacataaagatgctttcatcttatactgataacggtatagtggtcgcgactgctgaagacttcatgcagaatttcaaaaacctggtggggtaccataactctatcacagaagaaaatcttccccagctgggggccaatgagaacctggagtcgcaaagcgccttattggaaaacgacgaaaaggatgaagaagatatgtccctggattctggcgatgagatttcccacatcgaggtttgtagcaacttccatagtgaaatttgggagaaggagacaaaagggagcaggggaacagaccaaaagaaaaacactcagatagaactgcagtcctctccagatgtgcagaattccctactggaagataaaacctatctggattcggaagaaaggacttctattgacatcgtgtgtagtgagggagaaaacagcaacagcactgaacaggactcatatagcaatttccaggtctaccactctcagttaaacatgagccaccagttctcacactttaatgtgctgacccaccaaaccttccttggcacaccgtacgccctgagcagtagccagtcacaagagaacgagaactatttcctctctgcctataccgagtctttagatcgagataagtccccacctcccctctcatggggtaaatccgattccagcagaccatactcacaggaaaagtag

SEQ ID NO: 47386 - DNA, 3702 bp, Artificial Sequence
  Description of Artificial Sequence: Synthetic coding sequence
atgagcatcgaccacctgaagcagaagatcccccccgccctgttctacaaggagacatatctggggccgaacgaagtgctgaaaaacggtatgtactgcagtctgtacgaggtggtagagaagacccggataggatcaaatatggaatccctgctccagaaactggacagagaaaaacttgtactggttaagcccctcggcgacaggggctacctgttcctcctcagtccttatcagatggtccctccttatgaataccaaactgctaagtcgcgagtgctacacgctctcttcctgttccaggagccgcgatcaatcgtaactagccagaagggatccaccaatgcggcgccccaagagcggcatgagtccatgcctgatgtgttaaaaatagcccaattcctgcagttttcactgatccagtgccggaaagagttcaagaacatttcggcgattaactttcatagcgtcgtggaaaaatacgtgtccgaattctttaagcggggatttgggtcaggcaaaagggaattcatcatgttcccatatgactcacgactagacgacaagaaatttctgtatagcgctccacgaaataagtcccatatcgacacttgcctgcatgcttacattttcagacccgaagtgtaccaacttcctatctgtaaactcaaggagctgtttgaagagaaccgaaagctacaacagtttagcccgctctcggactatgaggggcaagaagaggagatgaacgggaccaaaatgaaatttggtaaacgaaataatagccgcggggaggctattatcagtggcaaacagaggagttcacactccctggattacgacaaggaccgggtcaaggagttaatcaacttgatccagtgcagaaagaagagcgtcggaggggattcagatactgaggacatgaggtctaaaactgtgctcaagagaaagctggaagatctgcccgagaacatgaggaagttggcaaagacctccaatttaagcgaaaattgccatctgtatgaggagtcccctcagccgatcggctcactcgggcacgatgcagacctcagacggcagcagcaggacacttgtaactccgggattgctgatattcacagactgttcaactggctgtcagagacgctggccaacgcccgacatagtgacgcttctttgactgacaccgtcaacaaggctctcggcttaagcactgacgacgcatatgaggagctgcggcaaaaacacgagtacgaactgaattccacaccagacaaaaaggattatgaacagcctacctgcgccaaggtggaaaacgcccagtttaagggcactcaatctcttctgcttgaggtagacgccacatctaaatacagcgtagcaatttcaaccagtgaagtaggcaccgatcacaaactccacctgaaggaggatccaaaccttatttcggtgaacaatttcgaagactgctcactgtgtccgtcagtgcctatagaacatggcttccggaggcagcagagcaaatccaacaacgtggaggaaactgaaatacactggaagctgatccccattacaggcggtaacgctagatcacctgaagatcagttagggaagcacggcgaaaagcaaacaccagacaccctgaaagggactacagaggatgacgtgctgacagggcaggtggaagagcagtgcgtgcctgctgccgaagcagagcctcccgctgtcagcgagaccacagagcgaaccgttctcggagaatacaacctattcagtcgcaaaatcgaggagatcctgaaacagaagaacgttagttatgtgtcaacagtgagtactcccattttttccacacaagagaaaatgaagagactgagtgaattcatctacagcaaaacgagcaaggcaggcgtgcaggaattcgtggacgggttgcacgagaagctaaataccatcatcatcaaggcaagtgcgaaggggggaaatctgcctccagtttctcccaacgactcgggggctaagatagcgtccaacccccttgagaggcatgtgatcccggtgagctctagtgacttcaacaataaacacctcctagaaccattatgctcagatccactcaaagataccaatagtgacgagcagcatagtacctccgctttaaccgaggttgagatgaaccagccacaacacgccacggagctcatggtgacatctgaccacatcgttcccggagatatggctcgcgagccagttgaggagactacgaaatctccttctgatgttaatattagcgctcaaccagccctcagtaattttatctcccagctagagcccgaagtgtttaatagtcttgtgaagattatgaaagacgtgcaaaagaacaccgtcaaattttatatccacgaagaggaggagagcgtcctgtgcaaggagataaaagaatacctgatcaagctgggcaatactgaatgccatcccgagcaattcctggagcgcaggtctaagttggacaagcttctcatcatcattcagaatgaagacatcgctggcttcatccataagataccaggactcgtcacgctcaaaaaactgccttgtgtatccttcgcaggcgtggatagccttgacgacgtgaaaaatcatacgtacaatgaactgtttgtcagcggaggcttcattgtatccgacgagtctattctgaatcctgaagtagtgacagtggaaaacctaaagaacttccttaccttcctggaggagctgtctacgcccgagggcaagtggcaatggaaggttcactgcaagttccaaaagaaactgaaggagctgggccgccttaacgcaaaagccctctcgctgttaaccttgctcaacgtataccaaaaaaagcacctggtggagatcctttcataccataactgtgattcacagactcgcaacgcgcccgaattagactgtctcattagactccaggctcagaacatccaacagaggcacatcgtgttcctcaccgaaaagaacattaaaatgctatcttcttatacagataatggaattgtggtggcgacggcagaggattttatgcagaactttaaaaatctggtgggctatcacaactccatcaccgaggagaacctgccacagctgggtgcaaacgagaacttggaatctcaatctgctttgctggagaatgatgagaaggacgaggaagatatgtctctggactccggcgacgaaatctcccacatagaggtctgctccaattttcatagtgagatctgggaaaaggaaacaaaagggtccaggggaactgaccaaaagaaaaacacacagatagaactacagtctagtcctgacgtacagaatagccttctggaagataagacctacttagactccgaggaaaggactagtatcgatattgtctgctcagaaggggaaaatagtaactccacagagcaggatagctactccaactttcaagtgtaccattcccagttaaacatgtcgcaccaatttagccactttaacgttctcacacaccaaacctttctcggcacaccgtacgccctgtcgtccagccagagccaagagaacgaaaattatttcctaagcgcatatacagaaagcctggaccgtgacaagtcaccacctcccctgtcttgggggaaatcagattcttccagaccatactcacaggagaaatag

SEQ ID NO: 47387 - DNA, 7293 bp, Artificial Sequence
  Description of Artificial Sequence: Synthetic coding sequence
atggccccccccgcccacaagagcatcctggagcggagcgagaacgtcttaatgtctccttggaaaggtaaactgattgtgcaggaccgaatgctgtgtgatatagctctgtggagcacatacggagcaatgatacctactcagttaccacaggagctggatttcaaatacgtaatgaaagtgtcttccttaaagaaaaggctcccagaagccgcctttcgaaagcaaaattaccttgaagagaaagtctgcttccaggacctgtgttttaatctgtacgaggtagaactttccaatagacaaggggaaaacatagacaaactgactgaatgcattaaaaacaaacagcttgcgattattaaatgtctcgaggatagaggattctttattttactgacatcatccgcccttttgagtgaacccgactttgggggtaaacagatgggattacacgggctccatctgttccgatctcctctgtccacaggcgtgaaagacctcaaagtcgaagatgatatttcgatgaaggtgatcccgattctgtccaccctgaactgtgcactcctagagacaaagaaatctctgccagaggaacgcatccatccaaacaccctcgttaaaaggcattttcaggaattatacaaagctgaccgctcaccatcgctgagcgtggctccacaggatcggatgaaagaccccacattcctcggaaagctgccgtccgggttcgacctcattccgcccgccgaaaaatgcccgtcagagagcctgacccagttaaattcatacttcagtgatccatcagcgtatattctggaagtcagcacagcactggaccttctcgctgaacacccacaatccccttgcgtatccgatggaatctgcgacgccgggttttctcttgtaatgactccagaccctgaattcctggtgagtgaggcagaggtgagaaaggagaccgagacaaagaaagactcagaggaaatgttgaaagccaagaaaagggtgttccccttgagcccagcctccaacctgagggtccagcccaagcggaaggcatcaatgccacacatggtccaatccaagaaagttaatctgtgcaggcccttccctaagcgaaccgcctcacgcgcagataacagctccgattctccgacaactttgaagctcgtgaagggacaatttccccaaaagcggaaaaggggtgctgaggtgttaacggcccagttcgtccagaagaccaagctcgatcgcaaaaaccaggaagctcccattagcaaagacgttccagtgcctactaatgccaaacgggcccggaagcaggaaaagtctccagttaagaccgtgcctcgggccaagcctccggtgaagaagtctccacagaagcagcgcgtgaacattgtgaaaggcaatgaaaatccaaggaatagaaagcagctacagccagttaaaggagagactgcttcaaagcttcagtctgagattagccggggatgccaagaagatggtattagcatcaattccgtccagccagagaacacaaccgctgcccacaacgacttgcctgaaaattctattgttaactatgactcccaggcactgaatatgctggccgacctcgcgctcagtagtgcaactagtagcactcccgtgtccgaggcccggaatctgcactgtagttccgaactgccgcagaatgacgtgcttctgtctaaagagaactcccttagaggcacctccgaccatgaataccataggggcgtaaaaacccagaaaggtgagcttttacctaatccaagttcagataggaaaagtaattctgggtctgacttgactgtgagccaagacgaagagtcactcgtgccctgttcccaggcacctgccaaggcacagtctgccctgaccgaagagatgctggagagctctgatgcatcccagtcctcttccgtctccgtggagcatagttatgctttactgcttacagagcactccaaaaaacacttacaggaaagagagattctttccccactcttcccgagaaatgggaccaagagccctgaggccgctacacccgttggaaaggtcatgcccttccggcaccaaccaggcttactgttgcagcagaagccacccgacgacccagtcgttaaacctaaggacaggcctccttcagctcgtgttaagaagagcagctgctctagaatcgtgttgagttgtgacgattctgtcaagatcacattcaaatgtgaaactgagtatgcgttttccctggattccaagtatacaaacaacccactggagaaaacggtggtgagagccctgcatgggccctggaatactgacttgcccgacaacgtcgaggaggtcaaattactgctgcacatgtgggtcgccctcttctattccaaccaaaacaagatcatcaggtccagtcggaaagtagtggagcactccaacccagccaaatacgtgagtatcaattccactctagaaagttgcgagttgagagagatcgaggaatccctgggtcttgaaaaatgttcggccgacagcttactcgaaacgaacgagattagtagagcacacgcagcggaggtctctttccgcgatcccaactgtctgctcccatttatcaaaacacccttaacccagggactcgaactgtgcgttcagaacgaacaaaagaagaccttcgcgcgggaatgtgacccagacacacaggaagatcagaatttcatctgttcttacaacaacgaggtaactggggaggaggccaagcaggaatccctggaaacctcaaatctcgtactctctggcattggtagcacccaaaccaacggtccttctgtcccttctgaggaagagattgttcagcctcttgacagtactagggttgcatcatactcgggtactgtgacacaggccacatttaccagaacttatgacgggcctggctcacagcctgtgatttgccagtcctccgtgtacggcacccttgagaacaaagtggatattcttgatgccgcagtccagacaaagaccgggaccttgcaggacttaattcaacacgggtcaccaataaacaatgaatgtcatcctagtctggagagaaaagacgataatatggggtgcgcggtgatcaacccagaaccaattaccctgacgtttgaaaaaaacgcgcacgtgcctatacagactgagggggttaatacagcggacgagcgcactacctttaagaaggagctgattaagcaggtgtctcccgcagcgtcacttcgccatccagtaagcaccagcgagaacgctcgcactcaaggccttcgggacatcccatctctcgttgttgcagggcagaagggtactaaatacctctgcgcctctagtgttgggggcgaaaccctggacaaggcagtttgctctctgcagaaggaaacccccttgcccgtttcactgccatcggacaagacgatggtcatggaggccttaagcctagcgaaatcttcaagtcatctgtcacctagtgaagaggttcgctgcactcaagactttctgtcccagacacagagtctgctcggactcagttcagagggactcctcgagctgacgcaggtcgaggtggacagcagctccgcctccaccactcttggcagacagtgcagcctgaactgtatctccagtggctgtcatacctccggagacagcctagaactccgcaaaaatcataagaacggtccaaatacagaaaatatgaatctcgaggcctttgattccgtgttcataaaacagacttctctgtccgtcagccgggaggtctccctggagctatccgaggaggacagcgatatcgatttagcactcaccatctcaccccccaccagtccaagggaagaaatgcccgcgggcgagatagagcaatttgaggaagcaccttttagcaacctggaactgcaggacgttgcagaggagataggcgagcccgaggaggtcgctctcacggagtctcgggaggtgtccagtgccgacaatgtgtccgtttacccatctgtctccgaggagccagtggaaaacaaggagaggaagggggataatctccagcctgtcaccttgatcctgtctaaagaaaactgtaccctggagatagccgaggagatcaatgtcactagtgatttccccttcgacagcgtcatcgaagaggtgtctcctgctagttcccccgagccacccgttcctgttaaagagacccgaccatatcaggccgttactccttgcatccttaagttacacggcacccaatgtgaaaaatccaaccagatttctcagtgcgaatccgaggatctgggaataacagagaaggagaacgtgttcgtgggtcccactcatcctgtgggacaggacaatttcactcaggtgcagcaaatgcaggtgtctgccgagatgcctcttatactcaccgaccatcctggaaggacgggccgcccaacccttcccggaaaggtcacagaggagatcgtatcttccgaacacgatgagggactgtctttttcggggaaggtgcagtgctacggcagagaactgaatcaacctgcctctgcggctaaatgtaccggggacttttcgcccagcccagaaaagctggtcaagagcgggaacccattacagccagtcagtattgagaatcggaaccttgacctcaaacatcttgtgctggagagttctgaacccccttttggacctcgtaacgtaatcgaaaataagtctctgagcgataccttagtgtctactaccgccccttctggcattgttaacgtgagcgtgaaacagcagacatcccccaaatcttcacagaatcaccttttcccaggggaccttaagaccgacgagggcatttatcttcaggtcaaatcacttactgccgctagcgtggacggggcctacagtacccaggggtgtatgtgttccgtggtcccgactctctgctcgtctagtgataacgcgaccctgactcattatgtccgccctattaatgcagaacctgtatttcaggctcaggagatccccgctggaagaatggcttctctgctgaagaacggggaaccagaggctgagctccataaagagactaccggtccgggaaccgccggtccacagtccaatacgacttcctcgttaaagggtgagcgtaaggctatacacacattgcaggacgtgagcacatgcgagaccaaggaattactgaacgtgggggtatcgtccctgtgcgctggcccgtaccagaacaccgccgatactaaagagaacctctccaaggaacccctggcttcattcgtgtcagagagctttgatacgtctgtctgtggaatcgccacagaacacgtagagattgaaaacagcggcgaggggctcagggcagaggccggtagcgaaacgttgggccgcgatggcgaggttggagtcaattccgacatgcactatgagctgagtggagactctgacctcgatctgctgggcgactgccgaaatccgagattggacttggaggactcttatacactaaggggctcttatacccgtaagaaagatgtgcccacggacggctatgagagcagtctgaactttcataacaacaatcaggaagactggggttgttcttcctgggtacctggaatggaaacgtccctgccgcccggtcactggaccgcagcagttaaaaaggaagaaaagtgcgtgccaccctacgtgcagatcagagatctccacggcatcctcaggacctacgcgaatttctcaatcacaaaagagttaaaagatacaatgagaacgtcccacgggcttaggaggcatccatcctttagcgccaactgcggcctcccatccagttggacatctacatggcaggtggcagacgacctcacacagaacacattggatctcgaatacctgcgctttgctcacaaactgaaacagacgattaagaatggagattcccagcattctgcctctagcgccaacgtgttccccaaggagtcacctacacaaatatcgattggggctttcccatctaccaagatctctgaggcccctttcctgcaccctgcaccaagatccaggagtcccttacttgtgactgtcgttgagagtgacccacgacctcaggggcagccccgaagaggctacaccgcaagtagtctggattctagttcctcatggagagagcggtgtagccataatagggacttaagaaacagccaacggaaccatacagtttcatttcacctgaacaaactcaagtacaattcaaccgtgaaggaatccaggaacgacataagtctcatcctaaatgagtatgccgaatttaataaggtgatgaagaactcaaaccagttcatcttccaggataaagaattgaacgacgtgtcaggtgaggcaacagctcaggagatgtacctgccctttcctggcagaagcgctagttacgaggatattatcatcgacgtttgtaccaatctacacgtcaagctaagatcggttgtgaaagaggcctgtaaatcaactttcctgttctacctggttgaaaccgaagataaaagctttttcgttcgcactaagaatttactccgcaaagggggccacacagagatcgaaccgcagcacttctgccaagcctttcatcgggagaacgacacactcatcatcatcattcgaaatgaagacatctccagccacctacaccagatcccaagcctgctgaagctgaaacattttccatccgtgatctttgcaggggtggatagtcctggcgacgttttggaccatacttatcaggagctgttccgcgccggtggtttcgttatatctgatgacaaaatcttggaggccgtcaccctggtgcagctcaaagaaattatcaagatactcgaaaaactgaatggtaatggaagatggaagtggcttctccattacagagagaataagaaactgaaggaagacgaacgagtggactccacagcacataaaaagaacatcatgctgaagtcttttcagagcgctaacataatcgaattgctgcactatcaccagtgcgactcaagatctagcaccaaggcagagatcctgaagtgcttgctgaatctgcagattcagcatattgacgcccgctttgcagtacttcttaccgacaagcctactatccctcgcgaagtgttcgagaatagcggcatcctggtgacagatgtgaacaatttcattgaaaatatcgagaagatcgccgccccctttaggtccagttattggtag

SEQ ID NO: 47388 - DNA, 4878 bp, Artificial Sequence
  Description of Artificial Sequence: Synthetic coding sequence
atggccccccccgcccacaagagcatcctggagcggagcgagaacgtgctgatgtccccatggaagggcaagctcatcgtgcaggacagaatgctctgtgacatcgccctgtggtcaacttatggagccatgattcccacacagttgcctcaagagctggattttaaatacgtcatgaaggtgagctcactcaagaagcggctaccagaggcggctttccgcaagcagaattacctggaagagaaagtgtgtttccaagatttgtgcttcaatctgtacgaagtcgaactgtccaatagacagggggagaatattgacaagctaaccgaatgcataaaaaacaagcagttagcaatcatcaagtgcctggaagatcgagggttctttattctattaacttcatcggccctattgtcagagccggatttcggtggtaagcaaatgggccttcatggtctgcacctctttcgttctccccttagcactggcgtgaaggatctaaaggttgaagatgacatatccatgaaggtgatccctatcctgagtacgctcaactgcgccctgttggaaacaaagaagtcacttccagaagaacgaatccaccctaacactctggtgaagcgccacttccaggagctctacaaagcagatcggtccccttccttgtcggtggcaccccaggatcgcatgaaggaccccaccttcctaggtaagcttccgtctggatttgacttaattccacctgcagagaaatgtccgtcagagtctctgactcagctgaactcatacttcagtgatccttctgcatatatattggaggtgagcactgctttggatctgttggctgagcacccacagagtccatgcgtcagtgacgggatttgtgacgcaggtttctccctggtcatgactccagatccggaatttctggtgagtgaggccgaagtgcgcaaagagacagagacgaaaaaggactccgaagagatgttaaaagccgtgtgcagcctgcagaaagaaacccccttgccagtcagcctgccctctgacaaaactatggtgatggaagccctaagcctggccaagagttcgtctcatcttagcccatctgaggaggtccgatgtacgcaagattttcttagtcagacgcagagtctccttggtttgtcctccgagggcctcttggagttgacccaagtggaggtcgattccagtagtgccagtacgactctgggccgacagtgtagcctgaattgcatctccagtgggtgccataccagcggggacagtctcgagctacggaagaatcataaaaatggccccaatactgagaacatgaacttagaggcttttgattccgtttttattaagcaaaccagcctctctgtctcaagggaagtttctctggagttgtcagaggaggactcagatatcgatctcgccctgaccatatctccccccacttctccacgtgaggaaatgccggctggtgaaatagaacaatttgaggaagcacccttctcgaatcttgagcttcaggacgtcgccgaggaaatcggggagcccgaggaggtcgccctcactgaatctcgcgaggtatcttcagcagacaacgtctccgtctatccttccgtgagcgaggagccagtagagaataaggagcggaaaggggacaatttgcagcccgtgaccctcatcctcagcaaggagaactgtacactggagatcgccgaggaaataaatgtcacctcagacttcccattcgatagcgtcatcgaggaggtctctccagccagctctcccgagccccccgtgcctgtgaaggagacacggccataccaggccgtgaccccttgtatcctgaagttgcacgggacacagtgtgagaaatctaaccaaatctctcaatgcgagagtgaggaccttggaataaccgaaaaagagaatgtgttcgttgggcccactcacccagtgggtcaggacaattttacccaggtccagcagatgcaggtcagcgccgagatgccacttattctcactgaccaccctgggagaaccgggagacccaccctgcccgggaaggtgactgaggagatcgtcagctccgagcacgatgaaggactgagcttctctgggaaggtgcagtgttatggcagagagctgaaccagccagcaagcgcggccaagtgtacaggtgacttctccccttcacctgagaaactggtcaagtctgggaaccctctacagccggttagtatagagaatcggaacttagacttaaaacacctggtattagagtccagtgaaccaccgtttggtccacgaaatgtaatcgagaataaaagcctgagtgacacactggtgtcaacaactgcaccctccgggatagtgaatgtgtcggtgaaacagcagacctctcctaagagctcacagaatcacctgttcccaggggacctaaagacggacgaaggaatctatctccaggtgaaaagtctcacggccgcatctgtcgacggcgcctattccactcagggatgtatgtgttcggtggtgcctacactgtgttcgtcatcagataacgctactctgactcattacgtgcgcccgattaatgccgaacctgtattccaggcccaggaaattccagctgggcggatggccagtctgctgaaaaatggagaacctgaggccgaactgcacaaggaaactacgggccccgggactgcagggccgcagtcaaacacaacatcctccttgaaaggggaacgcaaagccattcatacattgcaggacgtttctacctgcgagacgaaggagctgctgaacgttggcgtgagtagtctttgcgctgggccataccagaacaccgcagataccaaagaaaatctaagcaaagagcctctcgcctcttttgtcagcgaaagcttcgacactagcgtgtgcgggatcgccacagaacacgttgagatcgagaactccggcgagggactcagggcggaggcgggttcagaaacattagggcgtgatggggaagtgggcgtgaatagcgacatgcattacgagctaagtggcgattcggatttggacttactcggggattgccgtaatccgcgcttggatttagaagactcttatacattgcggggctcatacacccggaagaaggacgttccgaccgacggatacgagtcaagtctgaatttccataataataaccaagaagactggggttgtagttcttgggttccagggatggaaacgagtctccccccggggcattggaccgccgccgttaagaaagaggaaaaatgcgtgcccccttacgtccagattcgggatctgcacggcatcttacgcacttatgctaacttctccatcacaaaggagcttaaagacacaatgcgtactagccacgggctgagacggcatccctccttttcagccaactgcggactcccatctagctggacctcaacatggcaagttgccgatgacctgacccagaacaccctagatttggagtacctcagattcgcccacaagctgaagcagacaattaagaatggcgacagccagcactcagcaagctccgcaaatgtgttcccaaaagagtcacccactcaaatctccatcggcgccttcccctctacaaagataagtgaagcccccttcttacaccctgcacccaggagccgcagccctctgctggttaccgtggtggaatctgatccccggccacagggacagccacgacgcgggtatacagctagctcactggactcctcgtcaagctggcgagaacggtgttctcacaacagggatctccgtaacagccagcggaaccatactgttagctttcatcttaataagctcaagtacaacagcactgtcaaagagagtagaaatgacatcagtctgatactgaatgaatacgccgaattcaacaaagtgatgaagaattctaaccagtttatcttccaggacaaggaactaaacgatgtctcgggcgaagcgacagctcaggagatgtacttacctttcccaggccgtagtgcctcctacgaagacatcattattgacgtgtgtacaaatctacacgtaaaactgcgaagtgtagtaaaggaggcctgcaagagcacttttctgttctacctggttgaaactgaggataagagcttctttgtgcgcacaaaaaacctgctacgaaaaggggggcacacggagatcgagccacagcacttctgccaggcttttcatcgggaaaatgataccctgatcataattatccgaaatgaggatatctccagtcacctgcatcagattccctcactgctcaagttgaaacattttcctagtgtgatattcgctggcgtcgactctcctggggatgtgttggaccatacgtatcaggaactttttcgcgctgggggattcgtaatttcagacgacaagattttggaagccgtcaccctggtgcagctgaaggaaattataaaaatcctcgagaaactgaacggcaatggaaggtggaagtggctcctgcattacagagaaaacaaaaaacttaaggaggatgaacgcgtcgacagtacggctcataaaaaaaacataatgctgaagtctttccagtccgctaacattatcgagttattacactatcatcagtgtgactcaaggagcagcacaaaggctgaaatccttaagtgtctcctaaacctccaaattcagcacatcgacgcgcgattcgccgttttacttactgataagccaacaattcctcgcgaggtgtttgagaattccggaatactggtgacggatgtgaataactttatcgagaacatcgaaaagattgccgcgccctttcgttctagctactggtag

SEQ ID NO: 47389 - DNA, 27 bp, Artificial Sequence
  Description of Artificial Sequence: Synthetic coding sequence
atggccccccccgcccacaagagctag

SEQ ID NO: 47390 - DNA, 639 bp, Artificial Sequence
  Description of Artificial Sequence: Synthetic coding sequence
atgggcacccggcagaccaagggcagcctggccgagcgggccagcccaggcgccgcacctggccctcggagagaacgccctgatttttgggcatcactgttgttacgtgccggcgacaaagctggccgggcaggcgctgggatgcccccttatcatcggagggtgggtatggtgcaggaattactgcggatggttcgccagggccgccgcgaggaagcggggactcttctgcaacaccttaggcaggacctcggaatggagtccacatccctggacgatgtactctacaggtacgccagctttagaaacctggtggaccccataacccacgaccttataattagcctggctagatatattcactgccctaaaccacctcaaggctgtcctggtcgaaaacctccccgtcagcactccggaccagtagggaacccaacagaccttcctaggcctggggcaggcgatcagttgcccaccgctctgtggggagcgggaagacagcggggggcgggcctgcatcgccctcatggtaggcacggtcccgccgctgccgcatcaacgcagcaccccgctcctcctcatcacacgggtacccagtggcaaccggtcgatcccgggcgagcagcccgacctcactag

SEQ ID NO: 47391 - DNA, 1035 bp, Artificial Sequence
  Description of Artificial Sequence: Synthetic coding sequence
atgggcacccggcagaccaagggcagcctggccgagcgggccagccctggcgcggccccgggtcccagaagggaacggccggatttttgggcatctctgcttctgcgagcaggggacaaagccggccgcgctggcgcgggcatgccaccttatcacagaagagtggggatggtacaggaactcctgaggatggtgcgccaggggcggcgagaggaggctgggacactcctgcaacatctaagacaagatcttggtatggagtcaactagcctcgatgacgtattataccgatacgcctctttccgaaacttggtggaccctataactcatgatttgattatctctctcgcgcgatacattcactgccccaaacccgaaggggatgccctaggcgccatggagaagctctgccgccagctcacataccacctgagtcctcattctcagtggagaaggcatcggggcctggtcaagcggaagccccaagcctgcctgaaagctgtgctggcagggtccccccccgacaatactgtggacctgtccggtatacccctcaccagccgtgatttggagcgcgtgaccagttacctgcaacgttgtggcgagcaggtagactcagttgaacttggatttaccggcctgactgacgatatggtgctgcagcttttgccggcccttagcacattgccaaggttgaccacccttgccctcaacggaaacagactgactcgagcagtgctgcgcgacctcactgatattctgaaggatccatctaagttccctaacgtgacctggattgacctggggaacaatgtggatatcttctccctgccgcagcccttcctcctctcgttgcgcaagcggagccccaagcaagggcacctgcccacaatactcgagcttggggaggggcccggcagcggcgaagaggtacgggagggaactgtgggtcaagaagaccctggggggggcccggtagccccagccgaagaccaccacgagggaaaagagacagtcgccgccgctcagacatag

SEQ ID NO: 47392 - DNA, 948 bp, Artificial Sequence
  Description of Artificial Sequence: Synthetic coding sequence
atgggcgcccggctgggccggcgggccggccccgaggccggcagcgaagccggcgccgccgccgggtgcggtccagcaccctacgaacgccgcgtacgatggctccgagagatccagagtacattgcgagagcgccggccggaaagggcacgccagttattgcgcctcttgaggcaggacctaggcctcgagagaacactattacctgacattctctatcgggacgttgcatttctgaatcccgtggaccccatcagccacgacctattggtcaacctggcgcgggatttacagtgcccgaagaaggactacgagctgtggaaatcatcggataagatttgcaggcaactgatatatcatctcacgccccatagcaaacaacagcaaggtagctcgctgagacagcggaagactcaaagctgcttaaaatcatccttgcagaaaacactcctggcgggagagactgtagacctctctgggattcccctgagcacccaggatgtccagcacatcactagatatctctcttcacacggggcggtactcgctgtgcttgatctgagtttcactggcttgtcagacgagctgctccacctactgctaccttccttatgggctctccccagactcacccagctcctgcttaacggaaaccgactaacccgtgcgacggcaagaaagctcacagacgcaatcaaagacactaccaaatttccggccctagcctgggtcgatctggggaacaacgtggatgtggcgagtctgcctcagcccctgttagtcggactcagacgtcgccttagccagcggacatctctccctaccatctatgagggccttgatctggaacctgagggaagcgcggcgggggcaaccacacccgcgagcacttgggacagtaccgccgccggcttaggcccggaaccacaggcgtgctgtgccaggtag

SEQ ID NO: 47393 - DNA, 864 bp, Artificial Sequence
  Description of Artificial Sequence: Synthetic coding sequence
atggacatgcacagcgcccggctggacagcttcctgagccagctgcgatgggaattactgtgcgggagggatacggggtcccccagcatgccaggacctctgcaacccactagccagaccggaccagatgtgcagcctagccaccagctgagggcctcaggggcactcgaggaggattccgtgtgctgtgtggaagaagaggaagaggaggaggaagaggcagttgttaccgaggaccgcgacgcagcccttgggggcccaagagagcacgccctcgattgggactctgggttctctgaagtgagcggatccacttggcgggaagaggaacttccagtgtcgcagcgacccgcccccagcgctcagcccctgcggcgccaatgtctctctgtaagtggactgccaatgccctctcgagcgccagtcgcgtcagtaccgcccgtgcaccaccccagacctaagagcacacccgatgcctgcttggagcactggcagggccttgaagcagaggactggactgcagctctcctcaacagaggacgtagtaggcaacccctcgtgcttggcgacaattgtttcgctgacttggtgcataactggatggaacttcctgaaaccgggagtgaaggaggggacggtggaggacatcgggcccgcgcgaggcccccacaatttctcctgggcctttccgaacaattaagaagacggctagcaagagccaggaggaccgccatggccggcaagcggctctcttgtcctccccgacctgagccagaacttcccgccgacgtgagccgatttgctgccctcatgagctgccgctctcgtcagcctatcatctgtaacgacgtgagttacctgtag

SEQ ID NO: 47394 - DNA, 894 bp, Artificial Sequence
  Description of Artificial Sequence: Synthetic coding sequence
atgaccatggagagccgggagatggactgctacctgcggcggctgaagcaggagctgatgtccatgaaggaggttggagacggccttcaggatcagatgaactgcatgatgggcgctcttcaggagctgaaactgcttcaggttcagaccgctctcgagcagctagaaatcagtggtggaggccctgtcccaggcagtccagaaggacctaggacccagtgcgagcacccctgttgggaaggggggcggggcccggcacggcctaccgtctgttctccgtcctcccagcctagcctgggctccagcaccaagttcccgtcccataggtcggtttgcgggcgcgatttggccccccttcctcggacgcagccccatcaatcctgtgcccagcagggccccgagagagtggagcctgatgattggacctccacactcatgagccgggggagaaacagacagcctctagtgctgggtgataacgtttttgctgatctggtgggtaattggctggacctgccggagttggaaaagggcggggaaaaaggcgagaccggtggcgcaagagagcccaagggcgaaaaaggccagccgcaggagctgggccgaaggtttgcacttacggcaaatatatttaaaaaattcctcaggagcgtcagacctgaccgtgaccggctgcttaaggaaaagcccggatgggtgacacctatggtacctgagtccaggacgggccgcagtcagaaagttaagaagcgtagcctcagcaaaggatcgggacacttcccattcccagggaccggcgagcatcggagaggcgagaaccccccaacttcttgcccgaaggcgctggaacactcccccagtggtttcgacatcaacacagccgtttgggtttag

SEQ ID NO: 47395 - DNA, 849 bp, Artificial Sequence
  Description of Artificial Sequence: Synthetic coding sequence
atgcggcagctgatgagcatgaaggaggtgggcgacggcctgcaggatcaaatgaactgcatgatgggcgctctccaggagttgaagctgttacaggttcagacagccctagagcagcttgagatttcagggggcggacctgtgcctggatcaccagagggcccgagaactcagtgcgaacacccatgctgggaaggtggcagggggcccgccagacctacggtctgttcgcccagttcccagccaagtctgggctcttcaaccaaattcccaagccacaggtccgtctgcgggagagatctggccccactcccccggactcagccccaccaatcgtgtgcacagcagggccctgaacgggtcgagcctgatgattggacctccacactaatgtcacgagggaggaataggcagccgcttgttctgggtgataatgtgttcgcagacctcgtgggcaattggctggatcttcccgaacttgagaaaggaggcgaaaagggggagacaggcggcgcccgggaaccaaaaggtgaaaaaggtcagccccaagagctggggaggaggtttgccctcacagccaatatcttcaagaagtttctccgctcagtgagaccagatagggaccgcctgctaaaggagaagccagggtgggtgacacccatggtgcccgaatccagaacgggccggtcccaaaaggtgaagaaacgctcactgagcaaggggagcggccattttccctttcccggtacaggcgaacacaggaggggagaaaaccctcccaccagctgcccaaaagcccttgagcatagtccaagtggctttgatatcaacaccgcggtttgggtctag

SEQ ID NO: 47396 - DNA, 3231 bp, Artificial Sequence
  Description of Artificial Sequence: Synthetic coding sequence
atgaagcccgaccgggacaccctggacgagtacttcgagtacgacgcagaagagtttttagtgtcccttgccctgctgatcacagaggggaggactccggagtgctccgtgaaaggcagaaccgagtcatttcattgcccccctgctcagtcatgttatcccgtgacaacaaagcatgagtgttccgataaattagcccagtgcagacaggcccgccggacacggagtgaggtcaccctcctgtggaagaacaaccttcctataatggtcgagatgatgctactgcctgattgttgttacagcgatgatgggcctacgaccgaggggatcgatctaaacgaccctgctataaagcaagacgcactcctgctggaacggtggatcctcgagcccgtaccgaggcagaacggagatcggttcatcgaggagaagactctgctgctggccgtccggtcgttcgtgtttttctctcagcttagtgcctggctctccgtgagtcacggagctatccctaggaatatcctgtacaggatctctgctgccgatgtggacctgcagtggaacttcagccagactccgatcgaacatgtatttcctgtgcccaatgtgtcccacaatgtcgcactcaaggtcagcgtccagagccttccacgccaatctaattaccccgttctcacctgttcaattcacacgaatattggactatacgagaaacgcattcaacaacataagctcaaaacgcaccaacatcacaacccaaatgaggcggagcagtgcggcaccaactcatcccagcggctctgttcgaagcaaacatggaccatggccccagaatctgtgctccacgcgaagagcgggccctcccctgagtataccgcagcagtcaagaacataaagctttatcccgggaccggaagcaaaagtgaccatggcacatcacaagctaacatcctaggattttcaggaatcggagacatcaagtctcaagaaactagtgtgcgtacactaaagtcattcagcatggtggatagcagtataagcaataggcagagcttctggcagtccgcaggagaaacgaaccccctcatcggaagtctgattcaagagagacaggagataattgctcggatcgcccagcatctgattcattgcgatccttctacatcccatgtttccggacgtccctttaacacgcaagaaagttcttcactgcacagcaaactgttcagagtcagtcaggagaacgagaatgtgggcaagggcaaagaagcattctctatgacgttcggcagtcccgaatttagtagccccgaagatacaaatgagggcaaaatcagattaaaacccgagacccctcgaagcgaaacctgcataagcaatgacttctattcacacatgcccgtgggcgagactaatcctctgatcgggagccttctccaagaaagacaagacgttatcgccaggatagctcagcatctggaacacattgacccaaccgccagccatataccgcgccagtcttttaacatgcacgatagctcatccgtggcttctaaagtgttcagatctagttacgaagacaagaatctcctaaaaaaaaataaggacgaatcaagcgtgtctattagtcacactaagtgttcactcctcggtgatattagcgacgggaagaatctggtgccaaacaagtgtttcacatcattcaagaataatagcaaggagaagtgttctcttaaacaccagacccggaaccagtgccagaacaatccaagcgagataatacagagcacgtatcaggagacgcagaataagtcatcttccctgtctacttccagcatcttgtcccaacataaggagaacaacctggacctgacaagtagattcaaagaacaggagatgtcaaacggtatcgataaacagtactccaattgcacaacgatcgacaaacagatctgtactaacaaatataaagaaaagattattaacgaaaactataaccctaaattttttggaaatctccagtctgacgattcgaagaagaacgacagcaagatcaaagtcaccgtgttggagatgagcgagtatctgaacaagtacgaaagtatgtcttctaataaggactcaaagcggccgaaaacatgtgagcagaatacccagttgaattcaatagagaattacctcaataaggacaatgaggggtttaagtgtaagaaatctgatcagctaaaaaacgagcaggataagcaggaagatcctactaacgagaaatcccagaattacagccaacggagatccatcaaagattgcttgagtacctgtgagcagcctaagaacaccgaagtgctgcgcacaactttgaagcacagcaatgtttggaggaaacacaacttccacagcttggacggtaccagcactagggcctttcatcctcagacgggattgcctttattaagctcccctgtgccacagaggaaaacccaatccggttgtttcgacctggattcatctctcctgcatttaaagtctttttcgagtagatccccacggccctgcctgaacattgaagatgatccagacatacatgaaaaacctttcctaagtagttctgccccccccattaccagtctttcactgctggggaacttcgaagaaagtgtgctgaactacagatttgatccgcttggaatcgtcgatggctttactgccgaagtcggcgcatccggcgctttctgcccaactcatctcactttacctgtggaagtcagcttctatagcgtgtcagatgacaatgccccttccccctatatgggagttattactctcgagagcctgggaaaacgtgggtatcgagtgcccccctctggaacaatccaagtcactctgttcaatcccaataagactgtggttaagatgttcgtcgtgatctatgacctgagagacatgccggccaaccatcagacctttctgagacagcggacattcagtgtgccagtcaaacaagaagtgaagagaagcgtgaataaggagaatattaggcacactgaggagcgactgctgcgctatcttatccacttacgtttccagtctagtaaatcaggcaaaatttacctgcaccgggacgtccgactgctctttagtcggaaatctatggaggtggattccggggccgcctatgaactgaagtcatacaccgagagccccactaacccccaatttagtcctcggtgttag

SEQ ID NO: 47397 - DNA, 3231 bp, Artificial Sequence
  Description of Artificial Sequence: Synthetic coding sequence
atccggccccggagcgacaccctggacgagtacttcgagtacgacgcggaggaatttctggtcagcttggctcttctgatcacagaggggcggactccggagtgctctgtgaagggccgtactgagtccttccactgtccgcccgcccagtcatgttatccagtgaccaccaagcacgagtgttctgacaagctagctcagtgccgtcaggcccggcggactagaagcgaagtgaccttgctgtggaagaacaatctccctattatggttgagatgatgttgttacctgattgctgttacagcgatgatgggccgaccaccgaagggattgacctcaacgatccagctatcaaacaagatgccctgctcctggagagatggatcctagagccggtgcccagacagaatggagatagattcatcgaagagaagaccctgttattggccgtacggtccttcgttttcttttctcagctgtcagcctggctgtcagtttcccatggcgcaattccccgaaatatcctgtatcggatttccgcagcggacgtggatctgcagtggaatttttcccagacccctatagagcacgtcttccctgtgccaaacgtgagccataacgtggctctgaaagtatcagtgcagtcccttccacgacagtctaattacccagtgctcacgtgcagcatacataccaacatcggcttgtacgagaagagaattcaacaacacaaactcaagactcatcagcatcacaacccaaacgaagcagagcagtgtggaacaaacagcagtcagcgcctgtgctcaaaacagacctggaccatggctccagagtcagttctgcacgcaaagtccggtccgtctcctgagtatacagcagcagtgaagaacatcaagctctaccctggcacaggctcaaagtctgaccacggcacttcccaggccaatatcctgggattttccggaattggagatattaaaagccaggagactagcgtcaggactttgaagtcattttcaatggtagacagctcaatttccaatcggcagagcttctggcagtccgcgggagaaactaacccgctgattggctcattgatccaggaacgacaggaaatcattgcacgcatcgcacagcacctcatccattgtgacccaagtacgtcccatgtgtccggacggccgtttaatacacaggaatcctcttccttgcattctaagttgttcagggtaagccaggagaatgagaatgtcggtaaagggaaagaagcctttagcatgacattcggctcacccgagttctcttctcctgaagacaccaacgagggcaagatccggttgaaaccggagaccccccgctctgagacctgtataagtaatgatttttactcccacatgcctgtgggcgaaaccaacccccttatcggatcactgttgcaggaacggcaggatgtcatcgcacggattgctcaacacctcgagcatatcgatcctactgctagccatatccctagacaatcatttaatatgcacgactctagctcggttgcttccaaggtcttccgaagtagctacgaggacaagaatctcctaaagaaaaacaaggatgagagctcagtatcaatcagtcatactaagtgttctttactgggcgacatctcagacggaaagaacctcgtacctaacaagtgttttaccagcttcaagaacaactccaaggaaaagtgcagcctaaaacaccaaacgagaaaccagtgccagaataacccttccgagattattcagtccacctaccaagaaacacagaacaaatccagctcacttagtaccagctcaatcctgtcccagcataaggagaataatcttgaccttacatcccgattcaaggaacaagaaatgtctaatggtatagataaacagtactctaactgcaccacaatcgacaagcagatatgcaccaataagtacaaagaaaagattatcaatgagaattataacccaaagttcttcgggaaccttcagtcggacgactcaaagaaaaacgacagcaagataaaagtgacagtgctggagatgagtgagtacctgaataaatacgagagcatgtctagtaacaaggattccaagcggccgaagacatgtgagcaaaacactcagctgaactctatagaaaactatctcaataaggacaatgaaggcttcaagtgtaaaaagtcagatcagttaaaaaatgagcaggataaacaagaggatcccaccaatgagaaatctcagaactactctcagcggaggagcataaaggattgcctcagtacttgtgaacaacccaagaataccgaagtgttgcgaaccaccttaaaacactctaatgtatggcggaagcataattttcactcacttgatggcactagtacaagggcttttcacccccagacgggtttaccactgctgagcagtccggttccgcagcgtaagacacagtccggttgttttgacctggacagctccctgctgcatctgaaatccttctcctctagatcccccaggccctgccttaacatagaagatgacccggacatccatgaaaaaccatttctgagctcaagtgccccgccaattaccagcctctctcttctcggcaattttgaagagtccgtcttgaattaccggttcgacccgctgggcatcgtggacggatttacagctgaggtaggtgcgagtggggcattttgccctacacatctcacactgccagtcgaagtctccttttactctgtgagcgatgacaatgcaccctccccctatatgggcgtcattaccctggagtcactgggaaagaggggttacagagtgcctccctccggcacaatccaggtgactctctttaatccaaacaagactgtggtcaagatgtttgttgttatctatgacttacgggacatgcccgctaaccaccaaacattccttcgccagcgaactttttctgtaccagttaagcaggaggtcaagaggagcgtgaacaaagaaaacattcgccacaccgaggagcgactgcttcgctacttgattcaccttagattccagagcagcaaaagcggaaaaatctatctacaccgagatgttagactgctttttagtcggaaatccatggaagttgatagcggcgcggcatatgaactgaaaagctacacagagagtcctaccaatcctcagttctcgcccagatgctag

SEQ ID NO: 47398 - DNA, 2877 bp, Artificial Sequence
  Description of Artificial Sequence: Synthetic coding sequence
cggcccgacgccgacaccctggacgagtacttcgagtacgacgccgaagagtttctggttagcttggctctgcttataactgagggcagaacacccgagtgctctgtcaaggggcgcaccgaaagctttcactgccctccagctcaaagctgttatccggtgacaactaaacatgaatgctctgacaaattggcacaatgccgccaggccagaagaacacgcagcgaggtgacactgctgtggaaaaacaacttacccataatggtggagatgatgctcctacccgattgctgttatagcgacgatgggcctaccactgaaggtatcgatctcaacgatcccgccatcaagcaggatgccctgctgctggagcgttggatcctcgagccagtccccagacaaaatggcgataggttcatcgaagagaagacactcctgctggcagtgcgctcctttgtttttttcagccaactcagcgcttggttatctgtgagccacggggcaattccccgcaatattctctacaggatctctgccgccgacgttgatttgcagtggaatttttctcaaactcccatcgagcacgtctttcccgtgcctaacgtcagtcacaatgtggccttgaaggtgtctgtgcagagcctacctagacagagcaactatccagtgctgacgtgttcaatccacacgaacataggtctctacgagaaacgcatacagcagcacaagctgaaaactcaccagcatcataatccgaacgaggcagaacagtgtggtacaaatagttctcagcggctgtgctcaaaacagacctggactatggcccccgagtctgtcttgcacgcaaagtccggaccttctccagagtacacagccgccgtgaagaacataaagctgtaccctggaacgggttccaagtcagaccatggcacgagccaggcaaacattttgggcttctctggaatcggtgacattaaatctcaagagacttcggtgaggaccctcaagtcatttagcatggttgattcttcaatcagtaatcgccagtctttttggcagtcggctggggagacgaatccacttatcggcagtctgatccaggaaagacaggaaatcattgcccgtatcgcccagcacctgattcactgtgacccttctacaagccatgtctccggccgtccatttaacactcaggaatcaagctccctccactcaaaactcttcagggtttcacaggagaacgaaaacgtgggcaagggaaaagaggctttctctatgacctttggttcgccagaatttagctcccctgaagacaccaatgaggggaagattcggctgaagcctgagacccccagaagcgaaacctgtattagtaatgatttttatagtcacatgcctgtcggcgaaacaaacccactaattggtagcctgctgcaggagagacaagacgtgatagctaggatcgcacagcacttggaacacattgatcccacagcttcgcacatcccaaggcaatctttcaacatgcacgactcctcatccgtcgctagcaaagtgttcaggtcgagctatgaagataagaacctcctgaagaaaaacaaggatgaatcttcagtctcaattagccacaccaagtgctccctgcttggagatatttccgacggcaaaaacttggtgcctaataagtgcttcacatctttcaaaaacaattcaaaggagaaatgtagcctaaagcaccagacgcggaatcagtgccagaacaacccttccgagataattcagtccacatatcaggagacgcaaaacaaaagttcaagtctgtctaccagctccatcctctcgcagcacaaggagaacaacttagacctaacgtcacgttttaaggagcaggaaatgtcaaacgggattgacaaacagtattcaaattgtaccactatagataagcagatctgtacgaataaatataaagagaaaattatcaacgagaactataaccccaagtttttcggcaacctgcagagcgatgatagcaaaaagaacgattcaaaaataaaggtcaccgtcctggaaatgtcggagtatcttaataagtacgaaagtatgtccagtaacaaagacagtaagcggcccaaaacatgtgagcagaacactcaactgaacagcatcgagaattatctcaacaaagataatgagggatttaagtgtaagaaaagtgaccagctgaagaacgaacaagataagcaggaagacccaaccaatgagaagtcgcaaaactactcccaacgaaggtccataaaagactgcttaagcacatgcgaacagccaaaaaacactgaagttctgcgtacgaccttaaaacactccaatgtgtggagaaaacacaactttcacagccttgatggtacaagtacacgggcctttcatccccagacgggactcccactgttgtctagccctgtcccccagcggaaaacccagagcggctgctttgatcttgactccagtctcctacatttgaagtctttcagcagccgctctccaagaccctgccttaacattgaggatgatcctgacatccacgagaagccttttcttagttcgagtgccccccctatcacctccctctctttgttgggtaatttcgaagaaagtgtgttaaattaccgcttcgatccccttggcattgtggatggattcaccgcagaggtgggcgcttcaggtgccttctgtccaacacatctcaccctgcccgtggaagtgtctttctactcagtgtctgacgataacgctccttcaccttatatgggagtgatcactcttgagtccctgggaaagagaggatatcgtgtgcccccatctggtactatccaggtgtag

SEQ ID NO: 47399 - DNA, 3252 bp, Artificial Sequence
  Description of Artificial Sequence: Synthetic coding sequence
atggtgttcagcggcaacaagggcctgcaccgggaggacaccctggatgagtattttgagtatgatgctgaggagtttttagtgtcgcttgctttgttgattacagagggtcgcacgcccgaatgctcagtaaaggggcgtactgagagtttccattgtccgccggcccagtcctgttaccctgtgactaccaagcacgagtgtagtgacaaactggcccagtgtagacaggctagacgtaccaggagtgaggtgacgctcctctggaagaataacctacctatcatggtggagatgatgttgctgcctgattgttgctatagcgacgacggacctacaactgagggtatcgatctgaatgatccagctatcaagcaggacgccttgctcctggagaggtggatcctggagccagtgcctaggcagaacggcgatcgttttatcgaggagaaaaccctgctcctagccgtcagatctttcgtgtttttttctcaactgagtgcgtggctgagtgtgagtcatggtgcaatcccaaggaacattttgtaccgaatcagcgccgccgatgttgatttgcaatggaatttctctcagacccccattgaacacgtgttccccgtcccaaacgtttcccacaacgtcgccctcaaagtgagtgtacagagcctgccaaggcagagtaattatcccgtgctgacctgcagcatccatactaatattggactgtacgagaagcggattcaacagcacaagcttaaaactcaccagcaccataacccaaacgaagccgaacagtgcggtaccaattccagccagcgtctctgcagcaaacagacctggacgatggcacccgagagcgtgctgcatgccaagagtgggcccagccctgaatacaccgccgcagtcaaaaacataaagctttaccctggcactgggagcaaaagtgaccacggcaccagtcaggcaaatatcctgggtttctcaggcatcggcgacataaaatcacaggagacaagcgtgcgcacactgaagtcattttccatggttgactcttcaatctccaatcggcagtcattttggcagtcagccggtgagacaaaccccctgattggtagcttgatacaagagagacaggaaatcatcgccagaattgcccagcacttaattcactgtgatccaagcacctcacacgtctccggcagaccctttaacacccaggagagctctagcctgcactccaaactatttcgcgtttcccaggagaacgagaacgtgggcaagggtaaggaggctttttccatgaccttcggcagccccgagttctccagcccagaggacaccaatgagggaaaaattcgactcaagccagaaaccccaagaagtgagacctgcatttctaacgacttctactcccatatgcctgttggagagactaaccccttgattggctccctactgcaggagcggcaggacgtaatcgcacgaatcgcacagcatttagagcatatcgaccccacggccagtcatatccctcgccaatcattcaatatgcatgacagcagctcagtggccagtaaggtgtttcggagttcctacgaagataaaaacttgctgaagaaaaataaggatgagagttctgttagcatatctcacacaaagtgtagcctgctgggagatatcagcgacggcaaaaatttagttcctaataagtgtttcacaagttttaaaaacaacagcaaagagaaatgttccctcaagcaccagacaagaaaccaatgccagaacaaccctagtgaaattattcagagcacctatcaagaaacccaaaacaaatcttctagcttatcaacgagcagtatcctttcccaacataaagagaacaacctggacctcacctcaaggtttaaggagcaggagatgtcaaacgggattgataagcagtatagtaattgtacaacgattgacaagcaaatatgcactaataaatataaggaaaaaataattaacgaaaattataaccccaagttcttcgggaatctccaaagcgacgattccaagaagaatgactctaagattaaggtgaccgttctcgaaatgtcggaatacctgaacaagtatgaatcaatgagctcaaacaaggactccaaacgtccaaagacatgtgagcagaatactcagctaaattcgatcgaaaactacctgaataaagataacgaagggtttaagtgtaaaaaatcagaccagttgaagaatgaacaagacaagcaggaagatcctactaatgagaagagtcagaactattcccagaggaggtccatcaaggattgcttatcgacatgcgagcagccaaagaacacagaggtgttgagaaccacacttaaacacagtaacgtttggagaaaacacaattttcatagtttagatggtacctccactcgcgctttccacccacagacaggattgcccctgctttcttcccccgtgccccagcgaaagacacagtctggctgctttgatctcgatagcagtttgctgcatttaaaatctttcagctccagatcccctcggccctgcctgaacatcgaagatgaccctgatattcacgagaaaccattcctgagttcatccgcgccaccaatcacctccctgagtctcctgggaaattttgaggaatccgtcctgaattacaggtttgatcccttagggattgtcgatggttttaccgcagaggtaggggcttccggggcgttttgcccgactcaccttacactgcccgtcgaagttagcttttatagtgtaagtgacgacaacgccccaagcccatacatgggagttattacattagaaagcctcggaaaacgaggctacagagtcccacccagtggaactattcaggtcactttgttcaatccaaataaaaccgtggtgaagatgtttgtggtgatctatgacctgcgggacatgcctgccaatcaccaaaccttcctgaggcagcgcactttcagcgtgcccgtgaaacaggaggttaagcgctctgttaacaaggagaatatcagacatacggaggagcggctgcttagatacctcattcacctcaggtttcagtccagcaaatctgggaaaatctacctgcatcgtgatgtgcggctgctgtttagcaggaagtctatggaagtcgactccggtgcagcttacgaattaaaatcctacactgagtccccaactaacccccagttttctcctcggtgttag

SEQ ID NO: 47400 - DNA, 1890 bp, Artificial Sequence
  Description of Artificial Sequence: Synthetic coding sequence
atggaggtgaagggccccagcggccggagcttctgctgcgagagcgagggccagttcaagtcctgcctgaagcgccatacccccagcctgttacttccgagctcatggaagggaaacagcggttcctgcttgatggctaaagcgctgcaccgaatgagtcccactcctaatagttgcccactccctcttcccctgtgccgaatgagtggggttctctgctcccgaaatctgttcaccttcaagttttccctgttccaactggatagtggagccagcggagagcctgggcatagcctgggcctgaccctcggctttagccactgtggaaattgccagaccgccgtagtaagtgcccagcccgaaggtatggcttcaaatggcgcctatcccgccctcggtcctggagtcactgccaatccagggacgagcttgtcagtctttacagcccttccattcactacccccgcccctggaccggcccacggccccctgcttgtgacagcaggtgcacctccgggcggcccactcgtcctgagtacattaccatctactccgctcgttaccgaacaagacggctgcggaccaagtggagccggagccagcaatgtgttcgtacaaatgagaacagaggtggggcccgttaaagccgctcaagcccaaacactggttttaactcaagctcctctcgtgtggcaggctcctggtgcattgtgcggcggcgtggtgtgccccccccccttgctgctggccgccgccccggtagtgccagttatggcagcacaggtagtgggtggcacacaagcctgtgagggcggctggtctcagggcctgcccctgccaccccctccgcctccagcagctcaactccctcctattgtcagccagggcaatgccggcccatggccgcaaggcgctcatggcgagggatctctcgcttcctcacaggccaaggctcctcctgacgattcgtgtaaccccagatcagtgtatgagaatttccgcttatggcaacactacaagcctcttgccagaagacatctccctcaatcccccgacacggaggctttatcttgcttcttgatcccagtattgagaagccttgcccggaggaaaccaacaatgactttagaggagggcctctggcgagcaatgcgtgagtggcagcacacttcgaattttgataggatgattttctacgaaatggcagaaaaattcttggaattcgaggctgaggaggaaatgcagatacagaagagccagtggatgaagggaccgcagtgtctccctccaccagcaaccccccgcctggaacccagagggccccctgcccctgaggttgtgaagcagccggtttacttacccagtaaggctggacctaaggcgcccactgcctgtctgccacctcctaggccccagcgaccggtgactaaagcaagacggccccctcctcggccccatcgccgggcggaaactaaagcacgtttgccaccaccacgccctcaaaggcccgctgagactaaggtgcccgaagaaatacctcccgaggtggttcaagagtacgtggacattatggaggaactgctggggcccagcctgggcgccactggcgagccagagaaacagcgggaggaaggagaggtgaaacagccccaggaagaggactggaccccccctgatccgggactcttaagctacaccgataagctctgcagccagaaagactttgtgacgaaggtcgaagccgttatccacccccagttccttgaggagctgttaagcccagacccacaaatggactttctggctttatcacaggagttggagcaagaagaaggcctgaccctcgcacagggagcaccctctgatgccccaggcactgacagatgctag

SEQ ID NO: 47401 - DNA, 2637 bp, Artificial Sequence
  Description of Artificial Sequence: Synthetic coding sequence
atggaggtgaagggccccagcggccggagcttctgctgcgagagcgaagggcagtttaaatcttgtctcaagagacacaccccgtcgttgctactgccctcttcttggaaaggaaatagcggatcgtgtctcatggcaaaggccctgcataggatgagccccactccaaacagttgtcccttaccgctgcctctttgcagaatgtctggggtgctgtgttcacggaacctgtttacattcaagttttctttattccagctggattccggcgccagtggagaacccggccactctctgggcctgacattaggattttcccattgtggcaattgccagacagctgttgtctctgcccaaccagaagggatggcgtccaacggcgcttaccctgcccttggaccaggagtcaccgctaatcctgggaccagcctaagcgtgtttacggcactccctttcaccactcctgctcctggacccgcccacggcccactcctcgttaccgctggagcacccccgggcggcccactcgtgctgtcaacactgccttcgacccccctagtcacagagcaggatggttgcggaccaagcggtgctggagcaagtaatgttttcgttcagatgaggacagaagtcggccctgtaaaggcagcccaggcacaaacccttgtgctgactcaggctcccttagtctggcaggccccaggcgcgctctgcggtggtgtcgtgtgcccccccccactgcttctagctgccgcccccgttgttcctgtgatggccgcccaggttgtgggaggaacccaggcctgcgagggaggatggtctcaaggactgcccctgcctccgcccccaccccccgcagcccagcttcccccaatcgtgtctcaggggaacgccggtccctggcctcagggagctcatggcgagggttctttagcctcaagtcaggccaaggccccgcccgacgatagttgcaatccccgcagcgtgtacgagaacttcaggctatggcagcattataagcccctcgctagaaggcatctgccacagtcaccagacaccgaggccttgtcctgtttcctgatccccgtactgagaagtctggcacggcgtaagcctacaatgaccctcgaagagggcttatggcgcgcaatgagggagtggcagcacaccagcaacttcgacaggatgattttttacgagatggctgaaaaatttttggaatttgaagcagaagaagagatgcagatacaaaagagccaatggatgaaaggccctcaatgcttgccccctccagcaacccccaggctcgagcccagggggccacctgctccggaggtcgtgaaacagcctgtttaccttcctagtaaagcggggccaaaggcacctacggcttgcctgccacctccgcggccacagcgtcctgtgacaaaagctcgtcggcccccaccacgccctcacaggagggcagaaacaaaggcccgcctaccacccccaagaccccaaaggccagcagagaccaaagtgcctgaagagatcccccccgaagtggtccaggaatatgttgacattatggaagaactactgggcccatctttaggcgccactggtgaacccgagaaacagcgcgaagaaggggaagtgaagcagccacaggaggaagattggacacctccagatcctggtctgctgtcttacaccgataaactctgtagccagaaggacttcgtcacaaaggtcgaagccgtgatccatccacagttcctggaggagcttctgagccccgatccccagatggacttcttggccttgtctcaggagctggagcaggaggaaggccttaccctggcacagcttgtggagaaacgattgttgcccctgaaagaaaagcagcatgctcgggcagctccctctcgtggcaccgctaggcttgacagctcctctagcaaattcgctgccggccaaggtgccgagagggatgtgcccgtgcctcagcagggtgtgggaatggaaacctgcccgccacagacgacggcccgggactctcagggaagaggtcgtgctcacacaggcatggcccgttcaaaagattccgtggtcctgttgggttgccaggactccccaggactcagggcagcccgaccaactagcccgccccaggatcataggccaacttgccccggtgttgggacaaaggacgctctggatcttcccggtggttcccccgtgagggagtcccacgggttagcccaagggtcaagcgaggaggaggagctcccatcactggccttcctcttgggctcccagcacaaacttttaccttggtggctcccacaaagccctgtgccagcatccggactcttatcgccggagaagtgggggccgcagggcacgcatcaattcccatcggcagaacgacggggtctgaatctggcaccaagccctgcaaataaggccaagaaaaggccactgttcgggagtctctcacccgccgagaaaacaccccatcctgggcccgggctgcgagtctcgggcgagcaaagtctgacttggggattaggaggacctagccagagccaaaaacggaagggtgacccacttgtatcccggaaggaaaaaaaacaacgctgttctcaatag

SEQ ID NO: 47402 - DNA, 2418 bp, Artificial Sequence
  Description of Artificial Sequence: Synthetic coding sequence
atgttccaggagcccgtgtacttccagatcttcttccagctggactcgggcgcaagcggcgagccaggccattcactgggcttgactctggggttttcacattgcgggaactgccagaccgcggtggtgtccgcgcaacctgaggggatggcctcaaatggggcctatccggccctgggccctggcgttaccgctaatcctgggacaagcctttctgtgttcactgcactgccatttactactcccgcccctggccccgcccacgggccactgctggtgacggcgggcgctcctcctggtgggcccctggtgctgtccacactgcccagcactcctttggtgactgagcaggacggttgcggcccttcgggcgcgggggctagtaatgtgttcgttcagatgcggacggaggtggggccggtgaaagcagcacaggcgcagactctcgtgctcacgcaggcacccctggtttggcaggccccgggcgccttatgcggaggggttgtctgtcccccgcccctgctcttggctgccgctcccgtggtcccagtgatggctgcacaggttgttggtgggacacaggcctgtgaaggaggctggtctcaggggcttcccctacctccacctcctccccccgcagctcaacttccccccatcgtgagtcagggaaacgctggtccatggccgcagggagcgcatggtgaaggaagcctggcaagtagccaggccaaggctccccccgacgacagttgtaatccccgctctgtatacgaaaactttcggctgtggcagcactataagcccctggcccggagacacttgccacaatccccagataccgaggccttgtcatgctttctgatccccgtgctcaggtccctcgcacggagaaaaccgaccatgacgctggaagagggactgtggagagcaatgcgcgaatggcaacacaccagtaatttcgaccgcatgatattttatgagatggccgagaagtttctcgagtttgaagcggaggaagagatgcaaatccagaaaagtcaatggatgaaagggcctcaatgcctcccgcctccagcaacacccagactggagccgcgcggccctcccgcaccagaagttgtcaaacaaccggtctatctcccgagtaaggcggggcccaaagcaccaaccgcttgccttccaccaccccggccacaacgacccgtcaccaaggctcgacgacctccaccccgccctcaccgacgggcagaaactaaggctagactcccccctccgcgaccgcagagacctgctgagaccaaggtaccagaggagattcctccagaggtggtacaagaatatgtggatattatggaggaactgttaggcccttcgttgggcgccaccggggagccggagaagcagcgggaggaaggcgaagtcaagcaacctcaggaggaagactggacgccccccgatcccggtcttcttagttataccgataagctatgctcacagaaggacttcgtgacgaaggtggaggctgttattcacccacagttcctggaggagctactgtccccagatccccaaatggatttcttagccctgtcgcaggaattggagcaagaggaaggactgactctggcccagctcgtggaaaagaggctgttaccattgaaagagaagcaacacgctagagccgcccctagcagagggacggcccgattggattcaagtagtagcaagtttgctgcaggccagggtgctgagagggacgtccccgtaccgcagcaaggtgtgggaatggagacttgccctccccaaacaaccgcgagagatagccaggggagaggccgagctcatacagggatggctagaagcaaggacagcgttgtgctgctaggctgtcaagactcacccggccttagggccgcccggcctacatctcccccacaggaccataggcccacctgtccaggggtcggtaccaaagacgctctcgacctcccaggcgggagccctgtccgtgagtcacacggcctagcacagggatcaagcgaagaagaggagttaccatccctcgccttcctcctaggcagccagcataaactgctgccctggtggctgccgcaaagccctgtgcctgcgagcgggctcttgtcccctgagaaatggggacctcaggggacgcatcagttcccctcagccgagcgacgcggcttgaacctggcgcctagccccgctaataaagccaagaagcgaccgctgttcggcagcctcagccccgctgagaagacccctcaccctggtccgggactccgtgtctcaggggagcagtcactaacctggggtctaggtggccccagtcagtcacagaagcgtaaaggggacccgctggtatctaggaaggaaaagaagcaacgatgcagtcagtag

SEQ ID NO: 47403 - DNA, 789 bp, Artificial Sequence
  Description of Artificial Sequence: Synthetic coding sequence
atggaggagctgctgggccccagcctgggcgccaccggcgagcccgaaaagcaacgcgaggaaggggaggtgaagcagccccaggaggaagactggacccctcctgaccccggactgctgagttacactgataaactgtgtagccagaaggatttcgtcacaaaagttgaggccgtgatccatcctcagttcctcgaggaattgctgtcacccgatccccagatggacttcctggctctgagccaggagttggaacaagaggagggccttacactggcgcagctggtcgagaaacgcctactgcccttgaaggagaaacaacacgcacgcgccgcaccctcacgaggaaccgcaagattggactcttctagctcaaagtttgccgccggtcagggtgctgaaagggatgtccccgtccctcagcagggtgttgggatggagacttgtcctccccagaccaccgccagggatagccagggacgaggtagagcccatactgcctcagggttgttgtcaccagagaagtggggcccacagggtacccatcagttccccagcgcagagaggagggggttgaatctcgccccttcgccagcaaataaagcaaagaaacggcctcttttcgggtctctgtcacccgccgagaaaaccccccaccctggacccggcctgagggtcagcggggagcagtcattaacctggggactggggggcccttcccaaagtcaaaagagaaagggtgatccccttgtttcgagaaaggaaaagaaacagaggtgctcccagtag

SEQ ID NO: 47404 - DNA, 1971 bp, Artificial Sequence
  Description of Artificial Sequence: Synthetic coding sequence
tgactgacccaggcccccctggtgtggcaggcccccggcgccctgtgtggtggtgtggtgtgtcctccgcctctgctcctggcggctgcacctgtggtgccagttatggctgctcaggtggtcggcgggactcaggcttgcgagggcggatggtcccagggtctgcccctcccgcccccacctccccccgccgcccagctgccccctatcgtgtcccagggcaatgctggcccctggccacaaggggctcacggtgagggatccctggcttcatcccaagccaaagctcctcccgacgatagttgcaatccacggagtgtttacgagaactttcgcttgtggcaacactacaagccactagccaggagacacttgcctcagtctcccgacacagaagccttgtcttgcttcctcatcccagtgctgcgtagcttagctcgaaggaaaccaaccatgacattggaggaggggttgtggagagccatgcgcgagtggcaacacacttccaattttgaccgcatgatcttctatgagatggcagagaaatttctcgaatttgaggcagaggaggagatgcaaattcagaagagccagtggatgaagggcccacagtgcttgcctccaccagcaactccacggcttgagccacgagggccccctgcgcccgaggtggtgaagcagccagtgtatctgccatctaaggcagggccaaaggcaccaactgcctgtctacctcccccaagaccccagcgtcccgtaacaaaggccaggagacctcccccacggccccaccgtagggcagagaccaaggccagactacctccaccacggccacagcgacccgctgagactaaggttcctgaggagatcccgcctgaagtggttcaggagtacgtggatataatggaggagctactcggcccttctctgggtgcgaccggggagcctgagaagcagcgggaagaaggcgaggtaaagcagccccaggaggaagactggactccaccagacccggggttgttgagttataccgacaagctgtgctcccagaaagactttgtcaccaaagtggaggctgtcatccacccacagtttttggaagaactgttgtcaccagacccacagatggacttcctggccctgtcacaagaacttgaacaggaggaaggcctcacattggcgcagctggtagagaaaaggctactgccactcaaggagaaacagcatgcacgtgccgccccatctcgcggaacagcaagactggacagctcgtcctcaaaattcgccgccggtcagggggcagagcgggacgtgcccgtgccccaacagggagttgggatggaaacctgcccaccacagacaactgcccgtgacagccagggccggggaagagcacatactgggatggcgaggtccaaggattcagtcgtccttctaggatgtcaggattcgcctggcttacgggccgcccgtcccacgtctcctccccaggaccataggccaacctgcccaggcgtggggactaaggatgccctggatcttccgggcgggagtcccgtacgagaaagtcacggcctggctcaaggcagctccgaggaggaagagctgccttctctcgccttcctccttggcagccagcacaagttgctgccctggtggctaccccagtccccagtgcctgcttctggactgctatccccagagaagtgggggccgcaggggacacaccagttcccctccgccgaaagaagaggcctgaatttagccccttctccggcaaacaaagcaaagaagcgtcctctattcgggtccttaagcccagccgagaagacgcctcacccaggcccagggctgagggtttcgggtgaacagtcattgacatggggcttggggggaccatcacaatcacagaaacgtaaaggagaccccctcgtcagccggaaggaaaagaaacagcgttgcagtcagtag

SEQ ID NO: 47405 - DNA, 1866 bp, Artificial Sequence
  Description of Artificial Sequence: Synthetic coding sequence
atggccgcccaggtggtgggcggcacccaggcctgcgagggcggctggtcccagggtctgccgctccctccacctcctccaccagctgcccaattgccgcccattgtttcacagggcaatgctggcccctggccccagggagctcatggcgagagcagtctcgcatccagtcaagccaaagcccccccagatgatagctgtaatccaagaagcgtctatgagaactttcggctgtggcagcactataaacctctggcccggagacacttgcctcagagcccagataccgaagcgctcagctgcttcctaattcccgtgttgagaagcctcgcaaggcggaaacccacaatgacgcttgaggaggggctatggagggctatgcgcgagtggcaacacacgagtaatttcgacagaatgatattctacgaaatggctgagaagtttcttgaattcgaggcggaggaggagatgcagatccagaagtcacagtggatgaaaggaccgcagtgcctgcctccacctgctacaccccgcctggaaccaaggggaccccccgccccagaggttgttaaacaacctgtgtatctgcccagtaaggccggccctaaggcacctacagcttgtctcccaccgccaagacctcagcgacctgttacgaaggccagacgcccaccccctcgtccccaccgcagagcagagacgaaggcaaggctgcccccccccaggccccagcgcccggcagaaacaaaggtgcctgaggaaattcctcctgaagtggttcaggaatacgtcgacataatggaggaattactagggccttcgttaggagccaccggagaaccagaaaagcaacgggaggaaggcaaggtcaaacagccacaagaggaagattggacccctcctgaccctggattgctgagctatattgacaagctgtgctcccagaaggattttgtgacaaaggtagaagccgtgattcacccccagttcctggaggagttgttatcccctgaccctcagatggattttctggcgctcagtcaggatctcgaacaggaggagggactgaccttggcacagctagtggagaagagattgccacccttaaaagagaagcagcatgccagggccgctccctcgcgcggaactgccagactggattcgtcaagctcaaaattcgctgcaggccagggcgcagagagggatgtccctgacccccagcagggggttggtatggagacctgtccaccacagatgacggccagagattctcaaggacgaggccgtgcacatacgggcatggcgcgttcagaagactctgtagtgcttttgggatgtcaggattccccaggcctccgtgccgcctggcctacaagtccaccacaggatcaccgtcctacctgtccaggtgtagggaccaaagacgctctagatctcccgggggggagtcccgttagagagagccacggccttgcacagggctcaagtgaggaagaggagctgccgagcttagccttcctactgggttctcagcacaagctgttgccctggtggctcccccagtctcccgtacctgccagcgggcttctctccccggaaaagtggggcccccaggggacccatcagtcaccttcagcggagagaagggggctaaacttggcgcccagccctgctaacaaagccaagaaaaggcccctcttcgggagtcttagtccagcggagaaaactccctatcctggtcctggcctgcgcgtcagcggtgagcagtcacttacttgggggctcggaggcccaagccaatcacagaagcgaaagggggaccccctggtgagccggaaggagaagaaacagcactgttcacagtag

SEQ ID NO: 47406 - DNA, 1689 bp, Artificial Sequence
  Description of Artificial Sequence: Synthetic coding sequence
atgagcggcgtgctgtgcagccggaacctgttcaccttcaagttctctctattccagttggacagtggggcaagcggagaacccgggcatagtttggggttgaccctgggattttcatactgtggaaattgccagaccgctgtcgtcagtgcacaacctgagggcatggcctccaatggagcttatccagtgcttggacccggcgttactgccaaccccggaacgagtttgagtgtgtttactgcacttccctttactacccctgcaccaggcccagctcatgggcctctgctagtcacagcgggcgcacccccaggcggtcccctcgttctgtctactttcccgagcacgccgctggtgacagagcaggacggatgtggaccttcaggcgccggtgcctccaatgtgtttgtgcagatgcgaaccgaagtgggtcccgtgaaggcagcgcaagcacagacgcttgttctgacgcaggctcctttagtgtggcaagctccgggggctctctgtggcggtgttgtgtgcccgcccccccttcttttagcggccgcgccagttgtccccgtcatggccgcacaggtggtgggggggacccaggcttgcgagggcggctggtctcagggcctgcccctgccacccccacccccccctgctgcacagctgccaccaatcgtaagccaggggaatgctggcccttggccacagggggctcatggggagagctcactggcctcctcccaagccaaggccccgcctgatgacagctgcaatcctcggagcgtttacgagaatttccgactctggcaacattataaacccctggcgagaagacacttgccccagtctccagataccgaggccctgtcctgttttctgatccccgtgctgcgatcactcgcaagacgcaagcccaccatgaccctggaggaaggattatggcgggccatgcgcgagtggcaacacacctcaaacttcgaccggatgattttctacgagatggccgagaaattcctggaatttgaagcagaggaagagatgcaaatccagaaaagccagtggatgaaaggcccccaatgccttccaccccccgcgactccaaggctcgaaccgcgagggccgccggctccagaggtggttaagcaacctgtgtatctgccaagcaaggcaggacccaaagctcctaccgcgtgcctacctccgcctcggcctcagcgcccagtgaccaaggcacgtaggcctccaccaaggccacatcgacgcgctgagactaaagcaagactgcccccacctcggccgcagaggccggccgagaccaaggtgccagaggagatccctcctgaggtggtgcaggagtatgtcgacatcatggaggagctccttggcccctcattgggggccaccggcgagcccgagaagcagagagaggaaggtaaggtgaagcagcctcaggaggaagattggaccccccctgatccaggacttctgagctatatcgataagctttgctctcagaaggactttgttactaaggttgaagccgtcatacaccctcagttcctggaggaactgctgtcaccggacccccaaatggatttccttgctctctctcaggacctggagcaggaagaggggctgactctggcccagggagccccatctgacgcccctggcaccgatcgatgctag

SEQ ID NO: 47407 - DNA, 2637 bp, Artificial Sequence
  Description of Artificial Sequence: Synthetic coding sequence
atggaggtgaagggccccagcggccggagcttctgctgcgagagcgagggccagtttaagtcctgcctgaagaggcacacccccagtctgctcctacctagttcctggaaagggaattccggcagctgcttaatggcagaagccttacatcggactagcccaaccccgaattcgtgtcccctacctctccccctttgccggatgagcggagtcctgtgcagcaggaacctgttcacatttaagttttcactgttccagctcgatagtggtgcctcaggtgagcccgggcattccctgggcctgacactgggcttctcctactgcggaaactgccagacagctgttgtctccgctcagcctgagggcatggcttcaaatggggcttatcccgtcctcggcccaggagtgactgccaatccaggcacttcactgtcagtctttacagctctacctttcacaactcccgctcctggccccgctcatgggccattgctagtgacagccggcgcgcctccagggggacctctggtgctcagcacattccctagcacccccctggtaaccgaacaggatgggtgcggccctagtggagctggtgcaagtaatgtgttcgttcaaatgcgcactgaggtcggccccgtgaaggcagcccaggcccaaaccttagtactcacccaggccccattggtatggcaagccccaggagccctttgtggcggggtagtttgccccccaccgctactgctggcagcagctccggttgttcccgtgatggccgcacaggtagtgggcggcacacaagcctgtgagggcggatggtctcaaggcctcccactcccaccacccccaccacctgccgcacaactgccacctatcgtcagtcaaggtaacgcaggcccatggccccagggggcgcacggcgagtcctcgctggcatccagtcaagcaaaagcccccccagatgactcttgtaacccccgcagcgtctatgaaaactttcgcttatggcagcattataagccgctggctcgcagacacttgccccagagtccagacaccgaagcattatcatgtttcctgatccctgtattgcgatctctcgcgaggcgaaagcctacaatgacgctggaggagggcctttggcgggctatgcgcgagtggcagcatacgtcaaacttcgacaggatgattttttacgaaatggccgagaagttcttagagttcgaggccgaggaggagatgcagattcagaagtcacagtggatgaaaggcccccaatgtttgcctccacccgccacaccacggctggagccaaggggacctccggctccggaggtagtgaagcaacccgtttacctgccttccaaagccggacccaaggcacccacagcctgtcttcccccaccgcgaccgcagagacctgtgactaaggccaggcgccctccaccaagaccacacagacgcgctgaaactaaggcgaggcttccacccccacgcccccaaaggcctgccgagacaaaagttcccgaagagatacctcccgaagtggtgcaggagtatgtcgacataatggaagagttactgggcccctctctcggagcaactggagaacctgaaaaacagagggaggagggaaaagtcaagcaaccacaggaggaagactggactccccccgacccaggactgctctcctacatcgataagctatgtagccagaaagactttgtgactaaggtggaggctgtcatccacccccagtttctagaggaattgttgtctcctgatccacaaatggattttctcgccctgtcccaagacttggaacaagaagaggggctcactctggcgcagttagttgaaaagcggctgcctccactgaaggagaagcagcacgccagggcggcccctagtagaggcaccgccaggcttgattcctcctcctcgaaattcgctgccggtcagggagctgaacgagatgttccggatccacagcagggcgttggcatggagacctgcccccctcagatgaccgcccgcgactcacaaggacgggggcgcgcccacaccgggatggctcgatcagaggacagtgtagttcttttgggctgccaggactcacctggcctccgcgccgcttggcccactagccctccgcaggaccaccgcccgacatgtccgggcgtgggaaccaaggatgccctggacttgccaggtggcagccctgtgcgggaatcccacggactggcccaaggatcctctgaggaggaggagctgccaagcctggcttttttattagggagtcagcacaaattattaccttggtggttgccacagagtccagttcctgcatctggtctgttatccccggagaaatggggtcctcaggggacacaccagtctccatcagcagaaagacgggggctcaacttggctccttcccctgccaacaaagctaagaagcgaccattgtttgggtccctgagccctgccgagaaaaccccttatcccggccctggtctccgcgtttctggcgaacagtctcttacatggggtctgggcggaccctcccagtcacagaagagaaaaggagatccattggtttcccggaaagagaagaagcagcattgttctcaatag

SEQ ID NO: 47408 - DNA, 1890 bp, Artificial Sequence
  Description of Artificial Sequence: Synthetic coding sequence
atggaggtgaagggccccagcggccggagcttctgctgcgagagcgagggccagttcaaatcctgcctcaagagacacaccccttccttgctgctcccgagttcctggaaaggcaattcgggaagctgcctgatggcagaagcacttcacagaacttccccaactcccaattcctgcccactccccctgccactgtgcagaatgtccggcgtcctttgtagtcgcaatctgttcacctttaagttcagtttgttccagctcgatagcggagctagcggagagccgggtcactcgctaggcctcaccttgggcttctcatactgtggcaattgtcaaaccgcagtggtgagcgctcagcccgaaggaatggcaagcaacggtgcatatccagtactgggccccggcgtgaccgccaatccagggacttctctctccgtctttactgccctgcctttcacgacccctgccccgggtccagcccatggacctctcctcgtcaccgcaggagcccctcccggcggacctttagtcctatccaccttccccagcacccctctggtcaccgagcaggacggttgtgggcccagtggtgcgggggcttcaaacgtctttgtgcagatgcgaaccgaggtcggacccgtgaaggccgctcaggctcagaccctcgtcctgacacaggctccactggtctggcaggctcccggagccctgtgtggtggagtggtgtgtccacctcctctactgctagcagctgccccagtcgttcctgtaatggctgctcaggtcgtgggtggtacccaggcatgcgagggcgggtggtcacagggactgccactgcccccccctccgccaccggctgcccagctgccaccaattgttagccaggggaatgccggtccatggccgcagggcgcgcacggggaaagttcactggccagttcccaagcgaaagccccccccgacgatagctgcaatccgcgctccgtctatgagaatttccggctgtggcaacactacaaacctttggcaagacgccacttgccccagtctccagatactgaggccctgtcatgcttcttaattcctgtccttaggtcactggcccgcagaaagccgaccatgacgctcgaagaggggctgtggagagcgatgcgcgaatggcagcacacctcaaatttcgaccggatgatcttttatgaaatggcggagaagttcctggagttcgaggccgaggaagagatgcagatccaaaagtcgcagtggatgaaaggcccgcaatgtctgccaccacccgccacgcctagattggaaccacggggcccccccgctccagaggtcgtgaaacaacccgtgtacctgccttccaaggctggcccgaaagccccaacggcatgtcttcctcctcctcggcctcagaggccggtgacaaaggcacgacggccccctccgcggccccaccgaagagccgaaaccaaagcgaggctgcctcctcctcggccccagaggcctgcagagaccaaggttcccgaagagattcctccagaggtggtgcaggagtatgtggatatcatggaagaattgctgggtccctctctcggtgctactggagaacctgagaagcagcgtgaagagggaaaagttaagcagccccaggaagaggactggacaccgccagacccaggcttgctcagctacatcgataaattgtgctcccaaaaggatttcgtcaccaaagtggaggcagttatccatccccagttcctggaggagctactgagccctgaccctcagatggacttcctggcactttcccaggacctagagcaggaagagggactgaccctggcccagggagcaccctcagacgctccgggaaccgatcgttgctag

SEQ ID NO: 47409 - DNA, 2634 bp, Artificial Sequence
  Description of Artificial Sequence: Synthetic coding sequence
atggaggtgaagggccccagcggccggagcttctgctgcgagagcgagggccagtttaaatcctgtttaaagcggcataccccaagccttctgctaccttcctcctggaaaggaaattctggcagttgcctaatggctgaagctctgcataggatgtctccaacaccaaactcatgtcctttgccactcccactgtgtcgcatgtctggagtgctttgctcaagaaacctattcacattcaaattctcttttcagctggatagcggggctagcggggagccggggcactctctcggacttactctggggttttctcactgtggaaactgtcagaccgccgttgtgagcgcacagcctgaaggcatggcttctaatggagcctatcccgcactgggccctggtgtcaccgccaaccccggaacgagtctgtcggttttcacagctctgccatttacgaccccggctcctgggcctgctcacggaccactactcgtaactgcgggagcacccccaggggggccactggtcctctccaactttcccagtactcccttggtcacagagcaggacggctgtggcccgagcggcgctggggcatcaaatgtgtttgtacagatgcggactgaggtcggccctgtcaaggctgcccaggctcaaacactcgtgctgacacagaccccgctcgtatggcaggcccccggtgcgctgtgtgggggcgttgtgtgtcctcctcccctgctgctcgcagctgccccagtggtgcccgtgatggcagcgcaggtcgtgggcggcacacaggcttgcgagggaggatggtcccaaggcctaccactgcccccccctcccccacccgccgcgcaactaccaccaatcgtgtcacagggcaacgctggcccttggccacagggcgcccatggggaaggcagtctggcaagctcgcaggccaaggccccgcctgacgacagttgtaaccccaggtctgtctacgagaatttcaggttgtggcagcactacaaaccactggccagaaggcatctccctcagagtccggatactgaggctctgagttgctttctaattccagtgcttcggagtctcgctcgccggaagccaaccatgaccttagaggagggtctgtggcgcgccatgcgggaatggcagcacacatcaaacttcgatcggatgattttttacgagatggcagaaaagtttctcgagttcgaagctgaagaggagatgcagattcaaaagtcacagtggatgaagggcccccagtgcctgccaccccctgcgactcctagactggaacctcgtggacccccagctcccgaagtggttaaacaaccggtgtaccttccctcaaaggcaggtcccaaggcacctactgcttgtctgcctcctcccaggcctcagcgcccagtcacaaaggccagacgcccgccccccagaccccacaggcgagcagaaacgaaagctcgtcttcctccgccccgcccccagcggcccgccgaaacaaaggtccctgaagagattcctcccgaggtggtgcaagagtacgtggacatcatggaggagctgctaggtccctctctgggagcgacgggggagcccgagaagcagagggaagagggagaggttaagcagccgcaggaggaggactggacccctccggaccctgggttgcttagctacacggacaaactgtgtagccagaaagactttgtgacaaaggtggaggcggtgattcacccccagttcctggaggagctcctaagccccgacccgcaaatggacttcctggccttgagccaggaactagaacaggaagagggcctgaccctcgcccagcttgtggaaaagcgactgctaccccttaaagagaaacaacatgcccgagcagccccctcacgcgggacggctagactggactccagctctagcaaatttgctgccggccaaggcgccgaaagagacgtccccgaccctcagcagggagttggaatggagacttgtcctccgcagaccaccgctagggactcacaggggaggggcagggcccatacaggcatggctcggtccaaggacagtgtcgtcttgctgggctgtcaagattcccctggactgcgggcagcgcgacctacatctccaccccaagatcataggccaacatgcccaggtgttggaaccaaggacgctctcgacctcccgggtggctctccagtgcgtgaaagccacggcctggctcagggcagttccgaagaagaagaactgccctccctcgcgtttctgcttggaagccagcataagttgctcccatggtggctacctcagtcaccagtacccgcttctggcctgttgtcaccggaaaagtggggcccgcaaggcacccaccagtccccatcagcggagcgtcgagggctgaacttagctccctctccagcaaataaggctaagaagcggccactattcggaagcctgagccctgcagaaaagacgccacatcccggccccggtttaagagtttctggagagcagtcgctcacctggggcttgggaggaccctctcaatctcaaaaacgtaagggcgaccctctggtctcccggaaagaaaaaaaacaacggtgcagtcaatag

SEQ ID NO: 47410 - DNA, 789 bp, Artificial Sequence
  Description of Artificial Sequence: Synthetic coding sequence
atggaggagctgctgggccccagcctgggcgccaccggcgagcccgagaaacaacgggaggagggagaagtgaagcagccgcaggaagaggactggactccaccagatcctgggctactctcttatactgacaagctttgttcacagaaagacttcgtgaccaaagtggaggcagtgattcatcctcagttcttggaagagttactgagtcctgacccacagatggatttcctggccctgagtcaggagctggagcaggaagaagggctgacactcgcacaactggtggagaagcgattgctgcctctcaaagagaaacagcacgcaagggcagcaccttctaggggaacagccagattggatagcagtagcagtaaatttgcagccggccagggcgcggagagagacgtgccggatcctcaacagggagttggcatggaaacctgccccccacagacaacagcccgcgatagtcagggcagaggccgtgctcataccgcctctggtcttctgtcgcccgagaagtggggtccccagggcacacatcagtccccgagcgcagagcggagaggactgaacctcgctccctcaccggccaacaaggcaaaaaagagacctctcttcggctctctctcccccgctgagaagaccccgcatcctggtccaggactgcgtgtctccggagaacagagtctgacatggggtctcggcggcccgtcacaatcccagaaaaggaagggcgatccgttagtgagcagaaaggaaaaaaaacaaagatgctcccagtag

SEQ ID NO: 47411 - DNA, 2421 bp, Artificial Sequence
  Description of Artificial Sequence: Synthetic coding sequence
atgttccaggagcccgtgtacttccagatcttcctgttccagctggacagcggggccagcggggagcccgggcacagcctcgggttaactctcggtttctcgcattgtggcaactgccaaacagcagtagtgagcgctcagcctgagggcatggcatccaatggggcctaccctgccctcggtccgggcgtgacggctaatcctggaacaagcctaagtgtttttactgcactgcccttcaccactcccgctccaggccctgcccatggccccttactagtcacagccggagcgcccccaggagggcctctggtattgtccaacttccccagcacccctctggtgaccgagcaggacggatgcggacctagcggggccggggcttcaaatgtttttgtccaaatgcggaccgaagtggggcccgtaaaagccgcacaagcacaaaccctcgttctgacacagaccccactggtatggcaagctcccggcgcgttgtgcggcggcgtggtttgcccaccaccactgttgctggccgccgctccagtggtgcccgtaatggctgcccaggtggtgggcggaacacaggcatgcgaaggtggttggtcccaggggcttccactcccccccccacctccacctgcagcccagctccctccaatcgtaagccaggggaatgccggcccctggccccaaggggcccatggagagggctcacttgcctcttcccaagcaaaggccccacccgacgattcatgtaatcctcgtagtgtatacgagaactttcggttgtggcagcattacaaacccctcgcccgccgacacctaccccagtccccagacaccgaggctttgtcctgtttcctcatacccgtcttgcgttctcttgccaggcggaagcccactatgactttagaggaggggctttggagggccatgagagaatggcagcacacgagcaactttgaccggatgatcttctatgaaatggccgagaagttcttggaattcgaagcagaggaggagatgcaaattcaaaaatcccagtggatgaagggccctcagtgtctccctccccccgccacgcccagactagagccccggggaccccccgccccggaagtggtcaagcagcctgtataccttccatccaaggcaggccccaaagcaccgactgcatgcctgccgcctccccgaccgcagcggcccgtaacaaaagcgaggcgcccccccccccgacctcacagacgagccgagaccaaggctcgtctgcctccaccccgcccccagcgccccgctgagactaaagtcccagaggagatcccccccgaggtggtgcaggaatatgttgatatcatggaggaattgctaggtcctagtcttggggcaactggggagccggagaaacagagagaggagggagaggtgaagcagccgcaagaagaggactggacacccccggaccctggcttgctctcttacaccgacaagctgtgctctcagaaggacttcgtgacgaaagtggaagccgtgatccatcctcaatttctggaagaactgctaagtcccgaccctcagatggactttttggctttgtcccaggagctcgagcaggaagaggggctgaccctcgctcagttagtggaaaaacgcctcctgcccctgaaggagaagcagcacgctcgcgcggcaccttcccgtggcactgctaggctcgactcctcctcctcaaagttcgccgctggacagggcgctgagagggacgtccccgacccacagcagggagttggcatggaaacctgccccccgcagacaacagcccgcgatagtcaagggaggggacgcgcacataccggtatggccaggtccaaagactctgtggttctgctcgggtgtcaggattccccggggctgagggcggctaggcctacgagcccaccccaggaccaccggccaacctgtcctggagtgggtaccaaggatgctctagatctgcccgggggatctccggtgagagagagtcatgggctggcccagggctcgagtgaagaggaggagttacctagtttagcatttttgttagggtcccagcacaagctgctgccctggtggctgccacagtcgcctgtgcccgcatctggactgttatctcctgaaaaatggggaccccaaggtactcatcaaagtcccagcgcagagagaagaggcctgaacctcgccccttccccggccaataaggcaaaaaagcgacctttgtttggcagcctcagtccagccgagaaaaccccccaccccggacccgggctgcgagtatccggagagcagtccctgacctgggggctgggtggaccttcccagagccaaaagcgcaagggagatccactggtgtcacgaaaggaaaagaagcagcgttgtagccagtag

SEQ ID NO: 47412 - DNA, 1674 bp, Artificial Sequence
  Description of Artificial Sequence: Synthetic coding sequence
atgttccaggagcccgtgtacttccagatcttcctgttccagctggactctggggcctccggtgagccaggtcacagtctgggacttaccttggggttttcgcactgcggcaattgccaaacagcggtggtgtccgcccagcccgaggggatggctagcaacggggcctatcccgctcttggccctggagtcacagccaatccagggacctctttaagtgttttcaccgctcttcctttcacaacgcccgcccctggtcccgcccacggccctctgctggtgaccgcaggagccccacccggcgggcctctcgtcctaagtaactttccgtctacacctttggttacagaacaggacggttgtggcccttccggtgccggtgcgtccaatgtgttcgtccaaatgagaactgaggtgggtcctgtaaaagcagcacaagcccagacactcgtactgactcagacacccctagtctggcaggccccgggagccctatgtggcggagtcgtgtgccccccccccttgttgctggcagccgccccagtggtgcccgtgatggctgcccaggtggtgggggggactcaggcatgcgaagggggatggagccaaggactcccactgcctcctccccctcccccggccgcccaacttccgccgattgtgtcacagggcaacgccgggccctggccccagggggctcacggggagggtagtctggcgtcctcccaggccaaggctccccccgatgacagctgcaatccacggtctgtgtatgaaaattttcggctgtggcaacattacaagcctctggcgcgccgtcatctgccgcagtcccctgacaccgaggcactcagttgtttcctgattcctgtgcttagatcactggctagaagaaagccaactatgaccctggaagagggattatggcgggccatgcgggagtggcagcacacatcaaattttgacaggatgatattttacgaaatggccgagaagtttctggagtttgaagctgaggaagagatgcagatccagaaatcacagtggatgaagggtcctcagtgcctcccgccgcccgctacaccaagactggaaccaaggggaccgccagcaccagaggtggtaaagcagccggtgtatctgccttcaaaagccggacccaaggcacccaccgcctgcctgccgccaccgaggccacagcggcccgtcaccaaggcgcgtcggccaccgccaagacctcataggagggcggagactaaggctcgcctccccccgcccaggccccagagaccggctgagaccaaagttccagaagaaattccaccggaagtggtccaggagtacgtcgacataatggaggagctgctgggtccctcattgggcgccactggcgagccggagaaacagcgcgaggagggcgaggtcaaacagccccaggaagaagactggactccccctgatcctggcctcctgtcttacaccgacaagctgtgtagtcagaaggattttgtcactaaggtcgaggcagtgatacacccccaatttctcgaagagctactgagcccagacccacagatggattttctggcactttcccaggagctcgagcaggaagaaggccttacgctcgcccaaggggctccatctgacgctcccggtactgatcgttgctag

SEQ ID NO: 47413 - DNA, 759 bp, Artificial Sequence
  Description of Artificial Sequence: Synthetic coding sequence
tgaaccggcgagcccgagaagcagcgggaggagggcgaggtgaagcaaccacaggaggaagattggactccaccagacccaggcctactttcctacacagataaactatgctctcagaaagactttgtaacaaaggttgaagccgtgattcacccccagtttcttgaggaactactatccccggacccacagatggatttcctggctttgtctcaggagctcgaacaggaagaaggactgacccttgcgcagctcgtggaaaaaaggctgctgcctctcaaagagaaacagcatgctcgcgccgcgccaagcagaggtaccgcgcgtctcgactcctcctcttcgaaattcgccgccggccagggcgctgagagagatgtccccgacccgcaacagggggtgggcatggagacctgcccaccccagacaacagccagggacagccaaggcagaggcagagcccacacagcgagtggactcttgtcgcctgagaaatggggacctcaagggactcaccagtccccatcggccgagagacgaggacttaatctggcaccatcgccagccaataaagccaaaaaaagaccactttttggaagtctgtcaccggcagaaaaaacgccacaccctggccccgggcttcgcgtctctggcgaacagagcctgacctggggactgggcgggccctcacaaagccagaaacgaaagggggacccattagtgtctaggaaagagaagaaacaaagatgttcccaatag

SEQ ID NO: 47414 - DNA, 2637 bp, Artificial Sequence
  Description of Artificial Sequence: Synthetic coding sequence
atggaggtgaagggccccagcggccggagcttctgctgcgagagcgagggccagtttaagtcttgtctcaagcgccacaccccttccctgttgctcccttccagctggaaggggaattcaggcagctgtctgatggccgaggctttgcacaggacctcccccacccccaattcttgtcccttgcctctgcccctctgtaggatgtccggcgtgctgtgttcaaggaatctgtttactttcaaattcagcctctttcagcttgactcgggagcttctggcgaaccaggacattcccttggtctaacacttggcttcagctactgcgggaactgtcagaccgcggtggtctcagcccagcctgagggaatggcatctaatggcgcttatcctgtgcttggtcctggcgtgaccgccaacccaggcacgtcgctgtctgtgttcaccgccctgccatttaccactcctgctccgggcccggcacacggccccctgcttgtgaccgctggcgcaccaccagggggccccttagttctgtcaacctttccaagcacaccccttgtcaccgagcaagacggatgcagtccttctggcgcgggagcatccaacgtattcgtgcagatgcgaacagaggtggggcctgtgaaggccgcccaggcgcaaacattagtcctgacccaagctcctctagtttggcaggctccgggagctctgtgtggaggggtcgtttgtccacctccattactgttggctgctgctccggtggttcctgtgatggccgcccaagtcgtgggagggacacaggcctgcgaaggcggctggtcgcagggattgcccttaccaccccctccaccaccagcagcccagctgcctccgatcgtgagccaaggcaacgctggcccatggcctcagggcgctcacggcgagtctagcctggctagctcacaggccaaagccccccctgatgattcttgtaaccccagatcagtctacgaaaatttccgcctctggcaacactacaaacctctagcacgcaggcacctgccgcaaagtcccgataccgaagcattgtcctgctttctgattccagttctccggtcactggcccggcgaaaacctaccatgacattggaggagggtctgtggagggctatgcgcgaatggcagcatacatccaattttgataggatgatcttttacgagatggccgagaagttcttggagtttgaggcggaagaagagatgcagatccagaagtcacaatggatgaaagggccccaatgcttacctccacctgctacgcccagacttgagccacgcggacctccggcacctgaagtcgtgaagcagcccgtgtatctcccatctaaggcaggacccaaggctcagaccgcctgtctgccaccaccacgtccccagagaccagtgaccaaggcgcggagaccccccccccaaccacacagacgcgctgagaccaaggcaaggctcccacctcctaggccgcagaggccggccgaaaccaaggtgcccgaggagattccacccgaagttgtccaggaatatgttgacatcatggaagaattgctgggcccctccctaggcgccactggtgaaccggaaaaacaacgggaagagggcaaagtcaagcagccgcaagaggaagactggaccccccctgaccccggattgctcagctacatcgacaaactatgcagtcagaaggactttgtcactaaggtcgaagcagtcattcatcctcaatttctcgaagagctgttaagcccggatccccagatggattttctagcactgagccaggatctggagcaggaggaaggactgacgctcgcccaattagtcgagaagcggttacctcccttgaaggagaaacagcatagcagagcagctccctcaagaggcactgcacgcctggattcatcttcttctaaatttgctgctggccagggtgctgagagggacgtcccagaccctcaggaaggggtgggtatggagacatgccccccccagacaacagcccgggacagccagggaagaggcagggctcacacaggaatggcgagaagcgaagacagcgtggtacttctggggtgtcaggactcccctgggcttagggctgctaggccaacttcccctccccaggatcatcgacccacatgtcccggggttggtaccaaggatgctttggatctgcccggaggcagccccgtgagggaatcccatggtctggcccaaggttccagtgaggaagaagaactgcccagcctggctttcctactgggcagtcagcataagcttctcccgtggtggctgcctcagtcacccgtccccgcctcaggccttctctcacctgagaagtggggacctcagggtacacatcaatctccttcagccgagagacggggactgaatctggcaccaagcccagcgaataaggcgaaaaagcagccactgtttggctctctctctcctgcggagaaaactccacaccgcgggccgggtctgcgtgtttcaggcgaacaaagcctgacctgggggctgggcggtccctctcagtcccaaaagcgtaagggtgacccactggtttctcgcaaggagaagaagcagcattgttcacagtag

SEQ ID NO: 47415 - DNA, 2271 bp, Artificial Sequence
  Description of Artificial Sequence: Synthetic coding sequence
atggccagcaacggcgcctaccccgtgctgggccccggcgtgaccgtgaaccccggcacctccctaagtgtgttcactgcattgcctttcgctacgcctgctccgggacccgcacatagaccccccctggtgaccgccgtcgtacctcccgcagggccactggtattgtccgccttcccttcaacacctctggtcgcaggacaggacggtaggggaccgtccggggccggtgctagtaacgtttttgttcagatgaggacggaggtgggtccagtaaagccaccccaggcacaaacacttattctcacacaggcgcctctcgtgtggcaggcccccggcactctctgcggtggtgtaatgtgcccgcctcctctcctcttggccgcggcaccaggtgtgccagtaacttccgcccaggtggtgggcggcactcaggcgtgcgagggcggctggagtcacggtttacctctcccaccaccccctcccgctgctcaggtggcccccatagtctcgcccggcaacgcacgtccctggccccaaggcgcacatggcgaggggagcctagcccctagtcaggccaaagcccggccagacgattcgtgtaagcccaaaagtgtttatgaaaactttcggctctggcagcattacaagcccctggcacgcaggcacctaccccagagccctgataccgaagcactctcctgctttctgattccagtgctgcggtcccttgcaagacgcaaacctacgatgacactggaggaaggtctgtggcaggccatgcgggaatggcagcacacttccaactttgacagaatgatcttctacgagatggctgagaaattcctcgaatttgaggctgaagaggagatgcagatccagaagtcacaatggatgaaggggcctcagtcacttcctcctccagctccccctcgcttggaaccgagaggacctccagcccccgaagtggtaaaacagcctgtgtacctgcctagcaaggatggacccaaggcccctacggcttgcctccctcccccacgtcctcaaagaccagctgagactaaggcgcatcttccgccaccaaggccacagcgccccgccgagacaaacgcacatctcccaccacctcgccctcagagaccggccgaaacaaaggtaccagaggagatccccccagaagtagtccaggaatacgtagatatcatggaggaattactggggagtcacccaggggatactggggaacccgagggtcaacgggagaaggggaaagtcgaacagcctcaggaagaagatggcattacatcagaccctggactgctctcctacatcgacaagctgtgctcacaagaagatttcgtgactaaggtggaggctgtgattcaccctaggtttctggaagaactcctgtcccctgacccacagatggactttctggccctgtctcaggagctcgagcaagaggaaggcctcacgctggcccagctggttgagaagcgcctgctgagcctgaaagagaaaggttgtggtcgggccgctcctcgccatggcacggcgaggctggacagctcacctagcgagttcgcggctggacaggaagcagcccgagaagtccccgatccgcaacagcgggtgtccgtcgaaactagccccccccagacagccgctcaagatccgcagggccaaggacgggtgcgaaccgggatggcaaggagcgaggatccagctgttctcctgggttgtcaggactcgccaagactgaaggcagtgcgtcccacgagtcctccccaggaccatcggcctacgtgccctggcctgggcacaaaggacgccttaggcctgcctggcgaatctcccgtgaaggaaagccacggcttagcaaaaggttctagcgaggagaccgagctgcccggaatggtttatgtggtagggagccaccatcgactgaggccatggagacttagccagtccccagttccctccagcggtctactgagccctggtggacgcggacctcagggagcgctccagtcaccatccgcccaaaagcgaggactgtcaccatccccctccccagccagcaagtcaaagaaaaggccactgttcggaagccctagccctgccgagaaaacaccgcatccaggacccggactccgggtgtcgggcgagcagtcacttgcttggggccttggtggcccttcccaatcccagaaacggaagggcgacccattggctagccggaggaagaagaagagacattgttctcagtag

SEQ ID NO: 47416 - DNA, 1479 bp, Artificial Sequence
  Description of Artificial Sequence: Synthetic coding sequence
atggccagcaacggcgcctaccccgtgctgggccccggcgtgaccgtgaacccgggcacgtcactgagcgttttcaccgccctgcccttcgctactccagctccgggacccgcacacaggccgcccctggtcacggcagttgttccccccgcaggacctctcgtgctgtctgcctttccttctacacccctggtcgccggccaggatggtcgcggaccatcgggcgcaggggcaagcaatgtctttgtacagatgcggacagaagtcggaccggtcaagccccctcaggctcagaccctgatcctgacacaggccccccttgtgtggcaggcccctggaacactgtgcggaggggtcatgtgcccacccccactgctgctcgctgccgctccgggagttccagttacatctgctcaggtagtgggagggacacaggcttgtgagggtggatggtcacatgggctgccactgccccctccaccccctgctgctcaggtggctcccattgtaagccccggtaacgcccgaccttggcctcagggtgcccacggcgaggggtcactcgctccctcacaggcgaaagcaagaccagacgactcctgtaagccaaagtccgtgtacgagaattttcgactgtggcaacactacaagccattggctaggcgccatttaccacagtctccggatactgaggcactctcatgcttcctcattccagttttaagatctctggctagacggaaaccaacaatgacactcgaggagggactctggcaagcaatgcgggaatggcaacatacatcaaatttcgaccggatgatattctatgaaatggccgagaaatttctagagtttgaggccgaagaggagatgcagattcaaaagtcccagtggatgaagggcccacagagcctccccccgccagccccccctcgactggagccccgaggacccccggcaccggaagtggtgaagcagcctgtgtacctgccttccaaggatggtcctaaggctccgaccgcctgtctacccccacctagaccccagagaccggccgagactaaagcccaccttcctccgcctaggccacaaagaccggcagaaaccaaagtgccagaagaaattcctccggaggtggtgcaggagtacgtggatatcatggaagagctgctgggatcacaccccggggacactggagagccagaagggcaaagagagaagggcaaagtggagcagcctcaggaggaagacggcatcacctcagatccagggctcctctcttatatcgacaaactgtgttctcaggaagacttcgtgacaaaggtagaagcagtcattcaccctaggtttctggaagagctgctgtcccccgacccccaaatggatttcctggccttaagccaggagctcgaacaagaagaaggcttaacactggctcagggcgctccatccgatgccctgggtactgacaggtgttag

SEQ ID NO: 47417 - DNA, 2226 bp, Artificial Sequence
  Description of Artificial Sequence: Synthetic coding sequence
atggccagcaacggcgcctaccccgtgctgggccccggcgtgaccgtgaaccccgggacaagcctttctgtgttcaccgcgctcccttttgctaccccggcaccaggaccagcgcaccgaccaccactggtgaccgcagtggtcccccctgctggaccacttgtgttaagtgcgttcccatctacccccttggttgcaggtcaagatggaagaggcccgagcggtgccggggcatcaaacgtgttcgtacaaatgagaactgaagttggacccgtgaagccacctcaggcacagactttgatcctaacacaggcgcccctcgtgtggcaagccccgggtacgctctgcggcggggtcatgtgtcccccacctttgctgctggcagccgccccaggcgttcccgtgaccagtgcacaagtggtcggcggcacacaagcatgcgagggcggatggagccacggactgccgctgcctccacctccacccgccgctcaggtagctcctatcgtaagccccgggaacgcccgtccatggcctcagggggcacacggcgaagggtcgttagcaccgagtcaagctaaggctagacccgatgatagttgcaaaccaaagtctgtgtatgaaaactttcgtttatggcagcactacaagcctctggcgcgcagacacctgcctcagagtcctgacaccgaagctctgtcctgttttctaataccagtcttgagaagcctcgcacggcggaaacctaccatgacactcgaggagggtctctggcaggcaatgcgggaatggcagcacacctctaacttcgatagaatgatcttttatgaaatggcggagaagtttctcgagtttgaggctgaggaagagatgcagattcaaaagagccaatggatgaaaggacctcaaagtctgccccccccggcaccacctcgcctcgagcccagaggcccccccgccccagaggttgtgaagcagccggtgtatcttccttctaaggatggcccaaaggcacccacggcatgtttgccccctcctcgtccgcagagacccgccgagacgaaagctcatctcccaccccccaggccacagaggcctgcggaaacaaaggtgcctgaggaaattccccctgaggtggttcaggaatatgtcgacattatggaggagctcttggggtcacacccaggagacacaggggaacccgaggggcagcgcgaaaaaggcaaagtagagcagccacaggaggaggatggaataaccagtgaccctgggcttttatcttatattgataaactgtgttcacaagaggatttcgtgaccaaggttgaggcggttatccacccccgcttcctcgaggagttgctgtcaccggatcctcagatggactttctggccctgtcccaggaactggaacaagaggaggggctgacactagctcagctcgtggagaagagactcctcagcttgaaggagaaaggctgcggcagggcagccccccggcatggaacagccaggctggacagctcaccctcagagtttgcagctggacaggaggccgcccgggaagtgcccgacccccagcagagggtgagtgtggagacttccccaccgcagacagccgcccaggatccccaagggcaaggccgcgtgagaactgggatggcccgctccgaagatccggcagttcttctgggatgtcaagacagcccgagattgaaggctgtcaggccaacaagtccacctcaggaccaccggcccacttgcccaggcctcggaacaaaggatgcgctggggctgccgggcgagtcccctgtaaaggagtcacacggcctggctaagggctcaagtgaggagacggaactgccaggaatggtgtatgttgtcggatcacatcacagactgagaccttggagattgagtcagtcgccagtgccatcttcaggattgctgagccctggtggccgggggccccagggggctcttcagtcaccttctgcccagaagagaggattgtccccaagtccgtctccagctagcaagtctaagaaaagaccactgtttgggtcgccatcgcctgccgaaaaaaccccccatcccggcccagggctgcgtgtcagtggggaacagtcccttgcttgggggctgggaggcccttctcagtctcagaagcggaagggtgatcctctggccagtcgtagaaagaagaagagacattgtagccagtag

SEQ ID NO: 47418 - DNA, 1773 bp, Artificial Sequence
  Description of Artificial Sequence: Synthetic coding sequence
atggccagcaacggcgcctaccccgtgctgggccccggcgtgaccgtcaaccccgggacctcccttagcgtgttcaccgctctgccatttgccactccagcccccggccccgctcatcgaccgcctctcgtgacagcagtggtgccgccagcggggcccctagtgcttagtgccttcccatccactcccctcgtcgcaggacaggacggaagagggccgagcggggcgggcgcaagcaatgtgttcgtgcagatgcggacagaagtggggcccgtgaaaccaccccaggcacaaacactaatcttgacccaggctccgttagtctggcaagctcctggtaccctttgtggcggggtcatgtgtcctccccccttgctgctagctgccgcccctggcgtgcccgtaacttccgcacaggtggttggaggtacccaagcctgcgaaggcggatggtcacatggactgcctctgcccccccctccacccgccgcccaggtggcgcctatcgtgagcccgggcaacgcacgaccatggccacagggagctcacggcgaaggctccctcgctccatcgcaagcaaaggccaggcccgacgactcttgtaaaccaaaatctgtatacgaaaactttcggctttggcaacattataaaccactcgcacgccgccacttgccacaaaaggtcgtgcaggagtacgttgatattatggaggagctcctgggcagtcacccgggcgacacgggagaacctgagggtcagcgggagaaagggaaagtggagcagccacaagaggaggacggcattacgtctgatccagggctgctgagttatatcgacaaattatgctctcaggaggacttcgttacgaaggtggaagccgtcatccacccacgatttttagaagagctcctttcgcccgacccacaaatggatttcctagcgctttctcaggagctggagcaagaggagggcttgactctcgcgcagcttgtcgaaaagaggctgcttagccttaaggaaaaggggtgcggacgggctgcccctaggcacggtactgcccgcctggactcttcaccctctgaattcgcggcagggcaagaagcagcgcgcgaagtgcccgatccgcaacagcgagttagcgtagagacctcgcccccccaaaccgccgctcaggacccacagggacagggcagagttcggacaggcatggctagaagcgaggatcccgctgtgctcctgggatgtcaagacagtccccgactgaaggccgtcagaccgacgtccccaccccaagaccaccgacccacttgcccagggctcggtacaaaggatgctttggggctacctggagagtcacctgtgaaagagtctcacggcctagccaaggggagttcagaggagacagagctgcccggcatggtttacgtagtaggctcacatcaccgacttcgcccctggaggctgagccagtccccagtgccttcaagtggtctgctttccccaggcgggcggggcccacagggggccttacagtccccttctgcgcagaaacgtggtctctccccctctccctcacctgcctctaagtcgaaaaagagacccttattcggatctccctcaccagctgagaaaaccccccatccggggccagggctacgggtctccggtgagcagtctctggcctgggggctcggagggccttctcagagccagaaaagaaagggtgatccactggcctctcgccgcaagaaaaaacgccactgttcccagtag

SEQ ID NO: 47419 - DNA, 1479 bp, Artificial Sequence
  Description of Artificial Sequence: Synthetic coding sequence
atggccagcaacggcgcctaccccgtgctgggccccggcgtgaccgtgaatccgggaacttccctgtccgtcttcacggcactcccttttgctacgccgtccccaggcccaacacatagaccacctctcgtcaccgctgttgtgcccccagccgggcctctcgtcctgtcagcctttccaagtactcctctggttgccggacaagatgggcggggcccctccggggctggcgctagcaatgtttttgtgcaaatgcgaactgaggtcgggcctgttaagcctccccaggctcagaccttaattctgacccaagctcctctcgtctggcaggcccctggcaccttgtgcggcggcgtcatgtgtcctcctccactgctgctggccgcagctcctggcgttcccgtcacatctgctcaagtggtgggcgggacacaggcctgtgaaggcggatggtctcatggacttcctttaccgcccccgccacccgcagctcaggtggcccccatagtgagccctggcaatgcagggccctggccccagggcgcacacggtgaaggtagccttgccccttcacaggccaaagcccgacccgacgactcttgtaagccgaaatctgtgtacgagaacttcagactctggcaacattataagcccctcgcccggaggcacttaccccaaagcccagacaccgaagcgctgagttgttttctgatcccagtgcttaggtccctggcgaggcggaagcctacaatgaccttggaagaagggttgtggagggccatgcgggagtggcagcacacatctaactttgatcggatgatattctatgagatggccgccaaattcctggagttcgaggcagaggaagagatgcagatccagaaaagtcaatggatgaaggggccccagtctttacctccacctgcccccccaaggcttgaaccaagaggtcctcccgcacctgaggtggtgaaacagccggtttatttaccatccaaagacgggcctaaggccccaaccgcctgtttgcccccccctcgccctcagcggccagccgaaacgaaagctcacctgccccctccgaggccacctagaccagcagagaccaaggttccggaagaaattccgccagaagttgtccaagagtatgtggatatcatggaagaactgctgggatcccatccaggcgacactggcgagcctgaaggacagagagagaaagggaaggtggaacagccacaagaagaggacggtatgacaagcgacccaggtctgctttcatatatcgataagctgtgcagccaggaggattttgtgactaaggtggaagcggtaatccaccctcgatttctggaggagctgctttcccccgacccacagatggacttcctcgcccttagccaggaacttgagcaggaagaaggactgacactggcccagggggccccttcagacgccttaggaactgacagatgttag

SEQ ID NO: 47420 - DNA, 2226 bp, Artificial Sequence
  Description of Artificial Sequence: Synthetic coding sequence
atggccagcaacggcgcctaccccgtgctgggccccggcgtgaccgtcaatcctggcactagcctgagtgtctttactgccctgccattcgccacccctagcccaggtcccacccacagacctcctctcgtgactgctgtcgtcccgccagccggaccactggtcttatccgccttcccatctacacccttggtcgcaggccaggacggccgtggtcctagcggcgctggggcaagcaacgtctttgtgcaaatgcgcacagaagtgggacccgtaaagcctcctcaggcacaaaccctgatcttaacacaggcacctttggtgtggcaagccccagggacactatgcgggggggtgatgtgtccacccccactgttactagccgcggctcccggagtgcctgtgaccagcgctcaggtggtgggggggacccaagcctgtgagggcgggtggtcccatggcctgccattacctcctccgcctccagcagcacaagtggccccaatcgtgtcacctggcaatgctggaccttggcctcagggagcgcatggcgaagggagcctagcacccagccaagctaaggccagacctgatgatagctgcaagccaaagtcggtctacgagaacttcaggctgtggcagcactacaaacctctggcaaggcgccatttacctcagtccccagacaccgaagccctgagctgcttcctaattcccgtgctaaggtctctcgctcggaggaaacccaccatgactctcgaggagggtctgtggcgagccatgcgggaatggcaacacactagcaattttgacaggatgatcttttatgaaatggcagcaaagtttttggaatttgaggccgaagaggaaatgcagatacagaaatcccagtggatgaaagggccccagtcactcccgccaccagcaccccctagactggagccccggggcccgcccgctcccgaagtggtgaagcagccggtctacctgccctctaaagatggccccaaggccccgacagcgtgcctgcccccgcccaggccccagcgccctgcagaaaccaaagcacatctgccccccccgcggccaccaaggcctgctgaaactaaagtccctgaagaaatcccccctgaggttgtccaggaatatgtggacatcatggaggaattgcttgggtctcaccctggtgataccggagaaccagaaggccagcgcgagaagggcaaggtggaacaaccccaggaagaggacggcatgacaagcgaccctggcctcctgtcttatattgataagttatgctcccaggaggatttcgttactaaggtcgaagccgtgattcatcctcgcttcctggaggagctgctgagtccagatccacagatggactttttagccctatcccaggaattggagcaggaggaggggttgaccctcgcccagttagtggagaagcggttgttgtcgctcaaagagaagggatgtggccgagcagcacccagacacgggaccgcccgtctagattcatctccgtctgagtttgctgctggccaggaagctgccagagaggttcctgacccccagcaacgcgtcagtgtcgagacatcacccccccagacagccgcccaggatccacagggccagggacgtgtacgtacgggcatggctcgatcagaggaccctgcggtcctcttgggctgtcaggattccccaagactcaaagccgtcagaccgacctctccacctcaagaccaccgtccaacatgccccggcttgggcaccaaggatgctcttggtctgccaggcgaaagtcccgttaaagagagccacgggctggctaaagggagctcagaggagaccgagcttccaggcatggtctatgtggtgggatctcatcacagactgcggccatggcgactgtctcaatccccagtgcccagctcaggcttgctgagccccggcggtcgcggtcctcaaggggctctgcagagcccgtctgcccagaagcgggggctgagcccatcacccagccccgcatctaaatccaaaaaaagacctctgttcggttcaccaagccctgcggagaagaccccgcaccccggacctgggctcagagtgagcggggagcagagtctggcctgggggctcgggggtccatcccagtcacaaaagagaaagggggatcctctggcttcaagaagaaagaaaaaaaggcactgctcccagtag

SEQ ID NO: 47421 - DNA, 1869 bp, Artificial Sequence
  Description of Artificial Sequence: Synthetic coding sequence
atgtgccccccccccctgctgctggccgccgcccccggcgtgcccgtgacatcagcccaggtggttggaggcactcaggcgtgtgaggggggctggagtcatggactgccactgcctccccctcctccagccgcacaagttgctcccatcgtgagcccaggcaatgccggaccatggcctcagggagcccacggtgaggggtccttggccccctcccaggctaaggccagacccgatgattcttgtaaacccaaatcggtctacgagaattttcgtctctggcagcactataagcctttagcgaggcgtcacctccctcaatcaccggacaccgaagcactttcctgcttcctgatcccagtgctgagatctctagcaaggagaaagcctacaatgacacttgaggaggggctgtggagggctatgagagagtggcagcatacatccaactttgatcgaatgatcttttacgaaatggcagctaaatttctcgaatttgaggcggaagaggaaatgcagatccaaaagagccaatggatgaaggggccacagtctctgcctccgccggcacctccacggcttgagcctagaggtcccccggccccagaggttgtgaaacagcctgtctatctgcctagcaaggatggccctaaggcccctaccgcttgcttgccccccccacggccccagcgcccagcagagaccaaggcacacttaccgcccccccggccaccgcgccctgcagaaacaaaagttcccgaagaaataccccctgaagtcgtgcaagagtacgttgacatcatggaagaactccttggtagccatccgggcgatacaggcgaacccgaaggccaaagagagaaggggaaagtcgagcagcctcaagaagaggatggtatgactagcgaccctggactgctgagctacatagacaagctgtgcagtcaggaggactttgtaacgaaagtagaagcagttatccaccccaggtttctcgaggaactgctatcccctgacccgcaaatggattttctggccctgtcgcaggaacttgaacaggaggagggccttacactggctcagctggtagagaagcgtctactgtcactaaaggagaaggggtgtggccgagcagctcctcgccacggaaccgctaggctggacagtagtcctagtgaatttgctgctggccaggaagcagctagagaggtccctgaccctcaacagcgcgtgtctgtagaaacgagcccccctcagactgcagcgcaggatcctcaaggacagggaagggtgcggactggtatggccaggagcgaggacccagcagtgcttttagggtgccaggactcccccaggctgaaagctgttcggcccacctccccaccacaggatcatcggcccacctgcccaggcctcggaacgaaagatgcgctgggcttacctggagagtcccctgtgaaagagtctcatgggttggctaaagggtcctccgaggaaaccgagttgcctgggatggtctatgtggtgggctcacatcataggctgcgcccttggcgcctgtcccaaagcccagtgccctcttccggcctgctgtctcccggtgggagagggccacagggggctctgcaatccccctccgcgcaaaagcggggcctctcacccagtcccagtcccgctagcaagtccaagaaacggcctctctttggatctccatcacctgcagaaaagacgccacatcctggacccggacttcgcgtgtcaggggaacaatccctggcatggggacttggcggaccctcccagtctcagaaaagaaagggagatccccttgcctcccggcggaaaaaaaagcgtcattgtagccagtag

SEQ ID NO: 47422 - DNA, 1773 bp, Artificial Sequence
  Description of Artificial Sequence: Synthetic coding sequence
atggccagcaacggcgcctaccccgtgctgggccccggcgtgaccgtcaaccccggtacgtccttatcagtatttacagccttacccttcgcaactcctagcccaggtcctacacatcgcccaccactggtgaccgccgttgtgccgcccgcgggtcctctggtactgtcagcgttccccagcacccccctcgtggccgggcaggacggcagggggccaagcggggcaggagccagcaatgtctttgtgcaaatgcgcaccgaagtgggccccgtgaagccgccgcaggcccaaacccttatactcacacaggcccccttggtatggcaggcccccgggactctgtgcgggggcgtgatgtgtcccccgccgcttctgctggcagctgcccctggcgtgcctgtcacctctgcacaggtcgtcgggggcactcaagcgtgtgaagggggatggtctcacggcctacccctgcctccaccgccccctgctgctcaggtcgcccctatcgtcagccccggaaacgccggtccatggcctcagggcgcccatggagagggcagcttggcaccgagtcaggccaaagctaggcccgacgattcctgtaaacctaagagtgtttacgaaaatttcagactttggcagcattataagcccctggcaaggaggcatctaccacagaaggtggtgcaagagtatgtggacattatggaagaacttcttggatctcacccaggtgatactggcgaaccggaaggacagcgggagaaaggaaaagtggaacagccacaagaggaggacggcatgaccagtgaccctggattgctgtcatatattgacaaactgtgtagccaggaggattttgtcaccaaagttgaggcagtgatccacccacgtttcctggaggaactgttgagtcctgaccctcagatggactttcttgccctgagccaagagctcgagcaagaggaaggcctgacccttgctcagctagtggaaaaaagattactatcactgaaggagaaggggtgcggcagagctgcaccccgccatgggaccgctaggctggacagctcacccagcgagttcgccgccggacaggaggccgctcgcgaggtccccgatccccaacagagggtgagtgtagagacctccccccctcaaacagcagctcaggacccacaaggccagggacgggtgaggaccgggatggcacgctccgaggacccagctgtcctgttaggatgtcaggattctcccaggctaaaagcggtcagacccacaagtcctccccaggaccaccggcccacgtgcccgggtctggggacaaaagacgcactgggtcttcctggcgaaagcccggtgaaagagtctcacggtttggctaaaggcagctcagaagaaaccgagctacctggcatggtttatgtggtgggtagccaccatcgtctgaggccctggagactatcgcagtctcctgtgccgtcctctggactgctgagcccgggcggacgtggtcctcagggcgctctgcaatcccccagtgcgcagaagagaggattgtctccttcgccttcaccggcaagcaagagtaaaaagcgtccactgtttggcagcccttcccctgccgagaaaaccccccatccaggccccgggctgagagtcagcggtgagcagagtctggcttgggggcttggaggtccatctcagtctcagaaacggaaaggcgacccactggcttcccggcgcaagaagaaaaggcattgttctcagtag

SEQ ID NO: 47423 - DNA, 1689 bp, Artificial Sequence
  Description of Artificial Sequence: Synthetic coding sequence
atgctggcctgcctgcccggccccggcgacctgagcttccagctgctgtcccacacacaaatgaacaccgggcttcagaagtgggacacgacgcaaaaaatgcgaacagcacattatcccaccccagccgaacttgatgcttatgctaagaaggttgctaataatcctctgacgattaagatattccccaacagcgtcaaagtgccacaacggaagcacgtccgtcggacagtgaatggacttgacacaagtgcgcagcgatacagcccttaccctacacaagcagctactaaggctggcttactcgccattgtgaaggtgccagccaaaagcatattgaaggactttgatgggactagagctaggctgctccccgaggctataatgaatccacctgtggcaccgtatgccaccgtggccccttcaaccctggcccaccctcaagcccaggccctggcacggcagcaggctctccagcatgcgcagactctcgcacatgcaccccctcagacgctccagcacccccagggcattccccctcctcaagcgctttcacatccccagagtctgcagcaacctcagggcctgggacaccctcagcctatggcccaaactcagggactggtgcatccccaggctttagcacaccaggggctgcagcatccccacaacccactactccacggagggcggaaaatgcccgatagtgatgctccacctaatgttacagtctccacatccaccatcccgctgtccatggctgcaacgctgcaacacagtcagccacctgacttatctagtattgtgcaccaaattaatcagttctgtcagacccgggccggcatctccactacctctgtctgcgaggggcagatcgcgaatccatctccaataagccgatctctgcttatcaacgctagcacacgcgtgagcacccactccgtccccacgcccatgccctcttgtgtggtcaacccgatggagcacacccatgccgcaacagccgcgttgcctgcggctggccctgttaatctgcccaccgggatcagtagggtgcccaccgggtatcctagcgacctcaagccagtcacctggaatcaacaccagttagcccatttgcagcaaatgtgctcagaggcgagtggcaccccagctcctggcctcacaggtaagcacgctgcggggcgagagctagccgggcctggttttgtaggcaaggctcccgcctacccacaggaactatgcctagcacagtcgttccacctgaagcctccactcgaaaaacccacacctagccctcccgtcaacgggatggcagccccactcgcttatccaaacggacattacttccaacccctgtggaacaacatcctgcccacaccgaacagtgatagttctggaagccaagacttggctatgccgttccacggtggacaacctaccggcgcccctctggactgcgccgccgcccccggtgcccattaccgcgctggaactgggggcgggccagttgcctcacaaaactcccttatgcagaccgtggactacctctccggtgattttcagcaagcctgtttccgcgagcagtctctggccatgctgtccaaagctcatagagctccgggcaaccgtgcacccgatcccacggagtctcgatcactgcacatccagcaccccggctatagatag

SEQ ID NO: 47424 - DNA, 960 bp, Artificial Sequence
  Description of Artificial Sequence: Synthetic coding sequence
atgaagaacgtggacagcgacgacctggtgaccggcaccctgcccaagctgaagagcagcaaggagtggcttgaacctaagcccctgtgcttcatggaggtcctggcaaaagaagacaccgaagctgccattcagagcatactgtacaaagagaattccgtgataaaagaattggataaatatttgcaacaccacgcatttctgaacgcccgccgcaaagaaatgctgtacaagaggtgggttgattgcgtcgctgacccactgcaaaagaagattatcgagaaagtatgtagccataaaaagatcaagaaacgaagacagggagaactggatgggttcctgaaacatgtgaataagaagggcaatgcatttatcgagcattacgatccaaaggaatacgacccattctatatgagcaaaaaggatccaaatttccttaaagtgactattccccctttccatgatcccctgaaaaaagcccagtacgacaaagacaatgaaaaacgtaccctcttacagtgcgagacaggcaagatctatagtattaaagagttcaaggaagttgagaaggtgcagctgcactcacggttcccccagatctcaaactctcgacacttcatcacacctaacgagtggctgaaactacccacccgctacattgagagtgagttttgtcgtcgtcgacgcctgaaagtgaaggtcaatttcaatgactgctccttcgacttgaagcccctggcacgagccccctacttgttagagagccaggaggaagagaaaacagtcatctacaaaaacaaggggtcttcctttctggaacgtgagcctctgtgctaccaggaggggaataacccctcagccaaggaggctatttccgaggggtatttttcttccctcagcttgtctcggaacggaagaaaaacgcgtatggggcttccgccacgggtgtggggctgctag

SEQ ID NO: 47425 - DNA, 318 bp, Artificial Sequence
  Description of Artificial Sequence: Synthetic coding sequence
atggccaagatgttcgacctgcggaccaagatcatgatcggcatcggaagcagccttctggttgctgccatggtgctgctcagcgtcgtgttctgtctctatttcaaggttgccaaggcgctaaaggcggctaaggaccccgacgccgtggcagtgaaaaaccacaaccctgataaggtgtgttgggcaacaaacagtcaagctaaggctacaactatggagtcctgtccaagcttacagtgttgcgaaggctgtcgaatgcatgcaagctccgactccttacccccatgctgttgcgatattaacgaggggctgtag

SEQ ID NO: 47426 - DNA, 291 bp, Artificial Sequence
  Description of Artificial Sequence: Synthetic coding sequence
tgaaccgtgtgctgccacaccatgctgggcggcctgggcaagctggccgccgaaggcttagcccatcgaaccgaaaaggctaccgaaggcgctatccatgctgttgaggaggtcgtcaaggaagtggtcgggcacgctaaagaaaccggagagaaggcaatcgccgaggctatcaaaaaggcacaggagagcggcgacaagaaaatgaaggaaattaccgagactgtgacaaataccgtcacaaatgctataactcatgccgcagaatcattagacaagcttggacaatag

SEQ ID NO: 47427 - DNA, 270 bp, Artificial Sequence
  Description of Artificial Sequence: Synthetic coding sequence
atgctgggcggcctgggcaagctggccgccgagggcctggcccaccggaccgaaaaggcaaccgagggtgcaatacatgcagtggaagaggtagtgaaggaagtcgtggggcacgccaaggagacaggagagaaggccattgctgaggcaataaagaaggctcaggagtccggggataagaaaatgaaggaaatcactgaaacagtcaccaatacagtaaccaatgccatcactcatgctgccgagtcccttgacaagctcggtcagtag

SEQ ID NO: 47428 - DNA, 291 bp, Artificial Sequence
  Description of Artificial Sequence: Synthetic coding sequence
tgaaccgtgtgctgccacaccatgctgggcggcctgggcaagctggccgctgaggggctcgctcacaggaccgaaaaggctaccgagggagcaatacatgccgttgaggaggtggtgaaagaagtagtgggtcatgcaaaagaaaccggcgagaaggcaattgctgaagcaatcaaaaaagcacaggagagcggggacaagaagatgaaggaaatcacggagaccgtaacaaacacagttaccaacgctattacccatgctgcagaaagcttggacaagctaggacaatag

SEQ ID NO: 47429 - DNA, 291 bp, Artificial Sequence
  Description of Artificial Sequence: Synthetic coding sequence
tgaaccgtgtgctgccacaccatgctgggcggcctgggcaagctggctgcagaaggtttggctcatcgcacagagaaagccacagagggggcaattcatgccgttgaagaagtagttaaagaagtcgtaggccacgcgaaggaaacaggcgagaaggccattgctgaggccatcaaaaaagcacaggaatcaggcgacaagaagatgaaagagataacggagacagtgacaaatactgtgactaatgcaatcacacacgcagcagagagtctcgacaagcttggccaatag

SEQ ID NO: 47430 - DNA, 270 bp, Artificial Sequence
  Description of Artificial Sequence: Synthetic coding sequence
atgctgggcggcctgggcaagctggccgccgagggcctggcccacaggactgagaaagccacggagggcgcgatccatgctgttgaagaggtcgtaaaggaggtggttggacatgccaaggaaaccggtgaaaaggcgatagcagaagccataaagaaagcccaggaatctggcgacaagaagatgaaagagatcacagagaccgttacaaacactgttacaaacgctatcactcacgctgcagaaagtctggataaactgggtcagtag

SEQ ID NO: 47431 - DNA, 270 bp, Artificial Sequence
  Description of Artificial Sequence: Synthetic coding sequence
atgctgggcggcctgggcaagctggccgccgagggcctggcccaccgcactgagaaggctacagaaggagccatacatgccgtggaggaggtggtcaaagaagtggtaggacatgccaaggagacaggcgagaaggccatagctgaagccataaaaaaagcccaggagtccggcgacaaaaagatgaaagaaatcaccgaaactgtaacaaacactgtaacaaacgcaatcacacacgccgcggagtccttggataaacttggccaatag

SEQ ID NO: 47432 - DNA, 291 bp, Artificial Sequence
  Description of Artificial Sequence: Synthetic coding sequence
tgaaccgtgtgctgccacaccatgctgggcggcctgggcaagctggcagccgaaggattggcccatcgcaccgaaaaggctaccgagggcgccattcatgctgtcgaggaggtggtgaaggaggtagtgggccatgccaaagaaacaggtgagaaagccatagccgaagccatcaagaaggcgcaggagagtggcgacaagaagatgaaagaaatcactgaaacagtgacgaataccgtgaccaacgctattacccacgctgccgagagtctggataaacttggccagtag

SEQ ID NO: 47433 - DNA, 204 bp, Artificial Sequence
  Description of Artificial Sequence: Synthetic coding sequence
atgcggaagccccaggccggcaccggcgaggccgcccgggacccctcgctgaggcccgcacggaccgtcctcgtgggcgaccaggacgagtatacggcggccgaaaacaagagccctagggggacattgtgccccaccggagagcagcgcattcacgccagagaagatgcctgtattttttctaggctgttctctgagaagtag

SEQ ID NO: 47434 - DNA, 204 bp, Artificial Sequence
  Description of Artificial Sequence: Synthetic coding sequence
atgcggaagccccaggccggcaccggcgaggccgcccgggacccctctctgcggccggctcgcacagtgcttgtgggcgatcaagacgagtatacagctgccgagaataagagcccacgcggcaccctctgcccaaccggagaacagcggattcacgcccgggaggatgcctgcattttcagccgcctgttctccgagaagtag

SEQ ID NO: 47435 - DNA, 378 bp, Artificial Sequence
  Description of Artificial Sequence: Synthetic coding sequence
atgggcatcttccagctgctgcgggaccggcggatcagcagccggggccctggcctccacactccaaaggctgaaccccgcagacgcaagggcttgacgaccggcctcatgacccaggctgaacgacagaaacaggcacaccagcggcaggccacaatgcgcgaaaccgcactttggtgtaccgggcacatccggccacgcacccatatgcacaccggcacacatacacagaccgatagggagcgcgaacgcaatacacagcgcttacgagatcgcgaacgcagagaaaacgggcggcacacacacattcacacacagacgcacagacagagcttgatcgccaaggcacttaaagacacacaccctggaaatccttag

SEQ ID NO: 47436 - DNA, 279 bp, Artificial Sequence
  Description of Artificial Sequence: Synthetic coding sequence
atgaccaagccccaggccgagagcggcgaggccgcccggcaccccatattcagacccgccaggcgggtgtttggaattaagatgactacacttcaaccaagaattaaggccccccaagaactgacagtgctgcaggagcgatctaggccaacaagcaagaagatggccgtttgtttccatggaagtagtttgcggtcggaggccacaccgcgttactctctagaggaagaggctaggaatggccgctggcagcaggcattatcgtggtggcccctgtag

SEQ ID NO: 47437 - DNA, 2508 bp, Artificial Sequence
  Description of Artificial Sequence: Synthetic coding sequence
atgagcggcggcagccaggtgcacatcttctggggcgcccccatcgcaccactcaagattacagttagcgaagacaccgcgtccttgatgtctgtagctgatccatggaagaagatccaactgctgtacagccagcattccctctacctcaaggatgaaaaacaacacaagaaccttgaaaactacaaggtgccggagagtattggcagtcctgatctgagcggccactttctggctaattgcatgaatagacacgttcatgttaaggatgacttcgttcggagcgtttcagaaacccaaaacatagaatcgcaaaaaatacactcctcccgcctctctgatattaccagctcaaacatgcagatctgcggattcaaaagcaccgtacctcactttaccgaggaggagaagtaccagaagctactgagtgagaacaagattcgagacgaacagcccaagcaccaacctgacatatgcggaaagaattttaatactaaccttttccaacttgggcataagtgcgccgctgtgcttgatctcgtttgtagtacagagaagattaacataggccccgaggtagttcaacgcgagtgcgtgccaaccgagtatcacgaaatccagaaccagtgccttggccttttttctagtaacgcagtggataaatcccgaagcgaagccgccgtgaggaaggtatccgatctgaaaatcagcactgacaccgagtttctgtctattataacctccagccaggttgcgtttttggcccaaaagaaggataaaagacgctcccccgttaataagggaaatgtgaatatggaaaccgagcccaaggcatcatatggtgagattagaattcccgaggagaactccatccagctggacggcttcaccgaggcgtatgaaagtggccagaaccaggcctactcattggaactctttagccccgtctgtcccaagacagagaactctagaatacacatcaactcagacaaaggactcgaggaacacacaggctcacaagagttattcagtagtgaggacgaactgccgcccaacgaaatacggattgagctgtgctcttccggtattctgtgtagtcagcttaacacatttcataaatctgccattaagaggagctgtaccagcgaggacaaagtaggccagagtgaagctctaagcagggtcctgcaggtagcaaaaaagatgaaactaatctctaacgggggggactctgcagtcgagatggatcggaggaacgttagcgagttcaaatccattaaaaagaccagtctaattaaaaattgcgactccaagtcccaaaagtacaactgtctagtgatggtgctgagcccatgccatgttaaggagattaatattaagttcgggccaaatagtggcagtaaagtccctctggctacagtcacagtcatcgaccagtcggagaccaagaagaaggtatttctctggcgaactgccgccttctgggcctttactgtattccttggcgacatcattcttttgaccgatgtggtgattcatgaagaccagtggattggcgagacagtgctgcagtcaacatttagcagtcaactgcttaatctcggatcatatagcagcatccaacctgaagaatactctagtgtagtgagtgaggtagtcctgcaggatttgctagcttacgtctcctctaagcacagttaccttagggatctccccccacgccagcctcaaagggtcaactccatagatttcgttgagctcgagcatctgcagccagacgtgttggtgcacgcagtgctgagagtggtggactttactatcctgaccgaagctgtatactcctataggggacagaaacagaagaaggtgatgctcactgtggaacaagcccaggaccagcattatgccctggtgctgtggggacccggtgcagcctggtatcctcagctgcaacgcaaaaaaggcgtcgtactaataaaggctcaaatcagtgagctggcgtttccgatcaccgcgagccagaagatcgcactcaacgcacattcaagtttgaagtctatctttagttctctgcccaatatagtgtataccggatgtgctaagtgcggcctcgagctcgaaacagacgagaatcgaatctacaagcagtgtttttcctgtctgcctttcactatgaaaaaaatttactatagacctgcgttaatgaccgcgatagacgggcgacacgatgtgtgcatccgggtggaatctaaactgatcgagaagatcctgctgaatataagcgcagactgtctgaaccgggttattgttccatctagcgaaatcacctatgggatggtggtggcagacctatttcactctttgctggccgtgagcgccgagccatgtgttttgaaaattcaatctctgttcgtgttggacgagaactcatacccactgcaacaggactttagtttgctcgacttctaccccgacatcgtaaagcatggtgccaacgccaggctttag

SEQ ID NO: 47438 - DNA, 2715 bp, Artificial Sequence
  Description of Artificial Sequence: Synthetic coding sequence
atgagcggcggcagccaggtgcacatcttctggggcgcccccatcgctcccttaaagatcactgtgtcggaggacactgcaagtcttatgagcgttgccgatccatggaaaaagatccaattgttgtacagccaacactctctatacttaaaagacgaaaaacagcacaaaaatctggaaaactacaaggtcccagagtcaatcggatctccggacctgagtggtcattttcttgccaactgcatgaacagacatgtgcacgtgaaggatgattttgtccgaagtgtatcagaaacccagaatatcgaatcccagaagattcattcttcgcgcctgtccgatattacctccagcaacatgcagatctgtggttttaagagcactgttcctcacttcaccgaggaagaaaagtaccagaagttgttgtctgagaataaaatcagagacgaacagccaaaacaccaacctgatatatgcggaaaaaattttaacacgaatctatttcagttagggcataaatgtgctgccgtgctcgatctggtgtgtagcaccgagaagattaacatcggacctgaggtggtgcaacgcgagtgtgtgccgacagagtatcatgagatacagaatcagtgtctcggtctgttcagctcaaatgctgtggacaagtcgcggagcgaggccgcagtgagaaaggtgagtgatttaaaaatatcaaccgatacagaattcctctctattataacctcctcacaggtggcctttctggctcaaaagaaggacaaaagaagatctccagttaataaaggtaacgttaatatggagacggaacccaaagccagttacggggaaattaggataccggaggagaattccatccagctggacgggtttacagaagcctacgagagtggacagaaccaagcatactcactcgaactgttcagtccagtgtgccccaagacagagaacagccggatacacattaattctgataaggggttggaggagcacactgggtcccaggaacttttttcatccgaggacgagcttccacctaatgaaattcgcatagaactttgttcatcaggcatactgtgcagccagctcaacacattccataagtcagccattaaacgaagctgtacatctgaggacaaggtcggtcagtccgaggctctaagtcgcgtgcttcaagtcgctaaaaagatgaaattaatttcgaacggaggtgattccgccgtcgaaatggacagacgcaatgtgtctgaattcaagtcaataaagaagacatccctcattaagaattgcgactccaaatcgcagaagtacaactgtctggtaatggtcttgtccccttgccatgtgaaggagatcaacattaagtttggtccaaatagcggcagcaaggtcccattggcaacggtgactgtcatcgaccagagcgaaacaaagaagaaagtctttttgtggagaacagctgcgttttgggccttcacagtatttctgggagacatcattcttctgaccgacgtggtgattcatgaagatcagtggatcggcgaaactgtgctgcaaagtaccttttctagtcagctcctcaatctcggatcttactcaagtattcaaccagaggaatatagctccgttgtgtccgaggtggtcctgcaagatctcctggcctacgtctcctcaaagcattcttatctgcgggatctgccgcctagacagccgcagcgggtaaactctatcgactttgtggaattagagcatctgcaaccagatgtacttgtgcatgccgttttacgggttgtagatttcaccatcctcaccgaggctgtgtactcttatcgcggacagaagcaaaaaaaagtgatgcttactgtcgagcaggcacaggatcaacactatgcactggtgttgtggggtcccggtgcggcgtggtacccccagttacagcggaaaaaaggttatatctgggagtttaaatatctgtttgttcaatgtaattataccttggagaatctggagttacatactacaccatggtcttcatgcgaatgcttgtttgacgacgatataagggctatcacgttcaaggctaaatttcagaaatccgctcctagctttgtgaagatttccgatctggccacacatctggaagataaatgcagcggggtggtgctgattaaggcacagatctccgagttagccttccccattaccgcatcccagaagatcgccttgaatgctcacagctcacttaaatctatcttttcctcactccccaatatagtttacactgggtgcgctaagtgtgggctggaactggaaacagacgagaaccggatctataagcaatgcttttcctgcttgccattcaccatgaagaaaatttactataggcctgctttgatgaccgctatagacggtcgtcacgacgtctgtatccgtgtggaaagtaagctaattgaaaaaatcttactgaacatctccgccgactgtttgaaccgtgttatcgtgccctcttcggagatcacgtacggcatggtcgtggccgacctttttcactcattattggctgtaagtgccgagccttgcgttctcaaaatccaatctctgttcgtgttagacgagaattcttatcccctgcagcaagatttttccctgctggacttctaccccgacatcgtaaaacatggcgcaaacgcacgactgtag

SEQ ID NO: 47439 - DNA, 1680 bp, Artificial Sequence
  Description of Artificial Sequence: Synthetic coding sequence
tgagacgagctgccccccaacgagatccggatcgagctgtgcagctcagggattctgtgctctcaactgaacacatttcataaaagtgccattaagagatcctgtacgtccgaggataaagtgggccagtctgaggccttatcacgcgtcctccaggtggctaaaaaaatgaagctgatctcaaacggaggagatagtgcggtggagatggatcgccgcaacgtcagcgaattcaaatccatcaaaaaaacaagccttatcaagaactgcgactcgaaatcccaaaagtacaactgcctcgttatggtgctctctccatgccacgtgaaggaaatcaatatcaagttcggcccaaactctggttctaaggtaccgctagcgacagtgaccgttatagatcagtctgagacaaaaaaaaaggttttcttgtggaggactgcagccttctgggcgtttaccgtgttcctgggcgacatcattctgcttactgatgtagtgatccacgaggatcagtggataggggaaacggtgctgcagtctacattttcctcccaattgctgaatctgggctcttactccagcatacaacctgaggaatacagcagtgtggtgtcagaggtggtgttacaagatctgttggcgtacgtaagctcaaagcattcatatcttagggatctgcccccaaggcaacctcaacgggtgaacagcatcgacttcgttgagctggagcaccttcaacccgacgtgctggtgcatgccgttctgcgagttgtggacttcaccattctcacggaggcggtctactcttacaggggtcagaagcagaaaaaagtaatgttaacagtggagcaggcccaggatcaacattacgcacttgtgttatggggacccggtgctgcatggtatccccagcttcaacggaaaaagggctacatttgggaattcaagtacttgtttgtccagtgcaattacactttagagaacttggaattacatacgaccccttggtcctcttgcgagtgtcttttcgacgatgacatcagggctataacattcaaggcaaagttccaaaaatctgctccctccttcgtgaagatctcagatctcgctacacacctcgaggacaagtgctccggcgtggtgttaataaaagcccaaatctccgagctggctttccccattactgcatcgcagaaaatcgcgctgaatgcgcactccagccttaaaagtatttttagcagtttaccaaatatagtgtatactggctgcgctaagtgtgggctggaactggagaccgacgaaaaccgcatttacaagcaatgcttttcttgccttcccttcacgatgaagaaaatctactataggcctgccctcatgactgctattgacgggcgccacgatgtttgcattagggtagaatcaaagttgattgagaaaatcctgctgaacatctcggcagactgcctgaatcgcgtgatcgtaccatcgtccgagataacatatggaatggtggtggcagacctctttcactctctgctggcagtgagtgccgagccgtgtgtacttaaaatccaaagcctgttcgtgttagacgagaatagctatcctctacagcaggacttcagtctgttagacttctatcccgatattgtgaaacacggagctaacgctcggctctag

SEQ ID NO: 47440 - DNA, 2508 bp, Artificial Sequence
  Description of Artificial Sequence: Synthetic coding sequence
atgagcggcggcagccaggtgcacatcttctggggcgcccccatcgctcctctgaaaataacagtatctgaggacaccgcctcgctcatgtccgtggccgatccatggaagaagatccagcttttatattcccagcactctctgtacttaaaagacgagaagcagcacaaaaatttggagaactacaaagttccagagagcattggttcccctgacttaagcggccacttcctggctaattgcatgaacagacacgtccacgtgaaagacgactttgtgcggagcgttagtgagacccaaaatatcgagtcccagaagattcatagctctagattgtccgacatcacttcaagtaacatgcagatttgcggctttaagtccacagtacctcattttaccgaggaggaaaagtaccagaaactgttgagtgaaaacaagatcagggatgaacagcccaagcaccaacccgacatctgtggaaagaatttcaataccaatctttttcagctggggcacaagtgtgccgccgtgttagacctggtctgctctacagaaaagatcaacattggtcccgaagtcgtgcagcgggagtgcgtccccactgagtatcacgagatccagaaccagtgtctgggactattttcgtctaatgccgtcgacaagagtcgtagcgaggctgcggtgcgtaaggtgtcagacctcaaaattagcactgacacagagttcctcagcatcattacttccagtcaagtcgcttttctagcccagaagaaggacaaaagacggtctcccgtcaacaagggcaacgtgaatatggaaacagagccaaaggcctcttacggggagattaggatccctgaagagaactccattcaactagatggcttcacagaagcctatgagagtggccaaaatcaggcctatagcttggagctattctcccctgtgtgtccgaagacagaaaacagcaggatccacattaacagcgacaaaggcctggaagaacacacaggatctcaggaactgttttcaagcgaagatgagctgccacctaacgagattagaattgagctatgcagtagcgggattctctgttcccagttgaatactttccacaaaagcgctatcaagaggtcatgcacttccgaggacaaggtcggtcagagtgaggctctgtccagagtcttacaagtggctaagaagatgaagctgatttcgaacggcggtgatagcgccgtggagatggatagacgcaatgtgtcagagtttaaatctattaaaaagacctctctcattaaaaattgtgactctaagagccaaaaatataactgtctggtcatggttctttcaccttgtcatgtgaaagaaattaacatcaagttcggccccaatagtggaagcaaagtgccgctggccacggtgaccgtgatcgatcaaagtgaaaccaagaagaaggttttcctctggaggacagcagcattctgggcatttactgtttttctgggcgatatcattctgttgacagatgttgtcattcacgaggaccagtggattggagagactgtccttcagagcacattcagctcccagctgctgaatctagggtcctacagctccatccagccagaggagtatagctccgtcgtttcagaagtggtgctccaggatttactcgcctatgtgtcaagcaagcactcttacctgagggacctgccacctaggcagccgcagagagtaaactcaattgattttgtggaactcgaacatctgcagcctgacgtgcttgtgcatgcggtcctaagagtggtggatttcactatactcacagaggccgtatattcttatcgcggacagaaacagaagaaagtgatgcttacagtagagcaggcccaagatcagcactacgccctagttctgtgggggccaggcgctgcatggtaccctcaattgcagaggaagaaaggagtcgtcctgataaaggcgcaaatctctgaactggcgtttcctatcacagcttctcagaaaatcgccctgaacgcccactccagcttgaagtctatcttttccagtcttccgaacattgtctacacggggtgtgcgaaatgtggactggagctcgagacagatgaaaataggatctacaagcaatgcttttcctgtctgccgtttacgatgaagaaaatctactacagaccagcactcatgacagcaattgacggccgccacgacgtctgtattagagtcgagtctaagctcatagagaaaatcttactaaacatatccgccgattgcctgaaccgtgtgatcgtgcccagctcagaaatcacctacggaatggtagtggcagatctgttccactccttattggccgtgtcagcagagccatgcgttcttaaaatccaatcattgttcgtgcttgacgagaactcctacccgctgcagcaggactttagcctgctggatttttatcctgacattgtgaagcacggtgccaacgcccgtctctag

SEQ ID NO: 47441 - DNA, 732 bp, Artificial Sequence
  Description of Artificial Sequence: Synthetic coding sequence
atgctgaccgtggagcaggcccaggaccagcactacgccctggtgttgtggggcccaggagcagcatggtacccgcagctgcaacggaagaaaggctacatatgggagtttaagtacctgtttgtacagcgcaactacaccctcgagaatctcgagctgcacacaactccctggtcgtcttgcgaatgtctatttgatgatgacatccgtgcgatcacctttaaggccaagtttcagaaaagtgcacctagctttgtgaagatcagtgacctcgccacccatctggaggataagtgcagcggcgtagtgttgattaaagctcagatcagcgaactggctttcccattgacagccgcccagaagattgcactgaacgcccactcttctctgaagtctatcttctctagcctgccaaacatcatctacaccgggtgtgccaaatgtggactcgagctggaaaccgatgaaaaccggatctataagcagtgtttttcttgcctaccattcacaatgaagaagatttattaccgtcctgctttgatgaccgctgtcgacggtcgccacaacgtgtatatccgggtggagtctaaacttattgagaagattctattgaatatcagtgcacactgcttgaatagagtcataggaaatattagcagaagcccgatgggatggctctggcagacctgttcaactccgtgttggcagtcagcccaaaatctagtgtactag

SEQ ID NO: 47442 - DNA, 639 bp, Artificial Sequence
  Description of Artificial Sequence: Synthetic coding sequence
atgctgaccgtggagcaggcccaggaccagcactacgccctggtgctatgggggccaggggcagcgtggtacccgcaacttcagagaaagaaaggcgtagtgctcattaaagctcagatcagtgaactggcattccctttgaccgcagcacagaagatcgccctgaatgcacatagtagcctgaagtctatcttttcctccctcccaaacattatctacaccgggtgtgccaaatgtggtcttgagctggaaaccgatgaaaaccgcatttataaacagtgcttctcctgtctgcccttcactatgaaaaaaatttattaccgccctgcactgatgaccgcagtcgacggcaggcacaacgtatatatccgcgtggagtctaagctgattgagaaaattctcctcaacattagtgcacattgtctgaatagggttattgtcccttcctccgagataacatacggaatggttgtggccgacttgttccactctttgctggccgtttccgcggaaccgtgcgttctgaaaattcagtcactgttcgtgctggacgaaaattcttacccgttgcagcaggacttcagccttctcgatttctaccccgacatggtcaaacacggagccaatgctcggctgtag

SEQ ID NO: 47443 - DNA, 2505 bp, Artificial Sequence
  Description of Artificial Sequence: Synthetic coding sequence
atggaggaccccgccgcccccggcaccggcggcccccccgccaacggcaacggaaacggcgggggcaaaggaaaacaggccgccccaaaggggcgagaggccttccgcagccagcggcgcgaatcagaggggagcgtggattgcccaactttggaatttgaatacggagacgccgacggacatgccgccgagttaagcgagctgtactcatatacagaaaacttggagttcaccaacaatagacggtgcttcgaggaggatttcaaaacccaggtacaggggaaggaatggctggaattagaagaggacgcgcaaaaggcctacattatggggctcttagatcggttggaggtcgtgtctagagagaggcggctgaaagtcgcgcgtgccgtgctgtacctggcccagggcacattcggagagtgtgatagtgaagtggatgtcctgcattggtctcggtacaattgctttctcctgtatcaaatgggcactttctccacattcctcgaactgctgcacatggagatcgacaacagtcaggcctgttccagtgccctccgcaaaccagcagtcagtattgcagactctacggagctccgagtgctgctgtctgtcatgtatcttatggtggaaaatataaggctggaacgggagactgacccttgcgggtggcgaaccgcccgggagacctttagaactgaactttctttttcgatgcacaatgaggaaccgttcgccctccttctcttttctatggtgaccaagttctgcagtggcctcgccccgcacttccccataaaaaaggtgcttctgctcctgtggaaagttgtaatgtttacattaggaggatttgagcatcttcagacattaaaggttcagaaaagggccgaattgggactcccacccctggctgaggatagcattcaggtggtaaaatccatgcgggcagcgtcacctcccagctacacccttgatctgggggaaagccagttggcccctcccccctcaaagctgcgaggacgccgcggtagtcgtcgtcagctgttaaccaaacaggacagccttgatatctacaacgagcgtgatctgtttaagaccgaggaacctgcgaccgaggaagaagaggagagcgctggtgatggcgagagaacccttgatggagaactggacctgctcgagcaggatccgctcgtccctcctccccccagccaagcaccattatcagctgaacgagtcgcctttcctaaggggctgccttgggcgccaaaagtacgtcagaaggatatagagcacttcctggaaatgtcccgcaacaaattcataggctttactcttggacaggatactgataccctggtggggctaccaaggcccattcatgagtccgtcaagacattaaaacagcataagtacatatctattgccgatgtacaaatcaaaaacgaagaggagcttgagaagtgccctatgtctctcggcgaggaggtggtcccagagaccccatgcgagattctctaccaggggatgctgtatagtctcccacagtacatgatcgcgcttctgaaaatcttactggctgccgcccctacaagcaaggctaaaaccgactcaattaacatactggctgacgtactacctgaggagatgcccataaccgtcttgcagagtatgaaactcggcattgacgtgaatagacataaggagatcattgtgaaatccatcagtaccctcttgcttcttctgttaaaacattttaaattgaaccatatctaccaattcgagtatgtctcccagcacttggtgttcgccaactgcatccccctgattttaaagttttttaaccaaaacattctttcatatatcactgcaaagaactcgatcagcgttctggactacccttgttgtactattcaggacctccccgagctcactactgaaagtctggaggcaggagacaactcccagttctgttggagaaatctgtttagttgcatcaacctgttgaggcttctgaataaacttactaaatggaagcatagccgaactatgatgttagttgtgttcaaatccgccccgatccttaagagggcccttaaagttaagcaggcaatgctgcagctctatgttctgaaattgcttaagctccaaaccaagtatttggggcggcaatggagaaaatcaaatatgaaaactatgagcgctatctatcaaaaggtgcgccaccgtatgaacgacgattgggcatacggcaatgacatcgatgccagaccatgggattttcaggcagaggagtgcaccctgcgtgcgaatattgaagcctttaattcacgtcgttatgatagaccccaggactccgaattttcacccgtcgacaactgtctccagtctgtactgggccagcgccttgacctcccagaggatttccactattcctatgaactgtggcttgaaagagaagtgttctcgcaaccaatttgctgggaagaactgctgcagaaccattag

SEQ ID NO: 47444 - DNA, 2277 bp, Artificial Sequence
  Description of Artificial Sequence: Synthetic coding sequence
atggaggaccccgccgcccccggcaccggcggcccccccgccaacggcaacggcaacggaggaggaaaagggaagcaagctgctcccaaggggcgggaagcctttagatctcagagacgggagagcgaaggttcggttgactgcccaaccctcgaattcgagtatggggatgccgacgggcacgcagccgagctgtcagagctttacagctatacagaaaatctggaattcacaaacaacaggaggtgcttcgaagaggacttcaaaacacaggtgcaggggaaggagtggctggagctagaggaagatgcccagaaagcctacatcatgggcctgttagatagacttgaagttgtgagccgtgaacgaagattaaaggtagctagagccgtgctgtacctcgcacagggaacgttcggggagtgtgactctgaggtggatgttttacactggtcgaggtataactgcttcctgttgtaccagatgggaacgttctctacattcctagagttgctgcatatggaaattgataattcgcaggcatgtagcagcgcactgcggaagcctgccgtttcaattgctgacagcacagaactgcgcgtgctgctcagcgtgatgtaccttatggtcgaaaatataagacttgagagagaaactgacccttgcggttggagaacagccagagagacattcagaactgaactgtcattctccatgcacaatgaagagccgttcgccctgctcctgttcagtatggtaaccaagttctgctctggcctggcgccccacttccccattaaaaaagttctcctgctgctttggaaagtagtaatgttcaccctaggcggtttcgagcacttgcagaccctgaaggtgcagaagagagctgaactgggcctgccccccctggccgaggactcaattcaggtggtgaagagcatgagggcagcttctccgccttcttacaccttggacttgggggagtcacagttagccccacctccatctaagctgcgcggcagacggggctcaagaaggcaactcctgaccaagcaggacagtcttgacatctacaatgaacgggatctttttaaaacagaagagccagcaactgaagaagaagaagagtccgctggtgacggcgaaaggaccttagacggagaactggatttactcgaacaggacccactggtgccacccccaccatctcaggccccattgagcgcggaaagagttgcctttccaaagggcctcccttgggcgcctaaagttagacaaaaggatatcgaacactttctggagatgtctcgaaataaattcatcggattcacactaggccaggacacagatactctggtaggactgcccaggcccatccacgaatctgtgaagacactcaagcagcataagtacatctcaattgctgatgtccagatcaaaaacgaagaagaattagaaaagtgccccatgtccttgggcgaggaagtggtgcctgagaccccgtgtgagattctataccagggcatgctttacagtctcccacagtatatgatcgccttgctaaaaattctgctggctgcagcccccacaagcaaggctaaaaccgattccatcaatattctcgctgatgtccttccagaagagatgcccatcactgttctccagtctatgaagctggggatagatgtgaaccgtcacaaagaaattatcgtgaagtcaatcagtacccttctgctgctattactcaagcatttcaagctgaaccacatctatcaatttgagtatgttagccagcacttggtctttgccaactgcatccctctgatcctgaagtttttcaaccagaatattcttagttacatcaccgctaagaattccatctcagtgttagattacccctgttgtactatccaggatttacctgagctcaccacggaaagccttgaggcaggggacaattctcagttttgctggcgaaacctttttagctgtattaacctgctgcgactcctgaataagcttaccaagtggaagcattctcggacaatgatgctcgtcgttttcaagtccgctcccattctcaagcgtgccctgaaagtgaaacaagctatgcttcagctgtacgtccttaagcttctgaagctccagaccaaatacctcggtcggcagtggcgaaaaagcaacatgaagacaatgtccgccatatatcaaaaagtcaggcacaggatgaatgatgactgggcttacggtaacggtgaaagctcgcagagttcctag

SEQ ID NO: 47445 - DNA, 636 bp, Artificial Sequence
  Description of Artificial Sequence: Synthetic coding sequence
atgttcagccagggcctgtgcagcgacagcatgttccccgagatgtggcgccccgtggacatgggctggcctcagacgaggatgccgcgggtacggtcattgcacgcatacccaccattcttcccattgcagcaactgctcactaaacaagattccttagacatttacaatgagcgcgatctgtttaagacagaggaacccgccacagaggaggaagaggaatctgcaggcgacggggagcggactctggacggggaacttgacctcccctgggccccaaaagttaggcagaaggatatcgagcacttcctggagatgagtaggaataagttcatcgggtttaccctcggacaggatacagacaccctggtgggactgcccaggccaatccacgagtcagttaaaacgttaaagcagcacaaatatatcagcattgcggacgtgcaaataaagaatgaagaggagctcgagaaatgcccgatgagcctcgtctcacaaggctccccaacgcaggaggaatcacgcaggaaacccgtgttctccgtagtgaccgagcacgtgtgcatgcattctttctctattctgggctgtaattgcgtgcccggaggaaggggtggaactagggacgccatgtag

SEQ ID NO: 47446 - DNA, 1272 bp, Artificial Sequence
  Description of Artificial Sequence: Synthetic coding sequence
atgctgccctggaagaagcacaagttcgagctgctggccgaggccccccccaggcaagcctccaagccgaagggatacgcagtgtctctccactacagcgccctatcctccctcgcccgcgcatgccccgagggcgcccttagccgtgttggaagcatgtttagaagtaaacgaaaaaaattgcacatcacaagcgaggaccccacctacaccgtcctgtacctgggaaacgccacaaccattcaggcccggggtgatggttgtactgacttggcggtgggaaagatatggagcaagtctgaagccggtcggcagggcaccaagatgaaattaaccgtcagcgctcaggggatccggatggtgcacgctgaagagcgggctttgcggagacccggacacctgtatttgcttcacagggtcacctactgtgtggcggatgcaaggttacctaaggtgtttgcctgggtttacaggcacgagctgaaacataaggccgtcatgctgcgctgtcacgctgtcctggtgagcaagccagagaaggctcaagccatggctctgctcctctatcagacctccgccaatgccctggccgagtttaagaggttgaaacggagagacgacgcgagacatcagcagcaggaactggtgggtgctcacaccattccccttgtccccctgaggaagctgctcctccacggcccatgttgttacaaaccacccgtggagaggtcccgatcggctcctaaactgggctctatcactgaggatttattgggagagcagctggagcaggaactgcaagaggaggaggaggaggagcaaccagaaggatgtccagaggaggaagagaacagagccgccgagggagatcctgccgaggaggaggcagaagctcaacgcgctctggtcgtagcaatgcacttcgaatgtggggatctgctagataccctcgaaaatgggcgaggagaggcccttggcggtgggggggggtccctgggtccaggagccggacctcccccgcttttgcttggcagtgccagtgatatgaaggccgaactgtctcagttaatttcagatctcggcgagctttcctttggtaatgatgtgcgtacactacaagcagacttaagggtgacacgactcctgagtggcgactctactgggtcagagtcgtcgattgaagggggcgggccagatgcgactagcgcgacagcaggggatagctcgaggcaagccgacggtgcctctgctgacgaacctcattccgggtag

SEQ ID NO: 47447 - DNA, 990 bp, Artificial Sequence
  Description of Artificial Sequence: Synthetic coding sequence
atgctgccctggcggcggaacaagttcgtgctggtggaggacgaggctaaatgcaaggccaagagtttgtcgcctgggctagcttacacttccctgctgtcgtcatttctgcgctcttgtcctgacttactcccagattggcccctcgagcggctggggcgcgtttttagatctcgtagacagaaagtggagctcaataaggaagatcccacatatactgtatggtatctgggaaacgcggtcacgttgcacgccaagggcgatggatgtacagatgatgccgtcggcaagatctgggcaagatgtggtccaggcggcggaactaaaatgaaactcactttgggaccacatggaatccgaatgcagccttgtgagaggtctgccgcaggaggatcaggaggcaggagacccgcccatgcatatctactgccaagaattacttactgtacagccgacgggagacacccccgggtgttcgcctgggtgtaccgccaccaggctagacataaggcggtggtcctccgatgtcacgctgtattactcgctcgcgcccacaaggcacgggctctagccagactcctgaggcagacagccctagccgcattctccgacttcaaacggctccagcgccaaagcgatgctcgtcatgtacgccaacagcacctcagggctggcggagcagccgcgtccgtgcctcgagctccccttaggcgactgttgaacgcaaagtgcgcatatcgtccccccccttctgagaggtccagaggcgctccccgcctttcaagtatacaggaagaagacgaggaggaagaagaggacgacgcagaggaacaggaagggggagtcccacagagggaacgccccgaggtcctgagcctcgccagagagctgcgcacatgttccctgcggggagcccccgcccctccccctcccgcacaaccacgccgatggaaagccggaccccgggaaagagctggacaagctagatag

SEQ ID NO: 47448 - DNA, 1074 bp, Artificial Sequence
  Description of Artificial Sequence: Synthetic coding sequence
atggccgccgccgaggtggccgacacccagctgatgctgggcgtgggacttatagagaaggacaccaacggagaggtcttgtgggtctggtgctatccaagcacaaccgccactcttcggaacctgttgttacggaagtgttgtctgaccgacgagaataaattgctgcatcctttcgtcttcggacagtaccggaggacatggttctacattacgacaatcgaagtgcccgattcatcaatactgaaaaaagttactcatttctcgattgttctgactgctaaggactttaacccagagaagtatgccgccttcacacgaatcctatgcaggatgtacctaaaacatgggagtcctgttaaaatgatggaaagttatattgccgtgctgactaaaggcatatgccagagcgaggagaacggaagttttctgtcaaaggacttcgatgcaaggaaggcctacctggctggatctattaaggatattgtcagccagtttggcatggagaccgtgatcctgcacacggcgcttatgctcaaaaaacggatcgtcgtgtaccacccaaagattgaggctgtgcaggaattcactaggaccctccccgcgttagtttggcatcggcaggactggaccattctgcacagctacgtgcacttaaacgccgatgaactggaagccctgcagatgtgcaccggttatgtggctgggttcgtcgatctcgaagtctcaaacaggccagatttgtatgatgtttttgtgaatcttgccgagtcagagataaccatcgctccccttgcaaaggaagcaatggcaatggggaaactgcacaaggagatggggcagctcatcgtgcagtctgcggaggatcccgagaaaagcgaaagccatgtaatccaggatatcgctctcaaaactagggagatcttcacgaatctcgctcctttctctgaagtctctgccgacggcgagaagcgagttttaaatttagaggctctgaaacagaagcggttcccccccgcaacggaaaacttcctgtaccatctggcagcagccgaacaaatgctgaagatttag

SEQ ID NO: 47449 - DNA, 603 bp, Artificial Sequence
  Description of Artificial Sequence: Synthetic coding sequence
atggccgccgccgaggtggccgacacccagctgatgctgggcgtggggctgatcgagaaggacactaacggcgaagttttgtgggtatggtgctatcccagtacaactgcaaccctgcgcaacctgctcctacgaaagtgttgccttactgatgaaaataagctgctccacccctttgtctttggtcagtaccgaaggacttggttctacataacgaccatcgaagttcctgatagttctattctaaagaaggtgactcattttagtatcgtgttaacggccaaggattttaaccctgagaaatatgcagctttcactcgcatcctgtgtagaatgtacctgaagcacggatccccggtgaagatgatggagtcctatatcgccgttctgactaaggggatttgtcagagcgaagaaaacggtagtttcttatcaaaggactttgacgcgcggaaggcctaccttgccgggtctataaaagggttgtgcctgccttggtgcggtactgatagaacaggtccttcttttacacttacctgtaccagcacacctatgagttggaagccctgtcggtgcgctcaagtcaccagcctggacttatag

SEQ ID NO: 47450 - DNA, 621 bp, Artificial Sequence
  Description of Artificial Sequence: Synthetic coding sequence
atgctgcccagcctgggctactgcgtggacatcgtgagccagttcggcatggaaactgtcatcctgcatacagccttgatgctcaaaaagaggatagtggtttaccaccctaagatagaagcagtgcaagaatttacaagaaccctgcctgccctggtgtggcatcgccaggattggacgattctccactcctatgttcatttaaacgctgacgagctggaggccttgcagatgtgcaccggctacgtcgcaggtttcgtcgacctcgaggtttctaatcgcccagatttgtatgatgtgtttgtcaatctcgccgagtcagagattactattgcccctctcgccaaagaagcaatggctatgggaaaactgcataaggagatgggccagctaatcgttcagagcgctgaggaccctgagaagtctgagtctcacgtgatccaggatatagcgcttaagactcgcgagatcttcaccaacctggctccatttagtgaagtgagcgccgacggcgagaaaagagtgctgaatctggaggctctgaaacagaagagatttccaccggccacagagaactttctgtatcatttggccgccgctgaacaaatgcttaagatctag

SEQ ID NO: 47451 - DNA, 666 bp, Artificial Sequence
  Description of Artificial Sequence: Synthetic coding sequence
atggccgccgccgaggtggccgacacccagctgatgctgggcgtggggctgatagaaaaagacacaaatggagaagtgctctgggtgtggtgctacccgagcactaccgcaaccctgcgcaacttgcttctgagaaaatgctgcttgacagatgagaataaattactccacccgttcgtttttggccagtataggcgtacatggttttacattactactatcgaagtgccagattcctcgatccttaagaaagtgactcatttctcgatcgttctcaccgcaaaggatttcaatccagagaagtacgctgccttcactaggatcctgtgccgcatgtatttaaaacatggctcacctgtcaaaatgatggagtcgtatatcgccgtgcttacaaaaggcatatgtcaatcagaggagaacgggagcttcctttctaaggatttcgacgctagaaaggcatacttggccggctccatcaaggacatcgtctcccagtttggaatgaattgttatcttacacacagcactgacgcaaaagagaagaattgcggggtatctccccaagacagatccggtccaggagttcaccaggattcagcgtgtccgggtgtcgcgccaaccggcctcgaccacccgagcctgctccgcgccccccaaaggagatag

SEQ ID NO: 47452 - DNA, 1386 bp, Artificial Sequence
  Description of Artificial Sequence: Synthetic coding sequence
atgcaccagcggtacttctggaccgaccagggccaggtggccctgggaggtcactacatggccgagggagagggttattttgccatgtcggaagacgagttagcatgttctccctatattccgctgggaggtgacttcggtggcggagatttcggcggcggagacttcggtggaggagatttcggcgggggtggaagctttgggggacattgcctggactattgtgagtcccccaccgcccactgtaacgtcttgaattgggagcaggttcaacggctggatggcatcctctcggagactatacccatccatggcagaggcaatttccccaccctggagctccaaccgtctctgattgtcaaggtcgttcggcgccgcctcgctgaaaaaaggatcggggtgcgggacgtacgtttaaacggtagcgcggccagccatgtgttgcaccaggattctggactgggttataaggacctcgatttaatcttttgcgcggatttgagaggggaaggggaattccagactgtcaaggacgtggtccttgactgccttctcgatttccttcccgagggggtgaataaggagaaaattacccctctgactctgaaagaggcctatgtgcaaaaaatggtaaaagtgtgtaacgacagcgacagatggtcactgatttccctgagtaataattccggaaaaaacgtcgaattgaaattcgtagactctctgcggcgtcagttcgagttctcggtggattcattccagataaagctggactcactcctccttttctacgaatgcagcgagaaccccatgacggagacgtttcaccccaccatcattggggagtccgtctatggcgatttccaggaagcctttgatcacctttgcaataaaatcattgctacccgcaatcccgaggaaattagaggaggagggctattgaagtattgcaatctgcttgtgagggggtttaggcctgcctccgatgagatcaaaacactacaaaggtacatgtgctcaagattctttatcgactttagtgatattggtgaacagcagaggaagctagaaagttacctccagaatcacttcgtcggcctcgaagatcgaaagtatgaatacctcatgactctgcatggggttgttaacgaatccaccgtttgccttatgggacacgagcggcggcagacactaaatttgattactatgctggcaatccgggttctggcggatcagaacgttatccccaatgtggctaatgtaacttgctactatcagcctgccccctacgtggctgatgcgaattttagcaattactacattgctcaggttcagcccgtgttcacatgtcaacagcagacctatagtacctggctgccctgcaactag

SEQ ID NO: 47453 - DNA, 1572 bp, Artificial Sequence
  Description of Artificial Sequence: Synthetic coding sequence
atgcagatgcggcgggtgtggcggacctgccggagcggcccccggaagagacgcgaagcgcgatataagaagtctacggaggatatttttccggcccagcttctgaaactgcagaggcacgaacgcgtatggcaacaggaaccacccgtgagagaccacagatcttggggcgggtctggagccggaggcgtggccggccgggagtggacggatcagggtcaagtagctttgggcggacactatatggccgaaggggagggatacttcgccatgtccgaggacgaactggcctgtagtccctacatcccacttggaggtgatttcggcggaggcgatttcggtggaggagactttggcggcggggattttggtggggggggtagttttggcggccactgcctcgattactgcgaatcaccgaccgcacactgcaacgtgctcaactgggaacaggtccagaggcttgacggaatcctctctgaaaccattccaatccacgggcgaggtaacttccctaccttagaactgcaacctagtttgattgtgaaagtcgtccgaagacggcttgcagagaagcgcatcggggtgcgagacgtccgactgaatggctccgctgccagccacgtgctgcaccaagatagtgggttggggtataaagacttggaccttatattttgcgccgatctcaggggagaaggggagttccagaccgtgaaggacgtcgtcctagactgtctgctcgacttcttgcctgagggcgtgaacaaggagaagataacgcctctgacccttaaggaagcctacgttcagaaaatggttaaggtctgcaatgatagtgaccgctggtctctcatttccctcagtaacaatagcgggaaaaatgtagaactcaaatttgtagattctttgcgcagacagtttgaattctcagtggatagttttcagattaaattagattcccttctccttttctacgagtgttctgaaaatccgatgacggagacctttcatcctactattataggggaaagtgtgtacggtgattttcaagaagcctttgatcacttgtgtaacaaaataatcgccactaggaaccccgaggaaatccgaggaggtggcttacttaagtattgcaatctcctggtgaggggattcagacccgcctcagatgaaatcaagacacttcagcggtatatgtgtagtcggttcttcatcgacttttctgatataggcgagcaacaacgtaagctggaaagctacttacaaaaccattttgtcggcttggaagatagaaagtatgaatacctgatgaccctgcacggcgtcgtcaacgaaagtacagtgtgccttatgggacacgagagacggcagaccctgaatctcattaccatgctggcgattagagtcctcgccgaccagaatgtgatccccaatgtggccaatgtaacttgttattaccagcctgccccttacgttgctgatgcaaacttcagtaactactacatcgcacaagtgcagcccgtgttcacttgccagcagcagacctacagtacctggctgccatgtaattag

SEQ ID NO: 47454 - DNA, 267 bp, Artificial Sequence
  Description of Artificial Sequence: Synthetic coding sequence
tgaaagcggatcggcgtgcgggacgtgcggctgaacggcagcgccgcgtcccacgtgcttcaccaggactcgggactcggctacaaggatttggatctcatcttctgtgcagaccttaggggagagggagagtttcaaactgtcaaggacgtggtgctcgattgcctcctggattttctaccagaaggcgtgaataaggaaaagattacgccactcaccctgaaagaggaatcacacacaacaacatacttcctgaacatctcttag

SEQ ID NO: 47455 - DNA, 261 bp, Artificial Sequence
  Description of Artificial Sequence: Synthetic coding sequence
tgacaggacagcggcctgggctacaaggacctggacctgatcttctgcgccgacctcaggggcgaaggagaattccaaactgtgaaagacgtagtcttagactgtctgctggatttccttccagagggtgtgaacaaggaaaagatcacaccgttaaccctgaaggtctttcaccgccttctgaggcattggagggcagccgaaaaaaccggagttctgtttgcggaaccactatgcggaattggcagaccccaggtgtag

SEQ ID NO: 47456 - DNA, 1278 bp, Artificial Sequence
  Description of Artificial Sequence: Synthetic coding sequence
atgatgcccagcgagagcggcgccgagcggcgggaccgggccgccgcccaagtcgggaccgccgccgccaccgccgttgctacagccgctcccgcaggcgggggtcccgaccctgaggcgctgagtgcctttcccggacgccacctgtctggcctgagctggccccaggttaaacgactggacgctctgctcagtgaacccatacccattcatggtagaggcaacttcccaacattgtccgtacagcctaggcagatcgtccaggtcgtacgttcaactctggaagagcagggactacacgttcatagcgttcggctccatggctccgccgctagtcatgtgctccaccctgaatccgggctcggctacaaagacctcgatctcgtttttcgagttgacctgagatctgaggcctcctttcagcttacaaaggctgtggttctcgcctgccttctggatttcttgcctgctggagtgtcacgagccaagataaccccgctaaccctcaaggaggcatacgtacaaaagctggtgaaagtgtgtaccgacagtgacaggtggtctctgatttctctctctaataaatcaggaaagaatgtggaactgaagttcgttgatagtgtgagaaggcagtttgagttctccatcgactcttttcaaataatcctggatagcctgttgctgttcggccagtgctcaagcaccccaatgtctgaggcttttcaccctactgtgacaggcgagagcctctatggcgacttcactgaggcgctggagcacctccggcatcgagtcatcgcgactcggagcccggaagagatcagaggcgggggtctgttaaaatactgtcacttgctggtgagggggtttaggccccgacccagcactgacgtacgggctcttcagcgttatatgtgcagcagattttttatcgatttcccagatctagtggaacagcggagaacacttgagaggtatcttgaggcgcactttggtggtgcggatgccgctagaagatacgcctgtctggtgaccctgcacagggtggtcaatgagtccaccgtctgtttgatgaaccacgaacgccgacagaccctggatctgatcgcagctctagcgttgcaggccttagccgagcaaggacctgccgcaacagcagccctggcctggcggccaccgggcacagacggagtggtcccggcgaccgtgaactattatgtgacgcctgtccagcctctattggctcacgcttatcccacttggcttccctgtaattag

SEQ ID NO: 47457 - DNA, 1170 bp, Artificial Sequence
  Description of Artificial Sequence: Synthetic coding sequence
atgagcgagatccggttcaccaacctgacctgggaccaggtgatcacactcgatcaggttcttgacgaagtcattccaatccatggaaagggaaacttccctacgatggaggtgaagccaaaagatataattcatgtggtgaaggaccagttaattgggcagggcattattgtgaaggacgcaagacttaacgggagtgtggccagttacattctggcctcacacaatggaatttcctataaagatctcgacgtcatattcggtgtcgagcttcccggcaatgaggagttccaggtagtcaaagacgccgtcctggactgtctactcgattttctgcccaaagacgtgaagaaggaaaaactgtctcccgatatcatgaaggatgcatacgtgcagaagctggtgaaggtgtgcaatggacacgattgctggtccctgatcagtctgagtaataatactggcaagaacttagaattgaagttcgtgtcaagcctccgtcgtcagttcgagttcagcgttgatagcttccagatcgtgctcgaccccatgctcgacttctacagtgataaaaatgcaaagctgacaaaggagagctatccagttgttgtcgccgagtccatgtatggcgactttcaggaagccatgactcatcttcagcataaactgatctgtacccggaaacccgaagaaattagaggtggcggattgttaaagtattgcagtctcctggtgcacggatttaagccagcatgcatgtcggagatcaaaaacctggaacggtatatgtgttctaggttcttcatcgatttcccacacattgaggagcagcagaagaagattgaatcctacttgcataaccattttattggagaggggatgaccaagtatgattacctcatgacccttcatggcgtggttaacgaatcaacagtctgccttatgtcgtacgaaaggagacaaattctgcacctgatcactatgatggctctcaaggtgttgggagagctgaatatcctaccaaacacacagaaggtcacttgcttttatcaaccggcaccttattttgccgcagaagcaaggtacccaatatatgttattccagaacccccccccgtgtcatttcagccctaccatcctttacatttccgggggtccaatgggatgagctag

SEQ ID NO: 47458 - DNA, 1170 bp, Artificial Sequence
  Description of Artificial Sequence: Synthetic coding sequence
atgagcgagatccggttcaccaacctgacctgggaccaggtgatcactctcgatcaggtcctcgacgaagtgattccgattcacggtaaggggaacttcccaacaatggaagtgaaacccaaggacataatccacgtggttaaagaccagttgatcggccagggcattatcgtgaaggacgctaggctaaacggatcagttgcctcttatatcctggccagccataacgggattagctataaggatctggacgttattttcggtgtggagcttcccggaaacgaggagttccaggtggtcaaagatgccgtgctcgattgtcttctggactttctccccaaggatgtcaaaaaggaaaagctctccccggacatcatgaaagacgcgtatgtgcagaaactggtcaaggtgtgcaacggccatgattgttggagcctaatctctctgtctaataataccggtaaaaatctggagttgaagtttgtttcttcactgagacggcagttcgagttctccgtggattcctttcaaatagtgcttgacccaatgctggatttctattctgacaaaaacgcgaaattgacgaaagaaagctatcccgtagtcgtcgcagagtccatgtacggcgattttcaggaagctatgacacatctccagcacaaactgatttgcacaaggaaaccagaggaaatcaggggaggcgggctgctgaaatattgctctcttctagtgcatggctttaagcccgcatgtatgagtgaaatcaagaatcttgagcggtacatgtgctcccgcttttttattgactttccccacatcgaggaacagcaaaaaaagattgaatcctacctgcataatcatttcattggagagggtatgaccaagtatgattacctgatgacactgcacggcgtggtgaacgagagcacagtatgcttaatgagctatgaacgcagacagatactccacctgatcacaatgatggcgctgaaagtactcggagagctgaacatcctgcccaatacgcagaaggtaacatgtttttaccagcccgcgccctactttgcagccgaggctagatatcccatctatgtcatcccggagcccccccccgtatctttccagccttatcatcccctccacttcagaggctcaaatggaatgtcctag

SEQ ID NO: 47459 - DNA, 888 bp, Artificial Sequence
  Description of Artificial Sequence: Synthetic coding sequence
atgcagatgagcgtgccctgcgtgctgagcagcctgcagaaccacgagccaaataaaccacttttcaccacccagtctcaacttctgagtaaagtcttagaggtgctggatccggacaggaagctggaagacacgtgggcttactgccaggatactagaaagggcatgaaagaaccgactaagctcttgaagaagcactccactcaggtatacctcgggccctcaaaaaagaccagtgtatcaaatgcaggccagtggctgtatgaagaaaagccccataagatggatctgctccatgagaacggcccaaggcctggccttcatgagaatgtatgcaaggccgttagcgacttctgtaagtgggtcacaacattcggcattagtgatattgatgaggaattcatattgaagcagttcgatatcgactacgagactaagcccagccatgatgctctgcacacgatgaagctaaaccaggtgcctctcgagctaaagaggtccgtcgggctttccaagcttcaggagacggagttcttccagaagttaggatatgagcggaagctacaaaagcctcagaacccgtacaagcccaagtgggtcaaaatgcgctatggcgcctggtatttaaaccctaagctctggaagaaacagcgggtggacgagccccttgttgatcctgaggttagtcacaaggctcaagaagagaacttcaaaaaggaactgcaagaacaggaggagctgctggcagacctccatggaacagtagcttttaaggattttattctcagcagaggttatcgaaccccacgattcctggagaacatgtacatcggtaaggaatgtaagcgggcctgtaataaaaccccgatcaagcggacccaggcatag

SEQ ID NO: 47460 - DNA, 1056 bp, Artificial Sequence
  Description of Artificial Sequence: Synthetic coding sequence
atggccgaccggcggcggcggctgcggcccggcaccctggcccccgtaagggaaggcgttaactgcagatccagatgttttaccaagcacaagaacggcctcaaatttcccacctccctgcattctcgacagttagtctttcctaggaaaggcctggacgacttcagaaaagggtgccctccctgcacaggacttgtcacccaagtacccgttgagggtttcttgccgcaaatctaccatcgtgcaccacagcttgctccaaaaaagcggcaaataaagctactgaaggaagccgacgtgctgagcaaactcagtcccgcccagcaagctcgcaaagcattcctggaggatgttgaagcccatctgacaccacacccgcttgctttgtatctgaacctcgaggaagcaatgcctatagaactgctgtcaaaagtcctggaagtcctcgacccagatcggaagctggaggatacttgggcctactgtcaagatacaagaaagggcatgaaggaacctacgaagctgctgaaaaaacatagtacacaagtatacctaggaccttcgaaaaagaccagcgtgtctaatgctggacagtggctgtacgaggagaaaccgcacaagatggacctcctgcatgagaacgggccccggcccggcctccacgaaaatgggattagtgacattgacgaagagttcatcttgaaacaattcgacatagactatgagacgaagccatcccacgacgcactgcacaccatgaagctgaatcaagtgcctctcgagctgaaaaggagtgtcggactgtcaaagctccaggagaccgagttcttccagaagcttggatacgaacgaaagctccagaaaccccagaacccttataaacctaagtgggtgaaaatgcgatacggcgcgtggtacctgaacccgaaactgtggaaaaaacagcgggtcgatgaaccgctcgtcgacccagaagtctcccacaaggcccaggaagagaattttaagaaggaacttcaggaacagtctattttcaaaaaagccatggacatctag

SEQ ID NO: 47461 - DNA, 2376 bp, Artificial Sequence
  Description of Artificial Sequence: Synthetic coding sequence
atgggcgaccagcggctgcaggactggctgcggagccccggcatggactctaaaccatggtattgcaataagaggccctctaaatgcttcgctaagtgcaaacataggaggctgagattcccacccatggacacgcagaattgggtgttcgtgaaggagggcatggacgactttcggtatgggtgccctagcccagaagatactcttgtatgcaggcgagacgagtttctgcttcctaagatcagcctgcgaggcccgcaagctgatcccaagtcgggccaaaaaaaactgcttaaaaaggccgcattgttctcaaaactctcccccgcccagctagccagaaaagcctttgtcgagcaggtggaggcccagctaatggccaaacaccctctggcgatgtaccctaacctaggcgaggacatgccgcctgacttactgctacaggttctgaaacacctggacccagaacgagagctagaggacgcatgggcctgctgcgaaacccaggagaagaccacagaagtgccaactgagcccggcaaacacccctgtggcgaattctgtttgaaaccacccgagaccccagtgtctcatttgctgcctgagccgccagaaacaggcgtctctcacctgtcacctgaacccccaaagacgcccgtaagctctctacggccagagccacctgagacaggagtgagccacttaagacccgagcctccagaaactggcgtgagtcacatccgtccaggtccacctatcacccgccggcggtcaagtcttctccggcaactgctaaagctggattctgagcggaaattggaagatgctagggctccttgcgaaggcagagaaaagaccaccgatgagccaaccgaacccggcaaatacccatgtggtaagttttgcccgcggcccttcgagacccctctttctcacctccgacaggaacccccgaaaacgcccgtgtccagcctgcgtccggaacccccagagaccggagaatctcatctgagattagagcacagcaagacgagacggggttccagcctacgttctgagccgagcgagactggggtgtcacgtcttcgattggctcctcctaagacaaggcggggcagtagtttacatgcggaaccgtccaagacgggcgtctctcatctgagtccggaacctccaaagacagaggtttcgcatctgcacccggtcccccccaaaaccggagtgtgccatctgcgtctcgagccaccagatacatcccaggtgtctaatcttttgctgtacatactgaaagtgctcgatagcggcagaaccctgaaagacgtgtgggacagatgtgaagcccgggtgaaaaaaacgaaggagcccacggagccacataagagtccatgtggggaaccgtgcctgcagccacctgaaacgcaggtgtcgcatcctcaccccgagcatccaaaaacccgcaggcggtcctcactgcactcgcagcctccaaagacgcgtcgcacctccagtttgaggagtgagccgcccaaaactcgacggaccagtagccttcggtccgagccgcctaagactcggcgcaccagttcccttggacccgaaccaccgaaaaccaggagggtgagttcgttacggcctgaactgcctaagagccggcgagtgagcagcctgcatcccgaacctccaaaggcccccgagtctcatcagttcagtgagcctccaaaaataagggcgtcatacataaaagagctcctgcaggaggacacgccctcaacaaaggagtgcgttagtgacagcctgcagtacagatacactagtgagaagttacgtgaattttttaaatgggctggtgatttgggagccgacgaagagtccattcgaaatctgtttgacttcacccctaagtaccgggccactcatgaggatcagaagttcaagaaggttaaagagtgctcttcagaattgaagtactccatggaattggacgagaaagacgaagacaaattcttctctcaagagaagtactggggcagaaaattccatacaccaagcaatagttacactgcccaacgagtgaagatgaaatacggcgcctggtaccttaaacccaaactttggaagaagctgcgaagtgacgagccattgattgacccaaagctcctgttaaagaagccggatgagcctgatgtgctcgacgatctgtacggtccaatagccttcaaggacttcatactgtcaaagggctacgaaatgccgggcatcatccagcggctcttcgcaaggagggggtggacctatgactccgtcaagactccaatacagagggcaatgatattttataagtacaaagaaatcgtggaagcgagtgaggaggactag

SEQ ID NO: 47462 - DNA, 1938 bp, Artificial Sequence
  Description of Artificial Sequence: Synthetic coding sequence
atgggcgaccggcggccccaggaccggccccggagccagggcatggacagcaagccgtggtactgtgataagcccccttcaaaatactttgcaaagcggaagcaccggaggctaaggtttcctccagtggatactcaaaattgggtgtttgtgactgaaggaatggatgatttccgctacgcctgccagtccccggaggacacccttgtatgccggcgtgatgagtttctgctgccaaaaatctcccttagggggcctcaggccgatcgcaagtcccgaaagaaaaaactcctgaaaaaagccgccctgttttcagaactgagtccagttcagcccgcaagaaaggccttcgtggaagaggtggaagcacaactcatgaccaaacacccactcgctatgtaccccaatttgggaaaagatatgcccccggatctattacttcaggtgctgaagcaattggacccagagcgcaaactggaagatgcctgggccaggtgcgaggccagagaaaagaccaccgaagtaccaactgaatctggtaagtatccttgtggtgaatcatgtccaaggccgcccgagacaccggtgtcccggctgagaccacaattacctaaaacaccggtgtcctcaaggcgccctgaaccaccaaaaacgcgcgtgagctcacttagaccagaaccacctaaaacaagagtctctagcctgcatcccgagccgccggaaacccgtgcaagccaccttagggttgatccgcccgagaccggggtgagtcatctttgcccggagccccccaagacattggtaagctctgtccacccagagccccccgacactggcgcctcccatctatgccccgaacctcctgaaactcgagtctcacacttacatcctgaaccgccagagactggcgtgtcccacctccgtcccgagccctcaaagacgcaagtgtcctccttgtgtcccgagcctcccgaggcgggcgtctcacacctgtgcctggagccacctaatacacatagagtaagctcttttctcctgcaggttctaaagcttgattcagagaagaagctggaggacgctagagctcggtgcgaaggccaagagatgacaacagaagaattgacaaaacccggaaaataccatttctgggagagctgcccccgcccctttgaatccaggatgcctcaccttcgcttggtcttgcccatcactcgcaggatggcctctctttgtttgaagcccccaaagactcgacgagtgtcctcgctgtgccctgagcctaccaaaactggcgcgagccacctgaaggagctgtttcaggaggataccccaagtactatggaatgtgtctccgactcgctgcagcgaagacatacctcacggaagctgcgtgattttaaatgggctggggacctgggggtgaacgaagagtccatcagtagtttattcgacttcactccagagtgccggacaacagaccaagaccagaagattaagaaagccaatgaatgtgctagccgactgatgtacggtatggagctggatgacatggatgaggttgagtttctcagaattaaatactgggacaggaggagaagggccgcccctcactcttatagcgctcaaaggggtcggataagatacgggccttggtatttcgaacctaaactggggaagaagctgagatctgacgagccgttgatcgaccccaagccagtgttggagaaacccgacgaaccagacattctagatgggctgtacggacccattgcgtttaaggactttatcctgagcaaagggtaccgcatgccaggagtgatcgagaaacttttcgccaagaaaggctggacttacgattccgtcaaaacgccaattcaacgcgccgtgcaggtgtacaagtacaaggaggacgtcactgatgcttctaaagaggactag

SEQ ID NO: 47463 - DNA, 3108 bp, Artificial Sequence
  Description of Artificial Sequence: Synthetic coding sequence
atgggcgaccagcggccccaggaccggcccagcagccccggcatggacagcaccccctggtattgtgacaagcctccgtccaagtactttgcgaagcggaagcaccggaggctgcgattccccccggtggacacgcagaactgggtttttgttaccgagggcatggatgatttccggtacggctgtcagtctcccgaagacacattagtctgtagaagggacgagttcctgctgccaaagatatctctgagaggcccccaggctgacccaaagtcccgcaaaaaaaaattgctgaagaaggctgccttattttccaagttgagccctgcccagcccgcgcgaaaggcattcgtagaggaggtggaggcacagctgatgacaaaacacccccttgcaatgtacccaaacctcggtgaagacatgcccccggatctgttgttgcaagtcctcaaaccgttggatccagagcggaagctggaggatgccggaagctgcgaaggccaggagaagacaaccgatgaaccaactgaacctggaaagtacccatgcggggagttctcccccaggccccctgaaacccgggtgagctgccttcctcccgagccccccaaaacccccgtctcctccctcaggcccgagcctcccgagaccggagtgtcccacctccgaccgcagccacccaaaacacaggtgtcctctctccacctggagcctcccgaaaccggtgtgtcccacttgagaccggaaccgcccaaaacgcaggttagctccttacacctcgagccaccggagactggggtcagccacctgtacctcgagcccccaggtactggggtttctcacttatgcccagaacctcctaaaactagggtgtctcacctccacagggagccccccgaaaccggtgtacccgacttgtgcctcgaacctcccaaatcgcgagtgtctcatctgagacctgagccaagcgaaacaggtgttagccatctgcacccggaacccccaaagacactggtcagttctctgcacccagagcctcctgaaacaggtgttagccacctttgtcctgaacctcctgagacccgcgtgtctccgctacggcagctgcctcccgaagccggcgtctcacatctctgccctgagccccccaaaacacgggtgccacctctcagacccgagactcctaagaacggtgtgtcccctttgttccctgagccgccgaagacccgcatatccaatctacgcagtgaaccccctaagatcggggtgtctcatctctgtctggagccccccaaaacgagggggagccatctgaggcccgaaccccccgagacgggggtgtctcacctacgacctgagccccctaaaacccgcgtgtctagcctgcacctagagcctcctgaaactggggttagtcacctgtgccccgaacccccggagaaggatgtgtcccacctcagacctgaacctccggatactggcgttagtcacttgtgccctgagcccccaaaaacacgggtcagtcacctgcggcctgaaccaagtgaaactggggtcagccatctgcgcccagaaccgcccaaaattttggtgtcatctttgcaccaggccccaccggagtctagtgtgagccacttaagacctgagccccccgagactggagtttcacacttgagacccgagccacccaaaactcgtatgtattcattaaggccagaaccgcccgatacaggagtctcccacctctgccccgaaccaccaaagacaagggtcagctccttgccaccagagccaccagagacaggggtctctcacttatgccctgaacctccggaaacccgggtgtcacatctaaggcccgagccgcccgaaactggggtatctcacttgaggcctgagccaccaaaaacgcgcatgtactccctgagaccggagcctcccaatacgggcgtatctcacctgtgtcccgaaccccctaagacccgtgtgagttccctgccccctgagccccccgagacaggagtgagccatctttgccccgagccacctgagacgcgcgtgtctcacctgaggcccgagcccccggaaaccggcgtttcccgcctgcacccagaaccccccaaaacccgggtgagttcactgcatgctgaaccaccggagtccagagtgagccacctgtgcccagagccgcccgaaaccggtgtctcccacttacgtccagaaccacctaagcctagagtgtcttctcttcgccccgagccactggaaaccagggtgagccacctgcggcccgaacccccggagaccggggtcagccatctccatccagagctacctaagccccgagtgtcatcactgcacctggagcctcctaagaccagaagagtgtcctctctgagactggagccccctaagacaggcagagttagcagtctgtgcccagaaccaacaaaaacaggcgcaagccatttgaaggagttatttcaagagggtactagctccaccatggagtgcgtctctgacagcctgcaacggagacatacgtcccggaaattgcgcgatttcaagtgggcaggagacttaggtgtgaatgaagagagcataagtagtctcttcgattttacccctgagtgtcgagcgacttatcaagaccaaaagaacaagaaggcaaatgaatgtagcagtgggctcaagtattcaatggagttagacgagatggatgaagtcaagtttttcagccaggaaaaggatctcgacggcaagatacagaatgccccaaacagtcacagcgcccagcatgtcaagatggggtacggcgcgtggtatttaaagcctaagctggggaagaagctcagatctgacgagccattgattgacccaaagttggtgctggagaagccagacgagcccgacattctagacggactttatggtcctatcgcatttaaggacttcatcctctctaaggggtacgagatgcccggcattatccagcggcttttcgctagacgcggttggacatatgactccgtgaagacacctatccagcgcgctatgcaggtgtacaaatataaagaggatgtgacagatgctagcgaggaggattag

SEQ ID NO: 47464 - DNA, 888 bp, Artificial Sequence
  Description of Artificial Sequence: Synthetic coding sequence
atgcagatgagcgtgccctgcgtgctgagcagcctgcagaaccacgagccaaacaagcccctgttcacaactcagtcccaactgctgagcaaggtgctggaggtgctggacccggaccggaagctagaagacacatgggcctactgccaggacacaaggaaaggtatgaaggaaccaacaaaactacttaaaaagcattctacccaggtctatctgggcccttccaagaaaacgagtgtgagtaacgcagggcagtggctatatgaggaaaagccccataagatggacctccttcacgagaatgggccacggccggggttgcacgaaaatgtatgtaaggccgtctcggacttctgtaaatgggtcacaacatttgggatctccgacattgacgaagagttcattctaaaacagtttgacatagactacgaaacaaagccgtctcatgatgcgcttcacaccatgaagttaaaccaggtgccactggaactgaagaggtctgtcggcctctccaagttgcaggagactgagtttttccagaagctgggttatgagagaaagttgcagaagcctcagaatccatacaagccgaagtgggttaagatgagatacggcgcttggtatctgaaccctaaactatggaaaaaacagcgggttgatgagcctctggttgaccctgaggtgtcgcacaaagcccaagaggagaacttcaagaaagagctccaggagcaggaggagcttctggcagatctacatggaacagtcgcctttaaagacttcattttaagtcgcggttacaggacaccacgcttcttagagaacatgtacattggaaaagagtgtaaaagagcctgcaacaaaacacctattaagagaactcaagcctag

SEQ ID NO: 47465 - DNA, 1182 bp, Artificial Sequence
  Description of Artificial Sequence: Synthetic coding sequence
atggccgaccggcggcggcggctgcggcccggcaccctggcccccgttcgagagggagtgaattgtcggtctcgctgtttcaccaagcataagaacgggctgaagtttcctacgagcctgcacagccgacagctggtctttccgcgaaaggggctggatgacttccggaaaggttgtccgccatgcaccgggctagtgacccaagtgcccgtagagggctttctgccccaaatctaccatagagcaccccagcttgccccgaagaagcgccagataaaactcctgaaagaagcagatgtactttctaaactgtctccagcgcaacaagcacggaaggccttccttgaggacgttgaggcgcatttaacacctcatccacttgctctctacctgaatctcgaggaggctatgccgatcgagctactgtcaaaggtacttgaggtattagatcctgatcgcaaactggaagacacgtgggcatactgccaggacacacgcaagggcatgaaggagcccaccaagctgttgaaaaaacacagcacccaggtgtacctggggcccagtaaaaaaacgtcggtcagcaacgctggccaatggctgtatgaggagaagcctcataagatggacctgctacacgaaaacggcccacgacctggcctgcacgaaaacggcatctcagacatcgacgaagagtttattctgaagcagttcgacattgattatgaaaccaaaccatcccacgatgccctccatacaatgaagttaaatcaggtgccactcgagctgaagcgaagcgtgggcctcagcaagctgcaggaaactgagttctttcagaagctgggctatgagcggaaactacaaaaaccccaaaatccatacaaacctaagtgggtgaaaatgcgttacggcgcatggtatctgaatccgaagctgtggaagaagcagcgagtggacgaaccgctggtggatccagaagtgagtcacaaagcacaggaggaaaatttcaagaaggagctccaggaacaggaggaacttctggcagatctgcatgggaccgtggctttcaaagattttatcctgagtcgcgggtacaggacaccccggtttctggagaatatgtacattgggaaggaatgtaaacgtgcgtgcaataaaacccccatcaagagaacacaggcctag

SEQ ID NO: 47466 - DNA, 972 bp, Artificial Sequence
  Description of Artificial Sequence: Synthetic coding sequence
atgggcaacctgctgaaggtgctgacccgggagatcgagaactaccctcacttcttcttggacttcgagaacgcacagccgacagaaggggaaagggagatctggaatcagattagtgctgtgcttcaggattcagaaagcatcctggcagatctgcaggcttacaagggagctggaccagagatcagagatgccattcagaacccaaatgatatccagttacaagagaaggcctggaacgcagtgtgtcccctggtggtcagacttaaacgattctacgagttcagcattcgcctagaaaaggctctgcaaagtctgcttgaatctttgacatgcccgccctacaccccgacccagcacctggagcgtgagcaagctctggctaaagagtttgcagagatcctgcattttacactgcgcttcgacgaactgaaaatgcgtaaccccgcgattcagaacgatttcagttattatagaaggactatttctagaaatcggataaataacatgcacctcgacattgagaatgaagtcaacaatgaaatggcaaatcggatgtccttgttctacgcagaagccacgcccatgctgaagactttatcgaacgccactatgcatttcgtgtctgagaataagactctgccaatagaaaataccaccgattgcctttctaccatgacgagcgtttgcaaagtgatgctggagactccagaatatcggagccggttcacctcagaggagactctgatgttctgcatgcgggtaatggtcggcgtaatcattctctatgaccacgttcatccagtaggggccttctgcaagacatctaagatcgacatgaaagggtgtatcaaggtactgaaggaacaggcgcccgactcagttgagggacttctgaatgccctgcggtttaccacaaagcatttgaatgacgagtccacaagcaaacagatcagagcaatgttacagtag

SEQ ID NO: 47467 - DNA, 972 bp, Artificial Sequence
  Description of Artificial Sequence: Synthetic coding sequence
atgggcaacctgctgaaggtgctgacccgggagatcgagaactacccccacttctttcttgacttcgaaaatgcccagcctacagagggcgagcgcgaaatctggaaccagatcagcgcagtcctgcaagactccgagtcaattctggcagacttgcaagcctataagggggctggtcctgagattcgtgatgcaatacagaatccaaatgacattcagctgcaggaaaaggcgtggaacgccgtctgcccactggtggtacggctgaaaagattctacgaattctcaattcgcctggaaaaggctttgcagtcactcctggagtccctgacatgccccccttacacccccacacagcacctcgaaagagaacaagctctggctaaagagtttgccgagatcttacattttactctacgctttgatgagcttaagatgaggaaccctgctatccagaatgacttcagttactataggaggaccatttctcgcaaccggattaacaacatgcacctggacattgagaacgaggtgaacaacgaaatggcgaatcggatgagtcttttttatgcagaggccacccccatgcttaagactctgagcaacgctacaatgcatttcgtaagtgagaacaaaactttgcctattgagaacacgacggactgcttgagtaccatgactagcgtctgtaaggttatgcttgaaacgcctgagtatcggtcacgatttactagcgaggaaactctcatgttttgtatgcgcgtgatggtgggagtgataatactctatgaccacgtgcaccccgtgggcgctttttgtaaaacctccaagattgacatgaaggggtgcatcaaagtgcttaaggaacaagccccggatagcgtcgaaggactgttgaacgcattgcgattcaccaccaagcacctgaatgatgagtctaccagtaagcagattcgagccatgttgcagtag

SEQ ID NO: 47468 - DNA, 972 bp, Artificial Sequence
  Description of Artificial Sequence: Synthetic coding sequence
atgggcaacctgctgaaggtgctgacccgggagatcgagaactacccccatttcttcctagacttcgaaaacgctcagccaactgagggcgaacgagagatatggaaccagatctcagccgtgctccaggacagcgagtcaatcctcgctgatctccaagcttataagggtgccggcccagagattcgcgacgctatacagaacccaaatgacatccagctgcaggagaaggcctggaacgcagtatgccctttggtcgtccgactgaaaaggttttacgagttttcaatccgcctggagaaggcattacaatctctccttgagagcctgacatgcccgccttacacccccacgcaacacttggaacgcgagcaggccctcgccaaggagtttgccgaaattcttcacttcactctgaggtttgacgaattgaagatgaggaatcctgctattcagaatgattttagctactacaggcgcactatctctcggaaccggattaacaatatgcacctggacatcgagaacgaagtcaacaacgaaatggccaacaggatgtccctgttttacgctgaagccacaccaatgctaaagactctgtccaacgccaccatgcatttcgtcagtgaaaacaagacattgcctatcgaaaatacaactgactgcttgagcaccatgacaagcgtgtgcaaggtaatgctagagaccccagagtatagaagtcggttcacatctgaagaaacgttaatgttctgtatgagggtaatggtcggagtcatcattctctatgaccacgtgcaccctgtgggagcattctgtaagacatccaagatcgacatgaagggatgcatcaaagtcctcaaggagcaagcccccgattccgtggagggcttactcaatgctcttagattcaccaccaagcatctcaacgacgagtccacttctaaacagattagagctatgctgcagtag

SEQ ID NO: 47469 - DNA, 285 bp, Artificial Sequence
  Description of Artificial Sequence: Synthetic coding sequence
atgggcaacctgctgaaggtgctgacccgggagatcgagaactaccctcacttcttcttagattttgaaaatgcccagcccaccgaaggcgagcgtgaaatatggaaccaaattagcgctgtgttacaggattcagaatctatcctcgctgacctgcaggcctacaaaggagccggacccgagatcagggacgccatccagaacccaaacgacatccagctgcaggaaaaagcttggaacgccgtttgtcctctagtggtgagactgaaaagattttatgagtag

SEQ ID NO: 47470 - DNA, 264 bp, Artificial Sequence
  Description of Artificial Sequence: Synthetic coding sequence
atgggcaacctgctgaaggtgctgacccgggagatcgagaactacccacatttttttctagatttcgagaatgcacagccaacagaaggggagagagagatctggaaccagatcagtgctgtgttacaggatagcgaatccatcttagccgaccttcaggcctacaagggagccggtcccgagatccgggatgccattcagaatcctaacgacatccagctgcaggagaaagcctggaacgccgtttgccctttggtcgtgtag

SEQ ID NO: 47471 - DNA, 654 bp, Artificial Sequence
  Description of Artificial Sequence: Synthetic coding sequence
atgcagaaggccagctggcggacctgcagccacaccgaggagctggccactaaatatgagcgggctatccagcatcccgcagacgagaaattgcaggagaaagcttggggtgccgtggtgcccctggtcggcaaagagatactgagaatatttagtgaagttaggtccagcattaaacgctcttctggatcgcttaataagtatcccattttttcccatcctgcttcccgggcaagacaggcgctggccaagcagtttgctgaaatcctgcactttactctacggttcgacgaactgaaaatgactaatcccgccatccagaatgacttctcctactaccggagaaccttgagtcggatgcgtatcactatgtatagagccgaaggcgaaaacgaggtgaacaatgagctagcgaataggatgagtcttttctatgccgaagctactcccatgttgaaaaccctgtccgacgccaccacaaagtttgtgagcgagaacaagaatcttccgattgagaataccaccgattgtctgtccaccatggcgagtgtctgccgtgttatgcttgaaaccccagaatatcggtctcgttttaccaacgaggaaactgtcagcttcctggagggcaatggtgggtgccacaatacgctgtag

SEQ ID NO: 47472 - DNA, 975 bp, Artificial Sequence
  Description of Artificial Sequence: Synthetic coding sequence
atgggcaacctgctgaaggtgctgacctgcaccgacctggagcagggccctaacttttttctggacttcgaaaacgctcagcctacagaatctgaaaaagaaatatacaaccaggtgaatgtggttttgaaggatgccgaaggaatactggaagacctccaatcatatcgcggagctggccatgaaatcagggaagctattcaacaccccgcagacgagaaactgcaggaaaaggcttggggcgcagttgtgccacttgttggtaagttgaagaagttttacgagttctctcaaaggctggaagccgcccttcggggtctcctcggtgccctgacctcgaccccctattcacctactcagcatctggagagagaacaggcgttggccaagcagttcgcagagatcctgcacttcactctgcggttcgacgaactgaaaatgacgaatccagcgatccagaacgatttctcctattatcgaagaactctgtcgcggatgagaatcaacaacgtcccggccgagggcgaaaacgaggttaataatgaattggccaataggatgtctcttttctacgctgaggcaacaccaatgttgaagacgctgagcgatgcaactactaagtttgtgtccgaaaacaagaatctgcctatcgaaaacaccacggactgtctgagtaccatggcatcagtgtgccgggtcatgctggagacccccgaatacagaagcagattcactaacgaagagaccgtcagcttctgcctacgggtcatggtgggcgtcatcatactgtacgaccatgtccatccagtgggggcattcgcaaagacatccaaaattgacatgaaaggctgcattaaggtcttgaaagaccagcctcctaattctgtggagggattgctcaacgccctgcggtacacaaccaagcacctgaacgatgagaccactagtaagcagataaaatccatgttgcagtag

SEQ ID NO: 47473 - DNA, 975 bp, Artificial Sequence
  Description of Artificial Sequence: Synthetic coding sequence
atgggcaacctgctgaaggtgctgacctgcaccgacctggagcaggggcccaatttttttctggacttcgaaaatgcacaaccaactgagtctgaaaaagaaatttataatcaggtcaacgtggtgctaaaggacgccgagggtatactggaggacctccaatcctacagaggtgctgggcatgagattcgtgaggcaattcagcatcctgcagacgaaaagctccaggagaaggcctggggcgctgttgtgccactggtaggaaaactgaaaaaattctatgagttcagccaacggctggaggccgctctgagagggctgctgggcgctcttacaagcacaccctactctcccacacagcacctggagcgagagcaggcactcgccaagcagtttgccgagatcctccacttcaccctgagatttgacgaacttaagatgaccaacccggctattcagaatgacttttcttactaccgccggacgttgtccagaatgcgcatcaataatgtcccagcagaaggtgaaaacgaggtgaataatgagttggcaaataggatgtctctcttctacgcagaagctacccctatgttgaagactctgtctgacgcgacgactaagttcgtgagcgagaataaaaacctcccaatcgagaataccaccgactgtctatccaccatggcctcagtgtgccgggttatgctcgagacccccgagtatcgatcgcgcttcacaaacgaggagactgtgtcattttgcctgagagtaatggtcggtgtcatcatcttatacgaccacgtgcatccagttggtgcgtttgccaagactagcaagatcgacatgaagggatgtattaaggtcctgaaagaccagccaccaaatagcgtggaaggcttacttaatgccctgaggtatacaacaaagcatttaaatgatgagacaaccagcaagcagattaaatcaatgctccagtag

SEQ ID NO: 47474 - DNA, 192 bp, Artificial Sequence
  Description of Artificial Sequence: Synthetic coding sequence
atgggcaacctgctgaaggtgctgacctgcaccgacctggagcaggggcctaatttctttctggacttcgaaaatgctcaacctactgagagcgagaaggaaatctacaaccaggtcaacgtggtcctgaaagatgcagaaggcatcttggaggacctgcagtcttaccgtggcgctgggcacgagatctag

SEQ ID NO: 47475 - DNA, 198 bp, Artificial Sequence
  Description of Artificial Sequence: Synthetic coding sequence
atgggcaacctgctgaaggtgctgacctgcaccgacctggagcagggtccaaatttttttcttgacttcgaaaatgcccagcccactgagtccgagaaagaaatctataatcaggtcaatgtcgtactcaaggatgctgagggtatcctggaagacctgcaatcttaccggggggctgggcacgagatccgcgagtag

SEQ ID NO: 47476 - DNA, 297 bp, Artificial Sequence
  Description of Artificial Sequence: Synthetic coding sequence
atgggcaacctgctgaaggtgctgacctgcaccgacctggagcagggaccaaacttcttcttagactttgaaaatgcccaaccaacggaaagcgagaaagagatctacaaccaggtgaacgtggtgctcaaggacgcagaagggatcctggaagatctccagtcataccggggagccggacacgagattagggaagcaatccaacaccctgccgacgagaaacttcaggagaaagcttggggcgctgttgtcccactggtggggaagctgaagaaattttacgaattttcacagtag

SEQ ID NO: 47477 - DNA, 207 bp, Artificial Sequence
  Description of Artificial Sequence: Synthetic coding sequence
atgggcaacctgctgaaggtgctgacctgcaccgacctggagcagggacccaattttttcctcgactttgagaacgcacagccgactgaatcagagaaagagatctacaaccaggtcaacgtggtcttaaaggatgccgaggggatcctagaggaccttcagtcttacagaggtgctggccacgagataagagaggctattcaatag

SEQ ID NO: 47478 - DNA, 147 bp, Artificial Sequence
  Description of Artificial Sequence: Synthetic coding sequence
atgggcaacctgctgaaggtgctgacctgcaccgacctggagcaggggcctaactttttcctcgatttcgaaaacgcacaacccaccgagtctgagaaggaaatctacaaccaggtgaatgtcgttctcaaggacgcggaggggtag

SEQ ID NO: 47479 - DNA, 975 bp, Artificial Sequence
  Description of Artificial Sequence: Synthetic coding sequence
atgggcaacctgctgaaggtgctgacctgcaccgacctggagcagggccctaacttctttttggatttcgaaaatgcccagcctaccgagtccgaaaaggaaatttataaccaggtgaacgtcgttctgaaagatgcagagggtattctggaagacctgcagtcctacaggggagctgggcacgagatcagagaagctatacaacatcctgcagatgaaaaactgcaagaaaaggcatggggcgcggtggtcccactggtgggcaagctaaaaaagttttacgaattctctcagaggctggaagctgcgctgcgggggctgttaggagccctcacaagcaccccctactccccaacacagcaccttgagagggaacaggccctggccaaacagtttgccgaaatattacatttcacattgaggttcgacgagctgaagatgaccaaccccgcgatacaaaacgatttcagctattatcggcgcacactgtcgcggatgcgcatcaacaatgtgcccgccgaaggggaaaacgaggtgaacaacgagctggcaaatcgcatgagtctgttttacgcggaagcaacccccatgctcaagactctgtcagacgccaccactaagtttgtgagcgaaaacaagaacctccctattgaaaatacgacagactgtctgtctactatggcaagcgtgtgtcgggtgatgctggaaacccccgaatacagatctcggttcaccaatgaggagaccgtctccttctgcctgagggtgatggtcggggtcattatcctgtatgatcacgtgcatccagtgggcgccttcgccaagacctctaagattgacatgaaggggtgtataaaggtgctgaaggaccagccacctaatagcgttgaagggctgcttaacgctcttagatacaccaccaaacatctgaatgacgaaactactagcaaacagatcaaaagcatgctacagtag

SEQ ID NO: 47480 - DNA, 468 bp, Artificial Sequence
  Description of Artificial Sequence: Synthetic coding sequence
atgggcaacctgctgaaggtgctgacctgcaccgacctggagcagggccccaatttcttcctggattttgagaacgcccagcctacagagagtgaaaaggaaatctataaccaagttaacgtggtcctgaaggacgcggagggcattctggaggatctgcagtcatacagaggagcgggtcacgagattagagaggcaatacagcatcccgccgacgaaaagctgcaggaaaaggcttggggcgccgtcgttcccctggtggggaaactcaagaagttttatgagttcagccaaagacttgaagcggccttaagaggcctgctgggtgccttgacatctaccccctattctccaacacagcacttggagcgagagcaagcattggctaaacagttcgccgagatcttgcatttcactctgagatttgacgaactcaaagtcgagttgagcattggacccgactgttag

SEQ ID NO: 47481 - DNA, 975 bp, Artificial Sequence
  Description of Artificial Sequence: Synthetic coding sequence
atgggcaacctgctgaaggtgctgacctgcaccgacctggagcagggcccaaacttcttcctggacttcgaaaacgcacagcccaccgagtcagaaaaggaaatctacaaccaggtgaatgtggtgctgaaagatgcagaaggtatacttgaggacctgcagtcgtatcgcggggccggtcacgaaatccgggaggctatccagcatccagctgatgagaaactgcaggagaaggcatggggcgcagtcgtgccgcttgtggggaagctgaagaagttctacgagtttagccaacgcctcgaggccgcactgaggggcctcctgggtgccttgacgtctactccttactcccctacccagcacctcgagcgggagcaagcattggctaaacagtttgccgagatcctccacttcacgttgcgattcgacgagctgaagatgaccaatcccgctattcagaatgacttctcctattatcggaggacactgagccggatgagaattaacaacgtccctgcagaaggcgagaacgaggtgaacaacgagctcgccaaccgcatgtcactcttttacgcagaagccacccctatgcttaaaacgctttccgacgctactacaaagttcgtttctgaaaacaagaatctacccattgagaacactacggattgcctctccaccatggcctccgtctgccgcgttatgctggagacgcccgagtacaggagtagatttactaacgaagaaacggtttctttctgtctaagggtaatggtcggagtcatcatcctgtacgaccacgttcacccagtgggggcgtttgccaagactagtaaaatagacatgaaagggtgcatcaaagtcttaaaagatcagccgcccaattctgtggaaggactgctaaacgccttaagatatacaacgaagcacttaaacgacgagactacatcaaagcaaataaagtctatgctacagtag

SEQ ID NO: 47482 - DNA, 975 bp, Artificial Sequence
  Description of Artificial Sequence: Synthetic coding sequence
atgggcaacctgctgaaggtgctgacctgcaccgacctggagcagggcccaaacttctttctggacttcgaaaatgctcagccgactgaatcagagaaggaaatttataatcaggtcaacgtggtactgaaagatgctgagggcatcctcgaagatctccaatcctacagaggggccgggcacgaaattagggaggcaatccaacatccagccgacgagaaactccaggagaaagcctggggcgccgttgtgccgctggtaggcaaactcaagaaattttatgaattcagccagcgcctggaggctgctttgcgcgggctgctgggtgctctgactagtactccctactcccctactcagcacttagaaagagaacaggcgctggccaagcagtttgccgagattctgcattttaccctgcgcttcgacgaactgaaaatgacaaacccagcaatccagaacgatttttcttattaccgaaggaccctatcccgaatgcgaattaacaatgtgcctgctgaaggagaaaacgaagtcaacaacgagctcgcaaatcgcatgtctctgttttacgcagaggcaacgcccatgctgaagacactgagtgacgctactactaagtttgttagcgaaaacaagaatctgcctatagagaacactacggattgcctcagcaccatggccagtgtatgccgcgtcatgctcgagacacctgaatatagatcgaggtttaccaacgaggagacggtgtcgttctgcctgcgcgtcatggttggagtgattattctgtatgaccacgttcatcctgtcggggccttcgccaagacaagcaaaatcgacatgaagggctgcatcaaggtgttgaaagaccaaccccccaactcggtcgaaggtttgctaaacgcgctacgatatacaaccaagcatctgaacgatgagaccacctccaagcagattaagtctatgctgcagtag

SEQ ID NO: 47483 - DNA, 303 bp, Artificial Sequence
  Description of Artificial Sequence: Synthetic coding sequence
atgggcaacctgctgaaggtgctgacctgcaccgacctggagcagggcccaaattttttcttggatttcgagaacgcacaacctaccgagtccgaaaaggagatatacaatcaggttaatgtggtgcttaaggacgccgaaggcatcctggaggacctccaaagctacagaggcgcaggtcacgaaattcgtgaagcgattcaacaccctgcggacgagaagctgcaggagaaagcctggggtgctgtagtcccattggtgggaaaattaaagaagttttatgagtttagtcagcggctctag

SEQ ID NO: 47484 - DNA, 240 bp, Artificial Sequence
  Description of Artificial Sequence: Synthetic coding sequence
atgggcaacctgctgaaggtgctgacctgcaccgacctggagcagggaccgaactttttcttggactttgagaacgcacagcctacagagagcgaaaaggagatttataatcaggtgaacgtggtcttaaaggacgcagagggcatcctcgaggacctacaatcctataggggcgctggccatgagattcgcgaagcgatccagcaccccgcagacgagaaactacaggaaaaggcctag

SEQ ID NO: 47485 - DNA, 141 bp, Artificial Sequence
  Description of Artificial Sequence: Synthetic coding sequence
atgggcaacctgctgaaggtgctgacctgcaccgacctggagcagggcccgaacttctttttggactttgaaaatgcccagccaaccgagtccgaaaaagaaatttacaatcaggtgaatgttgttctcaaggacgcatag

SEQ ID NO: 47486 - DNA, 975 bp, Artificial Sequence
  Description of Artificial Sequence: Synthetic coding sequence
atgggcaacctgctgaaggtgctgacctgcaccgacctggagcagggacccaatttctttctggatttcgaaaacgcgcagcctactgagtccgagaaggagatttacaaccaggtcaacgtggtgctcaaggatgcagaaggtattctcgaagacctgcagagctaccgtggagccggacacgagattagggaggctatacaacacccggctgatgagaagctgcaggagaaggcttggggggccgtggtgccactggtggggaagttaaagaaattctatgaattttcacagaggctggaggcggccctgcgtggccttctgggggctctcacttccactccctactctcctacgcagcacctggagcgtgaacaggccctcgccaaacagttcgccgaaattttacattttacactccgttttgacgaattgaaaatgacgaaccctgcaattcagaatgacttttcatattacagaaggaccttgtcccgaatgcggatcaataacgttccagccgagggagaaaacgaagtgaacaacgagctggctaatcgtatgtccctattctacgccgaggctaccccaatgctgaagacgctaagcgatgctacgacaaagtttgtatccgaaaacaagaatctaccaattgagaacactacagattgcttgtccaccatggcatcagtgtgtagagttatgctggagacccctgagtaccgctcccggttcaccaatgaggagacggtgtcgttctgcctaagggtgatggtcggcgtaataattctctacgaccacgtgcatcccgtcggagcttttgccaaaaccagtaagattgatatgaaaggctgtatcaaggtcctgaaggaccagccccctaactctgttgagggcctgctcaatgctctgaggtacaccaccaaacacctaaacgatgagacaactagcaagcagatcaagagcatgctgcagtag

SEQ ID NO: 47487 - DNA, 975 bp, Artificial Sequence
  Description of Artificial Sequence: Synthetic coding sequence
atgggcaacctgctgaaggtgctgacctgcaccgacctggagcaggggccaaactttttcctggatttcgagaatgcacagcctacagaaagcgagaaggagatttacaaccaggtgaatgtggttctgaaggatgccgagggcatcctggaagatctccagtcttaccggggggccggacacgaaattagggaagctatccagcatcctgctgatgaaaagctccaggaaaaggcttggggagccgtggtacctctggtaggtaagctcaagaagttttacgaattttctcagaggttagaagccgcattgcggggcctcctgggagccttaacatctaccccatactcgccgacccaacacctcgagcgggaacaagccctggccaaacaattcgccgagattctccactttaccctaaggtttgatgagctaaaaatgactaaccccgccattcagaatgattttagctactaccggagaactctctcccggatgcgaattaacaacgtgccagctgagggggagaacgaagttaataatgagcttgcaaataggatgtccctgttttacgccgaggcgacccctatgctgaagacactgagcgacgcgactactaagttcgtgtccgagaataaaaacctcccgatcgagaacaccacggattgcctgagtactatggccagtgtctgtcgagttatgctggagactcccgagtataggtctagatttacgaatgaggagacggtgtcgttctgtctgcgagttatggtgggcgtcatcatcctgtatgaccacgtgcacccagtcggcgcctttgcaaagactagtaaaatcgatatgaagggttgtatcaaggttctgaaggaccagccacccaacagtgtcgaagggcttctgaacgctctgcgatacactaccaagcatctaaacgacgaaacgacgagtaaacagataaaatcaatgcttcagtag

SEQ ID NO: 47488 - DNA, 282 bp, Artificial Sequence
  Description of Artificial Sequence: Synthetic coding sequence
atgggcaacctgctgaaggtgctgacctgcaccgacctggagcagggacccaacttctttcttgactttgagaatgctcagcccaccgaatccgagaaagaaatatacaaccaagtgaatgtcgttctcaaggacgccgagggaatactggaagacctgcagtcctacaggggagctgggcacgagatccgagaggctatccagcaccccgctgatgagaagcttcaagaaaaggcttggggcgcagtggttccactggtgggaaaactcaaaaaattctag

SEQ ID NO: 47489 - DNA, 978 bp, Artificial Sequence
  Description of Artificial Sequence: Synthetic coding sequence
atggcccagtacaagggcaccatgcgggaggccggccgggccatgcatctactaaagaagagggaaaggcagagagaacagatggaggtgctcaagcaacggatcgccgaggagacgattttgaaatcgcaggtggataaaaggttttcagcccactatgatgctgtggaggctgagctgaagagcagcactgtcggtctcgtgaccctgaacgacatgaaggcccgtcaggaagctctggtgcgcgaaagagaacgccagttagctaagcggcagcatctggaagagcagaggctccagcaagaacggcagcgggaacaagagcagaggcgtgagcgtaaacgcaaaatttcctgcttgagctttgcactagatgacctggacgaccaagctgatgctgccgaggctcggcgcgccgggaaccttggcaagaaccccgacgtcgatacttcctttcttcccgatagagatcgggaagaggaggaaaatcgcctgcgggaagagctgagacaagagtgggaggctcagagagaaaaagtaaaagatgaagaaatggaagtgaccttcagttactgggatggctccggtcacagacgtacagtccgagttcgaaagggaaatacagtgcaacagtttctgaagaaggcccttcagggactacgcaaggactttctggaactccgatccgccggagtagagcagctcatgtttatcaaggaagacctgattttgcctcactaccatacattttatgactttataatagcacgggcacggggcaagagtggccctcttttttcgttcgacgtgcacgacgacgtgcggctgctcagcgatgctacaatggaaaaagacgaatctcatgctggtaaggtggtccttagaagttggtatgagaagaataaacacatttttccggcctcccggtgggaggcatacgacccagaaaagaagtgggataaatataccatcaggtag

SEQ ID NO: 47490 - DNA, 978 bp, Artificial Sequence
  Description of Artificial Sequence: Synthetic coding sequence
atggcccagtacaagggcaccatgcgggaggccggccgggccatgcacctgctcaagaagagggagaggcaaagggagcagatggaggtactcaagcagaggatcgccgaagaaaccatattgaagtcacaggtggacaagcgcttctccgctcactacgacgctgtcgaggcagaactgaagtccagcactgtgggactggtgaccctgaacgacatgaaggctcgacaggaggccctagtgagggagcgggagagacagctggctaagcggcagcatctcgaggagcagcgtcttcagcaggaaagacagcgagaacaggaacagcgtcgggaacgcaaaagaaaaatcagttgtctgtcttttgccctcgacgacctggatgatcaagcagacgcagcagaagcccggagagcaggaaatcttggtaagaaccctgatgtcgatacgtccttcctgcccgacagagaccgggaggaggaggaaaaccgccttcgtgaggagcttcgacaggaatgggaagcccagagagagaaggtaaaggacgaggagatggaggttaccttcagttattgggacggcagcggtcatcggcggactgtgcgggtgaggaagggaaacactgtgcagcagttccttaaaaaggccctgcaaggactgaggaaggatttcctcgagctaaggtcagcaggggttgagcagttgatgttcatcaaggaagacttgatcctgccccattatcacactttctacgacttcattattgcacgcgcacgggggaaatccgggccattattctcttttgatgtgcacgacgatgtccgcctcttaagcgacgctacaatggagaaagacgagagccatgccggcaaagtggtcctcagaagttggtacgagaaaaacaagcacatctttcctgctagtcgttgggaggcatacgatcctgagaaaaagtgggataagtacactatacgatag

SEQ ID NO: 47491 - DNA, 1269 bp, Artificial Sequence
  Description of Artificial Sequence: Synthetic coding sequence
atggtgatggtgctgagcgagagcctgagcacccggggcgccgactccatcgcgtgtggtacattctcaagggagctgcacacaccgaaaaaaatgtctcaaggtcccactctcttcagctgcggcatcatggaaaacgaccgatggagagatctggaccggaagtgtcccctgcagattgatcagccatccactagtatctgggagtgtctccctgagaaagactcaagcctctggcaccgcgaggcagtgacggcttgcgccgtcacgtccctgattaaggacctctcaataagcgatcataacggtaacccaagtgctccccctagtaagcgccaatgccgctctctgtctttttcagacgaaatgtcctcgtgcaggacttcttggaggcccctggggagcaaggtttggacaccggtggaaaagagacgctgttacagtggaggctctgtgcagcgctactccaatggattttccaccatgcagagaagctcctccttcagccttcctagtagagctaacgtcttgagtagtccatgcgatcaagctggtctgcatcaccgcttcggtggccagccatgtcagggagtgccgggctccgctccttgcgggcaggcaggggatacctggtccccagatcttcaccccgtgggcggtggtaggctggatctccagcggtccctctcatgctcacatgagcagttctcattcgtcgagtactgtcctccctctgctaactcaactccggcctcaacccctgaactcgctcggcgctcttccgggctttcacggtcccgtagccagccatgcgtgttgaatgataagaaggtgggggttaagcgtcggcgacccgaagaggtccaggaacagcgcccatctcttgacctcgccaagatggctcagaactgtcagaccttcagttcgttgagctgcttaagcgcaggcacggaggactgtggcccacagtctcctttcgcccgccatgtgtctaacacacgggcttggacagccctgctatccgccagcggtccaggaggccggactcctgctgggacgcctgtgcctgagccattaccaccgagtttcgacgatcacctggcctgtcaggaagatctgtcctgcgaggaaagcgatagttgtgctctggacgaagattgcggccgccgggcggaacctgcggccgcctggcgcgacagaggggccccagggaattccctgtgtagcctggacggagagcttgatatcgagcagattgagaaaaactag

SEQ ID NO: 47492 - DNA, 1269 bp, Artificial Sequence
  Description of Artificial Sequence: Synthetic coding sequence
atggtgatggtgctgagcgagagcctgagcacccggggcgccgactccatcgcttgtggtacattcagtcgcgagcttcacacacccaagaagatgtcacaaggcccaacactattttcctgtggcataatggagaacgatcggtggcgagacttggatcgaaaatgcccgctgcaaattgatcagccctccacatctatctgggagtgtttgcccgagaaggatagctctctgtggcatcgcgaggcagtgactgcctgtgctgtgacgagcctgattaaagatctcagtatcagtgaccacaacggcaacccatcagccccaccttccaagagacagtgccggtccctctccttttccgatgagatgagcagttgcagaacgtcctggagacccttgggttccaaggtatggacacctgtggagaagcgccggtgctacagcggcggctccgtgcaacggtacagcaacggctttagcaccatgcagcgcagcagctccttctctctacctagcagggctaatgtattgtcatcaccatgcgatcaggctggtctccaccacagatttggaggacagccttgtcagggagttccgggctctgcaccgtgcgggcaggctggcgacacttggtcccccgacctgcacccggtcgggggagggagactcgaccttcaacggtcattgagttgtagtcacgagcaattctctttcgtcgaatactgccctccctccgcaaacagcacacccgcctccacgcctgaactcgccagacggagttccgggctgtcacgaagtaggtcacagccttgcgttttgaacgataaaaaggtcggggttaagaggaggagacctgaggaggttcaggagcaaaggccatcactggatctggccaaaatggcacagaattgccagactttcagtagtctgagttgtctatctgcaggtaccgaagactgcggaccccagtccccatttgcccgtcacgtctcaaatacgcgggcttggacggctctcctcagtgcatctggcccaggcggtcggactcccgctgggactccagtaccagagccactccctccaagcttcgacgaccatctggcttgccaggaagacctctcttgtgaagagtctgactcttgcgcgctggatgaggactgcggcaggagggccgagcccgcggctgcctggcgcgaccgaggtgcgccgggcaactcactgtgtagtctggacggtgagttggatattgagcagattgagaaaaattag

SEQ ID NO: 47493 - DNA, 1179 bp, Artificial Sequence
  Description of Artificial Sequence: Synthetic coding sequence
atgatcaccctgatcaccgagcagctgcagaagcagaccctggacgaacttaagtgtacccgcttcagcatttctctgccgcttccggaccacgctgacatctcaaactgcggcaattcttttcagttggtatccgagggagccagctggcgcggtctacctcattgttcttgcgccgaattccaggactcattgaactttagttatcaccccagtggcctatctctccacttgagacctccatccaggggaaactcaccgaaagagcagcccttttcacaagtccttaggcccgagcctcccgacccagaaaaactccctgtgccacctgccccaccgagcaagcggcactgtcgcagcttatcagtccctgtggatctcagtcgctggcagccagtgtggaggccggctccttctaaactgtggactcccattaagcaccgcgggagcgggggtgggggcgggcctcaagtgccgcaccagtccccaccaaagagagtgtcatctctgaggtttctccaagctccgtctgccagtagccagtgcgcccccgcgcaccgaccttatagccctcccttttttagtttggcactggcccaggattcttcccggccatgtgccgcttcaccacagtccgggagctgggaatctgacgccgagagtctgtccccttgccctccccagagaaggttttcactgtcaccctcactgggcccccaggcctcccggttcttgccgtctgcccggtcaagccctgctagtagccctgaactgccctggcggccgcgaggcctccgtaacctgcctagaagtcggtctcagccgtgtgaccttgacgcccgcaaaaccggagtgaagcgtagacacgaggaggatccacgacgtttgagaccatctcttgacttcgacaagatgaaccagaaaccatactctggcggcctgtgcttacaggagaccgctagggagggtagcagcatctcaccaccttggtttatggcctgttctcctccccccctctcagcgtcatgcagtcccaccggcggctccagccaagtactgtccgagtcagaagaagaggaggaaggtgctgtgcgctgggggcgtcaggcactgtccaaaagaactctttgccagagagattttggcgatctggatttgaacctgattgaagaaaactag

SEQ ID NO: 47494 - DNA, 1179 bp, Artificial Sequence
  Description of Artificial Sequence: Synthetic coding sequence
atgatcaccctgatcaccgagcagctgcagaagcagaccctggacgagctgaaatgcacaaggttcagcatcagccttccacttccggatcacgcagatatcagcaattgcgggaattccttccagcttgtgtccgaaggcgcatcgtggcgaggactcccacactgctcttgtgctgagtttcaagacagcctgaattttagctaccacccctctggactgtcactgcacttgaggccccctagccggggaaactccccaaaggagcagccattcagccaggtgttacgcccagagcctccagacccagagaaactcccagtgccgcccgccccaccttccaaaagacactgtcggtccctctccgttccggttgatctgagtcggtggcagcctgtctggagacccgcacccagtaagctgtggactcccatcaaacacaggggcagcggcggcggcggaggtccacaggtccctcatcaaagcccaccgaagagagtgtcctcactgcgcttcctgcaagcaccatctgcgagttcacagtgcgcacctgcccatcggccatacagcccacccttctttagcctagccctggcgcaagattcttctagaccctgcgctgcatctcctcaatctggatcctgggagtccgacgctgagagcctgagcccttgtccgccacagcggcggttttcattaagcccaagtctaggcccacaggcgagtcgattcctcccttcagcccggagctcacccgcatcttctcctgagctcccatggagacctcggggcctgcgcaacctgcctcggagccgatctcagccttgcgaccttgacgcacggaagactggcgtcaagaggaggcatgaggaggatccgaggaggttgcgccccagtttagattttgacaagatgaatcagaagccgtatagcggtggactgtgcttgcaagagacagcccgcgagggctcttctatttctccaccgtggtttatggcttgctcacctcccccactgtcagcctcttgttcacctaccggggggtcgtcccaggttctctctgagtcagaggaagaggaggaaggcgcggtgcggtggggcagacaggcattatccaaaaggactctgtgtcaaagagactttggcgatctggacctgaaccttattgaagaaaattag

SEQ ID NO: 47495 - DNA, 1158 bp, Artificial Sequence
  Description of Artificial Sequence: Synthetic coding sequence
atgagcctgatcctgaacatcctgcgggagatgctggagtacttcggagtgcctgtcgagcaggtgttactcatatgggaaaataaggattatggaagtacgcggagtatcgtccggataatcggaaaaatgctgccactggagccctgccgccgaccaaacttcgagttaattcccctccttaactctgttgactccgataattgcggatctatggttccctctttcgcagatattctctacgtggccaacgatgaagaagcaagttacctccgtttcagaaattccatttggaagaacgaggaggaaaaggtagagatttttcaccccttacgattagtcagagaccccctgtctcctgccgtcaggcagaaggaaaccgtcaaaaatgatttgccagtgaacgaggccgccatacgaaaaatagccgctcttgagaatgagctgacttttctgaggtcccagatagccgcaattgtcgagatgcaggaactgaagaacagcactaactccagctcctttggattgagcgacgagcgcatttctttaggtcaactttcatcttccagagccgcccatctttctgtcgaccccgaccagttgccaggctccgtactctcaccacccccacctcccccactgccccctcagttctccagcctgcaaccaccttgttttccacctgtccagcctggctccaacaatatctgtgatagtgataaccccgctaccgagatgtcgaaacaaaatccagcagcaaataagactaattactcacaccattccaagtcacagcgcaataaggacattcccaatatgctggatgtgctgaaagacatgaacaaagttaaattacgcgcaattgagcggagtccaggtggcagaccaattcataagcgcaaaagacagaatagtcactgggatccagtcagcctgattagccatgccctcaaacaaaagtttgcttttcaggaggacgatagtttcgaaaaagaaaataggagctgggaatcatctcctttttcaagccccgagaccagccggttcggtcatcatattagtcagtctgagggccaacgcactaaagaagaaatggtcaatactaaagctgtggatcagggcatatcaaacactagcttattgaactcgcggatttag

SEQ ID NO: 47496 - DNA, 1158 bp, Artificial Sequence
  Description of Artificial Sequence: Synthetic coding sequence
atgagcctgatcctgaacatcctgcgggagatgctggagtacttcggcgtgccagtcgagcaggtactcctcatttgggagaataaagactatggctctaccagatctatagtgagaatcataggaaagatgctgcctctggagccctgcagaagacctaacttcgaactgatccctctgcttaacagcgtagatagcgacaactgtggctcaatggtaccgtcatttgctgacatactgtatgttgccaacgatgaagaagcctcatatctgagattccgaaactcaatttggaagaacgaggaggagaaggtagagatctttcacccactccgacttgtgagggatcccctgtcccccgccgtcagacaaaaagagactgtaaagaacgatctgccagtcaacgaggccgcaatccgcaagatcgctgccctggagaacgagctgacttttttacgttctcagatagccgcaattgtggagatgcaggaactgaaaaactccactaactcatcctcatttgggctgagcgatgagcggatttcactgggacagctcagctcctcgcgggctgctcacttaagtgtcgatccggaccaacttccgggaagcgttcttagtcctccaccaccaccccctttacctccacagttttcctccctgcaacccccctgcttcccgcctgtacagcctggctcgaacaacatctgtgacagcgacaacccagctaccgaaatgtcaaagcagaatcctgccgctaacaaaaccaactactcacatcacagcaagagccaaaggaacaaggatataccgaatatgctggacgtgcttaaagacatgaacaaagttaaattgcgtgctatcgagaggtcgcccggcgggaggcctattcacaaaagaaaacgtcagaattcgcactgggatcccgtgtccctgatttcacatgctctgaaacagaagttcgccttccaagaagacgacagcttcgagaaggaaaaccggtcgtgggaaagttcaccattcagtagtccagagacgtccagattcggccaccacatctcccagtctgaagggcagaggaccaaggaggaaatggttaacacaaaagctgttgaccaaggcatcagcaataccagtttattaaatagccggatctag

SEQ ID NO: 47497 - DNA, 879 bp, Artificial Sequence
  Description of Artificial Sequence: Synthetic coding sequence
atgagcggcatggaggccaccgtgaccatccccatctggcagaacaagccacacggcgctgcgcgctccgtggtccgacggatcggtacaaacctgcctctcaagccatgcgctcgtgcctcatttgaaaccctccctaatatatccgatctgtgtttgcgcgatgtgccccccgttcccactttagcagacatcgcttggattgcagccgatgaagaggaaacttatgctagagtcaggtctgacacccggcctctccggcacacctggaaaccatcgccattgatcgtgatgcaacggaatgcctccgtccccaatctacgcggtagcgaggagaggctccttgccctgaaaaaacctgcgttgcccgcactttcccggaccactgagctgcaggatgaattaagccatttaagatcccagattgcaaagatcgtcgctgcggatgcagccagtgcaagtcttacgcctgactttctgtcgcccgggtcctcaaacgtgtcttcgcctttgccttgtttcggctcatctttccacagtacaaccagctttgtcatttctgatataaccgaagagacagaagttgaggtcccggaattaccaagcgtgccactgctatgctctgcttcccccgagtgttgcaaacctgaacataaagcagcctgtagcagctccgaggaggatgactgcgtcagtctgagcaaagcgagttcctttgctgatatgatgggtattctaaaagatttccaccgcatgaagcagtcccaggatcttaaccggtccctgttgaaagaggaggaccccgccgtcctgatctccgaggtgctccggcgcaagtttgcactgaaggaggaagacataagtcgtaagggcaattag

SEQ ID NO: 47498 - DNA, 879 bp, Artificial Sequence
  Description of Artificial Sequence: Synthetic coding sequence
atgagcggcatggaggccaccgtgaccatccccatctggcagaacaagccacacggagccgcccgctcagtggttcgacgcattggaaccaacctgcccttgaagccttgcgcccgcgccagctttgagaccctgcccaatatctccgacctgtgcctgagagatgttccaccagtccccactttggcagatatcgcctggatcgcagccgacgaggaggaaacatatgcccgggtgaggagtgacactagacctctgagacacacttggaagccaagcccactgattgtcatgcagcggaacgcctcggtgccgaacctgcggggtagcgaggaacggctgttggctcttaaaaaacccgcacttcccgccctgagtcgaaccacagagctccaagacgagctgtcccacctgaggtcacagatcgctaagattgtagccgctgacgctgcctcagccagcttaacgcccgacttcctttcgcccggctcaagcaatgtgtcaagtcctcttccatgcttcggatctagttttcatagtacgaccagcttcgtgatctccgatatcaccgaagaaactgaagtggaggtgccggaacttccctcagtacccctcctgtgctctgccagcccagaatgttgtaagcctgagcataaggcagcttgctccagttccgaggaagatgattgtgtctccctatctaaggcctcctcttttgccgacatgatgggcatcttgaaggacttccatcggatgaaacaatcccaggacttaaaccgtagcctcctgaaagaagaagatcccgccgtgctgatctctgaagtgctgcggcgaaaattcgccttaaaagaggaggacatctcccggaagggcaattag

SEQ ID NO: 47499 - DNA, 879 bp, Artificial Sequence
  Description of Artificial Sequence: Synthetic coding sequence
atgagcggcatggaggccaccgtgaccatccccatctggcagaacaaaccgcacggggcagctaggtctgtggtgcggcggatcggcaccaacttgcccctgaaaccctgtgctcgcgccagcttcgagaccctgcctaatatctctgacctgtgtctgagagacgtccctcccgtcccgactctggccgatatcgcctggatcgctgctgacgaagaagaaacctacgcccgggtgagaagcgatactaggcccctgaggcacacgtggaagccttcaccactgattgttatgcagcgaaatgcctctgttcctaatctgcgcggatccgaagagaggttattggctctgaagaagcctgccttacccgctctatcaagaacgaccgaacttcaggatgagctgtcacacctgaggtctcagatcgcgaagattgtcgccgccgatgctgctagtgcgagtttaacccctgattttttgtctccggggtcatcaaatgttagctcccccttgccctgtttcgggtccagttttcacagtactaccagctttgtgatctccgatattacggaggaaactgaggtcgaagtaccagagttgccttcagttcccctactctgtagcgcatcaccggagtgctgcaaacccgagcacaaagccgcctgctcctctagcgaagaagacgattgcgtgtccctgtctaaggcctcaagctttgcggacatgatgggtattctgaaagactttcacagaatgaagcaaagtcaggatcttaaccggtctctgctcaaggaggaggaccctgcagttttgatctcggaggtgttgaggagaaagtttgccttgaaagaagaggacattagtcgcaaagggaactag

SEQ ID NO: 47500 - DNA, 843 bp, Artificial Sequence
  Description of Artificial Sequence: Synthetic coding sequence
atgagcggcatggaggccaccgtgaccatccccatctggcagaacaaaccacatggagctgctcgctcagtcgtgcggaggataggcacaaacctcccactcaagccatgtgcaagagctagcttcgaaacccttccaaacatctccgatctatgtttacgcgatgtcccgcctgtacccactttggcagacatcgcttggattgcggctgatgaagaagaaacttacgcaagagtaaggagtgacaccagaccactccgccacacatggaagcctagtcctctgatcgtgatgcaaaggaacgcttcagtccccaatctgcgtggctccgaggagaggctcctagctctcaaaaaacctgcgttaccggccttgtcgcgtactaccgagctgcaggacgagctttctcatctgagatcccaaattgcgaaaattgtggctgctgacgctggcagctctaacgtcagcagccccttgccctgtttcggatcgtcttttcacagcaccacaagtttcgtcataagcgatattacggaggaaaccgaggtcgaggttccagagctgccatctgttcctctgctctgctcggcttcccctgagtgttgtaaacctgagcacaaagccgcttgttcatccagtgaggaggacgattgcgtatcacttagcaaagcatcaagcttcgccgacatgatgggtatattgaaggactttcacaggatgaagcagtcacaagacctcaacagaagcctgctgaaggaggaggatcccgctgtactgattagcgaggtgctccgacggaagttcgccctgaaagaagaggacatctcccgcaaaggcaattag

SEQ ID NO: 47501 - DNA, 459 bp, Artificial Sequence
  Description of Artificial Sequence: Synthetic coding sequence
atgagcggcatggaggccaccgtgaccatccccatctggcagaacaagccccacggggccgcacgatcagtggtgaggcggataggcaccaacctacccttaaaaccatgcgcccgggcatctttcgagaccctgcctaacatttcggacctttgcctgcgcgacgtgcctcccgttccaacattggcagacatcgcttggatcgcagctgatgaggaggaaacctacgctcgcgtgcgctctgacactcgcccactgcgtcacacatggaagccctccccgcttattgtgatgcagcgcaacgccagcgtccctaacctccggggatccgaggagaggcttttggctctaaagaagcccgcattgcccgcgttgagccggactaccgaactgcaggatgaactttcccatttaaggtcccaaattgccaagatcgttgcggctgacgccgcatcttag

SEQ ID NO: 47502 - DNA, 618 bp, Artificial Sequence
  Description of Artificial Sequence: Synthetic coding sequence
atgagcggcatggaggccaccgtgaccatccccatctggcagaacaagccacatggcgccgcccgatctgtggtgagaagaatcggaaccaatttacctctcaaaccatgtgcccgcgctagctttgagaccctacctaatatttcagacttatgcctgagggacgtgcctccggtccccaccctcgcagacattgcctggatagccgctgatgaagaggagacctacgctcgggtccgatcggatacacgaccgctgcggcacacctggaagccaagccccttaattgtcatgcaaaggaatgcctctgtgcctaatctgcggggttctgaggagcggttgctggcgctcaagaagcctgccctgccagccctgtcacgcacaacagaactacaggatgaactttctcatctgaggagccaaatagcaaagattgttgccgctgatgccgtcacgagcccacgtaggcagcgatggaggagcctgagcttccaccaaagtccatgttttgtgcttcccgctctaaacgtggccaatcaaaacacgaagctccccgcagttcggctgaaaagaatgacagcctccctgtgcccgaggccggccgctttgcaaacctag

SEQ ID NO: 47503 - DNA, 618 bp, Artificial Sequence
  Description of Artificial Sequence: Synthetic coding sequence
atgagcggcatggaggccaccgtgaccatccccatctggcagaacaaaccccacggcgcggcaagatcagttgtgcggcgtatcggaaccaatctcccgcttaagccctgcgcgcgcgcaagtttcgagacgctgccaaacatctccgatttatgtctgagggacgtgcctcccgttccaacacttgctgacatcgcctggattgccgccgacgaggaggaaacttatgcccgtgttagatcagacactcgacccctgaggcacacctggaaacccagccctctgatagtgatgcagcggaacgccagcgtgcccaatctccgcggtagcgaagagcgtctcctggcactcaagaaacccgcactccctgctttgtctcggacgactgaactccaggacgaacttagccacttgcgctcacagattgcgaaaatcgtggcggcagacgcagtcacatcacctagacgccaacggtggcggtctttgtcattccaccagtcaccttgttttgtcttgccagctctcaacgtggccaatcaaaatacaaagctgccagccgtccgcctgaagagaatgacagctagcctgtgtccaagacccgccgctctacagacctag

SEQ ID NO: 47504 - DNA, 333 bp, Artificial Sequence
  Description of Artificial Sequence: Synthetic coding sequence
atgagcggcatggaggccaccgtgaccatccccatctggcagaacaaaccgcatggggccgcgcggtcggttgttcggagaatcgggactaatctgcccctcaaaccgtgcgcccgcgcaagcttcgagactcttccaaacatcagcgacctgtgcctaagggacgtcccgccagtgcctaccctcgctgacatcgcctggatcgccgccgacgaggaagagacctacgccagagtccgaagcgatacacgccctctcaggcacacgtggaaacccagtcccctcatagtgatgcagaggaacgccagtgtgcccaacctgcgggggagctag

SEQ ID NO: 47505 - DNA, 513 bp, Artificial Sequence
  Description of Artificial Sequence: Synthetic coding sequence
atgagcggcatggaggccaccgtgaccatccccatctggcagaacaaaccccacggggcagcacgttccgtcgttcggcgcatcgggacaaacctgcccttaaaaccctgtgcacgcgctagctttgagacgttacccaacattagtgatctgtgcctgagagatgtccctcctgttcctaccctcgcagacatcgcttggatagcggctgatgaggaggaaacctacgcccgcgtgagatctgacacacggccactaaggcacacctggaaaccaagccccctgatcgttatgcagcggaacgcctcggttcccaatctgaggggaagtgaagagcggctgttggctctgaagaaacccgccctgcccgcactgtcaagaacaaccgagctgcaggatgagctgtctcacctgagatcacagatcgccaagatcgtagccgctgacgccgcttccgcgtccctgacccctgactttctgtcccccggatccagtaacgtgtcaagcccttag

SEQ ID NO: 47506 - DNA, 348 bp, Artificial Sequence
  Description of Artificial Sequence: Synthetic coding sequence
atgagcggcatggaggccaccgtgaccatccccatctggcagaacaagcctcacggagctgctagaagtgtagtgagacggattggtacaaatctcccattgaagccgtgtgcccgcgcatccttcgagaccttaccaaacatctcagatctgtgcctgagagacgtaccccctgttccaaccctggcagacatcgcctggatcgcagccgacgaggaggagacatacgcgcgagtcaggtccgatacccggcctttaagacatacatggaagccatcccccttaatagtgatgcaaaggaacgcctctgtccccaacctccgggggagcgaggagcgactgttgtag

SEQ ID NO: 47507 - DNA, 1995 bp, Artificial Sequence
  Description of Artificial Sequence: Synthetic coding sequence
atgcaccggatgcccgaccccggcaagttcaagctgctggagcaggcgagagatgtccgagagcccgtgaggtactttagtagcgtggaggaggtggccagtgtgttccccgaccgcatattcgtgatggaagcaatcacgtttagcgtgaaggtggtttctggtgagttctcagaggatagtgaggtgtacaattttacactgcatgcaggggatgagctaacgctgatgggccaagctgagatcctgtgcgcgaaaacaaccaaagaacgctctcgattcaccactctgttgaggaaactcggtcgagcgggagctctggcgggtgttgggggcgggggacctgccagtgcgggcgccgccggtggtactggcggcggcggtgcccggccggtgaagggcaagatgccctgtctgatatgtatgaatcaccgaacaaatgagagtttatctcttccctttcagtgccaggggcgatttagcacgagaagtcctctggagttgcaaatgcaagaaggtgagcacactgtcagggcaataatcgagcgcgtccgcttgcccgtgaatgtgcttgtgccttcccgacctcccaggaacccatatgatctgcaccccgtgcgagaaggccattgctataaactggtgagtattatttccaaaactgtggtccttggcctggctctgcggcgcgaaggccccgcgcctctgcatttcctcctgctcaccgacacaccacggttcgccctgcctcaggggctattggcaggtgacccaagggtcgaaagactggtgcgggactcggcctcttattgcagggagagattcgaccctgatgagtattccacggccgtgagagaagcaccggctgagttggctgaggattgtgcttcaccccgacgagcccgtctgtgtctgcctgcgcctagagcgcccggtctagccagggcccccggcccactcgcgccggcgccggctggggagggagatcaggaatatgtttcaccggattgggccgctgctccagaacctgcagcaccgcctgccgagatcccttatgaggaactgtgggctcaccaggggcctgagggactggttagacccccacctggactggacctgatctccttcggtgctgccggcccaccacgccgggaacccgaagcacctccacctcctgtgccacctaagtcagaagccgtgaaagaggagtgccgactgctgaacgcaccacccgtgcccccacggggaggaaacggatctgggcgtctcagcagttccccccctgtgccgccaaggttccctaaacttcagcccgtacactctcccagtagtagccttagctactattccagcgggttgcaagatggcgctggatctaggtccggcagcggatcccccagccctgatacctacagcttatactgttatccctgcacctggggcgactgcaaagaacccgtgctcgagcccttcgacccctttgaactgggccaggggtcgtctcctgagcccgaactcttaagatcccaagagccacgggcagttggtacgcctggaccgggaccaagattgtcccccctgggcccatccaaggccttcgaacccgaaggactagttctgcatcaggtgcctactccgctgagtccagccgcgctgcaaggccctgaagctggcggggccctgttcctgacacagggcaggttagaaggccctcccgcaagccctcgggatggagccacaggattcggagtcagggacgccagctcgtggcaaccacccgcagacctctccgccctgagcttggaggaagtgagcaggagcctgagattcattggtcttagcgaggatgttgtatctttcttcgcccgcgaacggatcgacggcagtattttcgtacagttgtccgaggacatcctcgcagatgatttccatctgaccaaacttcaggtcaaaaaaataatgcagtttatcaaggggtggaggcctaagatctag

SEQ ID NO: 47508 - DNA, 2631 bp, Artificial Sequence
  Description of Artificial Sequence: Synthetic coding sequence
atggaccccgcccccagcctgggctgcagcctgaaggacgtgaagtggagctccgttgctgtcccccttgacctccttgtatctacttaccggctcccacaaattgcccggctcgacaatggcgaatgcgttgagggccttcgggaaaatgattatctgctcatccactcatgcagacagtggaccaccatcactgcccatagtcttgaggaaggtcattacgtgatcggccccaagatagagataccagttcactacgccggccagttcaaactcctagaacaggatcgggacattaaggaacccgtccagtactttaatagcgttgaagaggtcgccaaagccttccccgagcgcgtttatgttatggaagatatcactttcaacgttaaggtcgcgtccggtgagtgtaacgaggataccgaagtgtacaatattacactctgcacgggcgatgaactcacactcatggggcaagcagagatactatatgccaagacattcaaagaaaagagccgactgaatacaatatttaagaagattggaaagctgaattccatctcaaagctggggaaggggaagatgccctgcctgatatgtatgaatcaccggactaacgagtcgattagcctgcctttccagtgcaaagggagattcagtaccaggtctccactcgagctgcagatgcaggagggggaacacacaatccgaaacattgttgagaaaacacgcctacctgtcaatgtgacagtgcccagcccccctcctcgcaatccatatgatttgcacttcatcagggagggacatcggtataaatttgttaatattcagactaagacagttgtcgtatgctgcgttttgcgcaataataagatcctgccaatgcacttcccgcttcatctgactgttcctaagttcagcctgccggagcacctcgttaaaggtgagtcttggccagagaccctggtgcaccattggctgggcatttgccaggaacagttcgatattgatgaatattctcgggccgtgcgcgacgtgaaaaccgattggaacgaggaatgcaaatcaccaaagaagggaaggtgttccggacataatcatgtgcctaatagcttgtcatacgcccgcgacgagctcactcaaagcttccacaggttatcggtatgtgtgtatgggaataacctgcacgggaactcagaagtaaacctccacggatgtcgggacctcggaggggactgggcgcctttcccccatgacatcctaccgtatcaagactctggcgactcaggtagcgattatttattccccgaagcttctgaagagtccgcgggcattcccggaaaatctgagctgccatacgaggagctgtggctagaagagggcaaaccctctcaccaaccattaacacgatcgttgtcagagaagaaccgatgcgaccagttccgcggaagcgtccgctccaaatgtgcaacatcaccactccccatcccgggcaccctgggggcagcagtgaagtcttcagatacggcactcccccctcctccagtgccacccaagtccgaggccgttcgcgaggagtgtcgtctactgaatgcacctcccgtaccaccgaggagcgcaaagccgctgagcacgtctcccagtatcccgccgcgcaccgtgaaacctgctcgtcagcagacccgcagcccgagccccaccctgagctattatagttctggacttcacaatatcagtgtgaccaagacagataccaacccctctgaatctacccccgtctcttgttacccatgcaaccgggtcaaaaccgatagtgtagaccttaaatctccctttggatcaccttccgcggaggcagtgtctagtagattgtcctggccgaatcattatagcggcgcatctgagtctcagacccgttcagattttctgctcgacccgtcccgaagttacagctaccccaggcagaagacacctggaactcccaaacggaattgcccagcaccatttgactttgatggatgcgaattgttggctagccctacatcaccagtgactgccgagttcagcagtagcgtgtccggttgcccgaagagtgcatcctactcactcgagtctacagacgtgaagagcctcgctgctggcgtcaccaaacaatcaacttcctgtcctgccctgccacccagagccccaaagctggtggaggaaaaggtggcatccgaaaccagtcccctcccattgaagatcgatggggcagaggaagatcccaagtccggttctccagacctctcagaagaccagtactttgttaagaagggaatgcaagatattttcagtgcaagttaccctttttcatctccactgcacctccagctggcgcctcgaagctgcggagatgggtcaccatggcagcccccagctgacttgagtggcctttcgatcgaggaggtatccaagtctctgagatttattggtctgtcagaggacgtgatatccttttttgtcacggagaagattgatggaaacctgctcgtccagcttacagaggaaatcctgagtgaggacttcaagttgtccaagctgcaggtgaaaaaaattatgcagttcataaacggctggcggcccaagatttag

SEQ ID NO: 47509 - DNA, 2628 bp, Artificial Sequence
  Description of Artificial Sequence: Synthetic coding sequence
atggaccccgcccccagcctgggctgcagcctgaaggacgtgaagtggagttctgttgccgtccccttagatctgctcgtgagtacttaccggctgccccaaattgcccggctagataatggtgagtgtgtcgaggggttacgggaaaatgattatttgctcattcactcatgccggcagtggacgaccattactgcgcattccctggaggaagggcactatgtgataggacccaagatcgaaatccccgttcattacgccggacagtttaaactgcttgagcaggatcgagacatcaaagaaccagttcagtatttcaattctgtggaggaagtggccaaggcatttcccgaacgggtctacgttatggaggatattaccttcaatgtgaaggttgcttctggtgaatgcaacgaagacaccgaggtctacaatatcaccctgtgcacgggtgacgagttgaccctaatgggccaagcggagatactgtatgccaagacctttaaagaaaagtccagactgaatactatctttaaaaagataggcaagctcaattccatttctaaactggggaagggaaagatgccttgccttatctgcatgaaccaccgcaccaatgagagcattagtttgccatttcagtgcaaggggcgtttctcaacccgcagcccactggaactccagatgcaggaaggagaacacacaattagaaacatcgttgagaaaactcgacttccagttaacgtgactgtgccgagccctccaccacgcaacccctacgacctgcatttcatccgggaaggccaccgctacaaattcgtcaatatccaaactaaaacagtggtggtatgctgtgttctccgtaataataagatcctccctatgcactttcctcttcacctgacggtgcccaaattctctctccccgaacacctggtcaagggagagagctggccagaaaccctcgtacaccactggctgggaatctgccaggagcaattcgacattgatgagtactctcgcgccgtgagggatgtaaagacagattggaatgaagagtgtaaatctccaaagaaaggccgatgttccggacataaccacgtaccaaatagtctgagttacgcgcgggatgaactgactcagagtttccatcgtctcagcgtatgcgtgtacggcaataacttgcatggaaattccgaagtgaatttacatgggtgtcgcgatctcggcggagactgggcacccttcccccatgatatattgccataccaggacagtggagattcaggaagcgactatttgtttcccgaggcaagcgaagaaagcgctggtatcccaggaaagagtgagctcccgtacgaggagctttggctcgaagaggggaaaccctcacatcagcctttaacacgcagccttagcgaaaaaaatcggtgcgaccagtttagggggtccgtaagatctaagtgcgcgacgtcccccctgccgattccgggaaccctgggagcggcagtcaagtcaagcgacaccgctctcccacccccccctgtgcctccgaagagtgaagcagttagagaggaatgtcggctcctcaatgcccccccggtgcccccaaggtcggccaagccactgtccaccagccctagcattcctcccagaacggtgaaacctgccaggcaacagactagatccccctcccccactctgtcatattattcctctgggcttcacaatatcgtaaccaagaccgacaccaacccttcagaatctactcccgtgagctgttatccctgtaatcgggtaaagaccgacagtgtggatctcaagagtcccttcggatctcctagcgccgaagccgtttcctctaggctttcgtggcctaatcactattccggagctagcgaaagccagacgagaagcgacttcttgctggatccaagtcggtcttatagctaccctcgccagaagacaccaggtacccctaaacgaaattgtccagccccctttgacttcgatggctgtgaactcttggcctcaccgacctcccctgtcacagcagagttctcatctagcgtctcgggatgtcctaaatccgcatcttatagtctcgagagtacggatgtcaagagcctggccgccggtgtgaccaagcaaagcacgtcttgccctgccctgccgccccgggcccctaaactcgtcgaagaaaaagtcgccagcgaaacaagccccctgccattgaagattgacggggctgaagaggatcccaagtccggcagcccagacctctctgaggatcagtatttcgtgaagaaggggatgcaggacattttttcggcgtcgtatccgttcagttcacctcttcatctgcagcttgcacctcggtcctgcggggacggttccccctggcagcccccagctgatctgtctggtttgtcaatcgaagaagtctccaagagtctgagatttatcggactctccgaggatgtcatttctttttttgtgacagaaaaaatcgacggaaacctgttggtgcagcttacagaggagatcctgagtgaggattttaaactttccaaactccaagttaagaaaatcatgcagtttatcaatggatggcggcccaaaatatag

SEQ ID NO: 47510 - DNA, 2625 bp, Artificial Sequence
  Description of Artificial Sequence: Synthetic coding sequence
atggagaagctggccgccggcctggccggcctgcggtggagcatgggagcctttcctctagatctcatagtgagccgttgcagactccctacactcgcatgcctcggccctggcgaatatgctgaaggtgtgtctgagcgggacatattacttatccactcttgtagacagtggactacggtcaccgcccacaccctggaagaggggcactatgtgatcggccctaagatagacatccccttgcagtacccgggtaagtttaagcttctcgagcaagccagagacgtcagggagcccgttaggtacttctcttccgtggaagaagtggcaagtgtgtttccggatagaatcttcgtgatggaagctatcacattcagtgtgaaggttgtgtctggtgaattcagcgaggactcggaggtctataatttcaccctccatgccggtgatgagcttactttgatgggtcaggccgagattctatgcgcgaaaactacaaaagaaagatccaggttcaccacactgctgcggaaactggggcgtgcaggggccctagccggagtaggcgggggcggccctgccagcgccggagctgccggcggtaccggcggggggggagctagacctgtgaaagggaagatgccatgtctgatatgcatgaaccatcgcacgaatgaaagcctctctttaccctttcagtgccagggcagattcagcactcgcagtccactggaactgcagatgcaggaaggagagcacactgtgcgagcaatcattgaaagggtgagattaccggtcaatgtgctagtgccatctagaccacccaggaatccctatgatctccaccccgtgcgggaagggcattgctataagctcgtctccattatttcaaagaccgtcgtcctggggcttgccctgcggagggagggcccagcccccctccacttcttattgctcacagatacccccaggtttgccttgcctcagggccttctggcaggcgatccccgagtagagcgtctggtgagagattccgcctcatactgcagagagagattcgatcctgacgaatactcaaccgctgtgagagaggcacctgctgagttagctgaagattgtgcctcccccagacgcgcgcgcctctgcctgccggcccctagggccccaggcctcgcaagagcaccaggtccccttgccccagccccagccggggaaggggaccaggaatacgtgtctcccgactgggccgctgctccagaacccgccgcaccacctgctgagattccttacgaagagttgtgggctcaccaggggcctgaaggtcttgtccgtccaccgcccggattagacctgatctccttcggtgccgcaggccctcccagacgcgaacccgaagcccctccaccacctgtaccgcctaaaagcgaggcagtaaaagaagaatgtaggctgctaaatgcccccccagtgccacctaggggcggaaacggctccgggaggctaagcagctccccacccgtgcctccccggtttccaaaacttcagccagtccatagccccagctctagcctttcctattactcatctgggctgcaagatggggccggcagccggtctgggagtggcagcccatctcctgacacatattccctgtactgttatccttgcacgtggggcgactgcaaggtaggggagtcctctagcaggccggccccaggacccctgcccagcaccactcaaccttcacaggcgtcccgagctctgaccgaacccctatctggtcgcgccgctagtctgctgggcgccgacactccagtgaagacctatcactcctgccctccactgttcaaaccttcccatccccagaagcgatttgcaccctttggggccctgaacccattctctggccctgcttaccccagtggcccctccgcggccctctcgagtggccctagaacaacttcgggccccgtcgccacttccggtccagcttacagtcctggaccggcctcccccggccaagcttattccgccgcaccacctagctcttgcgcaccgtcctcatctagctcctccgaatggcaggagcctgtcctcgaaccgtttgatccctttgagctaggtcaggggtcatcccctgagccagagctgttgcggagtcaggagccacgcgctgtcgggacccccggacctgggccccggttgagcccgctgggccccagcaaggcatttgaaccagaaggcctggtgttgcatcaggtccccacacccctgtcccccgccgcactacaaggtccagaggccggcggggccctgtttctgacacagggccgcctagaggggccccctgctagtccacgtgatggcgctaccggctttggcgtgcgtgatgcttcatcctggcagcctccagccgatctgtcagcactgtctctggaggaagtctcaaggtcccttaggtttatcgggcttagtgaggatgttgtttcatttttcgctcgggagcggatagatggaagcattttcgtacaacttagtgaggacattctggcggatgattttcatctcaccaagcttcaggtgaagaagatcatgcagttcattaaagggtggcggccaaagatctag

SEQ ID NO: 47511 - DNA, 666 bp, Artificial Sequence
  Description of Artificial Sequence: Synthetic coding sequence
atgttcggcttccacaagcccaagatgtaccggagcatcgagggctgctgtatctgccgtgccaagtccagttcctccaggtttaccgactccaagcgttatgagaaagattttcagagctgtttcgggctgcacgagactagaagcggagacatctgtaacgcatgtgtgctcctggttaagagatggaaaaagctacctgccgggagcaaaaaaaactggaaccacgtggtcgacgcacgggcggggccttcactgaagacaacccttaagcctaaaaaggtgaaaaccttgtccggaaatcggattaaatccaaccaaatctcaaaactacaaaaagaatttaagaggcacaactccgacgcgcactcaactacgtccagcgcttcacccgcacagagcccctgctactcaaaccagtcagatgatggctccgatactgagatggcaagtggatctaataggaccccggttttctcattcctggatctgacctactggaagcgacagaagatatgttgcggcattatctacaaaggcagatttggcgaagtgctaattgacacacatctgttcaagccctgctgctcgaataagaaggcggcagctgaaaagccagaagagcagggtccggaacctctgcccattagcactcaggagtggtag

SEQ ID NO: 47512 - DNA, 222 bp, Artificial Sequence
  Description of Artificial Sequence: Synthetic coding sequence
atggccagcggcagcaaccggacccccgtgttcagcttcctggacctcacctattggaagcgccagaagatttgttgcgggataatatacaaaggacgattcggagaggtgttgatagacacccacctttttaagccttgttgttcaaataagaaagcagccgctgagaaaccagaggagcagggacccgagccattgccaatctcaacgcaggaatggtag

SEQ ID NO: 47513 - DNA, 789 bp, Artificial Sequence
  Description of Artificial Sequence: Synthetic coding sequence
atgagctacctgcccaccaacccccccggcagcatcctggccggctcagcctctctgagcgccgttacaggagttccggaaggggaggcaagattcacagaagactattgccctgaggaaaagatgttcggcttccataaacctaagatgtatcgctccattgaggggtgctgtatctgccgagccaaatcttcttcatcccgattcaccgatagtaaacggtatgagaaagacttccaatcatgcttcggcctacatgagaccaggtccggcgacatttgtaatgcctgcgtcctgctcgtgaagaggtggaagaaacttcctgccggaagcaaaaaaaactggaaccacgtggtggacgcccgcgctggaccctccctcaagacaacccttaaaccgaagaaggtgaaaactctctcaggaaacagaataaagtcaaatcagatctctaaacttcagaaagagttcaagagacataacagtgacgcacacagcacgacatcctccgccagccccgctcagtctccctgttactcaaatcagagcgacgatggctccgatactgaaatggcgagtggctcgaacagaactccagtattctcttttctggatttaacatactggaagcggcaaaaaatttgttgcggcatcatttataaagggagattcggtgaagtcctgatcgatacccacctgtttaagccttgttgctctaataagaaagctgctgctgaaaaacccgaggaacaggggcctgaacctctgcctatctcaacacaggaatggtag

SEQ ID NO: 47514 - DNA, 666 bp, Artificial Sequence
  Description of Artificial Sequence: Synthetic coding sequence
atgttcggcttccacaagcccaagatgtaccggagcatcgagggctgttgcatctgccgggccaaatcctcctctagtcgctttactgattctaagcgctatgaaaaagatttccagtcatgttttgggctgcacgaaacacgcagcggggacatttgtaacgcatgcgtcctgctcgtaaagagatggaagaagctcccggcagggagcaaaaaaaactggaaccatgtggtggatgctcgcgccggcccttcactgaagacgaccctcaaacctaaaaaggtgaaaactctgagcggaaatcgcatcaagtcaaatcagatctcaaaactgcaaaaggagtttaagcgccacaattcagacgcccacagcaccacctcctctgctagtcctgcccaatccccatgctattccaaccagtccgatgacggttctgataccgagatggcatccggaagtaaccgcacccccgtgttctccttcctggacctgacttattggaagagacaaaagatctgctgcggcattatttacaaggggagattcggggaggtgctcatcgacacacacctcttcaaaccctgctgttccaacaagaaagccgctgcagagaagcctgaagagcagggtccagagccgttaccaatttccacccaggagtggtag

SEQ ID NO: 47515 - DNA, 405 bp, Artificial Sequence
  Description of Artificial Sequence: Synthetic coding sequence
atgttcggcttccacaagcccaagatgtaccggagcatcgagggctgctgtatatgtagagctaagtcctcaagcagcagattcaccgactcaaagcggtacgagaaggattttcagtcatgcttcgggcttcacgaaactcgcagcggcgatatctgcaatgcctgtgtgcttctggtgaagcgctggaaaaaactgcctgcaggctctaagaagaattggaaccatgtggtcgacgcaagagcaggtccatcgctcaagactacacttaaacctaagaaggtgaagacactctctgggaacagaataaagtccaatcagatcagtaagttgcagaaggaattcaaacgtcataattcagacgcacatagcacgacatccagcgcctcgccggctcagtcctag

SEQ ID NO: 47516 - DNA, 384 bp, Artificial Sequence
  Description of Artificial Sequence: Synthetic coding sequence
atgttcggcttccacaagcccaagatgtaccggagcatcgagggctgctgtatttgcagggccaaatcttcctcatcaagattcacagatagtaaacgctacgagaaagactttcaaagctgtttcggcctccacgagacacggtcaggagacatttgtaatgcctgcgtcttgcttgttaaaagatggaaaaaactccctgctggctctaagaaaaactggaaccacgtggtggatgctcgggcaggcccatccctcaagaccacactgaagccaaaaaaggtgaaaaccttgagcggcaatagaataaaatccaatcaaatttcgaaactgcagaaggagtttaagcggcacaattcagacgcccattccactactagctag

SEQ ID NO: 47517 - DNA, 984 bp, Artificial Sequence
  Description of Artificial Sequence: Synthetic coding sequence
atgaacatcctgttcctgcagtggaaggtgaagctgcccccccagaaggaagtgataaccagcgatgagctcatggctcaccttgggaactgcctcctttcaatcaagccacaagagaaaagcgaaggactgcagctcaatttccaacaaaatgtggatgatgcaatgacagtgctgcccaaactcgcaaccggattggacgtaaatgtgcggtttacaggagtttctgactttgaatatacacctgaatgttcagtgttcgatctgcttggaatcccgctctaccacggctggctggttgatccacagtctccggaggccgtacgcgccgttggaaaactgtcatataatcagctcgttgaacgtatcatcacctgtaagcactcatccgacactaacctggtgactgagggactgatcgccgaacagtttctggaaacaacggctgctcagctgacatatcatggtttgtgcgagctgacagctgccgccaaagaaggggagctgtccgtcttctttcggaacaatcacttttctacaatgactaaacacaagagccacctgtatctcctggtgacagatcaagggttcctccaggaggagcaggttgtgtgggaatcactccataatgtcgacggtgacagctgtttctgtgacagtgattttcacctcagccactccctcggaaaagggccgggagccgagggtgggtccgggagtccggagacacagctgcaagtcgaccaagactatctgattgcactgtcactgcagcaacagcaaccccgcgggcctctgggattgactgacctcgaactcgctcaacagttgcagcaggaggagtatcagcagcagcaggccgcccagccagtcaggatgcgcaccagagtcctttccctgcagggcagaggtgccacttcaggtagacctgccggggaacgacggcaacgccctaaacacgaatctgactgcattttactgtag

SEQ ID NO: 47518 - DNA, 1554 bp, Artificial Sequence
  Description of Artificial Sequence: Synthetic coding sequence
atgctgctgggccccccccccttcaacgagagcaccaagcccagcccatccccatgtcactctttcgcgtcgcaggcctggctgagacaggttccggaagtgagcaagcaccttcagtgtccatcagccaaatctcttcttactatggagtaccaccagccagaggacccagccccaggtaaggccggcaccgccgaagctgtgattcctgaaaatcacgaagtccttgctggtccagacgaacatccccaggacaccgatgctagagacgccgatggtgaagcccgcgagagagaacccgccgaccaggctctgctgcctagccagtgcggcgacaaccttgagagcccacttcctgaggcctccagcgcccccccaggacctaccctgggcactctgccagaagtcgaaaccataagagcttgtagcatgccacaggagctcccccaatccccgcggacccgacaaccagagcctgatttttattgtgtcaagtggattccttggaaaggagaacagactcctatcatcacgcagtccactaacggtccatgccccctgttggctatcatgaacatcctattccttcaatggaaggtgaaattaccgcctcaaaaggaagttattactagtgacgaactgatggcgcaccttggcaactgtctcctctccatcaagccccaggagaaatcagaaggcctgcaactcaatttccagcagaatgtcgatgacgcaatgactgttctgcctaaattggccactggtctagatgtgaatgtccggttcaccggcgtgtcagacttcgagtacacccccgagtgctcggtgttcgatctgctgggtataccattgtatcatggctggctggtggacccacagagcccagaggctgtgagggctgtgggcaagctgagctacaaccaactggttgaacgtatcatcacatgcaaacacagctcggatacaaacctcgtgacggaggggctgattgcggagcaattcctggagacaaccgcagcccaactgacatatcatggcctgtgtgagttaacggctgcagccaaagagggcgagctctcagtgttctttcgcaacaatcatttctctactatgacaaagcataaatcacacctatacctgctagtgacagaccaagggttcttacaggaggaacaggtggtgtgggagagtctgcacaacgtagacggagattcctgcttttgtgattccgacttccatctctcccactctctgggcaagggccctggcgccgagggtgggtcaggttctcccgagactcagctgcaggtggatcaagactacctcatcgccctgtccttgcagcagcagcagcccaggggcccccttgggcttactgatctggaattggcccagcagctgcagcaggaggaatatcagcaacagcaggccgcgcagccggtcagaatgcggacgagggtcctatctctccaaggccggggcgcaacaagtggacgccccgctggtgagcgcaggcagagaccaaagcatgaatctgactgcatccttttgtag

SEQ ID NO: 47519 - DNA, 1410 bp, Artificial Sequence
  Description of Artificial Sequence: Synthetic coding sequence
atggagtaccaccagcccgaggaccccgcccccggcaaggccggcactgcagaggccgtgattcctgagaatcacgaggtactggccggacctgatgagcatccccaggacactgacgcaagggacgctgacggtgaggctagagagcgagagccagcggaccaggcgctcctgccctctcagtgcggagacaatctcgagtcacctctgccagaggcctcctcagccccgccggggcccactctcggtaccctgccggaggtggagaccattcgcgcatgttcaatgccgcaggagctccctcagtcgccacgcaccagacagccagagccagacttttactgtgtgaagtggataccctggaaaggggagcaaactcctataatcacccagagcacaaatgggccctgccccctcctagccattatgaatatcctgttccttcaatggaaagtcaagctcccaccacaaaaagaagtgattacttctgatgagctcatggcccatttgggaaactgcttgttgtccatcaagccacaggaaaagagcgaggggctgcagctgaattttcagcagaacgtggacgatgcaatgactgtgctccctaagcttgctacggggttggacgtgaatgtgcggtttactggcgttagcgatttcgagtacacaccagaatgcagcgtctttgatcttctcgggattccactttatcatgggtggcttgtggacccccaatctcccgaggccgtgcgagcagtcggaaagttatcctataaccagttagtggaacgcatcatcacatgtaagcactcttcggacaccaaccttgtgactgagggactaatcgctgagcagttccttgagactacagctgcacagctcacttaccacggtctgtgcgagcttacagccgcagccaaggaaggggaattatccgtgtttttccgcaacaatcacttcagcacaatgacaaagcacaagtctcacctgtaccttcttgtgactgaccaggggttcttgcaggaggaacaagtggtctgggagagcctgcataatgtggacggagattcatgcttctgtgactccgacttccacttatctcattctctgggtaaaggccctggcgccgaggggggctctggttcccccgaaacccagctacaggtcgaccaggactacctcatcgccctgtcacttcagcagcagcagccccgtggccccttggggctcacagatcttgagctcgctcagcagttgcagcaagaagaataccagcagcaacaggccgcccagccagtgagaatgcggactcgggtgctgagtctgcaggggcgcggggcaacaagcgggcgaccagctggtgagaggcgccagaggccaaagcacgaatcggactgtatactgctgtag

SEQ ID NO: 47520 - DNA, 1125 bp, Artificial Sequence
  Description of Artificial Sequence: Synthetic coding sequence
atgccccaggagctgccccagagcccccggacccggcagcccgagccggacttttactgtgtcaagtggatcccctggaaaggagagcaaactcctataattacacagtcaactaatggtccttgtccactcctggctatcatgaacatcctcttcctccagtggaaagtgaagctgcctccacagaaggaggtgattacctccgacgagctaatggcccacctcggcaattgtctgctgtccataaagcctcaggaaaagtctgaaggactgcagctgaacttccagcagaacgtggacgatgcaatgacggtcctgcctaagctcgctaccggactggatgttaacgtgcggttcacaggagtctcagactttgagtataccccagagtgttctgtgtttgacttgctgggtatccctctgtaccacgggtggcttgtggaccctcagagccctgaggcagtgagagcagtaggaaaactgtcttataatcagctcgtggaaaggatcataacctgcaaacattcatctgacactaacctcgtcacagagggcctgatcgccgagcagtttctcgaaaccaccgccgcccagctgacctaccatggcctttgcgaactgaccgcagctgctaaagagggtgaactgtctgtgttttttcgcaacaatcatttctccacaatgaccaaacacaagtcccacctctacctgctggtcacagatcagggcttcttgcaggaagaacaggtggtgtgggagagtctacataacgtcgatggcgatagctgtttttgcgactctgactttcacttgagccactcactcggcaaaggcccgggcgccgaaggcgggagcggcagccctgagacgcagcttcaggtagaccaggactacctcatcgctcttagcctgcagcagcaacagcctcgaggccccctgggcttaacagacctggaacttgcacagcagttacagcaggaggagtaccagcagcagcaggctgcccagcctgtgaggatgcgcacccgcgtactttctctccaagggcggggcgctacaagtggacgaccggctggcgagcggcgccagcggccgaagcacgagtcagattgcatcctcctgtag

SEQ ID NO: 47521 - DNA, 1863 bp, Artificial Sequence
  Description of Artificial Sequence: Synthetic coding sequence
atggagagcagccccgagagcctgcagcccctggagcacggcgtggcagcaggcccagcctccggcaccggatcatcacaggagggattacaagagacgcgcctggctgccggtgatggcccaggggtctgggctgctgaaacgtccggaggcaatggactcggagccgccgcagccaggcggtctctgcctgacagtgcctcccctgccggcagccctgaagtgcccgggccttgtagctccagtgccggcctggacctgaaggactccggactcgaaagtccagccgctgcagaggctcctttgaggggtcagtacaaggtcacagcctcacccgagaccgctgtagcaggcgtgggccacgagctcggaactgctggggacgcaggagcccgaccagatctggctggaacatgccaggcagaactcacagccgccggaagtgaagagcctagctctgcaggtggactttcgagttcttgtagcgacccctctccacccggtgaaagtccttccctggactctctcgagagttttagtaacctccacagtttcccctcttcctgcgagtttaattccgaagaaggcgccgaaaatcgggtgccagaagaagaggagggtgccgccgtgctccctggcgctgtcccattgtgcaaagaggaagagggggaggaaactgcgcaggttctagccgcctcaaaagaacggttcccaggtcagagcgtgtaccacattaagtggatccagtggaaggaagagaacacccctatcatcactcagaatgaaaacggtccttgtcctctcctggctatcctaaatgttctcctgctggcctggaaagtcaagttgccgcccatgatggagattatcacagccgagcagctgatggagtacctcggagactatatgctggacgcgaagcccaaggagatcagcgaaatccaacgtctaaactacgagcaaaatatgagtgatgctatggctattttgcacaagctgcagacaggtctggacgtgaacgtacggtttactggggtccgagtgtttgaatatacccctgagtgcatcgtgttcgaccttctggatattcctttgtaccacggctggctggtagatccccaaatcgacgacatcgtgaaggctgtgggtaattgcagctacaaccagctcgtggagaaaatcatcagctgtaagcagagcgacaacagtgaactcgtcagcgaaggttttgtagctgagcagttcctgaataacacagccacacaactcacatatcacggcctttgcgagttaacttccacggtccaggagggagagttgtgtgtgttcttccgaaataatcacttctccacaatgaccaagtacaaaggccagctgtatttgttggtcaccgaccagggattcctaaccgaagaaaaagttgtgtgggagtcactgcacaacgtggacggtgatggaaacttttgtgatagcgagtttcatctgcggcccccatcggaccctgagactgtgtacaaaggccaacaggaccagatcgaccaagattatttaatggctctgtccctacagcaagagcagcagtctcaggagattaattgggagcagattccggagggtatctccgacctggagctcgccaaaaagttacaagaggaggaagatcggcgcgcctcccagtactatcaggagcaggaacaagccgccgctgcggccgccgctgccagtacacaagctcaaggacagccggcgcaggcatccccatcgtctgggcgccaaagcggaaactcagagagaaagcgaaaagaaccccgggaaaaagataaagaaaaggaaaaagagaagaattcttgcgtcatactttag

SEQ ID NO: 47522 - DNA, 1866 bp, Artificial Sequence
  Description of Artificial Sequence: Synthetic coding sequence
atggagagcagccccgagagcctgcagcccctggagcacggcgtggcggcaggcccagcgtcaggtacagggtccagccaagaaggcttacaagagacaagattagccgcgggcgatggccccggcgtgtgggcagcggaaacatccggcggaaatggtctgggggccgccgccgctcggcggagtctgcccgacagcgcgagccccgctggcagccctgaagtgcccggcccatgctcaagctcggctggactggacctgaaggacagcggcctggaatcaccggccgctgcggaagcccccctcagggggcagtacaaggtcaccgctagtcccgagaccgcagtcgccggagttggccacgagctcggaactgccggcgacgccggagctaggccggatctcgccggcacctgtcaagcagaactgaccgctgccgggtccgaggaaccgtcttctgctggcggcctttcctcaagttgcagtgatcctagtcctcccggcgaaagccccagtctggacagcctggaaagctttagcaatctgcacagctttccctcctcttgcgagtttaattcagaagaaggagctgaaaatagagtgccagaggaagaggagggtgcagctgtgcttcccggggcagtgcccctctgtaaggaagaggagggagaggagaccgcccaggtcctggctgcctcgaaagaaaggtttcctggccagagcgtgtaccatatcaaatggatccaatggaaggaggaaaatacccccataattacccagaacgagaatggcccctgccccctgcttgctatcctcaacgttctcctgttagcatggaaggtgaagcttcctcccatgatggagattataactgctgagcaactcatggagtatctgggggattacatgctcgatgcaaagcctaaggagatctctgagatccagaggctcaattatgaacagaatatgagcgatgctatggccatcctacacaaactgcagacgggccttgatgtgaacgttagatttaccggagtacgcgtgttcgaatatactcctgagtgtatcgtgtttgacttactcgacatccctctgtatcacggatggctggtggacccccagatagatgatatcgtgaaggcagttgggaactgttcatacaatcaactggtcgagaagataattagctgtaaacagagcgacaactcagagctagtatcagagggcttcgtggcagagcagttcttgaataatactgccactcaactgacctatcatgggctgtgtgagctgacttctacggtgcaagaaggagaactgtgcgtctttttccgaaacaaccacttttccaccatgacaaaatataagggacagctttatctgcttgtgacggatcaggggttcttgaccgaagagaaagtcgtgtgggaatcgcttcacaatgtggatggcgacggcaacttttgtgactcagagttccacctccgacccccatcagatcctgagacagtttacaaaggccagcaggatcagatcgaccaggactatctgatggctctctcactgcagcaagagcagcaatctcaggagataaactgggagcaaatcccagagggtatatccgacctcgagctggctaagaagctccaggaggaggaggataggcgggcttcccagtactaccaggagcaggagcaagctgctgctgcagccgcagctgcatctacacaagctcagcagggccaacctgcccaggcttcaccctcatctggcaggcagtcggggaatagcgagagaaaaaggaaggagccacgcgagaaagacaaagagaaggagaaggagaaaaacagctgcgtcattctgtag

SEQ ID NO: 47523 - DNA, 2841 bp, Artificial Sequence
  Description of Artificial Sequence: Synthetic coding sequence
atgagcgtgcggctgcggttcctgagccccggcgacaccggcgccgttggggtggtgggaagatccgccagcttcgcagggttttcatcagcccagagcagacggattgctaaatccatcaaccgaaattccgtgaggagtagaatgcccgctaaatcttccaagatgtatggtactctgaggaaaggaagtgtgtgcgccgatcccaaaccgcagcaggtgaagaagatattcgaagccctcaagaggggtcttaaggagtatctgtgtgtgcaacaggcggaactggatcacctgtccggccgccacaaagacacacgtaggaattcgcgactagctttttactacgatctggacaaacagacccgctgtgtggagagacacatccggaaaatggagttccatatctccaaagtcgacgaactgtatgaagattactgtattcaatgtcgacttagagacggagccagcagtatgcagagagcattcgcaaggtgcccgccgagcagggcggctagagaatccttacaggaattggggagaagtttgcatgagtgtgcagaagatatgtggcttattgaaggcgctctggaagttcacctgggggaattccacattcgcatgaagggtctggtcggctatgcgcgcttatgccccggggatcactatgaggtcttgatgcggctgggccgccagcggtggaagctcaaggggcgtattgaatcagatgactctcagacctgggatgaggaagagaaggcgttcatccctacgcttcacgagaacctggatattaaggttactgaactccgtggcttgggttcactggctgtgggagcagtcacttgtgatatcgcagacttcttcacaacacgcccgcaagtaattgtagtggatattaccgagttgggaaccatcaagctgcagctggaagtgcagtggaaccccttcgataccgagagttttctggtcagcccttccccaacaggtaagtttagtatgggttcacgcaaggggtccctttacaactggacccctccttctaccccaagctttagagaaagatactacctgtctgtgctccagcaacctactcagcaggccttgctgcttgggggacctagagcaacttctattctatcctatctgtccgactcagatctgcgaggtccaagcctgagatctcaatcacaggaactgcctgaaatggactccttctccagcgaagacccccgcgacaccgaaacaagcacgtcagcgtcgacctccgacgtgggattccttcctctaactttcgggccccatgcctcaatcgaagaggaggcgcgcgaggacccacttccccccggattactgcccgagatggcccacctgtcgggcggcccattcgccgagcagcccgggtggcggaatctcggcggagagtcccccagcctgccacagggctccctgtttcatagcgggacagccagttctagccagaatgggcacgaagaaggggccaccggagatcgcgaagatggccctggcgtggccttggaggggcccctccaggaagttttggaactgctccgccccactgactcaacacagccacagcttagggaactcgaatatcaggtcttgggcttccgcgatcggttgaaaccttgtagggccaggcaggaacacacctccgcagagagcttaatggagtgcatccttgaatcatttgcattcctcaatgccgactttgcactcgacgagctctcattattcggcggctctcagggactccgcaaagacaggcccctgcccccaccatcatccttgaaggcctcatctagagaacttacagcaggtgcaccagagctcgatgtgctccttatggtacacctgcaagtttgtaaagctcttctccagaagctcgccagtccaaatctgtctagactagtacaggagtgccttttagaggaagttgcccaacaaaaacatgtgctggaaaccctgtctgtgttggatttcgagaaggtaggtaaggctacttccatcgaggaaataatccctcaagctagtagaacgaaggggtgcctcaaactgtggcggggatgtaccggaccaggccgggtcctgagctgtcccgccacgactttgctcaatcagctcaagaaaacattccagcatcgtgtgaggggaaaataccctggccagctggagattgcctgtagaagacttcttgaacaggttgtcagctgtggcggcttgctgcctggagcaggcttgcccgaagagcaaatcataacctggtttcagtttcacagttacctgcagcgccagtctgtctccgatctggagaaacactttacgcaactgaccaaggaggttaccctgattgaagagctgcactgcgcaggccaggccaaggtggtcagaaaactgcaaggcaagcgtcttggtcaactacaaccactcccacagactctgagagcttgggcccttctccagctggacggtacccctcgggtgtgtcgcgctgccagcgctagactcgcaggggcagtccggaaccgaagtttcagagagaaggctttgttattttataccaacgccttggccgagaatgacgcccgcttacagcaggcagcctgccttgccttgaagcacctgaagggtattgaatccatcgatcagactgcatcgctgtgtcagtctgatctcgaggctgtgcgggcggccgcgcgggagactaccctgtctttcggcgaaaagggacggctggcattcgagaaaatggacaaattatgtagtgagcaacgtgaggtattctgtcaggaagccgacgtcgaaatcacaatattttag

SEQ ID NO: 47524 - DNA, 2841 bp, Artificial Sequence
  Description of Artificial Sequence: Synthetic coding sequence
atgagcgtgcggctgcggttcctgagccccggcgacaccggcgccgtcggagtggtgggtcggagtgcgtcctttgccggcttctcaagtgcccagagtagaagaatagcgaagtcaatcaatagaaattctgtccgctccagaatgcccgcgaagagcagcaagatgtacggtaccctgcggaagggttccgtctgtgcagaccccaagccccagcaggtgaaaaagatttttgaggccctcaagagagggcttaaggagtacctttgtgtgcagcaagccgaacttgaccacctgtctgggcgccacaaagacacccgtcggaactcgcgcctcgcattttattatgacctagacaagcaaactcgatgcgtggaaagacatattcgaaagatggaattccacatatccaaggtggatgagctctatgaggactattgtattcagtgcaggttgcgcgatggtgccagttccatgcaacgagccttcgccagatgccctccaagccgcgcagctagagaatcactgcaagagctcggccgttctctgcatgaatgcgccgaagatatgtggttaatagaaggtgcgttggaggtccaccttggcgaattccacattcgtatgaaaggcctggtcggttatgcccgtctatgccccggcgaccattacgaagtgctcatgcggctgggccggcagaggtggaaattgaaaggcagaatcgagtccgacgattcacagacatgggacgaagaagaaaaggcctttatccctaccctgcacgagaatctggatatcaaagtaaccgaactgcgcggtctggggtccctcgccgttggggccgtgacatgcgacatcgccgacttcttcacgaccagacctcaagtcatcgtcgtggatattacagaattgggcacgatcaaactgcagttggaagttcagtggaacccatttgatactgaatcattcttggtgagcccaagtccgactggcaagttcagcatggggagccgcaagggaagtctgtataattggacccctccttctactccatcattcagggaacgctactatctgagcgtgctgcagcagccaactcaacaagccctcctgctgggcggccccagagcgacgagcatcctttcctacttaagcgatagtgacctccgaggaccaagcctgcggagtcaatcccaggagctgcccgaaatggattcatttagctccgaggatccaagggacactgaaacctctacctccgcatctacctccgatgtgggtttccttcctctgacctttggacctcacgcaagtatcgaggaggaggcccgggaagatcctcttccccctggtttattgcctgaaatggctcatttatccggcggccctttcgccgaacaacccggctggaggaacttgggtggggaaagtccttccctcccacagggaagcctgtttcactccggtactgcgtccagcagccagaacggacacgaggagggtgcaacgggggatcgggaagatggaccgggcgtggcactcgagggacccctgcaggaagtgcttgaactacttagacctactgacagtactcaacctcagctgagggaactagagtaccaggttcttggttttcgggatcggttgaagccttgcagagccaggcaggagcatacgtccgccgagtccctgatggaatgtatcctcgagagcttcgctttcttgaatgccgacttcgccttagatgagctgtctctgttcggcgggtcacaggggctccgcaaagatcgacctctgcccccccctagtagtctgaaggcaagttctagagagctcacagcgggcgcgcccgagctcgatgtgttattgatggtgcatctgcaggtttgcaaggccctgctgcagaagctggccagcccgaatctctcacggttagtgcaggaatgcctgttggaagaagtcgcacagcagaaacacgtactggaaaccctatccgtgctcgatttcgagaaggtgggtaaggctacttccatagaagaaattatcccccaggccagtaggacaaaaggctgtctgaaattgtggcgcggctgtacaggaccgggccgcgtcctgtcatgcccagccaccactcttttgaaccagcttaagaagacattccaacaccgggttcggggaaagtacccgggtcagctcgagatcgcctgtcggaggctcctggaacaagtggtctcgtgcggagggctgctgcctggcgctggcctgccagaagaacagataatcacctggttccagttccactcctacctgcagcgccagtctgtctctgatctggaaaaacacttcactcagctcacaaaggaggtgaccctgattgaggaattgcactgtgctggacaagccaaggtggtcaggaagcttcaggggaaacggctgggacagctccagccactgccccaaaccttacgcgcctgggccctgctgcagttggacgggactccaagagtgtgccgggcagcttctgcccggcttgccggagcagtgcggaataggtctttccgggagaaggctctgcttttctataccaatgccctggccgaaaatgacgcccggctccagcaagcagcgtgcctggccctcaagcacctgaaaggcattgagagcatagatcagacggcctcactttgccagtccgatctggaggctgtccgcgccgctgcgcgggagacaactctcagtttcggagagaaggggcggttggcattcgagaagatggacaaactttgcagcgagcagagagaagtgttctgccaggaggctgacgtggagatcaccattttttag

SEQ ID NO: 47525 - DNA, 2853 bp, Artificial Sequence
  Description of Artificial Sequence: Synthetic coding sequence
atggtgaccaccatgagcgtgcggctgcggttcctgagccccggcgacaccggtgcagtgggcgtggtgggaagaagcgcatcatttgccggtttctcaagcgcgcagtcccgcaggatcgctaagagtattaaccgtaactctgtccggtcaagaatgcctgccaaatcatcaaagatgtacggcaccttgaggaagggctcggtttgcgccgatccaaagccccagcaggtgaaaaagattttcgaagcgctgaaaaggggactgaaggagtacctctgcgtgcagcaggccgaactcgaccatttgagtgggcgccataaggacacacggagaaattcgcgcctggccttttattatgatcttgacaagcaaacgagatgtgtagaacgccacataaggaaaatggagtttcacattagcaaggtggatgagctctatgaggactactgcatccaatgcaggctgagagacggagcttcatcaatgcagagggccttcgcccgatgcccgccaagtagggcagcccgcgagagtctccaggaactgggccggagtctccacgagtgcgccgaggacatgtggcttatagaaggtgcactggaggtccatctgggggaatttcacatcaggatgaagggactggtagggtatgccaggctgtgccccggtgatcactacgaagtgttgatgcgactgggtaggcagcggtggaagctcaaaggccggattgagtctgatgactctcagacatgggatgaagaggagaaagccttcatcccaactctccacgaaaatctggatattaaagtgaccgagctgcgggggctggggtcgctagcagttggggccgtgacctgtgatatagccgacttctttactactcgcccgcaggtcatcgtggtggacatcacagaattgggcactatcaaattgcagctcgaagtccagtggaatccctttgatacagagagctttctggtctcgccctcacctactggtaaatttagcatgggcagccgaaaaggctctctgtacaattggactcctccctctacaccttccttccgtgaaagatattatttatctgtgcttcagcagccgacccagcaggccctgctgctgggcggtccacgggctacctccatcctgtcctacctctctgatagtgaccttaggggcccgagtttgagaagtcagagtcaggaactgccggagatggatagcttctcaagcgaagaccctagagacaccgagacttccacatctgccagcaccagcgacgtgggcttcctgccactgacatttggaccccatgctagcatcgaagaggaagcacgtgaggaccctttgccacccggtttgctccccgagatggcccacctctcaggcgggccttttgctgagcagcctgggtggagaaatctggggggcgaatctccatcactccctcaggggagcttgttccactccgggaccgcaagttccagtcagaacggtcacgaggagggagctacaggcgatagagaggatggcccaggcgtggcactcgagggcccattgcaggaggtgttagaactgcttcgaccaaccgattccacccagccacaactgcgtgagcttgagtaccaggtgctggggtttcgcgaccggttgaagccatgtcgggcccgccaagaacatacaagcgcagagagtctgatggagtgtattttggagtccttcgctttccttaacgccgattttgcactcgacgagctcagcctgtttggcggctcccagggcctgagaaaagacagaccccttccaccgcccagttcactcaaggcaagttcaagggaattgaccgcaggagcacccgagctggacgtgctcctgatggtccacctgcaggtgtgcaaggcactgctgcagaagctagcttcccctaacctcagccgactagtccaggaatgtctgctcgaggaggtggctcagcagaagcacgttttagagacactgtccgtcctggacttcgagaaggtcggcaaggctacttccattgaggaaattatcccgcaagcctcaagaacaaaagggtgtctgaagctgtggcgcggctgcaccgggccgggaagggtactgtcatgccccgcgaccactctcctgaatcaactgaaaaaaacctttcagcatcgggtgcgcggtaaatatcccgggcagctggagattgcatgtcgtaggctgctggagcaagtcgtctcctgtggcgggcttctacctggagctggactaccagaagagcaaatcataacatggtttcaatttcattcttacctccagagacaatctgtgtcggacttggagaaacacttcacacagttaacaaaggaggttaccctcatcgaagagttacactgtgccgggcaggcaaaagttgtgagaaaactccagggaaaaagactgggtcagctgcagccactaccacaaactctccgggcttgggctttgctccagctcgacggtacccccagagtgtgtagggctgcctccgcaagactagccggcgcagtgcgaaacagatccttcagggagaaggccctcctgttttatacgaacgctcttgcagagaatgacgcccgactccagcaggctgcttgtcttgccttaaagcacctgaaaggtatcgagagcatcgatcagaccgcatccctatgtcagtcagacctcgaggccgttcgggctgctgcaagagagacaaccctgagctttggagagaaaggccggttagccttcgagaaaatggataaactgtgctccgagcagagagaggtgttctgccaggaggccgatgttgagatcactatcttctag

SEQ ID NO: 47526 - DNA, 1269 bp, Artificial Sequence
  Description of Artificial Sequence: Synthetic coding sequence
atgaagaagaacaccagcaagaccaccatgcggatcaacaagcaggatgccctctgcacccctcactctcatgacccacgcgacttgcagaatatgttagacggtggtgagtatgccccatttgtctcaccgcccatgctggagtcgaacttcatccaggtgaatcggcgtggcgagtccatatatctccataatagagctaattgggtgacagtcggcatctgcttttctagttctactcacaaaatcccaaatgtcatgctcctcgctcacctgacccccggtgcccagaaggataccgagaccctgtttaagagcctcttgacatctcctcccgcagagaagctcgtgttgacacgcttcttgcccttgcagtttgtgacactatcggtgcacgatgccgagaatatgtctttaaaagtgaaactggtcagcggccgggcttattatcttcagttatgcaccagcgcctacaaacaggacaccctcttttctcagtgggtcgcactcatatcccttttaaaccaggagaaggccaaagtctccaaagtctctgaggtgagttcacttagtggaattaccaacagcacagacatcacgggatccatggacgtaacagatgtgaccacattcactgcaatactgactccttacatgtatgcaggaaccggacctgagcacgtccgcgattcaatcgatttccccgaatttactgacatcacagacatcactgacgtgactgatcttcctgaaaatgaggtacctgaggtaccagatgtacgaatagttaccgaggtcattgaggtgcgggaggccactgaagtgaccgatagttcggatatcactaactgttccggcgtcaccgtggtatttgaaaataacgacttgatccgggccaaacaagaagagaaggagaaattgaagaacattttgaagccgggctgccttcaggatacaaagagcaagagtgagctaaaagaaagctccaaacatgtgacgatctccaacatcactctgacgttcgaagggaaacgctatttccagactaccctgactccagtggaaagcgaggccaatactagcaaggagatgaaagacaagacctctgaagagaagatgccagactttcagtcaactgctctgaaagctgaagaatccaggtctctgcggacagaatctaacacgtctgtcctgtctcctcacattaagagcccaagtaattttctcaagctcgtgccccacctgagtgccccgttctcgcgggagtag

SEQ ID NO: 47527 - DNA, 1785 bp, Artificial Sequence
  Description of Artificial Sequence: Synthetic coding sequence
atgaacgccgacttcctgctgccctactacaccgcccagagcggctccagtatgtcaatgtttaatactacaatggggaaactccagcggcaactctacaagggagagtatgatatcttcaagtatgcccctattttcgaaagtgacttcatccagattacgaaacggggcgaggtgatagacgtgcacaacagagtgaggatggtgactatgggcattgccaggacttctcccatcctgcctctgcctgacgtaatgttgctggcacgacctgctacgggctgcgaggaatatgcgggacatggacaggcgactaaaagaaaaaaacggaaggctgccaaaaacctagaactgacacggctgctgcctctgaggtttgtgcgaattagcgtgcaggatcacgagaagcaacagctgcgtctgaagttcgctacgggacggtcctgctacttacagctgtgtccagcactggacactcgggacgacctgttcgcctactgggagaagctgatatatcttctgcgcccacctatggaaagcaatagcagtacgtgcggcatcccagccgaagacatgatgtggatgccggtttttcaggaggacagacgctccctgggggcagtgaacttacaggggaaaggggatcaggatcaggtgtcaatccaatccttgcacatggtctcagaagtgtgcggcgcgactagcgccgcctacgctgggggtgaaggccttcaaaatgacttcaacaagcctactaatgtgcttaacgccagtatcccaaagacatctactgagcttgccgaagaacccgccaccggcggcataaaagaggcagcagctgccggggcagctgctggtgccgccaccggaacggtagcaggagcgctttcagtggctgcagccaattcagcccccgggcaagtgagcgccgcaattgccggagcagcgactatcggtgcaggtgggaacaagggtaacatggctctggcgggcacggcctccatggctccaaattctactaaggttgctgtggcgggagccgctggtaagagctccgaacatgtatcctccgccagcatgtccctctcgcgagaaggcagcgttagtctggccatcgccggcgtggtacttaccagtcggacagctgccgaagcggacatggacgctgccgccggaccacccgttagcactcgacagagtaagtcttctctatccgggcagcacgggcgcgagcgtactcaggctagcgctgaagggtgcaaggagggcagagagcgaagagaaaaagaccgggctctgggacggtcttctcataggcggcgaaccggagaatcaagacacaagacgagaggcgacaaaattgcccagaaatcatcttcaagatcatccttcagccaccgggcgaatcgcgatgacaagaaagagaaggggtgcggcaatcccggatcgtccaggcaccgcgatagccacaagggggtaagtcacacaccgatatccaaagaatctcgtacatctcataagtccggccgcagcctgtggaccacctcatctggatctagcaaggggctcggccgggtgagctcattccttcggaacgttcgggccaacctcacaacaaaagtggtgggaacaccccacggacgcgatgtgaatgtgatggccaagatggcagaacggagtacaaacgtagccattgctgaaaccgctgagggcggccagggcctggagactgtgggcagtatgacccctgacatcatggagacagtgacctttgaagcacactag

SEQ ID NO: 47528 - DNA, 1110 bp, Artificial Sequence
  Description of Artificial Sequence: Synthetic coding sequence
atggtgagcgaggtgtgcggcgccaccagcgccgcctacgccggcggcgagggcctccaaaatgactttaacaaacccaccaatgttcttaatgcttccatcccaaagacatccacggagctggctgaggagccagctaccggggggatcaaggaagccgcggccgcaggagctgccgcaggtgccgctaccggtacggtggccggggccttgtcagtcgccgccgcgaattccgccccaggccaggtttctgccgcaatcgcaggggccgccacaataggagccggcgggaacaaaggtaacatggctttagcaggcactgctagcatggcgccaaacagcactaaagtcgccgtggcaggcgccgccggtaaatcctctgagcatgtcagctctgcttctatgtctctttccagagaagggtccgtctcattggctatcgccggcgtagtgctgacctctagaaccgccgcagaagctgatatggacgccgctgccggcccgccggtgagcacacgtcaatcgaagtccagtttatccggccagcacggaagggagcggacccaagcatccgcggaaggttgcaaagaagggagagagcgccgcgagaaagacagggcgcttggccgcagttctcatcgacggcggaccggggagagcaggcataagacccgaggtgataagatcgcacagaagtcttccagccgcagctcatttagtcacagggctaacagagatgacaagaaagagaagggctgcggtaaccccggctcatcaaggcatagggacagccacaagggtgtgtcccatactcccatcagcaaagagagtagaactagtcacaagtccggacgttctttgtggaccacaagctctggatcctccaagggtttaggacgagtatcatcattcctgcggaacgtgcgggccaacctgacaaccaaagttgttgggacccctcacggtcgcgacgtgaatgttatggccaagatggctgaacgaagcacaaacgtggctattgccgaaacagccgaagggggtcaggggctggaaaccgtgggctcaatgaccccggatatcatggagaccgtaacatttgaggcccattag

SEQ ID NO: 47529 - DNA, 726 bp, Artificial Sequence
  Description of Artificial Sequence: Synthetic coding sequence
atggaggactgctgcatgctgccctactacaccgcccagagcagccccgcaatgggaatgttcaataccagtatgggcaagcttcaacgtcagttatacaagggagagtacacaatttttcggtatgcccctatgtttgagtctgacttcattcagataagcaaaagaggagaggtgatagatgtgcacaatagagcgcgcatggttactatgggtatcgtgcgcactagtccatgcctgactctgcccgatgtaatgctgctggctcgacctgcagccgtgtgtgacaacgcacgctgcgggcccgccacacagaagagggagtcaccccctgccgagattctggaactgacacggctcctccctttgatgttcgttaagatcaccatccacaattctgttaaaaaacagctccacttaaaacttgccacgggaaggtctttttatttacagctctgccccccctcagacgcaagcgaagaccttttcgtacattgggaaaacctggtatatattctgcgcccccctgttgaagcttattctgatacgagggcaatcttggctggtaataccctggatagcagcgttctggaggaagtacagagaagccctgtgggttacgccatgaagttctgtgaagaaaaagagcagttcaggatttcacgcctccacatgaatgccgaaatgtttgggagtacttactgcgactacactattgaaatctag

SEQ ID NO: 47530 - DNA, 696 bp, Artificial Sequence
  Description of Artificial Sequence: Synthetic coding sequence
atgggcccccccctgtggcccgacctgcaggagccccccccccccggaacctcatctcagatcaggtctccactgctgtgcgacgtaatcaagcccgccccacaccacgatgtcactgttcgtgtggttcctccgccacgtttcctccccctgctgctgcgacctcttccatcggacggtgacatagccatgcgcagggatcggggtcctaagccagccctcggtggcgcaggggaggtggagccgggcgggatggccgcatcccctaccggcagacctcgccggctacagcgttatcttcagtcaggcgaatttgaccagtttagagatttccctatattcgagtctaactttgtacaggtgacccgcctgggggaggtggcaaacgaggtcaccatgggcgtcgcagcttcaagtcctgccctggagctgcccgatttgttacttctggcgggccccgccaaggagaacgggcacttgcagctcttcggccttttcccccttaaatttgttcaactgttcgtgcacgacaagtcgcgatgccaattagaagtgaagctgaatacttctcgcactttctatcttcaactgagagccccgctcaaaacgagggatagagaatttggccaatgggtccgtttgttgtatcggctaagattcctgagcgcttcagcagtgcccttcacccaggagtag

SEQ ID NO: 47531 - DNA, 744 bp, Artificial Sequence
  Description of Artificial Sequence: Synthetic coding sequence
atgggcccccccctgtggcccgacctgcaggagccccccccccccggcacatcgtctcagatcagatcccctctgctctgtgatgtcatcaagcccgccccccaccacgacgtcacagttcgtgtcgtgcctcctccccgatttctccctctgctgcttagacccctgccctccgatggggatatcgcaatgagacgtgataggggtcctaagcccgccctggggggggctggggaagtcgagccagggggaatggccgccagccctacgggaaggcccagacgtttgcaaaggtatctgcagagcggggaattcgatcaattccgtgatttccctatctttgagtctaatttcgtgcagttttgcccagatatctatccagcgcccacatccgacctttggccccaggtgacaaggctcggcgaagtcgcgaacgaggtcaccatgggcgtggctgccagttcgcccgccctggaactccccgatctgttgcttctggctggtcctgcaaaggagaacggccacctgcagctgttcgggctttttcctctgaagttcgtacagctgtttgttcatgataagagcaggtgtcagcttgaggtgaaacttaatacgtcaagaactttctatttgcagctccgcgcgccattaaagacacgagaccgagagttcgggcagtgggtgcgactgctctacaggcttcgcttcctgagcgcctccgccgttcctttcacccaggaatag

SEQ ID NO: 47532 - DNA, 2769 bp, Artificial Sequence
  Description of Artificial Sequence: Synthetic coding sequence
atgatctggctgcggaaccggcggtgcctggagcccctgcagggcacaccaaagtgggttccggttcttggcgagctacagaaaaccctgcagaaaggcgagtacctccccctccggccactgcctatgttcgaatcaaacttcgtacaggtcacccaccaggggggccctgtttttgtcaatcacaggactaatagactcgccatgggagtcgcagcatccctcccaggtctggtgttgccggatatacttctgatcggccagcctgcggaggacagggactgcagcgggctcgtattaactcgcatgatccctcttgaccttgtccatctctgtgttcatgacctgagtgcctggcgcctgaagcttcgtctggtctctggcaggcagtactatctggcactcgacgctcctgataacgaggtgggcttcctgtttcactgctgggttaggctcattaatctccttcaggaacccgctcctacctggactccacgtacaacccgcactgcccccctggacatgccactagcggaggctcccgcatccacctggcatttacaagatcaaccgataagccgacacgctgtgcgcgtcgccgaaaggaatttcccccataaaacggtcgccgcacaacggcagcggaaggctaaggcactcaaacgcagctttaagtcacaggccgtgggggactctgtgcctctgatatggagccagttggaacacgccgacgtgaggaagaagcccgctgagaaaaagtctcattcagacccccgccctgataggactcacacacagatccgtctcccagagaagacatccataacaacttggacgattttctctatcatctcgagcactgcgaatcaaacacagagctcccccaaagcctgcacatccgctagcgacgaagcaacgggacaggggcacgtggtagagtcgccaagccactgcgtctctgctgacagccccgacggcttctttcttggtagttgctcctccctggatccctgtctctggcaccaggatacagaggacctgatggatagcggcgggagtaccctgtcgtcagcagccagcgggcttgccccctaccctccagctgcttgtcttagcacaccctactcttcgattccaagaggacgagaaaaagccggccctatgggatctcatcaggggcccgggccccccccatgtcaaaaagccccctctggtctggtcacttcttgtaaagcaccatttcttgttgaccagtcacagaagctgccagcagtacccgcttcgtcttggaaaccccccccaggtctagcaccaccacagaaagccccagccgcgtccgccccaccaagaaaggcacctgcagtccccgcacccagccaaaaggcccccgctgtgcctgctcccagccagaaggccccagccattccagctcctagtcgtaaggcctcggccgcatctgcatctccccgaaaagcctccgcggtaccagctcctcctcagaagactcctcctccaagccagaaggcaccatcagttccaaccatcccacagaaggccgttagcccaactgcgccaaagaagaaatctctattgctccccgccccctcccaaaaagcgctgcccacttctcctacagaatatcagatggcccttagcccccccgcttcacgtgggaagctcccaggagacttcgatgtgctgccgaccggcatacccgggcgagccgtgctggagcgaagccagtccgggggaaagccagagcctgtcgtgactgtgaggactcaggaaactgacgttgtggaaatgacaacacaggccaaatcacccgaatctccatttactgtcaccaagaaagagagcaaagatatcctgataagccagaccaaggaggtgacgttggaggcgtttcgtggacagggaaagctagaagactgggcgcattgggccaagctggaggagcgatcgcccgacctgcctggagtgcgctccaaggagctcgagcaacgcaaacgttgggtgaaagccaaggaacttgcagttgagggccctagtcaggaacattcccgcccgttttcagttgaggcccttaccttaacaaaactgatgatcacagcaaactctaaagaacaaccctctaaaagcgctcttgtgagtctgcccagttggctactcgctacgcctcaggctagcgccacaagtatgatggccagcgtgcctagtcgccctggacaattgtcattactggagggtaagccagtcgtagtcagagagcaacctgaatcacatacctgggtcaaggaaggcaagcggccctggggtgaaatgaaggaacagccgtggggggagatgaaagaacctccctgggacccaaaaggcccgccaaaggttcccttccgatcaaaaccaaccagcgcatccctcaagagggagggcattagccaagctccaatcccattgaccgcgagcccctgggaagatttgagaccctccccactcagcgaaactttgatcagtaaaatggaggctaccgcccgcgcgagccaacagccaaagcgggtgagccaggagcctatgagaatgcctgcccagcaccctctcgcaacggtaggctcatcctctgagatactccttcccatgctgcttgaactagaaactgttcggaacacagccaccaaagcagaggagattcaagaggagagcggggttctgaacctcttgccttctctgcagcacagtcaacactcagagtggccggatgcaggtgcctag

SEQ ID NO: 47533 - DNA, 1035 bp, Artificial Sequence
  Description of Artificial Sequence: Synthetic coding sequence
atgctgagcagcttcccccaccggaagacctggcggaagagcaagaaaaccgttaaggtaacacggtcctaccccacctttccctctcttaatgcttgggaagaatttcgtgggttgctccctgtcgatggcgagccgaacccaggcgcggggctgggtgtcgaagaagggttgctgtgcagagtcgtgcattcccccgagtttaatctgtttcttgattcagtggtgttcgagagcaactttatccaagtgaagcggggacgaaattggcgggatgtgtacaaagctagcaacacgatggccttgggtgtgaccagtagcgttccttgtttgccgctgccaaatattttgttaatggcctcagtgaagtggcaccagggacaaaatcaaacatggaacagaccatccatcgcccccaacatctttctgaagaggatcctaccactgaggtttgttgagcttcaggtttgtgaccactatcaacgtatcctacaactaaggacagtcacagagaaaatttactacctgaaattgcacccggatcaccctgaaaccgtgtttcacttctggattcgactggtgcagatcttgcagaagggcctctccattaccaccaaagatccacggatcttggtcactcattgtctcgtcccgaaaaactgcagcagtccttctggcgactccaagcttgtgcagaaaaagctgcaagcatctcagcctagcgaaagccttattcaactcatgaccaagggtgaatcggaagccctatcgcaaatatttgcagatctgcatcagcagaaccagctgtcttttagatcctcccgcaaggttgaaacaaataagaacagttccggcaaagactcttctagagaggactccattccatgcacatgtgacctcagatggagagcctccttcacgtatggggaatgggagcgcgaaaatccctctggtctccaacctctttccctgctgtcaactttggctgcatccaccggaccccaattggccccaccaatcggaaatagcatttag

SEQ ID NO: 47534 - DNA, 903 bp, Artificial Sequence
  Description of Artificial Sequence: Synthetic coding sequence
atgagcaagatccggggcctgccccccgaggtgcgggagcccggcccaggtgttgagctgggggtggaaaatggcctcctctgtcaactgattcatagccccgagttcaacctcttctcaaatagcgttgtcttcgagagcaactttatccaggtgacaaagcctggaaattggagagacgtgtgtgaggggtctgcaaccgtgattctgggcgtgactagcagcgtacctagtttgccactgcccaatgtgctgcttatggccaacgtaacttggccccagggaccttttacaacctggtccaccccgggagatgcgcccgtgatcaatctgtctagattgctgcccctaaaatatgtcgaactcagaatttacgacaggcttcagagaatactgagggtcaggactgtgaccgaaaagatttactatctgaaactgcatgagaagcatccagaaattgtctttcaattttgggtccggctggtcaaaatcctgcagaaaggtctgtctattacaaccaaggatccgcgcatcaaattcactcattgccttgttcctaagatgcccaccaacagcacagagaccacacctgagaatagcctgctgagttccccacaacccagtgaacctcttgtcctgctagccgccgaacagacgagcggcagcttctcccagcttagtggcaaaccacaactcactgccgataggaataatgatacagcgattgagattgacaattgtagctcatataagatcccatccccggtggccagtccaatcaacctcaatatccctatgcgggcagcgctttcccactctttgtgggagcaagaagactggaacgaacacctgttacaggtgcacattgcctcctatctgggggagcattttctgggagcttag

SEQ ID NO: 47535 - DNA, 903 bp, Artificial Sequence
  Description of Artificial Sequence: Synthetic coding sequence
atgagcaagatccggggcctgccccccgaggtgcgggagcccggcccaggcgtggaattgggcgtagaaaacgggctgctttgtcaactgatccatagccccgaatttaacctgttttcaaattctgtcgtcttcgagtcgaacttcatccaggtcaccaaacctgggaattggagagacgtgtgtgagggctccgccaccgtcatactcggggtgacttccagtgtcccctctttgcccctgcccaatgtgctgctgatggcaaacgttacttggccacagggaccgtttactacatggtcaaccccaggtgatgcaccagtcataaatctttcccggcttctgccgctgaaatacgtcgagctacgaatctacgaccgcttgcagagaatcctgagggtgcgaacggtgactgaaaaaatctattacctgaagctgcacgagaagcaccccgagatcgtgttccagttctgggtccggctggtcaagatcttacaaaaaggcttaagtataactacaaaagacccgcgcattaagttcacgcactgtctggtgccgaagatgccaaccaatagcaccgaaactactcccgagaacagcttgctgagcagtccccaaccgagtgaacctcttgtgctcctggccgctgagcaaacctccggttctttttctcaactctctggcaagccccaactgactgctgacagaaataatgataccgctattgaaatcgataattgctcttcttataagattccaagcccagtggcctctcccattaatctgaacatccctatgagggccgctctgtctcattctctgtgggagcaagaagactggaacgaacaccttttacaggtacatatagcctcatacctcggggaacactttctgggggcttag

SEQ ID NO: 47536 - DNA, 903 bp, Artificial Sequence
  Description of Artificial Sequence: Synthetic coding sequence
atgagcaagatccggggcctgccccccgaggtgcgggagcccggcccgggggtcgaactgggcgttgagaatgggctcctgtgtcaactgatccacagcccagagtttaacctgtttagtaactccgtggttttcgagtcaaatttcatccaggtaaccaaacccggaaactggcgggacgtatgcgagggatctgccactgtcatactcggggtcacctctagcgtgcccagtctgcctctgccgaatgtgctgctgatggccaatgtgacttggccacagggaccctttacaacatggtcaacaccgggcgacgcccccgtgatcaacttaagccggttactgcctctcaaatatgtggagttgagaatatacgacagactgcaaagaatccttagagtgcggactgtgaccgagaaaatatactacctgaaactacatgagaagcacccagagatagtgtttcagttttgggtccggctcgtcaaaattctgcaaaaaggcctgtcaatcactacaaaggatccacggatcaaattcacccattgtctcgtgccaaagatgccgactaatagcaccgagaccacccccgaaaactccctcctttcttcgccacagcccagcgaacctttagtgcttcttgcagccgagcagacgagcggaagtttcagccagcttagtgggaagcctcagcttactgctgaccgtaacaacgatactgccattgaaattgacaactgcagctcatacaagatcccatcgcctgtcgcctccccaattaacctgaatatccccatgcgcgcagctctaagtcattctctgtgggagcaggaagattggaatgaacatctcttgcaggtacacattgcctcctacctaggtgagcactttctgggcgcttag

SEQ ID NO: 47537 - DNA, 930 bp, Artificial Sequence
  Description of Artificial Sequence: Synthetic coding sequence
atgagcaagatccggggcctgccccccgaggtgcgggagcccggccctggagtggaattgggggtagagaacggcctgctgtgccaactgattcactccccggaatttaatttgtttagcaattcagttgtttttgagagcaacttcattcagactcatgtgccagaagctgactttcaagtgactaagcccggtaattggagagacgtgtgcgaagggagcgccacagtaatcctgggggtgacttcctccgtgccctctctccctttgccaaacgtcctactgatggcaaacgtgacatggccccaggggccatttacaacatggtccacgcccggtgacgcaccagtgatcaatctgtcccgtctgctcccgttgaaatacgtggagctgcgcatttatgatcgactgcaacgtatcctgcgggttcggacggtgacagagaagatatattatttgaagctccacgagaaacacccagaaatagtgtttcagttctgggtccggctggttaagatcttacagaagggtctgtccatcaccaccaaagaccctcggatcaaatttacgcattgtctagtccccaaaatgcctacaaactctacagaaacaacccccgagaactcgcttctcagctctccccagcccagtgagccactggtactgctagctgctgaacaaaccagcgggtccttcagccagttgagcgggaaaccacaactaaccgcagatagaaacaacgataccgcgattgagatcgacaactgctcaagctacaaaatccctagtcctgtggcttcaccgatcaacctcaacatcccaatgagagccgctctgtcacattctctctgggaacaggaggattggaatgagcatctgttgcaggtacatatcgctagctatctgggcgagcacttcctgggtgcatag

SEQ ID NO: 47538 - DNA, 330 bp, Artificial Sequence
  Description of Artificial Sequence: Synthetic coding sequence
atgagcaccaacatctgcagcttcaaggacagcgccgtggacttcactggcaggtgttactttaccaagatttgtaagtgcaagctcaaagacatagcctgcctgaagtgcgggaacattgttggctatcatgtgatcgtcccttgcagctcatgcctcctgtcttgcaacaatggtcacttctggatgtttcattcccaggccgtgtacgatattaaccgcctggacagcactggcgttaacgttcttctctggggaaaccttcctgagatcgaggaatctacagatgaggatgtgctgaacatatctgcagaggaatgtatccgatag

SEQ ID NO: 47539 - DNA, 450 bp, Artificial Sequence
  Description of Artificial Sequence: Synthetic coding sequence
atgagcaccaacatctgcagcttcaaggaccggtgcgtgagcatcttgtgctgtaaattttgcaaacaggtgcttagcagtcgcgggatgaaagctgtgctactggccgacacagagattgatctattctctacagatatccctccgaccaacgctgtggatttcacaggccgctgctatttcactaaaatttgtaaatgtaagctgaaagatatagcatgtctaaagtgcggcaatatcgtggggtatcatgtaattgtgccctgctcttcatgtctgctgtcctgtaataacggtcatttctggatgtttcactcccaagctgtgtatgacattaatcgcctggactccacgggggtgaatgttttgctctggggtaacctcccggagattgaggagtccactgacgaagatgtgctcaacatcagtgcagaggaatgtatcaggtag

SEQ ID NO: 47540 - DNA, 450 bp, Artificial Sequence
  Description of Artificial Sequence: Synthetic coding sequence
atgcccaccaccaccgccctgcggtggaccgccgccgcccgggtgcgacgaaaaggtcgagggggctgggtcccagccgcgctgcgttccgtgtctcaggacggcgtgcctggttgtactgtcatgggtggtgagactcggagccctgaaaatgccgtcgactttacaggccggtgctatttcactaagatatgtaagtgcaaacttaaagatatcgcatgccttaagtgcgggaacatcgtgggataccatgtcatagtgccctgtagcagctgcctgttgagttgcaacaatgggcacttctggatgttccattcccaagctgtatacgatatcaatcgcctggattccaccggagtgaatgtccttttgtggggcaatctgcccgagattgaggagagcactgacgaggacgtcttgaatatctcagctgaagaatgtatccgttag

SEQ ID NO: 47541 - DNA, 330 bp, Artificial Sequence
  Description of Artificial Sequence: Synthetic coding sequence
atgagcaccaacatctgcagcttcaaggacagcgccgtggacttcaccggacggtgttactttaccaagatttgcaagtgtaaattaaaagacatcgcctgtctgaagtgtgggaatatcgtcggataccacgttattgttccatgttcatcctgcctgccatcatgcaataacggacacttttggatgttccatagccaggctgtgtatgacatcaacagactggattccaccggtgtgaatatcttactgtggggtaatttgcccgaaatcgaggaatcaaccgatgaggatgttctgaacatctccgcagaagaatgcatccgatag

SEQ ID NO: 47542 - DNA, 450 bp, Artificial Sequence
  Description of Artificial Sequence: Synthetic coding sequence
atgagcaccaacatctgcagcttcaaggaccggtgcgtgagcatcttatgttgtaaattttgcaaacaggtcttgagtagccgtggcatgaaagcagtacttctggctgatactgaaatagatctgtttagtaccgacatcccccccacaaacgccgtcgactttaccggtcgttgttattttaccaagatctgtaagtgcaaactgaaggatattgcttgtctgaagtgcggcaacattgtgggataccatgtgatcgtaccatgctccagttgcctgccaagctgtaacaacgggcatttttggatgtttcacagtcaggcagtatacgatataaataggctggattccacgggcgtgaatatattgttgtggggcaatctgcccgagattgaagagtccaccgatgaggacgtgttgaacattagtgctgaggagtgtattagatag

SEQ ID NO: 47543 - DNA, 363 bp, Artificial Sequence
  Description of Artificial Sequence: Synthetic coding sequence
atgaaggccgtgctgctggccgacaccgagatcgacctgttcagcactgacattcctccaaccaatgccgttgacttcacaggtcgctgttactttaccaagatctgtaagtgtaagctaaaggatatcgcttgtttaaagtgcggaaacattgttggctaccacgttatcgtgccctgttcctcctgtctgccatcatgtaacaacggccatttctggatgttccactcccaggctgtgtacgacatcaataggctggactcaacaggagttaatattctcctgtggggaaatctccctgaaatcgaagaaagcactgacgaggatgtattgaacatctctgcagaagagtgcattaggtag

SEQ ID NO: 47544 - DNA, 363 bp, Artificial Sequence
  Description of Artificial Sequence: Synthetic coding sequence
atgaaggccgtgctgctggccgacaccgagatcgacctgttcagcactgacattcccccgacaaacgcagttgattttacaggtaggtgctactttaccaagatttgtaaatgcaaactgaaggatattgcatgtctgaaatgcggtaatatcgtaggctaccacgtgatcgtcccgtgctcctcatgcttgccgtcctgtaataacgggcacttttggatgtttcacagtcaagccgtgtacgacattaaccggctagactcaacaggtgtgaatattcttctctggggtaatctgcctgaaatcgaggagtctacagacgaagacgttctgaatatcagcgccgaagagtgcatccgttag

SEQ ID NO: 47545 - DNA, 222 bp, Artificial Sequence
  Description of Artificial Sequence: Synthetic coding sequence
tgaggcaacatcgtggtgtaccacgtgatcgtgccctgcagcagctgccttctctcctgcaataacagacacttttggatgttccattcccaggcagtatacgatataaatcggctagacagcactggcgtgaatgtcctgctgcgaggcaacctgcctgaaattgaggaatctactgacgaagatgtgctaaacatcagcgcagaagagtgtattcgctag

SEQ ID NO: 47546 - DNA, 450 bp, Artificial Sequence
  Description of Artificial Sequence: Synthetic coding sequence
atgagcaccaacatctgcagcttcaaggaccggtgcgtgagcatcttgtgctgcaagttttgcaagcaggtgttgtcttctagaggaatgaaagccgtcttactggccgacacagagattgatctgtttagtaccgatattcctccaactaacgccgtcgatttcacaggtcgctgttactttaccaaaatctgtaaatgcaaattaaaagacattgcctgccttaagtgtggtaacattgtcggctaccatgtgatcgtcccttgttcctcctgtctgcttagctgcaacaaccggcatttctggatgttccatagccaggccgtttatgatattaacaggctagactcaacaggcgttaacgtcctgctccgggggaacctgcccgagattgaagaatccactgacgaagacgttctgaacatcagcgccgaggagtgtatccggtag

SEQ ID NO: 47547 - DNA, 549 bp, Artificial Sequence
  Description of Artificial Sequence: Synthetic coding sequence
atgaagccctggtgggcccgggactgggccctgcccagccggggccagtgcgtgtgccctggagagacaaacgcttgtcttgatgcagagcgagcctgtagggagtgtccgcgggggctagaggaaacctgggatctcctgtctcagctccagagtctactgggcactcacttggataagggagacttcggacagctgtcagggcctgaacctccaggagaggtagggaagagagctccagacggggcttcaaggtcaagcctagagcctatggaagacgctgccccaatcatatatctgctggccagccccgaccccagaattaagcacccacaggatctggccagtactccatcgcccggcccaatgacaacctccgtgagttctcttagcgcctctcagcctcccgagccttccctgctcctggagcgtccaagtcccaagccaccagctctatttttgacacatcacacccccctcattctctggcctgcacttctcctcttgcagaagactagcctgctgctgccctgcggaacgccactgtag

SEQ ID NO: 47548 - DNA, 1026 bp, Artificial Sequence
  Description of Artificial Sequence: Synthetic coding sequence
atggccgccctgtacgcctgcaccaagtgccaccagcggttccccttcgaggcactttcgcagggtcaacagctgtgcaaagaatgtcggattgcccacccagtggttaagtgtacctattgccggactgagtaccagcaagaacgactggagtgtaacgggactatcagtgctcactgcaacctccacctgcctggtagctcagattctcctgccagctccagccgcgttgcaggaattacaggaatcaagacaaacacgatatgcaaaaaatgcgctcaaaacgtgcagttatacggtacccccaaaccctgtcagtactgtaacatcatcgccgcttttattggtaacaagtgccaaaggtgtacaaattccgagaagaaatatgggcccccctacagttgtgagcaatgcaagcagcagtgtgccttcgacaggaaggatgacaggaaaaaagtggacggcaagcttctgtgctggctgtgcactctgagttataagcgtgtactgcagaagacaaaagaacagcgcaaacacctttcaagctccagtagggcaggacaccaggaaaaagaacagtatagtaggctgagtggagggggccattacaattcgcagaaaacccttagtacatcctccattcagaatgagatcccaaagaagaagtccaaatttgaatccataactaccaatggcgattctttctcccctgacctggccttagacagtccaggaacggatcacttcgtcataattgctcagctcaaagaggaagtcgcgacattgaaaaaaatgttgcaccagaaagaccaaatgatactcgaaaaagagaagaagatcaccgagttgaaggccgattttcagtatcaggaatcccagatgcgcgcaaagatgaaccaaatggagaaaactcacaaggaggtcaccgagcagcttcaggctaagaatcgagaactgcttaagcaagccgccgccctgtctaagtccaaaaaatctgagaagtctggcgcaattacatcgccttag

SEQ ID NO: 47549 - DNA, 2352 bp, Artificial Sequence
  Description of Artificial Sequence: Synthetic coding sequence
atggaggacgagcagcccgacagcctggagggctgggtgcccgtgagagagggtctgtttgctgagcccgagcgacaccggttgaggttcctggtggcttggaacggggctgaaggcaagttcgccgtgacctgccacgaccgcaccgctcaacaaagaagactcagagaaggagctaggctggggccagagccagaaccaaaacccgaggcagccgtgtctccctctagctgggccgggctgctgtctgctgcaggcctccgcggagcacatcgccagctggctgctctctggcctcccctcgagagatgcttcccgcgcctgccaccagaactcgatgtgggcgggggaggcgcctgggggcttggcttgggcctttgggccctgctgtggcccacccgcgcaggcccaggcgaggctgccctgcaggagctctgtggccagctggaaaggtacctcggtgctgccgccgacggctgcgggggcgcgacagtccgcgatgccttgttcccggctgagggaggagcggcggactgcgagtctcccagggaattcagagagagagctttgagagctcgttgggtggaggcggacgcccggttgcgccaggtcattcaaggacatggaaaagcaaatactatggtggccctcatgaatgtgtaccaggaggaggacgaggcctatcaggaactggtgactgtcgccacaatgtttttccagtacctattgcaaccgttccgtgccatgcgagaagtcgccactctatgtaagctggatatattgaagtctttggatgaagatgaccttggcccgagacgggtggtggcgctcgagaaagaagctgaggagtggacacgccgtgccgaagaggccgtggtcagtatccaggatataacggtgaactactttaaagagaccgtgaaggccctggcaggaatgcagaaagagatggagcaggacgcaaagaggtttggccaggccgcgtgggccactgcgattccaagactagaaaagctgcagctgatgctagcccgggaaaccttgcagctcatgagggcgaaggagctttgtctgaaccacaagagggccgagatccagggcaagatggaagacctccccgagcaggagaagaacacaaacgtggtggatgaactggaaatccagttttatgaaatccagctggagctctatgaagtaaagtttgagatcctgaagaatgaggaaatcctgttaaccacccagcttgacagtttgaaacggttgatcaaagagaagcaggatgaagtggtgtactatgacccctgtgaaaaccccgaggagctgaaagtcatcgattgcgtagttggcctgcaggatgacaaaaacctggaggtcaaagagttgcgaagacagtgtcagcaactggaatccaaaagaggaaggatctgcgccaagcgcgcaagtctgcgaagccgcaaagatcagtgcaaggagaaccaccgttttcgcttgcagcaggcagaggaatccattcggtactcgaggcagcaccatagcatccagatgaagagggacaaaatcaaggaagaagagcagaagaaaaaggaatggatcaaccaagagaggcagaagacactccaaaggctccgaagctttaaggataagagactcgcccaatctgtaagaaatacgtctgggtcagagcccgtggcacccaatctgccctcagacctgtcacaacagatgtgcctgcctgcctctcacgctgtttcagtcatacatccttcatccagaaaaacgcgcggggtccctctgtctgaggcgggaaatgttaagtctcccaaatgccagaactgccatgggaatatcccggtccaagtgtttgtgcccgtgggtgatcaaacgcacagcaaatcttcggaagaactctctctaccacctccccctccacctccaccacccccccccccgccaccacctcccccgccaccacctctgcgagccctcagcagtagctcacaggctgccacccaccaaaaccttgggtttagagctcccgtgaaagacgaccagccgcggcccttggtgtgcgagtctccagctgaacgaccaagagactccttagaaagcttctcatgtcctggttccatggatgaggtgttagcctctctccgccacggacgcgcccagggagtcaagttaaagaaggtgcatccagatctgggacctaacccctccagcaagcccacatcaaatcgaaggacctctgatctcgagcgttccatcaaggccgccttgcaaagaattaagagggtgtcagccgattcagaggaagattcagacgaacaagatccggggcagtgggatggatag

SEQ ID NO: 47550 - DNA, 837 bp, Artificial Sequence
  Description of Artificial Sequence: Synthetic coding sequence
atggccgccctgtacgcctgcaccaagtgccaccagcggttcccctttgaagccttatctcagggccagcagctctgcaaggagtgcaggattgcacaccccgtcgtcaagtgtacttattgccgcacggagtatcagcaagaatcaaagactaatacaatatgcaagaagtgtgcccagaatgttcagctgtatggaaccccaaagccttgtcaatactgtaacattatagccgctttcatcggaaacaagtgtcagcggtgcaccaactctgaaaaaaagtacggcccgccttactcgtgcgagcagtgtaagcagcaatgcgcttttgatcggaaagacgatcgcaagaaggtcgatgggaaactactctgctggctgtgtacactgtcctataaacgtgtgctccagaaaactaaggaacagagaaaacatctctcatcttctagtcgggccggtcatcaggagaaggagcagtactccagactttcaggaggtgggcactacaactctttcagtcccgaccttgccctcgactcgcccggaaccgaccacttcgtgattattgcacagctgaaggaggaggttgcgacacttaaaaaaatgctccaccagaaggatcagatgatactggaaaaggaaaagaagataaccgagttaaaggcagactttcagtatcaggaatcacaaatgcgggccaagatgaaccaaatggagaagacccataaagaagtaaccgagcagctgcaagcaaagaatcgcgaactgctgaaacaggctgctgcactttctaagtccaagaagagtgagaaaagtggggccataacatcaccctag

SEQ ID NO: 47551 - DNA, 924 bp, Artificial Sequence
  Description of Artificial Sequence: Synthetic coding sequence
atggccgccctgtacgcctgcaccaagtgccaccagcggttcccctttgaggctctatctcagggccagcagttgtgcaaggaatgtcgcatagcacatcccgttgtaaaatgcacctattgtcgaaccgagtaccaacaagagtccaagaccaatactatctgcaagaagtgcgcccaaaatgtacagctgtacggtactcctaagccctgccagtactgtaacatcattgccgccttcattggcaacaagtgtcagcgttgcacaaattccgagaagaaatatggtcctccatactcatgcgagcagtgtaaacagcagtgcgcatttgatagaaaggacgatagaaagaaggtcgatggcaaactactgtgctggctctgcaccctctcatacaagagagtcttacagaaaacaaaagaacagcggaagcatctgtctagttcttcccgagccggccaccaagagaaggaacagtattctaggttgtctggtggagggcattataacagccagaaaacattatcgacttcgtctatacagaatgaaatccctaaaaaaaaatctaaatttgaatctataacgaccaacggcgactcattctcccccgatctcgccttggattcaccgggcactgatcattttgtcataattgcccagctgaaagaggaagtggccacattaaaaaaaatgctgcatcagaaagatcagatgattctagaaaaggagaagaagatcaccgagttgaaagcggatttccagtatcaggagagccaaatgagagccaagatgaatcagatggaaaagacacacaaagaggtgaccgaacagctccaagccaaaaacagagagctcctaaaacaggccgccgcactgagcaagtccaagaagtctgaaaaaagcggggctataactagtccctag

SEQ ID NO: 47552 - DNA, 684 bp, Artificial Sequence
  Description of Artificial Sequence: Synthetic coding sequence
atggccgccctgtacgcctgcaccaagtgccaccagcggttccccttcgaggctctgtcccagggtcaacagctgtgtaaggagtgtagaatcgcacaccccgtggtcaaatgcacctattgcagaaccgaataccagcaggaatctaagacaaacaccatttgcaagaaatgcgctcagaatgtccagctgtacggtacagtagacggcaagctcttgtgctggttgtgcaccctgagctataagcgggtgctgcagaagaccaaggagcaacgaaaacacctcagtagttctagtagagccggtcaccaagagaaggaacaatatagtcgcctctccggaggaggacattacaattcttttagtccagatttagccctcgacagcccagggacagatcactttgtcattattgcccaattgaaagaggaggtagctacacttaaaaagatgctgcatcagaaggatcagatgattctggagaaagagaaaaaaatcactgaattaaaagcggatttccaataccaagaaagccagatgcgagccaagatgaaccaaatggaaaagacccacaaggaggtaacagagcagttgcaagccaagaacagggaactacttaagcaggctgcagctctgtctaagtcgaaaaagtcagagaaatctggcgccattacctccccatag

SEQ ID NO: 47553 - DNA, 1020 bp, Artificial Sequence
  Description of Artificial Sequence: Synthetic coding sequence
atggccgccagcgccctgtacgcctgcaccaagtgcacccagcggtacccctttgaggagttatcccaaggtcagcagctctgtaaagaatgccgcatcgctcatcctatcgtcaagtgtacctactgtcggtcagagtttcagcaggagagtaaaaccaatacaatttgcaagaagtgtgcccagaatgtcaagcagttcggtacgcctaagccctgccagtattgtaacataatcgccgcattcataggcacaaagtgtcaacggtgcactaactctgagaagaagtatgggcctccccagacttgcgagcagtgtaaacagcagtgcgcgtttgaccggaaggaggaaggtcgtcgcaaagtggatggtaagctactgtgttggctttgtacactgtcctataagcgtgtgttacagaagactaaagaacagcggaagtccctcggctccagtcactcgaactcttcaagcagcagtctgaccgaaaaggaccagcaccaccctaagcaccaccaccaccatcatcatcaccaccaccgccattcaagttctcaccataagatcagcaacctttccccagaagaggaacagggattatggaaacaatctcataaaagctccgcaactatacagaatgagactccaaaaaaaaaacccaaacttgagtcaaagccatctaacggggactcttcgtctattaatcagagtgccgattcaggcgggactgataatttcgttctcatctcccagttaaaggaagaggtaatgagcctgaagcggcttctgcagcaacgggatcaaacgatcctcgaaaaggacaagaagttaaccgaactgaaggccgatttccagtatcaggaatccaatttacgtaccaagatgaacagcatggagaaagctcacaaagagacagtggagcaattacaagccaaaaatcgggaactgttaaagcaggtcgctgccctctctaagggtaagaaattcgacaaatccggctctatcttgactagtccctag

SEQ ID NO: 47554 - DNA, 843 bp, Artificial Sequence
  Description of Artificial Sequence: Synthetic coding sequence
atgaccagctacatcctgatcagcttcgtgctgctgatcggcgtgggctgtattgaaaaggatcagtcttgtccagtgttcggaggaagaaaacggttacacctcctcttcgtaggcggtcagctgcggcaggtgcgcatgctgcgaggatcccctgaagccagtactgattgttgctggcttcaccaggctactggatctggttcagtcacacaagcaggagtacagtggtacgaccttggtagcctccaacccttgccgccacgctttaaaaggttctcttgtttgagccttcccagcagttgggactacaggtctagctgggaattacccgacctgcaagagggcaaaatacaggcaatatctgacagcgatggcgttaactatccttggtatggaaacactactgaaacctgcactattgtcggacccactaaaagggacagcaaattcataatcagcatgaacgataacttctaccccagtgtaacttgggctgtgccagtgtccgagtctaacgtggccaaactgacaaacatttacagagatcagtcctttactacttggctggttgccacaaatacaagcactaacgacatgataatcctgcagactcttcactggcgaatgcagttaagtatagaagtcaatcccaatagacctctaggacaacgagcccgtttaagggaacctatagcccaggaccagccgaagatactgtctaaaaacgagccaattcctccgagcgccctcgtaaaaccgaacgctaacgacgcacaggtgctgatgtggcggccaaagtacggtcagccgctggtggtcatccctcctaagcacagatag

SEQ ID NO: 47555 - DNA, 852 bp, Artificial Sequence
  Description of Artificial Sequence: Synthetic coding sequence
atgcccggcttcttctgcgactgctggcccagcctggagatccgggccctgctgtacgccatgggatgcatccagagtattggaggcaaggcgcgcgtgttccgtgaaggaatcacagttattgatgttaaagcaagtattgatccagtcccgaccagtattgatgagtcctcttcagtagtgttaagatacaggactccacatttcagggctagcgcccaagttgttatgcctcctatccctaaaaaggaaacatgggtggtcggctggatccaagcctgttctcatatggaattctacaaccaatatggtgagcaagggatgagctcatgggaactgccagacttacaggaggggaagattcaagctattagcgacagtgacggtgtgaattacccctggtacggaaacacgactgagacctgtacaatcgtcggacctacaaagagagattccaaattcataatctctatgaatgacaacttctatcccagcgttacgtgggctgtaccggttagcgagagcaatgtggccaaattgacaaacatatatagggaccaaagtttcaccacctggctagtggcaacgaacacttccaccaatgacatgattatactgcaaacattacactggcgcatgcagctgtccatcgaagtcaatcctaaccgtcccttgggtcaacgagcccggctcagagagcccatcgctcaggatcagcccaaaatcttgagtaaaaacgaacctatcccgccttccgcgttagtgaaacccaatgccaacgacgcccaggtgctcatgtggaggcccaaatacggtcagcctcttgtggtgattccaccgaaacatcggtag

SEQ ID NO: 47556 - DNA, 759 bp, Artificial Sequence
  Description of Artificial Sequence: Synthetic coding sequence
ggccagggcatcgccgccgccctgatccacctgcccagcaccggcaataagcattggaggccccggtctccagaggcttccacagattgttgctggctgcaccaggctacagggtcaggatctgttacccaggcaggggtccagtggtacgaccttgggtccctccagcctctgccaccccgcttcaaacgcttcagctgtttgtccttaccatcctcctgggattacagatcttcgtgggagctgcccgacctgcaggagggaaaaattcaggcgatctccgattcggacggtgtgaattacccgtggtacggcaatactacagagacctgcacaatagtgggacccacgaagcgggattcaaaatttattatctctatgaatgataacttctatccttctgtaacctgggctgtgccggtttccgaatccaacgtggccaagctgaccaacatttaccgcgaccagtcattcactacatggttggtggcaacgaatacgtctaccaatgacatgattatcctgcagaccctccattggagaatgcaactgagcatcgaggtgaaccccaacagaccactcggacagcgtgctaggcttagagagcccattgcacaggaccagcctaaaattctatccaaaaatgagcccatccctcctagtgctctcgttaagccaaatgccaacgatgcccaagtactgatgtggaggcctaaatacggccagccactggtggtgataccccccaaacacagatag

SEQ ID NO: 47557 - DNA, 786 bp, Artificial Sequence
  Description of Artificial Sequence: Synthetic coding sequence
atgggctgcatccagagcatcacctgcaaggcccggatccggcgggagaacattgtcgtttatgatgtatgcgccactatcgatcagtgtcctacgagaatcgaggagacctctcccattgtgttgcgctataagacaccctattttaaagcttcagcacgagtggtgatgcctccaatcccccgccacgagacatgggtggtggggtggatccaggcgtgcaaccagatggagttttttaacacatacagcgacttggggatgagctcttgggaattgccagacctaagggagggtagagtgaaggccatcagcgatagcgacggcgtgagctatccgtggtatggaaacaccacagagactgtgactctggttggccctactaataaaattagtaggttctccgtgtccatgaatgacaacttttacccaagcgtgacatgggccgtgcctgtgtcagattcaaatgttcctttacttaccaggataaagcgtgatcagtcttttaccacctggcttgtggccatgaacactactaccaaggaaaagattatactccagacgattaaatggcgcatgcgcgtggacatcgaggtcgatcctctacagcttctcggtcagagagcacgtcttgtgggacgaacccaacaggagcagcccagaattctgtcacggatggaacctatcccacccaatgcgctcgtgaagcccaatgcgaatgacgcgcaggtcctgatgtggaggccaaagagaggaccccctctggtggttattcctcctaagtag

SEQ ID NO: 47558 - DNA, 786 bp, Artificial Sequence
  Description of Artificial Sequence: Synthetic coding sequence
atgggctgcatccagagcatcacctgcaaggcccggatccggcgggagaatattgtggtatacgatgtgtgtgccactattgatcagtgccccacgcggattgaggagacctcaccaatagtcctcaggtataagaccccgtattttaaggcctcagctagggtggtcatgcctcccatcccacggcacgaaacctgggtggttgggtggatccaggcttgcaatcagatggagtttttcaacacatattctgacctcggcatgtctagttgggagctaccagacctgagagaagggagggtgaaagctatttcagacagcgacggagtgagctatccgtggtacggaaatactactgaaacagtgacgctggtcggtcctactaataaaatttcaagattcagtgtgtccatgaacgataacttctatccgtcagtcacgtgggctgtcccagtcagcgattccaacgtccccttacttacgaggatcaaaagggaccagtccttcactacgtggcttgttgcaatgaataccaccaccaaggaaaagattattcttcagaccattaaatggcgtatgcgcgtcgatatagaggtggatcccctacagctgctaggccagcgtgctcggctggtgggcaggacccagcaggaacaaccccgcatcttatctaggatggagcccattccgcctaacgctctcgtcaaacccaacgccaatgatgctcaggtgctcatgtggaggcccaaacgtggcccacctctggttgttattccacccaaatag

SEQ ID NO: 47559 - DNA, 1107 bp, Artificial Sequence
  Description of Artificial Sequence: Synthetic coding sequence
atggagaacatgcacctgcggcgggtgcggaccatgccccggcactcccagtcactgactatggccccctatagctctgtgtcactggtggagcaactggaggataggatcctttgccatgagaaaaccaccgctgccttggtagaacacgcctttaggatcaaggatgacattgtgaattccctgcaaaaaatgcaaaataaaggcggaggggatcggctcgcccgcctcttcttggaggaacatattcggaatatcactgcaattgttaagcagctgaacagagatattgaggtgctgcaggagcaaatccgcgcgcgcgataatatcagctatggcactaacagtgctctgaagacacttgagatgcgccaactaagcggcctcggagatctccggggccgagttgccagatgtgacgcgagcattgcgcggctctccgccgagcataaaaccacctatgaaggcctgcagcatcttaacaaggagcagcaggcggccaagctgatccttgaaacaaagatcaaagacgctgagggtcagatctcacaactactaaaccgcgtagacctttctatttccgagcagtcgacaaagcttaaaatgtcacatcgcgattctaatcatcagctgcagctgctagacactaagtttaaggggacagtggaggagttgtcgaaccaaattttgtctgctaggagttggttgcaacaggaacaagagaggattgagaaggaacttttacaaaaaatcgatcagctctctttgatcgtcaaagaaaacagcggggcaagcgagagagatatggagaagaagctgagtcaaatgtcagcccggttggacaagatcgaggaaggacaaaaaaaaacattcgacggccagcgaacccgccaggaggaggaaaaaatgcatggtcggataaccaagttagagctgcagatgaatcaaaatattaaggagatgaaggccgaagttaacgctggattcaccgcagtttacgagtccatcggctcactgaggcaggtgctcgaggctaaaatgaagttggatcgcgaccaattgcagaaacagattcaactaatgcagaagcccgagacacccatgtag

SEQ ID NO: 47560 - DNA, 207 bp, Artificial Sequence
  Description of Artificial Sequence: Synthetic coding sequence
atggagaacatgcacctgcggcgggtgcggaccatgccccggcactcccagagcctgacaatggcgccttactcctcagtcagcctggtggagcagcttgaggatcgcatcctgtgtcatgagaagacaaccgcagccctggtggagcacgcatttcgcattaaggacgatattgtaaatagtcttcaaaagatgcagaataaatag

SEQ ID NO: 47561 - DNA, 327 bp, Artificial Sequence
  Description of Artificial Sequence: Synthetic coding sequence
atggagaacatgcacctgcggcgggtgcggaccatgccccggcactctcagtctttgacaatggccccctactcatccgtcagtcttgttgagcagctagaggatcgcatcctgtgtcatgagaaaacaaccgcagcgcttgttgagcatgcattccggatcaaagacgatattgttaattcgttacagaagatgcagaataagggtgggggagaccgactagcacgtctgttcctcgaggagcacatccggaacatcacagcaattgtcaaacaactaaatcgcgatatcgaagtcctccaggaacaaattagagctcgcgattag

SEQ ID NO: 47562 - DNA, 204 bp, Artificial Sequence
  Description of Artificial Sequence: Synthetic coding sequence
atggagaacatgcacctgcggcgggtgcggaccatgccccggcacagtcagagccttacaatggctccctactcctctgtttctctcgtggaacagctcgaggataggatcttgtgccatgagaagacgaccgccgccctggtggagcatgcttttcggattaaggatgacatagttaatagccttcagaagatgcaaaattag

SEQ ID NO: 47563 - DNA, 348 bp, Artificial Sequence
  Description of Artificial Sequence: Synthetic coding sequence
atggagaacatgcacctgcggcgggtgcggaccatgccccggcactcccagagtctcaccatggcaccctatagtagcgtaagtctggtggagcagctggaggaccggatactgtgccacgaaaaaaccactgccgccctggtcgagcatgcctttaggattaaggatgacattgtgaatagcctgcagaagatgcaaaacaaaggcggaggcgaccgtctggcccgactgttcttggaggagcatatcaggaacatcactgcaattgtcaaacaactgaatcgggatatagaggtgctccaggaacaaattcgcgcgcgggataacataagctatggcacaaattag

SEQ ID NO: 47564 - DNA, 177 bp, Artificial Sequence
  Description of Artificial Sequence: Synthetic coding sequence
atggagaacatgcacctgcggcgggtgcggaccatgccccggcacagtcagagcctgacaatggctccatacagctctgtcagtttagttgaacagctcgaagatcggatcctctgtcatgaaaaaacgacggctgccctggtggagcatgccttcaggatcaaggacgacatttag

SEQ ID NO: 47565 - DNA, 402 bp, Artificial Sequence
  Description of Artificial Sequence: Synthetic coding sequence
atggagaacatgcacctgcggcgggtgcggaccatgccccggcacagccagagcctcaccatggccccgtacagctccgtgtccctagtcgaacagctggaggaccggatcctgtgtcatgaaaagaccaccgctgcattagtggaacacgcatttcggataaaagatgatatagtgaattctcttcagaagatgcaaaataagggagggggggaccggctggccagacttttcctcgaagaacacatccggaatatcaccgcgatcgtgaaacagctgaatcgagacatagaggtgttacaagaacagatccgggcccgcgataacatcagctacggaaccaattcggccctgaagactctagagatgcgtcagctctccggcttgggggacctcagatag

SEQ ID NO: 47566 - DNA, 351 bp, Artificial Sequence
  Description of Artificial Sequence: Synthetic coding sequence
atggagaacatgcacctgcggcgggtgcggaccatgccccggcactcgcaatcactgacaatggctccctattcaagtgtgtctctggtcgaacagctggaagatcggattctatgccatgaaaagacgactgctgcccttgtggagcacgcatttcgaatcaaggacgatattgtgaattcccttcagaaaatgcaaaataaggggggcggggaccgcctggctcgcctgttcttggaggagcatatccgcaatatcaccgccattgtgaaacagctgaaccgggacatcgaagtgctgcaggagcagattagggctagagataacatatcctacgggactaatagttag

SEQ ID NO: 47567 - DNA, 1359 bp, Artificial Sequence
  Description of Artificial Sequence: Synthetic coding sequence
atgcagctgcagttcctgggcaccctggccagcagcgagaagcggaaaaagtcacagcggctgttttttaagaatattaagtccactaagaataaagcaggcaaagcctccattatgagctccgacacaaatgttaacaagtccgcaagccccaccgccaccgcagaagagcagcccgttgaaccagacgggcctctgcctggatccgacaacaaccaggaaaaaaaggtcaggctgagtcccgctaaaatgtcaacgaaaaattcaacagacctcgtggaatacgtggacaaaagtcacgcctttctcccgattattcctaacacccagagggggcaactggaggataggctgaataatcaggcgaggacaattgcctttctcctcgaacaagcctttagaattaaggaggacattagtgcatgtcttcaaggaacccacggcttccgaaaagaggaaagcctggccagaaagctgctggaaagccatattcagacaattacttccattgtgaagaaactgtctcagaacatcgagattctcgaagaccagatacgggctcgggaccaagcggctactgggacaaatttcgcagtgcacgaaataaacatcaagcacctccagggcgtgggtgaccttcgtggccgggttgcccgatgcgattcttctatcgttaagctgtcaggtgatatacacctattccgtcaggaacaccgccagatcgagaaggctatccaggagttcgtcccggctttagaaactctatccaagaacttagatatgaaggtgatgcaacttcttggaaagattgagacagcaagtccagagcagacttccaacttaaaaatggtccagggtgactataggcacgaaatgaacctcctcgagttcaagttccactccctcagcagtaacttgtatgaagaggtcgaaaataataaaaagtggacagagaatcagtttcttaaatataggaaagatcacctaggtcacattaacgagtgcttaaaggtcttacaggagaagctggaaaaaagcgagaacaagatggaggagaagctgctccagctgtcttccaaggtagaaaacttcatcaatacccaaaagcaggaaacccagctatccaaagtgaagcacatggagaacaaattgtctaagaagatggaacaaatggagaaacagatttggggtgagttggagactatgcagaacgaataccaaagcggattcaaaagcatacatgattctctctcctctttacagcagatccagaaaaccaagatggatctggagaagtataaggtacagaaagatttgaagaagcttcagcgaaaaatagtcgagcttcaggaggtttag

SEQ ID NO: 47568 - DNA, 1104 bp, Artificial Sequence
  Description of Artificial Sequence: Synthetic coding sequence
atgagccggagccggcacctgggcaagatccggaagcggctggaggacgtcaaatctcagtgggtgcgcccagctagagccgatttctccgataacgaaagcgcgcgacttgccacagacgctctgctggatggcggctctgaggcatattggcgcgtgctctctcaagaaggtgaggtggacttcctgagttccgtggaggcacaatatatccaagcccaggccagggagcctccctgtcctcccgataccctaggaggagctgaggctggccctaagggcttagattcaagctccctgcaatcaggcacatatttcccggtggcttctgaagggagcgaaccagctctgctccactcatgggccagcgccgagaagccgtatctgaaagaaaagagcagtgcaaccgtgtattttcagacagttaaacataataacattcgggacttagtgagaaggtgtattacgcgcacatcacaggtgctggtaattctcatggacgtattcactgatgtcgagatcttctgtgacattctggaggcagccaataagcggggtgtgtttgtttgcgttctgctcgaccagggaggtgttaaactgtttcaggagatgtgtgataaagtacagatatccgatagccatttgaagaatattagtattagatcagtcgaaggggaaatctattgcgctaaaagtggccgcaagttcgcaggacagattagagagaagtttataatatccgattggcgttttgttctcagtgggtcatactctttcacttggctctgtgggcacgtgcatcgtaatatactcagcaagttcacagggcaggcggtcgagctctttgatgaagaattccggcacctttacgcatcaagcaagcctgttatgggcctgaagtctccacgactcgtggctcccgtccctccaggagccgcaccagcaaacggaaggctgagtagtagctccggtagtgcttcggacagaacttcctccaatccttttagtggacggtctgctgggtctcatccggttcccgagagtaaacagaataaaaccaaaaccaaaaaacagacaacgctttggtttttgatggctttttag

SEQ ID NO: 47569 - DNA, 1305 bp, Artificial Sequence
  Description of Artificial Sequence: Synthetic coding sequence
atgagccggagccggcacctgggcaagatccggaagcggctggaggatgtcaaaagtcaatgggtgcggccagcacgggctgacttcagcgacaacgagagtgcaaggctggccacggacgctttgctggacggcggaagcgaggcgtactggagggtgctgagtcaagagggggaggtggattttctgtcttcggttgaagcgcagtacatacaggctcaggcccgggagccgccttgtccgccagacacccttggaggcgccgaggccggtccaaaaggcctggactcatccagccttcagagcggaacctattttccagtggcatccgaaggctccgaacctgctctgctccatagttgggcgagcgcggaaaaaccctatctgaaagaaaaatcttctgcaaccgtgtacttccagacagtgaaacataacaacatcagagacttagtccggaggtgcattacacgcacctcgcaggtgctggtgatcctcatggacgtctttacagacgtcgagatattttgcgatattctcgaggctgccaataagagaggagtctttgtgtgtgtactccttgaccagggcggcgtaaagctgttccaggagatgtgcgacaaagtgcagatttccgactcccatctaaaaaatatcagtatccgtagtgtcgagggtgagatttactgtgccaaaagcggacggaaattcgccggccagattagggagaagttcatcataagcgattggcgtttcgtgctgtctggttcgtattccttcacatggctgtgcggccacgttcatcgcaacatactgtctaaattcactggccaggcggtggaactttttgacgaggagtttcgacatctgtatgccagtagcaaacctgtcatgggtcttaaatcaccccgactcgtggccccagttcctccaggtgcagcccctgctaatgggagactatctagttctagcgggtccgcatccgaccgaacaagtagtaaccctttctcagggcgaagcgccggatcccaccctggaaccaggtccgtgtctgctagcagcggcccatgttcccctgctgcaccccacccccccccacccccgagattccaacctcaccagggaccatggggcgcgccatccccacaggctcacttgtctccacgaccacacgacgggcccccagcagcagtgtacagtaacttaggggcgtatcgccccaccaggctgcagcttgaacagttaggccttgtaccccgtttgaccccaacttggcgacctttccttcaggcttctccccacttctag

SEQ ID NO: 47570 - DNA, 1305 bp, Artificial Sequence
  Description of Artificial Sequence: Synthetic coding sequence
atgagccggagccggcacctgggcaagatccggaagcggctggaggatgtaaagtcccaatgggtgcggcccgcccgtgcagacttctctgataatgaaagcgcaaggctggcaacagacgcgttactggacggtggctcagaggcttactggcgtgttttgtcacaagagggggaggtcgacttcttgtcttcagtggaagcgcagtatatccaagcacaggcccgtgaacccccctgccctcctgacacactcgggggtgcagaagcgggaccaaaaggactcgactcatctagcctacagagtggcacttatttccccgtggcatccgaaggttccgagccagccttattacattcatgggccagcgccgagaaaccttatctgaaggagaagagctctgcaaccgtgtatttccagaccgttaaacataataatatccgggatctcgtgcgaagatgcattacccgcacctctcaggtcctggttattctgatggatgtctttaccgacgtagagattttctgtgacattctggaggccgctaacaaacggggcgtgtttgtgtgtgtgcttctggatcaaggaggggttaaattgttccaggagatgtgcgataaagttcagatctcagatagccacctaaaaaatatttcaattagaagtgtggagggcgagatctactgcgctaagtccgggcgaaagttcgcaggccagattcgggagaaattcatcatttcggattggcggtttgtgctgagcggatcctatagttttacttggctctgcggccacgtgcatcggaacatcctctccaagtttaccggtcaggctgtggaactctttgacgaagaattcagacatctttatgctagtagcaagccagtcatggggctgaaatcacccaggctggtcgccccagtgccccctggcgcagcacctgcgaatgggcggctttcgtcgagctccggaagcgccagcgaccgtacctcttctaacccattctctggacggtctgctggcagtcatcctggtactcggtccgtgtccgcgtcaagcggcccatgttcacctgcagcaccccatcccccgccaccaccccggtttcaaccacaccagggcccctggggggcacctagccctcaggcccatttaagcccacggccccacgacggaccaccggccgctgtgtactccaatttgggagcctatagacccacacggttacagctggaacagctgggtctggtcccccgcctgaccccgacctggagaccgttcctgcaagcatcccctcacttctag

SEQ ID NO: 47571 - DNA, 885 bp, Artificial Sequence
  Description of Artificial Sequence: Synthetic coding sequence
atgagccggagccggcacctgggcaagatccggaagcggctggaggacgtgaaaagtcaatgggtgaggcccgctagagcagatttttctgacaacgagtctgccaggctcgcaacggatgccctcttggacgggggaagcgaggcatactggcgcgtactttcccaggaaggggaggtcgattttctgagctctgtggaagctcagtatattcaggctcaggcccgtgaaccaccttgtcctccagataccctcgggggggcagaagctgggcctaagggcttggatagcagttcactgcagtcgggcacttactttcctgtggcaagtgaaggcagcgaacctgcactgctgcattcttgggcttctgcagaaaaaccatacctgaaggagaagtcctctgccacagtctactttcagaccgtgaaacataataatatccgcgacctggttcgacggtgcatcacacgcacctcccagaacatttctattaggtcagttgaaggagagatttattgtgcaaaatctggcaggaagttcgccgggcagatccgggagaaatttatcataagcgactggagatttgtcctgagcgggtcatactctttcacttggctatgtgggcacgtccatcgtaacattctgtctaagttcactggacaggcagtcgagctgtttgatgaagaatttcgacacctctacgcatctagcaagcctgttatgggcctcaagagtccaaggcttgtcgctcctgtgcccccaggtgcagcccctgctaacggcaggctgtcttcaagttctggcagcgcatcagacaggacttccagcaatcctttcagcggaagaagcgctggatctcatcccgggactaggaccgatggatag

SEQ ID NO: 47572 - DNA, 1104 bp, Artificial Sequence
  Description of Artificial Sequence: Synthetic coding sequence
atgagccggagccggcacctgggcaagatccggaagcggctggaggatgtgaagtcccagtgggtgcgacccgcgcgtgctgatttttcagataacgaaagtgcccgcctggccacagatgcactgttagatggtggttccgaggcatattggcgcgtgctttcgcaggaaggagaagtggactttctgagtagtgtggaggcgcagtatatccaggctcaagcccgggaaccaccctgtccacctgacactctaggtggggcagaagctgggcctaaaggtcttgattcgtctagtcttcagtccgggacatattttcccgtggcttccgagggttccgagccagcattgttacacagctgggccagtgctgagaaaccctatctgaaagaaaagagctccgcaacagtctattttcaaacagtgaaacacaacaacatccgcgacctggtccgccgctgcattacacggactagccaagtgttagtaattctgatggacgtcttcactgacgttgaaattttctgtgatatcctggaggctgcgaataagcgcggcgtgttcgtctgcgttctgctggatcagggaggcgtaaagttattccaggagatgtgcgataaggtccagattagcgactcccaccttaagaacatctctattaggtcagtggagggagaaatctattgtgctaaatccgggcgtaagttcgctggacagattcgcgagaaatttatcatcagcgattggaggttcgtgcttagcgggagttatagcttcacctggctttgtgggcacgtgcatcgtaacatccttagcaaattcactggacaagccgttgagctgtttgatgaagagttccggcacctatacgcaagttctaaaccagtgatgggcttgaaatccccacgcctggtggcccccgtacctccaggcgccgcccctgccaatgggcgtctgagttccagctccggaagcgcgagcgaccgtacctcatccaaccccttctccgggcggtcagccggatcccacccagtccctgagtcaaaacagaataagaccaagactaaaaagcagacgaccctgtggtttctgatggctttttag

SEQ ID NO: 47573 - DNA, 885 bp, Artificial Sequence
  Description of Artificial Sequence: Synthetic coding sequence
atgagccggagccggcacctgggcaagatccggaagcggctggaggacgtgaagtcccaatgggtgcgccccgctagggccgacttttccgacaacgagtcagcccggctggctacagacgctcttctagacggaggcagtgaggcctattggcgggtgctcagccaggagggggaggtagactttctgagcagcgttgaggctcagtacattcaggcccaggctagggagccaccatgtccacccgacacgttagggggggccgaggcgggaccaaaggggctggatagcagcagtcttcagagcggcacctacttccctgtggcatctgagggtagtgagcctgcacttttgcatagttgggcctctgccgaaaaaccgtatctaaaggaaaagtcctctgccacggtttacttccaaactgtgaagcacaacaatatccgagacttggtccgtcgctgcatcacaaggaccagtcaaaatatctctatccgaagtgtggagggagaaatttactgcgcgaagtcagggaggaagtttgctggacagattagggaaaaatttatcatttcagattggagattcgtgctctccgggagctattcattcacctggctgtgcggtcacgtccacaggaatatcctaagtaagttcaccgggcaggcagttgaattattcgacgaggagttcagacacttgtatgcctcatccaagcccgtcatgggcctgaagagccctagactcgtcgcgcccgtcccccctggtgctgcgcctgccaatggtagactctctagtagctccggttccgcatctgatagaacatccagcaatcccttcagcggaagatcagccggatcacacccaggaacacgcacggatggctag

SEQ ID NO: 47574 - DNA, 3036 bp, Artificial Sequence
  Description of Artificial Sequence: Synthetic coding sequence
atggagaccagcagcatgctgagcagcctgaacgacgagtgcaagtccgataattatatcgagcctcactacaaggaatggtacagggtggcaatcgatatcttgattgaacatgggctcgaggcctaccaggagttcctagtgcaggagagagtcagcgactttctggctgaggaggaaatcaattacatcctcaaaaacgtgcagaaggtggctcaaagtactgctcatggaacggatgactcgtgtgacgacactctgtctagtggaacctactggcccgttgagagcgatgtcgaggctccaaacctagacctagggtggccctacgttatgcccggcctgctcggaggtacccacatcgatttgctttttcatcctcccagagcccatctgcttactattaaggagactatccgcaaaatgattaaagaggctagaaaggtcatcgcactcgtcatggatatcttcacagatgtggatatattcaaggaaatagttgaagctagcaccagaggggtttccgtgtatattcttctggatgagtcaaattttaatcactttttaaatatgactgagaagcaaggttgttcagtccagaggctccgcaatatccgtgtgagaacagtgaaaggacaggactatctgagcaaaacgggagccaagttccacgggaagatggaacagaagtttcttttagtggattgccagaaggtaatgtacggctcctacagttacatgtggtcttttgaaaaggcccatctatctatggtgcagataatcacaggccagctcgtagaatcattcgacgaggaattccgcaccctctacgcccgcagctgcgtgccttcatctttcgcacaggaagagtctgctagagttaaacacggcaaagctctatgggaaaatggaacctatcaacacagcgtatcctctctggcctcagtgtcaagtcaaagaaacctgtttggccgtcaggataagatacacaaattggattcctcctattttaagaatagaggtatttatacgctgaatgaacacgataaatataacatcaggtcacatgggtataagccacacttcgtgcctaactttaatggtcccaacgccatccgtcagttccagcccaatcaaatcaacgagaattggaaaagacactcttacgccggtgagcaaccagagacagtaccttacctgttactgaatagagcattgaacagaacaaataatccgcctgggaactggaaaaaaccatctgactcgctctctgtggcttcatcaagccgggagggatacgtgagccaccacaacacacctgcccagtcattcgcgaatcgtctggcccagcgtaaaaccaccaatctggcagaccggaattctaatgttcgacgctcctttaacggcacggacaatcacatcaggttccttcaacagagaatgccaacgctggaacatacaaccaagagttttctgaggaactggaggatcgagagctacctgaacgatcactctgaagcaactccagattctaacggtagcgctcttggcgaccggttcgagggctacgataacccggaaaatcttaaagcaaacgctctgtatacacactccaggcttaggagttcactagtgtttaagcccacactgcctgagcagaaagaagtgaacagctgtaccactgggtcctctaactccacgatcataggatcccagggctccgaaacccctaaagaggtccctgatactccaacaaatgtgcagcacctcacagacaagcctttacccgaatcaattccaaagctgcccctacagtcagaagctcctaagatgcacacactgcaggttcccgagaaccatagtgtcgcgctcaatcagacaacaaatggccacaccgagtccaataactacatctataagaccctgggcgtaaataaacagactgagaatctgaagaaccagcagacagaaaatctgctcaagagaagaagtttcccacttttcgacaattccaaagccaatctagacccaggcaacagcaaacattatgtgtattcaaccttgacccggaatcgagttagacagcctgaaaagcccaaagaagacctgctcaagtcatccaagtctatgcacaatgtcacccataacctggaggaagatgaagaggaggttactaagagaaactctccctcgggcacaacaactaaatctgtaagcatcgccgccctgctcgacgtgaacaaagaggagtcaaataaagaactggcaagtaagaaggaggtgaaggggtccccttccttcttaaagaagggatcgcagaagttacggagccttctgtcactgacacccgataagaaagagaatctgagcaagaataaagcccctgcgttctatcggttgtgttctagctctgacaccctcgttagcgaaggggaagaaaaccaaaaacctaagaagtctgataccaaggttgattccagcccccgccgcaaacatagctccagttcaaatagccaagggtcgattcacaaatccaaggaagacgtcaccgtcagcccctcccaggagataaacgcccctccagacgagaataagcggacaccttctccggggcccgttgagagcaaatttctggagcgggcgggcgacgcgtccgcccctcggttcaacaccgagcagatccagtatcgggatagcagggagatcaatgcggttgtgacaccagaaaggagacccacctcatcaccaaggcccacatccagcgagttgctgcgatcacacagtacagatcggcgcgtctattcaaggtttgagccgttctgtaagatagagtcctccattcagccaacatctaacatgccaaatactagtattaatcgtcccgaaattaagagtgccactatgggcaactcctacggccgatcctcccctctgctgaattacaatactggggtgtaccgctcatatcagcccaatgaaaacaagtttcgagggtttatgcaaaaattcggcaattttattcataaaaacaagtag

SEQ ID NO: 47575 - DNA, 2244 bp, Artificial Sequence
  Description of Artificial Sequence: Synthetic coding sequence
atgttcggcggccccggccccggcgtgctgggcgcccagggcatggccgggccacttcgcgggcgagtagaggaactgaagctcccgtggtggagagagtcaagcccactggtattgcgacacagcgaagcagctagactggccgccgacgctttgctggaacgtggcgaagcagcttatcttagagtgatctccgaagaaagggaactgccatttctgtctgctctggacgtggactatatgacgagccacgtccgcggcggaccagagctctcagaagcccaggggcaagaggcttcaggacccgataggcttagtctgttgtccgaggttacatctgggacatactttccaatggccagcgacattgacccaccggacctagatttgggatggcccgaagtgccacaggctacagggttctctcccacgcaggccgtggttcacttccagcgggacaaagccaagaatataaaggatctgctgaggtttttgtttagccaggcccataccgtggtggcggtcgtgatggacattttcaccgacatggagctactttgtgatctaatggaggcaagctctcggcggggggtgcccgtctatctcctacttgcacaagagcatctgagacatttcctggagatgtgctacaaaatggacttgaacggtgagcacctacccaatatgcgagttcgaagcacctgcggggacacatattgctctaaggcaggcaggcggtttactggtcaggcgttagagaaatttgtcctgatagactgcgagcaggtagtcgcagggagctacagttttacttggttgtgttcccaggcccacacctccatggttcttcagttaaggggcaggattgttgaggacttcgacagagagtttagatgtctctatgcggagagccaaccagttgagggcttttgcggcggggaagatcctcttagcccaagggcattacgtccacccccggtcgcacttgcctttcgcccagatgtacccagtcccacctcatctttaccttcctccactagtctttcctccattaaacaaagtcctttgatggggcgttcttcttaccttgcactccctggtggcggcgattgcagcgataccggagttgtgtccagctctctcggtccggctagaagagaggcaagcggacagccaagcctgcaccgtcagttgtctgatcccaaccacggatcacctcccgggctgtatagagccaacttaggaaaactgggcgcctacccatggtcccagtcatcccccgctctgaatcacaatagtacctcccctctgactctggccgtgggctctccattacttccgaggtctcgtcctcttctgcagttccaccgaggcgctcctgccctttcgcggtttcctgaaaacgggctcccaggctcacaggagccatcccctctgcggggacggtgggtgcctggtacaaccctcgagacagtggaagagaaagagaagaaggcctctccatcccagtctcggggacagctggacctcctggtgccttttccacgagcaagggaagtaggagatccagatagtggggtgaccccaaatagcggacctttgcggcccggagagcaggccccagaggaccggcgcctctcaccctctcaggctgattcacagttggacctgctgagccgtgccctggggacggggggagcccccgagctgggatctcttcgccctggagaccgcgctctagaggacaggcgactgtccctgaatcagtcccgtggccaaagtgacctcctgatgcaataccccaaagcccagggcagtcgggtgcctctggagactaattcaagcgcgaggccagcacgccgagcacctgatgagcgacgtcagacattgggtcactcacaactggatctgataacaaaattcggtcccttcaggggagaagggccagggcccaacggactccccatttctagtcctgccaggactgcaggcgcaggatctggagacgagaagcggctgactttgggccattccaaattggacctcattaccaagtaccaccagctccacggcgctcggcaggggactgagcctggggggcccaagggtggccacctgaatggcggaaattccgacttagtgagggacgaaaaacggctgacgctcggccatagcaagctcgacctcataaccaagtacaacaagtccaagttcaaacaacttcgttctagattcgagtcttag

SEQ ID NO: 47576 - DNA, 1437 bp, Artificial Sequence
  Description of Artificial Sequence: Synthetic coding sequence
atggccgccagccagctggccgccctggagggcgtggacagcggcccccgagtgcctggggctagtcccggcttcctgtattccgaaggccagcgtctggcgctggaagctcttttgtccaaaggcgcagaagcatttcagacgtgtgtccagcgtgaggaattgtggccctttctgtcagccgatgaggtgcaagggttggccgctgctgccgaagactggacggtcgctaaacaggagccatcagggatggccgaaggcgcaaccaccactgacgtggatgctggctcactgtcttattggccaggccagtcagagcaacccgcccctgtgctgcggttagggtggcctgtggactctgcttggaaggggatcacaagagctcagctgtatacccagccaccgggggagggccagcctcccctgaaggagctggtcaggctggaaattcaagccgctcacaaacttgtggcggtagttatggacgtcttcacagacccagatctcctacttgatttagtggacgcggctacacgccgctgggtgccggtgtacttactgcttgatcgccaacagctgccagccttcctggagctcgctcagcaactcggggtaaatccctggaacacagagaacgttgacgtgcgcgtggttagagggtgctcttttcaaagtaggtggcgaagacaggtctctgggactgttcgggagaagttcgtcctgctcgacggtgagcgggtcattagcggctcctactccttcacttggagcgatgctcgcttgcatcgcggcctggtaactttgctcaccggcgaaattgtcgacgccttctctttggagttccgcacgctctacgctgcctcttgccctttgcctcccgccccccctcagaagcccagcgtgataggaggactgcaaaggggccgatcgccacacagagtgagtagaagacgttcagtggcacctgcgtctccacccccccctgatggaccccttgcacatagactggctgcatgtcgagtgtctccagcaacgccgggtcccgccctgtctgacatactccgctcagtgcagagggctcgcacccccagcggacccccagcgaggccctccagatctatgtgggatctttcacgccttagtcagttaagtggcagttccgacggagataacgaactcaagaagtcatggggaagtaaagacaccccagccaaagctctcatgcgccaacggggcaccgggggagggccatggggcgaggtagatagccgtccaccatggggcggggccctacctctgccaccagcgcaccgcctgcgatacttgtccccagcgagacgccgtttcggcggggacgccacgtttaagctccaggagccaagaggggtgcgcccgagtgattgggcccccagagctggactgggcgggcaaccctag

SEQ ID NO: 47577 - DNA, 1503 bp, Artificial Sequence
  Description of Artificial Sequence: Synthetic coding sequence
atggccgagagccagctgaactgcctggacgaggcccacgtgaacgagaaggtgaccgaagcccaagccgccttttattattgtgaaagacggagggctgccctcgaggcgctgctgggcggaggcgaacaggcttatagggagcgactgaaggaagagcagctgagggactttctgagtagtcctgagcgccaggccctcagagccgcatggagcccgtatgaagatgctgtgcctgctgcaaacgccaggggaaaatctaaggctaaagcgaaagcacccgcaccagcacctgccgagtccggtgagagcctcgcatattggcctgaccggtccgacacggaagtacccccactggaccttggatggaccgacaccgggttttatcggggcgtgtcacgggtgacattatttacacaccccccaaaggatgaaaaggcaccacacttgaagcaggtggtgaggcaaatgatccagcaagctcaaaaagttatagccgtggtcatggatctgttcaccgacggggacattttccaagatatcgtcgatgctgcttgcaagcggagagtgcccgtgtacataattcttgatgaggccggcgtgaagtatttcctcgagatgtgccaggacttacagctgaccgacttcagaatacgcaatatccgcgtgcgttccgtcactggcgtgggcttttacatgcctatgggacgtatcaaaggcaccctgtcatccagattcctgatggtcgacggagacaaggtggccacaggatcttaccggtttacttggtccagttcacatgttgatcgcaacttgctgctgctgctgaccggccagaacgtcgagccgttcgacacggagtttagagagctctacgcgattagtgaagaggtagacctatacaggcagctcagcctcgccggccgagttggactacattatagctcaaccgtggcacggaaactcattaacccgaagtacgcccttgtctccggttgcagacaccctcctggcgagatgatgcggtgggcagcccggcagcagcgagaggccggaggtaatcccgaaggacaggaggagggtgctagcgggggagaaagtgcctggcgtctggaaagctttcttaaagatctggtgactgtggagcaagtgctcccccctgttgaaccaattccccttggagaactgagccaaaaggatggaagaatggtgtcccatatgcatagggacctgaaaccaaaatcacgtgaggcgccttctcggaacggcatgggggaagccgcccggggcgaagcagcccctgccagaagattctcctctagattattctcaaggagggcgaaacgccctgcggcccctaatggaatggcttcttcggttagcactgaaacctcagaagttgagttcctgaccgggaaaaggccgaacgagaacagctccgccgacatctccggaaagactagcccatcctcggcaaaaccctcgaactgcgttattagttag

SEQ ID NO: 47578 - DNA, 2472 bp, Artificial Sequence
  Description of Artificial Sequence: Synthetic coding sequence
atggccttcagccaggtgcagtgcctggacgacaaccacgtgaactggaggtcttcagaatctaaacccgagtttttctacagtgaggaacagaggttagccttggaagctttagtcgcacgagggcgagacgctttctacgaggtcctgaagagagagaatatcagggacttcttgtcagagctggaattaaaacgcatactagagaccattgaagtttacgaccctggctccgaagaccctagaggaactgggccaagccagggccccgaagataatggggtcggcgacggtgaggaggcctccggcgcggacggcgtgccgatcgaggccgagcctctgcctagcttggagtattggccccagaaatctgaccgctctattcctcagctcgatctgggatggcccgatactattgcttatcggggagtgacacgggccagcgtgtatatgcagccacctattgatggacaggcgcacatcaaagaggtggttcggaagatgatctcccaggcccaaaaagtcatcgcggtggtgatggacatgttcacagatgtggatatcttcaaagacttactggatgccggattcaagcgtaaggtcgctgtttatattattgtggatgagagtaatgtgaaatacttcctgcacatgtgcgagagagcatgtatgcacctgggacacctgaagaatctccgcgtgaggagttctggcggaactgagtttttcacaaggtctgccacgaaattcaaaggagcgctggctcagaaattcatgtttgtcgacggagatcgggctgtctgtggcagctacagcttcacctggtctgcagctcgaacagacagaaacgtgatttcggtcttgtctggacaggtggtggagatgttcgaccgccagttccaggaactgtacctcatgtctcatagcgtttctctgaaaggtattccaatggaaaaagaacccgagcctgaacctattgtcctgccctcagtcgtgcccttagttcccgcgggaactgtggccaaaaagctggtgaatccgaagtatgcactggtaaaagctaagagcgtagacgaaatcgcaaagatctccagcgagaaacaggaggccaagaagcctctcggccttaaaggccccgcccttgctgaacaccctggcgaattgccggagcttcttccccctatccacccaggactgctccacctggagcgggctaacatgtttgaatatttacccacttgggtggaacccgaccctgaacccggcagcgatatcctcggttacataaatattatcgatccgaacatttggaacccccaacctagccagatgaatagaattaaaatccgagacacctctcaggcaagtgcccagcatcaactgtggaaacagtcccaggattcccgcccgcggccagagccttgccctccccccgaaccttctgcgccccaagatggagtgcctgcagaaaacgggctgccacagggtgaccccgagcccctcccgcccgtgcccaagccacggaccgttccggtggccgatgtgttagcaagggactcatccgacattgggtgggtgctggaacttccgaaggaggaagctccccagaacgggaccgaccatcgcttacctcggatggccggtcctggacacgcaccactccagcgccaactttcagtgacccaagacgacccagaaagcctgggcgtcggactgccaaacggactggacggtgtagaggaagaagatgacgacgactacgttactctatccgatcaagatagtcactccggaagctccggtcgagggccaggaccccgacgaccgtcagtggcttcctcagtgtccgaggagtactttgaggtgcgggagcactccgtcccgctgcgcagacggcattctgaacaggtggccaatggacctacgccccctccgagacgccagctctcggcaccgcatattacacgggggaccttcgtcggacctcagggaggatccccatgggctcagtcaaggggtcgtgaagaggcagatgccttgaagcggatgcaggctcagagaagcacggacaaggaagcacagggacagcagttccaccaccatagggtgcctgcctccggtactcgagataaagacgggtttcccggcccaccacgctatcggagcgctgcggattcagtacagtctagcactcgtaatgctggtccagcaatggcaggcccccatcattggcaggctaaaggagggcaggtgccccgcttgctgcccgatccaggtagtcccaggctggcccagaatgccagacctatgacagacggacgcgcgaccgaggagcatccaagccccttcggcatcccttatagcaagttgtcccaaagcaagcacctaaaggcacgcactggcggatcacagtgggccagtagtgactcgaagagacgcgctcaggcccccagggatagaaaggatccgtag

SEQ ID NO: 47579 - DNA, 2472 bp, Artificial Sequence
  Description of Artificial Sequence: Synthetic coding sequence
atggccttcagccaggtgcagtgcctggacgacaaccacgtgaactggaggagctccgagtccaaaccggagttcttttacagcgaagaacagcggctggctcttgaagccctggtggcccgcgggagagatgcgttttacgaagtcctgaaacgcgaaaacatcagagatttcctgtcagagctcgaattaaaaaggatcttggaaacgattgaagtctacgatccggggagcgaagaccctcgggggacgggacccagccaagggcccgaggacaatggagtgggcgatggcgaggaagcttcaggcgccgatggtgttccaattgaggcagagccacttccctccttggagtattggccacagaagagcgaccggtccatcccacaacttgatctcggctggcctgatacgatcgcctaccgaggtgtcaccagagcctccgtctacatgcagcccccaattgacggccaggcacacattaaggaggtcgtgaggaagatgatctctcaagcacaaaaggtgatcgctgtagtgatggacatgtttacggatgttgatatcttcaaggacctcttggacgcaggctttaagcggaaagtagcggtttatatcattgtggacgaatccaatgtgaagtacttcttacatatgtgcgagagagcatgtatgcacttaggccacctcaaaaacttgcgggtcagaagcagcggtggaacggagtttttcacccgtagtgcgacaaagttcaagggggccctggcccagaagttcatgttcgtggacggagaccgagctgtttgtggaagctactcattcacttggagcgccgccagaacagaccgtaatgttatctctgtgctgagcggccaagtcgttgaaatgttcgaccgccagttccaggaactgtacctgatgtcccacagcgtgtccctgaaaggaatcccaatggagaaagagcctgaaccggaaccaatagtgcttccttcagtggtgcccctggtgcctgccgggacagtggctaagaagttggtcaaccccaaatatgctctggtgaaggccaaatcagtggacgaaatcgccaagatatcgtcagagaaacaggaggcgaaaaaacctctcggactcaagggaccagctctagccgaacatcccggggaactccccgagttattgccccctatccacccaggccttctacatctcgagcgagcaaacatgttcgaatacctgcccacatgggtggagcccgaccccgaaccaggctccgacatcctgggctatattaacataatcgatcctaacatctggaatcctcagccaagtcaaatgaacaggatcaaaatccgcgacacctctcaggcttcagctcagcaccagctatggaaacagagtcaggattctcgccctcgacccgagccttgccctccacctgagccgtccgccccccaggacggagtccccgccgagaatggattgcctcagggcgaccctgaacctctccctcctgtaccaaaaccgaggacggtaccggttgccgacgttctcgcgagggattcatcagatattggatgggtgctggagctgcctaaggaggaggcaccacaaaacgggactgaccatcggctgccgcgcatggcagggccgggacacgcacctttgcaacgccagctgtctgtgactcaggacgaccctgaaagcttgggtgtggggcttcccaacgggctcgatggcgtcgaggaggaggatgatgatgactacgttacacttagtgatcaagactcccactcgggctccagtggcaggggcccagggccaagaagaccaagcgtggcatcatcagtttctgaggagtatttcgaggtccgggagcacagcgtgccattgcgccgccgacacagcgaacaagtggctaacgggccaactcctccacctcggcgccaactctctgccccccatattactagaggtacctttgtaggcccccagggcgggtcgccttgggcgcagtcccgaggccgggaggaagccgatgcattgaaaagaatgcaggcccagaggagtaccgataaagaggctcagggtcagcagttccaccaccaccgtgtgccagctagcggtacccgcgacaaggacggtttccccgggccaccccggtaccgcagcgccgccgatagcgtccagtcatccacccgaaacgccggccctgctatggcgggcccgcatcattggcaggctaaagggggccaggttccccggctcctgcctgatccaggatccccccgcctggcacagaatgcccgtcccatgaccgacggtagagccacagaagaacaccccagtccctttggaatcccctacagcaaactctcacagtcgaaacacttgaaagcccgtacggggggaagccaatgggcttccagcgatagtaagaggagggctcaggcccccagggaccgtaaggacccttag

SEQ ID NO: 47580 - DNA, 819 bp, Artificial Sequence
  Description of Artificial Sequence: Synthetic coding sequence
atggccttcagccaggtgcagtgcctggacgacaaccacgtgaactggcgcagttcggagagcaagccagagtttttttactccgaggaacagaggctggccttggaagccctcgtggcccgtggtagagatgccttctatgaagtgctcaagcgagagaacatccgagactttctgagcgagttggagttgaaacggatcctagagacaatcgaagtttatgacccgggatctgaagaccctagaggtaccggacccagccagggaccggaggacaatggtgttggggacggggaagaggccagtggtgcagatggtgttcccattgaagcagagcctctgcccagtctcgaatactggcctcagaagagcgacaggtctatccctcaattagacctgggctggcctgacaccattgcttatcgcggcgtaaccagggccagcgtgtatatgcagcctcccattgacggtcaggctcacatcaaagaggtggtaaggaagatgattagtcaggcgcagaaggttatagcagtggtaatggacatgtttacggacgtcgacattttcaaagatctgctggatgccggcttcaagaggaaggtggctgtgtacatcatcgtggacgagtccaacgtgaaatatttccttcatatgtgcgagcgagcctgtatgcatctcggccatctcaaaaatctgcgggtgcgcagctctggcggaaccgaattctttaccagatccgctacaaaatttaagggtgcgctcgcacagaagtttatgtttgttgacggtgaccgcgcagtctgtggaagctatcgatag

SEQ ID NO: 47581 - DNA, 879 bp, Artificial Sequence
  Description of Artificial Sequence: Synthetic coding sequence
atgggcaaccagctggaccggatcacccacctgaactacagcgagctacctactggcgatcctagcggaattgagaaggacgagctgagggtcggggtcgcctacttcttctctgatgatgaggaggatctggatgagcggggtcaacccgataagttcggagttaaggccccaccagggtgtactccttgccccgaaagtccatcaagacaccatcatcatttgctccaccagctcgttttgaatgaaacacaattcagtgcttttaggggccaggagtgtatcttctcaaaggtctctggcggtccacaaggtgccgacctgtcagtctatgcggtcactgcgcttcccgccctgtgcgaacccggagatctacttgagctgctctggttgcagcccgctcctgagccgcccgcccccgccccacactgggcagtgtacgtcggaggcggccagataatccacctgcatcagggcgagattcggcaagacagtctgtacgaggcgggagccgccaacgtaggccgcgtggtaaacagctggtacagatacagacccttggtcgctgagctcgtcgtgcagaacgcctgcgggcacttggggcttaaatctgaagagatctgttggacgaacagtgagtcctttgctgcttggtgtcgcttcggcaagcgggagttcaaggctgggggcgaagtgccagcagggactcagccaccacaacagcagtactatcttaaggtacacttgggggagaataaagtccacaccgcccgcttccatagcctagaagatcttataagggagaaacggaggatcgatgcaagcggtcgacttcgggttttgcaggagttagccgatctagtggacgataaggagtag

SEQ ID NO: 47582 - DNA, 879 bp, Artificial Sequence
  Description of Artificial Sequence: Synthetic coding sequence
atgggcaaccagctggaccggatcacccacctgaactacagcgagctgccaactggcgatcctagcggtatcgagaaggacgaattgcgggtcggtgtggcttactttttcagtgacgatgaagaggatctagacgaacgtggccagcctgacaagtttggcgttaaggcaccacccgggtgtaccccatgtccagaatccccaagccggcaccatcaccaccttctgcaccagctggtccttaacgaaacacagttctccgccttccgaggccaggagtgcatcttctcaaaggtgtccggcggacctcaaggagcggacttgtccgtctatgcggtgaccgctttgcctgctctgtgcgaaccaggcgatctcctcgagctgctgtggctgcagcccgctccagagccacccgctcctgcgccacattgggccgtgtatgtgggaggtggtcaaattatacatttgcatcagggcgagattagacaagactcgctgtacgaagccggagcagctaatgtaggacgggtcgtgaacagctggtataggtaccgccctctggtagccgagctggtcgttcagaatgcttgcgggcatctggggttaaaaagcgaagagatctgctggacaaattctgagtcatttgctgcctggtgcagattcggaaagcgcgagttcaaagccgggggggaggtcccagctggaacacagccaccgcagcagcagtactaccttaaggtccatcttggagagaataaggtgcacacagctcggtttcattcgctggaggatctcatccgtgagaaaaggagaattgatgcaagcggacggttgcgcgtgttgcaagaactggcagacctggtggacgataaagaatag

SEQ ID NO: 47583 - DNA, 1068 bp, Artificial Sequence
  Description of Artificial Sequence: Synthetic coding sequence
atgggcaaccagctggaccggatcacccacctgaactacagcgagctcccaacaggggacccatccggcattgagaaggatgagctacgcgtcggagtggcctacttctttagcgacgatgaagaggacttggacgaacgcggtcagcccgacaagtttggcgtgaaggcccccccaggatgtacaccatgtccagagagcccctccaggcatcatcatcacctcctgcatcaattagtcctgaatgaaacccaattctctgcctttcgggggcaggagtgtattttctccaaggtaagcggagggcctcaaggagcggatttgtccgtatacgctgtgacggccttgcccgccttatgtgagcccggcgatttattagaactcctctggctgcaacctgcccccgagcctcccgcgcctgctccacactggtgggccagtcgcgccaggaggagcgccggccggacccgacgagcttccccaccgggtgccgcactggcctccggatcatccaggagagagggacgctgtagacaggcccggtcccctagaagcagctccaccatctctagatgtacttgggagcggacacggtccacaccacctgggtttacagcctggaagacctcaagtgcacgtagtgctgtctccaccccagccgcggcctgcgagtgctctagaagtagccccacctcttggacaacgcggagctccaggctcggagctgccggaccaagcgcctcaccagcgcccagatcactgccatttcctgcacccggattgagatcccagcggttctccacaagcgctccccctcggcacgcacgtcctcctccggttgccagggcccgagctgcaccaccccacccccaggcatccggtagaaagagccaggagctgcctcagggtagaaagggggcagcagcaagtgcgtggctgacagcaactgcagtcgtgaccgtgctgggtgacccagcttgtgcctttcctctgcgatgtaagcccggcaccggcaagggcctgaggggagaaaggacctggccaagtcccagagtgcacggccaatag

SEQ ID NO: 47584 - DNA, 594 bp, Artificial Sequence
  Description of Artificial Sequence: Synthetic coding sequence
atgcacctgttccagagcgagcggtggcccagcggccggcggcccaagagactgagagggcacagagcggcaagtgctcttcgcaccagaagacccgccggagctgccgtggcggcagctcgagcaggagccgcaagagcccgccccgccctggggaggctgagaggacgtcgggctgatcatccccctgcccccaggagggatccacccggccagccagaggctggggcggccaatgtgggaagggtcgtgaactcttggtatcgttatcgccccctagtggccgagttggtagtacagaacgcctgcggacacctcggtctcaaatccgaggaaatctgttggacgaactctgagtccttcgcagcgtggtgtcggtttgggaaaagggagttcaaggcagggggagaagtgcctgccgcagcccctgctgcagcggtgctgtcgcagggggccccaggccgggaacagggccctcatcggtttcactcactggaggatctgattcgggagaaacgataccgtagacaacgcccaccagcctctgcccctggggccaggagaccgcggggaagacaaggtgtcgcagcctag

SEQ ID NO: 47585 - DNA, 993 bp, Artificial Sequence
  Description of Artificial Sequence: Synthetic coding sequence
atggcccccgaggagaacgccggcaccgagctgctgctgcagagctttgagagaagatttcttgcggctaggacccttcgctcattcccttggcagtctctggaggccaagctgagggattctagcgactctgagcttttaagagatattctgcataagaccgtgaagcacccagtgtgtgtcaagcaccccccatcagtaaagtatgcaaggtgctttctgtctgagttaatcaagaagcatgaagccgttcacacagagcctctggacgaactgtacgaagcattggccgaaacactgatggccaaggagagcactcaggggcaccgctcatatctgctccccagcggtgggagtgtaacattaagcgagtcaaccgccatcattagctatggcacaactgggcttgtaacatgggatgctgccctgtacttggcggaatgggcgatcgagaacccagcagtgttcacaaacagaacggtactggagcttggctctggggccgggttgaccgggctagcaatctgtaagatgtgtcggcccagggcttatatctttagtgattgtcacagcagggtcctggagcagctccggggaaatgtccttctgaacggactgagtctggaagccgacatcaccgcaaagttggattcaccacgcgtgacggttgcccagctagactgggatgtggcaaccgtgcatcagctttctgcttttcaacctgatgtggtaattgccgctgatgtgttgtactgtccggaagccattatgagcctggtgggtgtgctgaggcgactcgccgcatgtagggaacaccaacgggcccctgaagtatacgtggccttcacagttaggaatccagagacctgccagctgtttacaactgagcttggtagggctggtattcggtgggaggtcgagccccgccatgagcagaaactgttcccctatgaggagcatcttgagatggctatgctgaacctgacactttag

SEQ ID NO: 47586 - DNA, 891 bp, Artificial Sequence
  Description of Artificial Sequence: Synthetic coding sequence
atggcccccgaggagaacgccggcaccgagctgctgctgcagagctttgagcgccggttcctggccgcccggactttacgatcgtttccatggcagtcgctggaagcgaaactgagggatagcagcgacagtgagctcctgcgagacattctgcataagactgtcaagcatcccgtgtgcgtgaagcacccacctagcgtcaagtacgccagatgcttcctgtcagagcttatcaaaaagccttcaggtggcagcgtcaccctttctgaaagtaccgccattatttcctacggtacaaccgggctggttacttgggacgcggcactttacctggccgagtgggcgattgaaaacccagccgtgttcacgaaccgcactgtgttagagttaggaagcggtgcggggctaacaggtctcgctatatgcaaaatgtgtcgaccgcgggcatatattttcagtgactgtcactctagagtactggaacaactcagaggcaacgtcctcctgaatggactgtcactggaggctgatatcactgccaagttggactcaccccgggttactgtggcgcagctggattgggacgtggccaccgtgcatcagctgagcgcatttcagccagatgtcgtgattgccgcggatgtcctctactgcccagaggctattatgagtttggtgggtgtgctgcgaaggcttgcagcctgcagggaacatcagcgggcaccggaagtgtacgtggcctttactgtgcgcaatcccgaaacctgccagttgtttactactgagctcggacgggccgggatccggtgggaggtcgagccgcgtcacgagcagaaacttttcccttacgaagagcatttagaaatggcaatgctgaacctcacactgtag

SEQ ID NO: 47587 - DNA, 390 bp, Artificial Sequence
  Description of Artificial Sequence: Synthetic coding sequence
atgccccccagcaccctgcagaacggccccagccggacccggcagccatccttgacagacgtgctttattgccccgaagccatagtgagtctggtcggagttctccagaggctcgctgcctgccgcgagcacaagcgggcccctgaggtgtatgtcgcctttactgttcgcaacccagagacctgccagctctttaccaccgagctgggcgaacctccgagacccccagggcctacatggtgccccagctgtccttgccggactccagtggaagtcaaagagctgggcgctggcgagaagttagggtgttctacactgccgcactacgccggaaacagtggccgcgggcggcctggatgggaccagatggggtcaggatcaagttcatag

SEQ ID NO: 47588 - DNA, 462 bp, Artificial Sequence
  Description of Artificial Sequence: Synthetic coding sequence
atggcccccgaggagaacgccggcaccgagctgctgctgcagggctttgagcggcggttcctggcagtgaggactctacgcagctttccctggcagtcactggaagctaaactgagagacagttccgactcagaactgctgcgcgatatcctccaaaagacagttcgacatccggtctgcgtcaagcaccccccttctgtcaagtatgcatggtgcttcctgtcagagctgatcaagaagtccagtggcgggtccgtgaccctaagcaaatcaaccgcaattataagtcacggaacaaccggcctggtcacgtgggatgctgccctgtacctggcagaatgggccatcgagaatcctgcagcctttattaatcgtagagccgttctgcctcgctctcacagagttgctggtagagggcctgcggaggcaggctgcctacctggcgcacaggctggatcctag

SEQ ID NO: 47589 - DNA, 993 bp, Artificial Sequence
  Description of Artificial Sequence: Synthetic coding sequence
atggcccccgaggagaacgccggcaccgagctgctgctgcagggctttgaacgtcggttcctggccgtgagaactctacgatccttcccgtggcagtctctggaagcgaagctgcgagacagtagcgattccgagttgttgcgagacattctccagaaaaccgtgagacaccccgtctgtgttaaacacccccccagtgtgaaatatgcatggtgcttcctgtcagaactgatcaaaaagcacgaggccgtccacaccgaaccccttgataagttatatgaagtccttaccgagacattaatggcaaaagagtcaacgcagggacaccggtcatacttgctgtcttctggcgggagcgtcacgctgtccaaaagtactgcaataatcagccacgggacaacaggcctggttacctgggatgccgccctatacctggcagagtgggcgatcgagaatcccgccgcattcattaacagaaccgtcctggagttgggctccggagctggactgaccggattggccatctgcaagatgtgtagacctcgcgcttacatctttagcgaccctcactcgagagtcttagaacagctcagaggaaacgtgttgcttaatggcctttccctcgaggctgatatcacagggaatcttgactcacctcgcgtgacagtggctcagctcgactgggacgtagccatggtgcaccagctgagcgcgttccagccagacgtggtgattgcagcagatgtcctctactgtcccgaagcaatagtgtccctagtgggagtgcttcagaggttggccgcatgcagggagcacaaaagagctccggaagtctatgtggcgttcaccgttcgcaaccccgagacttgtcagctgttcactacagagcttggaagagatgggatccgctgggaggcagaggcccatcacgaccaaaagcttttcccgtacggcgagcacttggagatggcaatgctgaatcttaccctatag

SEQ ID NO: 47590 - DNA, 891 bp, Artificial Sequence
  Description of Artificial Sequence: Synthetic coding sequence
atggcccccgaggagaacgccggcaccgagctgctgctgcagggctttgagcggcgcttcctggcggtccgaacgctccgatcattcccttggcagagcttggaggcaaagttgagagactcttcagattccgagctactgcgagatatcctgcagaaaaccgtgcgccatccagtgtgcgtgaaacatcctccatccgtcaagtacgcttggtgctttctgagtgagctcatcaaaaagagttctggaggtagcgtcacactgagtaagagcaccgcaattatcagccatggcacaacaggtctggtgacatgggatgcggctctatacttggctgaatgggccatcgaaaatcccgccgcattcataaatcgaaccgttctggaactgggatctggcgccggtctgactggtctcgccatttgcaagatgtgtcgacctagagcatacatcttttccgacccgcatagccgagtgctggagcagctcaggggaaatgtgttactgaacggcctgtcactcgaagcggatataacaggcaatttggacagcccaagagttaccgtcgcacagttggactgggacgtggccatggtgcaccagctgagcgcttttcagccggacgttgtcattgccgccgacgtgctgtactgccccgaagctatcgtgagtctggtcggagttttacagcggttggccgcgtgccgcgagcataagcgagccccagaagtttacgtggcttttacagtgagaaatccagagacctgccaactcttcaccaccgagctcgggcgggacgggatcaggtgggaagctgaagcacaccacgaccagaagctgtttccttatggggaacacttagagatggcgatgttaaatcttaccctgtag

SEQ ID NO: 47591 - DNA, 462 bp, Artificial Sequence
  Description of Artificial Sequence: Synthetic coding sequence
atggcccccgaggagaacgccggcaccgagctgctgctgcagggctttgaacgtaggtttttggctgtcagaaccctgaggtcttttccctggcagtcactggaagccaaactgagagactcttccgattcagagttgctccgtgatattctgcaaaagacggtgagacatcctgtctgcgtgaaacaccctccatctgtgaagtacgcttggtgtttcctgagtgaattaatcaaaaaatcatcaggaggtagtgtgaccctgagcaaatcgacggcaattataagccatggaaccaccggcctcgttacatgggatgccgcgctgtacttggccgaatgggcgatcgaaaacccggcagccttcataaatagaagggctgtgcttccgagatcccacagagtcgccggccgtggaccagccgaggcaggctgtctgcccggagcccaggcagggtcttag

SEQ ID NO: 47592 - DNA, 993 bp, Artificial Sequence
  Description of Artificial Sequence: Synthetic coding sequence
atggcccccgaggagaacgccggcaccgagctgctgctgcagggctttgagcgcaggttcttagctgtgcgaactctgagatccttcccctggcagtctcttgaggctaagttaagagacagcagcgattcagaattgctccgagatattctccagaagaccgtgcgccacccggtgtgtgtgaaacatccaccttcagtgaaatacgcttggtgcttcttatcagagctgattaagaaacacgaagccgtgcatacggaacccctagataaactctacgaagtgttagcggagactcttatggctaaagagtccacccagggccaccgcagctatctgttgtccagcgggggttccgtgacgctcagcaaatctaccgcaattatcagtcacgggaccaccggactagtaacctgggatgcagcgctgtacttggccgagtgggcgatcgagaatccagcagccttcatcaatcgaaccgtgctcgagctggggtctggcgcaggcctaacgggtcttgccatatgtaagatgtgcaggcccagagcgtatatcttctccgacccccactcgcgtattctggagcagctgagggggaacgtgctccttaatggcctgtccctagaagccgatataacggggaatctagattctccaagggtaactgtagcacagttggactgggacgttgccatggtgcatcaactgagcgcctttcagccggacgtggtgatcgcagctgacgtgctttactgtcctgaggcaatagtttctctcgtgggagtacttcaacgacttgccgcatgcagggagcataagagggctccagaagtgtatgtcgcctttaccgtgcgaaatcctgaaacctgtcagctgttcactactgaactggggcgggatggcatcagatgggaagcggaggcacatcacgaccaaaagttgtttccgtatggcgaacacctcgaaatggctatgctcaacttaacgttatag

SEQ ID NO: 47593 - DNA, 462 bp, Artificial Sequence
  Description of Artificial Sequence: Synthetic coding sequence
atggcccccgaggagaacgccggcaccgagctgctgctgcagggcttcgaaagaaggtttctggcagtacgcactctgcgtagctttccttggcaatctctggaggcgaagctccgcgattcctctgattctgagcttctgagagatatcctgcaaaagaccgtgagacaccccgtttgcgtgaagcaccctccatccgtgaagtacgcgtggtgcttcctgagtgagctaatcaaaaagagcagcggaggctctgtgaccctatctaaaagcaccgctattatctctcacggaactacaggactggtgacttgggacgccgccctatacctagctgagtgggccatagagaaccctgccgctttcatcaacaggagagccgtgttgcccaggtcgcacagagtggctgggcggggccccgctgaagccggttgcttaccgggagcccaggccgggagctag

SEQ ID NO: 47594 - DNA, 891 bp, Artificial Sequence
  Description of Artificial Sequence: Synthetic coding sequence
atggcccccgaggagaacgccggcaccgagctgctgctgcagggcttcgaacgacgatttcttgcggtacgcactctgcgatcttttccctggcaaagcctggaggcgaaattaagagactcctcagactcagagctgcttcgggacatactccagaagacagtcagacacccagtttgtgtgaaacaccccccatccgtgaagtatgcctggtgcttccttagcgaattaatcaagaagagtagcggaggcagtgtgacattgagtaaatctaccgctattatctcacacggcacgaccggcctagtcacatgggatgcagctttatatctggcagaatgggctattgagaaccccgccgcgtttattaatagaaccgtgctagagttgggcagcggtgctggtctgactggcctcgcaatctgtaagatgtgtcggccaagggcgtacatcttcagtgacccccactccaggattctggagcagttaaggggcaacgtcctcctgaatggcctcagcctggaggctgacattactggaaacctggacagtcctcgcgtcactgtcgcccagttagactgggacgtggccatggtccaccaactaagcgcctttcagcctgatgttgttatcgccgccgatgtcctctattgccctgaggcaattgtaagcctggtcggagtactacagaggctggctgcctgtagagaacacaagagggcccctgaggtctacgtggctttcactgtccgaaatccggagacctgccagttgttcaccacagaactggggcgagacgggataagatgggaagccgaggcgcaccacgatcagaagctcttcccctatggagaacacctcgagatggctatgctgaatctaacactgtag

SEQ ID NO: 47595 - DNA, 390 bp, Artificial Sequence
  Description of Artificial Sequence: Synthetic coding sequence
atgccccccagcaccctgcagaacggccccagccggacccggcagcctagtctgactgatgtgctgtactgtcccgaggcaatagtctccttggtgggcgtgctccagcgcctagccgcttgcagagagcataagagagcccccgaggtatatgtggccttcacggtcagaaatcccgaaacttgtcaactgtttactacagagctgggggaaccccctcgccctcccgggccgacctggtgtccttcatgcccatgccggacccctgttgaggttaaggagctgggtgccggcgaaaaactggggtgtagtaccctgccacattacgctggaaattctgggaggggtcggccgggttgggatcagatgggctccggctcttccagttag

SEQ ID NO: 47596 - DNA, 888 bp, Artificial Sequence
  Description of Artificial Sequence: Synthetic coding sequence
atggcccccgaggagaacgccggcaccgagctgctgctgcagggctttgaaagacgattcctggccgtaagaacccttagaagctttccttggcaatcactggaagctaagcttagggatagttctgatagcgaacttttaagggacattctgcagaagactgtgagacaccccgtctgcgtgaagcaccctcccagcgtcaagtacgcgtggtgcttcctgagcgagctaatcaaaaaatcaagtggtggttctgtgaccttatctaagagcaccgcgattatctcacatggaactactggcctggtaacatgggatgccgctctgtatctggccgagtgggctatcgagaaccctgcagctttcatcaatagaacggttctggaattagggagtggcgccggtttgaccggactcgccatttgcaaaatgtgccgcccccgggcatatatctttagcgaccctcattctagaatcctcgagcaactgagagggaacgtattactgaatggcctgagcctggaggctgacattacgggaaacctcgatagccctcgggtcaccgtggcacagcttgactgggacgtagccatggtccatcaactctcagcgttccagcccgacgtggtgattgctgcagacgtgctttattgtcccgaagcaattgtctcactggtgggcgtgcttcaacgcctcgccgcatgcagagaacacaaacgggcaccagaggtgtatgtcgccttcactgtcagaaacccagagacttgtcaattatttactactgagctcgggcgggatggcatcaggtgggaggcagaggcacatcatgatcagaaactgtttccttacggggagcacctggagatggccatgcttaatcttacctag

SEQ ID NO: 47597 - DNA, 450 bp, Artificial Sequence
  Description of Artificial Sequence: Synthetic coding sequence
atggcccccgaggagaacgccggcaccgagctgctgctgcagggcttcgagcggcgattcctggcggtaaggacgctaaggtcatttccatggcaatcgcttgaagctaagcttagggactccagcgactccgaacttcttcgagacatcctccagaagacagtgaggcaccccgtctgtgtgaaacacccgccctctgtgaaatacgcctggtgtttcttgtccgaacttatcaaaaaatccagcgggggtagcgttacattaagcaaatcgaccgccattatatcccatggcactactggcctggttacttgggatgccgcattgtaccttgccgaatgggccatcgaaaaccctgcagcattcatcaaccggcgcgccgtgctcccaaggtcccatagagtggccggtcgcggcccggctgaagccgggtgcttacctggagcctag

SEQ ID NO: 47598 - DNA, 396 bp, Artificial Sequence
  Description of Artificial Sequence: Synthetic coding sequence
atggcccccgaggagaacgccggcagcgagctgctgctgcagagctttaagaggcggttcctggccgcccgggccctcagatctttccggtggcagtccctggaggctaaactgagagattcctcagacagtgaactgctgagggatatccttcagaagacctgttgtatcgctcaaaagcccagctgtaggtggtctggaagttgtgggggctggttacccgccggctcaacatctggacttctgaattccacctggccgctcccatctgccactcagagatgtgctagctgcagtccgcctagctacgccggcctaggctctgacggcaagagaaaactgattatgactcgcaactgcttcccgactgaatctacttggcggtggcagtcctag

SEQ ID NO: 47599 - DNA, 498 bp, Artificial Sequence
  Description of Artificial Sequence: Synthetic coding sequence
atggcccccgaggagaacgccggcagcgagctgctgctgcagagctttaaaagacggttcctggcggcccgggctcttaggtctttcaggtggcagtccctcgaagcaaagttgcgcgatagcagcgacagcgaacttttacgagacatccttcagaaacacgaggctgtgcacacagagcctctcgatgaactgtacgaagttctggtagaaacacttatggcgaaggagtctacacagggccaccggtcatacttgctgacctgttgcatcgcccagaaaccttcctgcagatggtccggttcttgcggcggatggctacctgccggctctacttcgggcctgcttaattctacctggcctctacccagtgcaacgcaacgctgtgcttcctgtagccctccttcctacgctgggctcggatccgatggtaaacggaaactgatcatgaccaggaattgtttcccaactgagagcacctggcggtggcaaagctag

SEQ ID NO: 47600 - DNA, 477 bp, Artificial Sequence
  Description of Artificial Sequence: Synthetic coding sequence
atggcccccgaggagaacgccggcagcgagctgctgctgcagagcttcaagcgtcgcttcctggctgctcgagcactgcgtagcttcagatggcaaagcttggaagccaaattgagagactcaagcgatagtgaactgctgcgagacatactccagaaaaccgtaaaacatccagtctgcgtcaaacacccgccttctgtgaaatacgcgaggtgctttttgtctgaattgatcaagaaaacgtgttgtattgctcagaagccctcttgtaggtggagtggaagctgcggcggctggcttcccgcggggtctactagcggcttgcttaacagcacttggccgctgccttccgccactcagagatgtgcatcgtgcagcccaccgtcatacgctgggcttggatcagatggcaagcgcaagctgattatgactcgcaattgctttcctacggaatctacgtggcgctggcagtcatag

SEQ ID NO: 47601 - DNA, 555 bp, Artificial Sequence
  Description of Artificial Sequence: Synthetic coding sequence
atgagcggcgcccgggccgcccccggcgccgccggcaacggcgccgtccggggcttgagagttgatggtcttccacctctgcccaaatcactgtctggtctcctgcacagcgcttctggcgggggagcctccgggggatggcgacacctggaacgtttgtacgcacagaagtcacgcatccaagatgagttgtcacgaggcggcccgggcggcggcggtgctagggctgccgcactgccagcgaagccccccaatcttgacgccgctctcgccctcttacgtaaagagatggtagggcttaggcagcttgacatgtctctgctgtgtcagctgtacagcttgtacgaatcaattcaggaatacaaaggcgcatgtcaggcggccagttctccagactgcacttacgccctcgagaatggcttctttgatgaagaggaagagtactttcaagagcagaactctctgcacgatcgacgggacagaggaccacctcgcgacttgagcctgccagtcagctcgttaagctccagcgattggatcctggagtctatctag

SEQ ID NO: 47602 - DNA, 531 bp, Artificial Sequence
  Description of Artificial Sequence: Synthetic coding sequence
atgaacggcctgcccagcgccgaggcccccggcggcgccggctgcgctctcgctggtctcccccctttaccacgtggactgagcgggcttctaaatgcatccggagggtcttggcgcgagctggagagggtatatagccagaggtctaggatacacgatgaattaagtagagctgcccgtgcaccggacggacctcgacatgcggctggcgctgccaacgctggacctgctgcgggaccccgaagaccagtgaacctcgattctgctttggccgccctgagaaaagagatgctctggggactgtacgaatcaattcaggactataaacatttgtgccaggacttgagtttctgccaggacctgagtagctcactgcactctgattccagctatcctcccgatgcagggctgagtgatgacgaagaacctcccgacgctagcctgccaccggacccgccaccactgacggttcctcagacccataacgctcgcgatcagtggctgcaggatgccttccacatctcgctgtag

SEQ ID NO: 47603 - DNA, 489 bp, Artificial Sequence
  Description of Artificial Sequence: Synthetic coding sequence
atgaacggcctgcccagcgccgaggcccccggcggcgccggctgcgccctagctggcctgcctcccctgccacggggattatctggcctgctgaatgcttcgggcggcagttggcgcgaactcgagagagtatactctcaacgcagccgcgtggtgctgtctacaagtactcagaggtggccaagatgcgcgcggcgatgctgcctgcaggttgggctgcgccagttggatatgtccctgctgtgccagctgtgggggctatacgaaagtattcaggactataaacacttatgccaggatctctctttctgtcaggacttatcatcgtccctgcactctgactcctcatatccccctgacgccggcctgtctgacgatgaagagcccccggacgcctccttgccaccagacccgccccctttgaccgttccgcagacccataatgcaagagaccaatggcttcaggacgcttttcacatcagtctctag

SEQ ID NO: 47604 - DNA, 465 bp, Artificial Sequence
  Description of Artificial Sequence: Synthetic coding sequence
atgaacggcctgcccagcgccgaggcccccggcggcgccggctgcgcccttgctggactacctcctttgcctcggggactctcgggcctgctcaacgcatcaggagggtcgtggcgcgagctggaacgggtgtactctcagcgatccaggatccacgacgaactgtctcgggcagccagagcccccgatggtcctaggcacgccgccggcgcagccaacgccggccccgccgctggaccgagacggcccgttaacctcgactctgctctcgccgcacttaggaaggagatgctttccgcgggaggcgcggctgctgtcggccacgttctggttgtgcctgcagtgggacctgtgagagtcaatcccggtctgcaaacgcctgtgccaaggcccgagttactgcccggtcccgttattttacccccctttgggcagttactaccaacaggctgcggacctgtgtag

SEQ ID NO: 47605 - DNA, 570 bp, Artificial Sequence
  Description of Artificial Sequence: Synthetic coding sequence
atgaacggcctgcccagcgccgaggcccccggcggcgccggctgcgccctggctggactgcccccgttaccaaggggtctgtctgggcttctaaatgcctcaggagggagttggcgtgaacttgagcgcgtgtatagccagcggagtaggatccatgacgaactcagccgagccgccagggccccagatggaccccggcacgccgcaggggcggctaacgccggtcccgcagccggaccccgacggcctgttaatcttgatagtgcgcttgccgcgctcagaaaggagatggttgggctgcggcagttagatatgagcttactgtgccagctgtggggactctacgagagcatacaggactataaacacctttgtcaggacctgagcttctgtcaggacctctccagcagtttgcacagtgactcctcctatccccccgacgcagggttaagcgacgacgaggaaccgccagacgcatctctgcctccagacccccctcccctcaccgtaccccagacacataacgcccgggaccagtggttacaggacgcttttcacatcagcctctag

SEQ ID NO: 47606 - DNA, 2517 bp, Artificial Sequence
  Description of Artificial Sequence: Synthetic coding sequence
atgaacatcgacgtggagttccacatccggcacaactacccctggaacaaactgcctgcaaacgtgcgtcaatcactgggcaacagtcagcgagagtacgaaaaacaagtagtgctgtactccatccgaaaccagcttcgataccgaaataaccttgtcaagcatgtgaagaaggacgaaaggaggtattacgaggagctgctgaagtatagtagagaccacctaatgttatatccataccacctgtctgatatcatggtcaagggtctgcggattaccccatttagctactacaccggcatcatggaggacattatgaattctgagaaaagctacgattcactccctaacttcacagctgccgattgtcttagattgttaggcataggtcgtaaccagtacatagacctcatgaatcagtgccgcagtagcaaaaagttttttaggcgcaagactgctcgcgacctcctccccattaagcccgtggagatcgcgattgaggcctggtgggtcgtgcaggctggttatattaccgaagacgacatcaagatatgtacccttcccgaaaagtgtgccgtggacaaaataatagactctggcccccagctgagcggatctctggactacaatgtggtccatagtctgtacaacaaaggtttcatctacctggacgttccaatctcggacgactcctgcattgctgttccccccctcgagggctttgtgatgaatcgcgtgcagggtgactactttgagactcttttatacaagatttttgtttccattgatgaacataccaatgtagccgagctggcgaacgttctggagatcgatttgtctcttgttaagaacgctgtgagtatgtactgtcggctggggtttgcccacaagaaggggcaagtgatcaacctggatcagctgcactcttcgtggaagaacgtcccttctgttaaccggctgaagtccaccttggatcctcagaagatgcttctctcctgggacggaggggagtcgcgaagtcctgtccaggaggcctcaagcgcgaccgataccgatactaattcccaggaggatcctgcagacacagcttctgtgtctagcctcagtttgagcacagggcatacaaaaagaatcgcctttctcttcgattcgacattgacggcatttctcatgatgggcaacttatcccccaaccttaagtctcatgctgtgaccatgtttgaagtagggaagctatcggacgagtcattggactcgtttctgattgagttggagaaggttcagagcacaggcgaaggtgaggcccagagatacttcgaccacgctttaaccctgcggaatactatactttttcttcgccacaacaaggatttggtggcgcaaactgcacagcctgatcagccaaactatgggttcccccttgatttgcttcggtgtgagtctctgctggggttagaccccgctacttgtagtcgggttctcaacaagaattacactctgctggtctcaatggccccactaaccaacgagatcaggccagtcagctcttgcactccccagcacataggccccgctattcccgaggtgagtagcgtgtggttcaaattatatatatatcacgtcacaggtcagggccccccgtcactcctgctcagtaagggaacccgccttagaaagctgcccgacatcttccagagctacgaccgattactgatcaccagctggggccacgatcccggcgtggtaccaactagcaatgtcctgacaatgctcaacgacgcccttacacactcagctgtgctaatccaagggcacgggttgcacggaattggggagacggtgcacgtccccttcccatttgatgaaacagagctccagggcgagttcactagggttaatatgggggtgcacaaggcactccagatcttgcgcaacagagtggatctacagcacttgtgtggttacgtgacaatgctgaatgcttctagccaactagcggacaggaagctatcagacgcaagcgatgaacgcggcgagcctgatctggctagcgggtctgacgtgaacggcagcaccgaaagctttgagatggtgatcgaggaagcaacaatcgattctgccacaaaacagaccagtggggctactactgaggctgattgggtgccgctagagttgtgctttgggattcctcttttctcgtcagagcttaaccgtaaggtgtgccgcaaaatcgccgcccacgggctgtgtcggaaagagtctctgcagaatctgctgcacagctcaagaaaattgagcttgcaggtcttgaattttgtccacagttttcaggagggcgcctcaattctggacatccacacggaacccagtttttcctccctgctcagccagagcagttgtgctgacatgggagtgcctttacccgcaaagaacctgatcttcaaagacggtgttctgtccgaatggtctggccggagtccttcttccctattgatcgccaatcttcatctgcagtag

SEQ ID NO: 47607 - DNA, 276 bp, Artificial Sequence
  Description of Artificial Sequence: Synthetic coding sequence
atgaacatcgacgtggagttccacatccggcacaactacccctggaacaaactgcccgccaacgtccggcaaagcttaggcaactcccagcgcgagtacgagaaacaggtggtcctgtactcaatccggaaccaactcaggtacaggaataacctggtgaagcacgtgaagaaagacgaacgacgctactatgaagagctgctgaaatatagccgggaccacctgatgctctatccctaccatctctcagattctgtatgctatgtatgtctgtag

SEQ ID NO: 47608 - DNA, 819 bp, Artificial Sequence
  Description of Artificial Sequence: Synthetic coding sequence
atgatgcggcggaccctggagaaccggaacgcccagaccaagcagctgcaaactgccgtgagtaacgttgaaaagcactttggggagttgtgccagatttttgcagcatacgttagaaaaaccgccaggctcagagacaaggccgatctgctagttaatgagattaacgcttatgctgcaactgagactccacacctcaaactcggactgatgaatttcgcggacgagtttgccaagcttcaggattaccgccaagctgaagttgagcggctcgaagcaaaggtggtggaacccctgaagacgtatgggacgattgtgaagatgaaacgggatgatttgaaagccactcttaccgcgaggaacagggaggcaaagcagctgacccagctggagcgcaccaggcaacgaaatccatcagaccggcacgttatcgcccaggcagagacagaattgcagcgagcggcaatggacgcaagtcggacatctagacatctagaagagactattaataacttcgaacgtcagaagatgaaagacattaaaacaatcttctccgagtttatcacaatcgagatgctgttccatggtaaagctcttgaggtgtataccgcggcgtaccagaacatccagaacatagacgaggatgaagacttagaggtgttccgtaatagcttatacgcaccagactattcctcccgactggatattgtccgcgctaattctaaatctccgttacagcggtcattaagcgcaaagtgcgtgtctggaacaggtcagcaggaagctggctgggcagcgacctgccagacactaatttag

SEQ ID NO: 47609 - DNA, 756 bp, Artificial Sequence
  Description of Artificial Sequence: Synthetic coding sequence
atgatgcggcggaccctggagaaccggaacgcccagaccaagcagctgcaaaccgcagtgtccaacgtagagaaacacttcggagaactttgtcaaatatttgccgcttatgtcagaaaaacagcaaggctgagggacaaagccgacttactagtgaacgaaatcaatgcgtacgcggcaaccgagactccccacttgaagctgggcctcatgaatttcgccgatgaatttgctaagctgcaggactacagacaggccgaggtggaacgcttggaagccaaggttgtggaacctctcaagacttacggaacaatcgtgaagatgaaacgggatgacttgaaagccacgttgacagcccgaaacagggaggccaagcagttaacacagctggagagaacacggcaaaggaacccaagcgatcgccacgtcattgcgcaagcggaaacagagttacagcgcgctgctatggatgcgtcccgtacatctcgccatctggaggaaacaatcaataactttgaaaggcagaagatgaaggatattaaggttttcaggaactcactgtatgctcccgattactcatctaggctggatatcgtgagggctaactccaagagtccccttcagagatccctcagcgccaagtgcgtcagcggcactggacaggtcagtacctgccgcctgaggaaggaccagcaggctgaagatgacgaggatgacgagttggatgttaccgaggaggaaaattttctaaaatag

SEQ ID NO: 47610 - DNA, 870 bp, Artificial Sequence
  Description of Artificial Sequence: Synthetic coding sequence
atgatgcggcggaccctggagaaccggaacgcccagaccaagcagctacagacagccgtgtccaacgtggaaaagcatttcggggaactgtgtcaaatcttcgccgcgtatgtaaggaaaacggcccggctacgcgacaaggcagatcttttagttaatgaaatcaacgcctatgccgctacagaaaccccccatctaaagcttggcctgatgaatttcgcagacgaattcgcaaagctccaggactatagacaagccgaggtagaaagactggaggctaaggtggtggaacccctgaagacttacggtacaatcgtgaagatgaaaagagacgatctcaaggccacactgactgcgcgcaatagagaggcaaaacaactgacgcagctggaacgtactcggcagaggaatccaagtgaccgccacgtcatatcacaggccgagaccgaactccagcgcgccgccatggacgccagtaggactagcagacacctggaggaaacgatcaataactttgaacggcagaaaatgaaggacatcaaaacaatcttctcagaattcataaccatagaaatgctttttcatggtaaagctcttgaggtgtacactgccgcctaccaaaatattcagaatattgatgaggacgaggacctcgaggtcttccgcaactctttatatgcacctgactacagttctcgactggatatcgtcagggctaatagcaaatcacccctgcagcggtcgttatctgcgaagtgcgtgagcggaacaggacaggtgagtacttgccggcttcggaaggaccagcaggccgaggacgacgaagatgacgagcttgatgttactgaggaggaaaactttctgaagtag

SEQ ID NO: 47611 - DNA, 789 bp, Artificial Sequence
  Description of Artificial Sequence: Synthetic coding sequence
atgatgcggcggaccctggagaaccggaacgcccagaccaagcagttacagacagcagtatcaaacgtcgaaaagcacttcggcgagctttgtcagatatttgctgcctacgtaagaaagacggcccgcctacgtgacaaggctgatctgctagtcaatgaaatcaacgcctacgccgctacggaaacccctcatttaaagttaggactcatgaactttgcagatgaatttgccaagctacaggattaccggcaggctgaggtggagaggctggaggccaaggttgtcgaacctctgaagacgtatggcaccatcgtcaagatgaaacgggatgatttgaaggctaccctcacagcaagaaaccgcgaggctaagcaactgacacagctcgaaagaacccggcagagaaacccttccgataggcacgtgattgcccaggccgagaccgagttgcaacgggccgcaatggacgcctctcggacatctcgccatctggaagagactatcaataacttcgagcgccagaaaatgaaagacattaagactatatttagtgagttcattactatcgagatgctcttccatggaaaagctcttgaagtttacaccgctgcatatcagaacattcagaacatcgacgaagatgaggatctggaacgctggtcctttgctatgttgccgagacttgtgttgaatagctggggctcctctgaccccccagccttagccagccagagcgtgaggttctctgaaatactctgtatgcatcaaatcattcatttagtctag

SEQ ID NO: 47612 - DNA, 309 bp, Artificial Sequence
  Description of Artificial Sequence: Synthetic coding sequence
atgcagcgggtgagcggcctgctgagctggaccctgagccgggtgctgtggctcagtggcctgtcagagcccggagctgctaggcagcccaggattatggaggagaaagccctggaggtgtacgatttaattagaacaattcgagaccccgaaaaacctaacactctggaggagttagaggtcgtgagcgaaagctgcgtcgaggtccaggagatcaacgaggaagaataccttgtcattatacggttcacccctaccgtcccccactgctccctggctaccctcatcgtgggcaatctccacttttag

SEQ ID NO: 47613 - DNA, 483 bp, Artificial Sequence
  Description of Artificial Sequence: Synthetic coding sequence
atgcagcgggtgagcggcctgctgagctggaccctgagccgggtgctgtggctgtctgggttgtctgagcccggcgcagccagacaaccacgaatcatggaggagaaggcactggaagtctacgatctgatccggactataagggaccccgaaaagcctaatactctcgaagagctggaggttgtgtctgaaagttgtgtggaggtgcaggagatcaatgaagaagaatacctcgtcatcatacggttcacgccaacagtgccacactgttctctcgctaccctaatcggcctctgccttagagtgaagctgcagagatgcctgccgttcaaacataagctcgaaatttatattagtgaaggaacccattcaacggaggaagatattaataagcaaattaatgataaggagcgggtggccgcagctatggagaatcctaaccttagggaaatcgtggaacagtgcgttctggagccagactag

SEQ ID NO: 47614 - DNA, 309 bp, Artificial Sequence
  Description of Artificial Sequence: Synthetic coding sequence
atgcagcgggtgagcggcctgctgagctggaccctgagccgggtgctgtggctcagtggactgtctgagccgggagctgcaaggcagccccggatcatggaggagaaggccttggaagtgtatgatttaattagaacgattcgggaccctgagaaaccgaatactcttgaggaactagaagtggtttcagaaagctgtgtggaggtccaagagattaatgaagaggagtacttggtgattatcagattcacccctactgtgccacattgctcactggccaccctgattgttggaaacctgcacttttag

SEQ ID NO: 47615 - DNA, 1557 bp, Artificial Sequence
  Description of Artificial Sequence: Synthetic coding sequence
atggagtgcgacctgatggagaccgacatcctggagagcctggaggacctggggtataaaggccccctactggaagacggcgcattaagccaggccgtctccgcaggcgcctcgtccccagagtttactaagctatgtgcttggctggtcagcgaactgagggtgctctgcaagctggaagaaaatgttcaggcaactaactccccctccgaagcggaggagtttcaactcgaggtttccggcctccttggcgaaatgaattgtccttatctgagccttacctccggtgacgtcaccaaacggcttttaatacaaaaaaactgcctgctactgctgacttacttgatatcagaactggaggccgctcgaatgttgtgcgtgaatgcccctccaaagaaagcccaggagggaggggggtcggaggtcttccaggagctgaagggcatttgtatcgccctggggatgagcaagcctcctgccaacattacgatgtttcagttttttagcggaatcgaaaagaagcttaaggaaactctagccaaggtgccgcccaaccatgtcgggaaacccctgctgaaaaaacctatggggccggcccattgggagaagatagaggctattaatcaggcaatcgctaatgagtacgaggtgaggagaaaactgttgattaaacgattggatgtgactgtgcagtccttcggctggagcgaccgagccaaatctcagacagagaaacttgccaaagtttaccaacccaaacgaagtgtgctgagcccaaaaaccaccatttcagttgctcatttactggcagctcgccaggatcttagtaagattctaaggacgagctccggttccattcgagaaaagaccgcctgtgccattaacaaggttctgatgggtcgcgtgcctgacagggggggccgcccaaacgagattgaaccgcctccccccgagatgcccccctggcagaagcggcaggacggcccccaacagcagaccggcgggagaggcggaggtcggggcgggtatgagcactcatcctatggagggagaggaggccatgagcagggaggtgggcgaggaggtcggggaggatacgatcacggcggacggggcggcggccgcgggaataaacatcaaggaggctggactgacggtgggtctggaggtggtggcgggtaccaggacggtggctatcgcgacagtggattccagcccgggggctatcacggcggccatagtagcggagggtatcaaggcggaggttacgggggattccagaccagttcaagctacacgggatccgggtaccagggaggcgggtaccagcaggacaacagatatcaggatggaggacatcatggagatcgaggggggggccggggaggacgagggggccgggggggccggggaggaagagccggccaagggggtggatggggcgggcgggggtcccagaattaccaccagggcgggcaattcgagcagcacttccagcacggggggtaccaatacaatcactctggttttggccaggggagacactacacctcttag

SEQ ID NO: 47616 - DNA, 1560 bp, Artificial Sequence
  Description of Artificial Sequence: Synthetic coding sequence
atggagtgcgacctgatggagaccgacatcctggagagcctggaggacctgggttacaaggggcctctccttgaagatggcgcattatctcaggctgtttctgccggcgcttccagtcccgaatttactaagttgtgcgcatggttggtgagcgaattgcgagtgttgtgtaaactggaggagaacgtccaggccaccaattcacccagtgaagcagaagaatttcaactcgaagtgtccggcctcctcggcgagatgaattgtccgtatctgtcactcaccagcggcgatgtaacaaagcgattgctgattcaaaagaactgtctgctgcttctgacgtacctcatctccgagctcgaagccgcaagaatgctctgtgtaaacgcgccccctaaaaaggctcaggaaggcggaggcagcgaagtgtttcaagaattgaagggaatttgtatcgcactgggcatgtcaaagcccccagcaaatatcaccatgttccagttcttcagcggaatagaaaagaagaagttgaaagagacgctcgctaaggtgccacctaatcatgtgggaaagccgctcttaaagaagccgatgggccctgctcactgggaaaagatcgaggcaattaaccaggctatcgctaatgaatatgaggtccgcaggaagttgctgatcaagaggttagacgtcactgtgcagagcttcggttggagcgatagagccaaaagccagacagagaagctcgctaaagtttatcagccgaaacggtctgttttatctcctaaaacaaccatcagcgtggctcacctcctcgcagctcgtcaggacctttccaaaatcctccggacctcctccggaagcatacgagaaaagactgcctgtgctataaacaaggtgctgatgggccgggtccccgatcgcggcggtcgtcccaatgaaattgagccccctcctcctgaaatgcccccctggcaaaaaaggcaggatggaccacaacagcagacggggggacgagggggtgggcgcggcggctatgaacactcttcttacggagggcggggaggacatgagcaggggggcggacgcgggggtcgcggggggtatgatcacggaggccggggagggggaagaggcaataaacatcagggaggctggacagatggcggcagcggaggtggcggcgggtatcaagatggtggctatcgcgactcaggtttccagccaggagggtatcacgggggacattctagtggaggttatcagggaggcggatacggcggtttccaaacgtcatccagctatacgggctcaggatatcaaggtggcggctatcaacaagacaaccgctatcaagacggaggacaccatggggataggggtggtggcaggggcgggaggggaggtcgagggggtcgcggtggtagagctggacaaggaggggggtgggggggcaggggatcccaaaactatcaccagggggggcaatttgaacagcacttccagcacggaggctaccaatacaatcactctggctttgggcagggccgacattataccagttag

SEQ ID NO: 47617 - DNA, 972 bp, Artificial Sequence
  Description of Artificial Sequence: Synthetic coding sequence
atgggccccgcccactgggagaagatcgaggccatcaaccaggccatagccaacgaatacgaggtacggagaaagctcctgataaagaggctggatgttaccgttcaaagtttcgggtggtccgatagagctaaatcgcagaccgagaagctggcaaaggtgtaccagcctaagaggtcagtactgtcacctaagacaaccattagtgtcgcacacttgctcgccgcgagacaggatctaagcaagatccttcgcactagcagcggaagtatccgcgagaaaactgcttgcgccatcaataaggttctaatgggccgcgttcccgaccgcggcggtcggcccaatgaaattgaacctccaccaccggaaatgcctccctggcagaagaggcaggatggacctcagcaacagacgggaggccgcgggggtggcagggggggctacgagcatagctcctatgggggacgcggcggccacgagcagggagggggtagaggcgggaggggcggctatgatcacggcggccgcggaggcggtcggggcaacaaacaccaagggggctggacagacgggggatccggcggaggcggcggctaccaggatggtggctatcgggattctggcttccagccgggcggctaccacggggggcactcaagcggcggatatcaggggggcggctatggggggtttcaaactagtagcagctataccggatccggctatcaaggaggcggttaccagcaggacaaccggtaccaagacggaggccaccacggcgaccgtggcgggggcagaggcggaaggggaggacgcggtggccgagggggtagggcagggcaggggggcggttggggcggacgtggctcacaaaattatcatcagggcggtcagttcgaacagcactttcagcacgggggctaccagtacaatcattcagggttcgggcagggaaggcattacacctcttag

SEQ ID NO: 47618 - DNA, 1302 bp, Artificial Sequence
  Description of Artificial Sequence: Synthetic coding sequence
atgcggggccccgagcccggcccccagcccaccatggagggcgacgtgctggacaccctggaggccctaggctataagggacccctgctggaagagcaggcgctgacaaaggccgccgaggggggcctgagcagccctgagttttccgaattatgtatatggttgggtagccagatcaagtcattatgcaatctggaagaatccatcacaagcgctggaagagatgacctggagagttttcaactggagatatccggatttcttaaagaaatggcatgtccgtatagcgtgctgatatccggagatattaaggacaggctgaagaaaaaagaagattgcctcaaactgctgttgtttttgtcaacagaactccaagccagccagatattgcaaaataaaaaacacaaaaattcccagctggacaaaaattccgaagtgtatcaggaagtccaggctatgttcgacacactgggcatcccaaaaagcacaacaagtgacattcctcacatgctgaaccaagtcgaatcaaaggtgaaagacattctgagcaaggtgcagaaaaaccacgtgggcaaacctctgttaaaaatggacctgaacagcgagcaggcagaacaattagaacggattaacgatgcactgagctgcgaatatgagtgccgtagaagaatgctgatgaaacgactagacgtaactgttcagagctttggatggtctgatcgggcaaaggtcaaaaccgatgacattgctcgaatataccagcctaagagatacgctctttctcctaagaccactattaccatggcacacttgttagccgcccgggaagacctgtccaaaatcatccgtaccagctctggaacgagccgggagaagacagcatgtgctattaataaggtgttaatgggccgcgtaccggaccgaggcggcagaccaaatgaaattgagcccccacccccagaaatgccaccttggcagaagcgacaagaaggaggagggggtcgagggggttggggcggtggcgggggcggaggggggcgcgggggcggggggggggggggaggtcgcggcgggtggggggggggcggagggggctggggaggcggggggggtggaggcggaggctggggagggggaggcggcggcgggcgggggggtttccaaggtagaggagactacggcggcagaggaggatacggcgggagggggggatatggcggacgcggatacggggacccgtacggcggcggaggaggggggggcggggggggcggcggggggggaggataccgacgctattag

SEQ ID NO: 47619 - DNA, 993 bp, Artificial Sequence
  Description of Artificial Sequence: Synthetic coding sequence
atgcggggccccgagcccggcccccagcccaccatggagggcgacgtcctggataccttggaggccctagggtacaaaggccctttgctagaagaacaggctctgactaaagcagcagaaggaggcctgagcagtcccgaattcagcgaactgtgcatttggctcggaagccagattaaatctctctgtaatctcgaagagtcgatcacctctgcgggcagagacgatctcgagtcatttcagttggaaatatccggatttttgaaggaaatggcctgtccctacagtgtgctaatcagcggtgacattaaagacagactcaagaagaaagaggactgtctgaagctgttgcttttcctgtccacagagctgcaagcgagtcagattttacagaataagaaacacaagaatagccagctggacaagaacagtgaggtttaccaggaggtgcaggccatgtttgacacgctgggcattccaaaatctacgacttcggatatcccacacatgctcaatcaggtcgagtccaaagtcaaagatatcttgtcgaaggtccagaagaaccacgttgggaagccccttttaaaaatggacctcaatagcgagcaggctgagcagctggaacgcatcaatgacgccctgagctgcgaatacgagtgtcggaggcgtatgctgatgaagcgcctcgatgtaaccgtccagtcgttcggatggtcagatcgggccaaagtcaagacagatgacatcgctcgaatttaccaacccaaaagatacgctcttagccctaagaccacaataacgatggcacacttgctggccgctagggaggatctctcgaagatcataaggaccagttcaggtacatctagggagaagaccgcatgtgccatcaacaaggttggagtgtctttttcaaccgtggagaatgaattaatgatatcgtacctgatgtttcttcaaatcctggtctatttttcttttatgagttggtag

SEQ ID NO: 47620 - DNA, 549 bp, Artificial Sequence
  Description of Artificial Sequence: Synthetic coding sequence
atgatgcaggagagccccgaccccgaggacgacgagacccccacccagtcggacaggctgtctatgctttcccaggaaatccaaacactgaagaggtctagcaccggatcctacgaggagagggttaagcgactgtccgtgtctgaacttaatgagatcttggaggaaattgagaccgcgataaaggagtactccgaagagctcgttcaacaactggctctgcgggatgagctcgaatttgagaaagaggtgaagaatagctttattagcgtgcttattgaggttcaaaataagcagaaagagcacaaggagacggccaagaagaagaagaaacttaaaaatggaagcagccagaacggcaagaatgaacgttctcatatgcctggcacctatctcacaaccgtgatcccatacgagaaaaaaaacggtcctccttccgtcgaagatttacagatacttacaaagatcctccgtgctatgaaggaggactctgaaaaagtgccatctctcctcacagactatatcctgaaggttttgtgccctacttag

SEQ ID NO: 47621 - DNA, 1062 bp, Artificial Sequence
  Description of Artificial Sequence: Synthetic coding sequence
atggccgccgacggcgactggcaggacttctacgagttccaggagccggcccgaagtttattggaccaggagaactgcaacgcatctccagagcctggcgccgaagcgggcgcagaggctggcggaggggcagacggatttcccgcccccgcttgttctctcgaggagaagctctccctttgcttccggccgtctgatcccggggccgaacccccaagaacagcggtgcgaccaattactgaacggagtttgctccagggagatgaaatctggaatgccctgacagacaattacggaaacgtcatgccggtcgattggaagagctcccatacccgcaccctacacctgctcaccctgaatctcagcgaaaaaggtgtttccgactccctgctgtttgatactagcgacgatgaggagctgagagagcagctggacatgcattctatcatcgtgagctgcgtgaatgatgagcccctgtttacagccgatcaggtgatcgaggagattgaggagatgatgcaggagtccccggatcctgaggacgatgaaacgccaactcagtccgaccggttgagcatgttgagccaggagatccaaacacttaagaggtcaagtacaggctcatacgaggaaagggtgaagcggctgtccgtctcagagctgaatgaaattctggaagagatcgaaacagctatcaaagagtatagcgaggaactcgtacagcagctcgcacttcgagatgagctggagtttgaaaaggaagttaaaaactcatttatcagtgtccttattgaggtgcagaataagcagaaggagcataaagagacagccaaaaaaaaaaaaaaattgaagaatgggtcctcacaaaatggtaaaaatgaaaggtcccatatgcctggtacatatctaactacagttattccttacgagaagaaaaatggcccgccctccgtcgaagatcttcagatactcacaaaaattctgcgtgcaatgaaagaggactctgaaaaagttcccagccttctgaccgactacatccttaaggtgctctgccccacctag

SEQ ID NO: 47622 - DNA, 1143 bp, Artificial Sequence
  Description of Artificial Sequence: Synthetic coding sequence
atggccgccgacggcgactggcaggacttctacgagttccaggagcctgcaagatctctgctagaccaggagaattgcaatgcaagtcccgaacccggggcagaagctggcgccgaagcagggggcggtgccgacggattccctgctcctgcctgcagccttgaggagaaattgtccctctgcttccggccttctgacccaggagccgaacctccacgaaccgccgtccggcccatcacggagcgtagtctgttgcagggcgacgagatctggaacgccttaaccgataattacggaaacgtgatgcccgttgactggaaaagtagccacactcgtaccctacatctgcttacactgaatctcagcgaaaagggcgtatccgattccctcctgtttgatacaagcgatgacgaggaattacgagagcagcttgatatgcactctattattgttagctgtgtcaacgacgaaccactattcacggccgatcaggtcatcgaagaaatagaggaaatgatgcaggaaagtcctgatcccgaagatgatgaaacaccaacacaatcagataggctgtctatgctgagccaggagattcagacactgaagagaagctctacagggagttacgaagagagagtgaagcgactgagtgtgagcgagttaaacgagattctagaggagatagaaaccgctataaaagaatactcagaggagctggtgcagcagcttgcgctccgagatgagttagaattcgaaaaggaggttaaaaactcttttatctccgtgttgatcgaggtgcagaacaagcagaaggagcacaaggaaacagctaaaaagaagaaaaaactcaaaaacggcagtagccaaaatggcaagaatgaaaggtctcacatgcctggaactagattttccatggagggaattagtaatgtgatccagaatgggctcagacataccttcggcaacagcggcggagagaagcaatacttaaccacagtgatcccttacgagaaaaagaatgggccaccctcggttgaagatcttcagatacttaccaagattctgagagcaatgaaggaggactctgagaaggtgcctagtctgttgaccgattatattctgaaggtcttatgtccaacttag

SEQ ID NO: 47623 - DNA, 423 bp, Artificial Sequence
  Description of Artificial Sequence: Synthetic coding sequence
atgatcgaccagctgcagggcacctggaagagcatcagctgcgagaactctgaggactacatgaaggaactcgggattggcagagcctcccgaaagcttgggaggctagcgaagcctaccgtcacgatctccaccgatggcgacgtgattacaattaaaacaaagtcaatcttcaagaacaatgagatcagcttcaagctcggggaagagttcgaagagattacacccggcggacataaaactaaatccaaggttaccttggataaagagtctttaatacaggttcaggattgggatggcaaggaaaccaccattactcggaagctcgtagacgggaagatggtcgtggagagtactgtcaactccgtcatttgcaccaggacatacgaaaaagtgtcgagcaatagcgtgtctaattcttag

SEQ ID NO: 47624 - DNA, 2208 bp, Artificial Sequence
  Description of Artificial Sequence: Synthetic coding sequence
atgacccccgagctgatgatcaaggcctgcagcttctacaccggccacctcgtaaagacgcacttctgcacatggagggacattgctcggacaaatgagaatgtagtgctggctgagaagatgaaccgggcggtgacttgctataattttcgcctgcagaagtccgtttttcaccactggcactcgtacatggaggaccagaaagaaaaacttaagaacatcctgttaagaatccagcagataatctactgccacaagctgactatcatccttaccaagtggagaaacactgctcgccacaaaagtaaaaagaaggaggatgagctgatcctgaagcatgaactgcagctgaaaaaatggaagaataggctgattcttaagagagctgctgccgaagaatctaatttccccgaaagatcctcatccgaggtgttcttagtggacgagactcttaaatgcgacatcagtttacttccagaacgcgccattttgcaaatcttcttttacctctcgctgaaagatgtaattatttgcggccaagttaaccatgcatggatgctgatgactcagctcaactccctctggaacgcgatagacttttcttcagtgaagaatgtcatcccggataagtatatcgtcagcacacttcagcgctggaggctaaacgtgctaaggctgaacttcaggggatgcctcttaagaccaaagacttttaggagcgtgtcacattgtaggaacttacaagaattgaatgttagcgattgtccaaccttcacggatgagagcatgcgacacatttctgaggggtgcccgggagtcctgtgtctcaatctatccaatacaactatcaccaatcgcacaatgcgtctgctgcctcgacactttcacaatctgcagaacctctctctggcctactgccgacggttcacagataaagggttacaatacttgaatcttgggaatggatgccataaactgatatatctcgatctctcgggatgtacacagatctctgttcaggggttcaggtatattgctaactcttgcaccgggatcatgcatctgacaattaatgatatgcccaccctgaccgataattgtgtcaaggcactcgttgagaagtgttcaaggattaccagcctggtatttaccggcgcaccacatataagtgattgtacctttagggccctatccgcatgcaagttacgcaaaatacgcttcgaagggaacaagcgagtcacagatgcttcttttaaattcattgataagaattaccccaatcttagtcatatctatatggcagattgcaagggcatcacagatagctcactgcgttcgctgtccccactaaaacaactaacagttctgaacctcgcaaactgtgtgagaatcggagacatgggcctcaagcagtttttggacggtcccgcgtctatgagaatccgggagttgaatctgtccaactgcgtccgtttgtctgatgccagtgttatgaagttaagtgagagatgtcccaacctcaattacctctctctgaggaattgcgaacatttgaccgcccaggggattgggtacattgtcaacattttctccttggtgagcattgacttgtccggaaccgacatttctaacgagggacttaatgtattgagccggcacaaaaaactcaaggaactgagtgtgagcgagtgctaccgcattacggacgacggaattcaggccttctgtaagtcttccctcatactcgaacatcttgacgtctcctactgctctcaactgtctgacatgatcatcaaggcgctagcaatctactgcatcaacctcacgagtctgtccatcgccgggtgccccaagattactgatagcgctatggagatgctgagcgctaagtgccactatttgcacattctggacatatcaggctgcgtcttattgaccgaccagatcctggaggatttacaaatcggctgtaaacaacttcgaatccttaaaatgcaatactgcactaacataagtaagaaggccgctcagcggatgagttctaaagtgcaacagcaggaatacaacacaaacgatccaccaagatggttcggctacgatagggaaggaaatcctgtcaccgaactggataatataacatctagcaaaggggctctggaactgacggtgaagaaaagtacttactcaagtgaagaccaggccgcctag

SEQ ID NO: 47625 - DNA, 1371 bp, Artificial Sequence
  Description of Artificial Sequence: Synthetic coding sequence
atcctgctgcggatccagcagatcatctactgccacaagctgaccatcatcctgactaagtggagaaacacggccagacataagtccaaaaagaaagaagatgagctgatcctgaagcacgaacttcagctgaagaagtggaaaaacagactcattctgaagagggctgccgccgaggaatccaacttccctgaacgctctagtagtgaggtgtttctggttgacgaaactctaaagtgcgatataagtcttcttcccgagagggcaatcctgcagatcttcttctacctgtctctgaaggacgttattatttgcggccaagtgaaccacgcgtggatgctgatgacccaactgaattctctctggaatgcaattgacttttctagtgttaaaaatgttatacctgataagtatatcgtcagtacactgcagcgatggcggctgaacgtcctgcgcttgaactttaggggatgcctgctcaggccaaagacgttccgcagcctcagccctctgaagcagctaactgttcttaatctggcaaattgcgtacgcattggggatatggggctgaaacagttcctggatggacccgctagcatgcgcatccgtgagctaaacttatcgaactgcgttcggctgtcagatgcatctgtcatgaagctgtccgagcgctgcccaaatctgaattatctgagcctgcgcaactgcgagcaccttaccgcgcagggcattggatacattgtgaacatcttcagcctcgtgagcatcgacctgagtggcaccgatataagcaatgaagggctgaacgttctgtcacgacacaagaaattgaaggagctttccgtctcagagtgctaccggatcacggacgatggtatacaggctttctgcaagtcttcattgattctcgagcatctcgatgtgtcctactgctcgcagctgtctgacatgatcattaaggcattagccatatattgtatcaatctgacgtcactgagcatagcaggatgtccaaaaataactgactctgccatggagatgctctccgctaaatgccattacctacacatcttagacatttctgggtgtgtgttgctgacagaccaaattttggaggacctgcaaattggatgtaagcagttaagaatcctcaaaatgcagtattgtacgaacatttccaagaaggccgcccagaggatgagctcaaaagtccagcagcaagagtataacaccaatgaccccccacgttggtttggctatgatcgggagggaaaccctgtgacagagttggataatattacctcatccaagggggctctggagctgaccgttaaaaagtcaacgtactcttcagaggaccaggcagcatag

SEQ ID NO: 47626 - DNA, 2124 bp, Artificial Sequence
  Description of Artificial Sequence: Synthetic coding sequence
atgacccccgagctgatgatcaaggcctgcagcttctacaccggccacctggtcaaaacgcacttttgcacatggcgggacatcgcacggacaaatgagaatgtcgtccttgccgagaagatgaaccgcgcagtcacctgctataacttccggctccagaaatctgtattccaccattggcacagctacatggaagaccagaaggagaagctgaagaacatcttactgcgtatccagcagatcatctattgtcacaaattaaccatcatcttgactaagtggcggaatactgcgcggcacaaatccaaaaagaaggaagatgagttgatactgaagcatgaacttcaactgaagaagtggaagaatcgcctgatcttaaaacgggctgcggcagaagagtctaattttcccgagcggtcatcctctgaagtcttcttagttgacgaaacccttaaatgtgacattagtctcctgccggaacgcgcgattttgcagatatttttctacttgagcctaaaggatgtgataatctgcggtcaagttaaccatgcttggatgctcatgactcagctcaacagcttgtggaatgccatagactttagctccgtgaagaatgttattccggacaagtatatagtctccacccttcaacggtggcgtctgaatgtgttgcgcctgaattttcgcggttgcctgctccgacctaaaactttcaggagtgtgtctcattgccggaacctccaggagctgaacgtgtctgattgtcctacattcacagacgagtcaatgagacatatctccgagggttgtcccggagtgctctgcctcaacctctccaacacaacaattaccaacaggaccatgcggctgctgccacggcacttccataacttacaaaacctgagccttgcttactgtaggcgctttacagacaagggccttcagtatctgaacctggggaacggctgccataaattgatctatctcgacctgagcggttgtacacagatcagcgtgcagggcttccggtatattgcaaatagctgcactggtattatgcatctgaccattaacgatatgcctactctaactgacaattgcgtcaaggcattggttgaaaaatgttcccgaatcaccagtttagtgttcacaggtgccccccacatctctgactgcacctttcgagccctctcagcttgtaagttgcgtaagatcagatttgagggaaataaacgtgttaccgatgcctcctttaagtttattgataaaaattatccgaacctgagccatatctacatggccgattgcaaggggataaccgactccagcttgcgctccctttctcccctaaagcagctcacggttctcaacctagccaattgcgtaaggattggagacatggggctgaagcaattcctagacggtccagccagtatgaggatccgcgagctgaacttgtccaactgtgtgcgactgtcagacgcttccgtcatgaagctgtcagaacgctgccctaatctaaactatctgagccttcgcaactgtgaacacctgactgcccaggggatcgggtatattgtcaacatcttcagcctcgtgtctatagacctgagcgggacagatatcagcaacgaagcattttgcaagtcttcgttgatcctcgagcacctggatgtgagttactgctctcagctgtccgatatgattattaaagccctagccatctattgtatcaatctcacatcactcagcattgccgggtgccccaagattaccgatagtgccatggagatgctgtctgccaaatgtcactacttgcacatactagatatctctggctgtgttctgcttacagaccaaatcctcgaggatttacaaatcggatgcaaacaactccggatccttaagatgcagtattgcactaatatctcaaaaaaagccgcacaaaggatgtcctccaaggtacagcagcaggaatataacaccaacgatccaccccggtggtttggttatgaccgtgaagggaatcctgttactgagctggacaacattacaagttccaagggagctctcgaattgacagtcaaaaagtctacctatagctccgaggatcaagcagcatag

SEQ ID NO: 47627 - DNA, 1362 bp, Artificial Sequence
  Description of Artificial Sequence: Synthetic coding sequence
atgacccccgagctgatgatcaaggcctgcagcttctacaccggccacctcgtgaagacccatttttgtacctggcgcgatatagcccgtactaatgaaaacgtcgtcctggctgaaaaaatgaacagggcagttacctgctacaattttaggctacagaagagtgttttccaccattggcatagctacatggaagatcagaaagagaaactaaagaacattcttctgcgaatccagcagatcatatactgccacaaactaacgatcatcctgacaaaatggaggaatacagctagacacaagtcaaaaaaaaaagaagatgagcttatcctaaaacatgaacttcagctcaaaaagtggaagaaccgactgatcctcaagcgcgcggctgctgaagagtccaattttccagaacggtccagctcagaggtgtttctcgtggatgagacactgaagtgtgacatttccctcctgccggagcgagcgattctccagatcttcttttacctgagcctcaaagacgtaatcatctgcggtcaggtcaaccatgcttggatgctgatgacccagttgaactccctctggaatgcaattgattttagtagcgtgaagaatgtgattcctgacaaatatattgtgtccactctgcagcgctggcgtctgaatgttctgcgactgaacttcagaggctgtctgctcagaccaaaaactttcaggtccgtctcccactgcaggaatttgcaggagctcaacgtgtctgattgcccaacgtttactgatgagtcaatgcgccatatctccgaaggctgccccggggtgctctgtctgaatctaagcaataccaccatcacgaacagaactatgaggctcctgccacgtcatttccacaacctacagaacttaagcctggcatattgcagaaggttcactgataaaggtttgcagtaccttaatttaggcaatggatgccacaagctaatctacctcgacttatctggctgcacccaaatcaccgactcggcaatggagatgctgtctgccaagtgccactatctccatatactcgatattagtggctgtgtgcttctgacagaccagattctggaggacctccagattggatgcaagcagctgcggattctcaagatgcagtattgcacaaacatttctaaaaaggcagcccagcggatgtcatcaaaggtgcagcagcaggagtacaatacaaacgaccctcccaggtggtttggctatgaccgggagggaaatcctgtgactgaacttgacaatattacgtccagcaaaggtgccctagagcttaccgtgaagaaatccacttattcatcggaggatcaagccgcttag

SEQ ID NO: 47628 - DNA, 2073 bp, Artificial Sequence
  Description of Artificial Sequence: Synthetic coding sequence
atgacccccgagctgatgatcaaggcctgcagcttctacaccggccacttggtgaaaactcacttctgcacctggcgggatattgccaggacgaacgaaaacgtggtgttggccgaaaagatgaacagagcggtcacctgctataacttcagattgcaaaagagtgttttccaccactggcatagctacatggaggaccaaaaggaaaagctgaagaatatactcctgagaattcagcagatcatctattgccacaagctcaccataattctgacaaagtggagaaacaccgcccggcacaagagtaagaaaaaggaagacgaattaatactgaaacatgaacttcagctgaaaaagtggaaaaatcggctgatcctcaagcgagcagctgctgaggaaagcaatttccccgaaaggtcctcctctgaggtcttcctcgtcgatgagacactcaagtgtgatatcagcctgcttcccgaacgagctatcttacagatcttcttttatctgagtttgaaggatgtcatcatatgcgggcaggtcaatcacgcgtggatgcttatgacccaactaaatagcctctggaacgccatcgacttctctagcgtaaagaacgtaatccctgacaagtacatcgtgagcacactgcaacgatggagacttaatgtactcaggctcaacttccggggttgcctgttgcggccaaagacgtttagatctgtctcccactgcaggaacctccaggagcttaatgtgtccgactgtcccaccttcaccgatgagtccatgaggcacatttcagagggatgccctggggtgctgtgcctgaatctgtccaacaccactattaccaaccggacgatgaggttgctgccgagacacttccataacctacagaacttaagcctggcctactgccgcagatttaccgataagggcttgcagtacttgaacttaggaaatggatgtcataagcttatttacctagacctgtctggttgtacccagattagtgtccaaggctttcggtacattgccaatagctgcactggcattatgcatctcaccatcaacgacatgcccactttgactgacaactgtgtaaaggccctggtcgagaaatgttctaggatcactagtctggtctttaccggcgcaccacacatatcggattgtacctttagagctctatcggcatgcaagttgcgaaagattcggttcgagggtaataagcgcgtgactgatgcttccttcaaattcatagacaaaaactaccctaacctgagtcatatttatatggccgactgcaagggcattaccgattcctctctgcggagtttgtcaccacttaaacaactgacagttctgaatctggctaactgtgtgaggatcggggatatggggctaaagcaattccttgacgggcccgccagtatgcggatacgtgaactcaacctctctaattgcgtgaggctgtctgacgcaagtgtgatgaagttgtctgagcggtgtccaaatctgaattatctaagcctgcgcaactgcgaacacctgacagctcagggcattggatacatcgtaaatatatttagcttggtgagtattgatctcagcggcacagacatctctaatgagggtctgaacgtcttgtcacgtcacaagaagctgaaagagctgagcgtgtcagagtgttacaggatcacagatgacggcatccagatcacagattcggccatggagatgctcagtgccaaatgtcattacctccacattctggatatctctggatgtgtgctgttaaccgatcagatcctggaggaccttcagataggctgtaaacagctacgtattctaaaaatgcagtactgcaccaacatttccaagaaagctgctcagaggatgtccagcaaagttcagcagcaagaatataatacaaacgaccctccacgttggttcggctatgatcgagaagggaacccagtgaccgagcttgacaacataacgtcatccaagggagccttggaactgacggtcaagaaatccacatacagcagtgaggaccaggctgcgtag

SEQ ID NO: 47629 - DNA, 2124 bp, Artificial Sequence
  Description of Artificial Sequence: Synthetic coding sequence
atgacccccgagctgatgatcaaggcctgcagcttctacaccggccatcttgttaagacccacttctgtacttggcgggatatcgctagaactaatgaaaatgtcgtgctggctgagaagatgaacagagcagttacttgctataatttcaggctgcagaagtctgtgtttcatcactggcacagctacatggaagatcagaaggaaaaactgaaaaacatactgctccggatacagcagataatttactgtcataaacttacaatcatcctaaccaagtggcgcaatacagctcgacataagagtaaaaagaaagaggacgagctgatcctcaaacacgagctccagctgaagaaatggaagaaccgactgatcctcaagagagccgccgcggaggagtccaattttcctgaaagatcctctagtgaagtgttcctggtggacgaaacactgaagtgcgacatatctctgctgccggagcgcgctatactgcagattttcttttatttaagcttgaaggatgtcattatctgcggtcaggttaatcacgcatggatgctcatgactcaacttaattcgttgtggaatgccatcgacttcagctccgtcaaaaatgtgattcctgataagtatatcgtttccacactgcagagatggaggctcaatgttctgcgactgaacttcagagggtgtttgctgcgcccaaaaaccttccgaagcgtaagccactgtcgaaaccttcaggagctgaacgtctctgactgcccaaccttcactgatgaatccatgcgccacatctccgagggttgcccaggcgtcctgtgcttaaatctcagcaatactactattactaatagaacgatgcggttactcccacgtcacttccataatctccagaacctgtctcttgcttactgccgccggttcaccgacaaaggactgcaatatctgaatcttggaaacggctgtcataagctcatttacctcgatttgagcgggtgcacccaaatctcagtccaaggcttcagatatatagctaattcctgcacgggcattatgcatttgacgataaacgacatgcccaccttgacagataattgtgtcaaagctttggtcgagaaatgctcaagaattacatctttggtcttcacaggcgcaccgcatatttcagactgcaccttccgcgcactgtcagcctgcaagttgcgcaagatccgttttgagggaaacaagagagttaccgacgcctctttcaaatttatcgacaagaattacccaaacctctcccatatctatatggccgactgcaagggtatcacagacagttctctgagaagtctgtcaccgctcaaacagctgacagttttgaacctggcaaactgcgtgcgcattggcgatatgggcttgaagcagtttcttgacggccctgcctctatgcgcatcagggagttgaatttgtccaactgtgtgcgactgagtgatgcaagcgtcatgaagctgagcgagagatgcccaaacctgaattatcttagtctccggaactgcgagcacctcacggcgcagggcatcggatatattgtaaacatcttctctctggtgtccattgatctgtccggtactgatatctccaatgaggctttctgcaaatcttccctcatcctggagcatctcgacgtctcgtattgtagccagttgtcggacatgatcattaaggcgctagccatttactgcattaacctgacctctctctctattgctgggtgtccaaagatcaccgactccgcaatggagatgctctcagccaagtgccactacctgcatatcctggacatttccggctgtgtccttctgaccgatcagatcctggaggatctgcagatcggatgcaagcagctgcgcatcctgaagatgcagtactgcaccaatatctccaaaaaggctgcccaacgaatgtcatccaaggtgcaacagcaggagtacaataccaatgatcccccaagatggtttggctacgatagagagggcaaccctgtgaccgagttagacaatatcacttcctctaagggtgccttggagttgactgtgaagaagtccacttacagcagcgaggatcaagctgcctag

SEQ ID NO: 47630 - DNA, 2208 bp, Artificial Sequence
  Description of Artificial Sequence: Synthetic coding sequence
atgacccccgagctgatgatcaaggcctgcagcttctacaccggccacctagtaaaaacccacttctgtacatggcgcgacatagctaggacgaatgaaaacgtggtccttgccgagaaaatgaatagggccgtcacctgttacaactttcggctccagaagagtgtctttcatcactggcactcctatatggaagaccagaaggagaagctcaagaatatactacttcgaattcagcagataatttattgccataaactgacaattatcctgaccaagtggcgcaacacagcgcgacacaagtctaaaaaaaaggaagacgagctgatactgaagcatgagttgcagctgaagaaatggaagaaccgcctcattctcaagagagcagctgcggaggagtctaattttccagagcgatcatcgtctgaggtctttttggtggacgaaaccttgaaatgtgacattagcctgctgcccgagagggctatcctgcagatctttttttatttgtccctcaaggacgtgattatttgtggacaggtgaatcatgcatggatgctcatgacccagcttaattctctttggaacgccattgacttcagctctgtcaagaatgtcataccagacaagtacattgtgagcaccttacagcggtggcgtctgaacgttctgagacttaactttcgcggatgtctgttgcgccccaaaacatttagatccgtttcccattgtcggaacttgcaggaactaaatgtgtcagattgcccaacattcaccgatgagtctatgaggcatatttccgagggctgcccgggggtgctgtgcctgaacctaagcaataccaccattaccaaccgaacaatgagactcctgcctcggcatttccataatctgcaaaatctgtccctggcatactgccgtaggtttaccgataaaggcttgcagtatttaaatctggggaacgggtgccacaagctgatctaccttgaccttagcggctgtacgcaaatctcggtgcaaggctttcggtatatcgcaaactcctgcacggggataatgcacctaacaattaacgatatgcccacccttacagataactgcgtgaaggccctggtggaaaagtgctccaggatcacatcattggtcttcaccggcgctccacacatcagcgactgtacttttagggcactgagcgcttgtaaactacgaaaaatacgcttcgaaggtaacaagcgagttactgatgccagctttaaattcattgataaaaattatcccaatctgagccacatctacatggcagattgtaagggaatcacagactcctccctcagatccttgtcgcctctgaaacagttgaccgtgctaaacctggctaactgcgtccgaataggggatatgggccttaaacagtttttggatggtccagcatccatgcggatcagggagctgaacctctctaattgcgtccggctgagtgatgcaagcgtgatgaagctgagcgagcgctgtccgaacttgaactatctgtccctgcgaaactgcgagcacctgaccgctcaaggaattggatacattgtcaatatcttctcactcgtctccattgatctgtcgggtacagatatcagcaatgaaggcttaaatgtgctcagtcgccacaaaaagctcaaggaactttccgtatctgagtgctatagaattacagacgatgggattcaggctttttgcaaatcttcactgatcttagagcatctagatgtgtcgtactgtagccagctcagtgatatgatcataaaagccttggctatttactgcattaatctaacatctctgtcaattgccgggtgtccgaagatcaccgacagcgccatggaaatgctgtcagccaagtgccattacttacacattctggatattagcggctgcgttcttttgacagaccagatcctcgaagacctccagattggctgtaaacagttgcgcattctgaaaatgcagtactgcactaacattagcaaaaaagccgcacagagaatgtcatcaaaagtgcagcaacaagaatataacacaaacgaccctccaaggtggtttgggtatgatcgggaaggtaacccggtcacagagctggataatatcacaagctcaaagggtgctctggaactaacagtcaagaaaagcacctattccagtgaagaccaggcagcctag

SEQ ID NO: 47631 - DNA, 2073 bp, Artificial Sequence
  Description of Artificial Sequence: Synthetic coding sequence
atgacccccgagctgatgatcaaggcctgcagcttctacaccggccaccttgtgaaaactcacttttgcacttggagagacatcgcccgcactaatgagaatgtcgtgctagcagagaagatgaatcgggctgttacgtgttacaacttccgacttcagaagtctgtgttccaccactggcattcttatatggaagatcagaaggagaagctgaagaacatcctcttaaggattcagcagatcatctactgccataaactaactatcatcctgacaaaatggcgtaatacagcaaggcataagtctaaaaaaaaagaggacgaactcatactgaagcacgaattgcaactcaagaaatggaaaaatcgtctgatcttgaaaagggcggcggccgaggagagcaacttccccgaacgttcatcctcagaagtctttctcgtcgacgaaacgttaaaatgcgacattagcttgctgcctgagcgcgcaatcttgcaaattttcttttatctctctttaaaggatgtgatcatttgcggccaggtaaatcacgcgtggatgctgatgacccagttgaattcattatggaatgcgatagacttctcctcagtgaaaaacgtcatccccgataaatacattgtctccacattacagagatggagattgaacgtgttgcgcctcaacttcaggggatgtctgcttcgcccaaagaccttcaggagtgtttcacattgtaggaaccttcaggagttaaacgtgagcgattgccccactttcaccgatgagtccatgcgacacatttccgaaggatgtccgggggtgctatgtctgaacttgagcaacaccactataacaaacagaacaatgaggctgctcccaaggcactttcataacctccagaatctgagccttgcttattgccgcagatttacagacaagggcctgcagtacctgaacttgggcaacggatgtcataagttgatttacctggacctaagcggctgtactcaaatctccgttcaaggatttcggtatatcgccaactcctgtacaggaattatgcacctgaccataaacgatatgcccacactgaccgataattgtgtgaaggctcttgtggaaaaatgctcgaggataaccagcttagtgtttacgggggctcctcatataagcgactgtacctttcgtgccctgtctgcttgtaaactccgaaaaatccgctttgagggcaataaacgagtgaccgatgcgagcttcaaattcatcgacaaaaactacccaaacctatctcacatctatatggcggattgtaaaggaatcacagactcatctctcaggtcactgtctccactgaagcagctgaccgttctgaacctagccaattgtgtacggatcggggacatgggccttaagcagttccttgatgggcctgcttctatgcggatacgcgagcttaatcttagtaactgcgtccgcttgtccgacgcaagtgtaatgaaactttccgagcgttgcccaaacttaaactacctgtcgctgcggaattgcgaacatctgacagctcagggaatcggatacattgtcaatatttttagtctggtcagcatcgacctgagtggcactgacataagcaatgagggtctgaacgtactgtctcgacataaaaaactgaaagaactgtcagtgtcagaatgctaccggatcacagacgatgggattcagatcacggactccgctatggaaatgttatcagctaaatgtcattacttacatattctggacatctccggttgcgtgctgttaacagaccagattttggaggatttgcagatcgggtgcaagcaactgagaatcttgaagatgcaatactgcaccaatatttctaagaaggcggctcaacgtatgtcctcaaaggtacagcaacaggagtataacaccaacgacccccctcgatggttcggatatgaccgagaaggcaaccccgtaacagagctggacaacataacctccagtaagggcgcactggagctgacagttaaaaagagcacatactcctcggaagatcaggcggcctag

SEQ ID NO: 47632 - DNA, 1362 bp, Artificial Sequence
  Description of Artificial Sequence: Synthetic coding sequence
atgacccccgagctgatgatcaaggcctgcagcttctacaccggccatctggttaagactcacttctgcacctggcgcgatatcgccaggactaatgagaatgtcgtgctggcagagaagatgaatcgcgctgtaacctgctataatttcaggctacagaagtctgtatttcaccactggcactcgtacatggaggatcagaaagagaaattaaagaatatcctgttacgcattcagcaaatcatttattgccacaagctgaccattatcctgactaagtggcggaacaccgccagacacaaaagcaagaaaaaagaagatgaactcattctaaaacacgagttacagctcaagaagtggaagaaccggcttattttaaaacgggccgcagctgaagagtccaattttccagaacgttcctcctcagaagtctttctggtggacgagactttgaagtgcgatatttcactcctgccagaacgagccatcctgcagatcttcttctacctgtccctgaaggacgtgattatctgcggccaagttaaccatgcctggatgcttatgacccagcttaacagcctttggaacgcaatcgactttagctctgtgaaaaatgtcattcctgacaagtatatcgtctccacattgcagcgctggaggttgaacgtacttcggttaaatttccgaggttgtctgctgaggccaaaaacctttaggagcgtgtcacactgcaggaacctccaggaactgaacgtcagcgattgtcccacctttacagacgagtctatgaggcacatatctgaaggctgtcctggggtgctatgtttaaacttgagcaacaccacaattactaatcgcacaatgaggctgcttcctaggcatttccataacttgcaaaacctatcccttgcctactgccggagattcacagacaagggcctgcagtatttgaacctggggaacgggtgccataaacttatctatttagatctgtccgggtgcacacagatcacagactctgccatggagatgctgtctgccaagtgtcactacctacacatcctagacatctccggctgcgtcctactcacagaccagatattagaagacctccagattggatgcaagcaactgcgcatccttaagatgcaatactgtacaaatatcagcaagaaagctgcccagagaatgtcttcaaaggttcagcagcaggagtacaacaccaacgaccctccacgatggtttgggtatgaccgtgaggggaaccctgttactgagctggacaatatcacctcatcaaaaggggcactggaattaacagtaaagaagtccacctacagcagcgaagatcaagctgcgtag

SEQ ID NO: 47633 - DNA, 1440 bp, Artificial Sequence
  Description of Artificial Sequence: Synthetic coding sequence
atgagcagccccggcatcgacggcgaccccaagcccccctgcctgcctcgaaatggactcgtcaaactcccaggacagcctaatggtctgggggcggcctctatcactaaggggacccccgccactaaaaaccgaccatgtcaacctcccccccctccgaccctcccccccccttctctggcagcccccctctcccgtgccgccttggcaggcggtccgtgtactcccgctggaggtcctgcctctgccctggctcctgggcaccccgcagagcgtcctcccctcgcgaccgacgaaaagatcctcaatgggcttttttggtatttttccgcctgtgagaaatgcgtcttggctcaggtgtgtaaagcatggaggagggtgctgtaccagcccaaattttgggccggactgacacctgtgctgcacgcaaaggagctgtacaacgtgctgccagggggggaaaaggagtttgtcaacctccaaggattcgccgctcgcggctttgaaggtttttgtttggttggagtatccgacctcgacatctgtgaatttattgataattacgccctgtccaagaaaggcgtgaaggccatgagcctgaagcgctctactatcacagatgccgggctggaggtcatgctcgagcagatgcaaggcgtggtgaggctggagctgtccggctgcaacgattttactgaggccgggctgtggtcttccttaagcgccaggattacttcactctcagtgtcagactgtatcaacgtcgctgatgatgccattgcagccattagccagctgctgcctaatttagcagagctgagcctccaagcgtatcacgttacagacacagccctagcatattttactgcccggcaaggacacagcactcacacactgcgcctgctctcatgctgggaaattactaaccatggggtagtgaatgtggtccactccctgccgaatttgactgcattaagcctttccgggtgctcaaaggtcaccgatgatggcgttgagctcgtcgctgagaatctcaggaagttgagatccctcgatttgtcgtggtgcccgcgcataacagacatggctctggaatatgtggcatgtgacctgcatcgcttggaggagttggttctcgatcggtgcgtaagaatcaccgatacaggcctctcatatctgtctacaatgtcctctctgcgctcattgtatttacggtggtgctgtcaagtgcaggatttcggtctgaagcacctgcttgccctgggttctctgcgacttctatctttggccgggtgtccactgctcacgacgaccggattgtctggcctcgtgcagctgcaagaactcgaagagttggaacttacaaactgtccaggggctacacctgaattgtttaagtacttctcacagcacctacccagatgtctggtgatcgagtag

SEQ ID NO: 47634 - DNA, 1440 bp, Artificial Sequence
  Description of Artificial Sequence: Synthetic coding sequence
atgagcagccccggcatcgacggcgaccccaagcccccctgcctgcctcggaatggactggtgaagttaccgggacagccaaacggacttggtgccgccagcataacaaaaggtacccccgcaactaagaacaggccatgtcagccaccccccccacctaccctacctccccctagtctcgctgctcccctcagccgtgcggctttggcgggagggccttgtactccggccggaggaccagctagcgcccttgcgcccggacacccagccgaacgaccccctctcgccacggacgagaaaattctgaacggcctattctggtacttctcagcctgcgaaaaatgcgtgttggcccaggtgtgtaaggcctggagacgggtgctgtatcagcccaaattctgggctggactcacaccggtcctccacgccaaggaactgtataatgtgctccccggaggcgaaaaagagtttgtcaacctgcagggttttgcagcacgcggcttcgaaggtttttgtttagtaggcgtatccgacctggacatctgtgagtttatcgacaactacgcacttagcaaaaagggggtgaaagcgatgtcccttaagcgttcaacaatcacggacgccggccttgaggtgatgcttgagcagatgcagggagttgtacgtctggagctgagcggatgtaatgattttaccgaagcagggttgtggagtagcctgtctgctcgtattacttccctgtcagtgtccgactgcataaacgtggctgatgatgctattgccgctatctcccaactgctcccgaatctggcagagttaagcctgcaggcctaccacgtcactgacactgctttagcctatttcactgcacgccaaggacacagcacccatacattgaggctgctgtcttgctgggagattactaatcatggggttgttaacgtggtgcactccttacctaatctgacagccctgtcgctgagcggttgcagcaaggtcaccgacgacggcgtcgaattagtggctgagaatctgcgtaaattaaggtctctagatctgagctggtgtcccagaattaccgacatggcactggaatacgtggcttgcgacctccaccgactcgaagagctggtgctggacagatgtgtacggataaccgatactgggctctcttatctaagtacgatgagttcgctgcgcagcctgtacctgagatggtgttgccaggtgcaggacttcggccttaagcatctgctcgcgttgggtagccttaggctgctgagcctggccggctgccccttactaactacaacgggcctgtctggcctcgtccagttgcaggaattggaagaactggagttaaccaactgccctggagctacgcctgagctgttcaaatacttctctcagcaccttccgagatgcctggttatcgaatag

SEQ ID NO: 47635 - DNA, 780 bp, Artificial Sequence
  Description of Artificial Sequence: Synthetic coding sequence
atgcacgccgtgccccggggcttcggcaagaaggtgcgggtgggcgttcagagttgcccacctctgcttgggcctggggttcccccagctctactgagagtgctcgtaagcgcagaggaaccagccctgcccggcactcctagggccgattgggtgcagctgttactgcggcatgccccacagcgggctcgccatccacagttggctccaactctgcaaccccggaccgaatgtcgggggctgggtggtggcagacataggcccgccggcctgccagccgcaccagacgcacggacagccgcccaacggccttacgggctccgagccggtcagtaccgacctgccgtgcctgctgttgcagtgcccgtcgctggtcagcccggacatgatggggagggcggagtacacgctcgagctctcaggcacgtcgaggccttacaagcagcagagggtccgcaggcaggcgccgcccttctccaaaggcaacgccctgttctgcccggtgctgaaccagtgccgctcgccgccgccccagttccgggactttcacagcgccatccgccagctcggtgtagggccgggctgcacggttccctgcctgccggctgtcacgtcccccctgtccataggggcgtgccgcgtcacctccaggagcctgctgctgtcgcctctccacagctccctggcagagctgcacgggtcaagcgacgtcacctaccttcagccccccggggccctgaccgcagacatcctggcagaccccccggggctcctggatag

SEQ ID NO: 47636 - DNA, 2418 bp, Artificial Sequence
  Description of Artificial Sequence: Synthetic coding sequence
atggccagcagcggcgaggacatcagcaacgacgacgacgacatgcatccagccgccgctggaatggccgatggagtgcacctgttagggttctccgacgaaatccttctgcatattctcagccacgtgccaagcactgacttgatacttaatgtccgacgaacctgtaggaaactcgccgcactttgtctagacaaatctctgatacacactgttctattgcaaaaggactatcaggcaagcgaagataaggtgcgtcagctcgtgaaggagatcgggcgagagatccagcagctatcaatggctggctgttactggcttcctggatccactgtcgagcatgtggcccggtgcagatcactggtgaaagtcaatctgtctggttgccatctcacatccctgcgactgagcaagatgctctcggctcttcagcatctaagaagcttggctatcgacgtttctcccggattcgatgcatcgcagctttcaagcgagtgcaaggccaccctttccagggtcagagagctcaagcagactctgttcacaccttcctatggcgtagtcccctgctgtacctccctagaaaagcttctactgtactttgaaatccttgaccggactcgggagggtgcgatacttagcggccaattgatggtcgggcagtccaatgtcccacattatcagaacctccgagttttttatgcacgactagcacccggttacatcaatcaggaggtggtgcgactatacctcgcagtactctccgaccggacccctcagaatttacatgctttccttatctctgtcccaggaagttttgcagagtcgggggccacaaagaatttgctagactctatggctcgtaacgtagtcttggacgctcttcagttgcccaagagttggctcaatggtagctcactgttgcagcatatgaaatttaataacccattctatttctcattctcgaggtgtaccctgtcaggtggccatctgatccaacaagtgatcaatggagggaaggacttgaggtctctggcctcactgaacctgtctggctgtgtgcactgcttaagtcctgacagtctgctgaggaaggccgaagacgatattgactcgtcaattctggagacactggtggccagttgttgcaatctccggcacttgaatctgagcgccgctcatcaccactccagcgagggcctgggccgacacttatgtcaactactggcgaggctacgacaccttcgatcattgtcactaccggtatgtagcgtggccgactccgcacctcgggcggaccgggccccagcacagcccgccatgcacgctgtacccagggggtttggaaagaaggttcgggttggcgtacaaagctgtccttcacccttcagtgggcaagcctgtccccaacccagtagcgttttttggagccttctcaagaatcttccattcctcgagcacctcgaacttataggctcaaattttagttctgccatgccacgcaatgagcctgcaataagaaattccctgcctccctgttcccgcgcccagagtgttggcgattctgaggtggctgccattggccaactcgccttcctcaggcatctcacactcgcccaactcccgtccgtgctcacgggttcgggactagtgaacataggactgcagtgccaacagctcagatcactgtctttagcaaacttgggaatgatgggcaaggtggtatatatgcctgccctcagcgatatgctgaagcactgtaagcggctgcgtgaccttaggctcgaacagccctactttagtgccaatgctcagttttttcaggccctgagccagtgtcccagcctgcagcgtctgtgtctggtctcccggagtggtacactgcagcccgacgccgtcctggcattcatggcccgctgcctgcaggtggtgatgtgtcatcttttcacaggggagagcttggccacatgcaaatcacttcagcagtctctgttaaggcggtggggtgaagtcactggccgtcggccacagcttttcacagagttgcgcgaagaaccttctgcccgtacaagccgcgccacgggacggagacagccatgtttgccagattccggagtggtttgttgcccttgcggcagacctttggcagtcagcgggataatcctagtcggcgttagcccaagcctagttgtgaagacgacgtgtgtgtaccgcgtgctgtttaagaacctggattacgcttctatattttttctggtctgcctattcgagaccgagtcccacagcgtggtccaggccggggtgcagtggagagacctgagctcactgcaacccctgctgtcgggattgcaaccacagcctcctgaacaattagaaaatgagctggagatcggttttagctattgttttgtaatctag

SEQ ID NO: 47637 - DNA, 2157 bp, Artificial Sequence
  Description of Artificial Sequence: Synthetic coding sequence
atggccagcagcggcgaggacatcagcaacgacgacgacgacatgcatcccgccgctgccgggatggccgacggcgtgcacctgctgggcttcagcgatgagattctgctgcatatactctcccacgtgccatctactgacctgatcctgaacgtgcgccgaacttgccggaagttggctgcattgtgcctcgacaagtctctgattcataccgtgctgctacagaaagactaccaagcctccgaggacaaggtgagacagttggtgaaggagatcggcagagaaatccagcagctctctatggcaggttgctactggctgcccggtagtacagtggaacatgtagcaaggtgccggtctttggttaaagtcaatttaagtgggtgtcacctgactagcctcagactgtctaaaatgttgagtgccctgcaacacctccgatctctcgctatcgacgtgagcccgggcttcgatgcgagccagctttcttccgagtgcaaggctactctctcccgagtaagagaactaaagcagacgttatttacaccgagttacggggtggtgccctgctgcacaagtctggaaaaactgcttctttatttcgagattttagaccgaacgagggaaggagccatcttatcaggccaactcatggtgggccagagtaacgtacctcattatcagaacctgcgagtgttctacgctaggctcgccccaggctacatcaatcaagaggtggtgagattataccttgctgtgttaagtgatcgcaccccgcaaaacctccacgcattcctaatctcagtgccaggctctttcgccgaatccggcgctacaaagaatctgctggattccatggccaggaatgttgtcctggacgctctacagttgccgaagagctggctcaacgggagctctctacttcagcacatgaagtttaataacccattttacttcagtttttcccgctgtactctgtcaggggggcatctaatccaacaggtcattaacggcggtaaggacctcaggagcctcgcatcactgaaccttagtggatgcgtccattgcctgtccccggattctctgctgcgcaaagctgaagatgatatcgatagtagtatcttggagacgctcgtggcctcttgctgtaaccttcgccacctgaacttatcagctgcccatcaccacagctcagaggggctgggtagacatctctgtcagctgctggcccgcctcaggcacctgaggtctctctcattgccggtgtgtagcgtggccgactcagcaccgcgcgcagacagggccccagcacagcctgccatgcatgcggtgccacgcggttttggaaagaaggttcgcgtgggggttcaatcttgcccctcaccgttcagtggacaggcctgtcctcagccctcctcagtgttctggtccctgctgaagaatttaccctttctcgagcatctggagcttattgggtctaatttttccagcgccatgcccagaaacgagccagccatcagaaactccctccccccctgctccagggcccagtctgtcggcgactcagaggttgccgcgatcgggcagctggctttcttgagacacctgacccttgcacagttaccgtccgtcctgaccggttctggacttgtcaacattgggctgcagtgtcagcagctgagaagcctctctctggccaatcttggcatgatgggtaaagttgtatacatgcctgccttatctgacatgctgaagcactgcaagagactgcgcgacctgcgcctcgaacaaccatacttttccgctaacgcccagttcttccaggccctcagccagtgccctagcctgcagcgcttgtgtctagtgtcccggtctggcaccttacagcctgacgctgtgctcgcctttatggcaagatgcctgcaagtagtcatgtgtcatctttttaccggcgagtcgttggcaacttgcaaatccctacagcaatctctgctgaggtcctttcaggccgaacgcccagccttgaacgttgtcatattccccctgctgcacgagggacttaccgacgtgattcgcgatgtgcctctcgtgcacttagatgaaattaccctgttcaagtctagggtggcagaggagccccccaacctctggtggtag

SEQ ID NO: 47638 - DNA, 2406 bp, Artificial Sequence
  Description of Artificial Sequence: Synthetic coding sequence
atggccagcagcggcgaggacatcagcaacgacgacgacgacatgcatcccgccgcagccggaatggcagatggggttcacctgctgggttttagcgacgagatcctgttgcacatcctcagccacgtgccgagtacagatttgatcctcaatgtgagacgcacatgtagaaagctggccgcactttgtctggataaatccctcattcatactgttttgctgcaaaaagactaccaggcctcagaagataaagtacgccagctggtgaaagagataggtcgtgagatccagcaactgtcaatggctggttgctattggctgcccgggagtacagtggagcacgtggcccgctgcagatccctcgtgaaagtaaatttgagcggttgtcatcttactagccttcgcctgtccaagatgctatctgccctccaacatctcaggagtcttgccatcgacgtatctcctggcttcgatgcatcgcagctgtcgagtgagtgcaaagctaccctcagcagggtgagagagcttaaacagaccctcttcacaccttcatatggtgtggtcccttgctgcacctctttggagaagctcctgctgtactttgagatactggacaggacacgagagggcgccatcctctccggccagctgatggtcggccagtcaaacgtgcctcactatcaaaatttgagggtgttttatgcccgtcttgctcctggctacatcaaccaggaagtggtgcgcctgtacctggcggtactctctgatcgcaccccgcagaatcttcatgcattcttaatctctgtgcctggcagctttgccgagtctggcgcgacaaaaaacctgctagactccatggcccgaaatgtcgtgctggacgcactgcagctgccaaaaagttggttgaacggaagtagcctgttgcagcacatgaagttcaataatcctttttacttctcattttcgagatgcacattgtctgggggacacctgatccaacaagtcattaatggaggaaaagatctccgcagtctcgcctccctgaacttgagcggatgtgtgcactgtctctcacctgattctctgctgcgcaaggccgaggacgatattgatagtagcatcctggaaaccctggttgcgagttgttgtaatctgcggcacttaaacttaagtgccgcacaccatcactcctccgagggcctcggcagacatctgtgtcagctccttgccaggctgagacacctgcggtcactttctctgcctgtgtgctcagtagccgattccgcgcccagagcagacagggcgccggcacagcccgccatgcacgcagtgcccaggggattcggaaaaaaggtgagagttggtgtccagagctgtccatcacctttttctggacaggcctgcccccaaccatcctcggttttttggagcttgctgaagaatttacccttcctggaacacctcgagttgattggttctaactttagctccgccatgccaagaaacgaacctgccatacgcaacagcctgccaccctgctcacgggcacaatctgtaggggattccgaggttgccgctatagggcagctggcatttctccgacacctgacactcgcccagctgccctccgtgctaactggttcagggttagtaaatatcggcttacagtgtcagcaactcagaagtttaagcttagccaatctggggatgatgggaaaggtagtttacatgcctgctctatccgatatgctgaaacactgtaagaggctcagggatctgcgccttgaacagccctatttcagtgctaacgcgcaattttttcaggcactatctcagtgtccttccctacagagactctgtctggtgtcacgtagcgggacactacagccagacgccgttttagccttcatggctcgctgcctgcaagtcgtcatgtgtcatttgttcacaggcgagtcactggcaacctgcaaatccctgcagcagtccctgttgcggcggtggggagaggtgacgggcagaaggccacagctgttcaccgagctgagagaagagccctccgcgcggactagccgtgccactggaagacgacagccttgcttaccggattctggtgtggtctgttgcccttgtggccggccactggccgtctccggaattattcttgttggagtttccccgagtctcgtggttaagaccacctgcgtgtaccgagtacttttcaaaaacctcgactatgcctcaatcttttttctggtctgcctttttgagacggagtcccactcagtggtgcaggccggtgtgcaatggcgcgacttgagttccttgcaaccactgcttagcgggttacagccacaaccccccgagcagctcggcctccaggtttgcacgacgatccccggctag

SEQ ID NO: 47639 - DNA, 726 bp, Artificial Sequence
  Description of Artificial Sequence: Synthetic coding sequence
atgcacatcacccagctgaaccgggagtgcctgctgcacctgttctcattcctggataaggacagccgcaagtccctggccagaacatgctcacaacttcatgacgtctttgaggaccctgccctctggtctctcctccattttcggtctctgactgagctccagaaggacaatttcctgctcggccctgcactacgctcactttcaatttgctggcacagctcacgagtgcaagtctgcagtattgaggactggcttaaaagcgccttccagcggagcatatgttctaggcacgaatccttggtgaatgatttcctccttagggtatgtgacaggctttctgccgtacgaagccctcgcagaagggaagcgcctgcaccatcttcaggcactccaatcgccgtgggacccaagtctccccgatggggaggtcctgatcattccgagttcgctgacctcagaagcggggtcaccggagctcgtgccgccgctcgacgtggattgggctcacttcgggccgagcgaccgagtgagactccaccagctcccggcgtgagctggggtcctcctccgcccggcgcaccggtcgtgatcagtgtgaagcaggaggaaggcaagcaggggcgaactggcagaaggtcgcaccgggccgctccaccgtgtggcttcgccagaactagagtgtgccccccgaccttccctggtgccgacgcttttccacagtag

SEQ ID NO: 47640 - DNA, 1620 bp, Artificial Sequence
  Description of Artificial Sequence: Synthetic coding sequence
atggccgcccccgccagccggcaggtgcggcggcgggcccgggccgccccgcggccccgctccgctgaagattggtggtgggaccggctcgctcccagagggtcgggctatcacctgttacagtccgatagcatgctactggtcttgtctgagcctgggcctgcgagacccagggcccaacgccgagcctctcgcaggactccacgtcagccccctaggggaccttctgctgctgctaagcctaaggccggactgcgatcagaagctgccgcagcccccgcccccgctccagccccgaccccgactccagaggagggccctgatgcagggtggggagaccgaatcccactcgaaatcttggtgcagatttttggtctgcttgtggccgcagacgggcccatgcccttcctgggacgggccgcacgggtgtgtcgccggtggcaggaggccgcgagtcagccggccctctggcacacagtcaccctgagttcgcccctggtgggccgccctgctaaaggcggagtgaaagcagaaaagaagctcttggcgtccttggaatggttaatgcccaaccggttttcacagctgcagcgccttacacttatccattggaagagtcaggtccacccagtcctcaaactagttggcgagtgttgtccacggctcactttcttgaaactaagcggttgccatggcgttactgctgacgcccttgtcatgcttgctaaagcatgctgccaactgcacagtttggacctgcagcactccatggtcgagagcaccgcggtggtgtcgttcctcgaagaggccggaagcagaatgcgcaagttgtggctgacgtatagctctcagacaacagcgattctcggtgccctgctcgggagctgctgcccccagctgcaagtactcgaagtttctacggggatcaataggaattctattccactgcaactgccagttgaagctttgcaaaagggctgtccacagcttcaggttctgcgcctgctaaatctgatgtggctgccaaagcctcccggcagaggcgtggctcccgggccggggttccccagcctagaggagctatgtctcgcctcttcaacctgtaattttgtgtccaatgaggtcctcggaagactgcttcatggcagtccaaatttacgcctgctggacctgagaggctgcgcgcggattaccccagccggactccaggatctcccttgtcgcgagctcgagcaacttcatctgggactgtacggcacctcagaccgcctgactctcgccaaggagggaagcccattcttaacgcaaaagtggtgccacacgctcagggaactcgacctgagcgggcaagggttctcagagaaagatctggaacaggcactagctgcctttctgtcaacaccaggcggcagtcacccagcgttgtgttccctgaacttacggggaacccgcgtcactccctccactgtgtcttccgttatcagtagttgtcctggcctgctgtatttaaacctggagtcctgcagatgccttccacgtggcctgaaaagagcctacaggggtctggaagaggtgcagtggtgcctggaacagcttctcacatcacccagcccatcgtag

SEQ ID NO: 47641 - DNA, 1602 bp, Artificial Sequence
  Description of Artificial Sequence: Synthetic coding sequence
atggccgcccccgccagccggcaggtgcggcggcgggcccgggccgccccccgccctcgctctgccgaggactggtggtgggatagactggcacctagggggtccggctaccacctgctgcagtccgacagcatgctgctagtgctttccgagcccggtcctgcccgtccccgcgcccaaaggcgagcctccagacgcacccctagacagcctcctcgagggcccagcgccgctgccaagcctaaggctggcttacggtcagaggctgccgctgcacccgctccagcgcctgcacccactcctacccctgaagaaggccctgacgctgggtggggtgacaggatccccttggaaattctcgtccagatttttgggcttctcgtggccgccgatggaccaatgccattccttgggagggctgcacgggtatgtcgcagatggcaggaggccgccagtcaaccagcgctctggcacaccgtgacgttgtcttctcctctcgtcggccgccccgctaaaggcggtgtgaaagctgagaaaaagttgctcgcgtcgttggagtggctgatgcccaatcgcttttcccagctgcagaggctcacactgattcattggaagtcccaactagtaggcgagtgctgtccaagacttacctttttgaaacttagcgggtgccatggcgtcactgccgacgccctggttatgctagccaaagcatgttgtcaactgcattctcttgacctccaacactcgatggtcgagtccactgccgtcgtcagcttcctggaggaggccggcagcaggatgaggaagctgtggttaacatattcttcgcaaactactgctatcctcggcgctctgttgggttcatgctgtccccagctgcaggtcctggaagttagcaccgggataaatagaaactctattcccctccaactgcccgtagaggctctgcagaaggggtgcccgcagctgcaggtactgagactgctgaacctgatgtggcttcccaagcctccaggacggggtgtggcacccggccccggctttcccagcctcgaagagctctgcctggcctcttcaacttgtaattttgtcagcaacgaggtgctgggcaggctgctccatggctctcctaacttacgactcctggacctgcgcggatgcgcccgtattactcccgctggccttcaagatctcccttgccgagaactggagcagctccacctgggcttgtacggcaccagcgaccgccttacactggcaaaggagggttccccctttttaacgcaaaaatggtgccatacgctgcgcgagcttgacctgtccggccagggcttctccgagaaagatttggagcaggccctggcagccttcctgagcaccccaggcggatctcaccctgccctgtgtagcttgaatttgcgcgggacccgagtgacaccctctacagtgagcagcgtgatcagcagctgtcctggtctactttacctgaatctggagtcgtgtcgctgtctgccgcgcggcttaaagagggcttatcggggacttgaggaagttcaatggtgcctggaacagctgttgactagtcctagcccatcttag

SEQ ID NO: 47642 - DNA, 1125 bp, Artificial Sequence
  Description of Artificial Sequence: Synthetic coding sequence
atggccgagcccggcgagggcctgcccgaggaggtgctggccctgatattcaggcaccttagtcttagagaccgcgcagctgctgctcgcgtctgtcgagcctgggctgccgccgccacctgctcagctgtgtggcacgataccaagatatcatgtgagtgcgagcttgagggcatgttgcccccttacctttctgcctgtttagatcacattcacaatcttaggcttgagtttgaacctagccgcaagcccagtcgaagagcagcaatcgagctcctgatggtccttgctggcagagcccccggcctgagggggttacgcctggagtgtcggggcgagaagcctttgttcgatgctggacgcgatgtgctggaagccgtacacgcagtttgcggagccgcctcacagctcagacacctggatctgcgccggttgagtttcactctagatgatgcacttgtactgcaggccgcgcggtcctgcccggaactgcactcattattcctggataactcaactctcgttgggtcagtcggtccagggtccgttctagaactcctggaggcatgtccaaggctgcgggccctggggcttcacctcgctagcttatcccacgccattcttgaagccttagcggcccctgatagggcacctttcgctctgctggcactcaggtgtgcgtgccccgaagacgcccgtgcttctccgttaccaaacgaggcctgggtcgccctcaggaggcgccatcctggcctcgcggttgagctcgagctcgaacccgccttgccggccgagtctgtgaccagggttcttcagcccgctgtgcctgtagctgctctccgcctgaatctgtccggagacacagtgggacccgttcgctttgcagctcaccactacgctgcaactctgtgtgccctcgaggtccgagcagccgcatcagcggaacttaacgcagcacttgaggaactggccgctcggtgcgctgctttgagagaagtgcattgcttctgcgtggtcagtcactccgttcttgatgccttccgcgcccattgccctagattgcggacctataccttaaagttgaccagggagccccatccgtggaggcccactcttgtcgcttag

SEQ ID NO: 47643 - DNA, 492 bp, Artificial Sequence
  Description of Artificial Sequence: Synthetic coding sequence
atggccgagcccggcgagggcctgcccgaggaggtgctggccctgatttttcgccatttgagcctgcgcgaccgagccgctgccgcccgcgtgtgtcgcgcgtgggccgctgctgccacttgtagtgccgtttggcatgacactaagatctcctgcgagtgcgagctggagggcatgctcccgccttatttaagcgcctgcctcgatcacatccataacctgaggctcgaatttgagccctctcggaagccgagcaggagagccgccatcgaactgctgatggtgttagctggccgggctccagggctccgcggcctacggttggaatgccgtggcgaaaagcccctcttcgacgctggcagagatgtgcttgaggccgtccatgctgtatgcggagcagcttcacagttacgccacctggatttaaggcggctttcatttacactggacgacgcgttggtcctgcaggccgctcgcagttgtcctgagtag

SEQ ID NO: 47644 - DNA, 1125 bp, Artificial Sequence
  Description of Artificial Sequence: Synthetic coding sequence
atggccgagcccggcgagggcctgcccgaggaggtgctggccctgatctttcgccatctctccctacgtgatcgcgccgcggctgcaagagtgtgtcgggcctgggccgccgcggctacgtgcagtgccgtatggcacgacactaagatctcctgtgaatgtgagttggaaggcatgctgccaccctacttaagcgcctgtctagaccacattcacaatctgcgcctggaattcgagccttctcggaagccatcgaggcgtgccgctattgagctgttgatggtactggccggccgggccccgggcctgcgcggcttacgactcgagtgcagaggcgagaagcctctattcgacgcaggacgggatgttctcgaggctgtgcacgccgtgtgtggtgcagctagtcagctgcgccatctcgatttgagaaggctctccttcacccttgacgacgccctcgtgctacaagccgcgcggtcttgccccgaattacactcactcttcttagataactccactctagtgggcagtgtcgggcccggctcagttctggaactgctggaagcatgtccacgactgagggcgctgggtctgcacctggccagtctctcccacgctatactcgaggccctggcagcgcctgaccgcgcccccttcgcccttttggctctaagatgcgcttgccccgaggatgctagagccagccccttgcctaacgaggcttgggtggctctcaggagaagacatccaggcttggcagttgaactggagctcgagccagccctgcctgcagagagtgtcacccgggtgctacagcccgcagtgccagtggccgctctgcgactgaatctcagcggggataccgtaggtccggtccgtttcgctgcacatcactacgccgcaaccttatgtgctcttgaagtccgagccgcagctagcgcagagcttaatgcagcgctcgaggaattagcagcccggtgtgccgccctaagagaggtccactgtttttgcgttgtttctcatagtgtgttagacgcctttagggcccattgtccgagattgaggacttataccttgaagttgactcgtgagccccatccttggagacccaccttagtggcctag

SEQ ID NO: 47645 - DNA, 390 bp, Artificial Sequence
  Description of Artificial Sequence: Synthetic coding sequence
atggccgagcccggcgagggcctgcccgaggaggtgctggccctgatctttcgacacctctccttaagggatagagctgctgcagctcgggtgtgccgggcctgggctgcagctgccacatgttcagccgtgtggcatgacactaagatcagttgtgagtgcgaactggagggtatgctccccccctacctatccgcctgtctggaccacatccataaccttagactagagtttgagccctctagaaagccaagtaggagagcggccatcgaacttctgatggtactggcagggagagcccccggccttcgggggctgcgtctggaatgtcgaggagaaaagccactgtttgacgcaggccgcgacgttctagaagccgtgcatgcctag

SEQ ID NO: 47646 - DNA, 1701 bp, Artificial Sequence
  Description of Artificial Sequence: Synthetic coding sequence
atggacgagggcggcacccccctgctgcccgacagcctggtgtaccaaatctttcttagtctaggcccggctgatgtgttagccgcgggtcttgtctgccggcagtggcaggccgtttctcgggatgaatttctgtggcgagagcagttctataggtattaccaggtagcacgggatgtcccgcggcacccagctgcgatgtcctggtacgaagaatttcaaagactgtatgacacagtcccatgcgttgaggtccagactctgagagagcacacagaccaagtgcttcatctttcctttagccactctggctatcagttcgcaagctgcagcaaggactgcaccgtgaaaatatggtcaaatgacctaacgattagccttctgcacagtgctgatatgagaccttacaactggtcttacacccaattttcccagtttaataaggacgacagcctgctgctggcttccggcgtcttcctcggcccccacaactcaagtagcggggagatcgctgtgatctcgttagacagtttcgctttactatcaagggttagaaataaaccatatgacgtgtttggttgttggctgaccgaaacatccttaatttccgggaacttacatcggatcggcgatatcactagttgctcggtcctctggctcaacaatgccttccaggatgtcgagtccgagaatgtaaatgttgtgaaaaggctcttcaagatccaaaatttaaacgctagcactgtgaggacagtgatggtcgccgactgctcgcggtttgatagccctgacttgctcctggaagcaggggatcccgctacctcaccgtgtagaatcttcgatctgggttccgataacgaagaagttgtggctgggcctgcacccgctcacgctaaggagggtctacggcactttctcgatagagtgctggaaggacgtgctcagccccaactgtctgaacgaatgttggagaccaaggtggccgagctcctcgcgcagggccataccaagccacccgaacggtctgctacaggtgccaagtccaagtacctcatatttactaccggctgtctcacgtacagtccccaccagatcggaatcaagcagattctgccccatcagatgactaccgcggggccagtgctgggtgaagggaggggaagtgacgcattcttcgatgccctggatcacgtaattgatattcacggccacatcatcggaatggggctcagtccagacaatcggtatctttatgtgaactctcgggcctggcctaatggggctgtggtggccgaccctatgcagccgccccccatagctgaggaaatcgacctgctcgttttcgatctgaaaaccatgagggaagttaggcgagccctgcgagcgcaccgtgcatatacccctaatgatgaatgcttcttcatcttcctagacgtgtctagggacttcgttgcttctggggcagaagatcggcatggatatatctgggacagacattacaatatatgcctagccagactgcgccacgaagacgttgtcaactcagtggtcttttcaccgcaggagcaggagctgctgctaacagcgagcgatgacgcgaccatcaaagcttggagaagcccccgcactatgagggtactccaagccccaaggccaaggccaagaacattcttcagttggctagcctcccaaaggcggtag

SEQ ID NO: 47647 - DNA, 603 bp, Artificial Sequence
  Description of Artificial Sequence: Synthetic coding sequence
atggacgagggcggcacccccctgctgcccgacagcctggtgtaccagattttcctgtctctcggtccggccgacgtgctggcggctggtctggtgtgtagacaatggcaggcagttagccgtgacgagttcctttggcgggaacagttctaccgatattaccaggtggcacgagacgtccctaggcatccagccgcaatgagttggtatgaggaatttcagaggctctatgacacagtcccctgcgtcgaagtgcaaacactgcgggaacacacagaccaggtgctccatctgtcattttcacacagtggatatcagttcgcgtcttgtagcaaggactgcaccgtaaaagcaatcaccactgcagcccccgccgagcagatttggagtaatgacctgacaattagtctccttcattcagccgatatgcgaccctataattggagctatacacagttcagtcagtttaacaaggatgacagcctgctcctagcgtcaggcgtctttctaggaccacacaacagctcctccggggagatcgccgtcatcagcctggattccttcgccctcttatctcgcgtgcgtaacaaaccctacgactag

SEQ ID NO: 47648 - DNA, 804 bp, Artificial Sequence
  Description of Artificial Sequence: Synthetic coding sequence
gacagcctgagcagccccggcctgcccaccgacagcttcgccctgctcagcagggtgagaaacaagccttacgacgtcttcggctgctggctaaccgagaccagccttatcagcggtaacttgcacagaatcggcgacattacatcttgttcggtgctctggttgaataatgccttccaggatgtcgagagtgagaacgtgaacgtagttaaaagactcttcaagattcaaaatcttaacgcatcgaccgtccgaacagttatggtggctgattgttcccgcttcgacagtcctgatctgttattagaggccggcgacccagctacttctccatgtaggattttcgatctcggctccgacaatgaggaagtcgtagcagggccagcacctgcccatgctaaggaaggactccggcatttcctggaccgagtgcttgagggcagggcccagcctcagctatccgagcggatgttggagacaaaggtggccgaattgttagcgcagggtcataccaagccacctgagcgtagcgcaacgggggccaagtccaagtatcttatcttcaccacagggtgcctgacttactctccacatcaaattggcattaaacaaatcctccctcatcagatgacaacagctggtccagttctgggcgaagggcgcgggagcgacgcattctttgatgcgctggatcacgtcatcgacatccacggtcatataatcggcatgggattgagcccggataatcggtacctgtacgtgaactcaagagcgtggccaaacggcgcagtggttgctgattag

SEQ ID NO: 47649 - DNA, 390 bp, Artificial Sequence
  Description of Artificial Sequence: Synthetic coding sequence
atggacgagggcggcacccccctgctgcccgacagcctggtgtaccaaatattcctttctttggggccagccgacgtgctggcggcaggcctagtctgtcgacaatggcaggccgtgagtagagacgagttcctgtggagggaacagttttaccgatattaccaagtcgcacgggacgtgcctagacaccccgccgcaatgtcttggtatgaggagttccagagactatacgacacagttccctgtgttgaggtccagacactgagagagcacacggaccaggtcctgcatctgagctttagtcactccgggtatcaattcgcttcttgttcaaaagactgcacggtaaagatctggagtaatgatctgaccatttctctgttgcactag

SEQ ID NO: 47650 - DNA, 1467 bp, Artificial Sequence
  Description of Artificial Sequence: Synthetic coding sequence
atggagctgcccctgggccggtgcgacgacagccggacctgggacgatgactctgaccccgaaagcgagactgacccagatgcccaggcaaaggcctatgttgcaagggtgctgagtccaccgaaaagcggactggcattttctagacctagccaactgtccaccccggctgcttccccttccgcgtccgaacctcgagcggccagtagggtgtcggctgttagcgagccgggtctgctctccctgcctcccgagctgctcctggaaatctgtagctatctcgacgccaggctggttctgcacgtcctgtcgcgggtctgtcacgctctcagggacttggtgagcgaccacgtaacctggagattgcgggctctacgaagagtgcgtgccccctaccctgtggtagaagagaaaaatttcgattggccagctgcatgtatcgctctggaacaacacctgtcacgttgggccgaggatgggcggtgggtagagtacttttgtctcgctgaaggccatgtggcgtccgtggacagcgtcctattgctgcagggtggttcactctgcctctccggctcccgggaccggaacgtgaacttgtgggatttgagacagctggggacagagtcaaaccaggtgctcatcaaaactcttggtaccaaacgcaattccacccacgaagggtgggtgtggtccctggcagctcaggatcaccgggtctgttcagggtcatgggattccaccgtcaaactctgggatatggccgctgacggccagcagttcggcgagattaaagctagcagcgccgttttatgccttagctacctgcctgacattcttgtgacagggacttacgacaagaaggtgacaatctatgacccccgcgatcggatggagaccagagatgcactgatgggatgggggggacccagtagaggtagtgacattcccccgcaccgcccaataacacacgaagcgggcccagcactgctcaaacaccagcagctgcactccagaccagtcctgacgctcttggcagatgaccgacacatcatcagcggtagcgaggaccataccctcgttgttgttgatagaagagccaattctgtccttcagcgactgcagttggatagttatctgctatgtatgtcgtatcaggagccccagctctgggcaggggataaccagggacttctgcatgtgtttgccaaccggaatggctgctttcagttaatcagaagtttcgatgtcgggcacagtttcccgattaccggcatccagtactcggtcggggctctctacactacttccacagacaaaaccattagggtgcacgtccccacggaccctccacggacaatttgcacaaggcgacacgacaatggcctgaacagagtctgcgctgaagggaatctcgtggtggccggcagtggtgatcttagcctggaagtgtggcgcctgcaagcctag

SEQ ID NO: 47651 - DNA, 1377 bp, Artificial Sequence
  Description of Artificial Sequence: Synthetic coding sequence
atggagctgcccctgggccggtgcgacgacagccggacctgggacgatgactcagatcctgaatccgaaacagatccagacgctcaggccaaagcatatgttgctcgcgtcctctccccacccaagtctggactggctttttcccgcccttcccaactgtccacacctgccgcgtctccttctgcaagcgagccacgcgccgcctcgcgggtttccgcagttagcgagccagggctcttgagtctgccgcctgagttgctccttgaaatctgctcttacttggatgcacgattggttctccacgttctgtctcgtgtctgccatgcactccgtgatttggtttccgaccacgtgacgtggcggctgagagccctgcgccgcgtgagagcgccctatcccgtggtggaggagaagaacttcgactggcccgccgcatgcattgcattggagcagcacctgagcaggtgggcagaggacggtaggtgggttgagtatttctgtctcgccgagggtcacgtggcttctgtcgacagcgtcttgctgctgcagggcggctcactctgcctgtcgggctctcgagacaggaatgtgaacctctgggatctgcgacagctcggaaccgagtccaaccaggtactgataaaaactctcggcaccaagcggaactcaacccacgaagggtgggtgtggtcccttgccgctcaggaccaccgtgtgtgcagcgggtcatgggattccactgtgaagttatgggatatggctgccgatggccagcagttcggtgaaatcaaggcttcatccgcggttttgtgcctctcttatcttccggatatactggtaacaggcacttatgataagaaggtgacaatctacgaccctcgggcagggccggcgctgctgaagcaccagcagttgcattcacgtcctgtgctaaccctactggcggatgacaggcacataataagtggaagcgaggatcataccctggtggtggtcgaccgcagagctaattccgttttgcagcggctgcaattggacagttatttgctgtgcatgagctatcaagagccccagctctgggccggagacaaccagggattgctccacgtgttcgctaataggaacggttgtttccagctgatccggtctttcgatgtcggccacagttttcccatcaccggcatccaatatagcgtgggcgcgttgtacaccaccagcactgataagactatccgagtgcacgtgcctactgatccccctcggactatttgcacccggcgccatgataatggtcttaatcgggtctgcgcggagggaaacctagtcgtcgcgggaagtggcgatctgtcactcgaggtctggcgacttcaggcgtag

SEQ ID NO: 47652 - DNA, 591 bp, Artificial Sequence
  Description of Artificial Sequence: Synthetic coding sequence
atgcgggccagcagcgccgtgctgtgcctgagctacctgcccgacattctggtcactggcacatatgataagaaagtcactatctatgatccacgcgccggaccagcgctgctgaagcatcagcagcttcactcccgtcccgtgctgactctgttggctgacgaccgacatatcatctccggtagcgaggaccacacactcgttgtggtggatcgacgcgccaattctgtgctgcaaaggctccagttagattcgtatctgctttgcatgtcatatcaggaaccccagttatgggcaggagacaaccaaggtttactccatgtgtttgccaataggaatgggtgctttcagctcatcagatcctttgacgttggccattcattccccataaccggcatccagtacagtgtaggagcattatacaccacctccacagacaaaaccatacgagtgcacgtgccaacagatcctcctaggaccatttgcactaggcggcacgacaatggtctgaaccgggtgtgcgcggagggcaatctggtggtggcggggtcgggcgacctgagcctagaagtgtggcggctccaagcatag

SEQ ID NO: 47653 - DNA, 468 bp, Artificial Sequence
  Description of Artificial Sequence: Synthetic coding sequence
atgcacaagaacagcaagcggaacaacaacctgcgggtgagccacactgaggcgaacagcgtggacgctgaaaaagaaaagaacgagagtcaaaataacttctttgagctactgccggccgaaattactttcaagatctttagccaacttgatatcaggtccttatgccgcgcatcgttgacctgccgttcctggaatgataccatacgaaatagcgattctctatggaagccccattgtatgacagtccgggctgtatgcagaagggagattgatgacgacttggagagcggctacagctggagagtgattctgctgagaaattatcaaaagagtaaagtgaagcatgaatggctgtccggcagatattccaacatatgttcacctatctcccttcctgaaaaaatcatgtatcccatggacgcagacacatggggggagattttagaggccgagttggagaggtag

SEQ ID NO: 47654 - DNA, 744 bp, Artificial Sequence
  Description of Artificial Sequence: Synthetic coding sequence
atgtggcccctgctgaccatgcacatcacccagctgaaccgggagtgtctgctacacttattttcgttccttgataaagattcaagaaagtccctcgctaggacttgcagccaacttcatgatgtgtttgaagatcctgccctgtggagtctgctgcatttccgctccctcacagagctgcaaaaggacaacttcttgctgggaccagccctgcgcagtctgtctatctgctggcacagtagcagagtacaggtctgttctatcgaggactggctgaaatcagcctttcaacgatcaatttgctcacgccatgagagccttgtcaacgattttctcctcagagtatgcgaccgcctgagtgccgtgcggagtccacgaagacgtgaggcccccgcacctagcagtggcacgcccattgcagttggcccaaagtctccgcggtggggcgggcctgatcactctgagttcgctgacctcaggtccggggttaccggtgccagggccgctgcacggcgtggcctgggcagcctgagggcggagagaccaagcgaaactccccctgcgcctggcgttagctggggcccaccccctcctggtgcacccgtggtgatttccgttaaacaggaggaaggtaagcaggggagaactggacggaggtcacacagggccgccccaccctgtggcttcgcgcgcaccagggtgtgccctcctacttttcccggcgcggatgcttttccacagtag

SEQ ID NO: 47655 - DNA, 177 bp, Artificial Sequence
  Description of Artificial Sequence: Synthetic coding sequence
aacagcaccgaccccgtgaaggccgcccagttcgagatgagcaacccgagccacctcctcttctttctcccttgtcctttttctcccgtgagctctctcttcgctttcgttaatgccaaactgaagtggagactgggactgaaaacaccagagcagactaagcctcctggcccctag

SEQ ID NO: 47656 - DNA, 2073 bp, Artificial Sequence
  Description of Artificial Sequence: Synthetic coding sequence
atgcagccccccccccggaaggtgaagcccgcccaggaggtgaagctgagatttttggagcagctgtctatcctccagacctggcagcagcgagaggccgatttgctcgaggatatcaggtcctacagcaaacagagagccgcaattgaacgggaatacgggcaggccttacaaaagctggctggaccgttcctgaaacgcgagggccacagatctggtgagatggactcccgtggaaggactgtcttcggcgcgtggcgatgcctgttggacgccaccgtggccggtggacagacaagactgcaagccagtgataggtatagagacctggctggcggtaccggacggtccgctaaggagcaagtgctaaggaaaggcacagagaatcttcaaagggctcaggcagaggtgctgcagagcgtgcgtgaactttccagatcaaggaaactctacgggcagcgggaaagggtatgggccctggcccaggagaaagccgccgacgttcaagcgaggctgaaccggtctgatcacggcatctttcacagccggacttcactgcagaagctctccaccaaattgagtgcgcagagtgcgcagtacagccaacaactacaggctgcaagaaatgaataccttttaaaccttgtcgcgaccaatgctcacctggaccattattaccaggaggagctcccggcactgctcaaagctctggtaagcgagttatcagaacatctccgggacccgctcacgagcctcagtcatacagaactcgaggctgctgaggtaatcctggagcacgcccacagaggagaacagacaacctctcaggtgtcttgggagcaggatctaaagctgttccttcaggagccgggcgtcttctcccctacgcccccccagcagttccaacccgcaggaactgaccaagtgtgcgtgctagagtggggggccgagggggtggccggcaaatctggtctggagaaggaagtccagcgactgacatcccgggccgcaagggactacaagatccaaaatcacggccatcgggttcttcagcgtctcgaacaaagaagacagcaggccagtgagcgggaagctccaagcattgagcagcgcctgcaagaggtccgagagagcatacggagagctcaggtgagccaggtgaagggggccgcccggctggccctactgcaaggcgcagggctggatgtagagcggtggttgaaaccagcaatgacacaggcccaggatgaggttgagcaggaaaggcgcctttcagaggcaaggctgagtcagagggacttgtcacctacagccgaggacgccgagctctcagatttcgaagagtgcgaagagaccggagagttatttgaggagcccgctccgcaagcattagctacccgtgctcttccatgtcctgcccatgtggtgttcaggtatcaagctggccgggaagatgagttgaccattacggagggggagtggctggaggtcatcgaggagggggatgccgatgagtgggtgaaggctcggaaccagcatggagaggttggattcgttcccgaaaggtaccttaactttcctgacctgagcctaccagagagctctcaggacagtgataacccatgcggtgcagaaccaacggctttccttgcgcaggcactctacagttatacgggacagagcgctgaggaactttcctttcccgaaggagctctgataagactcctgccaagggcccaggacggtgtggatgacggattttggagaggggaatttggaggacgcgtgggcgtgtttcccagtcttctcgtggaagagcttctgggtccacccggaccacctgagctgtctgatcctgagcagatgctccctagcccttcaccaccgtcatttagtcctcccgcacctacatctgtgctggacggcccacctgcccctgtgttgccaggagataaggctctagactttcctgggtttctggacatgatggcacctagactccgtcctatgcgtccaccgcctccccctcctgctaaggctcccgacccgggacacccagatcctctgacgtag

SEQ ID NO: 47657 - DNA, 2055 bp, Artificial Sequence
  Description of Artificial Sequence: Synthetic coding sequence
atgcagaagctggccagccagtacctgaagcgggactggcccggcgtgaaagccgacgatcggaacgactatcggagtatgtaccctgtgtggaagagttttctggagggaactatgcaggttgcacagagtcgtatgaacatttgtgaaaattataagaatttcattagtgagcccgcgaggacagttagaagcttaaaagagcaacaacttaagcggtgcgtggaccaactcaccaaaatccagacagagcttcaggaaaccgtgaaggacttggctaaaggtaaaaaaaaatacttcgagacagagcagatggctcatgcagttagggagaaagctgatatcgaagccaaatctaaactgtctctgttccagtcccgcatcagtctgcagaaggcatccgtaaaacttaaggcacgaaggtccgagtgtaattctaaagccacacatgctcgaaacgattaccttttgacgcttgccgccgccaatgcacatcaggatcggtactatcagacagacctcgtcaacataatgaaggccctagatggcaacgtgtatgatcacttaaaggactatctgatcgccttctctcgaacagaactggagacatgtcaggctgtccagaacacctttcagttcttgcttgagaattcatccaaagtggtaagggattacaacctgcagttattcttgcaggagaacgcagtgttccacaaaccccagccatttcagtttcagccatgtgattcggataccagccgacagctggaatccgaaacagggaccactgaggagcattctctgaacaaggaggcaaggaagtgggccacacgcgtggcaagagaacataagaacatagtccaccagcagagggttctgaacgacttggaatgccatggagctgccgtgtccgaacagagccgggccgagctcgaacagaaaatagacgaagcccgtgagaacattcgtaaggctgaaattatcaagctaaaagcagaagcacggctcgatctgctaaaacagattggagtgtctgtggacacttggcttaagagtgccatgaaccaggtgatggaggagctggagaatgagaggtgggcccgcccccctgccgtcacgagtaacggcacactgcactcgctcaatgctgataccgagagggaggaaggtgaagagttcgaggacaacatggacgttttcgatgactcctcctccagcccttccggtacactcagaaattacccactgacatgcaaagtcgtctactcgtacaaggcctcacagcccgacgagctaaccatcgaggagcacgaggtcttggaagtcatcgaggatggggacatggaagattgggtgaaagctcgcaataaagtaggtcaagtgggatacgtgcccgagaagtacctgcagtttccaacttccaacagcctactctccatgctccagtcactggcggcccttgactcccgcagccatacctccagtaactccaccgaagctgagttggtcagcgggtccctcaatggggatgcctcggtatgcttcgttaaggcactgtacgattatgaaggacagacagatgatgaattatcatttccagagggggccatcatcaggatattgaataaagagaaccaggatgacgatggcttctgggagggtgaattcaatggcaggatcggagtcttccctagtgtcctggttgaggagctttcggcgagcgagaatggcgataccccatggatgcgcgagatacaaattagtccttccccaaaaccgcacgcatctcttccccccttaccgctgtatgatcagcccccctcctccccctatccaagtcctgacaagcgctcaagcttatacttcccccggtcaccgtcggcaaacgagaaatccttgcatgcagaatcccccggtttctcacaggcatcacgccatacacccgaaacctcatacggcaagctaagacccgttcgggcagccccccccccgcccacccaaaatcatagaaggcctgccgagaagatagaggatgtggagatcaccctagtctag

SEQ ID NO: 47658 - DNA, 2223 bp, Artificial Sequence
  Description of Artificial Sequence: Synthetic coding sequence
atgcagccccccccccggaaggtgaaggtgacccaggagctgaagaatattcaggttgaacagatgaccaagctccaagccaaacaccaggctgagtgcgatcttttggaggacatgagaaccttctctcaaaaaaaggctgcaatagagagagagtacgcccaggggatgcaaaagctcgcatctcagtacctgaagcgggattggccaggcgtcaaagcggatgaccggaacgattaccggagtatgtatccggtctggaaaagcttcttagaaggaacgatgcaagtggcacaaagccgcatgaacatttgcgaaaattataaaaacttcattagtgaacctgcccgcacagtccggagcctgaaggagcagcaactcaaacggtgcgtcgaccagctaaccaagatacagaccgaactgcaagaaacagtgaaggacttggctaagggtaaaaaaaagtacttcgaaacagagcagatggcccatgccgttcgtgaaaaggctgacatcgaggccaaatccaagctctccctgttccaaagccggattagtcttcagaaggctagcgtgaaactaaaagcccgccgatctgagtgcaatagcaaggccactcacgcccgcaacgactatctgctgaccctggcagccgcaaacgcccaccaggatagatattaccagacagatctcgttaatatcatgaaggcactcgacggtaatgtctatgaccacctcaaagattaccttatagcgttttcacgcacagaattggaaacgtgtcaggctgttcagaatactttccagttcctgctcgagaacagctctaaggtggtcagggattacaatctgcagctcttccttcaggaaaatgcagtttttcacaaaccacagcccttccaatttcagccttgtgacagcgatacctcacgacaactggaatcagagaccggaactaccgaagagcactcattgaataaggaggctcggaaatgggccacaagagttgccagggaacataaaaatattgtacatcagcagagggttcttaatgatctagagtgtcatggcgctgctgtcagtgagcagtcacgggccgagctggaacaaaagattgacgaggcccgggagaacattcgaaaggccgagattattaagcttaaggccgaggcacgcctcgacctgctaaaacagatcggcgtatctgtggatacatggctcaagagtgccatgaatcaggttatggaggaactcgaaaacgaaagatgggctcgtcccccagctgtcacctctaacggtaccctacacagcctgaacgccgacacagaacgcgaggagggggaggagttcgaagacaatatggacgtttttgacgactcgtcatcttcaccaagtggcaccctgcggaattacccactcacatgcaaagtggtttattcatataaggcctctcaacctgatgaattaaccatcgaagaacacgaagtcctagaggtaattgaggacggagacatggaagactgggtgaaggcgaggaacaaagttggccaggtgggatatgttcccgagaaatatctccagttccccacatccaattcactgctgtccatgctgcagtcattggcagccctcgatagccgtagccatacctctagcaactcaacagaggcagagctcgtgagcggctcactgaacggggacgccagtgtgtgcttcgtcaaagcattatatgactatgaaggccagacagacgatgagctgagctttcccgagggagccattattaggatccttaataaagaaaaccaggacgacgatggtttctgggaaggcgagttcaacggcaggattggcgtgttcccatctgttctcgtggaggaacttagtgcatcagaaaatggtgatactccgtggatgcgagagattcagatttcgccctctcccaaaccccacgcatccctcccgccacttcctctgtacgatcagccaccttcctctccttacccttccccagataagcgctcaagcctgtacttcccccggtcgcccagcgccaacgagaaaagtctgcacgccgaaagccctggatttagccaggccagtaggcacacgccagagacgtcttatggcaagctgcgtcctgtgagagctgctccccctccacctacccaaaaccatcgtagacctgctgagaagatcgaagacgttgagattacactggtttag

SEQ ID NO: 47659 - DNA, 1548 bp, Artificial Sequence
  Description of Artificial Sequence: Synthetic coding sequence
atgcagaagctggccagccagtacctgaagcgggactggcccggcgtgaaggctgatgatagaaatgactatcggtcaatgtatcctgtatggaaatctttcctggaagggacgatgcaggtggctcagtctaggatgaacatctgcgaaaactacaagaatttcatatctgaaccggctagaactgtgcggagcctcaaagaacagcaactaaaaaggtgcgtagaccagcttaccaagatccaaacagagcttcaggagacggttaaggatctggctaaaggcaaaaaaaagtattttgaaacagaacagatggcccacgccgtgagagagaaggccgatattgaagccaaatctaaattaagcctcttccagtctagaatctcactgcagaaagcatccgtgaagcttaaggctcggaggtcggagtgtaatagtaaggccacacatgcccgcaatgactacctcctcacactggcagccgccaacgctcatcaggatcggtactatcagactgatctggtgaatatcatgaaagccctcgatgggaacgtttacgaccatctcaaggactatttgattgcctttagccgcacggaactggaaacatgtcaagccgttcagaacactttccagttcctccttgagaatagctctaaagttgtaagagattataacctccagctcttcctacaagaaaacgcagtttttcacaaaccccaaccttttcagtttcagccatgcgattcagatacctcgcgacagctggaatccgaaaccggtaccacagaagaacattctttgaataaggaagcgagaaaatgggctactagagtagcgagagagcataaaaacattgtgcaccaacagagagttctgaatgacctggaatgtcacggggctgcagtgtctgagcagtctagggccgaattagagcagaagatcgatgaggcaagggaaaacatcagaaaggccgagattattaaactgaaggctgaggccagactggacctcctcaaacagattggtgtttctgtggacacatggctgaagagcgctatgaaccaagtgatggaagaattagagaatgagcggtgggcacggccaccagccgtaacctctaacggcacccttcatagtttgaacgccgatactgaaagggaggagggggaagagtttgaagacaacatggacgtctttgacgatagctcatcgtctccatccggaacattaaggaactaccccctcacatgtaaggtcgtttatagttataaagcatctcagccagatgagttaaccatagaggagcatgaggtgctggaagtaattgaagacggcgatatggaggactgggtcaaggcacgaaataaagtgggccaggtcgggtacgtgcccgagaaatatctacagttccctaccagtaattctctcctctctatgcttcagagtctagccgctctggattctcggagccacacctctagcaacagcactgaagccgagctcgtctcaggctccctgaacggcgacgccagtggaaaggactag

SEQ ID NO: 47660 - DNA, 1854 bp, Artificial Sequence
  Description of Artificial Sequence: Synthetic coding sequence
atggacctgaagaccgccgtgttcaacgccgcccgggacggcaagctgaggcttctgacaaagctcctggcttcaaaaagtaaagaagaggtgagctcattgattagcgaaaagaccaacggtgctactcccttgctgatggcagctagatacggtcacctcgacatggtggagtttctcctggagcagtgttcagcttccatcgaagtgggtggctccgtgaattttgacggagagactattgagggcgcaccgccactgtgggctgctagcgctgccggacacctaaaggtggtgcaatcactccttaaccatggcgcatccgtgaacaacactacactcaccaattctacaccacttcgcgcagcatgtttcgatggtcatctcgaaatcgtaaagtatcttgtcgagcacaaagcagaccttgaggtgtcaaatcgacacgggcacacctgccttatgatctcttgctataagggacataaagaaatcgcccagtacctgctggagaagggcgcagatgtcaatagaaagtccgtaaaagggaatacagccctgcacgactgcgccgagagtggttctttagacataatgaagatgcttctaatgtactgtgccaaaatggaaaaagatggctatgggatgacacccctgctcagcgccagcgttactggacacaccaacatcgtggattttttgacccaccacgcccagacaagcaagacagaaaggatcaatgcacttgaattactcggggccacatttgtagacaagaagcgagacctcctgggggctttaaaatactggaaaaaagcgatgaacatgagatactcagacaggacaaacattatcagcaaaccggtgccacagaccctgatcatggcctacgattacgccaaagaggtgaatagcgccgaggaacttgagggcctcatagccgaccccgacgaaatgaggatgcaggccttgctgatcagggaacgtatccttggtccaagccatcccgatacaagctattatattcggtatcgcggcgccgtgtatgccgattctggcaactttaaaaggtgcataaacctgtggaaatacgctctggacatgcagcagtcaaacctagaccctctgagtcccatgacggcaagttccctgctaagtttcgcagaattgttcagctttatgctccaggaccgagccaaaggactgctggggactactgtaaccttcgacgacctgatgggcatactctgcaagtctgtcttggagattgagcgagccataaagcaaactcagtgtccggccgacccactgcagctcaataaagccctcagtattattttgcatctgatttgcttgctcgagaaggtcccttgtacactggagcaagatcattttaaaaaacaaacaatttaccgtttcctcaaactgcaccccaggggaaaaaataacttctctcccctgcatctcgccgtggataaaaacacgacatgcgtgggtaggtaccctgtatgcaagttcccgagcctgcaggtgaccgcaattttaatcgaatgcggcgccgatgtgaacgtgcgagatagcgacgataattccccattgcacatcgccgctttaaataatcatcccgacatcatgaacctactcattaagtccggagctcacttcgatgctacgaatttgcacaagcagaccgctagcgatctactggatgaaaaagagattgccaagaaccttattcaaccaattaaccacacaacccttcagtgcctggccgcccgtgtaatagtgaaccatagaatttattacaagggccacatccctgaaaagcttgaaacctttgtatctctgcaccgttag

SEQ ID NO: 47661 - DNA, 5433 bp, Artificial Sequence
  Description of Artificial Sequence: Synthetic coding sequence
atggagaccctggacagccagcgggtgcaggaccggctgctggccgctcctggatgctccagccctagcggccaacaggaactcttttcctcgcacgtgatgcaggaggagagtgcaaatgacatggaatgcgagcaattgccggccgaaatactgcgacaggtaaccgtccatagggatcccatctatggcttcggctttgtggccggctcagaaagacccgttgtggtgaggagcgtgcgtcctggtgggccctccgaaaataaactgctggccggtgatcagatcgtggccattaacgaggaggatgtgtccgaagctccccgggaaaggctgattgagctgatcagaagcgcgaaggagtttatcgtgctgaccgtgctgcacacgcatcagagccccaaatcagctttcatctccgcagcaaagaaagcgaaattacgcagcaaccccgtgaaggtgcgtttctccgagcaagtcgccgtcggagagacggatgctaagatgatgaaaaaagaagcgctgttgctcattccgaatgtgctcaaggtattcttagagaacggacagataaagtcctttaccttcgacggtcgcactacagtaaaagacgtgatgctaactctgcaggatagattgagcctgcggttcattgaacatttcgccctggtcctggaatatgcaggccccgagcaaaatcacaagttcttgctgctgcaggataagcagccattagcctacgttgttcaaagaacacattaccacggcatgaagtgtttatttcgtataagcttttttcccaaggatcccgtcgaactgttgaggcgagatcctgccgccttcgaatacttatacatccagtcgagaaatgatgtaatcagggaaaggttcggcatggatcctaagcctgagatgctcctcggcctggccgccctacatatatacattactgtatctgccacacgaccatctcagaagattagtctgaaaaacgttgagaaggagtggggcctggaaccgttcctgcccccctcactgttgcaggtgatcaaggagaagaaccttaggaagagcctttcccaacagctcaaagcacatcagactcaccctagctgtgggacgaagggcagtgcgattcaggccaagctgcagtatctgagaattcttaacgagctccccacattcacgggagtgctgtttaatacggttggccttgatgaaaaacaatcagccacgacactgctggtgggccctcgccatggcataagtcatgtgatcgatcttaaaacgaatctcactaccgtgctctccgaattttccaagattagcaaaatccagctcttcagggagaaccagggggtggcgcgcgtagaaacaagcattatggatgcaaagccgcttgtcctgctgatggagtggcctgaggctactaattttgcttgtctcatcgctggctactgtcgtttgctgctcgacagtagaaagatggttttctcccgtccggcatcacagccgcttccccccccaatgatcaaggcagattatatgcactctgcacatagaccagtcaccggagggcatctgggcaaaaaagagagttcctacgtgggatctgtcggcactagccctcgaaagtcatcacggtgtaccccaccaccagccgattcagaactggtttccttttgctacctgcacatgcgcgaacaaaggaaagagcaggaaagtcgcacagatgttaacgaaaacctaatcttttttgaggagaccaggccacggactaagagcgacccgacgtctaaaagtagcggccagggctacgaggtggtccccgatgactttgacgcggcctccctggaccatgagccctgcgcttctcgtgcccggtcctacaccctggataactcgctgggcgcagaagcacttaatttttactgtgactcttgtaaggccaaactccaggagcagcttggtcctcggaaaggagggaagccaggcagttctagggacaatatcgttgatttaatgagtttgcctcctcccggcagtgaggaagaagaagaggaagaagacgaaaccacttctcttctgcccgctattgcggcacccccgccagggttcagggacaattccagcgatgaggatgacccaaaacgacgtgctgtgcagtcacaggagcagggacggcaccttcggggcttattatatgacgagatcccggtgacgctgatcgactctgtgcagactcggacagttcgggaccacgcacaagaattggacgatgccttggtgtctacccttcaggcgctggaagccctggcagcaagcgaagatgggccccacccaccgccaccccagactgctggcctgatcgtactggccaccattacacctgagagctcactcgacagtggtcatgagacaaattcaagtgagttgactgacatgtcagaaatgatgtctgccatgaaacagcatcagaatacaacttacttccttgcgcaacacctgaataaggatagcctcctggccaggaaagacttgccttttcggattcaaagttgtgcggcccaagccgtactgaccgctccgtatagcctggggcgtccagatcccaacccttctctgcagcccatagctaccggacagagtcccgggccccctggcgcgcgccggaagcttccacaatccgagggtcaagtccagggcgagagaacttactcgctcgccgttcatcccgccctgtctcctcaactcagcgagcaaaagaacctgtcattactgtctccggtgcctgaggacaagggccccggccatacccgcgccggcctcgagatgagcctccgggccgcaacttccagtttaagtgaggagcaagtcagcgaactgcgggacaatctgcctaaggaggtgcgactctctcctaagctgatcctggacccaaaatcctctgttacccccgctatcatttctgctgctttgcaacaggtagttcacaataagtctctggtgactgcaggtggagcactcggcaacccacctagtcgtggagaacggcgcctcgaagccagcatgggacgccccgaggtttctatgatgtcatcctccgcatccaagaatcttaagtttaagattagcccctcagcacctgagacctcgtggaactcccaacaccagctgggcgcagaagtcagttcaagtccccgcgcccccacaggcagcagagccgacagcttacatctatcacagcaggaggattcacttcctgttcagaactttcctcctaagtcttatcttctgcggacatcacgcgaatctgtgggaaaacaagcaacaggcgaggtggccggtaagggtggaccggtaggtggcaaaccgacccttcaaaagcagggtacaatatcttcacaaggtgagaaggcacagctggagtctacccctaaacgcagtaaactcgaagagacttcactggtcccccgcgccacctatcccatggcattgcagtcccccagctgccagtcccgctcccactccccatcctgtcagccacacggacacagtccaagttcacagtccaggggccagtcaccatcctgtcagccccggggccagtctcccctacggtctcaggcggccagtcgtcaagtgagcactatgccctctaggaaacttgagacaactctcaacggcgctcattccacatctgagggtccagctaagcccaagagtagtagagggccattcaggctgagaaacctgttttcggccaccttcccaactaggcaaaaaaaagagacagacgaacggcaggcccaacttcagaaggtaaagcagtatgagctcgagttcttagaagagctgttaaagccgcccagccaaggggaactccccggcactgagtacctgcagccccctgcccccggtagatgcagctgccaactaagatccagccccgtgcagcagggccccggaatgagcagagagcagcgccgctcatgcgattgtaaacgcatttgcagagggggccggcctcaggctactcaaactccagtgcccagtttaaggggcagggaaagagaccgtgtgctgccttcccagagacagcccgaggctggacctggggtcagtttgtcatcacctatcaatgtgcaaaggatccgatcaacttccctcgagtccagggaatgccgcagcgaccccgaatcaggcgtgagttgcctgactacctgcgcatcaggaggtgaatgcctgggagctccgaactacaggaagctaatgcgacgctacagtatcagcgaactggaccagggcgacagagccagcttaacttccgatgtgtatcctcatccacctctgggcatgcttccccgggaggctaaggaggtagaggcgagtctgcccatcgccctggggcccaaatctcggagccttgaatcacccacactgggcgacccatcctacgtgcaggtcgctcccgagacaaagggtcccagacagatggctgtgttttcgcttcccgaggaggtttaccgcaagcccgccgagttagacgaagattcagagtcctctaaatgttgctccatccgctactgtttttactaccggaaatgtgacatggccgacgacgccagcgacggaaaagacgaactgagctacagcattccaatgaagattctgcccgggatgaagctcgacgagcaggttgtgccggtagtcagcaggactctgcaggtgctggacgcagcgacttgtagcagcagttccccagaggcgagccgcacacaggagattgatctgagggtgtcaacgttcgaaggaagccttgccaagatcaatgctctaagggcccacgcctatgggttgcccgacggctttctggccgcgagactagacacgaatgagctgctgacggtgctcagacaatgtgtggccagcccggaagcccgggcccccaaaccatatgtctcccagatctctgagtataaactggaactggctctcaagttcaaagaacttcgcgcctcctgtcgcagagtggccaacgtagataagagcccaacacatatgctggccgccattacaggaagctttcaggtcctgagcagtcttattgagacttttgtccgactggtatttattgtgcgctcggaagctcagagacaagagcttctggctaaagtcgaagaggtggtacgaaattacacatttctgctcagagctgctgaggagtcaaccgcccgcaacttaaatcagcaacagcagcagcagcagcaacagcagcagcagcaacagcagcagcagcagcaacagcagcagcaacaacagcagcaggtggcggcggccgccggtgctgcgacagagcaccccccagggagtcctacctctgccacagtcatgagcacctttactcatagcctgaaaacccttattaagtag

SEQ ID NO: 47662 - DNA, 1650 bp, Artificial Sequence
  Description of Artificial Sequence: Synthetic coding sequence
atggccgtgcccccccggggccggggcatcgaccccgcccggaccaatccagatactttcccccccagtggagcaagatgcatggagccttccccggagcggcctgcgtgctcacagcaggagcctaccttggggatggacgcaatggcctccgagcacagagatgtccttgtgctgctaccatccagagagcagctgagactcgccgtgggggtgaaggcgactggcagagagctgtttcagcaggtgtgcaatgtggccagcatcagggacgcccagttttttggcctgtgtgtcgtgaggaataatgaatacatcttcatggatctggaacaaaaacttagtaaatacttttccaaggactggaagaaggaacggaacgaaggcaatgagaaacccagagctccgtttgtggcatttctgcgggtgcagcactacgttgagaatggccgggtgatatccgatcaccgtgccaggcacctgtactattgccacctgaaagagcgggtcctccgcagccaatgcgcacatagggaagaagcctactttctgctggcagcctgtgcgctgcaggccgacctcggggagcaccgcgaatcagctcacgccggtaggtatttcgagccacacagttattttccacagtggataatcaccaagaggggaatcgactatattctgcgacacatgcccactctgcacagagagagacagggactgagcccaaaagaggcgatgctttgttttatccaggaggcctgcaggctggaggatgtcccagtccacttcttccgcctccataaggacaaaaaggagggccgacctaccgtgattctgggcctagcgctaagaggagtgcatatctaccaaggcaaaaagttggagattcagctcgatgggctgcccgccgctcaaaagctagtttactataccggctgcacctggcggtcccgccaccttctacatctgttgcgagcttcccaccagcttcacctgcgggtgcgcccaaccctccagcagctcagacaaagggaggaggcagaagaaaaacaacattaccgcgagagctacatatccgacgaactcgaacttgacctggcctccaggtctttcccaggttctggcgtatcctcccagcattgccctcattgcctgtctcgccactccgctgactctcacggatcatcatatacatctggcattaaagcgaactcctggctgcgagaaagtcgcgagatgagtgtggacgtgcctctagaagttcatggcctgcacgaaaaggagccttcctcatcacctagaacctcacgttcgcatcctagtaccagaggagatagccaggctacgcggcaggagccatgcacccaggtgagaacacgagggcaatctgcggaggcggtgcatcagattcaggaaatgacagccggagtctctgaagagcagcatagccacggcctcgacgatatgcaattgcatcagttggcacttcatcctgccccaacatcactctctcatacttttcatcgggccctcgattgccgactggcaggaccatgcgagactcgtgctacacttccttccaaacggagttccaactgtctggcacttgatctgttcggtgaagctcccccccaggaattcgtcgtctag

SEQ ID NO: 47663 - DNA, 1446 bp, Artificial Sequence
  Description of Artificial Sequence: Synthetic coding sequence
atggacgacgtgaaggccaccggccgggagctgttccagcaggtgtgcaatgtcgcttccatccgggacgcccagtttttcggactctgtgtggttaggaacaacgaatacattttcatggacttagaacagaagctgtcgaaatatttttcaaaagattggaagaaggagcgcaatgagggaaatgagaagccaagggctcctttcgtggcctttctgagggtgcagcattatgtggaaaacgggcgagtgatctcagatcaccgagcccgacacctctattattgtcaccttaaggagagggttctacggagccaatgcgcgcaccgggaagaagcatacttcttgcttgcggcatgcgctctacaggcagatttgggggagcatagggagtctgcccatgctggtaggtattttgaaccgcacagttacttcccgcaatggatcatcaccaagaggggtatagactacattctgagacacatgccaacactgcaccgcgagcgacagggcctttcgcctaaagaagcaatgctctgtttcatccaagaggcctgccgactggaggacgtaccagtgcatttctttcggctccacaaggacaaaaaagagggacggcccacagtgatcctaggtctggcactgcgcggtgtgcacatctatcaaggcaagaagcttgagatccagctggatgggttaccggctgcacagaaattggtgtattacactggttgcacatggcgcagccgccacctgctccacctcctgcgggcgtcccaccaattacatctcagagtccgcccaacactgcagcaactgcgccagagggaagaggctgaggagaagcagcactatcgggaatcatacattagcgacgagttggaactcgatcttgcgtcccgctcttttcccggcagcggcgtgtccagccagcactgcccacactgcctctcccgccactcagccgatagtcacggaagctcatacacttcaggcattaaggctaactcttggctgcgggagtcccgcgagatgtccgttgacgtccccctagaggtccacggtctccacgagaaggaaccatcatcttcaccccgcacgagtcgctcccacccaagtacccggggcgactctcaagctacaaggcaggagccctgcacccaggtgcgaaccaggggtcagtccgccgaagctgtacaccaaattcaggagatgacagcaggagtcagtgaagagcagcacagccatggcttggacgatatgcagcttcaccagctcgcacttcatccagcacctacgtctcttagccatactttccatagagcgctcgactgtcgcctcgctggtccctgcgagaccagagcaactctcccttctaagagaagctctaattgcttggccctcgacctgttcggagaggcacctccacaggagtttgttgtgtag

SEQ ID NO: 47664 - DNA, 963 bp, Artificial Sequence
  Description of Artificial Sequence: Synthetic coding sequence
atgcccaccctgcaccgggagcggcagggcctgagccccaaggaggcaatgctatgctttatccaggaagcctgtagactggaggacgttccagtgcatttttttagacttcataaggataaaaaggaggggcgaccaacggttattttaggattggccttgaggggtgtgcacatttaccagggaaagaagctggagattcaacttgacggcttacccgctgctcagaagcttgtatattacaccgggtgtacctggcggtctaggcacctcttacatctgttgcgagcgtctcaccaattgcacctgcgcgtgcgccctacactacagcagctgaggcagcgggaggaagctgaagagaagcagcactaccgagaatcctacatctccgacgagctggagttggacctggcttcgcgttcctttcctgggagtggcgtaagtagccagcactgtccccactgtctgtccagacactccgctgattctcacggcagcagttatactagcggaattaaagcaaatagctggctccgcgaatctagagagatgtcagtggacgttccgctggaggttcatggcctccatgaaaaagagccatcatcttcccctagaacaagccgctcacacccttcgacccgcggagattctcaagcaacacggcaggagccgtgcacacaggtgaggacgcggggacaatcagccgaggccgtgcatcagattcaggaaatgacagctggggtgagcgaggaacagcattctcacggactcgacgacatgcagctgcatcaacttgccttgcaccctgctcctacatctttatcacacacatttcacagagctttagattgccgcctggccggcccctgcgagaccagggccacgcttcctagcaagcgcagcagcaactgcctggccctggatctgtttggggaggccccgcctcaagagtttgtggtatag

SEQ ID NO: 47665 - DNA, 1395 bp, Artificial Sequence
  Description of Artificial Sequence: Synthetic coding sequence
atggacggcaccgagggcagcgccggccagcccggccccgccgagcgatctcatcgctcctctgtttccagtgtgggggccagagcggcggatgttctcgtttacctcgcggatgataccgttgtaccattggccgtggagaacctgccttccctctctgcacatgaactccatcgcgctgtgcgagaagtgctccaacttcctgatattgccttggatgtgtttgctttatggctcgtgtcccccctgctggaagtgcagctcaagcctaagcaccagccatataagctgggaagacagtggcctgagctgcttctaaggtttaccagcgcccccgacgacgacgttgccatggacgaaccatttctccagtttagaagaaacgtgttctttccaaagcggcgggaactgcagatccacgacgaggaggtgctgcggctcctctacgaggaggccaagggtaatgtgctggccgccaggtacccttgcgatgtggaagattgcgaagcactgggcgcactggtgtgtcgcgtgcagctggggccgtaccagcctggaagaccggcggcttgtgatctgcgcgaaaagctggactccttcctgccagctcacctgtgtaaacgcggccagagtctctttgcagcgctcagggggaggggtgcccgggcagggcctggagagcagggcctcttaaacgcatataggcaggtgcaggaagtctcaagtgacggaggctgtgaggcagccctgggcacacactatcgagcctaccttctgaaatgccacgagcttcctttctacggctgtgcattctttcacggcgaggtcgacaagcccgcccaagggtttctgcatcggggagggagaaaaccagtgtcagtggctatcagtctcgaaggagtacacgttatcgactctagggaaaagcacgttttactcggcctcagattccaggagctgtcatgggaccacaccagccccgaggaggaggagccgatcctgtggctggagttcgatggagattctgagggcacacccgtgaacaaattgctgaaaatctactccaagcaggcagaactgatgtcaagcctgatcgagtactgcattgagctgtctcaggcggctgaacccgccggcccccaggactccgcgacagggtccccaagcgatccctccagcagtttggctcccgtgcagcgacccaagcttcgtcggcagggctccgtggtgtcatcccggatccagcacctgagtactatcgattacgtcgaggacggtaaagggatacgccgagtaaagcctaagagaacaacgtcatttttctccaggcagctctcccttgggcagggcagctataccgtggtccaaccaggagattccttggagcagggatag

SEQ ID NO: 47666 - DNA, 1293 bp, Artificial Sequence
  Description of Artificial Sequence: Synthetic coding sequence
atggacggcaccgagggcagcgccggccagcccggccccgccgagcggagtcatagatctagcgtgtcatcagtgggggcccgcgcggcagacgtgctggtctatctggctgacgacacagttgtcccattagccgtggagaacttgccctccctctctgcccacgagctgcatagagcagtacgggaggtcctccagctgcctgacattgccctggatgtgtttgctctctggctagtctctccactgctcgacgagccattcctgcagttccggaggaacgtattctttccaaagagacgtgagttacaaattcacgatgaagaggttctgcgtctgctttatgaggaggctaaggggaatgtacttgccgcgcggtacccttgtgacgtggaagattgcgaggctctaggtgcccttgtttgccgcgtacaactcggaccgtaccagcccggcaggccagcggcgtgtgatttgcgcgagaaattggacagtttcctgcccgctcacttgtgtaaacggggccagtccctgtttgcggccttaagaggacggggagcacgagccggcccaggtgagcaaggcctcctgaacgcttacaggcaggtgcaagaggtgtcttctgacggtggctgcgaagcggctctgggaacacattacagggcctatctgctcaaatgccatgaactacccttttatggctgtgcctttttccacggcgaagtcgacaagccagcacaagggttcctccacagaggtgggcgcaaaccggtttctgtggcgatctcactagaaggggtgcatgtaattgatagcagagaaaagcatgtgcttctgggactacggttccaagaactgtcatgggaccacacatcccctgaggaagaagagcctatattgtggctcgagttcgatggcgattccgagggcactccagttaacaagctgctgaagatttacagtaaacaagcggaactcatgtcgtccctgattgaatattgtattgaactttctcaggctgcggaacccgccgggccccaggactccgctaccggctctccatccgaccccagctctagtctggcccccgtccaaaggccaaagttgagaaggcaggggtccgtggttagctccaggattcagcacctctcaacgattgactacgtggaggatggaaaaggtatcagacgcgtcaaaccaaagagaacgacaagcttcttttctcgccagctgagtctgggacagggctcttataccgtggtgcagccaggtgacagtctcgagcagggctag

SEQ ID NO: 47667 - DNA, 273 bp, Artificial Sequence
  Description of Artificial Sequence: Synthetic coding sequence
atggacggcaccgagggcagcgccggccagcccggccccgccgagcggagtcatcgaagctcagtgagcagtgtgggcgctcgggctgccgatgtcctggtttatctggctgatgacaccgttgtgcccctggccgtggaaaacttacccagcctctccgcccatgagctgcacagggccgttcgggaggttctccagttgcccgatattgctcttgacgtgttcgcattgtggctcgtatcaccattactagaagttcagttgaagccttag

SEQ ID NO: 47668 - DNA, 1875 bp, Artificial Sequence
  Description of Artificial Sequence: Synthetic coding sequence
atggccccccggcggctgctgctggtgggcgagggcaacttcagctttgctgcggcgctgagcgaaaccctcgaccagagcactcaactcaccgcaacttgcctccagcggccagccgaactggctcgagatcctctcgcctgggaaaatctgcagtgtctcagggagcggggaatagacgtgagattcggagtggattgcacacaactagctgacgtgttcgagttacacgagcgcgaattcgatcagatctatttcatctttccccattgcggaaggaaggctggggtcgctaaaaatcgggagctactggctaaatttttccaatcatgtgctgacgttctggccgaagagggagaagtgcacgtggccttgtgtagaggacaggggggaacccctgccgacaaaccccagagagaatggcacaatagttggcaggtcgtagccatggccgctctcgggggtctgatcctttcagacgtgtaccccttttcttgtaaggccgtggctggttacaaatgtactggataccgatcacaagacaagtcgttccacgtggaaggagcgttgaaccacatattcactcgctccctcccttttgaaggaagccagccacgcatcttccgcatcaagctgggaaatcagtggtttagcttcccggagcccgaggccttagtgggcaaactcaaccgcgggtttctggaggctccatcctgccaccccataaagacaatcaatgagaagctgatcgcagaactcgggaaggtatttccacttaagaggctcaagtgttcttaccccttgctacctcaggagggcacctctgtcctacccttttggaattgtgatttcctgagcgccgcattctggatctctttgcacgaggacaattctaactctgagtctttgacggggggcacctctcaagacgtggaggactttttggtgtctttctccgaactgtcattactgaaaaatccaggaagggacgggaaagaagaggcctgcgaaggcacctgcggacaggcaaaaatatgtcttcggccttccctgctggtgcacgtgcaggatgtgattgaagtgcccgatttcctcagcgggagtctacacatcttgtcaggccccgtcttccaaaagtgtcatatactgccttttacaatgccggccttccatgaaactctgttcatactcggtgtgaaccaaaatttgaaagacgggtgcctccagagtttactcgaccacctaaagggaattttggattcgctgttgactcagacactaccggagtcatccaagctaagttcccttgtaaaattcgtgctccaatctaacggtaaggactacatgatccgggtgaaaacacataactttagcccagactgcacagaggacctcataatcggctctgtgattacctccgcaacttcagttattcacaaagaccagtgctttgtgttcgtaagtatgaatctcgatctcctggctatgttggtgtggtgtatctccgactggcggatgctgtggactttcgataacagatttctgaagaatttcgtgcccgggaagatcgaacccttcaaatcccatagcttgtaccctccctgttatgtccatgatgtaagtttctggatagaccaaaagaaggggttcgacgaactggaattccacactgttgctcgagccgtgtcccaagacacaatcataagcattcagttcttgtcgagattccagcaccccaagacgcagcaggtgagcttgtgctaccggctgacctaccaaacatgcgataaggcactgacacagcagcaggtggcttcgatgcaaagccaattcaggaaagagattcagcaacacttgtacgtaattccccgatag

SEQ ID NO: 47669 - DNA, 1428 bp, Artificial Sequence
  Description of Artificial Sequence: Synthetic coding sequence
atggccgccctgggcggcctgatcctgagcgacgtgtaccccttcagctgcaaagctgttgctggctacaaatgcacagggtataggtcacaggataagtcgtttcacgtggaaggggccttgaaccacatattcactcgatctctgcccttcgagggcagtcagccacggatctttcggattaagctgggcaatcagtggttttctttcccagagcccgaagctttagtgggcaagttgaacagaggattcttggaggctccaagctgccaccctataaaaacaataaatgagaagctgatagcggagttgggtaaagtttttccgctaaaacgcctcaaatgttcttaccctttgttgccacaggagggtacatctgtcctgccattttggaactgtgatttcctatcagccgccttctggatatcactacacgaggataatagtaactcagaatcactgacaggagggaccagccaggatgtcgaagactttttggtttcattctccgaattatctctgctgaagaatccgggaagggacgggaaggaagaggcatgcgaaggcacctgtggccaagccaagatctgcctgcgcccaagtctgctcgtgcatgttcaagatgtcattgaggtgcctgacttcctgtcagggtcactgcatatacttagcggccctgtcttccagaagtgtcacattcttccctttaccatgcctgcctttcatgagaccctcttcatcctgggcgtgaatcagaatctgaaggatgggtgcctgcagagtctgctcgatcatctgaaaggtattctggactctttgctcactcagaccctgcctgagagctctaaattaagcagccttgtaaagttcgtattgcaatccaacgggaaagactatatgattcgcgttaaaactcacaatttttcccccgactgtaccgaggatctgattatcggatccgtaatcacctccgcaacaagcgtaatacacaaggaccagtgcttcgtatttgtgagcatgaatttggacttgctggcaatgctggtttggtgtatctccgactggagaatgctgtggaccttcgacaatagatttctgaagaatttcgtacccggaaagatcgagcctttcaagagccattcactttacccgccgtgttacgtccacgacgtttccttttggatcgaccaaaaaaagggattcgatgagcttgagttccacacagtggcaagggcggtgtctcaggacacaatcatcagtatccagttcttgtcacgtttccagcaccccaaaacgcagcaggtctccctttgttaccgcctgacctaccaaacctgcgacaaggctttaactcaacagcaggtggcgtccatgcagtcgcagtttcggaaggaaatccaacagcacctgtacgtgataccccgctag

SEQ ID NO: 47670 - DNA, 1656 bp, Artificial Sequence
  Description of Artificial Sequence: Synthetic coding sequence
atgagcggcggcgagcagaagcccgagcggtactacgtgggcgtggacgttggtaccggctctgtgcgagcagcactggttgatcaaagcggggtcctcctcgcatttgcagaccaacctattaagaattgggagcctcagtttaaccaccacgagcaaagttctgaagatatctgggcagcatgctgtgtagtcaccaagaaggtggtgcagggcatagatctgaaccagatacgcggcctgggcttcgatgctacctgttccctggttgtccttgataagcagttccacccactgcccgttaaccaagaaggtgatagccataggaatgtcatcatgtggctggaccaccgggcagtgagtcaggtgaataggattaatgagaccaagcactccgtgctgcagtatgttggcggcgtgatgagcgtggagatgcaggcccccaagctcctttggttgaaagaaaatttgcgcgagatctgttgggataaagccgggcacttctttgacttgcctgactttctcagctggaaagcaactggggtcactgccagatctctctgtagtctggtgtgcaagtggacttactctgcagaaaaagggtgggacgatagcttctggaaaatgattggcttggaagatttcgtggctgataattattccaagatcggcaaccaggtcttacctcccggggcctccctgggaaatggtctgactcccgaggccgccagagatctgggcttgctacccgggattgccgtggctgcctcactcattgatgcacacgcaggagggctgggggtcatcggcgcggacgtgagaggccatgggctgatctgcgaggggcagcccgtaacaagcagactggcggtcatttgcggaacaagctcctgtcacatgggtatttccaaagacccaatatttgttcccggagtatggggaccatacttctcagccatggtccccggtttctggttgaatgagggaggccagagtgtaacaggaaaacttatcgatcacatggtgcagggacacgccgccttccccgagcttcaagtaaaagctaccgctcgatgccagagcatatacgcctatcttaattctcatctagacctgatcaagaaagcgcagcccgtgggctttttgacggtggatttgcatgtgtggcccgattttcatggcaatagaagtcccctcgccgaccttacactgaaagggatggtaactggcttgaagctgtcccaggacctggacgacttggctattttgtaccttgctactgtacaagctatcgctctgggtactcgattcattatcgaagccatggaggctgccggtcactccattagcactctgttcctctgcggaggtctgagtaagaaccctctgtttgtgcagatgcacgccgacattaccggcatgcctgtagtattgtctcaagaggtggagtcagtccttgtgggagcagccgtgctcggggcttgtgcgagcggcgatttcgccagcgtgcaggaggcgatggcaaagatgagcaaggtaggtaaggttgtcttcccgaggctgcaggataagaagtattatgataaaaaatatcaggtgttcctgaaactggtggagcaccaaaaagaatatttagctattatgaacgatgactag

SEQ ID NO: 47671 - DNA, 558 bp, Artificial Sequence
  Description of Artificial Sequence: Synthetic coding sequence
atgagcggcggcgagcagaagcccgagcggtactacgtgggcgtggacgtcggaactggctctgtgagagcggccttagttgaccaaagtggggtcctgttggctttcgcggatcagcccattaaaaattgggagccacagtttaatcaccatgagcagagctctgaggacatctgggccgcctgttgtgtggtgaccaagaaggtagtacaggggatcgatttaaatcagattcgaggccttggcttcgacgctacttgctccctggtggtgctggataaacagttccacccgctgccggtgaaccaggaaggcgatagccacagaaacgttattatgtggctcgatcacagggcagtgagccaggtgaatagaattaatgaaaccaaacactctgtgctgcagtacgtgggtggtgtaatgagtgtggaaatgcaggcacccaaactgctgtggctgaaggagaacctccgtgagatatgctgggacaaggccgggcatttttttgatctgccggacttcttaagttggaaagccaccggagtcacggctaggtag

SEQ ID NO: 47672 - DNA, 1392 bp, Artificial Sequence
  Description of Artificial Sequence: Synthetic coding sequence
atgagcggcggcgagcagaagcccgagcggtactacgtgggcgtggatgtcgggactggctcggtgcgggccgcattggtggatcaaagtggcgtattgttagctttcgcagaccagcccatcaagaactgggaaccacagtttaatcaccacgagcagtccagcgaggacatttgggctgcatgctgtgtcgtgaccaagaatctaagggagatctgctgggacaaagcgggccactttttcgacttgcccgattttcttagttggaaggctacaggtgttacagccaggtctctgtgttctttggtgtgcaagtggacgtacagcgccgaaaaaggctgggatgactcattctggaagatgataggactcgaggactttgtagctgacaattactctaagatcgggaatcaggtcctgccccctggggcctcactgggaaacgggttgacccctgaggccgctcgggacttggggcttttacctgggattgcggttgccgcctcactgatcgatgctcacgcaggtgggctcggggtgataggcgcagatgtgcgtggtcatggtctgatttgcgagggtcaacctgtcacatcaaggcttgctgtgatttgcggaaccagcagctgtcatatggggatttccaaggatccaatttttgtgcctggcgtttggggcccatacttctctgccatggtccctggattctggctcaacgagggcgggcagtctgttacggggaaattgattgaccatatggtgcaggggcatgccgccttcccagagctgcaggtgaaggccactgcccgttgccagtcgatatatgcttatctaaacagccacctagacttgattaagaaagcacagccagtgggattcttgaccgtggacctgcatgtctggcccgattttcatggcaatcggtcacccctggctgacctcacgctcaagggcatggtgaccggtctgaagctaagccaggatcttgacgatctagcgattctgtacctggctactgtgcaggctatcgccctgggcacgcgattcatcattgaggcaatggaggccgccggacacagtattagcacactcttcctgtgcggggggctgtccaagaatccactcttcgttcagatgcatgccgatataacaggaatgcccgtggtgttgtcacaagaggtggagtcagtgttggttggggccgccgttctaggcgcgtgtgcgtcaggagactttgcgagcgtgcaagaagccatggcgaagatgtccaaggttgggaaggtggtctttcctcgcctgcaggataagaagtactatgacaaaaagtaccaggtatttctaaagctggtggagcatcagaaagaatacttggctattatgaacgacgattag

SEQ ID NO: 47673 - DNA, 1728 bp, Artificial Sequence
  Description of Artificial Sequence: Synthetic coding sequence
atgagcggcggcgagcagaagcccgagcggtactacgtgggcgtggatgtgggtactgggtcggttagagccgctctggtagatcagagcggagtgctgctggcatttgcggaccagccaattaagaactgggagccccagtttaaccatcacgaacaaagcagcgaagatatctgggccgcctgttgtgtcgtcaccaagaaagtggtgcagggcattgatctgaatcagattcgggggctcggatttgacgctacgtgcagcctagttgtgttggataagcagttccaccctctgcccgtgaaccaggagggggacagtcaccggaatgtgatcatgtggctggaccacagagccgtcagccaggtcaacaggatcaatgaaaccaaacattctgttctgcagtacgttgggggggtgatgtccgtggaaatgcaggcacctaaactactatggctgaaggagaatctgcgcgagatttgctgggataaggctggccacttcttcgacttgcctgatttcctgagctggaaggccacaggagtgacggcacggtcactgtgctctcttgtatgtaagtggacttattctgccgagaagggatgggatgacagtttttggaaaatgattggattggaggactttgtcgccgacaactactccaaaatcggtaatcaagtgctcccgccgggagcctcactagggaatggactcacccccgaggctgcacgagacctgggactacttcctgggatcgcggttgcagccagtttgattgatgcacatgcaggaggactcggggtcattggggccgatgttagggggcatggattgatttgtgagggccagccggtgaccagcagactcgctgtcatttgcggaactagttcctgtcacatgggaatctccaaggatccgatctttgtgcccggggtctggggaccatacttcagcgccatggtccccgggttttggcttaatgaggggggtcagagcgtgactgggaagcttatcgatcatatggtccagggtcatgctgccttccctgagctgcaggtgaaggcaacagcccgctgccagtccatatacgcctatctgaattctcatctcgatctgattaagaaagcccaaccagtggggttcctcactgtggacctgcatgtctggcctgacttccatggcaataggtcccctctcgcagatcttactctgaagggtatgcgaaccactggctatctatatattccagcactggcagccctgcactctccgagttcccttttgtccccgcaggtgacaggcctgaagctttctcaagacctggacgacctcgccatcctgtatctggctaccgtacaggctattgcactgggaacaaggtttatcatcgaagctatggaggcagccggacactctatttccactctcttcctttgcgggggcctgtctaagaaccccttattcgtccagatgcacgccgacattactgggatgcccgtggtgctttcccaggaagtggaatccgttttagttggggctgcagtgcttggcgcctgcgcttctggcgactttgccagcgtccaggaggctatggctaaaatgtcaaaggttggcaaagtggtgtttccccgtttgcaggacaaaaaatactacgacaaaaagtaccaggtcttcctcaagctggtcgaacaccaaaaagagtacttggctattatgaacgacgattag

SEQ ID NO: 47674 - DNA, 3432 bp, Artificial Sequence
  Description of Artificial Sequence: Synthetic coding sequence
atgcacgtgatgaactgcgtgagcctggtgagcgacaaggagaacgggaatatcgcaacagcgcccggctttatgattggacagaccccaccccccgcaccacccccccccccaccaccccctcctcctagccccccctgtagttgttcaagagaggaatgcccttctagccctcccccccctccacctccacccttgcctggggaacctccaattccgcccccgccccctgggttgccaccaaccacccacatgaacggttattctcacttagggaagaaaaagcggatgcgatcgtttttttggaagacaattcccgaagagcaggtgagagggaaaacgaacatctggacgcttgctgccaggcaggaacaccactaccaaatagacactaagactatcgaagagttattcggtcagcaggaggataccactaaatcttctttaccacggcgcggtagaacattgaactcctcttttagagaagcccgcgaagaaatcaccattttagacgccaagcgcagcatgaatatcgggatctttctaaaacagttcaaaaaaagccctaggagtatcgttgaggacattcaccagggcaaaagtgaacattatggtagtgagacacttagagaattccttaagttcttgcccgagagtgaagaagttaaaaagctaaaagcattttccggagacgtatccaaactgagcttggcagacagtttcttgtacggtctcatccaggtccctaattactccttacggattgaagccatggttcttaaaaaagagttccttccttcctgttcctccctgtacaccgatataaccgtactgcgaacggccatcaaggagctgatgtcatgtgaagaactccattctatcttgcacttagtcctgcaggcagggaacatcatgaacgcagggggatatgccggaaatgccgttggcttcaagctgagcagcctcctgaagcttgccgatactaaagctaataagccgggaatgaatctgctccatttcgtggcacaggaggctcagaagaaggacactatccttttgaactttagcgagaaactccaccatgttcaaaagacagcaaggttgtccctcgagaacaccgaagccgaattacatctgctgttcgtgagaactaagagcctgaaagaaaatattcagcgcgatggagaactatgtcaacagatggaggacttcctccagtttgctatcgagaagctgagggagctggagtgttggaagcaggagctgcaagatgaggcctacacgctcatcgatttcttttgcgaggataagaagactatgaaattggatgagtgctttcagatcttcagggatttctgtaccaaatttaacaaggccgtaaaagacaaccatgacagggaagctcaggaactccgacagttgcagagacttaaagagcaagagcagaagcagaggagctgggcaaccggcgagttgggcgccttcggcagatctagttcagagaacgatgtggagctgctgaccaagaagggtgcagaggggctgctgccgttcctgcacccacgacctatcagcccatccagcccatcttatcgcccccccaacaccagacgttcacgcttgagcctggggcccagcgctgaccgggaactcttaactttcctcgaatcaagcacaggcagccccgaggaacccaacaaatttcatagcttaccacgctcctcgccaaggcaggcgcgcccaactatagcatgcctagagcccgccgaggtaaggcaccaggactcatcatttgcccacaagcctcaggcctctggtgggcaggaagaagctcccaatccgccttctgcacaggcccatcagttagcagcagcccagcctgagaaccacgcttctgcatttcctcgcgctcgacggcagggtgtcagcgtactgcggaaacgttactctgaacctgtctcactgggatccgcccagtccccacccctgagtcctctcgcgctgggaatcaaggaacacgagctggtgactggactggcccaatttaatttgcaaggcagtcagggcatggaagagaccagccaactaacgctctctgattttagcccaatggaactggagtcggtgggacacagagggccacaatctttgtcagcctctagttcctcattaactcctatgggcagggacgccctgggtagcttgtccccagctcttgaggatggcaaagccgccccggacgagcctggatcagcagctctaggaagcgtaggttcttccgatccagagaacaaagaccctcgccctcttttctgcatttccgatactaccgactgttctctcaccctggactgctcggagggaacagattcacgacctcgcgggggggacccagaggagggcggggagggagacgggtctatgtctagcggcgtaggggaaatgggggactcgcaggtcagtagtaacccaacaagctcaccgccaggagaggcacctgctcccgtgtcggttgattcagaaccaagctgcaagggcgggctgcccagggacaagcctacaaagaggaaggacgtggtggcccccaagagagggtcccttaaagaggctagccctggtgcctcaaaaccaggctcggctaggagatcacaaggcgctgtggctaaatccgtaaggacgctgactgcctcagagaatgagtcgatgagaaaggtcatgcctatcaccaaaagttccaggggtgcaggatggaggcgtcctgagctatcatcccggggcccttcccagaaccccccttccagcactgatactgtgtggtcacgtcaaaactccgtcagaagggcttctactggagcagaagaacagcgcttgccccgtgggagttccggctcatcatcaactcgcccagggcgcgatgtgcccttacagccccgtgggtcattcaagaaaccatctgctaagcccctgaggaacctcccccgccagaaacctgaagaaaacaaaacatgcagggcgcactctgaaggaccggagtctcccaaggaggaacccaagacaccttccgtcccttcggttccacacgagctgccaagggttccaagcttcgccaggaacaccgtggccagttcaagccggtcaatgaggactgatttgccccccgtagcaaaagcccctgggattacccgcacggtgtcacagagacagttgcgggtgaagggcgatcccgaggatgctgcaccgaaagattcaagtaccttaaggagagccagttcggcacgcgcccccaagaagaggcctgaatcagccgagggaccaagcgccaatactgaggctcctctgaaagccagaggagccggtgagcgcgcgtccctaagaagaaaggactcctctcggactacattaggcaggatattaaatcctctgaggaaatag

SEQ ID NO: 47675 - DNA, 3432 bp, Artificial Sequence
  Description of Artificial Sequence: Synthetic coding sequence
atgcacgtgatgaactgcgtgagcctggtgagcgacaaggagaacggtaacatcgccaccgcgcctggattcatgatcggccagacccccccccccgcccccccccctcccccgcctcctcccccaccatcgccgccttgcagctgcagccgggaggagtgcccttcctcaccccccccgccaccaccaccccctctaccaggcgaaccacccattcctccccctcccccaggactgccacctaccactcatatgaatggctattctcatctagggaagaaaaagcggatgaggtcatttttctggaagactatacctgaagagcaggtgaggggaaaaaccaacatttggacgctcgctgcgaggcaggagcatcactatcagattgacaccaaaacaatagaggaactcttcggtcagcaagaagatactactaaatccagtctgcctcggcgagggcgtacgctcaacagctcctttagggaggcacgtgaggagattaccattctcgacgctaagaggtcgatgaacatcggtatcttcctgaaacaattcaaaaaatccccccggagtatcgtggaggacattcatcaagggaaaagtgaacattacggaagcgaaaccctacgcgaattcctgaaattcctgccggagagcgaggaggtcaaaaagcttaaagctttctccggagacgtgtcgaaactctccctggctgacagcttcctgtatggactcatacaggtccctaactatagccttcggattgaggctatggttctgaagaaggagtttctgccctcatgtagcagcctttataccgatattacggtcctgcgtaccgccattaaagagttaatgagctgcgaggaactccatagtatcctgcatctggtcttgcaagctggcaatatcatgaacgccggggggtacgccggcaacgccgtcggctttaagctgtcatcactcctgaaacttgcggacactaaggctaataagccgggtatgaaccttctgcacttcgtcgcccaggaggctcagaagaaggatacgattcttcttaactttagtgagaaactgcatcacgtgcagaagacagcccgactcagccttgaaaataccgaagcagagctacacctgctctttgtgcgaactaaatcattgaaggaaaacatccagcgcgacggtgagttgtgccagcagatggaggattttttgcagttcgctattgagaagctgcgcgagctagaatgctggaagcaagagctgcaagacgaggcatatactctgattgacttcttctgtgaagacaagaagactatgaagctcgatgagtgcttccaaattttccgtgacttctgcactaagttcaacaaagctgtgaaggacaatcacgatagggaggcccaggaattaagacagctgcagaggttaaaagagcaggagcagaagcagaggagctgggctacgggcgaattaggcgcattcgggcgctcatcgtccgagaacgatgtggaactcctgacaaaaaagggagccgagggcttgttgccgttccttcacccaaggcccattagcccctcatcaccatcctacagacctcccaacacacggcgctctcgtttatcactgggcccatcagcagatcgtgaactgcttaccttcctagagtcctctacaggctcacccgaagagccaaacaaattccattccctgccccgctcttctcccaggcaggcaaggcctaccatcgcttgtctggaaccagcggaagtgagacaccaggattcttcattcgcccacaagccccaggcttctggtggccaggaagaggcaccaaatcctccttctgctcaggctcaccaacttgctgccgctcagcccgagaatcatgctagtgcctttcctcgtgctcgtcgacagggcgtatctgtgctaaggaaacgctacagtgagcctgtgtcccttggttctgcacagtcgcctccactgtcacccctggctctgggtatcaaagagcacgagctcgttacaggccttgcccagtttaatctgcagggctcccagggcatggaagagacaagccagctgaccttgtcggatttctcccccatggagctggagtccgttgggcatcgcggaccacagtccctaagcgcctctagttcctctctcacaccaatgggtcgcgacgctctcggtagtctctctcctgcactcgaggatggaaaggctgccccagatgagcccggctccgcagcccttggctccgttggatcaagcgacccagagaataaagacccccgtcccctgttctgcatcagcgacacaacggattgtagcctcactttagactgttcagaaggaactgacagcagacctcgtgggggcgacccagaagaaggcggggaaggcgacggaagtatgagcagtggagtcggcgaaatgggtgactcacaggtcagttcaaaccccacatcaagcccacctggtgaggctccggcacctgtctctgtcgacagcgagccctcctgcaagggcggactgcctcgcgacaaacctaccaagaggaaggatgtggttgctcctaagcgcggcagcttaaaagaagcctctcccggcgccagcaagcccggatctgctcggaggagccagggagcagttgcaaagagcgtgagaaccctcaccgcaagtgagaacgagtccatgagaaaagtcatgccaatcaccaagtcctcgcgcggcgccggttggcggagaccagagctttccagcagaggcccttcccagaatcctcctagctcaactgacacagtttggagtaggcagaactctgtcagaagagcatctactggggctgaggagcaacggttgccgcgcggtagttcagggtccagttccactcgccctggccgggatgttccactgcagcctcgcggttccttcaagaagccttctgccaaacctctcaggaacctgccgcgacagaagccagaggagaataaaacctgtcgagcccattctgaaggacctgagtcccctaaggaagagcctaaaactcccagtgttccatcagtaccccatgagttgccacgggtgccaagtttcgccagaaatacggtcgcatcgtcgtcacggtctatgcgcacagatctcccccctgtcgctaaggctccaggcataaccaggacagtgagccagagacagttgcgggttaagggcgaccccgaggacgcagccccaaaggacagctcgacactcaggcgtgcttcgtcagctagagccccgaaaaagaggccagagagcgcagaaggaccctcagcaaacaccgaagctcccctcaaggcccgtggagctggggagcgtgcctcgctgcggcgcaaagactctagcaggaccacattgggccgaatcctgaaccccctccggaaatag

SEQ ID NO: 47676 - DNA, 2250 bp, Artificial Sequence
  Description of Artificial Sequence: Synthetic coding sequence
atggaggaggagagcggcgaggagctgggcctggaccggagcaccccaaaggattttcacttttatcacatggacctatatgactccgaggaccgactgcatctttttcccgaggaaaacacacgcatgcggaaagtggtacaagcggaaatggcaaacgagtcaagaggggctggtgatggcaaagcacagagagacctccaggaggaggtggatgagctcgtgcacctgtacggcctggaagacgatcacgaacttggtgacgaattcgtggatgagaatattccgcggacaggcgtgagcgaatatcccccctacatgatgaaaagacgagacccagccagggagcagcgcgattggcggttgtccggtgaggccgcagaggccgaggacctggggttcggcgggtgggggtccgccggacagtgtcaggatctgagagaggcctaccgttatacccatggtcgagcttctgaggagtatgagtgttacgtcatccctgaagaagaagatgaagaggaggccgccgacgtgttctgcgtcacctgtaaaactccgatccgcgcctttcagaaggtgtttgatgagcataaagaacatgaagtcattccgctgaacgaggcgttagagagtgccaaggacgaaatccacaagaatatgtataaactggaaaaacagataatcgagatggagaacttcgcaaatcacttggaggaagtgtttattactgtcgaggaaaactttggcaagcaggaacagaattttgaatctcactacaacgaaattctggagacactcgcgcagaaatacgaggaaaaaattcaggcacttggggaaaagaaaaaagagaaacttgaggccctgtacggacagctggtgtcctgtggagagaacttagacacctgtaaagagttaatggaaacaatagaagagatgtgccacgaggaaaaagtagactttataaaggatgcggtcgctatggccgatagactcggcaagtttttgaagaccaagactgatgtagaaatctctgcccagcccgagttcgaagaccaaacactggatttctccgacgtggaacagctcatgggtagcatcaacacaataccagccccttctgctcccgtgatcaatcctcaagtcccaaactcagcaaccggaagcagcgtgcgcgtttgttggtcattgtactccgatgacaccgtggagtcatatcaactttcctaccgccctgtgcaggatagcagccccggcacagatcaggcagagttcactgttaccgtgaaggagacttattgctccgtgactaatttagtgccaaatacacaatacgagttctgggtgaccgctcataacagggccggcccctcaccgtcatccgaacgggccgtttatatgactgccccgagcccccccatcataaagacaaaagaaatcaggtcttgcgaagaggccgttctcatctgctgggaaagcgggaacctcaaccctgttgattcatacaccgtcgagctgacgcaggccgagtcacctgaggccagcggagtcacagaaagcgtggttggtatccctacatgcgaatcggtggtacaactgcagccggggcgcagttatattatttacgttagggccctgaacatggggggcccctccgttagaagcgaacccgccactgtgcacaccataggttcttatttccgactgaataaagacacctgtcatccatggctgaccattagcgaagacggtctgacagcggttcgatctgagagacgcacccctgccagggaactttcacctagtgatacacattttaccaggtgcgtcgcagtcatgggaaatctcatccctgtacgcggccaccattattgggaggtggaagtcgatgaacatctggattacagggtaggtgtggctttcgcagacgtgcgaaaacaggaggacttgggcgcaaattgcctcagttggtgtatgcgccacacattcgccagcagcaggcataagtacgaattcttacataaccgtaccacgccagacattcgtattacggtgccacctaaaaagattggtattctgctggactatgaacattctaaactgtccttcttcaacgtagacttaagccagcatttgtacaccttctcatgccagctccacgaatttgtgcatccctgtttcagtctggaaaagccgggctgtcttaaggtgcacaatggaattagtatgcctaagcatgttaccttctattag

SEQ ID NO: 47677 - DNA, 306 bp, Artificial Sequence
  Description of Artificial Sequence: Synthetic coding sequence
atggaggaggagagcggcgaggagctgggcctggaccggagcacccctaaggacttccatttctaccatatggacttgtacgattctgaagaccgattacatctgtttccagaagagaatacccggatgaggaaggtggtacaggccgagatggccaatgaaagccggggtgctggcgatgggaaggctcagcgggacctgcaggaggaggtagacgagctggtccacctatacggcctggaggacgaccatgaactcggcgatgaattcgttgacgagaacatcccccgcaccggggtatcttag

SEQ ID NO: 47678 - DNA, 975 bp, Artificial Sequence
  Description of Artificial Sequence: Synthetic coding sequence
atggccagcgaggccctgcaccaggtgggcgacggcgaggaggccgttctgaagaaggaaaacttcaacatgatgaatgcactagatcagctgcccaaaccattcagtaatccaaaaagtatgaaccggaccgtcaccaccaagggtttaccacttgcctctaaaggaaacctggtcaactttttggaggatgataccataaacctgctgaagcctctaccggtcgaggacagcgactgcagttctgacgaaaccagcatttccgccttttcgtctacccttctaaatcctatcaaactggcagtcacacagcctaactcttcatttttcgccgggatgttggagggtgagctgaacaaactgtctttcagcccaatggccaaaaatgcagagaatgaggaccttgccctaggaccatgtccttgtcctagcaaaagtcagatggccaccaggggcctgttagatttggataatccagagcttgagacagaaacatcatcaactcatagcgaaagtagcgttgtggtggaccttcccgacaccccatttattttcgagcacactgttaacaattccaccgccgtcatttcgtggacctatgcccttggtaagcagccagtgagtttctaccagctgctgctccaagaggtcgcaaagacccaagagaacgagctcccagaggcaaagaacagaccttggatctttaacaagatccttgggacaactgtcaagctgatggaactgaagcccaacacctgttactgtctgagcgtccgggccgccaatactgctggggtaggtaagtggtgtaagccgtataaattcgcgactctggccacagatttttctagtttcccagaaaactatccaatccaaattaccgtgcgaagaaaagagccccgccaaaagatcgtgtctattggacctgaggagatgagacgactggaggacttggagtacctattcccatgttag

SEQ ID NO: 47679 - DNA, 1383 bp, Artificial Sequence
  Description of Artificial Sequence: Synthetic coding sequence
atgttcgagaagtaccccggcaagatggagggcctgttccggcacaacccttacacagcttttcccccagccgtgccagggcttccccctggactgccaccagctgtgtcctttggatcacttcaaggtgcgtttcaaccaaagagcacaaatcccgaactcccacccaggctcggccccgtgcctagcgggctttcacaaaaggggacacaaataccagatcattttcggcccccccttcgaaagcccggcaaatggtgtgccatgcacgtgagagtggcatacatgatcctaaggcatcaggaaaagatgaaaggtgactctcataagctcgatttccggaatgacctcctgccttgcctaccaggaccctatggtgccctgccaccaggacaggaattatctcaccctgccagcctgttcaccgcaacaggcgctgtccacgcagccgccaatccatttaccgccgcccccggtgcacatggcccctttttgagcccctctactcatatcgatccttttgggcgccctacttcctttgcgtcgttagccgcgctaagtaacggagcctttggtggcctgggcagtcccactttcaactccggagccgtgttcgctcagaaggagagcccaggcgccccgcctgcattcgcaagcccaccggacccatggggtcgccttcaccggtcgcccctaaccttccctgcctgggtgcggcctcctgaggccgcccggactccagggtccgacaaagagagacccgtggagcgccgggaaccttccatcaccaaagaggaaaaggaccgcgacctacctttttcccgcccccagctgagagtctctccggcaacacctaaagcaagggccggggaagaggggccccggcccactaaagagtccgtgagagtcaaggaggagagaaaagaggaggccgccgcagctgccgcagcggctgcggccgctgcagctgcagccgccgccgctgctactggtccccagggccttcacttgttattcgaaaggcccagaccaccaccgtttctggggccctccccaccagatagatgcgcgggctttcttgaacctacttggctcgcggccccgcctcggcttgcccgcccaccccgcttttacgaagcgggcgaggaactcactggtccaggtgccgtggcggctgccaggctgtacggacttgaaccagcccatccacttctgtatagtaggcttgccccacctccacctccggccgccgctccagggacccctcatctgttatccaaaaccccacctggtgctttactcggtgcccctccacccttagtccctgccccccgaccctcctcgccacctagggggcctgggccagctcgtgcagatagatag

SEQ ID NO: 47680 - DNA, 1200 bp, Artificial Sequence
  Description of Artificial Sequence: Synthetic coding sequence
atgcacgtgcgggtggcctacatgatcctgcggcaccaggagaagatgaaaggggacagccataaactggactttcgcaatgatcttctgccctgcctgcctggaccttatggcgctctgccacccggccaggaactcagccatccagcttcccttttcaccgctaccggtgctgtgcatgccgcggctaatcccttcaccgcggcgccaggtgcccatggccctttcctgtctccgtccacgcatatcgaccctttcgggaggcctacctcatttgccagtttggctgctctaagcaacggagccttcggcggactcgggagccccaccttcaactccggagcagtgtttgcccagaaagagtctcctggtgcgccacccgcatttgccagcccccccgacccctggggccggcttcacagaagcccccttacctttcccgcttgggtgagaccccccgaagccgcacgaactccggggagtgacaaagaacggcccgtggagcgccgcgaaccctcgattacgaaggaagagaaagatcgggacctacccttctcacgcccccagctcagggtgtcgccagctaccccgaaggctcgcgcaggagaggagggccctcgtcccacaaaagagagcgtgcgcgtgaaggaggagcggaaggaggaagcagctgccgctgccgccgcagccgctgccgcagcggctgccgccgcagccgcagccaccggaccccaaggcttacacctcctgtttgagcgcccacgaccaccacccttcctaggaccttctccacctgaccggtgcgcgggctttctggagcctacttggcttgcggcgcccccccggctagcccgtccaccacgcttttacgaggcaggtgaagaacttacagggcctggagctgttgcggcagccagactctatggcctggaacctgcccacccgctcctgtattcacggcttgccccacctccgcccccggctgccgcaccaggcaccccacacctgctctctaaaacattttgcactttcctccagggatgcccgtctcagcaattccccagctggctgattaagccctcagattggtgctgtgtcccatctctttggcccttgtgtggcgagagagggttacaaggggaggagccaggaagggactctcaggcatctccttgggagggcggtgcctcacgtcgctag

SEQ ID NO: 47681 - DNA, 2919 bp, Artificial Sequence
  Description of Artificial Sequence: Synthetic coding sequence
atggaggccaaggaggaggaggtgatcgacggcttcgccatcgcctccttttcgacactggaggcactggagaaggacatggccctcaagcctcacgaaaggaaggagaaatgggagcggcgtttgatcaagaagcctcgggaatcagagacatgtcccccggccgagcccagtgagaaccgcagaccattagaggctgggagccctgggcaggacctggagcctgcctgcgacggggcacgcaaggtccctttgcagccctccaaacagatgaaagtgactgtgtctaaagggggcgacagggacagtgacgatgactctgtccttgaggcaacttcctctcgagaccccctcagtgattctagcgcacacgccgtcagcgggaggggctactcttgtgactccgagagcggcccagatgacaaagccagtgtgggttcggagaagctattcgctccagggacggacaaggggccagccttggagaagagtgaagctaaagcgggccctgtccctaaggtgagcggactggaacgctctagagagctctcagctgagtcattcctgcccaccgcttcccccgcaccccatgccgccccctgcccgggacctccccctggcagtagggctaacccactggtgaagaaagagcctcccgcgccccatcgtcatacaccccagcctcctcctcctcagcctcggggactcttaccaacccacgtaccagcctcccttggcgcttttgcgggccacagccaggccgccgccaacgggctacacggtctttctcgttcatctagcgcccccttaggactcggcaaacacgtgagcttgtccccccatgggccaggtccacacctctctaccagccatctggcactgcgttctcaagcacaacaccagctccacgctgccatgttcgctgctccccctacacttccaccccccccagctctgcctgccagtagcttagtgttgccaggccatccagccgatcatgagctgctgaggcaggaattgaatacgaggttcctagtccagagcgcggagcggcccggtgcctccctcggccctggggctctcttgcgcgccgaattccatcagcatcagcacacgcaccagcatacgcaccagcacactcaccagcaccagcacacttttgcgcctttccctgctggacttcctccgactcccccagccgcaccccccccctttgataaatatgcaccgaagctggactctccatatttccggcatagttcagtgagtttttttccctcgtttccccccgcaataccgggccttccaaccttactgccccaccctgggcccttcggctcactacagggggcctttcagcccaaggtttctgacccatatagggccgtcgtcaaagtctctacctgttgggaaggaccttggcaaggcaggaccctggtccctcctggccggccacgtggcgctcgcgatagccgcagcctgcagaagacgtgggttggggttgccccagcgccactctcagcttccattttgtcccagaaacctggtcggtggtgtgcagtgcacgttcaaatcgcctggcaaatctacaggcatcagcagaagatcaaagagatgcagctcgacccccacaagctggaggtcggcgcgaagctggacctctttggccgcccccccgcgccaggggttttcgccgggttccactacccccaagatctagctcgcccactgtttccttccactggggcggcgcatccggctagcaacccatttgggcccagcgcacacccgggcagctttcttccaaccggacccttaactgaccccttctctaggccatcgacattcggtggcctcggaagtctctccagtcacgccttcggcggcctagggagccacgcccttgccccaggggggtctatcttcgcaccaaaggaagggtcatccgtccatggcctgccctccccccacgaagcatggaatagattgcatagggcccctccctcattccctgcacccccgccttggcctaagagtgtagacgctgagagagtgagtgccttgacaaatcatgatagagagccagacaacggcaaagaggagcaggagcgggacctgctcgaaaaaactaggctcctgtcccgggcatcaccggcgacgcctgcaggacatcccgtctctgggttgctattgagagcgcaaagcgagctggggagatccggtgctcctgccgagcgcgaagctgagcccagagtgaaggaatcaaggagcccagctaaagaagaagcagccaagatgccagcaagagcctctcctcctcattcgaaagcagcccccggcgacgtcaaagtcaaggaggagagaggagaagacgaagcttctgagcctccagccggagggctgcaccccgctcctctgcagctgggcctagggcgggagcggcttggagctcccggtttcgcctgggagccatttagaggccttgagctgcctcggagagcttttcctgctgctgctccagcgcctggatccgccgcactgttggaacctccagagaggccttatagggatagagagccccacggatattcacctgagcgtttgagaggagaattagaaagggcgcgggctcctcacctacctcccgccgcccccgccctggacggggccctcctgccatctcttggggctttacatttcccccgcctgtcaccagccgcattgcacaacggtctgctggctcgtaccccccccgccgccgccgccctaggagcacccccccctctggtgactgctgctgggcccccaacaccccccggacctccgcgcagtaggactacgccgctaggcggcctgggccccggagaagcgcgtgactactctcctagtaggaacccccccgaggttgaggcccggtag

SEQ ID NO: 47682 - DNA, 3138 bp, Artificial Sequence
  Description of Artificial Sequence: Synthetic coding sequence
atggaggccaaggtgcggcccagccggcggagccgggcccagcgggaccgaggaaggcgcagggaagccgcaagggacgcgagagctcaaagcccaagtagtggcgatgaaccagagccctcacctggcaaggaaaacgccggtctcagaggcgccccgccaaggggggccgcaccagcgccccgaactgcccggcctcctaggcgccggagaagagaatcttcctctcaggaggaagaagtgatcgacggatttgcgatcgcctccttcagtacgttggaagcactggagaaagacatggcactgaagccacacgagcgcaaggagaaatgggaaagacgtctaatcaagaaacctcgtgaaagcgaaacttgccctcccgccgagccctccgaaaaccgtagacccctggaagccggatcacccggccaagacctagagcctgcgtgcgacggcgcacgaaaagtgcccctgcagccatcaaagcagatgaaggtgaccgtgagtaaagggggagacagggactccgatgacgattcggtattagaggcaacaagctctagagatccgctctcagatagcagtgcccacgctgtcagcggacgcggttattcatgcgacagcgaaagtggcccagacgataaggcaagcgttggtagcgaaaaactgttcgcccccgggacggacaagggacccgccttagagaaaagtgaagcgaaagccggccccgtgccaaaagtatccggtctggaacgatctagggagctctccgctgagtcgtttctgcctacagcaagtcctgctccacatgccgcgccttgcccaggcccacctcccgggtcaagggcaaatcccttggtaaagaaagagccgcccgctccacaccggcacactccgcaacctcctccccctcagccacgcggcctactgcctactcatgttcccgcttcgttaggcgccttcgctggacatagtcaggccgccgccaacgggctacacggtctgtctcggtcttctagcgctcctttaggtctcggcaaacacgtgtcactcagccctcacgggcccgggccccatctgagcacatcacacctggccctgaggtcccaggcccagcaccagttgcatgctgccatgtttgccgcccctcccactcttccaccgccacctgcactgcctgcctcatccttagtgctgcctggccaccccgcggatcacgagctcctcagacaagaacttaacacgcggtttctcgtgcagtctgccgagcgacccggcgcatccctgggtcccggggccctgctgcgagctgagtttcaccagcaccaacatacacatcagcacacgcaccagcatacacatcagcaccagcacaccttcgcgccctttcccgcaggtctgccccccaccccgcccgccgctcctccacctttcgataagtatgcccctaaacttgatagcccttactttcgacatagttctgtgtcattttttcccagctttccccccgccattcccggtctgcccactctgctgccccacccaggccctttcggttctctccagggagcgttccagcctaaggtgtcagatccgtaccgggcggtggtcaaggttagcacctgttgggaggggccttggcagggccggacactggtccctcctggtcgacctagaggggcacgcgactctcgatcactccagaagacatgggtgggagttgccccagcgcctctttctgcatctattctcagtcagaaacccgggcgttggtgcgctgtgcacgtgcagatcgcatggcagatctatcggcaccagcagaagatcaaagagatgcagctggatccacataaactcgaggtgggcgccaaactggatttatttggtcgccccccggctcccggtgtattcgcgggcttccactaccctcaagatctggctagaccactgtttccgtccaccggggcagcccaccccgcttctaacccttttggccccagcgctcatcccggaagttttcttcccactggacctctcaccgaccccttctcccgtccgtcaacatttggcggattggggtccttgagctcacatgcgtttggtggcctgggctctcacgccctggcaccaggaggctcaatttttgctccaaaggagggatcttcagttcacggattgccatctccccacgaggcatggaatcgtctccatagggctcccccatcttttccagccccgccaccctggcctaaaagcgtggatgccgagagggtgagtgccctgaccaaccacgaccgagaacctgataacggcaaagaagagcaggagcgcgatcttttggagaagactaggctcctgagccgggctagccccgccacccccgccgggcatcccgttagcggcctactgttgagggcgcagtcagagctagggagatcgggagcccctgccgagcgggaggcggagcccagggtgaaggagtctcggagcccagccaaagaagaggccgctaagatgcctgcacgagcttcaccaccacacagcaaagccgcaccgggcgacgttaaggtcaaggaggagagaggtgaggacgaggcgtccgagcccccagcagggggcctgcatcctgctcctctgcaactaggtctcgggagagagaggctgggggctcccgggttcgcctgggagccctttcgaggcctggagttgccacgcagggccttcccagccgccgcccccgcccccggcagtgctgcgctgctggaaccccctgagcgcccctatcgtgatcgagagccccatggttactccccagagcgtcttcgaggagagctggaacgggcccgagcaccgcacctgccacccgctgcacccgccttggatggagccctactgccatctctaggagccctgcactttccccgactgagtccagctgccctgcacaacggcttgctggctcgaactccgcccgccgcggcggctctgggagcaccacccccccttgttacggccgcagggcctcccactccaccggggccacctcgcagcagaacaacacctctaggcgggctgggcccaggggaggcgagggattatagccccagccggaaccccccagaagttgaggcacgctag

SEQ ID NO: 47683 - DNA, 1746 bp, Artificial Sequence
  Description of Artificial Sequence: Synthetic coding sequence
atggacatcatcaagggcaacctggacggcatcagcaagcccgcctccaactccaggattaggccagggagccgctcctccaatgcatcacttgaagtgttgtcaactgaaccaggtagtttcaaggtggacaccgcctccaatcttaacagcggaaaggaggaccattccgagtcttccaacacagagaaccggaggaccagcaatgatgataagcaagaatcctgtagcgagaagattaagctcgcggaggaaggctcagacgaggatcttgacctggtacagcaccagatcatcagtgaatgtagcgacgagccaaagctgaaggaactggacagccaactccaggacgccatccaaaagatgaagaagctggacaagatcctggctaaaaaacagaggagggaaaaggaaatcaaaaaacagggtctagagatgaggattaaactttgggaggaaatcaagtcagccaagtattctgaagcctggcaaagtaaagaagaaatggaaaacaccaaaaaattcttgtccctaacggctgtttctgaggagacagtcgggccgtcccacgaggaagaagacactttttctagtgtattccacacccagattcctcccgaggagtacgagatgcagatgcagaagctcaacaaggacttcacatgtgacgtagagcggaatgagagcttgatcaagtctggtaaaaaacctttcagcaataccgagaagatagagttacgcgggaagcataatcaggattttattaaacgcaatatcgagttggctaaagagtcccggaatcctgttgtcatggtcgatcgggagaagaagcgcctcgttgagctgctgaaagatctggatgagaaggactctggcctgagttcttccgagggggaccagtctgggtgggtcgtgccagtcaaaggctacgagctggccgtaactcagcaccagcagctagccgagatcgacatcaagctgcaggagttgagcgcggcctccccgactatctcatcctttagtcccaggctggaaaataggaataatcagaaaccagaccgtgacggcgagcgcaatatggaagtgacacctggggagaagatactccggaatacgaaagaacaaagggacctgcacaatcgcctccgcgaaatcgacgagaagttgaagatgatgaaagagaatgtccttgaatctactagttgcttgagcgaggagcagctgaagtgtttactggatgagtgcattctgaaacaaaagtccatcatcaagttatcctcggagcgcaagaaagaggacatcgaggatgtcacacccgtgttcccacagctctctaggagcattatctcaaaactgctaaatgagagtgagaccaaggtgcagaaaacagaggttgaggatgcagacatgcttgagagcgaggagtgtgaggcttctaaggggtactacttgacaaaggccctgaccggccacaatatgtcagaagcactcgtgacagaagctgaaaacatgaaatgcttgcagttctccaaagatgtgattatttccgacaccaaggactacttcatgagcaagacattaggcattggtcgccttaaaagacccagttttcttgatgacccgttgtacggcatctccgtaagcctgtccagtgaggaccagcatctgaaactctcatcgccagaaaatactattgcagacgagcaagaaaccaaggacgctgccgaggagtgcaaggaaccatag

SEQ ID NO: 47684 - DNA, 48 bp, Artificial Sequence; identical to SEQ ID NO: 21386
  Description of Artificial Sequence: Synthetic coding sequence

SEQ ID NO: 47685 - DNA, 7920 bp, Artificial Sequence
  Description of Artificial Sequence: Synthetic coding sequence
atgagcagcagccacagccgggccggccagagcgccgccggcgccgctcctgggggcggggtcgacacacgtgatgcggaaatgccagccaccgaaaaagacctggctgaagacgccccatggaagaaaatccaacagaacactttcactcgttggtgtaacgagcaccttaagtgcgtgtctaagcggatcgcaaatttgcagacggacttaagcgatggactgcgcttgatcgcattactggaagtcctgagtcaaaagaagatgcatcgaaaacataatcagagaccaacatttagacagatgcagctggaaaatgtgtcagttgccctcgagttcctcgacagggagagcataaagctggtgagcatcgatagcaaagccatcgtggatggtaacctgaaactgattcttggtttgatctggactctgattctacactactcaatttccatgccgatgtgggacgaggaggaagacgaggaagcgaaaaagcaaacgccaaaacagcggctgcttggatggatacagaataaactgccccaattgcccatcaccaattttagtagagattggcagtcggggcgcgctctgggggccctggtggactcttgtgcccccggcctttgcccggattgggactcctgggatgcaagtaagccggttaccaacgctagagaggcaatgcagcaggccgacgattggctgggcattcctcaggtgatcactccagaggaaatcgtggatcccaatgtcgatgagcatagtgtcatgacatacctctcacagttccccaaggctaagctcaagcctggagccccactgcgaccaaagctcaatcccaagaaagctcgggcttacggtcccggcatcgagccaacaggcaacatggtcaagaaacgggccgaattcaccgtggagacaaggagtgcaggtcagggcgaggtgctggtctacgttgaggatcccgccggacatcaggaagaagcgaaggtcactgcaaataacgataagaaccggaccttcagcgtgtggtacgtcccggaggttaccggaacgcacaaagtgacagtattgttcgcgggacaacacattgctaagtccccattcgaggtgtatgtggacaaaagccagggcgacgcttctaaggtgacagctcaaggccctggcctcgagccaagcgggaatatcgccaataagacaacctactttgaaatcttcacagctggtgcagggaccggggaggtggaggtggtgatccaggacccaatgggccagaaaggtacggtcgagccacagcttgaagctcggggagactcaacataccgatgctcctaccagcccacaatggaaggagtgcatactgtgcatgtaactttcgcgggtgttcccatccctaggtcaccctataccgttaccgtaggccaggcttgcaacccatcagcgtgcagggctgtagggcgggggcttcagccaaagggcgtccgcgtgaaagagaccgccgactttaaagtgtataccaaaggagccgggtccggcgagcttaaggtcacagttaaaggcccaaaaggcgaggagcgcgtgaagcagaaggacctgggtgatggggtatacggcttcgagtattaccccatggttccagggacttatattgttactatcacatggggcgggcagaatatcggtcgatctccattcgaagtcaaggtcgggactgagtgtggaaaccagaaagttagagcctgggggccaggacttgagggcggggtggtggggaagagtgcagacttcgtcgtcgaagccatcggagatgacgtggggaccttaggatttagcgtggagggaccctctcaagccaaaatcgagtgcgatgacaagggagatggcagctgtgatgtaaggtattggccgcaagaagcgggcgagtacgccgttcatgtactgtgtaactcagaggacattaggttgtctccctttatggccgacatccgcgatgccccccaggacttccatccggaccgtgtgaaggccaggggcccaggcctggaaaagactggagttgccgtgaacaagccagccgaattcactgtagatgctaagcacggcgggaaggcgcccctaagagtccaggttcaggataatgagggctgcccagtagaggccctagttaaagataacggaaacggcacatacagctgttcatatgtgcccagaaagccagtaaaacatacggctatggtgagttgggggggcgtgtcgatccctaattccccgttcagggttaatgtcggggccgggtcccatcccaataaggtcaaggtgtacggacctggcgtggccaagacaggcctgaaggctcacgaacctacgtatttcacggtggactgtgctgaagcagggcaaggcgacgtgagtattggcatcaagtgtgcgcccggcgtggtaggacctgccgaggccgacatcgattttgacatcattagaaacgataacgataccttcactgtgaaatatactcctaggggcgccggatcctacacaataatggtgctgttcgccgatcaggccacacccacttctcctatcagggtgaaagtagagcccagccatgacgctagcaaggtgaaagctgagggacccggcttaagccgtaccggggtcgagcttggcaagcccacccactttactgttaacgctaaggcagcagggaagggcaaacttgacgtgcaattcagcggtttgactaaaggtgacgccgtgagggacgtggatattattgatcaccatgataatacctacacagtaaaatacacccccgtgcagcagggaccagtgggcgtcaacgtgacttacgggggagaccccatccccaaaagccccttctccgttgcagtgtcaccatcccttgacctctccaagatcaaggtgagcggactgggtgagaaagtggatgtaggaaaagaccaagagtttacggttaaaagcaagggtgcagggggccagggaaaagtggccagcaagatcgttggcccatccggagccgcagttccctgcaaggtggagccagggctgggcgctgataactctgtagtgaggttcctcccacgcgaagagggtccttacgaagttgaagtcacatacgacggcgtacccgtgccaggcagtccattccctctcgaagccgtggcccccaccaaaccttctaaagtgaaggcttttggaccaggactgcagggtggcagtgcgggctctccagctagatttaccatagatacgaaaggggcaggtacaggtggactgggcctcacagtggagggtccttgcgaggctcagctggaatgtctggacaatggggatggaacctgttctgtatcatacgttcccaccgagcccggggattacaatattaatatcttgtttgcggatacccatattccagggtcccctttcaaggcacacgtagtgccttgcttcgacgcctctaaggtaaaatgtagcggccccgggctcgaacgcgcgactgcaggggaggtggggcagtttcaggtagactgctctagcgcaggatcagcagaacttacaatcgagatctgttcggaggcaggtctgccggccgaggtctacatccaagaccacggagatggaacccacactattacatatatcccgttgtgcccaggcgcctacaccgtcacgataaaatatggcggacagcctgttcccaattttccgagtaaactgcaggtggagcctgccgtggacaccagcggggttcaatgttatggacctgggatcgaggggcaaggggtattccgcgaggcaaccactgagtttagcgtagatgctcgggcattgacccagacagggggtccccatgtgaaagccagagtcgccaatcccagcggcaacctcaccgaaacatatgtgcaagataggggtgatggtatgtataaggtcgagtacaccccatacgaggaagggttacattccgtagacgtcacttacgacggaagccctgtgccctcctctccgttccaggtgcccgtgaccgaaggatgtgacccttcccgagttcgggtgcatggccccggtattcagtctggcaccactaacaaacccaacaaatttactgtcgaaaccagaggagcaggcacgggcggactggggcttgcggtcgagggaccctcggaagccaaaatgtcctgcatggataataaagacggaagctgttctgtagaatacattccatacgaagccggtacttacagcctgaacgtgacttacgggggtcatcaggttcccggctccccctttaaggttcccgtgcacgacgtcaccgacgcctctaaagtaaaatgtagcggcccaggcttgtccccgggaatggtgcgagcaaatctgccccagtcttttcaggtggatacatctaaagctggggtggctcccctgcaggtgaaggtacagggccccaaaggcttggtcgagcctgtcgatgtggtagataacgccgacggaacacaaaccgtgaattatgtgccatcccgggagggcccatacagtatatcagtgttatatggcgatgaggaagtccctagatctccgttcaaagtcaaagtacttccaactcacgacgcttctaaggttaaggcctctggacccggcctgaacaccacaggtgtgccagcatcccttcccgttgaattcacaatcgacgctaaagacgcaggagaggggttgctggcggtgcagataactgatcctgaggggaaaccgaagaagacccacattcaggataaccacgatggcacatacactgttgcctatgtcccagacgtcacggggcggtataccatcctcattaagtacgggggggacgagatcccattttccccttatagagtcagagcggtgccgacaggagatgccagtaagtgcacagtgactggcgcaggcataggcccaacgattcaaattggtgaggaaactgtgatcactgtcgataccaaggcagccggtaagggtaaggtaacttgcaccgtgtgcactcccgacggctccgaggtcgacgtggatgtggttgaaaatgaagacgggacatttgacatcttctacacagcaccccagccgggcaagtacgttatttgcgtgcgctttggcggagaacacgttcccaattccccttttcaggtaaccgcattggctggggaccaaccaagcgtacaaccacccctgcgttcacagcagctcgcgcctcagtacacatacgcacagggcggccagcagacatgggcgccagaaagacccctcgtgggtgtaaacggtctggatgtgacctcactacggcccttcgacctggtgataccttttactatcaagaagggcgaaattactggcgaggtgcggatgccatccggaaaagtagcgcagccaacgataaccgacaacaaggatggtactgtgactgtgaggtatgccccatccgaggcaggactgcacgagatggatatcagatatgacaacatgcacatccctgggagtcccctgcaattctatgtcgattacgtcaactgcggacatgttactgcctacgggcccggcctgactcatggcgttgtgaacaagcctgctacatttaccgtaaatacaaaggacgcgggagagggcgggctctccctcgcaatcgaaggaccctcaaaagccgaaatatcctgtaccgacaatcaagacggcacatgctcggtgtcttacctgcccgtcttgcctggggactacagtatacttgtgaagtacaacgagcagcacgtgcccggatctcccttcaccgctagggttaccggggacgacagcatgcgcatgtctcatctcaaggtcggaagtgccgcggatatacctattaacatttctgagacagacttatcactgctcaccgcgactgttgtacccccctcggggcgggaagagccttgtcttctgaaacgactccgcaatggccacgtcggtatttcttttgtgccaaaagagaccggcgagcaccttgtacacgttaaaaaaaatgggcagcatgtagcctcctctcctattcctgttgtaattagccagtcagagatcggtgatgcatcccgcgtccgggtgtccggacagggactacacgaaggccatacatttgagccagccgagtttattattgacacaagagacgcagggtacggaggcctgagcctctctatagaagggcctagtaaggttgatataaacacagaagatctggaggatggaacgtgccgggtgacatattgtcctacggagccgggaaactacatcattaacattaagttcgccgaccaacatgtgccaggttccccattcagtgtcaaagtaactggggagggcagagtaaaggagtccatcacgagacgccgaagagccccctctgtggctaatgtgggctcccactgcgacctgtctctaaagattcccgaaatcagcatacaggacatgaccgcacaagtgaccagtccaagcgggaaaacccatgaagcagaaatcgtcgaaggtgaaaatcacacctattgtattaggtttgtcccagcagaaatgggtacacatactgtgagtgttaaatataaaggacagcacgttccaggttccccatttcagttcaccgtgggaccactcggtgagggtggcgcccacaaggtgcgggccggagggcccgggctagaacgcgccgaggccggggtcccagccgagttctcgatctggacccgggaggccggcgctggggggctcgcaattgccgtggaaggcccatcgaaggctgagatcagctttgaagatcgcaaagacggtagctgcggagtggcttatgtcgtgcaggagccaggagattatgaggtgtccgtgaaattcaacgaagaacacatccccgattcccctttcgtggtccctgtggcttccccgagtggggatgcacgccggctaacggtgtctagcctgcaagagtctggactgaaagtcaatcagcctgcttcttttgctgttagtctgaatggggcaaaaggtgccattgacgcaaaagtacatagtccaagcggcgccttagaggagtgttatgtcacggagattgatcaggacaagtacgccgtgcgatttatacccagggagaacggagtgtatctgatcgatgtaaaattcaacggaactcacattcccggtagtccgttcaagattagggtcggcgagccgggacacggtggagatcccggtcttgtaagcgcttatggcgcaggattggagggtggtgtcaccggtaacccagccgaatttgtcgtcaacacatctaacgccggtgcaggcgccctgtccgtcacaatcgacggtccatccaaagtcaaaatggactgccaggaatgccccgagggatacagagttacttacaccccgatggcaccaggttcctacctcatcagcataaaatatggaggtccatatcacattggcggctcaccattcaaggcgaaagtcactggacctagactggtgtcaaaccatagccttcacgaaaccagctctgtgtttgtcgattcgctgactaaagctacatgcgctccacagcatggtgcacccggccctggccccgccgacgcctctaaagtcgtcgccaagggcttggggctgtctaaggcatacgtgggccagaagtctagttttacagtcgattgctctaaagccggaaacaatatgctgctcgtaggtgtccacggaccccgcacaccatgtgaagaaattctggtgaagcatgtggggtcccggctgtatagtgtgtcttatttattgaaagacaagggcgagtataccctggtggtgaaatggggggacgaacacatcccaggcagcccttatcgggtggtcgtgccctag

SEQ ID NO: 47686 - DNA, 3642 bp, Artificial Sequence
  Description of Artificial Sequence: Synthetic coding sequence
atgcggagccggaaccagggcggcgagagcgccagcgacggccacatctcctgtcccaagccatctattattggaaacgcaggggagaaaagcctgtctgaagacgccaaaaagaagaaaaagagcaaccgaaaagaagacgacgttatggcctccggcaccgtcaagaggcatttaaaaacctcgggcgaatgtgagcgcaagacaaagaaaagcctagagctctcgaaagaggatctgattcagctcttgtcgattatggaaggcgagctgcaggcccgtgaagacgtgatccatatgcttaaaactgaaaagacaaaacccgaggtgctagaggctcattacggctcagcggagcctgagaaagttctaagagtgctgcatagggatgcgattctcgctcaggagaaatccatcggggaagacgtatacgagaagccgattagcgagcttgatcggctggaagagaaacaaaaagaaacttaccgccggatgcttgaacagctgctcttggcggagaagtgccaccgcaggactgtatacgaactggagaacgagaagcacaaacacacagactatatgaacaagtcagatgattttacaaatctcttggagcaggaaagagaaaggctgaagaaactgctcgagcaggagaaagcctaccaggcccggaaagagaaggagaacgctaagcgcttgaacaagctgcgcgatgaactggtgaagctcaagtctttcgccctaatgctggtcgacgagcgtcagatgcacatagaacagcttggactgcagtctcaaaaggtgcaggatctaacacagaagctgcgagaagaggaggagaaacttaaggcaatcacctcaaagtcaaaagaggaccggcaaaagctcttgaaattggaggttgactttgagcacaaagccagcaggttttctcaggagcacgaggaaatgaacgcaaagcttgccaatcaggaaagccataacaggcagttgagactgaagttggtgggtctcacccaacgtatcgaagaacttgaggagacaaacaagaacctccagaaggctgaggaggagctgcaggaactccgcgataaaattgctaaaggcgaatgtggtaactcgtccttgatggcagaagtggaaaatcttaggaaaagagtgctcgaaatggagggaaaagacgaagagattacaaaaacagaatcccaatgcagggaactgagaaaaaagttacaggaggaggagcaccattcaaaagagctcagacttgaggtggaaaaactgcagaagagaatgtctgaattagaaaaactggaagaggcatttagcaagagtaagtcagagtgcactcagctacatctgaacctggagaaggagaagaatcttacaaaggacctgcttaacgagttggaagtagtcaagtccagggtgaaagaactagaatgcagcgaatcacgactggagaaggccgagctgtcccttaaggacgatctcaccaaacttaagtccttcacagtcatgttggtagatgagcgcaagaacatgatggagaagataaagcaggaagagcggaaagtggatggcctcaataagaatttcaaggtagaacaagggaaggtgatggatgtgaccgagaaattgatcgaggaatccaagaagttgctgaagctgaagagcgagatggaagagaaagtgtataacttaaccagggagagagatgaactgatcggcaagctcaagtctgaagaagagaaaagcagtgaattatcctgtagcgtggacctgctcaagaagcggctggacggaatagaggaagtggagcgggaaattactcgggggagaagtcgaaagggcagtgagctcacatgtcccgaagacaataaaattaaggagctgaccctcgagatagagaggctcaagaaaaggctgcagcagctggaggttgtcgagggcgacctgatgaaaacagaagacgagtacgatcagctcgagcagaagtttaggacggagcaggataaagctaatttcctgtcccagcagctggaggagataaagcaccagatcgcaaagaataaagctatcgagaagggcgaagtcgtgtcacaggaagccgaacttagacatcgatttagactggaagaggctaagtccagggacctgaaagccgaagtccaagccctgaaggaaaaaatccacgagctgatgaacaaagaagatcagctctcccagctgcaggtggattacagtgtactgcagcagcggtttatggaagaggaaaacaagaacaaaaatatggggcaggaggtgctcaaccttactaaagaattagaattgtccaaacggtacagcagggctctccggccatccgtgaacggacgacggatggtagacgttccggtgaccagcaccggagttcagactgacgccgtctcaggtgaggctgccgaggaagagactcctgccgtgtttatcaggaaatcttttcaggaagaaaaccacataatgtcaaacttacggcaggtcggtttgaagaaacctgtggaacggagtagcgttttagatcgatatcctcccgcggccaatgaactgaccatgcggaagtcatggattccttggatgaggaagagggaaaatggccccagtattacacaggagaagggcccaagaacaaattcaagtccagggcaccctggagaagtggtcctgtctccgaagcagggacaacccctacacatcagggtaaccccagaccatgagaattccaccgccacccttgagatcacaagccctacctcagaggaatttttcagttccaccaccgtgataccaacacttggtaaccagaagccgcgaatcaccattattcctagccctaacgttatgccacagaagcaaaaatcaggagacactaccctggggcccgaacgcgccatgtcaccagtgaccattacaacattttctagggagaagacccccgaatcaggtcggggcgcctttgcggatagacctacatcccccatccagatcatgaccgtgtcaacttctgctgccccagctgagatagccgtgagccccgaaagtcaggaaatgcccatggggcgcacaatcctgaaggtgacacccgagaagcagacagtccccaccccagtgcgcaagtataattcaaatgcgaatatcatcacaacagaggataataaaattcacatacacctgggctcccagttcaaaagatcaccagggacgtccggcgagggcgtgtcgccagtgatcaccgtccgccctgtgaacgtgactgcagagaaagaagtgtcaacaggcactgtgctccgctctccaaggaaccatctaagtagccgaccgggggccagcaaggtgacatctactatcaccatcaccccagtgacaacttcctccgccagaggtacccagagcgtctctgggcaggacgggtcaagtcagagacctactcccacccgaatccctatgtctaaggggatgaaagccggcaagcctgtggttgccgctccaggagctgggaaccttactaaatttgagcctcgggcagaaacacagtcgatgaagattgagttgaaaaaatccgcagcgagttcaactacctcgttaggcggtggcaaaggctag

SEQ ID NO: 47687 - DNA, 3345 bp, Artificial Sequence
  Description of Artificial Sequence: Synthetic coding sequence
atgctgaagaccgagaagaccaagcccgaggtgctggaggcccactacggctccgccgaacctgaaaaggtgttgagggtactccatcgggatgcaatcctggctcaagaaaagagtatcggggaagacgtgtacgagaaaccaatatctgagctagatcgactggaagagaagcagaaggaaacctaccgtcggatgcttgagcagctgctcctggcagagaagtgtcatcgccggactgtctacgaattagagaacgagaaacacaaacacactgactacatgaacaagagtgacgattttacaaatcttctggagcaggaaagagaaagactcaagaaactgctggaacaggaaaaagcctaccaggccaggaaggaaaaggagaacgcaaaacggctcaacaagctccgggacgaactagtgaagctcaagtcatttgcacttatgctcgttgacgagaggcaaatgcacatcgaacagcttggcttgcagtctcagaaggtgcaggacctgacccagaagctgcgagaggaggaggagaagctgaaagccataacctcgaaatcaaaagaggacagacagaagctattgaaactagaggtggatttcgagcataaggcctccaggttttcccaggaacatgaggagatgaatgccaagctcgccaatcaggaatctcacaataggcagttgaggctgaaacttgtgggccttacccaaagaattgaggagctcgaggagactaacaagaatctccagaaggcagaagaagaactgcaagaattgcgggacaagatagctaaaggagagtgcggaaattcatcattaatggccgaggtggaaaatcttcgaaagagggttctggagatggaggggaaggatgaggagattacgaagaccgaatctcagtgtagagaattgagaaaaaaactgcaagaagaggagcatcactctaaagaactcagactggaggttgagaaactgcagaaacgcatgtcggagctggagaaactcgaagaggctttcagtaagtccaaaagtgaatgtacgcagctgcacctcaatctggagaaggagaagaatctaaccaaagaccttctaaatgaactggaagtcgtcaagtcccgagttaaagaattagagtgctccgaaagcagactagagaaggctgaactgtctctgaaggatgacttgaccaagcttaaatcatttaccgtcatgctcgtggacgaacgaaaaaatatgatggagaagattaaacaggaggaacgcaaagttgatggcctgaataagaattttaaagttgagcaaggcaaagtcatggatgtcactgaaaagctgatcgaagaatccaaaaaactactgaaactgaaaagcgagatggaggaaaaggtgtataacttaactcgggaaagggatgagctcatcggaaaattgaaaagcgaggaggagaagtcaagtgaactgagctgttctgtcgacttgctgaaaaaacgcctggacggaatcgaggaggtggaacgtgaaataacgagaggacgatccagaaaaggcagtgagctgacctgtcctgaggacaacaaaattaaagagctcaccctggagatcgagcggctcaagaaaagattgcagcaattggaagtggtagagggtgatctgatgaaaaccgaggatgaatacgatcagctcgagcaaaaatttaggacggagcaggacaaggctaacttcctgtcacaacagttagaggagatcaagcaccaaatcgctaagaataaggccattgaaaagggcgaagtggtaagccaggaggccgagttgcgccacaggttcagactggaggaggctaaaagcagggatctgaaagctgaagtacaggctcttaaggaaaagattcacgagttgatgaacaaggaggatcagctgagtcagctccaggtggactactcggtacttcagcaacgctttatggaggaagagaacaagaacaaaaatatgggtcaggaggtgctgaaccttactaaagagcttgagctatccaaaagatacagcagggccctgcgtcccagtgtgaatgggcgtaggatggtggatgtgcccgtgacatccactggggtgcaaaccgacgcggtaagtggtgaggcagccgaggaagagactccggcggtgtttataaggaaatcattccaagaggaaaaccatataatgtccaacctcaggcaggtgggcttgaagaagccagtggaacgatcatcggtactggaccgctaccctccggccgccaatgagcttacaatgagaaagtcttggataccatggatgcgcaagcgagaaaacggtccatctatcacccaggagaagggaccaagaaccaactcctctcccggccaccccggcgaggtggtgttgtcccccaagcaagggcagcccctccacataagagttacccctgaccacgagaactccacagcgactctggaaattacttccccgacaagtgaggagtttttctcttcgacaactgtcattcctacgttagggaaccagaagcctcggatcacaataatcccatctccaaatgtgatgccgcagaaacagaagtctggtgatacaactttggggcctgagagagctatgtctcccgtgactatcacaactttcagtagagaaaaaacaccagaatccgggagaggtgcttttgcggataggcccacctcaccaatccagatcatgaccgtttcaacatccgccgctccagccgaaatcgccgtatctcccgagtcccaggagatgcccatggggcggactattctgaaggtgacacctgagaaacagacagtgccgacgcctgtaaggaagtacaactctaatgctaacatcatcacaacggaggacaacaagatacacatccacttaggaagccagtttaaaaggtcaccaggaaccagtggggaaggcgtcagccccgtgataacagttaggccggtgaacgtgacagccgaaaaagaggtgtccaccgggaccgtgcttcggtccccaagaaatcatctgtcgagccgcccgggggccagtaaagtgacttctactatcacgattaccccagtgactactagttcagcccgtggcacgcaatctgtctccgggcaggatggatcttcccaacgaccaaccccaacacgaatacccatgagtaaagggatgaaggcaggtaaacccgttgtagcagcccccggcgcaggaaaccttacaaaatttgaaccccgtgccgaaacacaatccatgaagatagaactcaagaagtcagccgccagctctactacaagtctgggagggggcaagggatag

SEQ ID NO: 47688 - DNA, 3534 bp, Artificial Sequence
  Description of Artificial Sequence: Synthetic coding sequence
atgcggagccggaaccagggcggcgagagcgccagcgacggccacatctcctgtcctaagccatcaatcataggcaacgccggcgagaaaagcctgtccgaggacgctaagaaaaagaagaagtctaacagaaaggaagatgacgttatggcctccggcacagtgaaacgtcatttaaagaccagcggcgagtgtgaacggaaaacgaagaaatccctcgaactctccaaagaagacttaatacaactgctgagcatcatggaaggggagttgcaggccagagaggacgtaatccacatgttgaaaaccgagaagaccaagcccgaagtgctcgaagcccactatggaagcgccgagcccgaaaaggtcctccgtgtcctacacagggacgcaattttggcccaggaaaagtccattggtgaggatgtttacgagaaacccatctccgagctggataggctggaagaaaagcagaaagagacttacagacgtatgctcgaacaacttctcctggcagagaaatgccaccgaagaactgtctacgaactggagaacgaaaagcataaacacactgactatatgaataagagtgacgattttacaaatctgttggagcaggagcgtgagcggcttaagaagctacttgaacaagaaaaggcctaccaggcgcggaaagaaaaagaaaacgccaagagacttaacaagctgcgggatgaactggtcaagctaaaatcattcgcgctgatgctggtcgatgaacgccagatgcacattgaacagctcggtctccaaagccaaaaggttcaggatctgacccaaaagctgcgtgaagaagaggagaaattgaaggccataacatccaaatcaaaggaagatagacagaaactcctgaagctggaggttgattttgagcacaaagcatccaggttctctcaggagcatgaagaaatgaatgcgaagctggccaatcaggagtcacataaccggcagcttcgtcttaaactcgtggggttgacacagagaatagaggagcttgaagagactaataaaaacctgcagaaagccgaggaagagcttcaggagctcagggataagattgccaaaggtgagtgcggaaacagtagtttgatggcggaagtggagaatttgcggaaacgcgtcctggagatggagggcaaagatgaagagatcacgaaaactgagagccagtgtcgtgagctacgaaagaagctgcaggaagaagagcatcactcgaaggagctgcggctggaagtcgagaaactccaaaaacgaatgtctgaactggaaaaactggaggaggcattttctaagagcaagtcagagtgcacccagttgcatctcaatctggaaaaggagaagaacctcacaaaggacttgctcaacgaactcgaggtagtgaagtcaagagttaaagaactggagtgctccgagtctagattagaaaaagcggaactttctctgaaagatgatcttactaagcttaagtcctttacagttatgctcgtggacgagagaaagaacatgatggagaaaatcaagcaggaagagcgtaaggtagatgggctcaacaagaactttaaggtggagcagggaaaggtaatggatgtgaccgagaaactgattgaggagagcaagaagttgctcaaactgaaatctgaaatggaagagaaggtctataatctcacgagagagcgcgacgagttaattggcaagctaaaatccgaggaggagaagtcttcagagctctcttgttcagtcgacctgcttaagaagcgcttggatggtattgaagaagtagaacgcgaaatcaccagaggaagaagccggaagggatccgaactcacgtgtcctgaagacaataagataaaggagctcacactggagatcgagcggctcaaaaaacggctccagcagctggaagttgttgagggagacctgatgaagacggaagatgaatacgaccaactcgaacagaagtttcggacggaacaggacaaagctaactttttaagccagcagttagaggaaatcaaacaccaaattgccaagaacaaagcgattgagaaaggagaggttgtctcccaggaagcagaactgaggcacaggttcagattggaggaggcgaagtctcgggatcttaaggccgaggtccaggcactaaaggaaaagatacatgagctcatgaataaggaggaccagttgtctcaactgcaagtggactattcagtccttcagcagcgctttatggaggaagaaaataaaaataaaaacatgggccaggaagtgcttaacctgacaaaggaactggagttgtctaaaaggtatagcagagccctgcgcccctcagtcaacgggagaagaatggtggacgtgcctgtgacttcaacaggggtccagactgatgctgttagcggcgaagcagcggaggaagaaacgccggccgtctttattcgtaagtcctttcaggaggaaaatcacatcatgagtaacctacgtcaagtaggccttaagaaaccagtcgaaagaagctcggtactggataggtacccgccagccgctaacgagctgaccatgagaaaatcctggatcccgtggatgcggaagagggagaatgggccctcaataacacaggaaaaaggccccaggacaaacagctcccctggccaccctggcgaggtcgtgctgtcacccaaacagggccagcccctgcatatccgcgttactcctgatcatgagaacagcaccgccaccctggagatcacctccccaacctccgaggagttcttcagttccaccactgttatccccacgctgggaaatcagaaaccccgcattactatcatcccttctccaaatgtcatgcctcaaaagcaaaagagcggagatacaactctcggccccgaaagggcaatgtcacccgtaaccataaccacattttctcgcgaaaaaacccctgagagtggtaggggcgcatttgctgacagacctacttcgccaattcagataatgactgtctcgacatccgccgctcccgctgagatagccgtctcccccgagtcccaggagatgcccatgggccggacaatcttgaaggtcacccctgaaaagcagaccgtgcctacaccggtgcggaaatacaatagcaacgcaaatattatcaccactgaagataacaagattcatatccacctcggaagccagtttaagcgcagccccggaacatccggagaaggcgtttctcccgtgatcaccgtaaggcctgttaatgtgacagctgagaaggaagtgtctaccggcacggttctgaggagccctaggaatcacctgtcatcccgccccggcgcgtcaaaggtgaccagtactatcacgattactcccgtgacaactagctcagctcggggcactcaatctgtgtctgggcaagatggctctagtcagaggcctacccccacgcgtatcccaatgagtaaggagagtattatcatccatcaacttcgaatgaacagcagatag

SEQ ID NO: 47689 - DNA, 279 bp, Artificial Sequence
  Description of Artificial Sequence: Synthetic coding sequence
atgggcgtgcacgtggagaccatcagccccggcgacggcatgctggaggatggtaagaaatttgattcttcacgggacagaaataagccatttaagtttatgctcgggaagcaagaggtgatacgcggctgggaagagggggttgtgcagatgtccgtcggacaaagagctaagttgactatttctcccgattatgcctacggagcaaccggacaccctggaatcatacccccacacgcaacgttagtgtttgatgtagaacttctgaaattggagtag

SEQ ID NO: 47690 - DNA, 327 bp, Artificial Sequence
  Description of Artificial Sequence: Synthetic coding sequence
atgggcgtgcacgtggagaccatcagccccggcgactggcggacctttccaaagagatcccagacttgtgtcatgcattacaccgggatgctagaagatgggaaaaagttcgactcatctcgggatcgtaataaacccttcaagttcatgcttgggaagcaagaggttattcgaggctgggaagaaggtgtggtgcaaatgtccgtgggccaacgggctaagttaacaatcagccctgactatgcttacggtgccacaggccaccccgggatcatcccccctcacgcaaccctggtttttgatgtggaacttctgaaactggaatag

SEQ ID NO: 47691 - DNA, 774 bp, Artificial Sequence
  Description of Artificial Sequence: Synthetic coding sequence
atgcccaagaccatgcacttcctgttccggttcatcgtgttcttctatctgtgggggttgttcacagcacagcgccaaaagaaagaggaatccactgaagaggtgaaaattgaggtgctccatagacccgagaactgcagcaagacctccaagaaaggcgacctccttaatgcacactatgatggttatctggcgaaagacggcagcaaattctactgctcgaggactcaaaatgaagggcaccctaagtggttcgttctcggagttggccaggtgatcaaaggactggacattgctatgaccgatatgtgtccaggcgagaaacggaaggtggtgatacccccatccttcgcctatggaaaagaggggtatggcattctcgaagaggtgtttctgctgcagaacatcctggtctcatgtcatcggaccactctgcatgttctcaagtgtatgctgttggtcaataacaacacctgtgctgaggggaagattcccccggatgccacactgatctttgaaatagaactttacgctgtgacaaaagggcctaggtcaatcgagacctttaagcagatcgacatggacaacgaccggcagcttagtaaagctgaaatcaacttatacctccaaagagagttcgaaaaggacgaaaaaccgcgggataaatcttaccaggatgccgtactggaggacattttcaaaaagaatgatcacgacggggatgggttcatcagtcccaaggagtacaacgtctatcagcacgatgagctgtag

SEQ ID NO: 47692 - DNA, 669 bp, Artificial Sequence
  Description of Artificial Sequence: Synthetic coding sequence
atgcccaagaccatgcacttcctgttccggttcatcgtgttcttctacctgtggggcttgttcaccgcccaaagacagaagaaggaagaatcgaccgaggaagtaaagattgaagttctccacagaccagaaaattgcagcaagacctcaaaaaagggcgacctgctcaatgcacactacgacggatacctggccaaagacggctccaagttttattgttccagaacgcagaatgagggacatcccaagtggttcgtgctcggtgtgggccaagtgattaagggactggacatcgccatgaccgatatgtgccccggagagaaacgaaaagtcgttatacccccaagctttgcttatggcaaggaggggtacgcagaagggaagataccacccgacgccacactaatttttgagatcgaactctatgcggttaccaaggggcctagatcaatagagacttttaaacaaattgatatggataacgatcgacagttgagcaaggcagaaatcaacctctatttgcaacgcgagttcgagaaagacgagaagccgagagacaaaagctatcaggacgccgtgcttgaggatattttcaagaaaaatgatcacgacggcgacggctttatcagtcccaaagagtacaatgtatatcaacacgacgagctctag

SEQ ID NO: 47693 - DNA, 666 bp, Artificial Sequence
  Description of Artificial Sequence: Synthetic coding sequence
atgcccaagaccatgcacttcctgttccggttcatcgtgttcttctacctttggggactgttcactgcgcaacgccaaaaaaaggaagaatctaccgaggaagttaaaatagaagtactgcatagacctgagaactgtagcaagacctctaagaaaggagatttattaaatgctcactacgacgggtatttggccaaggatggctcgaagttttactgttctcgaacccagaatgaggggcatccaaagtggttcgttctgggtgtcggacaggtgatcaaggggctagatattgccatgactgacatgtgccctggcgagaagcggaaggtcgtgattccacctagctttgcctacgggaaagaggggtacgaaggcaagatccctcccgacgctactctgatttttgagatcgaactttacgccgttactaagggacctcggagcattgagaccttcaaacagatcgacatggacaacgatcgacagctctctaaggctgaaatcaatctgtacctgcagagagaattcgagaaggacgaaaagcctcgggataagtcctaccaggacgcagtcctcgaagacattttcaagaagaacgaccatgatggggatgggttcatctcacccaaggaatacaacgtttaccagcatgacgaactctag

SEQ ID NO: 47694 - DNA, 1050 bp, Artificial Sequence
  Description of Artificial Sequence: Synthetic coding sequence
atggagaccccccccgtgaacaccatcggcgagaaggacaccagccagccacaacaggaatgggaaaagaacttacgtgaaaatttagattcagtgattcagatcaggcagcagcccagggatcctcctaccgaaacgctggagttagaggtgagcccagaccccgctagccaaatcctggagcacacccagggggcagaaaaactggtagccgagctggagggcgattcacacaaatcccacggctctacctctcagatgcctgaaactctccaagcgtccgatctttggtattgtcctgatggatccttcgtgaagaaaatcgtgatccgcggccacggcctggacaagcctaagttaggcagctgttgcagggtgcttgccctaggctttcctttcggctccggtccacctgagggctggactgaactaacgatgggtgttggcccctggagggaggagacctggggggaactcattgaaaagtgtctcgagtccatgtgtcagggcgaagaggccgagctgcagctgcccggacacagcggaccgcccgtacggcttactcttgctagctttacccaaggccgcgatagctgggagctggagacatctgaaaaagaagcgctggctagggaggaacgcgctcgcgggaccgagctcttcagggcaggaaaccccgagggagcagctaggtgctatgggagagcgctgagactgctgttaaccttgcccccccccggcccccccgaacgaacagtcctccatgccaacctggccgcctgccaactgctgttagggcaaccccagctggctgcccagagttgtgacagagtgctagagagagaacccggacatctgaaagcactgtacagacggggtgtggcccaggcggccctcgggaatctcgagaaggctaccgctgacctgaagaaggtactggcaattgaccctaagaatagggccgcccaggaagaactcggaaaagtggtaatccagggcaaaaaccaagacgccggacttgctcagggtctccggaaaatgttcggctag

SEQ ID NO: 47695 - DNA, 423 bp, Artificial Sequence
  Description of Artificial Sequence: Synthetic coding sequence
atgcccctgcccgagcccagcgagcaggagggcgagagcgtgaaggcttcacaggagccgtcaccgaaacccgggacggaagtaatacctgctgcaccaagaaaacccaggaagttttcgaaactcgtattgctcaccgcgtctaaagattcaaccaaagtggctggcgcaaagcgcaaaggcgtgcactgtgtgatgtccctgggcgtaccaggacctgctacactggccaaagccctgttacaaacccaccccgaggcacagcgagcaattgaagccgccccccaggagcccgaacagaagcggtctcgccaagacccgggaactgaccgaacagaggacagtgggctcgccgccggccctcccgaggcggctggggaaaactttgctccctgttcggtagccccagggaagtcactgtag

SEQ ID NO: 47696 - DNA, 423 bp, Artificial Sequence
  Description of Artificial Sequence: Synthetic coding sequence
atgcccctgcccgagcccagcgagcaggagggcgagagcgtgaaggcaagccaagagccatcgcctaaacccggcaccgaagtgattcctgctgctccaaggaagcccaggaaattctccaagctggtcctccttaccgctagtaaagactccacgaaggtggccggcgccaaaaggaaaggtgtacattgtgtgatgtccctgggcgttcccggcccagctaccctggcaaaggctctgctgcagacacatcccgaggcccagagagcaatagaagctgccccgcaggagcctgaacaaaagcggtcaaggcaggatcccggtacagatagaactgaggactcaggtctggctgccggaccacctgaagcggccggagaaaactttgccccctgcagcgtcgctcccggcaaaagtctctag

SEQ ID NO: 47697 - DNA, 735 bp, Artificial Sequence
  Description of Artificial Sequence: Synthetic coding sequence
atggacatggcctggcagatgatgcagctgctgctgctggccctggtcacagccgccggctccgcccaacccaggagcgcccgcgcccggactgatctgctgaacgtgtgtatgaacgcaaaacatcataagactcagccttctcccgaagatgaactctacggacagtgttctccttggaagaagaatgcatgttgcacggcgagcacctcgcaggagctgcataaggacacctccaggttgtataactttaactgggaccattgtgggaagatggaaccaacctgcaaaagacattttatccaggatagctgcctggaatgttctccaaacttaggcccttggatcaggcaagtaaatcaaagctggcggaaagaacgcatcttgaatgtcccactctgtaaggaggattgcgaaaggtggtgggaggactgcaggacctcctacacctgcaaaagcaactggcataaagggtggaattggacatctggaatcaacgagtgccctgccggagccctgtgcagtacatttgaatcatactttcccacgcctgccgcactttgcgagggtctgtggtctcacagcttcaaggtctctaattattcccgaggcagtgggcgctgtatccagatgtggtttgactccgcacagggtaatcccaacgaggaggtggcgaaattttacgcggccgccatgaacgcaggcgctccctctcggggcattattgatagctag

SEQ ID NO: 47698 - DNA, 864 bp, Artificial Sequence
  Description of Artificial Sequence: Synthetic coding sequence
atggacatggcctggcagatgatgcagctgctgctgctggccctggttaccgcagccgggtccgctcaacctagaagcgcaagagctcgcactgatctactgaatgtatgtatgaacgccaagcaccacaaaacccagccatctccggaagacgagctgtacggccaagttggagctccgcaggggccctcccccggttctgttcccctcgatgatctccctggggccgaagaacccgagtacggaggcgacggctgtggaggcgaaagattatcaccagtgtctagccccccctccgctgtgcccgggcgacgtatgccagcagcccgcccggctcccgctcggagttgtactaggactccccccgcctgtaccaccctgacggggatcaccgtggtgcgatggaatcctcctgcatctgccacgctgtctcgaaccgctgtctccgagtgcagtcccaacttgggtccttggatcaggcaggtcaatcagtcttggcggaaggagaggatactaaacgttccactatgcaaggaagactgtgagcgctggtgggaagattgcaggacatcttatacatgtaagtcaaactggcacaaaggctggaattggacctccggaattaatgagtgcccagctggcgccctctgttctaccttcgaatcctattttccaactcccgcagctttgtgtgaggggctgtggtcccattctttcaaggtgtctaactattccaggggcagcggcagatgtatccaaatgtggtttgattctgctcaggggaacccaaatgaggaggtggctaagttctatgccgctgctatgaacgctggggcccctagccgtggcatcatcgattcttag

SEQ ID NO: 47699 - DNA, 1380 bp, Artificial Sequence
  Description of Artificial Sequence: Synthetic coding sequence
atgaccctgagcaccgagatgagcgacgccagcggcctggccgaggaaacagacattgacgttgttggagaaggtgaagacgaggaggatgaggaggaggaggatgacgatgagggagggggggggggtccgcgactcgctgtccctgcccagcggcgcaggcgaaggagatcttatgctggcgaggatgagctagaagaccttgaagaggaagaagatgacgacgacattttgttagccccgcccgccgggggctcccccgcgccaccaggtccagccccagctgcaggcgccggtgctggcggtggcggtggcggcggtggcgctggtggagggggtagcgctgggtctggcgccaagaaccccctcgtgaaaccaccttactcttatatcgcactcatcacaatggcgattctacagtcaccaaaaaagcggctgacactgtcggaaatctgcgagttcatcagtggtcgctttccatattacagagagaaattccccgcctggcagaattctatacgacacaacctatcactaaacgactgcttcgtcaaaatcccaagagagcccggaaaccctggcaaagggaattattggactcttgacccggagtcagccgacatgttcgataacggttccttcttgaggcgccgaaagcgttttaaacgccagcccctgcttcctcccaatgccgctgctgcagagtctttgctgctacgaggagccggggctgctggtggcgccggggacccagcagcggccgccgcgctcttccctccagctcctccccccccccctcatgcctacgggtacgggccgtacgggtgcggctacggactgcagttaccgccttatgcccctcccagcgcactttttgctgccgctgcgagacgcagacggcggaggcttccgccagcattagctccagctgctccagcgacagccaggcggggacgccgcgccgggcctgacagactgcggctcccagctgcccctgctaggcgtcgaccgacccgtcccccagccgggttgcggggacaaggtggacgacccggacgactcagcgctggcgccctagctctacttcatagagagcatcacagaggacagctggggcctggcaggcgctgcagaagaaggagagctggccggagaagaagatcaggtctggctcttgctctcgctggtggcggggcagcctcatccagaatccagaggagaaggctccgcggtgcaggggggcgcggacccggcggcagggcacacccgattcccagaggtcgcagggggcggcgacgtctcctttctctgttggtgcgtcgcctgggcgatagcgcacctcgtgactgtcccgttcagtgccgtgaactgtattgctag

SEQ ID NO: 47700 - DNA, 2202 bp, Artificial Sequence
  Description of Artificial Sequence: Synthetic coding sequence
atggccgaggtgggcgaggacagcggcgcccgggccctgctggccctacggagtgctccgtgtagtcctgtcttatgcgcggcggccgccgctgctgccttccctgctgcggctccaccaccggcacctgctcagccccaaccccctcccggcccgccaccgccccctccgccgccgcttccacccggcgcaatcgcaggtgctggatcctctggtggctcttccggagtatctggagactcagccgtggcaggggcagccccagcactggtggccgcggccgctgccagcgtgagacaatcacccggccccgctctggcgcgactcgagggacgggagtttgagttcttgatgcggcagcctagtgtaactatcggccggaatagctcacaaggctccgttgatcttagcatgggactgtcctctttcattagccgcaggcatctacagttgtcgtttcaggaaccccatttttacctgagatgcctcgggaagaacggagtcttcgtggatggtgcttttcagcgccgcggcgcccccgccctgcagttacccaaacagtgcacattcagatttccctccaccgcaattaaaattcagtttacatctctgtaccataaagaggaggcccctgcgagtccattgcggcccttgtatccgcagatttccccgcttaagatccacatacccgagcctgacttacggtctatggtgagcccagtgccctctcctactggaaccatctctgtccctaactcctgcccagcatcccccaggggcgccggttcgtccagctatcgattcgtgcaaaacgtgacatcggatctgcagctcgccgccgaatttgccgctaaggctgcgtcagagcagcaggccgacacatccggtggggattcccctaaagatgagagcaaaccccccttctcctatgctcagttgatcgtgcaagctatatctagcgctcaggatcgccaacttaccctgagcgggatatatgcccacatcactaagcactacccttattataggacagcagacaagggctggcagaattctatccgtcataatttgagcctgaatagatatttcatcaaggtgccaagaagccaggaagagccaggaaaaggaagcttctggcgcatagatcccgctagcgaggcaaagctcgtggagcaggcttttagaaagcgccgccagcgcggggtcagttgcttccggactccatttgggcccctcagctccaggagtgcgcccgcctctcccacgcaccccgggttgatgtctccgagaagtggtgggttacaaacgccagagtgcctgagtagggaggggtcgcccatccctcacgatcccgagtttggctcaaagctggcctctgtgccagagtatcggtattcccagtcagctcccggatccccggtttctgcacagcccgtcattatggctgtgccacctagaccgagttcattggtggccaaacctgtcgcttacatgcctgccagcattgtgacttcccagcagcctgcaggacatgcaattcacgtagttcagcaggccccaactgtcactatggttcgcgtggtgactacgtcagcaaacagcgccaacgggtacattctcaccagccagggggctgccggaggttcacacgatgccgcaggggccgccgtgctagacctcggctctgaggccagggggctggaagagaagccgactatcgcctttgcaacgattccagccgccgggggcgtcatccagactgtggccagccagatggcaccaggcgtgccggggcacacagttaccattctccagcctgcaaccccggtgacactcggacagcaccacctccctgtacgtgccgttacacagaatgggaagcatgccgtgccgacaaattccctggctggcaacgcctacgctttgactagcccccttcagctcctagccactcaggctagtagttccgctccagtggtggtgacccgcgtgtgtgaggtgggacctaaggaaccagcagccgctgtggccgccacagccactacgaccccagctacggccacaaccgcctcggcttctgcctcctctaccggcgaacccgaagtgaagcgctcccgagtggaagaacctagcggcgccgtgactacaccggccggagtgatcgcagctgccggaccgcagggccccggcacgggcgagtag

SEQ ID NO: 47701 - DNA, 1713 bp, Artificial Sequence
  Description of Artificial Sequence: Synthetic coding sequence
atggcctactgcctgggcgtgaacttcgtgcccagccggttctgctatcagctgcaccgtctgctcctgcgttgtacttttcgcttccctagtacggccattaagattcagtttacatctttataccacaaagaagaggcccctgcaagtcctctcagacctctctacccacaaatctccccactgaaaattcatatcccggagcccgatttacgctctatggtctcacccgtgccgtcccctaccggcacgatcagtgtccctaactcatgccctgcctccccccgaggcgctggttccagtagttaccggtttgtccaaaacgtgacaagtgacttacagctcgcggcagaattcgctgctaaagccgcaagtgaacagcaagccgacacctctggcggagattcacccaaggatgaatctaagcctcctttcagctacgcccagttgattgttcaggccatttcctccgcccaggacagacagctgactttaagcggcatctacgctcacataacaaagcactacccttactaccggaccgcagacaagggctggcagaacagcataagacataatcttagcctgaaccgctatttcatcaaggtaccccgaagccaagaggaacccgggaaaggaagcttttggagaatcgacccagctagcgaggctaagctggtggaacaggcctttaggaagagaagacagagaggagtctcctgcttccgcacacctttcggccctctatctagcaggtccgcgcctgcttccccaactcaccctggcctgatgtccccacgctctggaggactgcagacccccgagtgtctatcaagagaaggttcaccgatcccccatgatcctgagttcggatctaagctagcttccgtccctgaatatcgatactctcagtccgcccctggaagcccagttagtgcccagcccgtgattatggctgtcccacctcgcccaagcagtcttgtcgctaagcctgttgcatacatgcctgcctccattgttacctcccagcagccggctgggcacgccattcatgtggtgcagcaggctcccacagtaacaatggtcagggtagtgactacatccgccaattccgctaacggttatatacttacaagtcagggcgcggcggggggctctcacgatgcagcgggtgcggcagtgctggatctcggctcggaggcgagagggctggaggagaaacctaccatcgcattcgctacgatccctgcggcaggcggagtgatccagacggttgccagccagatggcaccaggggtccctggacacacggtcacgatactccaaccagcgactcccgtgacactgggacagcaccatttgccggtgagggccgtgacccaaaacggcaaacatgctgtgcctacaaactctctggcgggtaacgcatacgccttaacatcacccctccagctcctcgccacccaggccagttcttcagcgccagtggtcgtgacacgcgtctgtgaggtcggtcccaaggagccagccgccgctgttgccgccaccgccaccacaactccagccaccgctacgacagcgagtgcaagcgcatcttcaacgggcgagccagaggtgaagcgatcgagggtcgaagaaccaagcggcgctgttaccaccccagccggtgtgattgccgctgccggccctcaggggcccggaactggcgagtag

SEQ ID NO: 47702 - DNA, 1470 bp, Artificial Sequence
  Description of Artificial Sequence: Synthetic coding sequence
atggtgagccccgtgcccagccccaccggcaccatcagcgtgcccaacagctgtcccgcaagccctaggggtgcaggttctagttcttaccggttcgttcagaacgttactagcgacctccagttggctgcagaattcgcagctaaggccgcaagcgagcagcaagccgacacatcaggcggggattctccaaaggatgagtctaaacctcccttttcctatgctcagctgatcgtccaggccattagctccgctcaggaccgacagctcaccctttccggcatatatgcccacattaccaagcactatccctattacaggactgcggacaaaggttggcagaacagcatcagacataacctatctttaaatcgctacttcatcaaggtgccaaggagtcaggaggaaccgggaaaagggtccttttggaggatcgacccagcctccgaggctaaactcgtggaacaagcctttagaaagaggagacagaggggcgtatcctgctttagaacaccttttggtcccttgtcctcccgatccgctcccgcctctcctactcaccccggactgatgtctcctcgttcagggggtttgcagaccccccctattcctcacgacccagagtttggctccaaacttgccagcgtgcccgagtacagatactctcagtcggcaccaggttcacctgtaagtgcgcagcctgtgattatggctgtccctcctcgacccagctcactggtggcaaaacctgttgcctatatgcctgcaagcatcgttacgtcccagcagccagcaggacatgcaattcatgtggtccagcaagctcctacagtgactatggttagagtcgtgactacttccgccaattctgccaatggatacatattaacatctcaaggagccgcgggcggtagtcacgacgccgctggcgctgcggtcctggatcttggctccgaggctaggggactcgaggaaaaacccaccattgcattcgctaccatacccgccgctgggggcgtaatccagactgttgccagtcagatggcgccaggcgtgcctggtcatactgtcactatcctacaacctgccaccccagtcaccctagggcagcaccacctgccagtccgggctgtcactcagaacgggaaacacgcggtccctactaactcactggcgggtaacgcatacgctctgacgtctcccctgcaactcctggctacccaggcctcctccagcgctcctgtggtggtcacccgcgtgtgtgaagtgggccccaaagagccagccgctgccgtggccgcgacagctaccactactcccgcaacggctacaactgcaagcgcctctgcaagctccactggagagcccgaggtcaagcgctccagggttgaggagcccagtggagcggtgaccaccccggctggagtcattgcggccgccggaccacagggcccaggtaccggcgaatag

SEQ ID NO: 47703 - DNA, 1752 bp, Artificial Sequence
  Description of Artificial Sequence: Synthetic coding sequence
atgcggcagcccagcgtgaccatcggccggaacagcagccagggctctgtcgatctctccatgggcctgtcctcatttatatcacgcaggcatttgcagctcagctttcaagagcctcacttctatctgcggtgtttaggtaaaaacggggtgtttgtggatggcgcgttccagaggagaggggctcctgctttgcagctgcccaagcagtgcacatttcgcttccccagtactgctattaagattcagtttacttccttgtaccacaaggaggaggcccccgcgtctcctctgcgcccactctatccacaaatttccccattaaagattcatattccagagccagatctgcggtcgatggttagtcccgtgccgtctcccactggtaccatcagtgtgccgaatagctgtcctgcgagccctcgcggcgcaggctccagtagctatcggtttgtacagaacgtaacctctgatttacagctggctgctgaattcgccgccaaagccgcatccgaacagcaggctgatacgagcggcggcgattcaccgaaggacgagtctaagccaccattctcctacgcccagctaatcgtgcaggctattagcagtgctcaggatcgacagctgaccctgagtggcatctacgcccacatcaccaaacattacccgtactatagaaccgccgataaaggatggcaaaattctatccgccataatctttcactgaaccgatacttcataaaggtgccacgtagccaagaggaaccagggaaggggagcttctggagaatagaccctgctagtgaggctaagctggtcgaacaagcctttcgcaagcggcgccagcgaggcgtttcctgctttcgcactcctttcggcccactgagttcccgaagcgcgccagccagtcctacccacccaggcttaatgagtcctcgatcaggtgggctccagacaccagagtgcctatctcgggagggatcacctattccacacgaccctgaatttggatcgaagttggcaagcgtgcccgagtataggtattcccagagcgcgcctggctctcccgtgagcgcccagcccgtcatcatggcagtccctcctcgtccttcttctctggttgcgaagccagtggcttacatgcccgctagtatcgtaacaagccaacagccagctgggcatgcaatacacgtggtccagcaggctcccacagtgaccatggtaagagtggttaccacttctgcgaattctgccaacggctacatattaacatcacagggagctgctggaggctcacatgacgctgccggtgccgctgtgctagatcttgggtccgaggctcgtggcctcgaggagaaacccactatagctttcgcaactatccccgccgctggaggggtcattcagactgtggcctctcagatggcgcccggagtaccaggccataccgtcaccatcctgcaacccgccacccccgtgactcttggccagcaccatctcccagttagggccgttacacagaacggcaagcatgccgtgcccaccaacagtctcgcaggaaatgcctacgctttgacctcacctctgcaactacttgctacccaagcctccagcagtgcacctgtggttgtgacaagggtatgtgaagtgggaccaaaggaacccctgcctcctcctcctttacccccccccctgcccctggaatccccccggtcaaagggccccggctggcggtccccggtggtgctgtag

SEQ ID NO: 47704 - DNA, 1947 bp, Artificial Sequence
  Description of Artificial Sequence: Synthetic coding sequence
atggtgagcctgccccccccccagagcgacgtgaccctgcccggcccaactagattggagggggaacggcagggagatctaatgcaggcaccgggcctccccgggtccccggctccgcagagcaaacacgctggcttcagctgtagctcctttgtgtccgacggccccccagaaagaacaccatcactgcccccccatagcccacggattgcctcgcccggtcccgagcaggtacagggccactgtcctgccggacctggcccaggaccattccgcttaagcccttctgataagtacccaggctttggcttcgaggaggctgctgcttccagccccggccggttcctgaaggggagccacgctccattccacccctataaacggccattccatgaggacgtctttcccgaggctgagactactctggccctcaaagggcatagttttaagacacctggccccctagaggctttcgaagaaattcccgtcgacgtggccgaggcagaggcatttttacccggattcagcgccgaggcctggtgtaacggcctcccctacccttctcaggagcacggtcctcaggtgctgggaagcgaggtgaaggtaaagcctccagtgctggagtctggggcgggtatgttttgttaccagcctcccctccaacacatgtactgctcttcccaaccccccttccatcagtactcacccggcggaggaagctacccaatcccttacctgggatcatcccactatcagtaccagcggatggcaccacaggcatctacagatggacaccagcccctgtttcctaagccaatatactcatactcaatcctaattttcatggcactgaaaaattcgaagaccggctctctgcccgtttccgagatttacaacttcatgaccgagcatttcccctacttcaagactgccccggacgggtggaaaaatagcgtgagacacaatctgagcctaaacaaatgctttgagaaggtcgagaataagagcggttctagctctcggaagggctgcctttgggccctgaaccccgctaagattgataagatgcaggaggaactgcagaagtggaaaaggaaggaccccatcgcagtcagaaaaagtatggccaagcccgaggagctggatagcttgatcggagacaagagggagaaactgggctctccactcctcgggtgccctcctccagggctttccggctcaggtccaatcaggcccctcgcccctcctgctggcttatcaccccccctgcattctctccatcctgcaccagggccgatccctggaaagaatccgctccaagatctcctgatgggccatacaccaagctgttatggacagacgtaccttcacctgtcacccgggctggcgcctccaggccccccgcaacccctgttcccccagcccgacgggcacctggaacttcgcgcccagcccggaacaccacaggacagccctctacctgcccatacccccccatcccacagcgcaaaactcctggccgagcccagccccgcccgaaccatgcacgacaccctcctacccgacggggatctcgggactgacctcgacgcgataaacccaagcttaacagacttcgacttccagggcaatctttgggagcagctcaaggatgatagcctagcactggatcctctcgtgcttgttacaagttcccccacatcctcttcaatgcctccacctcagcctccccctcattgctttccacctggtccctgcttaaccgaaactggcagtggagcaggggatctagccgcgcccggcagcggcggcagtggagctcttggcgacctgcaccttactaccctgtattcagcgtttatggagttggagccaactccacctacagcccctgccggaccatctgtatatctttcgccctcgtccaagcctgttgccttagcctag

SEQ ID NO: 47705 - DNA, 1191 bp, Artificial Sequence
  Description of Artificial Sequence: Synthetic coding sequence
atgcccaacccccggcccggcaagcccagcgcccccagcctggccttgggacctagccctggagctagtcccagctggagggccgcccctaaagccagcgacctcctcggcgcccgagggccaggtggcacttttcagggccgggatctccggggcggcgcccatgcctcgtcctcaagtctcaacccaatgccaccctcgcagctgcagctatccaccgtggacgcccatgctaggacccccgtgttgcaggtgcacccattggagagccccgctatgatttccctaactccccccactaccgccaccggcgtgttttcactgaaggctcgccccgggcttccgcccgggataaacgtggcttctttggagtgggtcagtagagagcctgccctgctgtgcacctttcctaatccatctgccccccgaaaggactccaccttgagtgccgtgccgcagtcctcatatcccttgctcgcgaatggagtatgtaagtggccagggtgcgagaaagtgttcgaagaaccagaggactttctaaaacattgtcaagcagatcatctcctggatgagaagggtcgcgctcagtgcttgctgcaacgcgagatggtccagagtctggaacagcagttggtcctggagaaggagaagctctctgcaatgcaagctcacttagccggaaagatggctctgacaaaagctagtagtgtggccagctcagataagggttcctgctgcattgtggctgctggctcgcagggtcccgttgttcccgcgtggtccggccccagagaggcccccgactcactctttgcggtgcggcggcacctctggggctcacatggcaattctacattccccgaattcctccataatatggactattttaaattccataacatgagaccaccatttacatacgccacgctgattagatgggcgatcctggaggctcccgagaaacagcgcacgctgaatgaaatataccactggttcacccgcatgttcgctttttttaggaaccacccggccacttggaagaacgccatcaggcataacttgtcactgcataagtgttttgttcgggttgagtcagaaaaaggggcagtatggactgttgatgagctggagtttcgaaagaagcgtagccagcgcccgtcaaggtgcagcaaccccactccagggccctag

SEQ ID NO: 47706 - DNA, 2052 bp, Artificial Sequence
  Description of Artificial Sequence: Synthetic coding sequence
atgcaggagctggagagcctgctggcccagcagaagaaggccctggcgaaaagcattacccaggaaaaaaatcgggtaaaggaagccctggaggaagagcagaccagggtacaagagttggaggaaaggttagccaggcagaaagaaatcagcgaatccaacatagcatacgaaaagcggaaggcgaaggaggcaatggagaaggaaaaaaagaaggtgcaggacctcgaaaaccgtctcacgaagcaaaaggaggagctcgaattgaaggagcagaaggaggacgtgctcaacaataaattatctgacgctttggcaatggtcgaggaaacacagaaaactaaggccaccgaatctctgaaagctgagtcattggccctgaaactcaatgagacgttagccgaattggagaccacgaaaaccaaaatgattatggtggaggagagactgatattgcagcaaaaaatggtgaaagcactccaggatgaacaggagtcccagcgtcacgggttcgaagaggaaataatggagtacaaggagcaaattaagcagcacgcccagaccatagtttctctcgaagaaaagctgcagaaagtgacgcagcaccacaaaaaaatagagggcgaaatcgctacactcaaggacaacgatcctgctcctaaagaagagcgcccacaagaccccctggtggcgcccatgacggagtcatcagccaaagacatggcctacgaacacctcatcgacgatctcctggcagcccagaaggaaattctatcgcaacaggaggtgattatgaaactgcgaaaagatctgacagaagcccattctcggatgagcgacctgcgtggagagttaaacgaaaaacagaagatggagctcgagcagaacgttgttctcgtacagcagcagtctaaagaactgagtgtcctgaaagagaagatggcgcaaatgtcaagcctcgtggagaaaaaggacagagagcttaaagctcttgaggaggctttaagagcatcccaggagaagcatagactccaactgaacaccgagaaggaacagaagcccaggaaaaaaacgcagacgtgcgacacctcagtacagattgaacccgttcatactgaggcgtttagtagctctcaggaacaacagagcttcagcgatctgggcgttcgctgtaaaggatccaggcatgaagaggtaatacaaaggcagaagaaagccctatcagaattgagggcacggattaaggagttggaaaaagcacggtcacccgaccacaaggaccatcagaacgagtccttcctggatctgaaaaatctaagaatggaaaataatgttcagaagatcttgctcgacgcgaaacctgatttgcctacgctgagtaggatcgaaatactggctcctcaaaatggcctctgtaacgcacgatttggcagcgcaatggagaaaagcggcaagatggacgtggccgaggccctggaactcagcgaaaagctctaccttgacatgagcaaaaccttgggttccctcatgaatatcaaaaatatgtccggtcatgtaagcatgaagtacctctcacgccaggagcgggaaaaggtgaaccaacttcggcaaagagatctagatttagtttttgacaaaatcacacagctcaagaaccagctaggacgtaaggaggagttactccgcgggtatgaaaaagatgtcgaacagctacgacgaagcaaagtgtccatcgagatgtaccagtcccaggtggctaagctggaagatgatatctataaggaggccgaagagaaagccctccttaaggaggctctagagaggatggaacaccaattgtgtcaggaaaaaaggatcaaccgagccattcggcagcaaaaacgcagagtgttcgtcgaaatggtgaagaaccgcatgcagaactcgaactcccaggtggggacaaggaaggctagcctgaagatggaccaggaacgtgagatgctcaggaaggagacatcctcaaaatcttcacagtccctcctacattctaaacccagcggcaagtactag

SEQ ID NO: 47707 - DNA, 4239 bp, Artificial Sequence
  Description of Artificial Sequence: Synthetic coding sequence
atgaaggcctacctgaagagcgccgagggcttcttcgtgctgaacaagagtactaccatcggtaggcacgagaatagcgacctggtgctccagtccccagatatagacaaccaccacgccctgattgagtataacgaagccgaatgtagcttcgtattacaggactttaattcacggaatgggacttttgttaatgaatgtcacattcagaacgtcgcggtgaagctcatcccaggggacatactacggtttggcagcgcaggtctcacttacgagctggttattgaaaatcccccacccgtgtcttttccctggatgcgggggccagcgccgtggcctggtcctcagcctccccgcgcaacccagcagcctaatcaggcgccacctccctcccacatccccttccaccagggcgttcagcctgctcccatgcagagaagttggtcccaggctttccccaggccaacagtagtcctgccagcctctcacagaaggcccgtgtctgccaataaggagatgtttagtttcgtagtggatgacgcacgcaagccacctgtcatcaagcaagtttggactaatgccatgaaactgtcagagaagagcgttgccgaaggcataccaggcgccgttcccccggctgagatttatgttgaggaggacctcgcacagcaagataaagacgagataatcctgctgctcgggaaagaggtgagcaggcttagcgactatgagattgaatcgaagtacaaagatgttattattgctaatcttcagaatgaggtcgcagagctgtctcagaaagtaagcgagaccaccactagcagacagaacgaaaaggagatctctcagaaatgccaagtcctggacgaagacattgacgctaaacagaaagagatccagtcccttaagagccagatcagtgccctgcagaaaggatactcaaaggtcctctgccagactctgtcggagcgaaatagcgaaattacatctctgaagaacgagggtgaaaacctgaagcgcgataatgcaattacaagcggaatggtctcctcactgcagaaggatattctcgctaaggatgagcaggtccagcaactgaaggaagaagtatcacatctgaaaagccagaacaaagacaaggaccatcaactggaggccttaggcagccggtgtagtgttctgaaagaggaactcaaacaagaggacgcccaccgcgagcttcgcgaggctcaggaaaaggagttgaaactgtgcaagacacagatccaggatatggaaaaagagatgaaaaaactgagagcggaacttcgcaaaagttgcaccgagcaatctgttatttccagaacgctcagggaaaaatctaaggtggaagagaagctccaagaagactcaagacgcaagctcctccaactgcaggaaatgggaaacagagagtcagtgattaagattaacctcgaaagagccgttggacagcttgagcatttcagatcccaagttattaaggcgacctatggtcgcgcaaagcccttccgcgacaagcctgtcaccgaccagcagctgatcgaaaagattacacaagtaacagaggacaatatcaatttccagcaaaaaaaatggaccttacagaaggaaacgcagctcagcaatagtaaacaggaagagaccactgaaaatattgagaaattgaggactagccttgatagctgccaggcctgcatgaagatctcctgctgtagccacgatctgaagaaagaagtcgatttgcttcaacacttacaggtgtcacctccggtttcaggcctgcagaaagtcgtactggatgtgctccgacacgccttgtcatggttagaggaggtggagcaactcctaagggaccttggtatccttccatcgagcccaaataaagaccaagtgcagcaattcagcggaaatagcgccgtatttacggccggcaaggccgccggcgccagcggccgcgaaggagaggcggagcggggtgaagctcgtgcgcggggagaagctcaaagccagaaccaggctaccgatggccgcgagggtgggaaggcgctggaggagtacatcacacaggagcgcaacagggcaaaggagaccctcgaagaagagcgaaagagaatgcaggagctcgagagtctgctcgcgcagcagaaaaaggcactggcaaagagtattactcaagaaaaaaatagggttaaggaggccttggaggaagagcaaacccgggtccaggaactggaggagcggctggcccggcaaaaggaagtgctggagtcttccattgctcacgaaaagcgcaaggccaaagaagctctcgagagtgagaagagaaaggtgcaagacctggagaatcacctcactcaacaaaaagagatctctgagtccaatatcgcatacgagaaacgcaaggctaaagaagctatggaaaaggaaaaaaagaaggtgcaggacctggaaaacagactcactaaacagaaggaagaactggagctgaaagaacagaaggaagatgtgctgaacaataaactgtcagacgctctggccatggtggaggaaacccagaaaaccaaagctactgaaagtttgaaggctgagagcctagccctgaagctgaatgagacgcttgcggaactggaaacaactaaaacgaaaatgattatggtcgaggaacgtttgatcctgcagcagaaaatggttaaggctttacaggacgaacaggaatcccagagacatggcttcgaggaggagatcatggagtataaggaacagattaaacagcacgcacagaccattgtcagtctagaggagaaattacagaaagtgacacagcatcacaagaagatagaaggcgaaattgcgacactgaaagacaatgatcccgcacctaaggaggagcgcccacaagatccgctggtggcgcccatgacggaatcctccgctaaggacatggcctatgagcatttgattgatgatctgctcgctgctcagaaagagattctttctcaacaggaggttattatgaaactcaggaaggacttgacagaggcacatagtagaatgagtgacctgcgaggggaactgaacgagaagcagaagatggaactggagcagaacgttgtgctcgtccagcagcaaagcaaggagctctctgtgctaaaggagaagatggcacagatgtcctcacttgttgagaaaaaggatagggagctgaaagcactcgaagaagctctccgcgcgtctcaggaaaagcataggctccagctgaacaccgaaaaggaacagaaaccacgcaaaaagacacagacctgtgacacttcagtccagatcgagccggtccacacagaagcttttagttcttctcaggagcaacaaagctttagtgacttgggagttcgttgtaaaggctctcgtcacgaggaagtgattcagagacagaagaaagccctcagcgagcttcgggcacggatcaaagagctcgagaaggcaagaagtcctgatcacaaggaccaccagaacgaatccttcctggacttaaaaaacctccggatggagaataacgtgcagaagatcctcttggacgcaaagcccgacctgcccacacttagcaggatcgaaatactggcaccgcagaatggcctttgtaacgcacgcttcgggtctgcaatggaaaagagcggcaaaatggacgtggccgaagccctagaactatccgagaagctgtacctggatatgtcaaaaacgctgggatccctgatgaacatcaaaaacatgagtggccacgtgagcatgaaatatttaagcagacaggagcgagagaaagtaaaccagctgcggcagcgcgacctagacctggtgttcgataagatcactcaacttaaaaatcagctcggtaggaaggaagaactcttaagaggatatgagaaagatgtggagcaactgaggcggtccaaagtgtcgatcgagatgtatcaatcccaggtcgcaaagttggaagatgacatctacaaagaagccgaagagaaagcactgctgaaagaggccctggagcggatggagcatcagttgtgccaggaaaagcgtattaatcgggcaattaggcagcaaaaagtggggacgcggaaggcttcacttaagatggaccaggagcgcgagatgctgagaaaggagacaagctccaaaagcagtcagagtctgctgcactctaaaccatctggcaaatactag

SEQ ID NO: 47708 - DNA, 4362 bp, Artificial Sequence
  Description of Artificial Sequence: Synthetic coding sequence
atgaaggcctacctgaagagcgccgagggcttcttcgtgctgaacaagtccactactatcggccgccacgagaacagtgacctggtgctccaatccccagacatcgacaatcaccacgccctgattgagtacaacgaagcagagtgcagcttcgtcctgcaagactttaatagcaggaacggaaccttcgtcaatgaatgccacattcagaacgtcgcagtgaaacttattcccggcgatattctgcgcttcggctcagccggtctaacatacgagctggtgattgagaaccctcctccagtgtccttcccttggatgcgcgggccagccccctggcctggaccacaacctccaagagcgactcagcagccaaatcaagccccaccgcctagccacatccctttccatcagggcgtgcagccggcaccaatgcagcggagctggagccaagcatttcctaggcctaccgtggtgctcccggcctcccaccggagacctgtgtccgctaacaaggagatgttttcctttgtggtcgacgatgctagaaaacccccagtaataaaacaagtgtggactaacgccatgaagctttcggaaaagtctgtcgctgaggggattccaggagctgtcccacctgctgagatctacgtggaggaagacctggcccaacaagataaggatgagattatccttctgctcggcaaagaagtttctcgcttatccgattacgaaattgagtcaaaatacaaagacgtaataattgccaacctacagaacgaagtggcggaattgtcccagaaagtttccgaaaccacaacatcacgccagaatgagaaagaaattagtcagaaatgtcaggtcctggatgaagacattgatgctaagcagaaggagatccagagtctgaagtctcagataagcgcactgcagaaaggatattctaaggtgctttgccaaacactgtctgagcgcaacagcgaaatcacttcgttgaagaacgagggcgaaaacctgaagcgcgacaatgcaataacctccgggatggtctccagcttacaaaaggacatccttgcaaaagacgagcaggtgcagcagcttaaagaagaggtctcacacttgaagtctcagaataaggacaaagaccaccaactcgaggctctgggttctaggtgcagcgtgctgaaagaggagctcaagcaggaggacgctcaccgcgaactgcgagaagctcaggaaaaggagctgaagctctgcaaaacccaaatccaggatatggaaaaagaaatgaagaaactccgcgccgagctcagaaaatcgtgtactgaacagagcgtgatcagtaggacactccgcgaaaagtcgaaggtggaggagaagctgcaggaggatagccgccgaaaactgcttcagttacaggagatgggcaaccgtgagtccgtaatcaagattaatctggaaagagcagttgggcagctggagcacttcaggtctcaggtgatcaaggccacatacggacgagccaagccgttccgcgataagcccgttaccgatcagcagctgattgagaagataactcaggttaccgaggataacataaatttccagcaaaagaaatggactcttcagaaagaaacgcagctgtcaaacagtaagcaggaggagactactgagaacatagagaagctgaggacctcattggactcttgccaggcctgcatgaagatcagctgttgctcacatgacctcaaaaaggaggtggatttacttcagcatctccaggtatctccacccgtctcagggctgcaaaaggtcgtgctggatgtgttaagacacgctctgtcatggctggaggaagtggaacagctgctgcgtgacttgggcatcttaccctcatcacccaataaggatcaagtgcaacagtttagtggaaactccgccgtgtttactgccggaaaggccgctggggcaagcggcagggagggcgaggcagaacggggtgaggcgcgggcccgtggagaagcgcagagccagaaccaagcgacggatgggagggagggtggcaaagcactcgaagagtacatcacccaggaacgaaatcgcgctaaggaaacgttagaagaggagaggaagagaatgcaggaactagagtctcttttggcgcagcagaaaaaggccctggctaaaagtatcacacaggagaagaatcgagtgaaggaggctctggaggaggaacaaactcgggttcaagaactggaagaacgcctagcccggcagaaagaggttctggagtccagtatcgctcacgagaagagaaaggccaaagaggctctcgagtccgagaagaggaaagtccaggatcttgaaaatcatctgacccagcaaaaggagattagcgaatctaacatcgcttacgagaagagaaaggccaaggaggccatggagaaggagaagaaaaaggtgcaagaccttgaaaaccgtttgacaaaacagaaggaggaactggaattgaaagagcagaaggaagacgtactgaacaacaagctttctgacgcactggccatggtggaggagactcagaagacaaaagccaccgagtcacttaaggccgaatctctcgccctgaaactcaatgagacacttgctgagctcgaaacaaccaagactaagatgattatggtggaggaacgtctgatcttacagcagaagatggttaaggccctccaggacgagcaggaatctcagcggcacgggtttgaggaagaaatcatggagtataaggaacagattaagcaacacgcacaaaccattgtgtcgttggaagagaagctgcaaaaagtcacacagcatcacaagaagattgaaggagagatcgccacactgaaggacaatgatccggcaccgaaggaagaacgaccacaagaccctctggtagctccgatgaccgaatcctctgccaaggacatggcatatgagcatctgattgacgatctgcttgctgcccagaaagaaattctgtctcagcaggaggttattatgaagctgcgaaaggacctcacggaggcacactcgagaatgagcgacttaaggggtgaactgaacgagaaacagaagatggaattggaacagaacgttgtcttggttcagcagcagtctaaagaactttctgtgttgaaagaaaaaatggcccagatgtccagcctggttgagaagaaggatcgagagctgaaggcactggaggaagctctgcgcgcaagccaggagaaacaccgcttacaactcaatacagagaaggagcagaagcctcgaaaaaagactcagacatgtgataccagtgtgcagattgaaccagtgcatacagaggcattttctagttcacaggaacagcagtcatttagtgatctaggcgtaaggtgcaaagggagtaggcacgaagaagtaatccagagacaaaagaaggcgctgagcgaactccgtgcccgaataaaagagctggaaaaggcccgctcacccgaccataaagaccatcagaatgagtcctttttagatctgaaaaacctgcggatggagaataatgttcagaaaatcctcctcgatgccaagcctgatctgccaaccctgagtagaatagagattctagccccgcaaaatggattgtgtaatgcgaggtttggaagtgccatggagaaaagtggaaagatggacgtggcagaggccctggagctgtcagaaaaactgtacctggacatgtccaaaacactgggctctctgatgaacatcaagaatatgagtgggcacgtcagcatgaagtatttgtcgcgccaagaaagagagaaggtgaaccagctgaggcagcgcgatttagatctcgtgttcgataaaataacccaactcaagaatcagttggggcgaaaagaagagctgctgcgcggatatgagaaagatgtggagcaacttcgacgatcgaaggtaagcatcgaaatgtaccaatctcaagttgcgaaactggaggacgacatatacaaggaagctgaggagaaggcactgctgaaggaagccctggagcgaatggagcaccagttgtgtcaagaaaagcggataaatcgggctataagacagcaaaagatgcggaagctgcggctccgggaattgcgcggagctcaggttcatacagctgccgggaaggattcttgggacttgacacccgaccccagtgacccaggctcacctgctgtttgtagggtggggcgaaaatgcaggggggctcgtacggagaaacggaagaggattgacacactccagctctgtctccagcgcgagcggcaggctggacctgccccacccgcctgttccctcaacggctag

SEQ ID NO: 47709 - DNA, 951 bp, Artificial Sequence
  Description of Artificial Sequence: Synthetic coding sequence
atgatcctgcggcccccccggccctgcggcaccatcagcgccctgcagaagggctacagcaaggtcttgtgtcagaccctttccgagcgcaactccgaaattacctctcttaagaatgaaggcgagaatttgaaacgcgataatgcgattaccagcggtatggtcagctccttgcaaaaagacatactggccaaagacgaacaggtgcagcagctgaaggaagaagtatcccatttaaagagtcagaataaagacaaggatcatcagctggaggccctgggcagtcggtgtagtgtacttaaagaagaactaaagcaggaggacgcacatcgcgagctccgcgaggcccaagaaaaggagctaaagctatgcaaaacccagattcaggatatggagaaggaaatgaagaagttacgggcagaattgaggaagagttgtaccgaacagagcgtgatctcgcgtacattacgagagaagagcaagctggaacattttcggtcccaggtgattaaggcaacctacgggagagcaaagcctttcagagacaagccagttaccgatcagcagctcatagaaaagataacccaggtgactgaggacaacataaactttcaacaaaagaagtggaccctccagaaggagacgcaactgagtaattctaagcaggaggagacaaccgagaatatagagaaattaaggacttcattggactcctgtcaagcgtgtatgaagatttcctgctgttctcacgatctgaagaaggaggtggacttgctccaacatctgcaggtcagcccaccagtgtcaggactgcagaaggtggttctcgacgtcttgcgccacgcactgtcttggttggaagaggtggaacagctgctccgcgatctggggattttgcccagttcccccaacaaaggctattgggatttcttttcccacatggtcgcttag

SEQ ID NO: 47710 - DNA, 4131 bp, Artificial Sequence
  Description of Artificial Sequence: Synthetic coding sequence
atgaaggcctacctgaagagcgccgagggcttcttcgtgctgaacaaaagtaccaccatcggaagacacgaaaacagtgacttagtacttcagtcccctgacatcgacaatcaccatgctctgatcgagtataacgaggctgagtgcagctttgtgctgcaggattttaacagtagaaacggaactttcgtgaatgagtgccacatccagaatgtggcagtgaaattaattccaggggatatcctgagatttgggtctgccggactgacatacgaattagtgatagagaatccgccacctgtttccttcccttggatgaggggacccgcaccctggccgggaccacagccacctcgagcaacccaacaaccaaaccaggcacccccaccaagccacattcctttccaccagggcgtccagcccgccccgatgcaaaggagctggtcccaggcattccctagaccaaccgtggttctgccagcatcacatcggagacctgtctccgctaacaaggaaatgttcagtttcgtcgtggacgatgcacgaaaacctcctgtgatcaaacaagtgtggacaaatgccatgaagctttccgaaaaatccgtcgcggaggggataccaggcgccgttcctcctgccgagatctacgtggaggaggacctggcccaacaagacaaggacgagatcatcctgctgctgggcaaagaggtgtctaggctgtctgactacgaaattgaatcgaagtacaaggatgtgatcatagccaaccttcagaacgaggtggccgagctgtcccagaaggtctctgagacgactaccagcaggcagaacgagaaggagatcagccagaagtgccaggtgttggatgaagacatcgatgccaaacagaaagagatccagtccctgaagtcacagatcagcgcacttcagaaggggtattctaaggtgttgtgtcagacgctgagcgagaggaatagcgagattactagcctgaagaacgaaggcgaaaatcttaaaagagacaacgctataacctctggaatggtatcctctctccaaaaagacatactagctaaggatgagcaagtgcagcaactgaaagaagaggtctcacacctgaaatcccagaataaagacaaggatcaccagttagaagctctgggaagtagatgtagcgtgttaaaggaggaactgaaacaggaagatgctcaccgagaactgagggaggctcaggaaaaggagctcaagttgtgtaaaacccagatccaagatatggaaaaagaaatgaaaaaactcagggctgagttgcggaaatcatgcaccgaacagtccgtcatctccaggacgcttcgcgaaaagtccaaggtagaggaaaaactgcaggaagattcacgtaggaagctcttgcagctgcaggaaatgggtaacagggaatccgtcatcaagattaatctggagcgagccgttggacagctggaacattttcggtcccaggtgataaaagccacctacggaagggcgaaaccttttcgtgataagcctgttactgaccaacagctgatagagaagatcacacaggtaacagaagataacataaactttcaacaaaaaaagtggacactacagaaagagactcaactttccaactccaaacaggaggagaccacggaaaacatagagaaattgaggacttccctggactcatgccaggcctgcatgaaaatatcttgctgctctcatgatctgaaaaaagaggtcgacttgcttcagcatctccaggtttcaccccccgtgtccggcctccagaaggtggtgttagacgtattacgacatgctctcagttggctcgaggaagtggagcagttactgcgggacttaggcatcctccctagcagtccaaataaggaccaagtgcagcagtttagtgggaactctgctgtcttcacggctgggaaagcagctggtgcgagcggtcgcgagggggaagcggagcgaggggaggctagagcccggggggaggcgcagtcccagaatcaagctacggacggcagggaggggggtaaagccctggaagaatatatcacccaggagaggaaccgagctaaggagaccctggaggaagaacgtaaaaggatgcaagaactggaaagtctactggctcagcagaagaaagccttggctaagagtatcacacaggagaagaatcgcgtgaaagaagctctggaggaagagcaaactagggttcaggaactggaggagaggttggctcgccagaaggaaatctccgagtctaatattgcatatgaaaagagaaaagcgaaagaggcgatggaaaaagagaagaaaaaggtacaggacttggaaaatagactcactaaacagaaggaagagctggaacttaaggaacagaaggaggatgtgctcaacaacaagctgagcgatgcgcttgctatggtggaggaaacacagaagactaaggcgaccgaatcactcaaagctgagtctttagcactcaagctcaacgagactctagcggagctcgagaccactaaaacaaagatgatcatggttgaggagcgactaatcctgcagcagaagatggttaaagctcttcaagacgagcaggagtcccagcgccacgggttcgaagaggagattatggaatacaaagaacagatcaagcagcatgcacagactatcgtgagcttggaggaaaaactgcagaaagtgacacagcaccacaagaagatagagggggagattgccacgctaaaggataatgacccagccccaaaggaggaacgacctcaagaccccctggtcgcccctatgactgagtcaagtgctaaagacatggcttacgagcacctaattgacgacctgcttgccgcccaaaaggagatcctatctcagcaggaagtcatcatgaagctgcggaaagacctcacagaggctcacagcaggatgagtgacctccgcggggaattgaacgaaaaacagaagatggaactggagcagaacgttgtgctggtccaacagcagtccaaagagttgagcgtcctaaaggaaaagatggcacagatgagctcactggtggagaagaaagacagagaattaaaagcgctggaagaggcattgagggcctcacaagaaaagcatagactgcagctgaatacagagaaggagcagaagcctcgaaagaaaactcagacctgtgatacttctgtacagatcgagcctgtgcataccgaggctttcagctctagtcaggaacaacagtcatttagtgatttaggggtgcggtgcaaaggatcaagacacgaggaagtgatccaacgccagaaaaaagcgctgtcagagttgagagccaggatcaaggaactggaaaaggctcgctctcctgaccacaaggatcaccaaaacgagagctttctggatctcaagaacctcaggatggagaacaatgtgcagaagattcttctcgatgcaaaacctgacttgcccacgctgtcacggattgagatcctggcaccccagaatggcctgtgtaacgctcggttcggatctgccatggagaaatcggggaagatggacgttgcggaggccctggaattatctgaaaagctgtatctggatatgagtaagacactgggatccctgatgaacattaaaaatatgagcggacatgtgagcatgaaatacctctctaggcaggaaagagaaaaggttaatcagctcagacagcgtgacctagatttggtgttcgataaaattactcagctgaagaaccaacttggaagaaaggaggagctactgagagggtacgagaaggacgtggagcagctcagacgcagtaaagtttcaatagagatgtatcagtcacaggtggctaaactcgaagacgacatttataaggaggccgaagagaaggccctcctcaaagaagccctggagcgcatggaacatcaactgtgtcaggagaagcggatcaatcgcgccatacgccagcaaaaagtagggaccagaaaggcgtctctaaagatggatcaggagcgagagatgttgagaaaggagacgagttcaaagtctagccagagcctgctacactccaaacccagcggaaagtactag

SEQ ID NO: 47711 - DNA, 1656 bp, Artificial Sequence
  Description of Artificial Sequence: Synthetic coding sequence
atgagctggggcaccgagctgtgggaccagttcgacagcctggacaaacatacccagtggggaattgatttcctcgagcgatacgcaaaatttgttaaagagaggatagaaatagagcagaattacgccaagcaactgaggaacctggtgaagaaatactgcccaaagagaagctcgaaagacgaggaaccacggttcacgagttgtgtagcgtttttcaatatcctaaatgagttgaatgactacgcagggcagcgagaggtagtcgctgaggaaatggcccacagggtctacggtgaactgatgagatatgcacacgatttaaagactgagcggaagatgcatctgcaggagggacgtaaagcccaacagtaccttgacatgtgctggaagcagatggacaactctaagaagaagttcgagagagagtgccgggaagctgaaaaggcgcagcaatcatacgagaggctggacaacgatacaaacgccactaaggccgacgtggaaaaggcgaagcagcagcttaacctcagaacccacatggccgatgaaaacaagaacgagtacgcagcgcagttgcagaatttcaatggcgagcagcacaaacacttttacgttgtgatcccacagatctataaacagctccaagaaatggacgagagacgcacaattaagttgagtgaatgttaccgcggctttgctgactcagaacgtaaagtcatccctattatatcaaagtgcttggaaggaatgattctcgcagctaaatctgtcgacgaacgtcgcgacagtcagatggtggttgactcttttaagagcggctttgagccccctggggacttccccttcgaagattatagtcagcacatatatcgtaccatatccgacggaactatttctgccagcaagcaggagagcgggaagatggacgcgaagaccaccgtgggcaaggcaaagggcaaactgtggctgttcggaaagaaacccaagggcccagcactggaagatttctcacaccttcctcctgagcagaggcgaaaaaagctgcagcagcgaattgacgagctgaacagggagctccaaaaagagagcgaccagaaagacgcccttaataaaatgaaggatgtgtacgaaaagaaccctcaaatgggcgacccaggatctttgcagccaaagctggccgagaccatgaacaacattgaccggcttaggatggagatccacaagaacgaggcttggctgtctgaagtcgaagggaaaaccggtggtagaggggataggaggcattcctcggacatcaatcacttagtaacccagggccgcgagagcccagagggttcttacactgacgacgctaatcaggaggtacggggcccacctcagcagcatggccaccataacgaatttgatgatgagtttgaagatgacgaccccctgcctgccatcggacattgcaaagcaatctatccctttgacggccataatgaagggacgctagctatgaaagaaggcgaggtcctgtacataatagaggaagacaaaggagacggctggaccagagcgaggcggcagaacggggaggagggctacgtgccaacaagttacatcgatgttaccctggaaaaaaacagtaaaggggccgtaacctacatttag

SEQ ID NO: 47712 - DNA, 1818 bp, Artificial Sequence
  Description of Artificial Sequence: Synthetic coding sequence
atgagctggggcaccgagctgtgggaccagttcgacagcctggacaagcacacccagtgggggatagatttcctggaaaggtacgcgaaatttgtcaaggagagaattgagatagaacagaattatgccaaacaactccggaatctcgttaagaagtactgtcccaagaggtcctctaaggatgaggaaccccgatttacgtcctgtgtggcatttttcaacatcctcaacgagctgaatgattatgctgggcagagggaagtggtcgcagaggaaatggcccaccgtgtgtacggcgagctgatgaggtacgcgcacgatctcaagacggaaagaaagatgcatctccaagaagggagaaaggcacaacagtatttagacatgtgctggaagcagatggacaatagcaagaaaaagtttgagcgcgagtgtcgggaagctgagaaggcccagcagagctacgagaggctggataacgacactaacgctaccaaggcagacgtcgagaaggcaaagcaacagctgaatcttaggacccatatggccgacgagaataagaacgagtacgccgctcagctgcagaactttaatggtgaacagcacaaacatttttatgtagtgatcccccagatttacaagcagctgcaagaaatggatgaaagaaggactatcaagttaagtgagtgttaccgcggttttgctgattctgaacgaaaggttattccgataatctcaaagtgtctggagggcatgatcttggcggccaaaagcgtggatgagaggagagacagccagatggttgtggactctttcaagtctggttttgaacctccaggcgactttccgttcgaggactactctcagcatatctaccgaaccattagtgacggcaccattagcgcctctaaacaggagtctggtaaaatggacgccaagaccacggttgggaaagccaagggaaagctgtggctatttgggaaaaagccaaagccccagagtcctcccttgacaccaacatctctgtttacatcaagtaccccaaacggctctcagttcctgactttcagcattgagcctgttcattattgcatgaatgagattaagaccgggaaaccccgcatcccctcattcaggagtttgaagagggggtggagtgtgaaaatggggccggccctcgaagacttcagccatctccctccagagcaaaggcgaaagaaattgcagcaacggattgatgagctaaatagagaactgcagaaagagtctgaccagaaggacgcactgaataaaatgaaggatgtgtatgagaagaaccctcaaatgggagatcccggcagcctccagcccaagctggctgaaacaatgaataacatagaccggctcaggatggagatccataagaatgaggcatggctttctgaggtcgaaggaaagactggggggcgtggagacaggagacattcatccgacatcaaccatctcgtcactcagggcagggaaagcccagaggggagctacacagatgacgccaaccaggaagtccggggcccacctcaacagcacggccaccacaacgaattcgatgatgaatttgaagatgacgacccactcccggcaataggccactgtaaggcgatctaccccttcgatgggcacaacgaaggcactttggccatgaaggaaggcgaggttttgtacattattgaggaagacaagggagacggctggactcgggccagaagacaaaatggtgaggaggggtatgtcccaaccagctatatcgatgtgaccctggagaagaactctaaaggatcgtag

SEQ ID NO: 47713 - DNA, 1815 bp, Artificial Sequence
  Description of Artificial Sequence: Synthetic coding sequence
atgagctggggcaccgagctgtgggaccagttcgacagcctggacaaacacacccaatgggggattgatttcttggagagatacgctaagttcgtcaaagagcggatcgagattgaacaaaattacgctaaacagctacgcaacctggtcaagaagtattgtccaaagaggtccagcaaagacgaagagcctcgcttcacttcatgtgtggctttcttcaatattctcaacgaactcaacgactacgccggacagagagaggtggttgcagaggaaatggcccatagagtatatggtgagctgatgcgatacgcacacgacctgaagactgagcgtaagatgcaccttcaggagggtcggaaggctcagcagtatcttgacatgtgttggaaacagatggataatagcaagaaaaagttcgagcgcgaatgccgggaagctgaaaaggcacagcagtcttacgagaggctagataacgacactaacgcaaccaaggccgacgtggaaaaggccaaacagcagttgaatctgaggacccacatggccgacgagaacaaaaacgaatatgccgcccagctgcaaaactttaacggcgagcagcataagcatttctacgtcgttataccacagatttataagcagctgcaggaaatggacgagcgccgcaccataaagttaagcgagtgttacaggggattcgccgattccgagcggaaagtcattccaatcatttccaagtgtctcgagggcatgattctggctgctaagagtgtggacgagcggcgggatagtcaaatggtggttgattcttttaagagcggcttcgagccaccaggcgactttcctttcgaagactatagccagcacatctatcgtaccatcagcgacggaactatttcagcctctaaacaggaatcggggaaaatggatgctaaaaccacggtcgggaaggcgaaaggcaagttgtggttgttcggtaaaaaaccaaaaccccagtcgcccccgctgacgcccacctcactgtttacgtctagcactcctaatgggagccaatttttaactttctctatagaaccagtgcactattgcatgaacgaaattaaaacagggaaacctcgaatccctagtttccgctcccttaagcggggaggaccggccctcgaggattttagccatttgcccccagaacagcgcagaaagaagctacagcaacgaatagatgagctcaatcgagagctccagaaagaatccgatcagaaggatgcactcaataagatgaaggatgtttacgagaaaaatcctcagatgggagatccaggctccctgcagcccaaattagccgaaaccatgaataacatagatcggctccgcatggaaatccacaagaatgaggcgtggctaagcgaagttgagggcaaaacaggagggcggggcgataggcggcactcaagtgatatcaaccacctcgtcacgcagggtcgtgagtctcccgaaggtagctatacagacgacgctaatcaagaggtccggggaccgccgcaacagcatggccaccacaatgaattcgatgacgagtttgaggacgacgatcccctgcccgctatcggacattgtaaggcgatttatccattcgacggtcacaatgaaggcactctggctatgaaggagggggaggtgctttacataatcgaagaagataagggcgacggttggaccagggcccgccgccaaaatggagaggaaggttatgttcctacctcttacatcgacgttactttagaaaagaattcgaagggagcggttacctacatttag

SEQ ID NO: 47714 - DNA, 1803 bp, Artificial Sequence
  Description of Artificial Sequence: Synthetic coding sequence
atgagctggggcaccgagctgtgggaccagttcgacagcctggacaaacatacccaatgggggatcgacttcttggagcgctacgccaaattcgttaaagagcggatagagattgagcagaactatgcgaagcaactgcgcaatcttgtgaaaaaatattgcccaaagcggtcttccaaagacgaggaacctcgatttacctcctgcgtggctttctttaacattctaaatgaactcaatgattacgctggtcagagagaggtggtagccgaggagatggcccatcgggtgtatggcgagctaatgcgttatgcgcatgacctgaagaccgagcggaagatgcacctccaggaaggacgaaaagcccaacagtacttagacatgtgttggaaacagatggacaattcgaaaaagaagtttgagagagaatgccgagaggctgagaaggctcagcagtcatatgaacggcttgacaacgacactaatgccaccaaggccgatgtagaaaaggctaagcagcagctgaacttaaggacccacatggccgatgaaaataaaaatgaatacgccgcacagctccagaattttaatggagagcaacataagcacttctatgtggttatacctcagatatataaacagctgcaggagatggatgagcgaaggaccatcaagctcagcgaatgctataggggcttcgctgacagtgaaaggaaagttattcccataataagtaagtgtctcgaaggaatgattttggcagccaagtcagtggatgagagacgcgactctcaaatggtggtggactccttcaaatctggttttgagccccccggtgatttcccatttgaagattacagccaacatatatataggaccatcagcgacggaaccattagcgctagtaagcaagaatctggaaagatggatgcaaaaaccacagtcggcaaggccaaaggcaagctgtggctgttcggcaaaaagcctaaaccccagagccctccactgacacccacaagcctgttcacatcaagtacacccaacggttctcagtttctaacattttctatcgagccagtccactattgcatgaacgagatcaaaacgggaaagccacggatcccttcatttagaagcctgaagcggggaggaccagcattggaagactttagccatctgccacctgaacaaaggcgtaagaagctccagcagcggatagacgaactaaatcgggagctgcagaaagagtccgaccagaaggatgccctgaataagatgaaagacgtctatgagaaaaacccccagatgggggatcctggatcattgcagccaaagcttgcagaaacaatgaacaatattgacaggctccgtatggagattcacaagaatgaagcctggttgtccgaggtggagggaaagacaggaggaaggggggacaggcgccattcctccgatatcaatcacctggtcactcaaggacgggagtctccggaaggaagctatacggatgacgccaatcaggaggtgcgcggcccaccccaacagcacggtcaccataacgagttcgatgatgagttcgaggacgatgatcctcttcccgccatcggtcactgtaaagcaatctaccccttcgacgggcacaatgaggggactctcgccatgaaagagggcgaggtactgtatatcatagaagaagacaaaggcgatggctggacccgcgccagaagacaaaacggagaggagggatatgtgccaactagctacatcgatgtgaccctcgagaaaaacagtaaggggagttag

SEQ ID NO: 47715 - DNA, 1257 bp, Artificial Sequence
  Description of Artificial Sequence: Synthetic coding sequence
gacaacagcaagaagaagttcgagcgggagtgccgggaggccgagaaggcccagcagtcatatgagaggctggataacgacaccaacgctacgaaagccgacgtcgaaaaagccaagcagcagctcaacctgcgaactcacatggcagacgaaaataaaaatgagtacgcagcccagctgcagaacttcaacggagagcaacataaacatttctacgtggtgattcctcagatctacaaacagttacaagaaatggacgagaggcgaacaattaaactctcagagtgctacagggggttcgcggactctgaacgcaaggtaatcccaatcatctccaaatgcctggagggaatgatcctagccgccaagtcagtggacgagaggagagatagccagatggtcgtggactcctttaagtctggattcgaacctcccggggactttccttttgaggattactcccaacacatctacaggacaatttccgatgggacaatctctgcctctaaacaggagagtggcaagatggacgctaaaactacagtaggtaaagcaaaaggcaaactgtggctgtttggaaagaagcccaaaggtcctgccctggaggactttagtcatctgcctcctgagcagaggcggaaaaaactccagcagagaatcgacgaacttaatagggaactgcagaaggagtctgaccagaaagacgccctcaacaagatgaaagacgtctacgaaaaaaacccccagatgggggatccgggttcacttcagcccaagctcgctgagaccatgaacaatatcgacagactgagaatggagattcacaagaacgaggcatggttatccgaagtcgagggaaagaccggtgggcgaggagacaggcggcattcatccgacatcaatcatctggtcactcaaggacgggaatctcctgagggaagctatactgatgatgcgaaccaggaggtccgaggtccacctcagcagcacggccatcacaacgaatttgacgatgagtttgaagacgacgatcccttgcctgctattgggcactgcaaggctatatatccttttgatgggcataacgaagggacacttgcaatgaaagaaggggaggttttgtatataattgaggaagacaagggtgatggttggacgagagctcggcggcaaaacggcgaggaaggctacgtccctacatcttatattgacgtaacgttggaaaagaatagtaagggcgcggtgacttacatatag

SEQ ID NO: 47716 - DNA, 747 bp, Artificial Sequence
  Description of Artificial Sequence: Synthetic coding sequence
atggacgccaagaccaccgtgggcaaggccaagggcaagctgtggttgttcggcaagaaacctaagccgcagtctccgcctctcacaccgacttctctgtttaccagctctacccctaacggctctcagtttctaaccttttcaatcgaaccagttcattactgcatgaacgaaattaagaccggcaaacctagaatcccaagcttccgcagtttaaagaggggctggtcggtcaaaatgggcccagctctggaagatttctcccatctcccacccgaacagcggcgaaaaaagctgcagcaacgtattgatgaattgaatagagaattgcagaaggagtctgaccagaaggatgccttaaataagatgaaagatgtctatgaaaagaatccacagatgggcgatccaggatcactgcagcctaaactggcagagaccatgaataacatcgatcggctcaggatggaaatccacaagaacgaggcatggctaagcgaggttgagggtaagactggtgggcggggagatcgaagacactcctccgacatcaaccacctggtgacacagggacgtgaatcacccgaagggtcatatacggacgatgcaaatcaagaggtaaggggtcctcctcagcagcacgggcaccacaatgagttcgacgacgagttcgaggatgacgaccccctgcctgcaatcggacactgcaaggcaatctacccactaatggacattatgaaagtgctgtag

SEQ ID NO: 47717 - DNA, 3054 bp, Artificial Sequence
  Description of Artificial Sequence: Synthetic coding sequence
atgggcaagaagagccgggccgtgcccggccggcggcccatcctgcagttgagcccaccaggacctagaggcagcacgcctggcagggacccggaaccagagcctgatacggagcccgactccacagccgcagtcccatcgcagcccgcaccaagcgccgccacaaccactacgaccgcggtcaccgccgccgccgcctcagatgactccccttcagaagatgagcaagaggctgtgcaggaagtgccccgtgttgttcagaacccacccaagcccgtgatgaccactagacccacggccgtgaaggcgaccggcggcttatgtctgcttggggcatacgctgacagtgacgacgacgacaatgacgtatcggaaaaactagcccagtcaaaagagaccaacggaaatcagtccaccgacatcgatagtacacttgccaatttcctggccgaaattgacgccattaccgccccccaacccgctgcacctgtgggtgcaagcgctcccccgccaacgcccccaagacctgaaccgaaagaggccgccaccagcactctgagcagctctacctccaacggcactgactctacccaaacatcaggttggcaatatgacacccagtgtagtctcgctggcgtcgggatcgaaatgggggactggcaggaggtttgggacgaaaacactggttgctattattactggaatacccaaaccaacgaggtcacgtgggagctgccacagtacctggccacccaagttcaaggcctccagcattatcagccctcttctgtcccaggagcggagacatcatttgtggtgaacaccgatatctatagtaaagaaaagaccatatcagtgagcagctccaaatcagggcccgtgatcgctaagcgcgaagtgaaaaaggaggtaaacgaagggatccaggctctgtctaactctgaggaggagaagaagggagttgctgcgagcctgctcgctcctctgcttccagaagggattaaggaagaggaggagcgatggagaagaaaagtgatctgtaaagaggaacccgttagtgaggtgaaagaaactagcaccacagtagaagaggctaccaccatagtaaagccccaagagatcatgctggacaatattgaagatccttcacaggaggacctctgcagtgtagtgcaatcaggcgagtctgaagaagaggaggaacaggacaccttagagctggagctggtattggagcggaagaaggctgaactgcgtgctctggaggagggcgacgggtcagtgtctggcagcagccctaggtctgatatatctcaacctgcttctcaggatggcatgagacgcctgatgtcaaagaggggcaagtggaaaatgtttgtcagggccacctctcccgagagtacttcgcgcagtagctccaagactggccgcgatacccccgagaatggagagactgctatcggtgctgagaactcggagaaaatagacgagaactcagacaaagaaatggaggtagaggagagtccggagaaaataaaagttcaaacgactccaaaggtggaagaggagcaggaccttaagtttcagatcggtgaactggctaacaccctaaccagtaaatttgagttcttaggtattaacagacagtctatttccaattttcatgtcctgctactgcagaccgagaccagaatcgctgactggagggagggggcccttaacggcaactacctgaaacggaaactccaggatgccgcagaacaactcaagcaatacgagataaatgctacgcctaaaggatggtcttgtcattgggatcgggatcacagacggtacttctacgtgaatgagcagagtggcgagtcccagtgggagttccccgatggagaggaagaggaggaggagagtcaagcgcaggaaaaccgtgatgaaacactcgcaaaacagaccctgaaagataagacaggcacagattccaattcgaccgaaagctcggagacgtccaccggcagcctgtgtaaagagtctttttcaggccaggtatcaagctccagcctcatgcctctcacccctttctggactctgctgcagtccaacgtgcctgttctgcaaccccctcttcccttagaaatgccgcctccacctccaccaccccccgagagtcccccccctcctccacctccgccaccaccggccgaagacggagagatccaggaggtcgaaatggaagacgaaggctcggaggaaccaccagcgccgggaaccgaagaagatacaccgctgaagccatcagctcagaccaccgtggtcactagtcagtcctcagtggacagcacaataagctcctcctctagcaccaaagggataaaaagaaaagctacagaaatttctactgcggtcgtgcaacggtccgctacaatcggttcctcgccagtgttgtatagccaatccgccatcgcgactggacaccaggccgccggcatcgggaaccaagcgactgggattggacatcagacaattcccgtgagcctgccagcggccggcatgggtcatcaggccagagggatgtctctccaatcaaactatctgggcttggccgccgccccagcaataatgtcctacgcggaatgcagcgtgcccatcggtgttactgctccttccttgcagccggtgcaggctagaggtgccgtccccacagctaccataatcgagccccccccccccccacctccccccccacctccccctccaccagcgccaaaaatgccacccccagagaagacaaagaaaggaaggaaggataaagctaagaaatcaaaaactaagatgccaagcctagtcaagaaatggcagtctatccagcgagagttagacgaagaggataattcctccagctctgaggaagatagggaaagcaccgcacagaagcgaatcgaggagtggaaacagcagcagctcgtaagtggaatggcggaacggaacgctaacttcgaagctctgcctgaggactggagggctagactgaagagaagaaaaatggcccccaatacctag

SEQ ID NO: 47718 - DNA, 3279 bp, Artificial Sequence
  Description of Artificial Sequence: Synthetic coding sequence
atgggcaacgccggcagcatggacagccagcagaccgacttccgggcacacaacgtgcccctgaagctgccaatgccagagcccggggagctcgaagagagatttgcaatcgtcctgaacgctatgaatctacctcccgataaggccagactgctcaggcaatacgataacgagaagaaatgggaactgatatgtgaccaggaacgctttcaggtaaagaatccccctcacacatacatccaaaagctcaaaggctatcttgaccccgcagtaacaaggaaaaagttccgtaggcgtgtccaagagagcacccaggtgctaagagagctggagatctctctccgaactaaccatattggatgggtgcgtgagtttctgaatgaggagaataagggactggacgttctggtggagtacctgagttttgcccagtacgcagtaacttttgacttcgaatcagtggaaagcaccgtggagtctagtgtggataaatcgaaaccctggagccgcagcatcgaggacttgcacaggggctctaacctcccaagccccgtcggcaacagcgtgtcacgctccggcaggcactccgcactgcggtacaatactctgccttccagaaggacactgaagaatagtcgattggtcagcaagaaggacgacgtccatgtgtgcattatgtgcctgcgcgccatcatgaattatcagtacggattcaacatggtgatgagtcacccacatgccgtgaatgagattgccctgagccttaataataagaacccccggaccaaggctttggtgttggagctgttggccgccgtgtgcctcgttcggggggggcacgagatcattttgtcagcctttgacaattttaaggaggtgtgtggcgagaaacagcgtttcgagaagctgatggaacacttccgtaatgaggacaacaatattgactttatggttgcctctatgcagttcatcaacatagttgtgcatagcgtagaagatatgaacttcagggtccacctgcagtacgagttcacaaagttgggcttggatgagtatttagacaaactgaagcatacggaaagcgataaacttcaagttcaaatccaggcctacctcgataacgtatttgatgtcggggcactgttggaagatgccgaaactaagaatgctgccctggagagagtggaggaactggaggagaatattagccacctgtctgaaaagctccaggacacagaaaacgaggctatgtcaaaaatagtagaattagaaaagcagctgatgcagcggaacaaggagctagacgtggtccgagagatttataaggacgccaatacgcaggtccacactctccgcaaaatggtcaaggaaaaggaagaagcaattcaacgacagagcacacttgagaagaaaatccacgagttagaaaagcagggcaccattaaaatccaaaagaaaggcgatggagacatcgcgattctcccagtcgttgcctcgggcaccctgtctatgggaagtgaagtcgtcgctgggaatagtgtgggacctaccatgggcgctgcatcctcaggcccgctgccccctccccccccacctctgcctccctcatcagacacccccgagacagtgcagaatggccccgttaccccgcccatgcctccaccccccccaccccccccaccccccccgccccctccccctccccccccccccccccctcttccgggcccggccgcagagacagttcccgccccaccgcttgctccacccctcccctcagcgcccccactgcccgggacaagtagccctaccgtggtcttcaactcaggattagccgcagtgaagattaagaaaccaatcaaaacgaaattcaggatgcccgtttttaattgggtggcattgaagcccaatcaaataaatgggacagtcttcaacgagatcgatgacgaacgtattctcgaagaccttaatgtggacgagtttgaagaaatcttcaagacaaaggcccagggccccgctattgacttatcgtcaagcaagcagaagatacctcagaaaggtagcaataaagtaactcttctagaggcaaatagggctaaaaacctagctattacgttgaggaaagctgggaaaactgcagacgagatatgcaaagctattcacgtattcgatttgaagacactgccagtggacttcgtcgagtgtctcatgagattcctgcccacggagaatgaagtgaaagtgctaaggctctatgagagggagaggaagccacttgaaaatctgtcagatgaagacagattcatgatgcagtttagcaagatcgaacggctgatgcaaaagatgacaatcatggcgttcatcggaaacttcgccgagagcattcaaatgctgaccccacaactacatgccataattgccgccagtgtgagcataaagagcagtcagaagctgaagaagatcctggagatcatcctagcccttgggaattatatgaactcgtccaaacgcggagcagtgtacgggttcaaattacagtcactcgatctgctgttagatactaaatccaccgatagaaagcagacgttgctacactacatctctaacgtggtcaaagaaaaataccaccaggttagtctgttctataatgagctgcactacgttgagaaggccgccgccgtaagtctggaaaatgtcctgctcgatgttaaggagctacagcgcgggatggatttgaccaagcgagagtacaccatgcacgatcacaataccctgcttaaagagttcatcttgaataatgagggcaaactaaagaagctccaagatgatgccaagattgcacaagatgcattcgatgatgtggtgaagtactttggagagaatccaaaaaccaccccaccttctgtatttttccctgtattcgtccgctttgtcaaagcctacaagcaggcagaggaagaaaatgaactgaggaagaaacaagagcaggcattgatggaaaagcttttggagcaggaagcactgatggaacagcaggatcccaaaagcccctcccacaagtccaagaggcaacagcaggaactgatcgcggagctaaggcgcagacaggtgaaagacaaccggcacgtgtacgaagggaaagacggtgccatagaagacatcatcaccgatctcaggaatcaaccgtacagacgcgctgacgccgtcagaagaagtgtgcgtaggcgctttgatgatcagaacctgcgctccgtgaatggggcagaaatcactatgtag

SEQ ID NO: 47719 - DNA, 1707 bp, Artificial Sequence
  Description of Artificial Sequence: Synthetic coding sequence
atgggcagcgaggtggtggccggcaacagcgtgggccccaccatgggcgccgccagcagcgggcccctccccccgcctccaccccctttacccccctcgtcggacacgcctgagaccgtgcagaacggccctgtgaccccgccgatgcccccaccccctccccttcctggacctgccgccgaaaccgtgccagctccgcctctcgcaccaccactcccatcggctcctcccctgccaggaacatcgtctcctacagtggtttttaactctggtctcgctgccgtgaaaattaaaaagccgatcaagacgaagtttaggatgcccgtgtttaactgggtggcccttaaaccgaaccagattaacggaacagttttcaacgagattgacgatgaacgtatcctcgaggacctaaatgtggacgaattcgaagaaatctttaaaaccaaggcacaggggccagccatcgatctttctagcagcaagcagaagatccctcagaaagggtcgaacaaagtgacactgctcgaggcaaatcgagcaaagaatctggccatcacgcttaggaaagccggcaagaccgccgatgaaatctgtaaggctatccacgtttttgacctgaagaccctgccggttgatttcgtggaatgcctgatgaggttcctgccaaccgaaaacgaggtgaaggttctgagactgtacgagcgtgaaaggaagcccctcgagaatctgagcgatgaagaccggtttatgatgcagttttccaaaattgagcgcctgatgcagaaaatgactatcatggccttcattggcaattttgccgagtctatccagatgcttacacctcagttgcacgctatcattgctgccagcgtaagcatcaagtctagccagaagctgaaaaagattctggaaattatcctcgcgctggggaattatatgaactcctccaagcggggcgcagtctatggcttcaaactgcaatctctcgacctgctgttggacacaaagagcaccgatcgaaagcagacactgctgcactacatctccaacgtggtcaaggaaaagtaccatcaagtgtcgttattctacaatgaactgcattatgtggagaaagctgcagccgttagcctggagaacgtcttgctggacgtgaaggagcttcaacgggggatggacttgaccaagcgggaatatacaatgcatgaccataacaccttactcaaagaattcattctgaacaatgagggcaagctcaagaaattgcaggacgatgctaagatagcacaggatgcttttgacgatgtggtgaagtatttcggcgagaaccccaagactactccgcccagcgtattctttccagtgtttgttaggttcgttaaagcctacaagcaagcagaggaggagaacgagctgcgaaagaagcaggaacaggccctcatggagaagctcctagagcaagaggcccttatggaacagcaagatccgaagagtcccagtcacaaatcaaaacgccaacagcaggagctgatagccgagcttcgccggcgccaggttaaggacaatagacatgtctacgaggggaaagacggcgctatcgaagacattatcacagcactcaagaagaacaacattacaaagttccccaacgtgcactctcgtgtccgcatcagttcttcaacccccgtggttgaggacacccagtcctag

SEQ ID NO: 47720 - DNA, 3087 bp, Artificial Sequence
  Description of Artificial Sequence: Synthetic coding sequence
atgggcaacctggagagcgccgagggcgtgcccggcgagccccccagtgtgccgttactactacctcccggcaagatgccaatgcctgaaccctgtgagctggaagagaggttcgctttggttttgtctagtatgaacctccctcccgacaaggcgagacttctaaggcagtacgacaacgagaagaaatgggatctcatttgcgaccaggaacggttccaggtgaagaacccgccgcatacatatatccagaaactccagtcttttctggaccccagcgttaccagaaagaagtttaggcgacgcgttcaagagtctacaaaagtcctgcgggagctggaaattagcctgagaaccaatcatatagggtgggtgagggagtttctcaacgacgagaacaaaggactagacgtgctggttgattacttgtccttcgcacaatgttctgtgatgttcgatttcgaagggctggaaagtggcgacgacggggcattcgataagctgaggagttggtctagatctatcgaggacttacaaccccctagcgctctgtccgcgccattcaccaatagcttggcccggtctgcgcgacagagcgtgttacgctattctacactgcccggacggcgtgcacttaaaaatagtaggctcgtgtctcagaaggatgacgtacacgtatgcatcctatgcttacgcgcgatcatgaattatcaatatggctttaatctggttatgtctcacccgcacgctgtaaacgagattgccctgtccctcaacaataaaaatccgagaacaaaggcgctggtgctggagctgctggctgccgtgtgtcttgtgagggggggacacgaaataatactggcggcctttgataacttcaaagaggtgtgcaaagaactacatcgctttgaaaaacttatggagtacttccgcaatgaggattcaaatatcgattttatggtggcctgcatgcaatttattaatatcgtggtacattccgtggaggacatgaactttagggtccacctacagtatgagttcactaagttaggactggaggagttcctgcaaaagtcgcgccacacggaatcagagaagctgcaggtgcagatacaagcttaccttgataatgtgtttgatgttggcggtctcctcgaagatgcggagacaaagaatgttgccttagaaaaagtggaagagttggaggagcatgtctctcatctcaccgaaaagctgcttgatctcgagaatgaaaacatgatgagggtggctgagctcgaaaaacagctgcttcaacgggagaaagaactcgaatccataaaagaaacttacgagaacacgtcccaccaggtgcacacacttagacggctgatcaaggagaaagaggaagctttccagcggaggtgtcatcttgagccgaatgtccgcgggttggaatctgtggatagtgaagcgctcgctcgtgttggccccgcagagctctctgagggtatgcccccctctgatctagacctgctcgcgcctgctccgcccccagaggaagtgctcccgctgcccccacccccggctccaccgctgccgcctcccccacctcccctgcccgacaaatgccctcctgcccctcctctcccaggtgcagccccctctgtggtcctgacggttggtcttagcgccatcaggataaaaaaacccatcaagaccaaattccggctcccagtgttcaactggaccgcactcaagcctaaccagatctctgggaccgttttctcagaactggacgatgaaaagattttggaagatcttgacctcgataagttcgaagaactctttaagacaaaagcgcagggccccgctctggatctcatctgctctaaaaacaagacggcacagaaagcagctagcaaggttactctgctggaggccaatagagcgaagaatctcgccattactctgcgcaaggcggggagatccgccgaagagatctgtagggcaatacacacatttgatctccagacactaccagtagactttgtggagtgtctgatgcgcttcttgcccaccgaagctgaggtgaagttgttacgccagtacgagagagagcggcagcctttggaagaactggctgccgaagatcgctttatgcttttgttcagcaaggtggagcgcctcacacaaagaatggctgggatggcctttctgggaaactttcaggataatctgcagatgctcacgccccagctcaacgctattattgctgcctctgcctcggtgaagagttcgcaaaaattgaaacagatgctggagataatcctggctctgggcaattacatgaacagttccaagcgtggcgccgtgtacggattcaaattgcagtcccttgatcttctactggataccaagtccacggaccgaaagatgactctgctgcactttattgctctcacagttaaggagaagtaccccgacctggcaaacttttggcatgaacttcatttcgtggaaaaggccgccgcggtgtccctggaaaatgtgctcctcgacgttaaggagttgggtcgcggcatggagctgattcgcagggagtgctcgatccacgataatagcgtgttgagaaacttcttgagtaccaacgaggggaagctggataagctgcaaagagacgcaaagaccgctgaggaagcttacaatgccgtggtgcgatacttcggcgaatcccctaaaactacacccccatccgtgttcttccctgtgttcgtgcgctttattagatcgtataaagaagcagagcaggagaacgaggccaggaagaaacaggaagaggttatgcgggagaagcagctggcgcaggaagctaagaaattggatgcaaagactccaagtcagaggaacaagtggcagcagcaggaactaattgccgagcttcggcggcgacaggccaaggagcaccgaccagtctacgagggaaaggacggcaccatcgaagatatcatcacagtgcttaagagcgttcccttcaccgccagaacagccaaaagaggctcgagatttttctgcgacgctgctcaccatgatgagtcaaactgttag

SEQ ID NO: 47721 - DNA, 3084 bp, Artificial Sequence
  Description of Artificial Sequence: Synthetic coding sequence
atgggcaacctggagagcgccgagggcgtgcccggcgagcccccctccgttcccttattactgccacccggtaagatgccgatgccagaaccgtgcgagctggaagaaagattcgccctggtgctctcctctatgaacctccccccagataaggcccgccttctacgtcagtatgataatgaaaagaaatgggacttaatttgtgaccaggaaagatttcaggtgaagaaccccccccatacgtatattcagaagctgcaatccttcctggacccatccgtaacacgtaaaaaatttaggcgtcgggttcaggagtccaccaaagtgctaagggagctggaaataagtctgcgcaccaatcacatcggatgggttcgcgagttcttgaacgacgaaaataagggccttgacgtccttgttgattatctgtccttcgcccagtgcagcgtgatgttcgatttcgagggattggagagcggtgacgacggtgcatttgacaagctccgatcctggagccgatccattgaggaccttcagcccccctcggccttgagtgcgccttttactaattctttagcacgtagtgcccgccagtccgtgctcaggtattctacacttcccggcagaagagcccttaaaaacagcagattagtatcccagaaagatgatgttcatgtgtgcatcttatgcctgagagccatcatgaattatcagtatgggtttaacttggtgatgtcacatccccatgctgtgaacgaaattgccttgtccttgaataacaaaaatccacggaccaaggctctcgttttagaattgctcgctgcagtatgcttggtgcgtggtggccacgagatcatattggcagcattcgacaattttaaggaggtgtgtaaagagctgcaccggtttgagaagttgatggagtatttcagaaacgaagacagcaacattgacttcatggtggcgtgtatgcagttcattaatattgtggtccatagcgtcgaggatatgaatttccgagtccatctccagtacgaatttacgaaattaggcttggaagaattcctgcagaaatcacggcacacagagtccgaaaaactacaagtccaaattcaggcctatctggacaatgttttcgacgtgggtggcttgttagaggacgccgaaaccaaaaacgtggccctggaaaaagtcgaggagctggaggagcatgtgagtcatctcacagaaaaactcttagatttggagaacgaaaacatgatgcgggttgctgagctagaaaagcagctgctccagcgggaaaaggagctggaatccattaaggaaacctatgaaaatacatcacatcaggttcatactctgcgacgcttgatcaaagagaaggaggaggccttccagcgccgctgccatctggaaccaaatgtgagggggctggagagtgtggactctgaggcactggcaagagttggaccagcagagttatctgaggggatgccaccatctgacctggacttactggccccagccccacctccagaagaagtcttgccacttcctccacctccagcccctccgcttccgccacccccgcccccactacccgacaagtgcccccccgctccgcctctgccaggcgctgctccctcagttgtgctgacggtaggcctctccgcgattaggatcaagaaacccatcaagactaaattccgcctgcctgtcttcaactggacggccctgaaaccaaaccagatatccggtacagtgttcagtgagcttgatgacgagaaaatccttgaggatttggacctggataagttcgaggagctgttcaagaccaaggcccaggggccggcactggacctgatctgttccaaaaataagacagcccagaaggctgcctctaaggtgacactgctggaagctaatcgggctaagaacttggctattaccctgcgcaaagctggcaggtctgccgaagaaatttgtcgagcaattcacacttttgacctgcagactctgcctgtggattttgttgagtgcctaatgcgcttccttcctaccgaggctgaggtgaaactgctgcggcagtatgagagggagcgccaaccactcgaggaactggctgctgaagacagatttatgctgcttttctctaaggtggagcgcctgacacaaaggatggcgggtatggccttccttgggaatttccaggacaacctccagatgttgacaccgcagctgaatgctattattgccgcatctgcctccgtgaaaagttcacagaagcttaagcagatgctggagatcatcctggccctgggcaattacatgaattccagcaagcggggagccgtgtatggctttaaactccagtcattagaccttctgcttgacacaaagtctacagataggaagatgaccctactccatttcatcgccctgacagtgaaagaaaagtatcctgacctggcaaacttttggcacgagctgcattttgttgagaaagccgccgctgtttccctggaaaatgtcctgttggacgtcaaagagctcgggaggggcatggaactgatccgtagggagtgcagtatccacgataattccgtgcttcgaaacttccttagcaccaacgagggcaagctggataagctgcagcgtgacgcaaaaaccgccgaggaagcctataatgccgtagtgcgttatttcggcgagagccctaagacgacccccccttctgtgttctttcccgtgtttgtaagatttataaggtcttataaagaggcagagcaagaaaacgaggcccgaaaaaagcaggaagaggttatgagggagaagcagctcgctcaggaggccaaaaagctcgatgcgaagaccccctcccagaggaataagtggcaacagcaggaattgatagccgaacttcgaaggcggcaggccaaagagcacaggccagtttacgagggcaaggatgggacaattgaggatatcattaccggactccactgccaacccatggtcgtgagacaccaagccaggtccgctgctccaccaagtggacccccgcgagctccgggaccacactag

SEQ ID NO: 47722 - DNA, 2931 bp, Artificial Sequence
  Description of Artificial Sequence: Synthetic coding sequence
atgggcaacctggagagcgccgagggcgtgcccggcgagccccccagtgtgccccttctgctgcctcctgggaagatgcctatgcctgaaccttgtgagcttgaagaacgatttgcgcttgtgctgagtagtatgaatctgcctccagacaaagccaggctgctccggcaatacgacaatgagaaaaaatgggatctgatctgcgaccaagagcgctttcaagtgaaaaacccaccccacacatacattcaaaagcttcagagcttcttggacccaagcgtgactagaaagaagttccggcggagggtgcaggagagcactaaggtgctgagggaactggagataagtctgagaacaaaccatatcggatgggtccgtgagttcttaaacgacgaaaacaagggattggatgtgctggtcgattacctgagctttgcacagtgttctgttatgtattcaacccttcctggccggagggctctcaaaaactcccgtctggtttcccaaaaagacgatgtccacgtctgtattttatgcctgcgcgcaatcatgaactaccagtacggctttaacttagtgatgagtcaccctcatgctgtgaacgagattgcactaagtcttaataataagaatccccgcactaaggctttggtgcttgaacttctggccgcagtgtgcttagtcaggggcggccacgaaatcatcttggctgctttcgacaacttcaaagaggtctgcaaggagctgcaccggttcgagaaactgatggaatacttccgtaacgaggattctaatatagattttatggtggcctgtatgcagtttattaacattgtggtgcacagcgtggaggacatgaactttagggtacacctgcagtacgagttcactaagttaggccttgaggagtttctgcagaaatcccggcacacagaatctgagaagctgcaggtgcagatccaagcgtatttagataatgtctttgatgtaggagggctgctggaggatgcagagacgaaaaatgtggcgctcgaaaaagtagaagagctggaggagcatgtctctcacctgactgaaaagctcctagacttggaaaacgaaaatatgatgagagtggctgagttggaaaaacagttactgcaacgtgagaaggaattggaaagcattaaagagacttatgagaacacgagtcaccaagtgcacactttacgcagactgatcaaggagaaggaggaggccttccaaaggaggtgtcatctagaacctaacgtgcgaggcctggaatccgtggacagcgaggcccttgcccgcgttggccctgcagagctgagcgaaggtatgcctcctagtgacctcgacctgctggcgccagctccaccgcctgaggaagtgcttcccctgccaccaccacccgccccccccctcccaccaccccccccacccctcccagataagtgtccccctgccccccccctgcccggtgctgctccatctgtggtacttacagtgggcctgtcagctataagaatcaaaaaacccataaaaactaaatttcggttacccgtatttaactggaccgccctcaaacccaatcagatctctggcaccgtgttcagtgagctcgatgatgagaaaattcttgaagatctggatctagataaattcgaggagctgttcaagacaaaggcacagggccctgctctggacctcatatgtagcaaaaataaaactgcccagaaggccgccagcaaggtgacactccttgaagctaatcgggcaaaaaacctggcaataactctgaggaaggctggccgaagcgcagaggaaatctgcagagctattcatacttttgatctgcaaaccttgcccgtagatttcgtggaatgccttatgaggttcttgcccactgaagctgaggtgaagctgcttaggcagtatgaaagagaacggcagcctcttgaagaactcgcagcggaagacagatttatgctgctgttctcaaaggtggagagattgactcaacgaatggccggcatggcttttcttggaaattttcaagacaaccttcagatgctcaccccacagctgaatgccatcatagcagcctccgctagcgttaagagtagtcagaaattgaagcaaatgctggagataatcctcgcccttggaaactacatgaattcctccaagcggggagctgtctatgggttcaagctgcagtcactagatcttctgttggacacgaagtccacggaccgcaaaatgacgctcctgcacttcatcgcactcacagtcaaggagaagtatccggatttggccaacttctggcacgaattgcactttgtggaaaaagccgccgctgtgtctctggagaatgtcctgttggacgtcaaggagctgggtcgcgggatggagttgattaggcgagagtgtagcatccatgacaatagcgtgcttagaaacttcctctctactaacgaagggaagctcgataagctccaacgcgatgccaagacggctgaggaagcctataacgctgttgtgagatatttcggagagtctcctaaaacaactcccccatccgtcttcttcccagtgtttgtaaggtttattaggtcctacaaggaggccgagcaggagaatgaggccagaaaaaaacaagaggaagtcatgcgtgagaaacagctggcccaagaagctaagaaactagacgccaaaacgcccagtcaacggaacaaatggcagcagcaggaactcattgccgaactgcggagacggcaagcaaaggagcaccgccctgtgtacgagggaaaagatggtacaatagaagatattataaccggcctccactgtcaaccaatggtggtgagacaccaagcacggagcgccgcacccccctccgggccacctcgggccccaggcccccattag

SEQ ID NO: 47723 - DNA, 3084 bp, Artificial Sequence
  Description of Artificial Sequence: Synthetic coding sequence
atgggcaacctggagagcgccgagggcgtgcccggcgagcccccctcggttccgcttctgctgcccccaggcaaaatgcctatgcctgagccctgcgaactcgaagaacggtttgccctcgtgctgagcagcatgaacttacctcctgacaaggctcggctgctgcgccagtacgataacgagaaaaagtgggatctgatttgcgatcaggagagattccaagtcaagaatcctcctcacacctacatacagaaacttcagtcatttctcgatccatctgttacgcgtaaaaaatttaggcggcgcgttcaagagagcaccaaggtgctgcgggaactggaaatttcacttcgaactaaccatattgggtgggtgcgggaattcttgaacgacgaaaataaggggctcgacgtgcttgtcgactacctgagctttgcgcaatgttctgtcatgttcgatttcgagggtttagaaagtggcgatgatggcgcctttgataagctccgatcctggtcccggtctatcgaagacctgcagcctccctccgccctgagtgcaccttttactaactctttagcacggagtgccaggcagagtgtgctccggtattctactctcccgggtagaagggcactgaagaactcaaggttggtcagccagaaggacgatgtgcacgtctgcattctctgcctaagagccatcatgaattaccagtatggattcaatctggtcatgtcccacccgcacgctgtgaacgagatcgcgttatcgctgaacaataaaaatcctcggaccaaggcattggtgctggagctgctggccgcggtgtgtctagtacgtggcggccacgaaatcattttggcagctttcgataacttcaaggaggtatgtaaggagttacacaggtttgagaagctcatggaatattttcggaacgaggattcgaatatcgactttatggtagcttgtatgcagtttatcaacatcgtcgtgcacagtgtagaggacatgaacttccgagtgcacttacagtatgagttcactaagttgggcctggaagagttcctccagaaaagcagacatacagagtccgaaaagctgcaagtgcaaatccaagcatacttggacaatgtgtttgatgtcggtgggctgctggaagacgcagagacgaagaacgtagccctcgagaaggtggaggagctggaggaacatgttagtcacctgacggagaagctccttgacctggaaaacgagaacatgatgcgggtagcagaactggagaaacagctcctgcaaagggagaaggagttggagtcaatcaaagaaacctacgagaacaccagtcaccaggtgcacacattacgacgcctgattaaagagaaggaagaggccttccagagacggtgccacctcgaaccaaatgtcagaggcctggagtccgtcgattcagaggctttagctagggtgggtccagccgaactctcggaaggcatgcccccgtcagatctggatttgctcgcccctgccccccctcctgaggaggtgttgccgcttccaccgcctcccgcccctccgttgcctccgccgcctcccccactgcccgataaatgccctcccgcccctcctcttcccggagccgccccaagcgtcgtgctcactgttggtctgtccgccatcaggattaaaaagccgatcaagaccaaatttagactgcctgtgttcaattggactgcactgaaacctaaccagattagcgggactgtcttttctgagctggatgacgagaagattttagaggaccttgatctggataaatttgaggagctgtttaaaactaaggcgcaaggccccgctctggatttgatctgtagcaagaacaaaacagcacagaaagctgcgagcaaagtgactcttctagaagcaaatcgcgccaagaatttggccatcactctccggaaagcggggagatccgccgaggaaatttgtagagcaatccacaccttcgatcttcagaccttgcccgttgattttgtggagtgccttatgcggtttttgcccactgaggcggaagtcaagttgctgcgtcaatatgagagggagaggcaacccctcgaggagctggccgctgaggatcgctttatgctgctgttcagcaaagtcgagcgcctgacacagcgtatggctgggatggcattcctggggaacttccaagacaaccttcagatgctgacacctcagctaaatgctattatagccgcttccgctagtgtcaaatcctcccaaaagctcaaacagatgttagagattatactcgcactgggtaattacatgaacagctctaagaggggcgcggtgtatggatttaaactgcagtcccttgacctcctcttagataccaagtcgaccgatagaaagatgaccctgctacacttcattgcactcacagttaaggagaagtatccggatctcgctaacttctggcacgagctccattttgttgagaaggctgcggctgtgagtctcgaaaacgtgctgctggacgtgaaggagttgggaagaggtatggaactgattcggagagagtgctcgatccacgacaattctgtcctcaggaacttcctgtccacaaatgagggcaagctagacaaactgcaacgcgacgctaagaccgctgaggcatacaacgctgtggtacgctatttcggagaatcacccaagaccaccccaccgtccgttttcttcccagtctttgtcagatttataaggtcatacaaggaagccgaacaggagaatgaggcgaggaaaaagcaggaggaagtcatgagagaaaagcagctcgcacaggaggctaagaagttggacgctaagaccccttcacagcggaacaagtggcagcagcaggaactgattgccgagttgaggcgccgccaggccaaggagcatagacccgtctacgaaggcaaggatgggacaatcgaggatattatcaccgtgttgaagtctgtgccattcacagcaaggacagccaagcggggaagcaggttcttctgcgatgccgctcaccacgatgagtccaattgctag

SEQ ID NO: 47724 - DNA, 1227 bp, Artificial Sequence
  Description of Artificial Sequence: Synthetic coding sequence
atgagcaagcgggacatcgtgctgaccaacgtgaccgtggtgcagctgttacgtcaaccttgtcccgtgacacgggcccctcctccccctgagcctaaggctgaggtggaaccgcagcctcagccggaacctaccccagtgagagaggagattaagccccccccacctccacttccccctcaccccgctacacccccgccgaagatggtgtccgtggcaagggagctgaccgtgggaattaatggatttggaaggatagggcgactagtgctgagggcctgcatggagaaaggcgtcaaagtcgtggcagtaaatgacccattcatcgatcctgaatacatggtctatatgttcaaatacgacagcacacacgggcgttataaggggagtgtggaatttcggaatggtcagctggtcgtggacaaccatgagatctctgtataccaatgcaaagaaccaaaacaaatcccttggcgggctgtggggagcccttatgtcgtggaatctaccggcgtctatctgtccatccaagccgctagcgaccacatcagcgccggagcccagagggtggtgatctcagcccccagcccggacgcgccgatgttcgtcatgggcgttaacgagaatgattataaccccggcagcatgaacatcgtgagcaatgcctcttgcactactaattgtctggccccattggccaaagtgattcatgaacgttttggaatcgttgaggggctgatgactactgtgcacagttatacagctacgcagaagaccgtcgacggcccctctagaaaagcctggagagatggcagaggcgcgcaccagaatattatccctgcctctactggcgccgctaaggccgttacgaaggtgatcccagaactgaaggggaagttaaccgggatggcgtttagagtacccacacccgatgtatcagtggtcgatctaacatgccgactggctcagccagctccatactccgcaatcaaggaggccgttaaggccgcagctaagggtcccatggccgggatcctggcttacaccgaagacgaggtggtaagcacagattttctgggcgacacgcactcttcaattttcgatgcaaaagctggcatcgctctcaacgataatttcgtgaagctgatcagctggtatgataatgaatatggttacagccacagggtcgtggacctgctgaggtatatgttcagcagggacaaatag

SEQ ID NO: 47725 - DNA, 2811 bp, Artificial Sequence
  Description of Artificial Sequence: Synthetic coding sequence
atggccgccgcccgggacccccccgaggtgagcctgcgggaggccacccagagaaaactccgccgcttctcggagctccgtggaaagttagtggcccgtggggaattctgggatatcgtggctataactgctgccgacgaaaagcaggaactggcttataatcaacagctctctgagaaactgaaaagaaaggagctaccactcggtgtgcagtatcatgtattcgtggatcctgcaggggctaagattggaaacgggggcagtacactctgcgctctccaatgtctggagaaactctacggcgataaatggaacagctttacaatccttctcatccattccgatgagtggaagaaaaaggtgtccgagtcgtacgttattactatagagaggctggaagacgatctccagatcaaggaaaaggagctgacagagttgagaaacatctttgggtccgacgaggccttttcaaaagttaatttaaattaccgcactgaaaacggtctcagcctgctccacctgtgttgtatttgtggcggtaagaaatctcacatccgaaccttaatgctgaagggcctgcggccctctaggctgacacggaatgggttcactgccctgcacttggccgtgtacaaggacaatgctgagctgataacaagtttgctgcattccggcgccgacattcagcaagtcggctacggcggccttactgcacttcacatagccacaatcgcaggtcacctggaagcagccgatgtgctgctgcagcatggcgccaatgttaatatccaggacgcagtgttctttactccgcttcacattgcggcctattacggtcatgaacaggtaactcggctgttgctcaaattcggggccgatgttaacgtctcaggtgaggtgggggacaggccactacacttggccagcgctaagggttttcttaacatagctaaactgctgatggaggaaggttctaaagcagatgtgaacgcccaggacaatgaggaccacgtgcccctgcatttttgcagtaggtttggccatcacgatatcgttaaatacctgcttcagtctgacctggaggtgcaaccacatgtggtgaatatctatggggacactccccttcacctggcctgctacaacggaaaatttgaggtcgcaaaggagatcatacaaatcagcggcactgagtcgctgacgaaggagaacatcttctcagaaactgcttttcacagtgcatgcacgtatggcaaaagtatcgacctggttaagttcttattggaccagaacgtgattaacatcaatcaccaaggtcgagacggacacaccgggcttcatagcgcttgttaccacggtcacattcggctggtgcagtttctgctggataatggagcagacatgaatttggtggcttgtgatcctagccgctctagcggagagaaagacgagcagacctgtctgatgtgggcctatgagaagggtcacgacgccatcgtcactctactgaaacactacaaacggcctcaagatgagctgccttgtaatgagtactcccaaccgggcggcgatggcagttacgtctccgttcccagtccattgggtaaaattaagagcatgaccaaggaaaaagctgatatcttgttgttgcgagcaggactgccaagtcactttcaccttcagctcagcgaaatcgaatttcatgaaatcatcgggtctgggtcgtttgggaaggtctacaaggggcgctgtaggaataaaatcgtggcaataaaaagatacagagccaacacttactgctctaagtctgacgttgatatgttttgtcgggaagtgagtatactgtgtcagctgaatcacccgtgcgtgatacaatttgtcggggcatgccttaatgacccgtcacagttcgctatcgtgacgcaatacatttcaggaggatccttgtttagtctcttacacgagcagaagcgtattctggatttgcagtccaaactcatcatcgcggtggacgtagcgaaagggatggagtatctacataacctgacgcaacccattatacatagagacctaaatagtcacaatatactgctttacgaagatggacacgcggtggttgctgattttggagaaagccggtttcttcagtctctcgacgaagataacatgacgaagcaaccaggcaacctcagatggatggcccctgaggtctttactcaatgcactcgctacaccatcaaggccgacgtatttagctacgccttgtgtctgtgggaaatactgaccggagaaataccttttgcgcacctcaaacctgctgccgccgcagctgatatggcatatcaccatattagaccccccataggatactctattccaaagccaatctcgtctcttctgatccggggttggaacgcttgtcctgaaggcagacccgagttttctgaggttgtaatgaaactggaggaatgtctgtgtaacatcgagttgatgtctccggcaagctctaacagtagcggaagcctttcgccttcttcatcgagtgattgtctggtaaacagaggtggaccaggcaggagccatgtggcagctctacggagtcgctttgagctggagtacgccctcaatgcacgatcctatgcggccctatctcagagcgctgggcagtacagctcacagggactttcattagaagaaatgaaaaggagcttgcagtacacgcctatcgacaaatacgggtatgtgagtgatcccatgtcctcaatgcacttccactcttgccgcaactcctcctctttcgaagacagctcctag

SEQ ID NO: 47726 - DNA, 2532 bp, Artificial Sequence
  Description of Artificial Sequence: Synthetic coding sequence
atggccgccgcccgggacccccccgaggtgagcctgcgggaggccactcaaaggaagcttagacgcttcagtgagctgcgcgggaagctggtggcaagaggtgaattttgggacattgttgcgattaccgctgccgatgagaagcaggagttagcatacaatcagcagctctctgaaaaactgaagagaaaggaattgcctttgggagtgcagtaccatgtgttcgtagaccctgctggagcgaagattggaaatggaggcagtaccctctgcgcactgcagtgtctggaaaagttatatggggacaaatggaacagttttaccatattgctgatacactctgatgaatggaagaagaaggtgtctgagtcatatgtgataaccatcgagcggctcgaagacgacctacagatcaaggaaaaggaactcaccgaacttcggaacattttcggctcagatgaggccttctccaaagtcaatttaaattaccggaccgagaatggcttgtcactgctccacctgtgttgcatttgcggaggaaaaaagtcccacattaggacgctaatgctgaaagggttaaggccctctaggctgacccggaacggattcacggccctgcacctggcggtttacaaggataacgcggagctcattacttcactcctgcacagcggcgccgatattcagcaagtcgggtacggggggctgacggctttacacatcgctaccattgctggccatctggaggcagcagatgtcctcttgcagcatggcgctaacgttaatatccaggatgctgttttctttacccccctccacattgccgcatattatgggcacgagcaggttactcgcctcctgctgaaatttggggccgatgtaaatgtgtcgggagaggtgggggacaggccccttcacttggcaagcgccaaaggttttctcaacatcgctaagttgctgatggaggagggctctaaggccgacgttaatgcccaggataatgaggatcacgttcccctgcacttctgcagccggttcgggcaccacgacatcgtcaaataccttctacagagcgaccttgaggtgcagcctcatgtcgtgaacatctacggggataccccactccacctggcatgctacaacggcaagttcgaagtcgccaaagaaataattcaaatcagtgggaccgaatcgttaaccaaggagaacattttttctgaaactgccttccactccgcttgtacgtatggcaagtcaatcgacctggtaaaatttctgttggaccagaatgtgattaacatcaaccaccagggccgagatggacacactggactgcactcagcatgttaccatgggcacattcgcctggttcagtttctgctcgacaatggcgccgatatgaatctggtcgcatgtgatcctagtcgcagctccggggaaaaggacgaacagacgtgtctgatgtgggcctacgagaagggacacgatgcgattgtgacgttgctgaagcattataaacgcccacaggatgagttgccttgcaatgagtattcccagcccggcggcgacgggtcctatgtatccgtcccttctccactcggaaaaataaagagtatgactaaggagaaagctgatattttactgctgagagcaggcttgccctctcatttccatttgcagctgagtgagatcgagttccacgaaataatcggctcaggctcctttggaaaagtctacaagggccggtgccgcaataagatcgttgccattaaacgttatcgggctaacacctactgctcgaaaagcgacgtggacatgttctgccgggaagtgtctattctgtgtcagttgaatcatccatgtgtgatacagttcgtaggcgcatgcctgaacgatccttcccagttcgcgatcgtgacacagtatatatcgggaggctctcttttctccctcctccatgagcagaagcgaatacttgatttacagtccaaactcataatcgccgtcgacgtggcaaaaggcatggagtatctccataatcttacacagccaataattcacagggatctgaactctcataatatcctgctgtacgaggacggacatgctgtggtggctgatttcggcgaatcccgcttcctgcaaagcctagacgaggataatatgaccaaacaaccaggaaacctgcggtggatggcccctgaggtgtttactcaatgtacgcgttacacaattaaagccgacgtgttttcatacgcactgtgtctctgggagatcctcacaggggagattccatttgctcaccttaaaccggccgcggctgccgcggatatggcataccaccatattcgcccccctattgggtatagcatacctaaacctattagtagcttgctgatccgcgggtggaacgcctgccctgaggccaagagtagaccatcacattatccagtgagcagcgtctacaccgagacattgaaaaaaaagaacgaggatcgttttggtatgtggattgaatacctgaggaggtag

SEQ ID NO: 47727 - DNA, 444 bp, Artificial Sequence
  Description of Artificial Sequence: Synthetic coding sequence
atgagcttccggttcggccagcacctgatcaagcccagcgtggtgtttctaaaaacggagttgtctttcgccttggtaaatcgaaaaccagtcgttcctggacacgtgttggtgtgtcccttgagaccagtggaaagattccacgatctgcgtccagatgaggttgcagacctgttccagacaacccagcgggtcggaactgtggtggagaagcactttcacggaactagtctaactttttcaatgcaggatggtcccgaagccggacagaccgttaagcacgtacatgtgcacgtgctgccacggaaggctggcgatttccatagaaatgacagcatctacgaagaactccaaaaacatgataaagaagatttcccagcgtcctggcggtccgaggaagagatggcggcagaagctgccgcattaagagtgtatttccagtag

SEQ ID NO: 47728 - DNA, 930 bp, Artificial Sequence
  Description of Artificial Sequence: Synthetic coding sequence
atggagcagctgctgcgggccgagctgcggaccgccaccctgcgggcctttggaggacctggcgccgggtgtatcagcgaaggacgggcctacgatactgatgcgggacctgtgttcgtgaaagtcaaccgtcggacccaggcccgacaaatgttcgagggcgaagtcgcatccctggaggccctccgaagcactggcctggtgcgcgttcccagacccatgaaggttatcgatttgcctggagggggagccgctttcgtgatggagcatctcaaaatgaaatcattgagtagccaggccagcaaacttggagagcaaatggccgatctgcacttgtacaaccaaaagctccgggaaaagctaaaggaggaggagaacacagtgggccggagaggtgagggagccgagccacaatacgtggacaaatttgggttccataccgtgacctgctgtgggttcattcctcaagtcaatgagtggcaggacgactggcccacgtttttcgcacgccaccgattgcaagcgcagcttgatttgattgagaaggattacgccgaccgggaagccagagaattatggtctcggctgcaggtgaagatacctgatctattttgcggactcgaaatcgtgcctgcactcttgcatggcgatctgtggagcggcaacgtcgctgaggatgatgttggcccaataatctacgaccccgccagtttctacggacattctgagtttgagcttgcaattgccctcatgttcggagggttcccacggtcatttttcacagcatatcatcgcaaaatacccaaggcgccaggcttcgatcaaaggctgcttctctatcagcttttcaattatttgaaccactggaaccattttggtcgggaataccggtcccctagcctcggcaccatgaggaggctgttgaaatag

SEQ ID NO: 47729 - DNA, 609 bp, Artificial Sequence
  Description of Artificial Sequence: Synthetic coding sequence
atggagcagctgctgcgggccgagctgcggaccgccaccctgcgggcttttggcggccccggagcaggatgcatatcagagggtcgcgcctatgacaccgacgccggacccgtgtttgttaaagttaaccggcggacacaggcccggcaaatgtttgaaggggaggtcgcgtctctagaggcactgaggagtacaggattggttagagtgccacgacccatgaaggtgatcgacctccccggagggggcgctgcctttgtgatggagcatctcaagatgaaatccctttcttcccaggcttccaagcttggagagcagatggcagatctccacctgtataaccagaagctgcgagagaaactcaaggaggaggagaacactgttggacggcgcggcgagggcgcagaaccccaatacgttgataaattcggatttcacactgtgacttgctgtgggtttattccacaagaaccgctggaacctagcagcctgaagagcgtgaagtttcaacgaaggttatggactgcccagctcccctgcgccagtttggaggaggcaaatataggaccttacttcggctttgtaaggaacacagctccaatcatctag

SEQ ID NO: 47730 - DNA, 534 bp, Artificial Sequence
  Description of Artificial Sequence: Synthetic coding sequence
atgcaggcccggcagatgttcgagggcgaggtggccagcctggaggctctgcgttccacaggactggttcgcgtgcccagacctatgaaagtgatcgacctgcccggcgggggggcagcattcgtgatggagcaccttaaaatgaaaagcctctctagtcaggcctctaagctcggcgaacaaatggccgacctacatttatacaaccagaagctaagagagaaacttaaagaggaggagaacacagtgggcaggaggggggaaggagctgaacctcagtacgtcgacaaatttggctttcacaccgtgacctgttgtgggttcattccccaagtgaacgagtggcaggacgattggcctacttttttcgccaggcaccggctgcaggcgcaactagacctgatagaaaaagactatgctgatcgggaagccagagagctttggtctagactgcaggtggggactgcagtgacctccctgggcaaaagctggtcgtcacatgatcctgcagcatttgtgagagtgcatctatag

SEQ ID NO: 47731 - DNA, 1212 bp, Artificial Sequence
  Description of Artificial Sequence: Synthetic coding sequence
atgcccgagcccctggcccccgagagctaccccgagagcgtgtgcgaggaagacgtcacattggccctgaaggagctggacgagcggtgtgaagaagaggaggcggatttcagcggcctgagctcacaagatgaggaggagcaggacggatttcccgaagtacaaacgagccccctgccttccccattcctctccgccatcattgcagctttccagcccgttgcatacgatgatgaagaggaggcgtggcgttgccacgtcaatcagatgttgtccgacacggacggatctagtgccgtatttacatttcacgtcttcagtaggctgtttcagacaatccagaggaagttcggcgagatcaccaatgaggccgtttcttttctcggagattcattacagcggataggcaccaaattcaagtctagcttggaggtcatgatgctctgctccgagtgccctacagttttcgtggacgccgaaacattaatgtcttgcgggttattggagaccctaaagttcggagtgttggaattacaggagcacctggatacctataatgttaagcgggaggccgccgaacagtggcttgatgattgcaagaggactttcggcgcaaaagaagatatgtataggattaacaccgacgcacaagaactggagctgtgccgccgcctctacaagctgcacttccagcttctcttactttttcaggcttactgtaaattgatcaaccaggtaaacaccattaagaacgaagctgaagtgattaatatgagtgaagagctcgcccagttggaaagcatcttgaaagaggccgaaagcgcgtcagaaaatgaggaaattgacatcagtaaagccgcacagaccaccatcgagacagcaatacacagcctgatcgaaaccctcaagaataaggagtttatttccgcagtggcacaggtcaaggcttttcgcagcctatggccttctgacatattcggatcttgcgaggatgaccccgtccagacgctattacacatctacttccatcatcagacgctggggcagaccggcagctttgccgttatcgggtctaacctggacatgtcggaggccaattataagctcatggagctgaacctggagattagggagagcctgcgcatggtgcagtcctaccagctgctggctcaggcgaaacctatggggaatatggtgagtacaggcttctag

SEQ ID NO: 47732 - DNA, 9042 bp, Artificial Sequence
  Description of Artificial Sequence: Synthetic coding sequence
atgagcaacatcaccatcgaccccgacgtgaagcccggcgagtacgtgatcaaatcgctgttcgccgagtttgccgtccaagctgaaaagaagatagaggtcgtgatggctgaacccctcgaaaaactcctgtcccggtcactgcagaggggcgaggatctccagtttgatcagctgatttcaagcatgtcctcagtggctgaacactgcctgcccagccttctcaggacacttttcgactggtatcgaaggcaaaatgggactgaagacgagagttacgaataccggccgagatccagtactaagtctaaaggcgacgagcaacagcgggaacgagattatttgttggaacgccgggacctcgcagtggacttcatcttctgcctggtgttggtggaggtcctgaagcagattccagtgcaccctgtacccgaccccctcgttcacgaggtcttgaaccttgcctttaaacatttcaaacacaaagagggctacagcggcacaaacacaggtaacgttcacattatagcagacctctatgccgaggtcattggagtgctagcccaatccaagttccaggccgtgaggaagaagtttgtcaccgagctgaaagagttgcgacaaaaggaacagagtccacatgtggtccagtccgtgattagtctgatcatgggcatgaagttttttcgcgtcaaaatgtatcccgtagaggacttcgaagcatccttccagtttatgcaggagtgtgcccagtattttctggaggtgaaagacaaggatatcaagcacgccctggcgggcctgttcgtcgaaattctgatcccagtggctgccgcagtgaaaaatgaggtcaacgtaccatgcctgaaaaatttcgtggagatgctctatcagacaactttcgagttaagctcaagaaaaaagcactctctggcattgtatccattaattacctgccttctctgcgtgtcacagaaacagttctttttaaacaattggcatatctttcttcagaactgcctctcacacctgaaaaataaggaccccaaaatgtcaagagttgcactggagtcgctgtacagactgctctgggtttatgtcattcgcattaagtgtgaatctaatacagtaacacagagccgcctgatgtccatcgtgtctgcactctttcctaaaggttcccgaagcgttgtccctagagacactccactgaatatttttgtgaaaatcatccagttcatagcacaagagcggctcgattttgccatgaaggaaattatttttgatctgctgagcgtaggcaaatcaacgaagacatttactattaaccccgagaggatgaacatcggcctcagagtcttccttgttatcgccgattctctgcagcagaaagatggagaaccgcccatgccaaccacaggtgtcatcctgcctagcgggaacacacttagggtcaaaaagatctttctaaataagacgctaaccgatgaggaggctaaggtgatcggaatgtctgtgtattatccgcaggtccgaaaagccctggactcaattctgagacacctggataaggaggtcggccgccctatgtgcatgaccagcgtacagatgtcgaataaggaaccagaagatatgatcactggagagaggaaacccaaaatcgacctgtttcggacatgcattgcagcgattcctcgtttgattccagatggcatgtccaggactgacctaatcgagctcctggctcggctgactattcacatggacgaggaactgcgtgctcttgcattcaacacgctgcaggccctgatgcttgatttccctgattggcgggaagacgtgctgagtggctttgtatactttatcgtaagagaggtaaccgacgtccaccctaccctgctcgacaacgccgtgaaaatgcttgtccaactgatcaatcagtggaaacaggccgctcaaatgcacaacaagaatcaagacactcagcacggggtcgctaatggtgcctctcatcccccccctctcgaacgcagtccatactccaacgtctttcacgtagtggaggggttcgccctggtgattttgtgcagctcccgacccgccactcggcgtctcgctgtgtcagttctgagagagattcgggcgctctttgcgctgctggagatccctaaaggcgacgacgagctcgcaattgatgttatggaccgattgagtccatccatcctggaatcttttattcacctcactggagctgatcagacaaccctcctgtactgtcccagcagcatagacctccagaccctcgcagagtggaattcatcacctatctcccatcagtttgatgtcatctccccatcacatatttggatatttgcccacgtgacccagggacaggatccatggataatctctttaagttcctttttgaagcaggagaaccttcccaagcattgctccaccgccgtttcctatgcatggatgtttgcgtacacgcgtctgcagctgttgtcccctcaagttgacatcaacagtccgatcaacgctaaaaaagtgaacacaacaacctcctccgatagctacattggactatggcgaaactacctcattctatgctgcagcgcagcaacaagttcaagttctacttccgcggggtccgtacgctgctctccgcctgagactttggccagtactcccgactcagggtatagtatcgattctaaaatcattgggattccaagcccaagctcactgttcaagcatatcgtccccatgatgcggagtgagtccatggagatcaccgagtctttggtcctcggacttggacgcaccaaccccggagcattcagggagctgattgaagagttgcacccgataattaaggaggcattggagagaaggccagagaacatgaagcggcggaggcggagagacatcctcagagtgcagctggttagaatctttgagttgctcgcagatgctggcgttatttcccattctgctagtggcggcctggataacgagacccactttctgaataacactcttctggagtatgtcgacctcactcgacagttgctcgaggcagaaaacgaaaaagacagtgacacgttgaaagacatcagatgtcactttagcgccctggtcgctaatataatccaaaacgtccctgtacatcagcgccgttcaatcttccctcagcagagtctccggcactccttgttcatgcttttttcacactgggccggccccttcagcattatgttcactccactggatagatattccgacagaaatatgcaaatcaacaggcaccagtattgcgccctcaaggccatgagcgctgtgctgtgttgtggccctgtggcagacaacgtgggtctttccagcgacggatatctttataagtggctcgataacatactagattctctggacaaaaaggtccatcagctcgggtgcgaggcagtgaccctgctgctggaactgaatcctgaccagagcaacctgatgtactgggccgtcgacagatgttatacaggaagcggcagggtggcagccggctgctttaaggccatagcgaatgttttccagaaccgggattaccaatgcgacacggtgatgctgttgaatctgattctgttcaaggctgctgactcaagcagatccatttacgaggtagcaatgcagctactgcagatcctggagcccaaaatgttcaggtatgcacacaaactcgaggtgcaacggacagatggcgtattaagccagcttagccctctgccccacctctattcagtaagttactaccagctgtccgaggagctggcccgggcctaccctgaactcacattggctatcttcagcgagatcagtcaaagaattcagactgctcacccagccggtcgacaagtgatgttacactacttgttgccgtggatgaacaatatagaactcgttgatctgaagcccctgcctaccgccaggcgccatgatgaggacgaggacgattcacttaaagacagagagctgatggtaacttcccgaagatggctccggggggaaggatgggggtctcctcaggcaactgcgatggtcctaaataacctcatgtacatgaccgccaaatacggtgatgagctcgcatggtccgaagtagagaatgtttggacaaccctagcagatggctggcccaagaatctgaaaataatccttcactttctgatatcgatttgtggggtaaacagtgagcctagcctgctaccctacgttaaaaaggtcatcgtgtacctcggacgagacaaaaccatgcagttgctcgaagagctcgtgtcagaactgcaattgactgatcctgtgtcatctggcgtgacccatatggataaccccccatattataggataacctcatcgtacaaaataccttccgtgacgtctgggactacatccagttcaaataccatggtcgcaccaacagacggaaatccggataataagccaatcaaggagaacatcgaggagagttatgtccacctggatatttattcgggactcaactcccacctgaatcggcagcaccacaggctggaatcgagatattcatcatcttctggcggtagctacgaggaggaaaaatccgattcaatgcccctgtatagtaattggcgactgaaggtaatggagcacaaccagggagaacctcttcccttccccccagctggaggctgttggtctccactggtggactatgtcccagagactagctctccgggtttgcccctacacagatgcaatattgcggtgatcctgctgaccgatttgatcatcgaccattcggtgaaagtggagtggggcagttatctccacctgctgttacatgctattttcattggcttcgatcattgtcatcccgaggtatacgaacattgtaaacggctgctgcttcacttgcttatcgttatgggcccaaacagtaatattcggacagtcgcgagtgtgctgctgcggaataaggagtttaatgaacctcgtgtgctcaccgttaagcaggtcgcacatctggactacaatttcaccgctggaatcaatgatttcattcctgattaccagcctagtccaatgacagactcaggtctttcatcttcttcaacaagttcatcaatcagtctgggcaacaactccgctgccatatcccaccttcacaccacaattctgaatgaggtggatatctctgtcgagcaggatggtaaggtcaaaacccttatggagtttataacttcccggaaaagaggtccattgtggaaccatgaggacgtgagcgcaaagaacccatcaatcaaaagtgcagaacagctgacaacatttttaaagcatgtagtatccgttttcaagcagagttcttctgagggcattcatttagagcaccaccttagtgaagtggcattgcagaccgccttatcctgttcttctcgccattacgctggaaggagcttccagatttttagagctctcaaacaacccctcacagcgaccaccttgagtgacgtactttcccgactcgtcgaaacagtaggggatcctggtgaagacgcgcaaggttttgtcattgagcttttgcttacgctggagagcgccattgataccttagccgagactatgaagcactacgacctcctgagtgccctctcccaaacatcatatcatgacccaataatgggtaataagtacgctgccaataggaagagcacagggcagctgaatctctcaacctcccccattaactcctcaagctacctgggctacaatagcaatgccagaagcaacagtctgcgtctttctctgatcggagaccggcgcggggaccggcgccggagcaataccttagatattatggacggtcggatcaatcactcctctagtctggctagaactcgttccctgtcaagcctcagggaaaaagggatgtacgacgtccagagcaccacggaacccacaaacctgatggctactatcttttggattgccgcttccctgctcgagagcgactatgagtacgaatatcttttggcactcaggctgcttaataagttgctcattcatttgcccctggataagtccgagtctcgggaaaagatcgagaatgttcagtctaaactaaaatggactaactttccaggcttgcagcagctgttcctgaaaggatttacaagtgcttccacccaggaaatgactgtccacctgctcagcaaacttatcagtgtctctaagcatacgttggtggacccctctcagttgagtgggttccccttaaatatcttatgtctgctgccgcatctgatccagcactttgattcccccacacaattctgcaaagaaacagcttcccggatcgccaaggtgtgcgcagaggaaaagtgccctacattggtgaatctggcacacatgatgagcttatactccacccacacatattctagggactgcagcaattggattaacgtggtctgccgatacctgcacgactccttttccgacacaacattcaacctggtcacctacctggccgagttactagagaaaggtctctcctccatgcagcaatccctgctccaaattatttacagtctgctgtcccatatcgacctgagtgccgctcctgcaaaacagttcaatttggagatcatcaagatcatcggcaagtacgtccagtccccatattggaaagaggccctgaacattcttaaactggtggtgtccaggtccgcttccttggtagtgccctccgatatccctaaaacatacggcggcgatactgggtcacccgaaatctcattcacaaagatttttaataacgtgtccaaggagctcccaggcaagactctggactttcattttgatatatccgagacaccgattatcggtaataagtatggagatcagcactccgcggcagggagaaacggaaagcctaaagtgattgcggtcacccgttccactagtagcacttcctctggttccaactcaaatgcattggtgcctgtttcatggaagcgtccacagctgtcacagcgcaggaccagagagaagctgatgaacgtcctgagcctctgtggccctgagtccggcctgccaaagaatccctctgtggtgttctcctctaacgaggacttggaagtgggggatcagcagacctctcttatatcaaccacggaagatattaaccaagaggaagaggtcgcggtggaagataattcgtccgaacagcagtttggggtctttaaggactttgactttctggacgtggaactcgaggatgctgaaggcgagtcgatggataactttaattggggggtccgtagaagaagcctggatagcattgacaaaggagacacgccatctctccaggaataccaatgcagttccagtacgccctccctaaacctcaccaatcaggaggataccgacgagtctagtgaggaggaagccgccctcactgcttctcaaatattgagtaggacacaaatgctgaactctgacagcgccaccgacgaaacgatccccgaccaccccgatcttcttctccagtccgaagactctaccggatcaattaccacagaggaggttctccaaattagggatgagacccctaccttggaggcttcccttgataacgcaaactctcggctcccagaggatactaccagcgtgctgaaagaagagcacgtgaccacttttgaggatgagggttcttatattatccaagaacagcaagaaagcctcgtttgtcagggtatccttgatctggaagaaactgaaatgcctgaaccactagcccctgagagttacccggagtctgtttgtgaggaggatgtgactctcgccctgaaggagctggatgagcggtgtgaagaggaggaggcagatttcagcggactgagtagccaggacgaggaggaacaagatggctttcctgaggtgcagacatcccctctgccttcccctttcctgagcgcaattatagctgctttccaaccagtggcatacgatgacgaggaggaggcctggcgatgccacgtcaaccagatgcttagcgatacagatgggtctagtgcagtttttacatttcacgttttctctcggctctttcagaccatccaacgcaagttcggggagatcaccaacgaggctgtctcatttctcggtgatagcctgcagcggatcgggaccaaatttaaatcaagcctggaagttatgatgctttgttcagagtgcccaaccgtgtttgtggacgccgagacactgatgagttgtggactgctcgagacattgaaatttggcgttttggagttgcaggaacacctcgacacctataatgttaagcgcgaggcagcagaacaatggctggacgattgtaagaggacttttggagcgaaagaagacatgtataggattaatactgatgctcagcagatggagatactggcagaactggagctctgtaggcggttgtataaactgcattttcagttactgctgctctttcaggcttactgcaagttgattaaccaggttaacaccataaagaacgaggcagaggtgatcaacatgtcggaggagctggcacaacttgaatccatcctgaaggaggccgaaagcgcaagcgagaacgaagagatcgacatttcaaaagccgcacagaccacaatcgagaccgccatacacagtctgattgagacactgaaaaacaaggaattcatcagtgcagtagcccaggtcaaagcttttcggtctctctggccctctgatattttcggctcatgcgaggatgaccctgttcagacactcctgcacatttactttcaccatcagaccctcggacagacgggaagtttcgctgtcattggtagcaacttggatatgtccgaggcaaactacaagctgatggagcttaatctggagatacgcgaaagtctccggatggtgcagtcgtaccagttactcgctcaagcgaaaccaatggggaatatggtgagcacgggcttttag

SEQ ID NO: 47733 - DNA, 9042 bp, Artificial Sequence
  Description of Artificial Sequence: Synthetic coding sequence
atgagcaacatcaccatcgaccccgacgtgaagcccggcgagtacgtgataaagagcctttttgcagagttcgctgtgcaggctgaaaagaaaattgaggttgttatggccgaaccgcttgagaagctcctctcacggagcctgcaaaggggagaggaccttcagtttgaccagcttatctccagtatgtccagtgtcgccgagcactgtctgccttccctgcttcgtactctattcgactggtatcggagacagaatggtaccgaggacgaaagttacgaataccggccccgctcctcaactaaaagtaagggcgatgagcagcagagagagagggattacctgttggagagacgggatctcgctgtggactttatattttgcttagtcctggtcgaggttctgaagcagattcccgtgcatcccgtgccggaccctcttgtccacgaggtccttaacctggccttcaagcactttaaacacaaggaaggctattcagggaccaacaccggcaatgtgcatatcatcgctgacctgtacgcagaggttattggtgtgttggcgcagtccaagtttcaggccgttaggaagaaatttgtgactgagctgaaggaattacggcagaaggagcagagtcctcatgtggtacagtcagtaatttcccttatcatgggaatgaagttcttccgagtcaaaatgtatcctgtggaagactttgaagcctcgtttcagttcatgcaagagtgcgcccaatactttctggaagtgaaggacaaggacattaagcacgctctcgcaggtctgttcgtggagattctgattcctgtagccgctgcggtaaagaatgaggttaatgtgccatgcttgaagaattttgtggagatgctctatcagaccacctttgagctatcctcccgcaagaaacacagcctagccctctatcccctcatcacatgcctcctgtgtgtctcccagaaacagtttttcctcaacaactggcacatctttctgcagaactgtctgtcacacctcaagaacaaagatccaaagatgtcccgagtcgcactggaatccctttaccggctgttgtgggtttacgtcattcgcattaagtgcgagtctaacaccgtgacccagagccgactaatgtccatcgtcagtgccctgttccctaagggaagccgcagtgtagtgccacgagacacaccacttaacatctttgtaaagattatccagttcatagcacaagagagactggatttcgcaatgaaagaaatcatctttgatctcctcagcgttgggaagtcaactaagacattcaccataaacccggaaaggatgaatataggactgagggttttccttgtgatcgctgattccctgcagcagaaggatggggagccgcctatgccaacgacgggggtcatcctgccaagcggcaacacccttagagtaaagaagatcttccttaacaagacgctcacagatgaagaagccaaggtgatagggatgtcagtttattatcctcaagtcaggaaggctctcgactctatcttacggcacctcgataaggaagtgggtaggcctatgtgcatgacttccgtgcagatgagcaacaaggagcccgaggatatgatcaccggcgaacgcaaacctaaaatcgatctgtttcgcacttgtatcgcggcaatccctcggctgatccccgatgggatgtccagaacagatctgatcgagctgctagcccgcctgaccatacacatggacgaggagctgagggctctggcttttaacactcttcaagctttgatgctggacttcccagactggcgagaagatgtcttgtctggattcgtctacttcattgtacgggaagtcaccgatgtgcacccaaccctgctggacaacgctgtgaagatgcttgtccaattgatcaatcaatggaaacaggctgctcagatgcacaacaagaatcaagatacccagcatggggtggccaacggcgccagtcatcctcctccccttgagaggtccccgtactcaaatgtgttccatgtcgtggaaggtttcgccctagttattctttgctcttcgcggcccgctacccgtaggcttgccgtaagtgtgttgagagagataagggcgctgttcgcactactggagattcccaaaggtgatgacgagcttgccattgacgtgatggacaggttgtccccatccatcctggagagctttattcatctgaccggtgctgaccagactacattgctatactgcccttcctcaattgacctgcagactctggctgagtggaactcttcgccaatttctcaccagttcgatgtaatcagtcccagtcacatttggatcttcgctcacgtgacccaaggacaggatccctggatcatatctctgagtagcttcctgaaacaagaaaatttacccaagcactgttccaccgccgtctcttacgcttggatgttcgcttacacccgcctgcagttgctgagccctcaggtggacataaacagtcccatcaacgccaagaaggtgaacacgactaccagctccgactcttacatcggactgtggcgcaactacctgattctgtgctgcagtgcggccacttcgtcaagcagcacaagtgctggcagcgtcagatgctctcccccagaaaccctggcatcaacccctgactcgggctactcaatagattccaagatcatcggcattcctagcccaagctctctcttcaaacatatcgtccctatgatgcgcagtgagtccatggaaataacagagagcctggtgctgggtttgggtaggacaaatcccggtgctttccgtgaactgatcgaggagctacacccaattattaaagaagctctggaaagaaggcccgagaacatgaagagacgtagacggagagacatacttcgggtgcagttagtgcggatcttcgaactgcttgccgacgctggggtcatctctcacagcgctagcgggggactcgataacgagacacactttctgaataatactctgctggagtacgttgatctcacccgccagctgctggaggcagagaacgagaaagactccgacactttaaaggatatacgctgtcacttctctgcactcgttgccaacatcatccagaatgtgccagttcaccagaggcgcagcattttcccccagcagtctttgcgacactccctgttcatgttatttagccattgggcaggacctttttctattatgtttacaccattagatcgctacagtgatagaaatatgcaaattaatcggcatcagtactgtgccctcaaagccatgagcgcggtcctgtgttgcggtcccgtcgcggataatgtagggctcagttcagatgggtatctgtataagtggttagacaacatcctggacagtctcgataagaaggtccatcaattaggctgtgaggccgtgacgttgcttcttgaactaaatccggatcagtccaatctcatgtactgggccgtggataggtgctacaccgggtccggcagagttgccgcaggctgctttaaagccatagccaatgtctttcagaaccgggattatcagtgtgacactgtgatgctactaaacctcatcctgtttaaggcagctgatagctccagaagcatatatgaggtcgccatgcagcttcttcagatactggagcccaaaatgttccgctatgctcataaattggaggtgcagcggaccgacggcgtgctgtcacagttgtcccctcttcctcatttatactcagtcagttattatcaactgtctgaggagttagctcgggcatatccagaactcactttagccatcttctccgagatatcccagcggatacagacagcacatccagccggccgccaggtgatgttgcattacctgctcccttggatgaataatatagagctcgtagatcttaaaccgctgcctaccgccagacgccatgatgaggacgaagacgactccttaaaggacagagagctgatggtgacatctcgcaggtggctgcgcggagagggatggggatccccccaggcaaccgcgatggtcctaaacaacctcatgtacatgacagccaagtatggtgacgaactcgcatggtcagaagtcgaaaacgtctggacgactctagccgacgggtggcccaaaaatctgaagatcattctgcatttcctgatctctatttgtggagttaacagtgaaccctccctgctgccctacgtgaagaaagtgatcgtgtatctgggccgtgataagacgatgcaacttctggaggagctagtctctgagctgcagctgaccgaccccgtctcttctggtgttactcatatggataacccgccatactatcgtatcacatcgtcctataaaattccctccgtaacttccggaactacctcaagcagcaatacaatggtcgcgcccactgacggaaatccagacaacaagcccattaaagaaaacattgaggaatcatacgttcacttagatatatactccgggctgaactctcatttgaacagacagcaccatagactagagtctcgctattctagctcctcaggcgggagctacgaggaggaaaagagcgactcaatgcctctctactccaactggcggctcaaagtcatggaacacaaccagggtgagcctctaccctttcctcccgctggcggttgctggagcccccttgtggactacgtaccggagacctcttctcccggcctacccctgcatagatgcaatatagccgttattctgcttacggacctcattattgaccactccgtcaaagtggaatgggggtcttacctgcacctgctcctacacgcgatatttatcgggtttgaccactgccaccccgaggtctatgaacattgtaaaagacttctgctacacctcctgattgtcatgggtcctaatagcaatattagaaccgtcgcatccgtactgctgcggaacaaagagtttaacgaaccacgggtcctgacagtaaagcaagttgcgcacctggattataactttacagccggtatcaatgacttcatacctgattatcaacctagtccaatgaccgactcagggttaagcagcagttccacctccagctcaatttccctgggtaataactcagccgctatctcccacctgcatactactatcctgaacgaggtggatatctccgtggaacaggacggcaaagtcaagactttaatggagttcatcacttctagaaaaagggggccgctgtggaatcatgaggatgttagcgccaaaaatccgagcattaagtctgctgaacagctaaccacttttttaaagcacgtggtcagcgtgttcaaacaatcttcatctgaagggatccacttagagcaccatcttagcgaagtggctctacagaccgccttgagctgcagtagcaggcattatgcgggcagaagttttcaaatcttccgcgctctgaagcagcctctgaccgccaccactctgtcggacgtcctgtcaaggctggtggagacagtgggggacccaggcgaagacgctcaaggctttgtgatcgaattacttctcaccctggagtctgctatcgacactctggctgaaaccatgaaacattacgatctgcttagcgccctcagccagacatcttaccatgatccaatcatggggaacaagtacgccgcaaatcgcaagtctaccggacaattgaatctgagcacgagcccgattaacagtagctcgtatctgggttacaactcaaatgcccggtctaatagtctaagactcagtttgatcggggatagaagaggagatcggaggaggtcgaacactctggacattatggacggtcggatcaaccactcctcctctctcgctcgcacccgcagcttgtccagcctgagagagaaggggatgtatgatgtgcaatcgactacagagcctactaaccttatggcgactatcttctggattgcagcctcgctcctggagtcggattacgagtacgaatacttactggctctacgtctccttaataagctcctcatccatctacccttggacaagtccgagtccagagagaagattgagaatgtccagtccaagctcaagtggacaaacttccccggcctccagcagctttttctgaagggctttaccagtgcatcaacacaggagatgacagttcatttactttcaaaactgatcagtgtgtcgaagcacactcttgtggacccctcccaactttctggatttccactgaacatcttatgtctcttaccccatctgatccagcattttgactctcccacacagttctgtaaagaaacagcaagccgtattgctaaggtgtgtgccgaagaaaaatgccccacgttggtcaacctagcccacatgatgtctttgtacagcacacacacctactcccgcgattgctctaattggattaatgtggtctgccggtacctccacgatagcttcagtgacacaacctttaatctggtaacctatctggccgagctgttagaaaagggattgtcctccatgcagcagagtctgctccagataatctattccttgctaagccacattgacctttcagccgctccggcgaagcagtttaatctcgaaatcatcaagatcattggtaaatatgtccagtccccatattggaaggaggcactgaacatcttaaaacttgtagtgtcgcgcagcgcctcactggtggtcccgagcgatattcctaagacctatgggggcgacacagggagcccagagattagcttcactaaaattttcaacaatgtctctaaggagctgccgggaaagactctggactttcatttcgatatttccgaaactccaatcatcggaaataaatacggggatcagcacagcgccgctggccgcaacgggaagccaaaggtcatcgccgttacccgatcaacttcatccactagctcaggatctaactctaatgcactggttcctgtcagctggaagcgcccccagctgtctcagcggcggacaagagagaagcttatgaacgtgctcagcttgtgtggaccggagagtgggctgccaaagaatccgagtgttgtttttagttcaaacgaggatcttgaggttggggatcaacagacctctctgatttccacgacggaggacatcaaccaggaagaagaggtggctgtggaggataactcttcggagcagcaattcggtgtgttcaaggattttgacttcttggatgtggagcttgaagacgccgaaggtgagtccatggacaatttcaactggggtgtacggagacgctcactggactctattgacaaaggagacaccccttccttacaggaataccagtgcagctcttctaccccgtctttaaacctcacgaaccaggaggacaccgacgagagcagcgaggaagaggccgccttgacggccagccagatcctgtcgagaacgcaaatgctcaactccgacagtgccactgacgagactatccccgaccaccccgatctcctgctgcagagcgaggactccacaggaagcattactacagaagaagttctgcaaattagggacgagaccccaaccctggaggctagcctggacaacgctaattcccgacttcctgaagatacaacatctgtgctgaaggaggaacatgtcacaaccttcgaagacgagggcagctacataatacaggaacagcaagagtctcttgtttgtcagggtattcttgacctggaagaaacggagatgcccgagcccctcgcccctgagagctacccagaaagtgtgtgcgaggaggatgttacactcgctctgaaagaactcgatgaacggtgcgaggaggaagaggccgactttagcggactgtcttcccaggacgaggaagagcaggacgggttcccagaagtgcagacatcccccctgcctagcccctttttatctgcgattatagcagcttttcaacccgtggcatatgacgatgaggaagaggcttggcgatgtcatgtgaatcagatgctctcagatacagatggttcatcagctgtgttcactttccacgtgttttctagactcttccaaaccatccagcgaaaattcggggaaattaccaatgaagccgtgtctttcctgggggattctctgcaaagaatcggaactaaattcaaatcatcactagaagtgatgatgttgtgcagtgagtgtccaaccgtattcgtcgatgcggagaccctgatgtcctgcggcctgcttgaaacgctgaagtttggggtccttgaacttcaggaacacctggatacatacaacgtaaagagggaagcagccgagcagtggttagatgattgtaagcgcacgttcggtgcaaaagaggatatgtacaggatcaataccgatgcacagcagatggagatccttgccgagctggagctgtgtcggagactgtacaaattacacttccagctgctgctattgttccaggcatattgtaaactcattaaccaggtgaataccattaaaaatgaggcggaagtcattaatatgtccgaagagctcgctcagctggagtcaatccttaaggaagctgagtctgcttcagaaaacgaagaaatcgacatctctaaggccgcgcaaaccaccattgagacggctatccattcactaatcgagaccttgaagaataaagaatttatttctgctgtcgcgcaagtgaaggcttttaggtctctgtggccgagtgacatttttggaagttgtgaggatgatcctgtgcagactctgctgcatatctattttcaccaccagacccttggccagactgggtcctttgccgtcatcggtagtaatctcgacatgagcgaagctaactataagttgatggagttaaatctggagatcagggagagtctgcgcatggtacagtcataccaactgctggcccaggccaaacctatgggtaacatggtgtcaactggattctag

SEQ ID NO: 47734 - DNA, 1212 bp, Artificial Sequence
  Description of Artificial Sequence: Synthetic coding sequence
atgcccgagcccctggcccccgagagctaccccgagagcgtgtgcgaagaggacgtcactttggcgttgaaggagcttgatgagcgctgcgaagaggaggaggccgatttctcaggactctctagtcaggacgaagaggaacaggatggcttcccagaggtgcaaactagccctctcccatcacctttcctgagcgctattatcgccgcgttccagcccgtggcctacgacgacgaggaggaagcatggcggtgccatgttaaccagatgctgtcagacactgatggtagctccgccgttttcacctttcacgttttctcgagactgttccaaacaattcagcgaaagtttggcgaaatcactaatgaagcagtaagcttcctcggggatagtctccagagaattgggactaagttcaaatcttccctggaggtgatgatgctgtgttccgaatgtccaacggtattcgtggacgccgagacacttatgagttgcggcctgctcgaaacactgaagttcggagtgttagagctccaggagcacctcgatacgtacaacgtcaaaagagaagccgcagagcaatggttagatgattgcaaacgaacttttggggccaaagaggatatgtatcgaatcaacacggacgcccaagagctggagttgtgtcgccgcctgtataagctccattttcagttgctgctgctattccaggcctattgcaagctcattaatcaggtcaataccattaagaacgaagctgaagtgataaatatgtccgaggagttggctcaattggagtccatactcaaagaggccgagtctgcatccgaaaacgaggagattgacatcagcaaggccgctcagacgaccattgagacagccatccattctttgattgagactttgaaaaacaaagaatttatcagcgctgtcgctcaggtgaaagctttccgcagcctgtggccttccgacatctttggatcgtgcgaggacgaccctgtgcaaaccctactacatatttacttccatcatcagactctgggacaaaccggatctttcgccgtgattgggtcaaatcttgacatgtcggaggccaactataagcttatggagctgaatctggaaatccgtgaatcactgagaatggttcaaagctaccaattgctcgcccaagccaagcctatgggaaatatggtgtccactgggttctag

SEQ ID NO: 47735 - DNA, 9042 bp, Artificial Sequence
  Description of Artificial Sequence: Synthetic coding sequence
atgagcaacatcaccatcgaccccgacgtgaagcccggcgagtacgtcataaaaagcctgttcgctgaatttgctgtacaggccgaaaagaaaatagaagtcgtcatggcggaaccattggagaagctgttatctcggtcgttgcagaggggcgaggacttgcagttcgatcagctgataagtagtatgtctagtgtggcggaacattgcctcccctccttgctccggacactctttgactggtacagaaggcaaaatggaaccgaggatgaatcttacgagtaccgtcctagatccagtaccaagtccaagggcgacgagcaacaacgcgaacgggactatctcctggaacggagagacctcgccgtcgacttcatattctgtctggtactggtggaggtgctgaagcagattcctgttcaccccgtacccgatcctctagtgcacgaggtactgaatcttgcctttaaacacttcaagcacaaagagggttactccgggaccaacacaggtaatgtgcatatcatcgccgatttatacgctgaggtcatcggagttttggctcaaagcaaattccaagctgtccgcaagaagttcgttacagaacttaaggagctgcgacaaaaggaacaatcgccacacgttgtgcagtccgtgatctcactaatcatgggcatgaagttctttcgcgtaaagatgtaccccgtggaggacttcgaagcttcctttcaatttatgcaggaatgtgctcaatatttcctagaggttaaggacaaagatatcaaacatgctctggctggactctttgtggaaatactcatccctgttgctgctgctgtaaagaacgaggttaatgttccatgcttgaagaactttgttgagatgttgtatcaaaccacgtttgagctgtcctctcgcaagaaacactcgcttgccctctatccactgatcacttgcctgttgtgcgtctctcagaagcagttttttctgaacaactggcatatattcctccagaattgtctgagccaccttaaaaataaagatcctaaaatgagtcgggtggcattggagtcactttatcgtctcttatgggtctatgtcattaggattaaatgcgaaagcaacaccgtcacccaatcaaggctgatgtctatcgtgtcagcgctctttccaaaaggttcccggtccgtcgtaccccgcgacacgccattgaatatctttgtaaaaattatccagtttatcgcacaggagcgcttagattttgcgatgaaagagataattttcgatctcctttctgtgggtaagtctacaaaaaccttcaccattaatcccgagcgcatgaatattggcctgcgggttttcctggtcatcgccgatagcctccaacaaaaagatggggagcctccaatgcctacaacaggagtgattctgccctctggaaacaccttgcgtgtgaagaagattttcctgaacaagacactgactgacgaggaggctaaagtgattgggatgagcgtttactacccacaggtccgcaaggcactggatagcatcctacgacatttggacaaggaggtcgggagacccatgtgcatgacaagcgtccaaatgtctaataaagaaccagaggacatgatcaccggggagcgtaaaccaaaaattgatctattccgcacatgcatcgcagctatcccgcggctgattcccgacgggatgtcacggacagatctcatcgaactattggccagactgaccatccatatggatgaagagcttcgcgcattggccttcaacactctgcaggccttgatgcttgatttcccagactggcgcgaagacgtgctctccgggttcgtctattttatcgtccgtgaggtaactgacgtgcaccctacgcttctggataacgcggtgaagatgctggttcagttgatcaaccagtggaagcaggccgctcaaatgcacaacaaaaatcaggacacacaacatggcgtcgcaaatggtgcttctcatcccccccctttagaaagaagtccttactccaacgtctttcatgtagtagaagggttcgcattagtgatactgtgtagctctcgacccgctacccgacgactggccgtgtccgttctgagagaaataagagcactctttgccctcctggagatccccaaaggagacgatgaactcgctatcgacgtgatggataggcttagtccttccatcctggagtctttcatccatcttacgggggccgatcagaccaccttgctgtactgtccgtcctccattgatttgcagactctggcggagtggaactcctccccgattagtcatcagtttgacgtaattagtccatctcacatttggatcttcgctcacgttactcaggggcaggacccgtggattataagtctttcctccttcttgaagcaggagaacctacccaaacattgctccaccgccgtgtcatatgcgtggatgttcgcctatactcgactgcagctgctgtcaccccaggtagacatcaatagccctatcaacgccaagaaagttaatacaactacaagtagtgactcttacattggcctgtggcgaaactaccttatcctttgttgctctgcagctacgtctagttcatccacgagcgcagggtcagtgagatgttctcctcccgaaaccctggcatccactcctgattcaggatactccattgactccaaaatcatcggcattcccagcccctcatcactctttaagcacatcgtgcctatgatgcgtagcgaaagcatggagataacagaaagcttagtactaggactgggacggaccaacccaggcgcattcagggaactgatcgaggaattgcaccccattatcaaggaggcactggagcgacggccagaaaacatgaagcgacgcaggcggcgagatatactgcgagtgcaattggtacgaatcttcgagctcctcgcggacgccggggttattagtcacagcgccagtgggggacttgacaacgagacacatttcttgaacaatacactgttagagtatgtagacttgaccaggcagctgttggaggccgagaatgaaaaagattcagacaccttgaaggatatccgttgccatttctctgcactcgttgccaacatcatccagaacgtgccagtgcatcagcgtaggagtatctttcctcagcagtctctgaggcacagcttgtttatgttgttctcacactgggcaggccctttcagcatcatgttcacgcctctggatagatactctgatcggaatatgcaaataaaccgacaccagtactgtgcactcaaagcgatgtccgccgtgctgtgttgtggcccggtagctgataacgttgggttgtcatccgacgggtacctttataagtggttagacaatattctggattctctggataagaaggtccatcagctcggctgcgaagccgttactctgctcctggaactgaaccccgaccagtctaaccttatgtactgggctgtcgatcggtgttacaccggtagtgggcgggtggcggctgggtgctttaaggccattgccaacgtgtttcagaatcgcgattaccagtgcgataccgtcatgctgctgaacctgatactttttaaagccgccgattcttcacgctcgatctatgaagttgccatgcaactgctgcaaattctggagccgaagatgttccgctatgcacacaaactggaagtgcaacgcacggatggcgtgcttagccagctgagccctctgccccatctctactccgtgtcttactatcagttgtccgaagaattagcaagagcctaccccgaactgactctggctatcttcagtgaaatctctcagcggattcagaccgctcaccctgccggccgacaagttatgcttcactacctcctgccatggatgaacaacatagagctagtagacctgaagccactgcctactgcgcggcgccatgacgaagatgaggatgatagcctaaaggatagggagctcatggtgacttcacgccggtggctcaggggtgaaggctggggaagtccccaggctactgccatggttcttaacaacctgatgtatatgaccgctaagtatggcgatgagctcgcttggagcgaggtagagaacgtctggacaacattggcggacggctggcccaagaatctgaaaatcattctacacttcctgatcagcatatgcggcgtgaactctgaaccctctctcctgccgtacgtcaagaaagtaatcgtgtatctggggcgcgataagaccatgcagctgctggaggaactcgtatcggaactacagctaaccgatccagtctccagcggcgttacccatatggacaatcctccctattatcggattacatcctcctacaaaatccccagcgtgactagtgggaccacatcaagcagtaacaccatggtcgctccaactgatggaaatccagacaataagcccatcaaagagaatatcgaggaatcttatgtgcacctggacatctatagtggcctcaactcccatctcaacaggcagcaccaccggctcgagagccggtacagcagctcgagtggggggtcctatgaagaggagaagagtgattctatgccactgtactcgaattggcggcttaaggtcatggaacacaaccagggcgagcctctgccgtttcctccagccggggggtgctggtccccactggtggattatgtgcccgaaacgtcttcaccaggactgcccctccaccgttgcaatatcgccgtgattctcctgacggatttgataatcgaccattcagtgaaggtcgagtggggctcctacctccacctattgttgcacgccattttcataggctttgaccactgtcatcccgaggtgtatgagcactgtaaacgcctcctcttacacctactgatcgtaatgggcccgaacagcaacatcagaactgtggccagcgtacttctccgcaacaaagagttcaacgaacctagagtgctgactgttaaacaggtggcccacctagattataatttcaccgctggcattaacgatttcatccctgattaccaaccgagccctatgactgacagtgggctgtcaagctccagcaccagcagttccatctcattggggaataacagcgctgctatcagtcatctgcacacgactatattaaacgaagtggatatcagtgtcgaacaggacggcaaagtgaagacgctcatggaattcataacatcaaggaagaggggtccactctggaaccatgaggacgtcagtgccaagaaccccagcatcaagtccgcagagcaactgactacctttctcaagcatgtcgtgtcagtttttaagcagtcttcatctgagggcatccatctcgagcaccatctatctgaagtcgcccttcagaccgcactctcttgttcaagtcgtcattatgccggaaggtcttttcagatctttagagcactcaagcaacctcttactgcaactaccctgtctgatgtgctcagccggttagtggagactgtgggagaccccggggaggacgctcaggggttcgttattgaattactgttgacattggagagcgccatcgacacactggcagagactatgaagcactacgatctcctgtcagcactctctcagaccagctaccacgaccctattatgggcaacaaatatgcagccaatcggaagagcacaggccaattaaatctctccacgagcccgataaatagctcctcctacctgggctacaacagtaacgcacgctccaattcactgaggctttcactcatcggtgacaggaggggcgatcggagacgatcaaatacactggacattatggacggacggattaatcacagctcaagcttggccaggaccagaagtttgagttccctgagggaaaaaggcatgtatgatgtccaaagcactacagagcccaccaacctgatggccacgattttctggatcgccgccagtctgctggagtctgattacgaatacgaatatctcctggctctccgccttttgaacaagctgctgattcacctgcccttggataagtctgagagcagagagaagattgagaacgtgcaaagcaaattgaagtggaccaacttccccggcttacagcagctgttcctcaagggattcacatccgcttctacacaggagatgacagttcacctccttagcaagctgatcagtgtcagtaagcatactctggttgacccatctcagctgtctggttttcccttgaatattctatgtcttcttcctcatctgattcagcacttcgactctcctactcagttctgcaaggagactgcaagtcgtatcgctaaggtgtgcgctgaggaaaagtgtcctaccctcgtcaatttagcacacatgatgtccttgtactcgacccacacctattcccgtgactgctctaattggatcaatgtggtgtgtcgttacttgcatgactccttttccgacaccacatttaatttagtcacatacttggcggaacttttggaaaagggactgtcttccatgcagcagtctctcctgcagatcatctattcgctcctgagccacattgacctcagtgcagctccggccaagcaattcaacttagaaatcatcaaaataattggcaaatacgtgcagtcaccttattggaaggaagctctcaacatccttaagctggtggtgagtagatctgccagtctcgtggtgccttctgacataccgaaaacatacgggggtgacaccggaagtcccgagatttcatttacgaagatctttaataacgtgtctaaggaactgcctgggaaaactctggatttccatttcgacatcagtgaaacaccaataataggcaataaatacggtgaccagcatagtgctgcgggccgaaacggtaagccgaaggttattgccgtaacgagatccacgagtagcacgagctcggggtcaaattcgaacgccctggttccagtgtcttggaagagaccacagctgtcccaaaggcgcacacgcgagaagcttatgaacgtgctgtctctgtgcggaccagaatcagggctcccaaaaaatccttctgtggtgttctcttcgaacgaggatctggaggtcggcgaccagcagacctcattgatctccactacagaagacattaaccaagaagaggaggtggcagtggaggacaactcctccgaacagcagtttggagtgtttaaagacttcgacttcctcgatgtggaactggaagatgccgagggcgaaagcatggataattttaattggggagtgaggagacggtctctcgacagtatcgataagggcgatactccatcgcttcaagaatatcaatgttcatcaagtaccccctcattgaaccttactaaccaagaggatactgacgagagctcagaggaagaggctgcattgaccgcgagccagattttatcaaggacacagatgttgaatagcgattccgcaactgacgaaacaattcccgaccaccctgacctcctccttcaaagtgaagactcaaccggcagcattacaactgaggaagtgctccaaatcagagatgaaacccccactctggaggcctcactcgacaatgccaactctcgattgcctgaagatacaactagcgtgcttaaggaagaacacgtgacgacctttgaagatgaaggatcatacatcatccaggaacagcaagaatcactggtgtgtcaagggatcttggatctggaggagaccgagatgccggagccactggctcctgagagctatcccgaaagcgtttgtgaggaggatgtgaccctggccctcaaagagctggatgaaaggtgtgaggaggaggaagcggacttttcagggctgtcctcccaggacgaggaggagcaggacggttttcctgaggtgcaaacaagtccactgcctagcccttttctgtcagctataatcgccgcattccagccagtcgcatacgacgatgaagaggaggcatggcgatgccatgtaaaccagatgctttcagatacagacggatcttcggccgtctttactttccacgtcttttcgaggttatttcaaactatccagcggaagttcggggagatcacaaacgaggcagtgagttttctgggggacagcctgcagcgtatcggaactaagttcaaatcctcactagaggtcatgatgttatgttccgagtgtccaacagtctttgtggatgcggaaacattgatgtcatgtggccttctcgagaccctgaagtttggggtcttggagcttcaagagcaccttgatacctataacgtgaagcgggaagctgcggagcagtggctggatgattgcaaacgtaccttcggggcgaaagaagacatgtatcgaataaacacagacgctcagctgaatgagattttggtcgaattggaactgtgccggcggctgtacaagctgcatttccagctgctgctgttattccaggcttactgtaagctcatcaatcaagtgaacactatcaagaacgaggcagaagtaattaatatgtcagaagaactcgcccagcttgaaagcatccttaaggaagcggagtccgcctctgaaaatgaggaaattgacattagtaaagctgctcagactaccatcgaaaccgctatccatagcttaatcgagaccttgaaaaacaaagagtttataagcgccgttgcccaggtcaaagcatttagaagcctgtggccatccgacatttttggttcatgcgaagatgacccggttcaaactttgcttcatatttactttcatcaccaaaccctgggccaaactggctcattcgcagtgattggttctaacttagatatgtccgaggccaattacaaactgatggagcttaatctagagattcgggaatctctcagaatggtgcagtcctatcagttgttggcccaagcaaagccaatgggaaatatggtcagtaccggcttctag

SEQ ID NO: 47736 - DNA, 549 bp, Artificial Sequence
  Description of Artificial Sequence: Synthetic coding sequence
atgcgggagcccatctacatgcacagcaccatggtgttcctgccctgggagttacacactaagaaggggccatcccctcctgagcagttcatggccgttaagttatcagactcaaggatagcattaaagtctggttacgggaagtatttagggatcaattctgatgagttggtcggccacagcgatgccattggccctagggaacagtgggagcccgtgttccagaacggtaagatggccctgcttgcttccaactcttgcttcatccgctgtaacgaagcaggggatattgaagcaaagtctaagaccgctggtgaggaggagatgatcaagatacgctcctgcgccgagaaagagacgaaaaaaaaagacgacatccccgaggaagacaaaggcaatgtgaagcagtgtgaaatcaactacgtcaaaaagttccagagtttccaggaccacaaactaaagatctctaaggaggaatctaagatccttaaaaaggcccagaaagacggcttcctacacgagacccttctcgaccgcgagcccaactag

SEQ ID NO: 47737 - DNA, 549 bp, Artificial Sequence
  Description of Artificial Sequence: Synthetic coding sequence
atgcgggagcccatctacatgcacagcaccatggtgttcctgccctgggagctgcataccaagaaggggccttctccccccgaacaatttatggctgttaaactgtctgattctcgcatcgcactgaagagcggttacggaaagtacttggggatcaattccgatgagctcgtggggcactctgatgctataggaccacgagaacagtgggagcctgtctttcagaacggaaagatggccctacttgccagtaacagttgtttcatcaggtgtaatgaggccggggacattgaggccaagtcaaaaacagctggcgaggaggagatgattaaaataaggtcctgtgccgaaaaagagaccaagaagaaggatgatatcccagaggaggataagggtaatgtaaagcagtgtgaaatcaactacgtcaaaaagtttcagtcgttccaggatcacaagctgaaaatttctaaggaggagagcaagatcttgaaaaaagctcagaaagatgggtttctgcacgaaacacttctggaccgcgaacccaattag

SEQ ID NO: 47738 - DNA, 369 bp, Artificial Sequence
  Description of Artificial Sequence: Synthetic coding sequence
atggacgagggcacctacatccacgccctggacaacggcctgttcacattgggcgcaccacataaagaagacattgacgagggcccctctccccccgaacaatttatggcggtaaagctgtccgattctagaatcgccttaaaatctgggtatggcaaatacttagggatcaactctgatgagcttgtggggcacagtgacgctatcgggccgcgagaacagtgggagccggttttccagaatggaaaaatggccctcctcgcatccaatagctgcttcatccgttgcaatgaagcgggcgatatagaggcaaagagcaagaccgcaggtgaagaagagatgattaaaatgctatctcaccatttgtag

SEQ ID NO: 47739 - DNA, 837 bp, Artificial Sequence
  Description of Artificial Sequence: Synthetic coding sequence
atgggcaagggcaacgaggacagcgacctgcactgcagcagcatccagtgttctactgaccagccaccctttcagcagatatccttcacagaaaaaggaagtgatgaaaagaagccatttaaagaaaagggcaagactgcattcagtcatagcagtgaaaaacatatacagcggcagggatccgaacccaaccctaataaagaaaacagcgaggagaccaaactgaaagcgggcaactctaccgcaggcagcgagcccgagtctagcagctatagggagaactgtcggaaacgcaagatgtcctcgaaggacagttgccaggataccgcaggcaactgtcctgaaaaagagtgctcattgagcctgaataagaagagccgctcgagtaccgccgtccacaattctgagattcaggaaacttgtgacgcccatcatcgaggccactcccgggcctgtaccggtcattccaaacgacaccgctctagagccctaggagtgcagacacccagcatcagaaaatccctcgtcacttccgtgcgcgctatgagcgaagccgtgtatcaggatttggcgcaagtatgggcccagcagatccactctcctctgacttgtgagcagctgaccctgttgacccgcttacggggtcctctttgcgcccaggtgcaaacactctacagcatggccactcaggcggcctacgtattccctgccgaatcctggctggttcccgctaccctgcccgggcccggggagagcgctctggatagggaagcccatcctttcccagggcaagagatcaccgagacagtcagtggctccgacgaggcaaaactatag

SEQ ID NO: 47740 - DNA, 849 bp, Artificial Sequence
  Description of Artificial Sequence: Synthetic coding sequence
atgggcaagggcaacgaggaccccgacctgcactgcagcagcatccagtgttctactgaccagcccccattccagcagattagtttcacggagaaaggatccgatgagaaaaagccatttaaaggtaaggggaaaacagcgtttagtcattcctctgagaaacatacccaaagacaagccgggagcgaccctaaccccaacaaggaaaactcagaggaaactaagctcaaggccgggaactcaacggcaggcagcgaaccggaatcaagtagttaccaagaaaactgtcgtaagcgaaaaatttcctcaaaagatatctgtcaagacagagcgggaaactgtcccgaggaagagtgcaacttaactcttaacaaaaagagtagatcttccacagcagtgcataactcagagatacaggagacctgcgacgcccaccaccgtggaagctcccgagcatgtacgggcagatcaaagagacaccgtagcagggccctggaggtgcagaccccgagcctgcgtaagagcttagtgaccagtgtgagagccatgtcagaggctgtgtatcaggacctggcgcaggtctgggcacagcaaatccacagcccacttacatgtgagcagctgacgctgctgacaagacttagggggccgctgtgcgcgcaggtgcaaacactctacagcatggcgacacaagccgcatacgtgtttccagccgaatcctggttagtgccagctaccctgcccggcccaggggattccgcactggacagagaagcacacccctttcctgggcaggagatcactgagccggtgtcaggttctgatgaagccaaacttggagcgccttag

SEQ ID NO: 47741 - DNA, 984 bp, Artificial Sequence
  Description of Artificial Sequence: Synthetic coding sequence
atgggccggaccagcaaggacaagcgggacgtgtactaccggctggccaaagaaaatggatggcgcgcccggtccgccttcaaattgctgcagctggataaggagtttcagctgttccagggagtgacaagagctgtggatttgtgtgccgcgccaggtagttggtcccaggtcctgtcacaaaaaatcggcggacaggggtcgggtcatgtcgtggccgtggatctgcaggcgatggccccactgccaggggttgtccagatacagggcgatatcactcagttgagtactgccaaagagattatccagcacttcaaaggttgtcccgccgatttggtggtctgtgatggggctcctgacgtgacagggctacatgacgtggacgagtatatgcaggcacaactgctgttagcagcacttaacatcgcaacacacgtattgaagcccggaggatgctttgtggccaagattttccgcggacgcgacgtgactttactgtactcccagctccaagtgtttttcagctcagtactgtgcgccaagccacggagctcccggaactccagcattgaagcctttgcagtatgccaggggtacgaccctcctgagggatttataccagatctttccaagcccctcctcgatcacagttatgactttaatcagttggacggacccacgagaatcattgtcccgtttgtgacatgtggagacctgtcgtcttacgattcagatcggtcttaccccttggacctggaaggcggaagcgaatacaagtacacccccccgacacaacctcccatctcgcctccttatcaggaagcatgcacgttaaagcgcaaaggtcagctggccaaggaaattcgtcctcaggattgccccatctcccgggtagatacatttccccagcccctggcagctcctcagtgtcacaccttactcgcgcctgaaatggaagataatgagatgtcttgcagcccatag

SEQ ID NO: 47742 - DNA, 984 bp, Artificial Sequence
  Description of Artificial Sequence: Synthetic coding sequence
atgggccggaccagcaaggacaagcgggacgtgtactaccggctggccaaagagaatgggtggagagctcgcagcgctttcaaactactacaactggacaaggagttccagttgtttcagggcgttacccgagcagtggatctgtgcgctgcaccaggctcttggtctcaggtcctgtcccagaagattggtggccagggctcgggacacgtcgttgcggttgacctgcaagccatggcccctctgcctggtgtagtgcaaattcaaggggacatcacgcaacttagcaccgccaaggagatcatccaacacttcaagggttgccctgccgacttggtggtgtgcgacggcgctccagatgtgactggcctgcatgacgttgatgaatatatgcaggcccagctgctgctggccgcgctgaatatcgctactcacgtactcaagcccgggggctgcttcgtagccaagatatttcggggcagggacgtgactctgctttactctcagcttcaggtgtttttctcgagcgtgttgtgcgcaaagcctagatcttcccggaatagttccattgaggcttttgccgtgtgccaaggctacgatcctccagaaggctttattcccgatctcagcaaaccgctgcttgatcacagttacgatttcaaccaattggacggcccaactaggattatagtaccttttgtcacttgcggggacctatctagctacgattcagaccggtcctacccgctcgaccttgaagggggctcagaatacaagtacacacctcccacccagccacccattagcccaccttaccaggaagcttgtacgctgaagcgcaaggggcagttagccaaagaaatccggcctcaagattgtcccatatccagagtcgacacatttccccagcctctggctgctcctcagtgtcataccctcctggcccctgagatggaagataatgagatgtcttgctcgccctag

SEQ ID NO: 47743 - DNA, 411 bp, Artificial Sequence
  Description of Artificial Sequence: Synthetic coding sequence
ctgctgggcgagcgggccatcccccgggccggcagccaggccggctggcggcctaccctcggttctgtggggggccgagttggttctcctagttcggcggaatgctgccgccctttcccggggcagcgccggtggaactttgtggctctacagccgccagctaggcggtgggacctgactatgctgccaaggttggttctgaactcctgggcacaggcaattttaccacctcaacctcctaaagtgctcggcttgcaggaccccggcgccagcttcggatcacgtttgcatcccgcgctggagcgcagccccggcatgatctatagctgggctgtgttcctctacccgggagtacaccccgtgcaccctaggaatactgacctgattaccgtaaccaaatccgacggatag

SEQ ID NO: 47744 - DNA, 450 bp, Artificial Sequence
  Description of Artificial Sequence: Synthetic coding sequence
atgaagcccgccggcaacggcttccccagccccctggccggccccgggtccaggcggggatgtgtgcccgggttgaccacatggattcgggccagagcgcgggaaacaggttccaggagaggtcgtaacgtgttctctccagaaagggcagcgggttcgggcgggtgcttttgttccggaaggatacccagggtgtccgccgtggatgcacttagagtagcaggcgctcgacgcgctgcggtgtctagagggaaggctggagtgcccctgcggtaccgggaacgacacctcgaactctccgagtggcctagaaaaccagccagagcccactttcccgcccgaactggatgctggtggttttggtggctgctaagtggcggcacacctggaacctctaagggcggttttatctggttgtatctgacctggcaattcctgcttaataagtag

SEQ ID NO: 47745 - DNA, 747 bp, Artificial Sequence
  Description of Artificial Sequence: Synthetic coding sequence
atgggcatcatggccgccagccggcccctgagccggttctgggagtggggaaaaaacattgtgtgtgtaggccgcaactacgcggaccatgttagggaaatgagatcagccgtgttatcagaaccagtactctttctcaagccaagtaccgcctacgcacctgaaggctcccccattctgatgccagcatacacccgaaatctgcatcatgagctcgaactcggcgtggtgatgggaaaacgttgtcgcgcagttccagaggccgcagcgatggactatgtgggtggctacgcgttgtgtctcgacatgactgccagggacgtgcaagacgaatgcaagaagaaagggctcccatggacccttgcgaagtcgttcacggcatcctgcccagtgtcagctttcgtgccaaaggagaaaatccctgatccacataaacttaagttatggctcaaggtgaacggagaactgcgacaggagggcgaaacatcgtcaatgatttttagcatcccatacattatttcctacgtgtcgaaaatcatcacactggaagaaggagatatcattcttacaggcacccctaaaggcgtcggccccgtgaaggagaatgacgagatcgaggccgggatacacgggctgagacaggggctcacattgtccccgaaactcgaatgtagctcagctattaccgcccattgcagcctcgagcttcctggttcttctaaccctcctagcgcatctaggttctag

SEQ ID NO: 47746 - DNA, 681 bp, Artificial Sequence
  Description of Artificial Sequence: Synthetic coding sequence
atgggcatcatggccgccagccggcccctgagccggttctgggagtgggggaagaatatcgtctgtgttggtcgcaactacgctgatcacgttcgagagatgcgcagtgctgttctttccgagcccgtgttgtttttgaagccaagcacggcttatgcacctgaaggctcccccatactgatgccagcttatacccggaatctccatcatgagctcgagctgggagtcgtgatggggaaacgctgccgcgccgtgccagaggcagctgccatggattacgtcggcggctacgccctgtgcttggacatgaccgcaagggacgtgcaggacgagtgtaagaagaaggggcttccatggaccctcgctaagtcatttactgccagttgtccggtcagcgccttcgtgccaaaagagaagattcccgacccgcataaactgaagttatggctgaaggttaacggagagctccggcaggagggtgagacctctagtatgattttcagcatcccttatatcatcagctacgtttccaagattattaccctcgaagaaggcgacatcattttgactggtacaccaaagggagtgggccccgtgaaagagaacgatgagatcgaagccggtatccatggattgcctaaggtgtctagtgcaactctccccgtcagactgcaggagtag

SEQ ID NO: 47747 - DNA, 675 bp, Artificial Sequence
  Description of Artificial Sequence: Synthetic coding sequence
atgggcatcatggccgccagccggcccctgagccggttctgggagtgggggaaaaatatcgtttgtgtgggccgcaactatgccgaccacgttcgcgagatgcgctctgcggtgctgtccgagccagtcttgtttttaaagccgagcacagcttacgctcccgagggtagtcccatactgatgcccgcctatactcgtaatttgcatcatgagttggagctcggtgtcgtgatgggcaaaagatgcagggcggtgccggaggcagcagctatggattacgttggcgggtacgccctctgtctggacatgaccgcccgggacgttcaggacgaatgcaagaaaaagggactcccatggacactggcaaagtctttcacagcttcctgcccagtgtctgcttttgttcccaaggaaaagattcctgatccccacaagctgaagctctggttgaaggtaaatggagaactgagacaggaaggcgagaccagttcaatgatcttctccatcccttatatcattagttatgtgagcaaaattattacactggaggaaggggacataatcttaacaggcaccccaaagggggttgggcccgtcaaggagaacgacgagattgaggccggcatacacggcctcgttagtatgacttttaaagtggagaaacctgagtattag

SEQ ID NO: 47748 - DNA, 1134 bp, Artificial Sequence
  Description of Artificial Sequence: Synthetic coding sequence
atgtacaccttcgtggtgcgggacgagaacagcagcgtgtacgccgaggtcagtcgcctgctcctggcgacggggcactggaagcgcttgcgaagggacaacccacgctttaacctcatgctaggagaaaggaatcggctgccctttgggcgactgggtcatgaaccaggcttagtacaactcgtcaattactataggggcgccgacaagctttgtaggaaggccagcttagtaaagctgatcaagacaagccccgagttagccgaatcttgcacctggttccccgagtcctacgtgatctacccaacaaatcttaaaactcccgtcgcccctgcccagaatggtatccagcctcccatttccaattcaagaaccgatgagagagaatttttcttagcatcctacaatagaaaaaaagaggatggagagggaaacgtgtggatcgccaagtccagcgctggagcaaaaggagaaggcatcctgattagctcagaggcctctgagctcttggacttcattgataatcaaggacaggtgcacgtgatccagaaatatttagagcatccgttactgttggaacccgggcacaggaagtttgatattcgttcatgggtgctggtggaccatcagtataatatttatttgtatcgcgagggcgtcttgaggaccgctagtgagccataccatgtggataatttccaggataagacctgtcacttgaccaaccattgtattcagaaagagtattcgaaaaactatggcaagtacgaggagggcaacgagatgttcttcaaagagtttaatcagtacctgacctccgcgctaaatatcactttggagtcatctattctgctccaaataaagcacatcatccggaattgcctgcttagtgtcgagcccgctatatcaaccaagcaccttccatatcaaagttttcagctgttcgggtttgacttcatggtggacgaagaactgaaagtctggctcattgaggttaacggggcaccagcctgcgcgcagaagttatacgccgagttgtgtcaagggattgtagacattgccatatcctccgtatttcctccccctgacgtggaacagcctcagactcaacccgcagccttcattaaactctag

SEQ ID NO: 47749 - DNA, 384 bp, Artificial Sequence
  Description of Artificial Sequence: Synthetic coding sequence
atgctggtgagcggccggcggcggctgctgaccgtgctgctgcaggcccagaagtggccttttcagccaagtagggacatgcggctagtgcaattccgcgcgccgcatcttgtggggcctcacttaggccttgagaccggcaacggaggaggagtcattaatttgaatgctttcgaccctacactgcctaagaccatgactcagtttcttgagcagggcgaagcaactttatctgttgccagacgcgcgctggcggcacaactgccagtgctccccagaagtgaggtgacatttctggcacctgtcacgcggccggataaggtggtatgtgtcggaatgaactatgtcgaccattgcaaggaacaaaatgtaccagtcccttag

SEQ ID NO: 47750 - DNA, 246 bp, Artificial Sequence
  Description of Artificial Sequence: Synthetic coding sequence
atgctggtgagcggccggcggcggctgctgaccgtgctgctgcaggcgcagaagtggccatttcagccgtctcgggatatgcgcctcgtgcagttcagagctcctcatttagtggggccgcaccttgggctggagacaggaaatggcgggggggtaattaatcttaatgcatttgacccgacattgcctaagactatgacccaatttcttgagcaaggagaggccacgttaagcgtggcccgatag

SEQ ID NO: 47751 - DNA, 945 bp, Artificial Sequence
  Description of Artificial Sequence: Synthetic coding sequence
atgctggtgagcggccggcggcggctgctgaccgtgctgctgcaggctcagaaatggccattccaaccctcccgcgatatgagactcgtgcagttccgagcaccgcacctcgttggaccacacttggggctggaaaccggcaacggaggcggcgttattaatttaaatgcctttgaccccactctgccaaagaccatgactcagttcttggagcagggagaagctacattgagcgtggcaaggcgcgccttggcagctcaactgcctgtgttaccacggtcagaggtgaccttcctggcccccgtaacccgccccgacaaagtcgtgtgcgtcggcatgaattacgtggaccattgcaaggagcagaatgtgccagttccaaaggaaccaatcatcttttctaagtttgccagcagcatcgttggtccatacgatgaagtggtactgcccccacaatcccaggaggtggattgggaggtggagttagcagtggtcattggcaagaaggggaagcatatcaaggccaccgacgcaatggcgcatgtcgccggctttaccgtggcacacgacgtgagcgccagggattggcagatgaggagaaatggtaagcaatggctgctggggaagacttttgataccttttgccccctcggacccgctttggtcactaaagactctgtggccgaccctcacaacctcaagatttgctgcagggttaacggggaggtggtgcaaagcggcaatacaaatcagatggtatttaaaacagaagacctgatagcatgggtttctcaatttgtaaccttttatcctggcgacgtcattctgactggcacacctcctggtgtgggagtattcagaaagcccccagtgtttctgaaaaagggcgacgaagttcagtgtgagatcgaggaattgggggttatcatcaataaggtcgtatag

SEQ ID NO: 47752 - DNA, 945 bp, Artificial Sequence
  Description of Artificial Sequence: Synthetic coding sequence
atgctggtgagcggccggcggcggctgctgaccgccctgctgcaggcccagaagtggccattccaaccatcaagggatatgaggttggtgcagttccgggccccacacttggtcggtccccacctgggcctcgagacaggcaacggcggcggcgtgataaatctcaacgcctttgacccaacccttccaaaaaccatgacccaattcttggagcaaggcgaggctacgttgtccgtcgcacgccgcgccctcgctgcacagttgccagttctgccgtggtctgaagtcacatttctggctccagtgacctggcccgacaaggttgtgtgtgttggcatgaactacgtagatcattgcaaggaacagaacgtgcccgtcccgaaagagccaatcattttctccaagttcgcctcaagcattgtgggcccttatgatgaggtggtgctcccccctcagagccaggaagtggattgggaggtggaattagccgttgtaatcgggaaaaaaggaaagcatatcaaagccaccgacgcaatggcccacgtggctgggttcacagtggctcatgatgtgtctgcacgggactggctgacacggcgaaatggcaagcaatggctacttggaaagacttttgataccttctgccccttaggccctgcgctcgtcacaaaggactcagtagccgacccgcacaaccttaaaatatgctgtcgggtaaatggcgaagtggttcagtcaagcaataccaaccaaatggtgtttaaaactgaggatctgatagcatgggtctcccagttcgtgaccttttacccaggcgacgtgatcttaactggcacaccacctggggtgggtgtgtttcggaagccccccgtttttttgaaaaagggcgacgaggtgcagtgtgagatcgaagagctgggcgtaatcatcaataaagtggtctag

SEQ ID NO: 47753 - DNA, 945 bp, Artificial Sequence
  Description of Artificial Sequence: Synthetic coding sequence
atgctggtgagcggccggcggcggctgctgaccgccctgctgcaggctcagaaatggcccttccagcctagccgcgacatgaggttggtgcagtttcgggcgccgcatttggtgggacctcaccttggactcgaaaccggtaatggggggggcgttatcaatctgaacgcttttgaccccacattacctaagacaatgacgcagttcttggagcagggcgaggccaccctgtctgtggctcgcagggctttagccgcacagctgcccgtcctcccctggagcgaggtgaccttcctggctcccgtgacatggcctgacaaggtggtttgcgtcggtatgaattacgttgatcactgcaaggagcagaacgtacctgtgcccaaagaacctatcattttctctaagtttgcctcaagcattgtggggccctacgacgaggtggttttacctccacaaagtcaggaagtggattgggaggtggagcttgcggtggtgattggaaagaaaggaaagcacatcaaggctactgacgccatggcacacgtcgctgggttcacagtggcccatgacgtatctgcaagggactggcttactcgcaggaacggcaaacagtggttactggggaaaactttcgatacattctgccctcttggtcctgcactcgttaccaaggacagtgtggcggacccacacaatctcaagatctgttgcagggtgaacggggaggttgtccagtccagcaatacaaatcaaatggtgttcaagactgaggacctcattgcttgggtatcacagtttgtcactttttaccccggtgacgtcatactgaccgggactcctccaggggtgggagtcttcagaaagccacccgtctttctcaagaagggcgacgaggtccaatgcgagatcgaggaacttggggtaataatcaacaaggtggtgtag

SEQ ID NO: 47754 - DNA, 945 bp, Artificial Sequence
  Description of Artificial Sequence: Synthetic coding sequence
atgctggtgagcggccggcggcggctgctgaccgccctgctgcaggcacaaaagtggccatttcagccctccagagacatgcggctagttcaattccgagccccccacctcgtgggcccgcacttaggtctcgagacagggaatggcggaggtgttattaacttgaatgcattcgatcccaccttaccaaagacgatgacccagttcttggaacagggggaagctaccctctcagtcgcaagacgagcactcgccgcccaattacccgtactgccttggagcgaggtgacattcctcgcccccgtaacctggcccgacaaggttgtgtgtgttggcatgaattatgtggatcactgcaaggagcagaacgttcctgtgccaaaggaacccatcatattttcaaagttcgccagcagcattgtgggaccatacgatgaggtagtcttaccaccacaaagccaagaagtggattgggaagttgagctggcggtggttataggcaagaagggcaagcatataaaagccaccgatgcaatggctcacgttgccggatttacagtcgcacacgacgtatcagcaagagactggctgaccagaagaaacggaaagcaatggctgctcggaaagacttttgataccttttgcccgctcgggccagcactcgtgaccaaggactccgtcgcagatccgcataacctcaagatctgctgtagagtaaacggcgaggttgtgcagtcctcaaacacaaaccagatggtttttaagacagaagatctgattgcttgggtctctcagttcgtgaccttttatccaggagatgtgattttgaccgggactccgccaggtgtgggggtgttccggaagcctcccgtcttcttaaagaagggcgatgaggtgcaatgcgagattgaagaactaggagtgattataaataaagtagtctag

SEQ ID NO: 47755 - DNA, 468 bp, Artificial Sequence
  Description of Artificial Sequence: Synthetic coding sequence
atggccacccggaacccccccccccaggactacgagagcgacgacgattcatacgaggttcttgatttgaccgaatacgcccgcagacaccagtggtggaatcgggtctttggacacagctctggaccaatggttgagaaatattctgtggcaacacagatagttatggggggcgtcacagggtggtgtgcgggctttctgttccagaaagtggggaaactcgcggctacagcagtcgggggagggttcctgctcttgcaaatagcctcgcattcaggttatgtgcagatcgactggaagcgggtcgagaaagacgtgaacaaagcgaagcgccagatcaaaaagcgtgccaataaggcagcacctgagattaacaatctcattgaggaagccaccgagtttatcaagcagaacattgtgatctcctcgggatttgtgggaggctttcttttagggctggcatcttag

SEQ ID NO: 47756 - DNA, 339 bp, Artificial Sequence
  Description of Artificial Sequence: Synthetic coding sequence
atggagctggtgctggtgttcctgtgcagcctgctggcccccatggtcctggccagcgcagcagagaaggagaaagaaatggatcccttccactacgattaccagacgctcagaattggcggactagtgttcgcggttgtgttgttttctgtcggcatcctacttatcctcagaccccaggagatgaggaagccacggtggcgcacgtcttctccgcctatgcagcagtctcctaggaaacagcgcacagaagtccagccctctggtggtaggaggcagccacaaggaggcagggggcccgtgttgctgtggcagaaaataccactgtgggggcagtag

SEQ ID NO: 47757 - DNA, 339 bp, Artificial Sequence
  Description of Artificial Sequence: Synthetic coding sequence
atggagctggtgctggtgttcctgtgcagcctgctggcccccatggtactagcatctgccgccgagaaagagaaggaaatggatcctttccactacgactatcagacgctgagaattggggggcttgtgtttgcagtggtcctttttagcgtgggaattctcctaatcctccgaccacaggagatgaggaagcctcgatggcgtacatcctccccacccatgcagcagtctcctcgcaagcagcgcaccgaggtgcagccatccggagggaggcgacagccacagggggggcggggaccagtcttgctgtggcagaagattcccctttggggacagtag

SEQ ID NO: 47758 - DNA, 3537 bp, Artificial Sequence
  Description of Artificial Sequence: Synthetic coding sequence
atgggccaggacgccgaggacaccagcgaggagccccccgagaaggaggagctcgccggcgtacaggaagcagaaaccgccacagactgccccgaagtcttggaggaagggtgcgaggaggctacaggggtgacaggaggcgagcaggtagacctctccgaaccccccgaccacgagaaaaaaactaatcaggaggtggcggctgccaccctggaggaccacgcccaagatgagtcggctgaggagtcttgccagatcgtccctttcgagaacgattgtatggaggactttgtgactagcctcaccggaagtccctacgagttcttcccaacagagtctacttctttctgctctgaaagctgctcgcctctctccgaatccgccaagggcctggagtccgagcaggctccaaagctagggctgagagctgaagagaacccaatggtgggggctttgtgtggccagtgtggttctttgcagggaggggcggcggagggccccgctgcccctgacgtcgtggttgtccttgaagaagaggctctggatgacgccctcgctaatccctacgtgatgggggttggattacctgggcaagcagcgcctggtgagggtggccaggccgcgtctgatgcactcggcggttacggaagcaaagaggaactcaactgtgaagcagagggcggactggtccccgccgaccggaaaaatacatccacccgtgtgcgtccccactcaggcaaggtggccggctatgtccccgagaccgtgcctgaagagacaggccccgaggcgggatcaagtgcgccggggatcggaggtgcagcagaagaagtcggcaagaccctcttgagtctggagggcaaacctctggaggcttccagagctctgccagccaaaccacgggcatttactttgtaccctcgttctttttcagttgagggacgggagattcccgtgagcgtctaccaggagccggaggggagcggactggacgatcacagaatcaaaaggaaagaggacaatctatcactaagctgcgtaatcggctcatcggggtctttcagccagcggaaccatcttcctagctcggggacctcaactccgtcctcaatggtggacatcccccctcccttcgacttagcttgtattacaaagaaacctattaccaagagttctccttcactactgattgagtcagactcaccagacaagtacaagaaaaagaagtcctcctttaagaggttcctcgcactaacttttaaaaagaaaaccgaaaataaattacacgtcgacgttaacgtctcttcctctaggtcctcttctgagagctcttaccacgggccctcgcggattttggaggtggatcggcgctccttgagcaatagtccacagctgaagtcccgcacggggaaactcagagcaagcgagtccccctcttcgctgatattttacagggacggcaagaggaagggagttccattctctaggacggtatcgcgcgtcgagtcctttgaagaccgctcacgcccacccttcctgccgctccccctgaccaagccaagatctatctccttcccatcagccgacacttcagattatgaaaatatccctgcaatgaacagtgattatgagaatatacagatccctccgagacgtccagcacgggccggggcctttaccaagttgttcgaggatcagagcagggccctgtcaaccgctaatgagaatgacggctacgtcgacatgtcttcttttaacgcatttgaaagcaagcagcagtctgcagatcaggacgcagagtcagcctacacggaaccctacaaggtctgcccaatcagctccgctgctcctaaagaagaccttacaagcgacgaggagcaacgctcttccgaagaagaggactcagctagccgcgatccctctgtaacacacaaggtggaaggtcagtctcgggccttagttatcgcccaggagctgctgtcctctgagaaggcttacgttgaaatgctccagcatttaaacctcgactttcatggagccgtgatgcgcgcgctggacgatatggatcacgaaggcagggacacactggccagagaagaactgcggcagggtctcagtgagctaccggcaattcacgatttacaccagggaatacttgaggagctggaggagcgactgtcaaactgggagagtcagcaaaaagtggcggacgtctttctcgccagagaacagggcttcgatcaccatgcgacgcacattctgcagtttgacagatatttaggcctcttatccgaaaactgcttgcactcaccacggctcgcggccgctgtcagggaattcgagcaatctgtccagggcggcagccaaaccgccaaacatcgtctattgcgggtggttcaacggctgtttcagtaccaggtgttgctgactgactacctgaataatctgtgccctgattccgccgaatatgataatacccagggcgctctgtccctgatttcaaaagtgacggatcgggccaatgattctatggagcaaggcgagaaccttcagaagttagtacatatagaacattcagtccgcggccagggagatctgcttcaaccaggacgtgaattcctcaaagaaggtactttaatgaaagtgactggcaaaaaccgtcgtccaaggcacctcttcctgatgaatgacgtgctcctctatacctatccccaaaaggatgggaagtatcgtctgaaaaacactttggcagtcgccaacatgaaagtatctcgccctgtgatggagaaggttccctatgccttgaagattgagactagcgaaagctgtttgatgctgagtgcctcttcctgtgctgagagagatgaatggtacggctgcctgagtcgagcactgcctgaagactacaaagcgcaggccctagcagccttccatcactctgtggaaatccgggagcggcttggcgtatctctgggcgagcgccctcccactcttgtgccagttacccacgtcatgatgtgtatgaactgcgggtgtgactttagtctcaccctgagaagacaccactgtcatgcctgcgggaaaatcgtttgccgcaattgtagtaggaacaagtatcccctgaaatacctaaaggacagaatggctaaggtgtgtgacgggtgcttcggtgagttgaaaaaaagaggtcgcgcagtccccggtctcatgcgcgaaaggcccgtgagcatgtcattcccgctgtcatctcccaggttctccggcagcgcttttagttctgtgtttcagtcaatcaatccttcaacatttaagaagcagaaaaaagtgccaagtgctctcacggaagataaagtggccctcgagagcatgcctttacttggcttcaccatcgccccagagaaggaggagggaagtagtgaggtgggaccgatattccatctataccacaagaagacactgttttattcctttaaggctgaagatactaatagtgcccagaggtggatcgaggctatggaggatgcctctgtgctgtag

SEQ ID NO: 47759 - DNA, 24 bp, Artificial Sequence
  Description of Artificial Sequence: Synthetic coding sequence
tgagagaagcagagccagtgctag

SEQ ID NO: 47760 - DNA, 354 bp, Artificial Sequence
  Description of Artificial Sequence: Synthetic coding sequence
atgagctggcggggccggagcacctactactggccccggccccggaggtacgtgcagcctccagaaatgattggaccgatgagaccagaacagttctccgatgaggtcgagccagcgacacctgaggagggcgagcccgccacccagtgccaagaccccgccgcagcacaggaaggcgaagatgaaggagcttcagctggacaaggtcctaagccggaagcgcactcacaggaacaaggtcacccacaaaccggatgtgaatgtgaagatgggccagatggacaggaaatggaccctcctaatcctgaggaagtaaagacacctgaagagggtgagaagcagagccagtgttag

SEQ ID NO: 47761 - DNA, 354 bp, Artificial Sequence
  Description of Artificial Sequence: Synthetic coding sequence
atgagctggcggggccggagcacctactactggccccggccccggcgctacgttcagccacccgagatgatcggcccaatgcggccggagcaattctctgacgaggtcgagccagcaacacccgaggagggagagcctgccactcagtgccaggatcctgccgcagcccaagaaggcgaagacgagggggcatccgcaggccaaggcccaaagcctgaggctcactcccaggagcaggggcacccccagacaggatgcgagtgcgaagacgggccagacggacaggagatggacccgccaaatccagaagaggtgaagactccggaagagggtgaaaaacagagtcaatgctag

SEQ ID NO: 47762 - DNA, 354 bp, Artificial Sequence
  Description of Artificial Sequence: Synthetic coding sequence
atgagctggcggggccggagcacctactactggccccggccccggagatacgtgcagccaccggaaatgatcggccccatgcggccagagcagttttctgatgaagtggagccagccaccccagaagagggcgaacctgctacacaaagacaggatccagctgctgctcaagaaggtgaagacgaaggcgcaagtgcgggtcagggccctaaaccagaggcacactcacaagagcagggccatccacagaccggctgcgaatgtgaagatggcccagacggccaggaaatggacccccccaaccctgaggaagtgaagactcctgaggagggcgagaagcagagccagtgctag

SEQ ID NO: 47763 - DNA, 354 bp, Artificial Sequence
  Description of Artificial Sequence: Synthetic coding sequence
atgagctggcggggccggagcacctactactggccccggccccggagatacgtccaaccccccgaaatgatcgggcccatgcgccctgagcagttcagcgacgaagttgaacccgcaactcccgaggagggggagccagctacccagcgacaagaccctgcagcggctcaagaaggggaagacgagggggcgtctgccgggcaggggcctaagcccgaagctcattcccaggaacaggggcacccgcaaacggggtgcgaatgcgaagacggccccgacggtcaagagatggatcctcctaatcctgaggaggtgaaaacccctgaggagggagaaaagcagtcccagtgctag

SEQ ID NO: 47764 - DNA, 354 bp, Artificial Sequence
  Description of Artificial Sequence: Synthetic coding sequence
atgagctggcggggccggagcacctactactggccccggccccggaggtacgtgcaaccaccagaaatgatcggccccatgagacccgaacagttcagcgacgaagtggagcccgccacacctgaagagggtgagcccgccacccaacgccaggatcctgccgcagcccaggagggtgaagatgagggcgcctcagcaggccagggcccaaagcccgaagcccactcccaggaacaggggcacccccagaccggttgtgaatgtgaagacgggccagacggacaggaaatggacccgcctaatcccgaggaagtaaagacacctgaagagggtgagaagcagagccagtgttag

SEQ ID NO: 47765 - DNA, 354 bp, Artificial Sequence
  Description of Artificial Sequence: Synthetic coding sequence
atgagctggcggggccggagcacctactactggccccggccccggaggtacgtgcagccacccgagatgattggacctatgaggccggaacagttctcagatgaggttgaaccagcgacccctgaggagggcgagccagctactcagcgccaggaccctgctgcggcccaagaaggggaggacgagggagccagcgcaggccaaggtccaaagcctgaggcagacagccaggagcagggacaccctcagacagggtgtgaatgcgaagacggacccgatggacaggaaatggacccgcctaacccagaagaggtcaagacaccagaggagggagaaggccagtctcagtgttag

SEQ ID NO: 47766 - DNA, 1131 bp, Artificial Sequence
  Description of Artificial Sequence: Synthetic coding sequence
atgttcggcgccgccggccggcagcccatcggcgcccccgccgccggcaattcctggcacttctcgcggaccatggaggaacttgttcacgatctggtgtccgcacttgaagaaagttcagagcaggcaaggggcggattcgctgagaccggagatcacagtcgctccatcagctgccctttgaagcgccaggcgcggaagcgcagaggtaggaagagacgctcatataatgtgcatcatccatgggaaacaggtcactgcctaagtgagggctcagattcctcgcttgaggagccttccaaagactaccgagagaaccacaataataacaagaaagatcacagcgatagtgacgaccagatgctggtggctaagcgaaggccatcttccaatctgaataataacgtgcgtggaaagagacccctgtggcacgaatcagactttgccgtggacaacgttgggaaccgaacacttagacgtcggcgcaaggtgaaacgcatggcagtagacttacctcaggacatttctaacaaacgaacgatgacccagccacctgaggggtgcagggatcaggacatggattccgatagggcctatcagtatcaggagtttacgaaaaacaaagtcaaaaagaggaagctgaagatcatcagacaagggcctaagatccaggatgaaggggtggtactggagtccgaggagaccaatcaaaccaataaagataagatggaatgtgaggaacagaaggtttcagatgaacttatgtcagaaagtgattcgagtagcctatcttctaccgacgcaggcctatttacaaacgatgaaggcagacaaggcgatgatgagcaaagcgattggttctacgagaaagaatcgggtggcgcatgcggcatcaccggggttgtgccatggtgggagaaagaggatccaaccgaattggacaaaaacgttccagatccggtgtttgagagcatcctgaccggatccttccccctgatgagtcatccatctaggaggggcttccaagctagactgagcaggctgcacggcatgtcaagtaagaacatcaaaaaatcaggagggacacctaccagtatggcgaccaattggacatccgaaattcccctttag

SEQ ID NO: 47767 - DNA, 1587 bp, Artificial Sequence
  Description of Artificial Sequence: Synthetic coding sequence
atgttcggcgccgccggccggcagcccatcggcgcccccgccgccggcaattcctggcattttagccgtaccatggaggaactggtccatgaccttgtctccgcccttgaagagagctcagagcaagcccggggcggctttgctgagactggggaccactcacggagcattagctgtcctttaaaaagacaggcaaggaagcgccgtggtcggaagaggcgctcctataacgtgcatcacccatgggagacagggcattgcttgagtgaaggaagcgattcctctctggaagagccgtcaaaggactaccgcgagaatcataataacaataagaaggaccatagtgactcagatgatcagatgcttgtggcgaagcgccgtccctcgtctaacctgaataataatgtcaggggcaagagacccctatggcatgagtctgacttcgccgtcgacaacgttgggaatcgaaccttacgacgccgacggaaggtcaagaggatggctgtagacttgccccaggatatttcaaacaaaagaactatgacccagcctcctgaaggctgcagggatcaggatatggactcagatcgagcgtaccagtatcaggagttcactaagaataaggttaagaagcggaagctcaagatcataagacaagggcccaaaatccaagacgagggggtagtactcgagtccgaggaaacgaatcagacaaacaaagataagatggagtgcgaagagcaaaaagtgagcgatgagttgatgtcagagagcgattcctcttctttgtcttcaacagatgcgggcctgttcaccaacgatgagggacgccagggagatgatgagcagagcgactggttctacgagaaggaaagcggcggagcgtgcggcattacaggcgttgtgccatggtgggagaaagaagacccaacggaactcgataagaacgtgccagaccctgtgttcgaatccatcctgaccggctcattccctctcatgtcacatcccagcagaagggggtttcaagcacgcctcagccggctgcatggtatgtctagcaagaacatcaagaagtctggtggcacccccacttccatggttcctatccctggtcctgttggtaacaagcgtatggtgcacttttcacccgacagccatcaccatgaccactggtttagccctggggcacggaccgagcacgatcagcatcaacttctgcgtgataatcgggcagagaggggccacaaaaaaaattgcagcgtgcggactgcatcacggcagacaagtatgcatctgggaagcctgtgcacaggagacattaaacgccggagaaaggcggccccattgccagggccaaccactgccgggtttgtgggggaaaatgctcagcccattctggagaataatattggcaatcgcatgctgcagaatatgggctggactccaggctcaggccttgggcgagacggaaaaggcatctccgagcctatccaagccatgcaaagacctaagggcctgggcttgggcttcccactgccaaaaagtacaagcgctactacgactcccaatgcaggaaagtctgcatag

SEQ ID NO: 47768 - DNA, 1578 bp, Artificial Sequence
  Description of Artificial Sequence: Synthetic coding sequence
atggccgtgcccggcgaggccgaggaggaggccaccgtgtacctggtggtgagcgggattccaagtgttctaagaagtgctcacttacggtcctatttctctcagttcagggaggagaggggcggaggattcctgtgttttcattacaggcacaggcctgaaagagccccaccccaggccgcaccaaactcagccctgattcctacagaccctgcagcagaagggcaactactgtcccaaacttcagctaccgatgtgcgccccctgtccacacgagattctacacccatccagaccagaacctgttgctgtgtcataagtgtgcgagggcttgcacaggcccagagactgatccggatgtacagcggtaggagatggttggattctcacggtacttggcttcccggccggtgtttgatacgtaggttgcgcctgcccacagaggcctctggtttaggttctttcccttttaagaccagaaaagagctacagtcctggaaggcggaaaacgaggctttcacattagcagacttaaagcaactccctgaactcaacccacccgttctgatgcctagggggaatgtgggaactcccttaagagtattcctggagctcatccgcgcctgtcgcttgccccctagaattatcacacagttacaactgcagttccctaagaccggttccagtaggcgctacggcaacgttccttttgagtacgaagatagcgaaacagtggagcaagaagagcttgtctatacagctgagggtgaggaaattccccagggtacatatctggcggatatccctgcttccccctgcggggaaccagaggaagaggtggggaaagaagaggaggaggagagccactcagatgaggacgacgacaggggcgaggagtgggaacgccatgaggccctccacgaggacgtaacaggccaagaaaggacaacagaacaattgtttgaagaggagatcgagctgaagtgggaaaagggtggtagcggcttggtgttctacacggacgcccaattctggcaggaggaggagggggacttcgatgagcaaacagctgacgattgggatgtggacatgtctgtgtactatgaccgggatggcggggataaagatgccagagattccgttcagatgaggttagagcaacgcctgagggatggccaagaggatggatccgttatagagcgtcaggtggggacctttgaacgccacacgaagggcatcggcaggaaggtgatggagcggcaagggtgggccgaggggcagggactcggctgccggtgctccggcgtcccagaagcgcttgattctgacggccagcacccgcggtgcaaaagagggctgggataccacggcgagaagttacagcccttcgggcagctcaagcgaccccggagaaatgggctggggttgataagcactatatatgacgagcccttaccccaagaccaaacagaatctctgctgagacgacagcctcctacatccatgaaatttaggacagacatggcctttgtacgcgggagcagctgcgccagcgacagccccagcttacccgattag

SEQ ID NO: 47769 - DNA, 714 bp, Artificial Sequence
  Description of Artificial Sequence: Synthetic coding sequence
atgccccggggcaacgtgggcacccccctgcgggtgttcctggagctgatccgggcctgtaggttgccacctcgaatcatcactcagctgcagctgcagttcccaaagaccgggagcagtagaaggtacggtaacgtaccctttgaatacgaggactcagagaccgtggaacaggaagagcttgtgtataccgctgagggcgaagaaatccctcagggtacgtacctcgccgacattccagcatccccctgtggggagcccgaggaagaagtcgggaaagaagaagaggaagaaagccactccgacgaggatgacgataggggtgaggaatgggagaggcatgaggctcttcacgaggacgtgacaggccaggagcgaacaactgagcaactcttcgaggaggagatcgaattaaaatgggagaaaggcggatccggcttagttttttatactgatgcccagttttggcaggaggaggaaggggatttcgatgagcagacggcggacgattgggatgtcgacatgtctgtgtactacgatagagacgggggtgataaagacgcacgggactctgtgcagatgagactagaacagaggctgcgggatggccaagaagatggttctgtgatcgagcggcaggtagggacattcgaaaggcatacaaaggggatctttaccaagagtcctcttcccagtcccccactgggatactag

SEQ ID NO: 47770 - DNA, 231 bp, Artificial Sequence
  Description of Artificial Sequence: Synthetic coding sequence
tgattcgacgagcagaccgccgacgactgggacgtggacatgagcgtttattacgacagggatggcggcgacaaggatgctcgtgacagcgtacaaatgcgacttgaacagagattacgcgatggccaggaggacggttctgtgattgagcgacaggtgggcacatttgaacggcacactaaaggcatcttcaccaaaagcccgctgccatcgcccccattaggctactag

SEQ ID NO: 47771 - DNA, 387 bp, Artificial Sequence
  Description of Artificial Sequence: Synthetic coding sequence
atgcggctggagcagcggctgcgggacggccaggaggacggcagcgtgattgagaggcaagtaggtacctttgagaggcatacgaaaggcatcggcagaaaggtaatggagcggcaaggatgggccgaggggcagggcttggggtgtagatgtagcggcgttcctgaggccctagacagtgacggacaacaccctaggtgtaagcggggcctgggatatcacggggaaaagctgcagccattcggccagctcaaaaggccgagaaggaacggactcggtctgatctccacgatttatgacgaacctctgccccaagatcaaactgagagcctgctccggcgtcagcccccaacttcaatgaaattccgcacggacatggctttctag

SEQ ID NO: 47772 - DNA, 1524 bp, Artificial Sequence
  Description of Artificial Sequence: Synthetic coding sequence
atggccgtgcccggcgaggccgaggaggaggccaccgtgtacctggtcgtgtccggtatccccagtgtcttacgctccgcccacctgcgttcttacttttctcaattccgcgaagaacgcggaggtgggttcctctgctttcattatcggcaccgtcccgaacgggcgcctccccaggcagcaccaaacagtgctctaattcctactgatcccgccgctgagggtcagttgctgtcccaaacttccgccacagatgtaaggccactgtccacccgggactcaaccccaattcaaacacggacatgctgctgtgttatctccgttaggggccttgctcaggcccagcgcctgattcgaatgtactccgggcgacgctggctggatagtcatggtacatggctccctgggagatgccttatcagacggttgcgactgcctaccgaggcctccggtctcggatcttttccctttaagactaggaaagaactgccagagctgaatccccccgtgctcatgccaagaggcaacgtgggaactcccctgcgggtgttcctagagctgattcgcgcatgccgactcccccccagaataatcacacagctgcaactacagtttcccaagacaggttcctctaggcgttacggaaatgtgccattcgagtacgaagattctgagactgtggaacaagaggagctggtgtatacagccgagggcgaggaaattcctcagggcacctatctggcagacattccagcctcgccctgcggcgagcccgaagaagaagtgggaaaagaggaggaagaagagtcacacagcgatgaggatgacgatcggggggaggaatgggagcgccatgaggcattgcatgaagatgtaaccggccaggagcggacaactgaacaactgtttgaagaggagattgagttgaagtgggaaaagggaggcagtgggctggtgttctacaccgatgctcagttctggcaggaggaggaaggagatttcgatgagcagacagccgacgattgggacgtagatatgtccgtatactacgacagagatggaggcgataaagacgcacgcgacagtgtgcagatgcggctcgagcagaggctgcgcgacggccaggaggacggaagcgtaatcgagaggcaagtggggaccttcgagagacataccaaaggtatcgggcggaaagtcatggaacgccagggctgggccgaaggccagggcttgggctgcagatgctcaggtgtgcccgaggctctcgacagtgacggtcaacacccaaggtgcaaacgcggactgggatatcatggtgagaagctacagccctttggccagctaaagcgccctaggcgtaacggcttggggctgatcagtaccatatatgatgagcccctccctcaagatcagaccgagagcctgctgagaaggcagcctcctactagcatgaaattcaggactgatatggccttcgttagaggctcgagctgtgcgagcgatagcccctcgttgcccgactag

SEQ ID NO: 47773 - DNA, 420 bp, Artificial Sequence
  Description of Artificial Sequence: Synthetic coding sequence
atggacggcctgaaggtgggccacgaccccgccaaggagttcaccaatcactggtggaatgaactattcaacaagactgctgccaatcttgttgtagagaccggacaggatggagtgcagattaggagtttgtccaaggagaccacgagatacaaccaccctaagcccaatctgctctatcaaaagtttgtcaaggtgttggaggccgtcggtaatagggtccatccattcagcctaccctggttcccttgggggctaaattcatgtctggtttgtctgattaacagtcagaacttccctaatattgtcggctcctgcgatcagccatgttgttgcctgctccgtctaccgcgtccatccgccgggatagaaatctttcggttcagggggagttgtcacctgctgcgggaacagcaatag

SEQ ID NO: 47774 - DNA, 1338 bp, Artificial Sequence
  Description of Artificial Sequence: Synthetic coding sequence
atgaacgtgacccccgaggtgaagagccggggcatgaagttcgccgaagagcagttactgaaacatggctggactcagggcaaaggcctgggacggaaggagaacggcatcacccaggcgctgagagttaccctgaagcaggacacccatggggtgggccatgatccagccaaggaattcaccaatcactggtggaatgaactctttaacaagactgccgccaatctcgtagttgagacagggcaggatggggtccagatcagatcactctctaaagagacgacgcgctacaaccacccgaagccaaacctgctctaccagaagtttgtgaagatggcgacactgacatccggcggcgagaaaccgaataaggacttagagagctgcagtgatgacgacaaccaaggttccaaatctccgaagatcctgacagacgaaatgctgcttcaagcgtgcgaaggaagaactgcacacaaagcggccaggctgggcatcacaatgaaggcaaagctcgctagactagaagcccaggagcaagcttttcttgcccgcctcaaagggcaagatcccggggctccccaactacagtcggagagcaagccacccaagaaaaaaaaaaaaaagcgaaggcagaaagaggaggaggaagccaccgcctccgagcggaacgacgccgacgaaaaacatcctgaacacgcagagcaaaatatccgaaagtcaaagaaaaagaagcggagacaccaagaaggcaaagttagtgacgaacgagaaggcacaaccaagggcaacgaaaaggaggacgctgccggaacaagtggtctcggcgagctcaatagccgggaacagaccaaccaaagtctgagaaagggaaaaaaaaagaagagatggcatcatgaggaggagaaaatgggtgtcctcgaggaaggggggaagggcaaagaggccgctgggagcgtccgaaccgaggaggttgaatcgcgggcctatgctgacccctgtagccgcagaaaaaagcgacaacaacaggaggaggaggacctcaacctggaagatcggggagaagagaccctcggaggagggacccgggaggcggagtctagggcgtgtagcgatggcaggtccagaaaaagtaaaaaaaagaggcagcagcaccaggaggaagaagatattcttgacgtccgagacgagaaagatggaggagccagagaggctgagtccagagcgcacacagggagttcaagcaggggcaagaggaagcggcagcagcatcctaagaaagaacgggctggagtttcaacagtccagaaagctaagaagaagcagaaaaaacgcgactag

SEQ ID NO: 47775 - DNA, 1113 bp, Artificial Sequence
  Description of Artificial Sequence: Synthetic coding sequence
atgaacgtgacccccgaggtgaagagccggggcatgaagttcgccgaggagcagctgttgaaacatggctggacacagggtaaagggcttggacgaaaggaaaacggaattacccaagcattacgggtcaccctgaagcaagatacgcatggcgtggggcatgaccctgccaaagaatttactaaccactggtggaacgagcttttcaataaaaccgctgccaacctggtggtcgagaccggccaggacggcgtgcagataaggagtctgtctaaagagactaccagatacaatcaccccaaacctaacctgctatatcagaaattcgtcaagatggccacgctgacttctgggggggaaaagcctaataaagaccttgagtcatgcagtgacgatgacaatcagggctccaagagccctaaaatacttactgatgagatgctgctccaggcctgtgagggtcgaactgcccacaaggctgcccggctgggtatcactatgaaagccaagttagctaggctggaggcgcaggagcaggccttcctcgcgcggctgaagggccaggacccaggggccccacagcttcagtccgagagcaaaccccctaagaagaagaagaaaaaacggcggcagaaggaggaggaggaggccaccgctagtgaacgcaacgacgctgacgagaaacatcccgagcacgctgagcaaaacattagaaaatccaaaaagaaaaagcggcggcaccaggaagggaaagtgagcgacgagagagaggggaccactaaaggaaatgagaaggaagacgcggccggtaccagtggattgggcgaactcaacagccgcgaacagaccaatcagagcttacggaaggggaaaaagaaaaaacgatggcatcacgaggaagagaaaatgggcgtgctggaggagggcggtaagggaaaggaggcggccggaagcgtgcggacagaggaagtggagtcaagggcctatgctgacccgtgttcaaggagaaagaaaagacagcagcaggaggaagaagacctgaatctggaagaccggggtgaggaaactttccgttggtggaatcaaggctcccgagagcagagtatgcaatag

SEQ ID NO: 47776 - DNA, 1128 bp, Artificial Sequence
  Description of Artificial Sequence: Synthetic coding sequence
atgttcccccggagcggccccagcaacgacgaggtgaagagccggggcatgaagtttgccgaggagcaactgcttaaacatggctggacccaaggaaaggggttgggaaggaaggaaaacggcattacccaggctctgagggtgactcttaagcaggacacgcacggcgtgggccacgatcctgccaaagagttcacgaatcattggtggaatgagctctttaacaagactgccgctaacctcgtggttgagactgggcaagatggggtgcagatccgttccttgtccaaagaaaccacaagatacaaccatcctaagcccaacttgctctatcagaagtttgtgaagatggccaccctgacctcaggaggcgaaaagcctaataaagacttggagagctgcagcgatgacgacaatcaggggagcaaatccccgaagatcctgacagacgaaatgctgctgcaggcctgcgaaggacgcacagctcataaagccgcacggctcggtataacaatgaaagccaaactggccaggcttgaggcacaggagcaggcttttctggcccgacttaaaggacaggatcccggggcacctcagctgcaaagcgagtcaaaaccacccaagaagaagaaaaagaagcgaagacaaaaggaagaggaagaagctaccgctagtgagcgaaacgacgccgacgagaaacatcctgagcacgctgagcaaaacattagaaagagcaagaaaaagaagcgccggcaccaagaggggaaagtttctgacgaaagggagggaacaactaagggcaatgagaaagaggacgccgccggtacaagcggcctgggcgaattaaacagcagagagcagaccaaccagtcgctcagaaagggcaaaaagaaaaagcgttggcatcacgaggaggaaaaaatgggcgtattagaagaggggggtaaagggaaagaggcggccgggagcgtcaggacagaggaggtggaatctcgcgcctatgctgatccttgctcccgccgcaagaagagacagcaacaagaggaggaggatctgaacctcgaggaccgcggtgaagaaaccttcaggtggtggaaccagggtagccgcgaacagagcatgcagtag

SEQ ID NO: 47777 - DNA, 1218 bp, Artificial Sequence
  Description of Artificial Sequence: Synthetic coding sequence
tgaagcctggtgctgggcgtgatcacctgcgcccccgagcggctgaatttcccagcctccgcgtgtgccctgaagagagccgcctggttgctcaggggaagaggtgtgtttcacaacggcttgaagatctgtgagaaattcgggcccaatctagatacatgcccggaaggcactattttaggacttagattggacagctccggtggattacacctccacgtgaacggagttgatcaaggcgtcgctgtgcctgacgtgcctcagccgtgccatgctttggtagacctgtacgggcaatgtgagcaggtgaccatcgtcaatcctgagccgggggcggcttccggaaaaagcgctgggactcagggagacatggaaaaagcagatatggtggatggcatcaaagagtccgtttgttggggtcccccaccagccgccagccctctgaaaagctgtgagtaccacgccctttgttctaggtttcaagaattgctcctgctcccggaggactatttcatgcctcccccaaaaaggagcttatgctactgcgaatcctgcaggaagctgaggggcgatgaagcacaccggcgcagaggcgagcccccacgtgagtacgctctccccttcggctggtgccggtttaatctccgcgtcaatccccgtctggaggcaggcaccctgacgaaaaaatggcacatggcctaccacggcagcaacgtggccgctgtgaggcgcgtgctcgatcgcggagaactgggggcgggaaccgcatctatcctgagttgtcgaccgctgaaaggtgaaccaggggtaggcttcgaggaacccggcgaaaactgtgcccccccacgggaggaacagcctccgcctgtgttgcttagtcctagtcttcagtatgccggcgccgaaaccctcgcttccaaagtccagttccgagatccaaagagccagcggacccatcaggctcaggtggcatttcaacgttcccttagtctttgccctcacgaagctgcattctctggggcgactgggagagaatggggcagggtaggggctagaaaaatgggggctagcgtccagctgttactcactctgatcagcaaggagcccattaataccgtttccgaaccccctccacgaccactgagtcgcgccccgctcagcggcgctcgcgtgccctggggagcgacccgatgggccagggaaataaaggagagctag

SEQ ID NO: 47778 - DNA, 1377 bp, Artificial Sequence
  Description of Artificial Sequence: Synthetic coding sequence
atgagcagcagccggcccgagcccggcccctgggcccccctgagccctaggctacagccattaagccagagttcctcctcactgctcggagagggacgcgagcaacgcccggagctgcgtaagactgcctcctccacggtgtggcaggcccagttaggagaggcttccaccaggccgcaagctccagaggaagaaggaaaccccccggagagcatgaagccagctcgggcctctggccctaaggcccgcccaagtgccggcggccattggtggtcttccaccgtcgggaatgttagtactatggggggtagcgacctatgtcggcttcgggctccatccgccgcagctatgcagcggagccacagcgaccttgtgcggagcactcaaatgcggggccattctggggctcggaaagccagtctctcctgttctgcattaggatcctcccctgtgcatcgagcacagctacagccagggggaacaagcggacagggcggccaagcccccgccggactcgaacgggacctggccccagaggatgaaacctccaactctgcctggatgctgggagctagtcagctctccgtgcctcctttagatctcggagacaccactgcccactccagttcggcacaagccgagccgaaagcagccgaacagttagccacgacaacatgtcacgcccttcctccagccgctcttctttgcggcatgcgggaggtcagagccggagggtgttgtcatgcattgcccgcgactgggattctggccttcccaaagctcgtcgcctccgtatcggaatctggactgcaggctcagcacggcgttaaaattcactgcagactctcaggcggtttgccaggccacagccattgctgcgctcacctctggggtccagcaggcctggtacccgagcctgggtcaagaactaaggacgtgtggactatgaccagtgctaatgatctcgccccagccgaagcttcacccctgtctgctcaagacgctggcgttcaggccgcgccagtagccgcatgtaaagcagtggcaacaagcccctcactcgaggcgcccgcagcccttcatgtgttccccgaagtgactctggggagcagtctggaagaggtcccgtctcctgttagggacgtcaggtgggacgctgagggaatgacatgggaggtctatggagccgccgtggaccttgaagtgcttggggtagccatacagaaacacctggagatgcagttcgagcagctccagcgtgccccagccagcgaggattccctttcagtggaaggccgtcggggtcctctgcgcgccgtgatgcaaagcttgcggagaccttcttgctgcggctgtagtggggctgcacccgagtag

SEQ ID NO: 47779 - DNA, 1377 bp, Artificial Sequence
  Description of Artificial Sequence: Synthetic coding sequence
atgagcagcagccggcccgagcccggcccctgggcccccctgagcccccgactccagcctctgtcccagtctagcagtagtctcctaggcgaaggtcgggagcagagacccgaactccgaaagaccgcttcaagtacagtctggcaggcacaactcggagaggctagtactcggcctcaggcgcctgaggaggaaggcaatcccccagagtcaatgaaacccgcacgtgcgtccggcccaaaggcaaggccctcagctggcggacattggtggtccagtaccgtaggtaatgtaagtaccatgggaggctcagatctgtgccgactgagggctccctctgccgcagctatgcaacgctcccattctgacctagtgcgcagcacacagatgcgaggtcactctggcgccagaaaagcctcgcttagttgctccgctctcggaagctcaccagtccaccgagcccaactccagcctggtgggacgtcaggtcagggcggccaagcccccgcaggcttggaacgcgacctggcccccgaggatgagactagcaattctgcctggatgctgggcgcttcacagctctccgtgccccctcttgacttgggggatacaactgctcacagctcctccgcccaggccgagccaaaagctgccgagcaactggccaccaccacatgccacgcgctgccccctgccgctcttctctgtgggatgagagaggtgcgtgccggaggatgctgccatgcattgcccgcaactggcatactggcctttccaaagttagtcgcatctgtgagcgagtccggcctgcaggcccaacatggggtgaaaatccactgtcggctgtcgggcggactgccagggcacagccactgctgcgcccatctttggggtccagccggcctggttcctgagcccgggagcaggacgaaagatgtgtggactatgacctccgcgaatgacttggctccggccgaggcttcacctcttagcgcacaggatgctggagttcaggcagctccagtggcagcatgcaaggcagtcgctacatccccctctctagaagctccagctgcgttacacgtattccccgaagtgacgctgggcagtagcttggaagaggtcccttcccccgtccgagatgtacgctgggacgctgagggcatgacgtgggaagtgtacggggctgcagttgatctggaagtgctcggcgtggccattcagaagcaccttgaaatgcaatttgagcagttgcagcgagccccagcatccgaggatagtttgagcgtagaggggcggcgagggccactgcgcgccgtcatgcagtcacttaggcgccctagttgttgcggctgttcaggtgctgcacctgagtag

SEQ ID NO: 47780 - DNA, 1377 bp, Artificial Sequence
  Description of Artificial Sequence: Synthetic coding sequence
atgagcagcagccggcccgagcccggcccctgggcccccctgagccctcgcctgcaacccttgagccagtcttcttcctcgctcctgggagaaggtcgggagcagcgacccgaattacggaaaacggcctcaagtactgtgtggcaggctcaattgggagaagcgtcaacgcgacctcaggcccctgaggaggagggcaacccgcccgaaagcatgaagccagctcgggcctcaggcccgaaggcacgtccttctgccggtgggcattggtggagctcaacggtgggaaacgtgtctaccatgggcggcagtgacctctgcagactccgcgcaccgagcgctgcggctatgcaaaggtcgcacagtgacctggtgcggtccacacagatgcgcgggcattccggcgctaggaaagcctcactatcttgttctgcgctgggaagctcccctgtacaccgagcgcagttacagcctgggggtacatctggccagggcggacaggcacccgccggcttggagagggacctggcccctgaggatgagaccagtaactccgcgtggatgctgggtgcctcccagttgagcgtgccaccactagacttaggtgacacaacagcacactctagtagcgcccaagcagaacctaaagcagccgagcaactggccacgacaacatgccatgccctgccgcctgccgccttgctctgcgggatgagagaggtgcgagccggtgggtgttgtcacgccctccccgccacgggaattctagctttcccaaaactggtggccagtgtcagcgagtcagggttacaggcccagcatggtgtcaagatccactgtcgcctgtctggtggtctgccaggccactcgcactgctgtgcacatctgtggggtcccgcaggtcttgtcccagaaccgggctcaagaactaaggacgtctggaccatgacatcggctaatgatctggccccagctgaggcgtcccctctctctgcgcaagatgctggtgttcaagctgctccggtggccgcttgcaaggcagttgctacaagtcctagtttggaggctccggctgcgctgcatgttttccctgaagtgactctgggaagctctctcgaagaggtaccttcgccagtcagggatgtgcgctgggatgccgaaggcatgacctgggaagtttatggcgcagccgtagacctggaagtgcttggtgttgcaattcagaaacacctggagatgcaattcgagcagctccagagagctcccgcaagcgaagattccttgtccgtagagggccgccgaggccccctccgggccgtaatgcagtctctacgcaggccatcctgctgcggctgtagcggtgccgctcccgagtag

SEQ ID NO: 47781 - DNA, 1641 bp, Artificial Sequence
  Description of Artificial Sequence: Synthetic coding sequence
atggagctggagaacatcgtggccaacagcctgctgctgaaggccaggcaggagaaggactactcctctctgtgcgataagcagcctataggtagacgcctcttccgccagttttgtgacacgaagcctacgctcaaaaggcacatcgaatttttggatgcggtggctgagtatgaggtggcagacgatgaagacagaagtgactgcggactgagtattctggacagatttttcaacgacaaactggccgcccccttgcccgagattccccctgacgtcgtcacagaatgcagattagggttaaaagaagaaaacccatctaaaaaggcgttcgaagaatgcactcgggttgctcacaactatttgagaggcgagccttttgaagagtaccaagagagtagctatttctctcagttcctacagtggaagtggctggagcgccagcctgttactaagaacacttttaggcactatagggtgctggggaaaggcggctttggagaagtttgcgcttgtcaggttcgtgctacaggcaaaatgtacgcgtgcaaaaagctccagaagaagaggatcaagaagcggaaaggagaggctatggccctcaatgagaaacgcatattggaaaaggtgcagtcgcgtttcgttgtatctcttgcctacgcttatgagacgaaggatgcactgtgcttagtcttaacaattatgaatggcggggacctgaagttccatatctataacctgggcaatcctgggtttgacgagcagagggctgtattttatgccgctgaactgtgctgtggccttgaagatttacagagggagaggattgtataccgcgatctcaaacctgagaacattctcctggacgaccgaggtcacatacgaatatcagatctaggcttggccaccgagattcccgaagggcaaagagtgagggggagggtcggcactgtaggttacatggcacccgaggtggtgaacaatgaaaagtacacctttagtcccgactggtggggcctgggctgtctcatatatgaaatgatacaaggtcattctcctttcaaaaaatacaaagagaaggtgaagtgggaggaagttgatcagcgcatcaaaaacgatacagaagagtattcagagaaattttccgaggatgcaaaatccatctgtagaatgctgctgaccaaaaatccctcaaagagacttggatgtagaggggaaggcgcagccggcgttaagcagcaccccgtattcaaggatatcaacttccggcgtcttgaggcaaatatgctggagccccccttttgccccgaccctcatgccgtttattgcaaggacgtcttagatatcgagcagttcagtgtggtgaaggggatctatttagacacagctgacgaggacttttacgcccggttcgccacaggatgcgtatccataccgtggcagaatgaaatgatcgaatccgggtgttttaaagacatcaacaaaagtgagtctgaggaggcactaccactagatttggataaaaacattcacacgcctgtgtcccgccctaaccgcgggttcttttacagactttttcgacgaggtggctgcctgaccatggtgccctcagagaaagaggtggaaccaaagcagtgttag

SEQ ID NO: 47782 - DNA, 1503 bp, Artificial Sequence
  Description of Artificial Sequence: Synthetic coding sequence
atggagctggagaacatcgtggccaacagcctgctgctgaaggccaggcaggaaaaagactacagttctctttgcgacaagcagcccatcggccgcaggctgtttcggcagttttgcgatactaagcccactctgaagcgccacattgaattcctcgacgcggtggctgaatatgaggtcgccgatgatgaggacagaagtgactgcggtctatccattctcgaccgcttctttaacgacaaactggctgctccgttgccagagatcccacccgacgtggtgacagagtgcagattgggtctcaaggaggaaaacccatctaagaaggcctttgaggagtgcacacgagtggcacacaattacttgcgcggcgagccctttgaggagtaccaggaaagttcctacttcagtcagtttctgcaatggaaatggctcgagcgccagccggttactaaaaacacatttcgtcactacagagttctgggaaaaggtggatttggagaagtatgtgcgtgtcaggtccgtgccaccggaaaaatgtacgcatgtaagaaactgcaaaaaaagagaatcaagaagaggaaaggtgaagcgatggcattaaatgaaaagcggatcctggaaaaggttcaatctcggtttgtggtctcactcgcctacgcttatgagacaaaggacgccctctgcctggttctcactatcatgaacggcggtgacttgaaatttcatatttataacttaggaaatccaggattcgacgaacagcgggctgtattttatgcagccgagctgtgctgcggcctcgaggatctccagcgagagagaattgtgtaccgcgacttgaaaccggaaaacattctcttagacgacagagggcacataaggatatccgacctggggcttgcaaccgaaatacctgaaggacagagagtgagggggagagtgggcacggttggttatatggctcccgaggtcgttaataatgaaaagtatacattcagcccagactggtggggcctcggctgcctgatatatgagatgatccagggccattctccattcaaaaagtacaaagaaaaggttaaatgggaggaagtcgaccagcgtatcaagaacgatacggaggagtactcagagaaattctctgaggacgccaaatctatatgccgaatgctccttaccaaaaatcctagcaagaggctggggtgcaggggagaaggcgccgcgggagtgaagcagcacccagtcttcaaagatattaacttccgtaggctggaagcaaatatgcttgagccaccgttctgccctgacccccacgccgtatactgtaaagacgtgcttgacattgagcagttcagcgtcgtcaaaggtatatacctggatactgcagacgaagatttctatgcccggttcgccacgggatgtgtctccatcccttggcagaacgaaggctgccttaccatggtgccgtcagagaaagaggtggaacctaaacaatgttag

SEQ ID NO: 47783 - DNA, 405 bp, Artificial Sequence
  Description of Artificial Sequence: Synthetic coding sequence
atgcacggcggcggcggcgtgagcagctgcagcgccagcagcgtgtcttccgtgtcacaaaaccccccagccgccgccgctccagggcacggtgcgagggaacatcgcggtcagttggccgctgccgagtctgcatcctcccctctgcatcctgctactaaggcgagtgtgggacctgcccttcagcgcgagacccccacaattctttgcgccatcctgtgcctcggtccccatgtgtcgctcgcctgtgtgagccgcgagctggcaactgaaccgagaaccagcagcccatgtgcatctcacggttcttcaagtcatcctgttactctcaccgagctgctgatttctagcatcagcctccgggatggagcagccctgcttggactgtgttcgcggactgtctag

SEQ ID NO: 47784 - DNA, 1599 bp, Artificial Sequence
  Description of Artificial Sequence: Synthetic coding sequence
atggagctggagaacatcgtggccaacagcctgctgctgaaggcccggcagggcgggtatggcaaaaagtccggtaggtcaaagaaatggaaggaaatcctgaccctgcctccagtatctcagtgttccgaattgaggcatagtattgagaaagattattcctctttgtgcgacaagcagcctatcggccgtcggttgtttcggcagttttgtgatacaaagccgactctcaaacggcacattgagtttctggacgccgtggccgagtatgaagtcgccgacgatgaagaccgttcagattgtggactgagcatcctggacagattcttcaacgataaactggcagctcccctgcccgagatcccccccgatgttgtgacagaatgtcgcctgggactcaaggaggagaatccatcaaaaaaagcctttgaagaatgcactagagtggctcataactatctgagaggggagccgtttgaagaataccaagaatcatcttattttagccagttcctccagtggaagtggctggaacgacagccggttaccaagaatacattcaggcactaccgcgtgttgggtaagggcgggtttggcgaagtatgtgcatgtcaggtaagagctacaggaaagatgtatgcttgtaagaagcttcagaagaagagaataaaaaaacgcaaaggagaagcaatggctctgaacgagaagaggatcctcgaaaaagttcagagtcggttcgtggttagcttggcatatgcttatgagaccaaggacgcgctctgcttggtattgaccattatgaacgggggagaccttaagttccacatttataaccttggcaacccggggttcgatgaacagcgagccgtgttttatgccgcagaattgtgctgcggccttgaggacctgcaaagggagaggatcgtgtatcgagatctcaaacccgagaatatcctgctcgacgatcgtggccatattaggatcagcgacctggggctggcaaccgaaatccctgagggccaacgcgtgagaggaagagtggggaccgtgggatatatggcccccgaagtcgtgaacaatgaaaaatacaccttctcacccgactggtgggggttaggctgcctgatctacgaaatgattcagggccactctccatttaaaaaatataaggagaaggtgaaatgggaagaggtcgaccagaggataaagaacgacactgaggaatattctgagaagtttagtgaggacgcgaagtctatctgcagaatgctgcttactaagaatccctccaagagactgggctgtcggggcgagggcgcagctggggtaaagcaacacccggtgttcaaagatatcaattttcgacggctggaagcgaatatgctggaaccaccattttgtccagaccctcacgcagtctattgcaaggacgtgttagatatcgaacagttctcagtggttaagggcatctacctcgataccgccgacgaggatttctacgctcggttcgctaccggttgcgtttcaatcccctggcagaacgagggttgcctcacgatggtgccatcagagaaggaggtggagccaaaacagtgttag

SEQ ID NO: 47785 - DNA, 942 bp, Artificial Sequence
  Description of Artificial Sequence: Synthetic coding sequence
atgaagagcccccccctgctgagcccctgcctgagctggaagcggatggccgggatctttttccttcccttcatcagttctggcttcgccccgagattcaagcaggaagaaaacttcatgttggggagagcacatccctcacagccacggttcaattggtctcatcttacacctctggagctgaaaaaccgcagtgtaggactggggacagagtctacgggccgaggcaaaccccacttcactttggaaggccataaatttctgatcttcggcggttctatacattattttagggtaccccgagaatattggagagaccggctgctgaagctgaaggcctgtggattcaataccgtgaccacctatgtaccttggaatctgcacgaacccgaacgcggcaagttcgatttctctggcaacctggaccttgaggcattcgtgctgatggccgccgaaataggtctgtgggtgattctgcgcccgggcagatacatttgtagcgagatggacctgggcggactcccttcatggcttctccaggatcccaggcttttgctcagaacaaccaataaatcctttatcgaagcagtggagaaatacttcgaccaccttatcccaagggtgattcccttgcagtataggcaggccggtcctgtgattgcagtgcaggtggagaacgagtatggtagctttaacaaagacaaaacctacatgccttacttacacaaagctttgcttcggcggggcatcgtggaattattgctaactagcgatggagaaaagcatgtattatctgggcataccaaaggcgtgttggcagccatcaaccttcagaagctgcaccaggacacattcaatcagctccacaaggttcagggtgctagtattgacgcaggactgctctccgatgcctctcaagctgccactagctcctcgctttag

SEQ ID NO: 47786 - DNA, 1962 bp, Artificial Sequence
  Description of Artificial Sequence: Synthetic coding sequence
atgaagagcccccccctgctgagcccctgcctgagctggaagcggatggctggtatattcttcctccccttcatttcatcaggcttcgcccctcggttcaaacaggaggaaaattttatgttgggcagggctcaccccagccagccccgattcaattggtcacatctgaccccactggagctgaagaacaggagtgtcggactcggaacagagagtaccggacgagggaaaccccacttcacacttgaaggccacaagtttttgatctttggagggtctattcattattttagagtcccaagggaatattggcgcgaccgtttactgaagttgaaagcatgcggatttaacacagtgacaacttacgttccgtggaacctgcatgagcccgagcggggcaagttcgatttttcaggtaatctggacttagaggcatttgtcctaatggcagccgagatcggcctgtgggtaattctgagaccaggccgatacatttgttcagaaatggatctcggtggattgccatcgtggctgctgcaggacccacgactgcttctgagaaccactaacaaaagctttattgaggctgttgagaagtacttcgaccatctgatcccacgggtgataccactgcagtatagacaggcagggccagtgatagctgtgcaggtcgagaatgagtatggttccttcaacaaggataaaacctacatgccctacttgcacaaagccctgcttcgtcgggggattgtggagctgctgttaacctccgacggggagaaacacgtgctgtcagggcatactaagggtgtccttgcagccattaacttacagaagctacatcaagatacatttaatcagttgcataaagtgcaaagggataaacctttattgattatggaatattgggtgggctggttcgaccggtggggggacaaacaccatgtcaaggatgccaaggaggtggagcatgccgtctcagaattcataaaatacgaaatatctttcaacgtctatatgtttcacggaggcactaacttcggattcatgaatggggcaacttactttggaaagcactctggcatcgtgacttcctacgactatgacgctgtactgactgaagccggcgattataccgagaaatatctgaaactccagaagctgttccagtccgtgtccgctacacctcttccaagggtgccaaagctgcccccaaaagccgtatacccccctgtgaggccgtctctgtatctgcccctgtgggatgccctgagctacctaaacgagcccgtaaggagtaggcagcctgtgaatatggagaatctgcccatcaataacgggagtggacagagctatgggctggtcctttacgagaagtctatctgctctgggggaaggttgagggcccacgcacatgatgtcgctcaggtgttccttgacgaaaccatgatcggcatccttaatgaaaataataaggaccttcacattcctgagctgcgggactgtaggtatctgagaattctggtcgagaaccaagggcgcgtcaattttagctggcagattcaaaacgagcaaaaaggcattactggctccgtcagtatcaataacagcagtctggagggcttcactatctattccctcgagatgaagatgagcttttttgagcgcctgcgctccgccacgtggaagccagtccccgactcccatcagggtccggccttctactgtggtaccttgaaggctgggccaagccctaaagatacattcctctccctgctcaactggaactacgggtttgttttcattaacggcaggaatctgggcagatattggaacattggcccccagaaaaccctgtacttgccaggcgtctggcttcaccccgaagacaatgaagtaatactgtttgaaaagatgatgtctggcagtgacataaagtcaactgataagccaacattatag

SEQ ID NO: 47787 - DNA, 447 bp, Artificial Sequence
  Description of Artificial Sequence: Synthetic coding sequence
atggagcccgaggccttcgagatctgcccctacgacccccaccacaggatcccacttagcaggtttcagtaccacctggcctcttgtcgaaggaagaatcccaaaaaagctaagaaaatggctacctgtaagtataacgcctgccacgtggtgcccattaaaaatcttgaagagcatgaggctgtgtgtgtgaacagaagtgctgtcgaggaagaagatacggagaatccgctcaaggtcagccctccctcttccgaacagaacgacgacacacagcaagtgtccccctgtctccctagcccggacatctggaacgtcgacggtgcgaactgccagcacgtgtttgttttaaaaacattcttccctcagaaggtagtgtgcgaaaatgatacaaaagaaagtgccagagaaacctccccccagaagattcttcgaccaggacagtag

SEQ ID NO: 47788 - DNA, 372 bp, Artificial Sequence
  Description of Artificial Sequence: Synthetic coding sequence
atggagcccgaggccttcgagatctgcccctacgacccccaccacaggataccccttagtcgatttcagtatcacttggcctcttgtagacgcaaaaaccctaagaaggctaaaaaaatggcaacttgtaagtacaacgcttgtcacgtggtgccgatcaagaaccttgaggaacacgaggctgtttgtgtcaatcgcagtgccgtggaggaagaggacacagaaaatcccttgaaagttagccctccctccagtgaacaaaacgatgatactcaacagacattctttccccaaaaggtggtgtgtgagaatgataccaaggagtccgctcgagagacctctccgcagaaaatcctaagaccgggtcagtag

SEQ ID NO: 47789 - DNA, 1491 bp, Artificial Sequence
  Description of Artificial Sequence: Synthetic coding sequence
atggaccccctgggcgcccccagccagttcgtggacgtggacaccctaccctcctggggagactcttgccaagacgagttaaattcgagtgatacaaccgcagagatcttccaagaagacacagtcagatcaccattcctttataacaaggacgttaacggcaaggtggtactatggaagggggacgtcgctctgttgaattgcacggctatcgtgaacactagcaacgagagtcttactgataagaaccccgtttcagaatctattttcatgcttgcggggcctgacctcaaggaggatctgcagaagctcaaagggtgccgaacaggcgaagcaaaacttactaaaggattcaacctggccgcacgcttcatcatccacaccgtaggaccaaagtacaaatcgcgatacagaactgcggctgaaagttcactttattcatgctatcggaacgtgctgcagcttgccaaagagcaaagtatgagcagcgtgggattctgtgtcattaattccgctaaaagagggtatcctcttgaggatgccacacacatcgctttgcgtacagtccgccggtttctcgaaatccacggggaaaccattgagaaggtggttttcgccgtctccgacttagaggaagggacctaccagaagctgcttcccctatactttccccggagtcttaaggaagagaaccgaagccttccttacctgcccgccgacatcgggaacgcagagggggagccagtggtgcccgagcggcagatccggatctccgaaaagcccggcgcacctgaggataaccaggaggaggaagacgaggggcttggagtggacctgagcttcattgggagccacgctttcgcccggatggagggagacatagacaaacagaggaaacttatactccagggccagctgagcgaggctgccctgcagaagcaacatcagaggaactacaatagatggctgtgtcaggcgagatctgaggatttatcggatatcgcaagtctgaaagctctatatcagactggcgtggataattgcggacgcaccgtgatggtggtagtaggacgcaacataccagtcaccctgatagacatggacaaagcactcctgtattttattcacgtgatggaccatattgccgtcaaagagtatgtgctcgtgtacttccacacactcacatcagagtataatcatcttgactcagacttcctcaagaagttgtacgatgtcgtggacgtgaagtataaacgcaatctgaaggcagtgtatttcgtgcacccaactttccgcagtaaggtgtcaacctggttcttcaccactttttccgtctccggtctcaaagacaagatacaccatgtagattcgctgcatcagctgttcagcgccatctcacccgagcaaattgattttccaccttttgttttggaatacgacgctcgtgtccgcagcaccaggtcgtcaccctcccctggcatggtatactag

SEQ ID NO: 47790 - DNA, 1494 bp, Artificial Sequence
  Description of Artificial Sequence: Synthetic coding sequence
atggaccccctgggcgcccccagccagttcgtggacgtggacaccctgccctcctggggagactcctgtcaagacgagctcaattctagcgataccacagccgagatctttcaggaagacactgttcgaagcccattcctttacaacaaagacgtcaacggcaaggtggtgctctggaagggagatgtggcccttctgaattgtactgcgatcgtgaatacgagcaacgaaagtctcacagataagaaccccgtgtctgaaagcatctttatgctcgcaggacccgacctgaaggaagacctgcagaagctcaaaggctgcaggactggagaagctaaactgactaaagggtttaacctggcagcaagatttattattcataccgttgggccaaagtacaagagtcggtataggactgctgctgaatccagtctctattcctgttaccggaatgtgcttcagctggccaaggagcagtctatgagcagcgttggcttctgtgtcataaactctgctaaaaggggttatccactcgaagatgccacccacattgccctcaggacagtgcgccggtttctcgagattcacggagagacaattgagaaagttgtctttgctgtgagcgatctggaggagggcacttaccaaaagcttttgcctctctacttcccaagatccctgaaggaagagaatcggagcctaccctacctgcccgcagatattggcaacgccgagggcgagcccgttgtgcccgaacgtcagattcgtatctccgaaaagcccggggctccagaggacaaccaagaggaagaggacgaggggctgggcgtggacctgtcctttatcggctctcacgcatttgcgagaatggagggcgatattgataaacaacgtaagttgatcttacaagggcagttgagcgaagcggccctgcagaaacaacaccagcgaaactataatcgttggctgtgtcaagccaggagcgaagatctaagtgatatcgcctccctgaaggcgttgtatcagaccggcgtggacaattgcggacgtactgtgatggtcgttgttggcaggaacattcccgtgaccctgatcgacatggataaggcgctcttgtatttcattcatgttatggaccacattgcggtgaaagaatacgtgctggtgtattttcacacgctgacttccgagtataaccatcttgatagcgatttcctcaagaaactctatgatgtggttgacgtcaaatacaagcggaacctgaaagcagtgtacttcgtgcaccccacctttaggtccaaagtatctacatggttcttcacaacattctctgtgagtgggcttaaggacaagatccaccacgtggacagtttgcaccagctgttttctgccattagtcccgaacagatcgacttcccacctttcgtccttgaatacgatgctcgtgagaacggcccttactacacatcttatccaccatcccctgacctgtag

SEQ ID NO: 47791 - DNA, 384 bp, Artificial Sequence
  Description of Artificial Sequence: Synthetic coding sequence
atggccaagatcctggagcacgacgacgtgagctacctgaagaagatccttggcgagcttgctatggtgctagatcagattgaagcggagctggagaagcgcaagttagaaaacgaggggcaaaaatgcgaactctggctctgtgggtgcgcctttactttggccgatgtgttgctgggagcaacactgcatagactgaaattcctaggactgagtaagaagtattgggaggacggaagccggcctaacttacagtcctttttcgaacgggtccaacgacggtttgccttccgtaaagtgtctcgatggaattgcggagactggcttggatcagagggtactctgcctcaagacaaggcggacattaagacacaattgctttag

SEQ ID NO: 47792 - DNA, 1104 bp, Artificial Sequence
  Description of Artificial Sequence: Synthetic coding sequence
atggccacccccaacaacctgacccccaccaactgcagctggtggccgattagcgcactcgagtctgatgcagcaaaaccagccgaagctcccgacgctccagaagcagcaagcccagcgcattggcctagagagagcttggtgctctatcactggactcaatcattttcgtcccagaaggtccgcctggtgatcgcagaaaagggattggtgtgtgaggagcgcgacgtctcactgccacaaagtgaacacaaggaaccctggtttatgcgtttgaacttgggcgaggaagtcccagttataatccacagagataacatcataagcgactatgaccaaatcatagattatgtcgaaagaaccttcacaggcgagcacgttgtggctctgatgcccgaagtcggatctctgcaacacgcccgcgtgctacagtacagagaactcctcgatgcactgcccatggacgcatacacacacggctgtattcttcaccctgagcttacaaccgactctatgatccctaagtatgcgactgccgagattcggcgccatttagcaaatgcaactaccgatttgatgaagctggaccatgaagaggagccacagctttcagagccctacctctccaaacaaaagaagttgatggcaaaaattctggaacacgacgacgtgtcgtatctgaaaaaaatcctgggagagctggccatggtcttagaccagatagaagcggagttagagaaaaggaagctggagaacgagggccaaaaatgtgagctatggctgtgcggatgcgccttcactctcgccgatgtcctcttgggtgccacgttacatagactgaagttcttggggctgtcgaaaaaatactgggaagatggcagccgcccaaatcttcaaagcttttttgaacgcgtgcagcggaggttcgctttcagaaaggtgctcggagatatccatactacactcctctccgcagtgatccctaatgccttcagactcgtgaagcggaagccaccctccttctttggtgcatcatttctgatgggatccctgggaggcatgggatacttcgcctattggtatctgaagaagaaatacatttag

SEQ ID NO: 47793 - DNA, 930 bp, Artificial Sequence
  Description of Artificial Sequence: Synthetic coding sequence
atggccacccccaacaacctgacccccaccaactgcagctggtggcccatttcagcgcttgaatcagacgctgccaaacccgcagaagccccagatgcgccagaggctgcctcacctgcccactggcctcgtgagtcgttggtgttatatcactggacacagagttttagttcgcagaaggtaaggctggtgattgcagagaagggacttgtttgcgaagagcgagacgtctcactgccccagtctgaacataaggagccttggttcatgcggctgaacttaggagaagaggtcccagtgatcattcacagggataacatcatcagcgactacgatcagataatcgactacgtggaaagaaccttcaccggtgggcacctggctaatgctaccacagatctgatgaagcttgaccacgaagaagaaccacagcttagcgagccataccttagtaagcagaagaaacttatggcaaaaatcttagagcacgatgacgtgagttatcttaaaaaaattcttggagagctggctatggtgctggaccagattgaggctgaactggaaaagcgaaagcttgagaatgaaggccagaagtgcgagctgtggttgtgcggatgcgcttttaccctagctgacgttctcctcggagcaactctgcacagattaaagttccttggactctctaaaaagtattgggaagacggctctcggcctaacttacaatcctttttcgagcgggtgcagcgtagattcgcgtttcgaaaggttctcggggacatccacactaccctgctctcagccgtaattcctaatgccttccgtctggtaaagaggaaacccccctccttctttggggcctcatttctgatgggcagccttggcgggatggggtacttcgcttattggtatctgaagaagaaatacatttag

SEQ ID NO: 47794 - DNA, 1089 bp, Artificial Sequence
  Description of Artificial Sequence: Synthetic coding sequence
atggccacccccaacaacctgacccccaccaactgcagctggtggccaatctcggccctggaatcctgcggacaggcgtctggaggtcctcgtcggtcgcggggcggacagccccactggcctagagagagcctcgtgctgtaccattggacccagtccttcagttcgcaaaaggtgaggttagtcattgcagagaaggggctggtatgcgaggagcgagacgtcagcttacctcaaagcgaacataaagagccctggttcatgcgtctcaacctgggcgaggaggttcctgtcattatacatagagacaacattatctctgattatgatcagattatcgactatgtggaacggacttttaccggcgagcacgtggtcgccctgatgccagaggtgggaagccttgcaagaaccggcgccgcggtccgcgagttgcttgacgcattgcccatggatgcttatacccacggctgtattcttcacccagagcttaccaccgactcgatgatccccaaatacgctaccgcggagattcggcggcacctggccaacgctacaactgatctgatgaagctggatcacgaagaggagcctcagctgagcgagccctacttgagtaagcaaaaaaaattgatggccaagatcctcgagcatgacgacgtatcttacctgaaaaaaatccttggggaactcgcgatggtgcttgaccagattgagggcgccggtgaagaggaagctggtgagcgaggggccgagatgagggccgtcgcgctgtggctttgcctccacgcagatgttctgcttggagcaactctgcaccgcctgaagtttctgggactgtccaaaaagtattgggaggatggtagccgacctaatttacagagctttttcgagagggtgcagagaagattcgccttccggaaggtgttgggtgacattcacactaccctactgtcggccgtgatcccaaacgcatttaggctggttaagagaaaacctccaagcttcttcggcgcttcttttctgatgggatcgttgggaggaatgggatacttcgcttactggtacttgaaaaagaaatacatctag

SEQ ID NO: 47795 - DNA, 444 bp, Artificial Sequence
  Description of Artificial Sequence: Synthetic coding sequence
atggccacccccaacaacctgacccccaccaactgcagctggtggccgatttccgcactggagtcggacgcagctaagccagccgaggcccctgacgctccagaggcggcctcacctgctcattggccacgagagtcactagtgctgtaccattggacgcagagctttagctcacagaaggttcgcttggttattgcagaaaaggggctggtgtgtgaggaaagggacgtgagtctgccacaatctgagcacaaggaaccgtggttcatgcggctcaacctgggcgaggaagtccctgtcatcatccaccgcgacaacattatatcagactatgaccaaattatcgattatgtcgagcggactttcaccggaggcccacgtctcgccgcttctcttgagctgcggggagccaaccctcgagggcaactcggaagagcccagtag

SEQ ID NO: 47796 - DNA, 867 bp, Artificial Sequence
  Description of Artificial Sequence: Synthetic coding sequence
atggccacccccaacaacctgacccccaccaactgcagctggtggcccatttccgcgttggagtctgatgcagctaagccagccgaagcccccgacgctccggaggccgccagtcctgctcactggccaagagaaagccttgtgctgtaccattggacgcagagtttcagctcccagaaagttcggctcgttatcgccgaaaaaggcctggtgtgtgaggagcgggacgtgtcgctgccgcagtcagagcataaggagccgtggttcatgcgtctgaacttgggcgaggaggtcccagtgattatccacagggacaatataataagtgactacgaccaaattatagactacgtggaacgcacctttactggcgggcacttggcgaatgccacaacagaccttatgaagctggatcatgaagaagagcctcagctgagtgagccttacctgagtaagcaaaaaaaactaatggcaaaaatcttagaacacgatgacgtgagctacctgaaaaagattctgggcgagctggctatggtccttgaccagatcgaagcagaactcgagaagcggaagcttgagaacgaagggcagaagtgtgagctctggctttgcgggtgcgctttcacccttgccgacgtgctcttgggtgcgactctccatcgactcaagtttctggggctctcaaaaaagtattgggaggatgggtcacgaccaaacctccagtccttctttgaacgggttcagcgacgctttgcttttcgaaaagtgctcggtgacattcataccactttgttgagcgccgtcattccaaatgccttcaggttggtgaaaagaaagcccccttctttcttcggtgcctccttctag

SEQ ID NO: 47797 - DNA, 756 bp, Artificial Sequence
  Description of Artificial Sequence: Synthetic coding sequence
tgaagcttcagcagccagaaggtgcggctggtgatcgccgagaagggccttgtctgcgaagagcgggatgtgtcactaccccaatcggagcacaaggagccgtggtttatgcgactgaacctgggggaggaggtgcccgtcatcatccatcgcgataacatcatctctgactacgaccagattattgactacgtggagagaacctttactggagaacacgtggtcgcccttatgcctgaagtcggaagccttcagcacgcccgagtacttcagtatagagagctgttggatgccctgccaatggacgcctatacccacggatgcatcctgcatccagagctgactaccgattcaatgatccctaagtatgcgacagccgagatacgccgccatcttgcgaatgctacaaccgacctgatgaaactggatcatgaggaagagccacagctctccgaaccctatctgagtaaacagaagaaattaatggcgaagatcttggaacacgacgacgtctcatatctgaaaaagattttgggggagctagcaatggtactagaccagattgaagccgaactcgagaaaagaaagctggagaatgagggaggctgccagccctggggacggtggggcctgcagcccacgcagccgactctgcctctgccttcactcagcctttttttcccacaaaagagtcagcggaccagccaggtggttaagaggatgggctacggagtaagacttcggtttaagtcttag

SEQ ID NO: 47798 - DNA, 372 bp, Artificial Sequence
  Description of Artificial Sequence: Synthetic coding sequence
ctggagcacgacgacgtgagctacctgaagaagatcctgggcgagctcgcgatggtcctggaccagattgaggcagaacttgagaagcggaagctcgagaatgaggggcagaagtgcgaattgtggctctgtggctgcgcattcaccctggccgatgtcctactaggagccacattgcacaggctgaagtttctcggactcagtaagaagtactgggaggatggtagccggcccaacctgcagtcgttcttcgagcgcgtacagagacgctttgcgtttcggaaggtcagccggtggaactgcggagactggctgggctccgaaggcacactgccacaggataaagctgatatcaaaacccagttgctgtag

SEQ ID NO: 47799 - DNA, 528 bp, Artificial Sequence
  Description of Artificial Sequence: Synthetic coding sequence
atgaagctggaccacgaggaggagccccagctgagcgagccctacctgtcgaagcagaaaaaattgatggccaagattttagagcatgatgacgtttcgtacctgaaaaagatccttggtgagctggcaatggttttggaccagatagaagccgagctcgagaaaaggaaactggagaacgagggtcagaaatgcgagctctggctgtgcgggtgcgcgtttacactggccgacgtactactgggcgcaacactgcacaggctgaaattcctgggactgtctaaaaagtattgggaggatggctcaagacccaatctgcagtcctttttcgaaagagtgcagcgcagattcgctttccgtaaagtgctgggagatatacataccaccttgctctctgctgtgatacccaatgcattcaggctggtgaaacgtaagccgccgagctttttcggagccagcttcctgatgggttcactgggcggcatgggctattttgcctattggtatctgaaaaagaaatacatctag

SEQ ID NO: 47800 - DNA, 1002 bp, Artificial Sequence
  Description of Artificial Sequence: Synthetic coding sequence
ccccggcggagccggggcggccagccccactggccccgggagagcctcgtcttgtaccactggacccagagcttcagtagccagaaggtgaggctagtcatcgctgagaaaggccttgtttgtgaagagagggatgtgagccttcctcagtctgaacacaaggagccatggtttatgcgactgaatctgggcgaagaagttcctgtcatcatccaccgtgataacatcatatctgactacgaccagatcatcgactatgtggaacgtacattcactggtgagcacgtggtggccctgatgccggaggtgggctctctcgccagaaccggggcagcggtgagggagttgttagacgccctcccaatggacgcctatacccacgggtgcatcctgcatccggagctcactaccgactctatgatcccaaagtatgcaaccgccgaaatcagaagacatttggcaaacgccaccaccgacctgatgaaactggatcatgaggaggagccccagttgtctgagccatacctctctaagcagaaaaagctgatggcaaaaattttagagcacgacgacgtgtcctacttgaagaaaattcttggagagttagcgatggtgttagaccaaatcgaaggcgccggggaagaagaagccggcgagcgaggggcagaaatgcgagccgttgcattgtggctttgccttcacgcagacgtacttctgggcgctactcttcataggctcaagtttctgggacttagtaaaaaatattgggaggatggttctcgacctaatctacaatccttcttcgagagagtgcagcggcggttcgcctttcgcaaagtgctcggagacattcatacaacactgctttcagcggtgattcccaacgcctttcgcctggtgaagcgcaaacctcctagtttcttcggcgcgagcttcctcatgggtagcctgggtggcatggggtacttcgcctattggtatcttaaaaagaagtacatttag

SEQ ID NO: 47801 - DNA, 1302 bp, Artificial Sequence
  Description of Artificial Sequence: Synthetic coding sequence
atgggcgactggagcttcctgggcaacatcctggaggaggtgaacgaacatagcactgttatcgggagggtctggctcacagtgctgttcatctttagaatcctgatcctgggtactgctgccgagttcgtttggggggacgagcagtcagatttcgtctgcaatacccagcaacccggatgtgaaaatgtatgttatgacgaggcctttccgatctctcatataagactctgggtgctccagatcatcttcgtttccactccaagcctgatgtacgtgggtcatgctgtgcactatgtccgtatggaggaaaagcgtaagagccgcgaagcagaggagctgggccagcaggctgggacaaatgggggcccagaccagggatcggtgaaaaagtcttcggggtcaaaggggaccaagaagttccggcttgaaggaacgttactgagaacctatatctgccacattatctttaagacgttatttgaagttggtttcatcgtgggccactacttcctttacggatttcggatcctccctttatataggtgttccaggtggccctgccccaacgtcgttgactgttttgtcagtagaccaactgagaagactatatttatccttttcatgctttctgtcgctagtgtgtccctattcctgaatgtgatggaattgggccatttgggtctgaaggggattaggtccgcactgaaaaggccggttgagcaacctttaggagaaatccctgagaaatcattgcactccatagccgtgtcttctatccagaaggccaagggataccagttgctggaggaggagaaaatagtgtctcactacttccctttgacagaagtgggcatggttgagacttcccccctgcccgccaagccatttaaccagttcgaagagaagattagcacgggcccactgggagacctatcccgcggctatcaggagaccctcccatcatacgcccaggtcggagcccaggaggtagaaggggagggtccacctgcagaggagggagcagagccagaagttggagagaagaaggaggaagcagagcgcttaactacagaagaacaggagaaggttgcggtaccagagggagaaaaggtggagacccctggagtcgataaagagggggagaaagaggagcctcagtccgagaaggtgtctaaacaaggattacccgccgagaaaacaccttccttatgtccagaactgaccacagacgatgcacgtcccctgagtcggctatcaaaggctagcagccgggccagaagcgatgacctgacggtttag

SEQ ID NO: 47802 - DNA, 1455 bp, Artificial Sequence
  Description of Artificial Sequence: Synthetic coding sequence
atgggcagcgccttcgagcgggtggtgcggcgggtggtgcaggagcttgatcatggaggtgaatttattcccgtgactagtctccaatcatccaccggtttccaaccgtattgccttgtggtgcggaaacctagctcgtcttggttctggaagccaaggtacaagtgtgtgaacctttcaattaaagacatcctcgaacctgatgctgcggagccagacgtccagaggggaagatctttccacttttatgatgctatggatggccagattcagggttcagtggagctcgccgcccccgggcaggctaagatcgcaggcggggcggctgtttccgatagcagtagtacctctatgaatgtttacagtcttagcgtggacccaaacacttggcaaacacttttgcatgaacggcatctgcgccagcccgagcataaggtgctacagcaactacgatctcggggcgacaatgtgtacgtggttaccgaagtcctacagactcagaaagaggtggaagttacccgcacacacaagagggaaggttccgggaggttcagcctgccaggggcaacctgtctccagggtgagggccaagggcacctgtctcagaaaaagactgtgactataccttcaggctccaccctcgcctttagggtcgctcaactggtgattgattccgacctagatgttctcctcttcccagacaagaaacagagaaccttccagcctcctgcaacaggtcataaaagatccaccagcgagggcgcttggccccagttgccaagtggattgtctatgatgcgctgcctccacaactttcttaccgatggagtcccggcagaaggcgcttttactgaagactttcaaggtctacgagccgaagtggaaaccatttctaaagagctagaactcctggaccgggagctgtgccagcttttgctcgaggggcttgaaggtgtactcagagatcagctggccctccgagcgctcgaggaagcccttgaacagggacagtctctcggccctgttgaacctctggatggaccggctggcgccgtgctcgagtgcctcgtactttcgtctggtatgctggtccccgaactggcgattcccgttgtttacctcctcggcgccctgacaatgctgtccgagacacaacacaaactgctcgctgaggccctcgagtctcagaccctgttgggccccctggagcttgtaggttcccttttggagcagtccgctccttggcaggaacgcagcaccatgagcctgcctcccggcctacttggaaacagctggggggagggagctcccgcctgggtcctactggatgagtgtggtcttgaactcggcgaggacaccccacacgtgtgctgggagccgcaggcacaggggcgaatgtgcgctctctacgcctctctggccctgctgtcgggtctatctcaggagcctcattag

SEQ ID NO: 47803 - DNA, 345 bp, Artificial Sequence
  Description of Artificial Sequence: Synthetic coding sequence
atgggcagcgccttcgagcgggtggtgcggcgggtggtgcaggagctcgatcacgggggagaatttatccctgtaactagccttcagtcctccaccgggttccagccctattgcttggtggtgcgtaagccttcatcaagctggttctggaagccaagatataagtgcgtgaacctgagtatcaaagacattttggagcctgatgccgccgagcctgacgtacagcgcggaaggagtttccacttttatgacgcgatggacggtcagatccagggcagcgtggagctggcagccccaggacaggctaaaatcgctggtggcgcagccgttagtgacagttcgtag

SEQ ID NO: 47804 - DNA, 1455 bp, Artificial Sequence
  Description of Artificial Sequence: Synthetic coding sequence
atgggcagcgccttcgagcgggtggtgcggcgggtggtgcaggagctcgaccatggaggcgagtttattccagttacttccctacagagctctactggcttccaaccttactgcctcgtggtgcgaaagcctagttctagttggttttggaagccacgctacaagtgtgtcaatctatcaattaaagatattctggagcccgatgctgctgaaccggatgtccagcggggcagaagcttccacttctacgacgctatggacggccagatacaaggcagcgtggaattggcagccccgggtcaggccaagatcgcagggggcgctgcagtgagcgattcctccagcacgtccatgaatgtttactctctgagcgtagatccaaacacctggcagacactgctgcacgaacggcacttaagacaaccagagcataaggtcctgcaacagctcaggagcaggggagataacgtgtacgtcgtcactgaggtgttacaaacacaaaaagaggtcgaggttacccgaacacacaaacgggaagggtctggtcgcttctccctgccgggggcaacctgcctccaaggggaggggcaggggcatctgtcgcagaaaaagaccgtcacaatcccatcaggatctactctcgcgttcagggtggcccagctggtgatagattcagacctcgacgttctcctgtttcccgacaagaaacagcgcacttttcagcccccagctaccgggcacaagcggtccactagcgagggggcatggcctcaactccccagcgggctgtcaatgatgagatgcttacacaattttctgaccgacggagtgcctgccgagggcgccttcaccgaggatttccagggccttcgcgctgaagttgaaacaatttccaaagaactggaactcttagatcgggaattatgtcagttattgctcgaaggtctcgagggggtgttgcgggatcagctggcattgagagcactggaggaggctctggaacagggccagagcctcgggccagttgaacctctcgatgggccagccggtgcagtgttagagtgcttagttctgtcttccggcatgcttgttcctgagctcgcgataccagtggtatacctgctcggagcgcttaccatgctctcagaaacacaacataaactcttagcagaggccttggagtcccaaactctactcggaccactggaattggtaggatccttgctggaacagagcgcgccttggcaggagcggagcactatgagtctaccccccggcctccttgggaacagttggggggagggagctcctgcatgggtgttactcgatgaatgtggcctggagctgggggaggacacgccacatgtgtgttgggagccacaggcccagggaaggatgtgtgcactgtacgccagccttgccctcttgagtgggctgtctcaggaacctcactag

SEQ ID NO: 47805 - DNA, 147 bp, Artificial Sequence
  Description of Artificial Sequence: Synthetic coding sequence
atgggcagcgccttcgagcgggtggtgcggcgggtggtgcaggagctggaccacggcggagagttcattcccgtcaccagtctccagagcagcacagggttccagccatattgtcttgtagtccgcaagcccagttcttcatggtag

SEQ ID NO: 47806 - DNA, 495 bp, Artificial Sequence
  Description of Artificial Sequence: Synthetic coding sequence
atgggcagcgccttcgagcgggtggtgcggcgggtggtgcaggagttggatcatggaggagagttcatcccggtgaccagtctccaaagcagcacagggttccagccttactgcctggtagttcgcaagccaagctcatcatggttttggaaaccgcggtacaaatgtgtgaacctttccattaaggatatcctggagccggacgccgcagagccagacgtgcagagagggcgtagtttccatttctacgacgctatggacggccaaatccaggggtccgtggagctcgctgccccaggccaggccaaaatcgctgggggagccgccgtctccgactcatccagcacgagcatgaatgtctatagtttatcagtggatcctaatacatggcagactctactgcacgagcggcacctacgccagcctgaacacaaggtgttgcagcagcttcggtccagaggggataatgtctacgtagtgacagaggtgctttag

SEQ ID NO: 47807 - DNA, 465 bp, Artificial Sequence
  Description of Artificial Sequence: Synthetic coding sequence
atgggcagcgccttcgagcgggtggtgcggcgggtggtgcaggagctggatcacggtggcgagtttatccccgttacgtcacttcagtcaagtactggcttccagccgtattgcctcgtggttcgcaaaccatccagctcctggttctggaagccacgttacaaatgcgtcaacctgtcaatcaaggacattttggaacctgacgctgccgagcctgatgtccaacgggggcggtcgtttcatttttacgatgccatggacggacagatacagggaagcgttgagcttgccgcacctggccaggctaaaatcgccggcggagccgccgtcagcgacagttcgtcgacatcaatgaacgtgtacagcctctccgtggatcctaacacctggcagacccttctgcatgaacgacacttacgccaacccgaacacaaggtattacaacaactgcggtcccgaggttag

SEQ ID NO: 47808 - DNA, 810 bp, Artificial Sequence
  Description of Artificial Sequence: Synthetic coding sequence
atgcccctgggcctgaagcccacctgcagcgtgtgcaagaccacctctagcagtatgtggaagaagggggcacagggggaaatcttatgtcaccattgcaccggccgaggaggcgctggctccggtggcgcggggtcaggcgccgccggaggcaccgggggctctggtgggggcggctttggcgccgcgacttttgccagcacctctgcgaccccacctcagtccaacgggggcggcgggggtaagcagtcaaagcaagagattcacaggaggtcagctaggttgaggaatacaaaatacaagagtgcccctgccgctgagaaaaaagtgtccaccaaaggaaagggcagaagacacatttttaaacttaaaaatcccattaaggctcccgaatccgttagcactatcatcacagccgagtcaatcttctacaaaggcgtatactaccagatcggagatgtagtttcagtgatcgacgagcaggacggcaagccctattacgcacagattaggggttttatccaagaccagtactgcgaaaagagcgctgccctgacatggcttattccgaccctctcgtccccccgcgatcagttcgatcccgcatcatacatcatagggccagaggaggatctgccccgcaagatggagtatttggaattcgtgtgtcacgctccatccgagtattttaagtcgcggtccagccccttccctaccgtccccactaggcccgaaaaagggtacatatggacccacgtgggacctactccagctatcaccatcaaggagtctgtggccaaccatttatag

SEQ ID NO: 47809 - DNA, 990 bp, Artificial Sequence
  Description of Artificial Sequence: Synthetic coding sequence
atggagctgcacatcctggagcaccggctgcaggtggccagcgtggccaatgaaagtatcccgttattcacatacgggttgatcaagcttgcttttctgtcatcaaagacccgctgtaaatttttctcccttactgagacccccgaagactataccattatcgtggacgaagagggtttcttggagctgccctcgagcgagcacttgtcagtagcggacgccacatggctggctttgaatgtcgtgtctggaggaggaagcttcagctcctcacagcccatcggcgtgacaaaaattgctaaaagcgtaattgctcctctggccgatcaaaatatctcagtttttatgttatccacatatcagaccgactttatcctcgtgcgcgaacgcgacttgccgttcgttacccatacactgagtagcgagttcacaattctgcgcgtggttaatggagaaactgtagccgctgaaaacctggggatcaccaatggatttgtaaagcctaagctggtccagaggcccgtaatccaccccctgtcgtcacctagcaacagattttgtgtgacatccttggatccagacaccctacctgctgtggccaccctactcatggacgttatgttctattcaaacggagtaaaggatcccatggcaactggagacgattgcggccatattcgcttcttctctttctcactgattgaaggatatatatcccttgtgatggatgtgcagacacagcagagattcccctcaaacttactattcacatcagcatccggagaattgtggaaaatggttcgaatcggcggtcagccgttgggttttgatgaatgcggtattgtggctcagatttcagaacccctggccgccgcagacatcccagcatattatatcagcacattcaagttcgatcacgcactcgttcctgaagaaaatatcaacggggtaattagcgcactcaaagtgagtcaggctgaaaagcactag

SEQ ID NO: 47810 - DNA, 990 bp, Artificial Sequence
  Description of Artificial Sequence: Synthetic coding sequence
atggagctgcacatcctggagcaccggctgcaggtggccagcgtggccaaggaatctataccactcttcacctacggccttattaaactggccttcttatcgagtaagacccgatgtaagttcttcagcctgaccgagacacccgaagattatacgataatcgtcgacgaggagggattcttagaactgccatcgtccgaacacctgagcgtggctgacgcaacctggctagccctgaacgtggtttcaggaggagggtcgtttagcagcagccagccaattggagtaacaaaaatcgcaaagtctgtgatcgcccctctcgctgatcaaaatatctcagtctttatgctgagcacctaccagacagactttatacttgtccgagaacgcgacctcccatttgtaacccacaccctcagctctgagtttacaatcctgcgggtggtgaacggtgagactgtcgcagccgagaacctcggaattaccaatggatttgttaagcccaagctggtacagaggccagtgatccaccccctttccagtccttcgaataggttctgtgttaccagtcttgatcccgatacccttccagccgtagccacactcctaatggacgtgatgttctactccaacggcgtgaaggatcccatggccactggtgacgattgcggccatattagattcttctccttttcgctgatagaaggatatatcagccttgtcatggatgtgcagactcagcaacgttttccttcaaacttgttgttcaccagcgcctctggagagctatggaaaatggtgaggataggagggcagccactcgggtttgatgagtgcgggatcgttgcacaaatctctgagccattagcagctgccgacatcccggcctactacatctccacgttcaagtttgatcacgctctagtgcctgaggagaacattaatggagtgatctcagctttaaaggtgagccaagccgagaaacattag

SEQ ID NO: 47811 - DNA, 990 bp, Artificial Sequence
  Description of Artificial Sequence: Synthetic coding sequence
atggagctgcacatcctggagcaccgggtgcgggtgctgagcgtggcccgccccggactttggctgtacactcacccactaatcaagctactcttcctgccacggaggagcagatgcaagttcttctctctgaccgaaacccctgaggactacaccctgatggtcgacgaagagggatttaaagaactgccacccagcgagtttctacaggtcgccgaagctacttggctggtgctgaacgtgagttcgcactctggagctgccgtgcaggctgcgggtgtgactaaaatcgcacggtctgtgatcgcgccattagccgaacatcacgtgagtgtcctgatgctgtcaacctatcagacagacttcatccttgtcagggagcaggatttgtcggtggtgatccacaccttggcacaggaattcgacatctaccgagaagttggcggcgagcctgtgcctgtgacacgagatgattcttcaaatggttttccacgaacccagcacggccccagtcccactgtgcatcctatacagagtccgcaaaaccgcttttgcgttctaactctcgaccctgaaaccttacctgctatcgccactactttgatagacgtgctgttctacagccacagcacccccaaagaagccgcatcttccagtcccgaaccatccagcattactttctttgcgttttcattaatcgaaggatatatatccatcgtcatggatgccgaaacccaaaagaagttcccgtctgatctgctcttgacgtcttcatctggggagctgtggcggatggttcggataggtggtcagcctctggggtttgacgaatgtggcatcgtggcccagatagctggtccactggctgccgccgacatttcggcctattacatctctacgttcaatttcgaccatgccctggtgcctgaggacggcataggatcagtcatcgaagtactgcagcgtaggcaggaagggcttgcaagctag

SEQ ID NO: 47812 - DNA, 492 bp, Artificial Sequence
  Description of Artificial Sequence: Synthetic coding sequence
atgagctgccggggccggggcgccggcggccggtggaacagcaccagctggagtaccggctgtaaattaccggccagtcctaggcgtgtgagtcgctgttcacccaccggcttgatcaagttggccttcctcttctccaagacaagatgcaaattcttctctctcactgaaacacctgaagactacacaattatcgtggacgaggaagggttcctggaactgcctagctcagaacacctgtccgttgcagatgctacctggctagctttaaatgtcgttagcggaggcggctccttcagcagttctcagcctatagggatgaccaaaattgctaaatcagtcatagcacctcttgccgaccagaatatctctgtgtttatgctgtccacataccagactgacttcattctggtgctgaaacgggaccttcctttcgtgacccacacactgtcttccgaattcaccattctttggagcgtggctcgcctttag

SEQ ID NO: 47813 - DNA, 1164 bp, Artificial Sequence
  Description of Artificial Sequence: Synthetic coding sequence
atgaaggccctgatcctggtgggcggctacggcacccggctgcggcctctgaccttgagtaccccaaagcccttagtcgatttctgtaacaagccaattctcctccaccaagtggaggcattggcagccgccggagtggaccatgtcatcctcgcagtctcctatatgtcccaggtattagagaaggaaatgaaagcacaggaacagcgcctcgggatcagaatcagcatgagccatgaggaggaaccacttggtactgcaggacccctggccctcgccagggacctgctgtccgaaaccgcagaccccttttttgtcctgaactcagatgtgatctgtgactttccttttcaggccatggtgcaattccatagacaccatggccaggaggggagcattcttgtcactaaagtggaggaaccatccaaatacggcgtggtcgtttgtgaggccgacactggcaggatccacagattcgtggagaaaccccaggtctttgtgtcaaataaaatcaacgccgggatgtacatattatcccccgccgtgctgcagcgaatccagctccagcctaccagcatcgaaaaagaggtcttcccgattatggcaaaagaaggacaactctacgcaatggagctacagggcttctggatggatatagggcaaccgaaagacttccttaccggcatgtgcctctttctgcaatccctacgccagaaacagcccgaacgtctctgcagcggtcctggcatcgtcggtaacgtgctcgtcgatccaagtgcacggatcgggcaaaactgctccattgggccaaacgtctccttggggcccggcgtggtggtggaggacggagtctgcatacggagatgcacagtcttgcgcgacgctcgtatcagaagtcactcctggctggaatcctgtatcgtaggctggagatgccgcgttgggcaatgggtgtcactgtgggccggcctcggcggcgagcgtggcggagagtgcgcttgtctccccgataaagcctaccctctgcttgaagtcaggatggaaaatgtaaccgtgctcggcgaggatgtcattgtgaatgacgagttgtatctcaatggcgcgtccgtgctgccgcataaaagtatcggtgagtccgtccccgagcctagaattatcatgtag

SEQ ID NO: 47814 - DNA, 1083 bp, Artificial Sequence
  Description of Artificial Sequence: Synthetic coding sequence
atgaaggccctgatcctggtgggcggctacggcacccggctgcggccgctcactctgtcgacacctaagccacttgtggatttttgtaataagcccatcctgctgcaccaggttgaagccttggccgcagccggcgtggatcatgtcattttagctgtgtcctacatgagccaggtgctggagaaagagatgaaggcacaggaacagcgcctgggcatcaggatatcaatgtctcacgaggaagaaccacttggcacagccggtcctcttgcacttgcccgagatttgctgagcgagactgctgaccccttcttcgtcctcaactccgatgtcatttgcgactttcctttccaggccatggtgcagtttcaccggcatcacgggcaagagggaagcatactagtcactaaggtggaagagccaagtaaatacggagttgtcgtatgtgaagcagacactgggcggatccatagatttgtggagaaacctcaggtgtttgtcagcaacaaaatcaacgcgggaatgtacattctctcccccgctgtcctgcagcgtatacaactgcagcccacttcgatcgagaaagaagtgttcccgattatggcaaaggaaggtcagctttatgccatggagcttcagggattttggatggacatcggtcagcctaaagatttccttacgggaatgtgcctctttttgcagtcattacgccagaagcagcctgagcgtctctgttccggacccggtatcgtggggaacgtattggtagaccccagcgcacggatcgggcagaattgctcgataggccctaatgtgtccctgggccctggtgtcgtagtggaagacggagtgtgtatacgaaggtgtacagtattgcgagacgcacggatccgctcgcattcttggctcgaatcttgcatcgtaggatggcgatgtcgggtcgggcagtgggtgcggatggaaaacgtgaccgtgctcggagaggacgtaattgtgaatgatgaattgtatctgaatggagctagtgtcctgccgcacaaatcaatcggcgaatccgtgcccgaaccacggattattatgtag

SEQ ID NO: 47815 - DNA, 1083 bp, Artificial Sequence
  Description of Artificial Sequence: Synthetic coding sequence
atgaaggccctgatcctggtgggcggctacggcacccggctgcggcctcttacactttccactcccaaacctttggtggacttttgtaacaaacccatcctcctgcaccaggttgaagcactagccgcggccggcgttgaccacgtgattcttgccgtttcctacatgtcccaggttcttgaaaaagagatgaaagcccaggaacagaggctggggatacgcataagcatgtctcacgaagaggagcccctgggcactgctggccccctggctctcgcccgtgacctgctctccgagactgctgacccatttttcgtgctaaactctgatgttatctgtgacttcccatttcaggcgatggtgcagtttcaccgccatcacgggcaggaaggttctattctggtgaccaaggtggaagaacccagcaaatacggcgttgttgtgtgcgaagcagataccggtcgtatccataggtttgtcgaaaagcctcaagtgttcgtatctaacaagatcaacgctgggatgtacattctctcacctgccgttctccagcggatccagctgcaacccactagcatcgaaaaagaagtcttcccaattatggctaaagaggggcagctgtacgctatggaactccaaggtttttggatggacattgggcagcccaaggatttcctgaccggcatgtgtctgtttctgcagagcctgcgccagaagcagcctgagcggttatgttccgggcctggaatcgtaggtaacgttctggtcgatccgagcgcacgcatagggcagaattgcagcatcggtccaaacgtaagcctggggcccggggtggtggttgaagatggggtgtgcatcaggcggtgcaccgtgctgagggatgccagaatcaggtcccatagttggctagaatcctgcattgtaggctggagatgccgggtcggtcaatgggttcgcatggagaacgtcactgttctgggtgaagatgtaatcgttaatgacgaactgtatctgaacggcgcatccgtgctacctcataagtcaatcggcgaatcagtccccgagccccgaattatcatgtag

SEQ ID NO: 47816 - DNA, 555 bp, Artificial Sequence
  Description of Artificial Sequence: Synthetic coding sequence
atggacctgggccccctgaacatctgcgaggagatgaccatcctgcatggcggctttttacttgcagaacagctgtttcacccaaaagccctcgccgagctgacaaaaagtgactgggaaagggttggtagacctatcgtcgaggccttacgggagatctcgtctgccgctgctcatagccagcccttcgcatggaaaaagaaagccctgatcatcatttgggctaaggttctgcaaccccaccctgttacccccagcgacacggagaccaggtggcaggaagatctgtttttcagtgtggggaatatgatccccactataaatcacacaattctgttcgagctcttgaaatctctggaggccagtggattattcattcagctgctgatggccctgcccactactatctgtcatgctgaactggaaaggttcttggagcatgtcaccgttgacacatccgccgaggacgtagcattctttcttgacgtgtggtgggagagaactaccccccgccgctgcctccagccttgcatctggaccaactggcctcggtag

SEQ ID NO: 47817 - DNA, 1188 bp, Artificial Sequence
  Description of Artificial Sequence: Synthetic coding sequence
atggacgaggagcccgagcggaccaagcggtgggagggcggctacgaacgaacatgggagatcctgaaggaggacgagtccgggtccctaaaagcgacaattgaggatatcctgttcaaggccaagcgaaagagggtgtttgagcatcacggccaggtgagactggggatgatgcgccacttgtacgtcgttgtggatggctctaggactatggaagatcaggatctgaagccaaataggctgacttgcactctgaaacttctggaatattttgtggaagaatactttgatcagaatcctatttcccagattggcattatcgtcaccaagagcaaacgtgccgaaaagctcactgaactttctggcaaccctcggaaacacattacgtccttaaaaaaagctgtggatatgacttgccatggggagcctagcttgtacaattctcttagcatcgcaatgcagacattgaaacacatgcccggccataccagtcgagaagtgctcatcatctttagttcactgactacctgcgatcccagcaacatctatgacttaatcaagactctgaaggccgcgaaaattcgggtgtccgtaatcgggctctctgccgaggtaagggtatgcacagttctcgcgagagagaccggcgggacctaccacgtgattttagatgagtcccattataaagagcttctgacccaccacgtttctcctcctccagcctcttcctcatcggaatgtagtctaattcggatgggattcccacagcacacgatcgcgtccctttctgatcaggacgccaaaccatccttttcgatggcacacttggatggaaatacagagcccggactcacactgggtggctacttttgcccgcagtgcagggccaaatactgcgaactgccagtggaatgtaagatatgtggactgacactggtctctgcacctcatctggcaagaagctaccatcatctatttcccctcgacgccttccaggagattcctctggaggagtacaacggtgaaagattctgctacggctgccagggtgaattgaaggaccagcacgtgtatgtgtgtgccgtctgtcagaacgtgttctgcgtggattgtgacgtgtttgtgcatgactccctgcactgctgtcccggttgcatccacaagatacctgccccctcgggcgtatag

SEQ ID NO: 47818 - DNA, 1188 bp, Artificial Sequence
  Description of Artificial Sequence: Synthetic coding sequence
atggacgaggagcccgagcggaccaagcggtgggagggcggctacgagcgtacctgggagatactgaaagaggatgaatccggctcgctcaaagccactattgaagacatcttatttaaggccaagcggaaacgggtttttgaacaccacggccaggttcgccttggtatgatgcgtcacctgtacgtcgttgtggacggtagccgtacgatggaggatcaggatctgaagcctaaccgcttaacttgcaccctgaaactcctagagtacttcgtcgaagagtatttcgaccagaaccctattagccagatcggtattatcgtcacaaaaagtaaaagagcagaaaaactgaccgagttgtcgggcaacccccgcaaacacattaccagcctgaaggaggctgttgatatgacttgtcacggggagccaagcctatacaacagtctttccatggccatgcagacgctcaaacatatgccaggtcacactagtcgggaagtcctgatcatcttttctagccttacaacttgtgacccttcaaatatctacgacctgattaagactcttaaggcagccaagattcgcgtatccgtcatcggtttgtctgcggaggtaagagtatgcaccgtactcgcccgggaaactggcgggacgtatcatgtcatcttggatgagtcacattacaaggagctcttgacgcatcacctgtctcctccccccgcctctagcagctctgagtgtagtttaatccggatgggctttccgcagcacaccattgcctccttgagcgatcaggacgccaagccttccttcagcatggctcatctggacggtaataccgagcctgggctcactctgggtggctacttttgccctcagtgccgcgcaaagtattgcgagctgccagtggaatgtaagatttgtggcttgacacttgtgagtgcccctcatctggcgagaagctatcaccacctgtttcctcttgacgctttccaggagattccacttgaggagtataacggtgagcgtttctgctacggttgccagggagagctgaaagatcagcacgtgtacgtgtgcgcagtgtgtcagaatgtcttctgcgttgactgcgacgtctttgtacacgactccttgcactgttgtcctggttgtattcataagatccccgcaccatcaggcgtttag

SEQ ID NO: 47819 - DNA, 537 bp, Artificial Sequence
  Description of Artificial Sequence: Synthetic coding sequence
cagtacatctgcagcttcgaggactgcaagaagaccttcaagaagcatcagcaactaaagatccatcaatgtcagcacaccaatgagccactcttcaaatgtacccaagagggatgcggaaaacatttcgcctccccttctaagctgaaacgccatgccaaagcacatgaaggctacgtatgtcaaaagggctgcagctttgtggcgaagacatggaccgagctgctgaagcatgttagggaaacccacaaagaggaatcccgcccattcgtctgtgagcacgcggggtgtggtaagactttcgcaatgaaacagagcctgacccgtcacgctgtggttcatgatccagacaaaaagaagatgaagctcaaagttaaaaaatctcgggagaaacgatcgctggcttctcacctgagcggctatattcctcccaagaggaagcaaggacagggcctttcactctgtcagaacggcgaaagtcccaactgcgttgaggataagatgctcagcaccgtcgcagttctgactctgggctag

SEQ ID NO: 47820 - DNA, 1098 bp, Artificial Sequence
  Description of Artificial Sequence: Synthetic coding sequence
ctggacccccccgccgtggtggccgagagcgtgagcagcctgaccattgctgacgctttcatagctgcaggtgaatccagtgcccctacgccccctcgtccagccttgccaagaaggttcatctgcagcttcccagattgctccgccaactactccaaggcttggaagctcgacgcgcacctttgcaaacacactggggaaaggccatttgtttgcgactacgaggggtgtgggaaggccttcattagggactatcatctgagtaggcatatcctcacacacactggggagaagccctttgtgtgtgccgctaacggctgtgaccaaaagttcaacactaagagtaatctgaagaagcacttcgaaagaaaacacgaaaatcagcaaaaacagtacatttgttccttcgaagactgcaagaaaacgtttaagaaacatcagcagctgaagatccaccaatgccagcatacgaacgaacccctgtttaagtgcactcaggagggctgcggcaagcactttgcttccccctcaaagctgaagagacacgcaaaggctcatgaaggatatgtctgtcagaagggttgttcttttgtggccaagacctggaccgaattactcaaacacgtaagagagactcataaggaggaaattctgtgtgaagtttgcaggaaaacatttaaacgcaaagactatttaaagcagcatatgaagactcacgctcccgagcgcgacgtgtgcaggtgtccccgcgagggctgcggacgcacgtacactactgtcttcaatctgcagtcacacatcttgtcgttccacgaggagtccagaccctttgtctgtgagcatgcgggatgtggaaagacattcgctatgaagcaaagtttgactaggcatgcagtggtccacgatcccgacaaaaagaagatgaaactcaaggtgaaaaagagccgcgagaaacggagcctagcaagccatctgtctgggtatataccacccaagagaaagcagggccagggcctctcgttatgccaaaatggggagagccctaattgcgttgaagataaaatgctgtccactgtagccgttctcaccctcggttag

SEQ ID NO: 47821 - DNA, 1089 bp, Artificial Sequence
  Description of Artificial Sequence: Synthetic coding sequence
atgagcgaccccagccagctgacccagaacgtgtgcctgacccaggagatggagctttcaaaagcgttctccggtcagcggaccctgcttagtgccatcctctctatgctctccttaagtttctcgacaaccagcctactgagcaattattggtttgtcgggactcagaaggtgccgaagccactgtgtgagaagggactcgcagccaagtgcttcgacatgcccgtttccctagacggtgatacaaatacctcaacccaggaagtggtacagtataactgggagaccggcgatgatcgatttagctttaggagttttagatccgggatgtggctgagctgtgaagaaacggtggaagagcctgccctcctgcacccccaaagctggaagcagttccgggccctcaggtcttcaggcactgccgctgccaagggcgagcgctgtaggagctttattgaattgacaccccctgcgaagcgagagatcctctggctttctttagggacccagatcacatacataggactgcagttcatctcattcctactgttgctgactgatctcctcctcactggaaaccctgcctgtgggttgaaactgagtgcattcgccgccgtatcaagcgtcctaagcggactcctggggatggttgcacacatgatgtatagccaggtgttccaagccacggtgaatttggggcctgaggactggcggccacatgtgtggaattatgggtgggctttttacatggcttggctgtctttcacgtgctgcatggcttcagccgtaaccacctttaacacttacacaaggatggttctggaatttaagtgcaaacactcaaagagtttcaaagagaatccgaactgcctgcctcaccaccatcagtgctttcctaggcgcctgtccagtgctgcccccactgtggggcctttaacctcctaccatcagtaccacaaccagcctatccactcagtttctgaaggtgtagacttctattcagagttacggaacaaaggattccagcggggagcttcacaggagctgaaggaggctgtccggtccagcgttgaggaggaacagtgctag

SEQ ID NO: 47822 - DNA, 981 bp, Artificial Sequence
  Description of Artificial Sequence: Synthetic coding sequence
atggccaagatggagctgagcaaggccttcagcggccagcggaccctcctgagtgccattctatccatgctgagcctctcctttagtacaacctccctgctcagtaattactggttcgtgggcacgcagaaagtcccaaagcccctgtgcgaaaaaggactagctgccaagtgcttcgatatgcctgtgtcattggatggggacactaatacttctactcaggaggttgtccagtacaactgggaaacaggtgacgaccgcttctccttcagatcattcagaagcggcatgtggttgtcttgtgaggagactgtagaggaacctggtgaaagatgtagatcatttattgagctcacacccccagccaaaagagagattctttggcttagcttgggaactcagattacttacataggtctacagtttatcagtttcctgctgctcttgaccgatttgctgctgacagggaacccagcttgtggcctcaagctatctgcttttgccgcagtttcgtccgtactgtcaggcctgttggggatggttgcacacatgatgtacagtcaggtttttcaagcgaccgtcaacctggggcctgaggactggaggccgcatgtttggaattacggctgggccttttacatggcatggttatccttcacctgctgtatggcctctgccgtaacgacctttaatacctataccagaatggtgctggaatttaagtgtaagcactctaaaagcttcaaagagaaccctaactgcctgccccatcaccaccagtgtttccctcggagactgtcctccgccgccccaacagtcggtccgttgacgtcctaccaccagtatcacaatcaacctatccactcggtgtctgagggcgttgatttttatagtgagcttcgcaataagggatttcagagaggagcctcccaggaactgaaggaggctgtccgctcctctgtggaagaagaacagtgttag

SEQ ID NO: 47823 - DNA, 966 bp, Artificial Sequence
  Description of Artificial Sequence: Synthetic coding sequence
atgagcgaccccagccagctgacccagaacgtgtgcctgacccaggaaatggagctaagtaaggcctttagtggccagcggacactgctgagcgctatcctgtccatgctgagcctgtccttttccacaactagtctcttgagcaactactggtttgtgggaacacagaaggtgcccaaacccctgtgcgaaaaggggctagccgctaagtgctttgatatgcctgtctccctagatggcgatacaaacacaagcacccaagaggtggtacagtataattgggagacaggcgacgatcgattctcatttcgctcatttcgctccggcatgtggcttagctgcgaggagaccgttgaagagcccgccttactacacccacagtcttggaaacagtttcgagcgctgcggtcttccgggacagcagccgccaaaggggagaggtgcaggtcttttatagagctgacacccccggctaaacgcggcgaaaaggggcttctggagtttgctactctgcagggaccctgccaccctacgttgaggttcgggggcaagagattgatggagaaggccagtttgcccagtccaccactcggactgtgtggcaagaatcctatggtaatcccaggcaacgcggaccatctgcaccgcactagcatccatcagctaccacctgccaccaatcggttggccacccactgggagccttgcctttgggcccagactgagagactctgttgttgtttcctgtgtcccgtccggtcccctggtgacgggggcccccatgatgtctttacaagtctaccgtcagactgccagttaggctcgcgccggctggaaacaacctgcctggagctgtggttagggcttctccacggcctcgcgcttttacacctgcttcacggagtgggctgccaccatctgcagcatgtgcatcaggacggggcaggggtgcaagtgcaagcctag

SEQ ID NO: 47824 - DNA, 858 bp, Artificial Sequence
  Description of Artificial Sequence: Synthetic coding sequence
atggccaagatggagctgagcaaggccttcagcggccagcggaccttgctctcagccatcctgagcatgctgtctttatctttcagcacaacatctctcctgtcaaattactggtttgttggtactcaaaaggtgcctaaaccgttgtgtgagaagggactggctgcaaagtgcttcgatatgccagtctccctggatggcgacacaaacacctccacccaagaagttgtccagtacaactgggaaaccggcgatgataggttttcttttaggtccttccgatccggcatgtggcttagctgtgaagaaaccgttgaggagcccggggagcggtgtcgctccttcattgaactgactccccctgcaaagaggggggagaagggcttactggagtttgctacgctgcagggcccatgccatcctactcttcgcttcggaggcaagcggttgatggagaaggccagtctgccatccccgcctctcggtctatgcggaaagaaccccatggtcatccccgggaatgccgaccatttacatcgcacatctatacatcagttgccacctgcaacaaataggctggccacacattgggagccctgtctgtgggcgcagaccgagagactatgttgctgcttcctctgtcccgttcggtctccaggagatgggggtcctcacgacgtattcacatccttaccttcagactgccagctgggctccagacgtctcgagacaacttgtctggaactctggttgggcttactgcatgggctagcactactccatctcttgcatggcgtcggatgccatcaccttcagcacgtgcaccaggacggcgcgggtgtgcaggttcaagcctag

SEQ ID NO: 47825 - DNA, 888 bp, Artificial Sequence
  Description of Artificial Sequence: Synthetic coding sequence
atggagctgagcaaggccttcagcggccagcggaccctgctgagcgcaatcttgagcatgctttccttgagcttctctacaacctcactgctgtccaactactggttcgttggaacacagaaagtccctaagccattgtgcgaaaaggggctggctgcaaaatgctttgatatgccagtctcactagatggcgatactaacacctcgacccaagaagtggtccagtacaactgggaaacaggtgatgaccgtttcagctttaggtccttccgatcagggatgtggctgagttgtgaggagactgttgaggaaccagcactactgcatccccaatcctggaagcagttcagggccctgagaagttccgggacagctgccgccaaaggtgaacgatgtcggtccttcatagagctgactcctccagccaagcggggccttcttgggatggttgctcacatgatgtactcccaagttttccaggctacagtgaatctgggccctgaggactggaggccacacgtgtggaactatggttgggctttctacatggcctggctcagtttcacctgttgtatggccagcgctgttacaaccttcaacacctatacgagaatggtactagaattcaagtgcaagcattcgaagtcctttaaagagaatcccaattgtctaccacaccaccatcaatgctttccaaggcgcctgtctagtgcagcacctacggttgggcccctgaccagttaccatcagtaccacaatcaaccaattcactccgtgagtgagggagtggatttttactcagaactgcgcaataaggggttccaacggggggcatcccaggagctgaaagaggcggtccggtccagcgtggaagaggagcagtgctag

SEQ ID NO: 47826 - DNA, 1023 bp, Artificial Sequence
  Description of Artificial Sequence: Synthetic coding sequence
atggagctgagcaaggccttcagcggccagcggaccctgctgagcgccatcctaagcatgctcagtctatcgttctcaacaacaagcctgttatccaattattggttcgtcgggactcagaaggtgccgaagcccctttgcgagaaggggctagcagcgaaatgtttcgacatgccagtgagcctggacggggacaccaatacttccacacaagaggttgtgcagtacaattgggaaaccggagacgacagattcagctttcgctctttcagaagtggcatgtggctatcgtgtgaagaaactgtagaagaacctggtgagaggtgccgtagcttcatcgagttaaccccacccgcaaagcgtggtgaaaaggggttgctggaattcgctaccctgcaagggccatgccacccaacactgcggttcggcgggaaacgccttatggaaaaggccagcttaccctccccgcccctaggtctctgcgggaagaaccctatggttattccagggaacgccgaccacttgcaccgaacttctattcatcagttgcctcccgctacaaacaggttggcaacacattgggagccttgcctgtgggcccaaactgaacgcttatgctgttgttttctctgtccggtccgatcgccgggggatggcggccctcatgacgtcttcacaagcctcccttccgactgccagctgggatctaggcgcttagaaacgacctgtcttgaactgtggctgggacttctgcacggcctcgccctcctccaccttttacacggcgttggatgccatcacctacagcacgaccaccatcagtgtttcccaagacgtctctcttcagccgcccctacggtcggcccgctgacctcataccaccaatatcataatcagcccatccactccgtgagcgagggtgttgacttctactcagagctgagaaataaagggtttcagagaggcgcctcccaagagttaaaggaggctgttcggtccagtgtggaggaggaacagtgctag

SEQ ID NO: 47827 - DNA, 1020 bp, Artificial Sequence
  Description of Artificial Sequence: Synthetic coding sequence
atgagcgaccccagccagctgacccagaacgtgtgcctgacccaggaaatggagctgtctaaagcattttccggccagcgcaccctgctgagcgccatcctgagtatgctgagtctttcatttagcaccactagccttttgtctaattattggttcgttgggacccagaaggttccaaaacctctatgtgagaaaggcctggcagctaagtgtttcgacatgcctgtgtcgttggacggagacacaaatactagtactcaggaggtggtgcaatacaattgggaaaccggcgacgatcgtttctctttccggtcctttcgtagcggcatgtggctctcctgcgaggagactgtggaagagcccggggagaggtgtaggtcgtttatagagcttacacccccagcaaaacgtgagatcctctggctgagtctgggtacccagattacatatattggcctgcaatttatttcatttcttttgttgctgaccgatctgctgctgacaggcaatccggcgtgtggcctgaaacttagcgccttcgctgccgtctctagcgtgttatctggtctgctgggaatggtcgcacacatgatgtattcacaggtgttccaggctaccgtgaacctgggccccgaagattggcgcccacacgtgtggaattatggctgggccttctacatggcttggctaagtttcacatgttgtatggcgagcgccgttaccacttttaatacgtataccagaatggtcctggagttcaagtgcaaacatagcaagagctttaaagagaacccaaactgcctgccacaccaccaccaatgtttcccgagaagattgtccagcgccgcgccaacagtgggcccactgactagttatcaccagtatcacaaccaaccgattcattccgtaagcgagggcgtcgacttctatagcgaactgagaaataagggctttcagagaggagcctctcaggagctaaaagaggcggtgcggtcaagtgtcgaggaagagcagtgttag

SEQ ID NO: 47828 - DNA, 828 bp, Artificial Sequence
  Description of Artificial Sequence: Synthetic coding sequence
atggccaagatggagctgagcaaggccttcagcggccagcggaccttgttgtcagccatcttatccatgctgtctttgagtttctcaactacctcattgctgagcaattattggttcgttggcacgcagaaggtgcccaagcccttatgcgagaagggtcttgctgccaagtgttttgatatgccagtctcactcgacggcgatactaatacatccactcaagaagtggttcaatataactgggaaaccggtgacgatcgattctcctttcggtctttccgcagcggcatgtggctctcgtgcgaggagaccgtggaggagcctggcgaacgatgtcgatccttcatcgaactgacgccgcccgccaagagagggcttttgggaatggtagctcatatgatgtacagccaggtttttcaagcgacggtcaatctcggacctgaagattggcgtcctcatgtgtggaattatgggtgggccttttacatggcctggttgtctttcacgtgttgcatggcaagcgccgtgaccacatttaatacgtacacccggatggtccttgagttcaaatgtaagcattccaagagcttcaaggagaatcccaactgtctgccacatcaccaccaatgcttccccagaagactgagttcggcagcccccacggtcggccctcttaccagctaccaccaatatcacaatcagccgattcattccgtatctgagggagttgatttttatagtgaacttaggaataagggttttcagcgtggtgcctcccaggaattgaaagaggccgtgaggtcctcagttgaggaggagcagtgctag

SEQ ID NO: 47829 - DNA, 897 bp, Artificial Sequence
  Description of Artificial Sequence: Synthetic coding sequence
atggccaagatggagctgagcaaggccttcagcggccagcggaccctgttgtcagccatcctgtcaatgctctccctctctttctccaccacatccctgttgagcaactattggtttgtgggtacccagaaggtaccaaaacccctctgcgaaaagggcctggcagccaaatgttttgacatgccggtctcactagacggggatactaatactagcacacaggaagttgtccagtataactgggaaacaggtgatgatcgcttttctttccggagctttaggtccggcatgtggctctcgtgtgaggaaactgtggaggagccagctttgcttcacccacagagctggaaacagttcagagcactcagatcttccggcaccgctgcagccaagggagagaggtgtagatcattcatcgaactcaccccgcccgccaagcgtggattactgggaatggtagcccatatgatgtatagtcaagttttccaggcaaccgtcaatcttggccccgaagactggaggccccacgtgtggaactatggttgggcattttatatggcatggttatcctttacgtgctgcatggctagtgccgtcacaacctttaatacgtacacccgcatggtgctggagttcaagtgcaagcacagcaagagttttaaggaaaatcccaactgtctgcctcaccatcatcagtgcttccctagaagactgagctccgctgctcctaccgtcggtcccctcacgtcataccaccagtaccataaccagcctatacactccgtgagcgagggtgttgacttttacagtgagcttcggaataaaggctttcagcgtggcgcttcccaggaactcaaggaagctgttcggtctagcgtggaggaggaacaatgctag

SEQ ID NO: 47830 - DNA, 462 bp, Artificial Sequence
  Description of Artificial Sequence: Synthetic coding sequence
atgagcgagagcctggtggtgtgcgacgtggccgaggacctggtggagaaacttcgtaaattccgcttcaggaaggagaccaacaatgccgctattatcatgaagatagataaggataagcgcttggtggtgttagacgaggagttagaagggatctcccccgatgagctgaaggacgagttgcctgagcgccagccgaggttcatagtgtactcatataaatatcagcacgacgatggcagggtgtcctatcccctgtgtttcattttctctagccccgtggggtgcaagcctgaacaacagatgatgtatgctgggtctaagaataaactggtgcaaactgccgagctgactaaagtcttcgaaatcaggaatactgaggatttgaccgaggagtggctccgcgagaagcttttcttcacaaatgtgaatttctgcgtaagcaaggtatttatgtattag

SEQ ID NO: 47831 - DNA, 429 bp, Artificial Sequence
  Description of Artificial Sequence: Synthetic coding sequence
atgagcgagagcctggtggtgtgcgacgtggccgaggacctggtggagaaattgagaaagttcagatttcggaaggagacaaacaacgctgccattatcatgaagattgataaagacaagagactggttgtgctggatgaggagctagagggcatctccccagatgagttgaaagatgagctgccggagcgccaaccccgattcatcgtgtacagctataagtaccagcatgacgatggaagggtgagctatccactctgtttcatttttagctccccagtgggctgcaagccagagcagcagatgatgtatgcaggctctaagaacaagttagtccagactgctgaactgactaaggtgttcgaaattcgcaacacagaagacctgaccgaggagtggttacgggagaaactggggttttttcactag

SEQ ID NO: 47832 - DNA, 1785 bp, Artificial Sequence
  Description of Artificial Sequence: Synthetic coding sequence
atggccgtggaggagctgcagagcatcatcaagcggtgccagatcttggaggaacaggatttcaaagaggaggacttcggtttatttcagctagctgggcaaaggtgtattgaagagggacacacagaccagttgctggaaatcattcagaacgaaaagaataaggtgatcattaaaaacatgggctggaatctggttgggcccgttgtccggtgtttattgtgcaaggataaggaggactctaagcgaaaagtctactttctgattttcgatctgctcgttaaactgtgtaatcctaaagagctgttactggggctgcttgaactgatcgaggaaccaagtggtaaacagatctcgcagtccattctcctccttctgcagccactgcaaacagtgatacagaagctacataacaaagcctatagtattgggctcgctttatccacactttggaatcaactaagcctcttgcccgtcccctacagcaaagagcaaattcagatggacgattacgggctttgccagtgttgtaaggccttgattgaatttacaaaaccattcgttgaggaggttatcgacaacaaggagaatagcctagagaacgagaaactaaaggatgagttactcaagttctgctttaagagccttaagtgtccgctgctcactgcccagttcttcgaacagtccgaagaaggcggcaacgatcctttccggtactttgcttcagaaattatagggtttttgagcgcaatcggacatccttttccaaagatgattttcaatcacggccgaaagaagcgtacctggaattatctagagtttgaggaggaagaaaacaaacaactcgcagatagtatggcctcactggcctatctggtattcgttcagggtattcatatagatcagcttcccatggttctgtcacccctctacttactgcaattcaacatggggcatatagaggtgtttttgcagcgaacagaggagagcgtcatcagcaaggggctggagttgctggaaaattccttgctcaggattgaagataactccttgctgtatcagtatcttgagatcaaatctttcctgacagtcccacagggactcgtgaaggtcatgacgttatgccccatagaaacactcaggaagaagagtctcgccatgcttcagctgtatatcaacaaactcgatagccaggggaagtacacactattccgctgtcttctaaatacatccaaccactcaggagtggaggccttcattatccagaatattaaaaaccagatcgatatgtcgttaaaaagaactagaaataacaagtggtttactggaccgcagcttatttccctgctcgacctggtgttgtttctgcctgaaggggccgagacggatttgcttcagaattcagatcgcattatggcctctctgaatctgcttcgatacttggtcatcaaggataatgaaaatgacaaccagaccggactctggactgaattggggaacattgagaacaatttcttgaagccgctgcatattggactgaacatgtccaaggcacactacgaggccgagatcaagaattcacaggaggcacagaagagtaaagatctgtgctcaatcacagtgtccggcgaggaaatacccaacatgccgccagagatgcagctcaaagtgctgcattcagcgctgtttactttcgatttaattgagtccgtattggctcgggtggaggagctgatcgaaatcaagaccaaatccacttccgaagagaatataggcatcaagtag

SEQ ID NO: 47833 - DNA, 1743 bp, Artificial Sequence
  Description of Artificial Sequence: Synthetic coding sequence
atggccgtggaggagctgcagagcatcatcaagcggtgccagatcctcgaggagcaggatttcaaagaagaggacttcgggctcttccagctggccggtcagcggtgtatcgaagagggccacactgaccagctccttgagataatccaaaatgagaaaaataaagtgataattaagaacatgggctggaatctcgtaggaccagtggtccgctgcctcctgtgtaaggacaaagaggatagcaagagaaaagtctattttcttatctttgacctgctggtgaagttgtgtaaccccaaggagctgctacttggcctgctcgaactgatcgaagaacccagcggtaaacagatatctcagtcaattttgttgctgctgcaacctcttcaaacggtcattcaaaaattgcacaacaaggcctattcaatcggactggcactgtcgaccctgtggaaccagctctcgctcctgcctgtgccatactctaaggagcagatccagatggacgattatggactctgtcagtgctgtaaagctcttatcgaatttactaagccttttgtcgaagaagtcattgacaacaaagagaacagtttagaaaatgaaaagttgaaagacgagctacttaagttctgtttcaagtctttgaagtgtccacttttgaccgctcaattcttcgagcaatctgaggaaggaggaaatgatccatttcgttacttcgcatccgaaattataggtttcctttccgctatagggcatcctttccctaaaatgatttttaatcatggtcggaagaaacgcacttggaattatctggaattcgaggaggaagagaataagcaactcgccgactccatggcttctctcgcttatctggtttttgtgcaaggcattcacattgatcagctgccaatggtgttgagccccctctacctgttgcaatttaatatgggacacatagaggtctttttacagcgaaccgaggagtctgttatctcgaaaggcctcgagctgttggagaactcactgctgagaatcgaagacaattcactcctgtatcaatacctggaaataaaatcttttctgaccgttcctcagcgaaagaagtctctggcgatgctgcaactttacatcaacaaattagactcacaggggaagtacacgctgtttagatgtctgcttaacacctctaatcactcaggcgtggaggccttcattattcaaaacataaagaatcagattgatatgtccctgaagagaaccagaaacaacaaatggtttactggaccccagctgatatctttactcgacctagttctgttcctcccagaaggggccgagaccgatctactgcaaaattcagatcgcattatggctagcctgaacctactccggtatctcgtcataaaagacaatgaaaatgacaaccagacaggcctttggactgaacttgggaacattgaaaacaactttcttaagcccttgcacataggcctcaatatgagcaaagcccactacgaggccgaaataaaaaattcccaagaggcacagaaaagcaaggatctttgcagcatcaccgtgagcggtgaagaaatacccaacatgcccccagaaatgcagctcaaagtcctccattctgcactgttcaccttcgaccttatagaaagtgtcctggcacgcgtggaagaactgatagaaattaagacgaaaagcacttcagaagagaatatcggaattaagtag

SEQ ID NO: 47834 - DNA, 768 bp, Artificial Sequence
  Description of Artificial Sequence: Synthetic coding sequence
aacggcaagaccgtgcaggtgctgcccagcgccctgagcaccatgtttgggatcgattcatgcccctactacgtgctcgagaatcactatattacgaccccgcttagcaccgaagaagcagcgttcccactggcgtatgtcatgaccatcagtcaagacttcgacacatttgagtggttgttctgggccatttacatgccccagaatgtatactgcatacacgtggataaggccgccaccattgactttaagatcgccgtgtcagagctgctggaatgcttcagtaacgcctttatttcatcacaatccgaatacatcatatacggtggcaaaagtaggctccaggccgacctggcctgtatgagggacctgatagcttccactgtgcagtggcgatacgtcactaatacaggagatcacgacttcccactcaaaactaatagggaaattgttcaatatctcaagactatgaattggacaaacattacacccaaccttgtcagcgtgcttaaatctactgagaggatcaagtatacacacagggagtataggaccagagcacacgcgtttgttctgaaaaagcacaaaaagaaatcaccacccccaaggcagttaaagatacactttggttcgtcgtatgtggctttaactagagagttcgttcattttgctctgtataataagatagccatcgagctgctgcagcgctctcaagacacctacagccctgataaacacttctggattacgttaaacaacataccatag

SEQ ID NO: 47835 - DNA, 1176 bp, Artificial Sequence
  Description of Artificial Sequence: Synthetic coding sequence
atgaaggtgtggagctgctacctgtgcatcatcaccctgcagatcattattatcgtgacggtactatacaatgtgcacgtgtcccaaccagattccggtcaaatagacgacgtggggggggaatatcaagctctgtctagacttcacatttgtgatgcagctttgaacggcaaaaccgtgcaggtgctgccctccgcgctctccaccatgtttggcatagactcctgtccctactatgtgctcgagaatcactatataactactccgctgtctaccgaggaagcagccttcccactcgcttacgtcatgaccatttctcaggatttcgacacctttgagtggttgttctgggcgatctatatgccccagaacgtgtactgcatccatgtcgataaagcggccacaatcgacttcaaaatcgcagtctcagagctgctagaatgcttcagtaatgccttcatctcttcccagtccgaatacattatatatggagggaaaagcagattgcaagctgaccttgcctgcatgcgggacctgattgcctctacggtgcagtggcgctacgtcacaaatacgggagaccatgactttcccctcaaaaccaacagagaaattgtgcagtacttgaaaaccatgaattggacgaatatcacccccaacctcgtatctgtcctgaaatccaccgaaagaattaaatacacacaccgggagtaccggactcgagctcatgcctttgtcttaaaaaagcataaaaaaaaatcaccacccccccgacaactcaagatccattttgggtcgtcatatgtggctctgactagagagttcgtgcattttgccctgtacaataagatcgctattgagctgctgcagcggtcacaggatacgtattctccagacaagcacttttggataaccctaaataacatcccagtggagtgtactggcccatggatactggcggtgaacagcgggtcctgtcagaaccgacacatctgccctaggggcctcgagtttcagcaacaatatccagtgaactccttcggtggcaacaattgctccattgctgctgggaccgccgcgccccgcgaagccttgggcccttttcatctgaaggccgcctgttcagcacaccagaacaagtgggggttctggaactgttatctgcatcttaaatag

SEQ ID NO: 47836 - DNA, 909 bp, Artificial Sequence
  Description of Artificial Sequence: Synthetic coding sequence
atgtgcctgcagcccctgcaggagcagaagcagtgggccctggacggcgccgagtaccgcaccatacaggccaactgcacgggaacgggcattggctataacattatttgggtgcctatggctagttgcgatttctcaatccggacctacacttatgccgatactccggatgacttccagctgcataatttcagccttccggaggaagacacaaaacttaagattcccctcattcacagggctcttcagttggcccagcgcccggttagcctgttagccagcccctggacaagtccaactcggttaaagaccaagggtgctggaaacggaaagggcccattgaagggacagccgcgcgacatataccaccagacttgggcgaggtacatcgtcaaatttctcgacgcctacgcagagcataagttgcaattttgggcggtcaccgccgagaatgaaccgtccgcagggttgctctctggatacccctttcagtgtcttggatttacaccagaacatcagagggatttcattgcaagggatctggggccaacattggctaatggaactcaccacaatgtgcgattgctgatgttggacgaccagaggctcctgctcccccattgggcaaaggttgtgttgactgatcccgaggcggcaaagtatgtgcacggcattgccgtacactggtatctggattttctggcacccgcaaaggctaccctcagagagactcatcatctattccccaacaccatgctgttcgcctccgaagcatgcgtgggttccaagttctgggagcagtcagttagactgggatcttgggataggggtatgcaatactctcactccatcatcactaatctgctgtatcacgtcgtgggctggacagattggaatccaagtttgtag

SEQ ID NO: 47837 - DNA, 1080 bp, Artificial Sequence
  Description of Artificial Sequence: Synthetic coding sequence
atgtgcctgcagcccctgcaggagcagaagcagtgggccctggacggggccgaatatcggaccatccaggccaattgcacaggtaccggcattggttataacatcatctgggtgcctatggcaagctgcgacttctccatcagaacctacacctatgccgacacccccgacgatttccagctacacaactttagtctcccggaggaagatactaagctgaaaataccactaattcacagggcactccaactcgcccagcggcctgtttctttactggcctcgccatggacttcacctacccggctgaagacgaagggagctggcaacgggaagggaccattaaagggtcagcccagggacatttaccaccagacttgggcaagatacatcgtgaagttcctggatgcatacgccgagcacaaactgcagttttgggctgtgaccgctgagaacgaaccttcagccggcctgctcagtggttaccccttccagtgcttggggtttacaccagagcaccaaagggacttcatagcacgagacctcggacccacccttgcgaatggaacgcatcataacgtgaggctgctcatgctggatgaccagagattgctgctgccgcactgggccaaggtcgtactgaccgacccagaagcagcaaagggtctgtgcggcttccaggtactcggggcagaatgtgctgcaaggctcctgggaagccgggacgccgtacaaccgcagcaccatcacaaaccacccgtaccctgcggccgcctcgaccgactggagccaatcatagttgatattacgaagcatactttttacaaacagcccatgttctaccatcttggacacttctctaagtttatcccggagggttcacagagggtgggactggtggcttcccaaaaaaacgatccggatgccgtcgcactgatgcatccagacggctcgcctgtcgtagtggtgctcaacaggtcaagcaaggacgtgccgctaacaattaaggaccccgctgtgggctttctggaaacgatttcccccgggtatagtatacacacatatctgtggaggcgtcagtag

SEQ ID NO: 47838 - DNA, 1566 bp, Artificial Sequence
  Description of Artificial Sequence: Synthetic coding sequence
atgagcagcgacagcgaccggcagtgccccgtggacggcgacatcgatcagcaggagatgatcccctccaagaagaatgcagttctggtcgacggggtggttctaaacggccccacaaccgacgctaaggctggggagaagttcgtggaagaggcatgccgcctgattatggaggaagtggtactcaaggcaaccgacgtcaatgagaaagtatgcgaatggaggcctccagaacagttgaagcaacttctggatctcgaaatgcgagattccggggaacccccacataagctccttgagctgtgccgtgacgtgattcactacagtgtcaagacaaaccaccctcggttctttaaccaactttacgctgggctcgactactactcgcttgttgcaagattcatgacagaggctctgaacccttcagtgtacacatacgaagtgagtcctgtgttcctcctagtcgaggaggccgtgttaaaaaagatgattgagttcataggctggaaagaaggagatgggatattcaacccaggcggctcagtgtctaacatgtacgctatgaacctcgccagatacaagtattgtcctgacatcaaagaaaaaggattgagtggaagccctcgcttgatcttatttaccagtgcagagtgccactattcaatgaagaaggctgcaagttttttggggattggaaccgagaatgtttgctttgtggagaccgacggaaggggaaagatgatccccgaggagctggagaaacaagtctggcaggctagaaaggaaggtgccgctccttttctggtctgtgccacatcaggcaccacagtcttgggggcatttgaccctctggacgagatcgccgacatttgcgagagacattccctttggctgcatgtcgacgcatcctggggtggctccgccctaatgtccagaaaacaccgaaaactactgcacgggatccaccgcgctgacagtgtcgcctggaacccacacaagatgctgatggcgggcattcagtgctgtgccctgctggtgaaggacaagagcgacctgttaaagaaatgctatagcgcaaaggcttcctacctgttccagcaagacaagttctatgatgtatcctatgacactggcgacaaaagcatccagtgtagcagacggcccgacgcttttaagttctggatgacttggaaggctctcggcacattggggctggaggaaagagtgaatagagctcttgccctgtcccgctatctagtggatgagataaaaaagcgggagggatttaagctcttgatggaaccagaatacgccaatatttgcttttggtatattccaccgagcctacgagagatggaagaaggcccagagttttgggccaagttaaatctggtggcaccagctattaaggagcgtatgatgaagaaagggtccctcatgttgggttatcagccccataggggaaaagtgaactttttccgccaagttgttatttcacctcaggttagccgcgaggacatggatttcctccttgacgagatcgatctgctgggcaaggacatgtag

SEQ ID NO: 47839 - DNA, 1116 bp, Artificial Sequence
  Description of Artificial Sequence: Synthetic coding sequence
atgagccacgagaagagcttcctggtgagcggcgacaactacccccctccaaacccgggataccctggtgggccccagcccccaatgccaccatacgctcagcccccgtatcctggagcaccgtacccccaaccccctttccaacctagcccatatgggcaaccaggatacccccacgggcccagcccctatcctcaaggtggttacccacaggggccctatcctcagggcggctatcctcagggcccttacccacaggaaggatatccgcagggtccttatccccagggcggatatccccagggcccctatcctcaaagcccatttccaccaaatccgtatggtcagccccaggtgtttccaggacaggaccccgactcaccccagcacggtaattaccaggaggagggccctcctagctactacgataatcaggattttcccgccaccaattgggacgataaaagtatccggcaggcttttatccgtaaggtatttctggtactcacactgcagctctccgttactctgtcgacagtttctgtgtttacgttcgtcgctgaggtcaagggcttcgtcagggaaaatgtgtggacctactacgtgtcctacgcggtgttctttatatctctgattgtcttgagttgctgtggcgactttcgtcggaaacatccatggaacctcgtcgccttgagtgtgctcacagctagcttatcatatatggtggggatgatcgcctcattttataataccgaggccgtgattatggctgtggggatcaccaccgctgtgtgcttcaccgttgtaattttcagcatgcagacaagatacgactttaccagctgcatgggagtcttattggtaagcatggtcgtcttgtttatctttgcaatcctgtgcatttttatacgcaatcggatcctggagatcgtatacgcttctctcggggctctgctcttcacctgtttcttggctgtagatacccagctgctgctcggcaataaacagctgtccttgtccccggaggagtacgtatttgcagcactaaacttgtacactgatatcattaatatttttctctatatcctgaccattatcggtcgagctaaagagtag

SEQ ID NO: 47840 - DNA, 1332 bp, Artificial Sequence
  Description of Artificial Sequence: Synthetic coding sequence
atggccgcccaccggaagcacgtgttcgtggagaaggtgctgcagcgactctttccccctgtgccgtcaggtcagggcaaacgggagccccagactctggcggtccagaatccacctaagaaggttacatcagaaaaggtcagccagaaacacgctgagcccctcaccgacaccggatcagagacccccacagcccgccgactctacaccgcatccggccccccagaaggctatgttccttgttggcctgaaccttctagttgcggctcccctgaaaatgcctcttcaggtgacgatacagaagatcaagatccacatgaccagccgaagcggcggcgaatccggaaacataagagtaagaaaaaatttaagaaccccaacaacgtactgatcgaacaggctgagttggaaaagcagcaatcactcctgcaggaaaagtcccagaggcagcacaccgatggaactacaatcagcaaaaacaaaaagcgcaagctgaaaaaaaagcaacagattaagcgcaaaaaggcagcggggctcgcagcgaaggctgctggagtgtcgttcatgtaccagcctgaggactcttccaacgagggggagggcgtgggcgaagcttgcgaggaggacggcgtcgatacttctgaggaggatccgacactcgccggtgaggaagatgtgaaagatacgcgggaagaagacggcgccgacgcctccgaagaagacctgactagggctaggcaggaggaaggtgccgacgcttccgaggaggacccgacccctgctggcgaggaggatgtgaaagacgcacgggaagaggatggtgtcgacactatcgaagaagatctgacaagggctggggaagaagatggaaaagacacacgggaggaggacggcgctgacgcgtcagaggaagacccaacttgggccggtgaggaagagggagccgacagcggagaagaggacggtgcagatgccagtgaggaggacgataccatcactaatgaaaaggcccactcaattttgaactttctgaaatccacccaggagatgtacttttatgacggggtatctcgagatgcggcttcagctgctttggctgacgccgccgaggagctgctggatcggctggcatctcatagcatgctcccttctgatgtcagtatcctttaccatatgaaaacccttctgcttctgcaggacaccgagaggttaaaacatgccctagaaatgtttcctgagcattgtaccatgccgcccgaccacgcaagagtcatttcagcctttttttcctactggattacccatatccttccagaaaagagctctgattag

SEQ ID NO: 47841 - DNA, 1269 bp, Artificial Sequence
  Description of Artificial Sequence: Synthetic coding sequence
atggccgcccaccggaagcacgtgttcgtggagaaggtgctgcagcggctgtttccccctgtcccatcagggcagggtaagcgggagccccagacactggcggtacaaaatccacctaagaaagtgacctctgagaaggttagccagaagcatgctgagccactgacagacacaggatccgaaactccaacagccagacgcctttatacagcctccggtccccccgagggttacgtgccatgttggcccgaacctagctcttgtggtagcccagaaaatgcttccagcggcgatgacacagaagaccaggatccccacgaccagcccaagcggagaaggattcgtaagcacaagagcaagaaaaagttcaaaaacccgaataacgtgctgattgaacaggcagaactggagaagcaacaatctcttttgcaagaaaaaagccagcgccagcatacggatggaacaaccatcagtaaaaataagaaacggaaactgaaaaaaaagcagcagattaagaggaagaaggccgcaggcttagcggctaaagcagcgggtgtgtcctttatgtaccagcctgaagattctagcaacgagggcgagggggtgggagaagcctgtgaggaggatggcgtcgatacatccgaggaggacccaactttggctggagaggaagacgttaaggacaccagagaagaagacggcgctgacgcctctgaagaagatctgaccagggcccggcaagaggaaggcgccgacgcctctgaagaggaccccactcccgccggagaggaggatgtgaaagatgctagggaggaagacggagtggataccattgaagaggacttaacccgcgcgggggaagaggacggaaaagacactagagaggaggacggagctgatgcatcagaagaggatccgacctgggccggcgaagaggagggggcagattctggcgaggaggacggagccgatgcctctgaggaagacgatacaatcaccaacgagaaggctcattcaatcctgaactttcttaaatccactcaggagatgtatttctacgacggagtttccagggacgctgctagcgcagctttggcggacgcagccgaagaattactggatcggctagcgagccattccatgttgcccagcgacgtgtcaattctgtaccacatgaagacactattgttacttcaggacaccgaaagactcaaacatgctctggagatgtttcccgagcactgcacaatgcccccagctctgacatag

SEQ ID NO: 47842 - DNA, 3948 bp, Artificial Sequence
  Description of Artificial Sequence: Synthetic coding sequence
atgaacttcctgagcaccgccgagagccggaccgcccaggccgccgcctcggggacaacactgcttcctcagtttcgggcaccctcttggcagacgggcatgcattccagtgccgccacagagctgttcgctaccggaccactgccttctacaggcacactgcctccttcactgagcgcatatcagcatcccacaactttttctaatagaaacttcgcgactactagccctttggtccttcaggatagcacatttaacacaacgagtaatggcatcttgtcccaccacgacccgctgctgcagattaaaaccagtcagggcacggtgcctacagccctcgcatttgagcgcctggggtcaagcgtgttgtctaattctatccctccccagtccagtacatatcgctcagcccaagaatccgccccacacctgctgcaacctcaattctctctgttgccatcagctctcggtggctcgcagcaaaccccacaggcctactcttctactctgtttacaagttccacagcctccatcgagagagctctgctgcgggagtgcagcgtcatcaaacatcatcagcgtcctagcggcactcagtccattcaggcccaactcaccggcagccagcactcgctccatagctatctgtccaatagttcggttgtaaatttccaggaaaccactcgtcagtcgagcctgtcatgcagcccaatcggcgacagtactcagaatctccccgattcaagccctacccagaattacatctctatgcactcaagccagaacgtgcagacccaggaatcatcttctccacagagccaaaagttcctgcccgctgtacagtcctcctcttttgcttcttctacccattgtcaaactttacagaataatattacgagccccgaccctaaatcttatgcggagagaaagctcgactcagatgtgtatccctcgtcaaagcaagaggacgggttccctatgcaggaattacaagtgcttcagccccaggcatctttggaatctagcactcagcgtttgtcagacggggaaataaacgcgcaagaaagcacatacaaggtgtccaaagccgatgatcgttattctcagagtgttatcaggtccaattcccggctagaggaccaggtcatcggcgtggcgctgcaagccagcaaaaaggaggaaagcgtagtggggtcagtcactcagctcaaccaacaaataggccaggtgaacaacgctgctactctcgatctgaagaactcaactaacctgatccagaccccccagatcagactaaacactaaagacctaaaacagcaacacccactgatcttgaaggtacacgagagcaaagtgcaggaacaacacgatcaaatcatcaacgcaagtagccagattcaaatacccaaccacgcactgggccacggccaccaggctagtctgccaaacacccaggtgctgcttgacagtgcttgtgatctacaaatcttgcaacagtcaatcctccaagcaggcctcgggcaggtgaaggcatccttgcaggcccagcgagtgcagtcaccacagcagatcgtccatcccttcctgcaaatggaaggccatgtgatccagtccaacggggaccactcacagcaacagctgcatcctcaaaatagtgaagtgatgaagatggacctgtcagagtcatcgaaaccactgcagcagcacctcaccaccaagggacactttagcgaaaccaatcaacatgactcaaaaaaccagtttgtctctctgggaagtatgtgctttccagaagccgttcttctatccgacgagcggaatatcctgagcaatgtggatgatattctagcagcgaccgccgccgcatgtggcgtgacacccaccgatttctctaagagcacctccaacgagacgatgcaggccgtagaggacggggactctaagtcccacttccagcagagcctggacgtgcgccatgttacatcggattttaattccatgactgctacagtcggaaagccacaaaacatcaacgatacaagcctgaacggcaatcaggtcaccgtcaatttaagtcccgtgcctgcactccagtccaagatgaccttggaccagcagcatattgaaacgccaggtcagaatattccaacaaaggttacatccgctgtggtcggaccctctcatgaggtccaggagcagtcttccggaccttttaagaaacagtccgctactaatctggagtcagaagaggacagcgaggcgccagtagactccaccttaaacaataatcgcaaccaggaattcgtgagcagtagcagaagtatttcgggcgagaacgcaacatccgagtccgagtttaccctgggtggcgatgatagcggtgtgtccatgaatcccgcccgaagcgctctcgccctgctggcaatggcccagtccggcgacgcggtgtcggtcaagatcgaggaagagaatcaggacctgatgcatttcaacctgcagaagaaacgcgccaaaggtaagggccaggtgaaagaagaggacaattccaatcagaaacagctcaaacgacccgcccagggaaagaggcagaatcctcgcggaaccgatatttacttaccctacacaccgcctagttctgagagttgccacgacgggtatcagcaccaggagaagatgagacagaaaatcaaggaagttgaggagaaacaaccggaagtcaagacagggttcatagccagcttcctggattttctgaagagtggaccaaagcagcagttcagcactctagccgtaagaatgccaaaccgcacccgccgccccggtacacaaatggtgaggaccttttgtccgcctcctctcccaaagcccagcagtaccacgcctactcccctcgtctctgagactggtgggaacagtccctccgataaggtggataacgagttgaaaaacctagaacatttgtcatctttctcctctgatgaggatgaccctgggtacagccaggacgcttataaaagcgtgtccactccactgacgacactggacgccacatctgacaaaaaaaagaaaacagaagccctgcaagtcgctaccacctctccgaccgccaacacgactgggacagccacgaccagttctaccactgttggtgctgtaaagcaggagcccttgcattcaacctcctacgcagttaatattctggagaacatctcgtcttcagagtcttcaaagcccattgaactcgatggacttccatcagatcagtttgcgaaagggcaagatactgtggcaattgaaggctttactgatgaggaggacactgagtccggcggcgagggccagtaccgtgagagggatgaattcgtggtcaagatcgaggacattgaaaccttcaaagaagctttgaaaaccgggaaggagcctccagctatttggaaggtgcagaaagccctgctgcagaaattcgtcccagagattcgggatgggcagagagagtttgccgctacaaactcatacctgggttactttggcgatgccaagtcaaagtataagagaatctacgtaaagttcatagagaacgccaataagaaagagtacgtgcgcgtgtgcagcaaaaagccacggaataaaccgtcacaaacaatccgcaccgtgcaggccaagccatcttcatcaagtaagacctccgatccactcgcaagcaaaaccacaaccaccaaagcaccctcagtgaagcccaaagtgaagcaacctaaagtcaaggcggagccgccaccaaagaagaggaagaagtggaaagaggaattctcaagttcacagtccgacagcagtcccgagatccataccagtagcagtgatgacgaggagttcgagcctcctgccccttttgtgactcgattccttaatacacgcgctatgaaggaaactttcaaaagctacatggagtag

SEQ ID NO: 47843 - DNA, 5208 bp, Artificial Sequence
  Description of Artificial Sequence: Synthetic coding sequence
atgaacttcctgagcaccgccgagagccggaccgcccaggccgccgcctctggcaccaccctgttaccccagttcagagctccctcttggcagaccgggatgcacagttccgctgctacagagctgttcgctactggccctctgcccagtaccggaactctgccaccaagccttagtgcatatcagcatccgactacatttagcaaccgtaatttcgctaccacttctcccctggtgttacaggactcaaccttcaataccacttcaaacggcatccttagtcatcatgaccctttgttacagatcaagacaagccaagggaccgtacctaccgcattggcctttgagagactaggctcgtcggtgctctccaactctattcccccgcagtcttccacctaccgctccgctcaggagtcagctcctcacctactgcagccccaattttcactgcttccctcagcactgggcggcagccaacagacccctcaggcttatagttctacacttttcacgtcctctacagcttcaatcgaaagggcgctgttgcgtgagtgttccgtcattaaacaccatcagcgcccctctggtacccagtccatacaggcccagcttacagggagccagcattcactacactcatacttatcaaacagctctgttgtcaactttcaggaaacaaccagacagtcctccctgagctgcagcccgattggcgactccacacaggtcagtaacgggggcctacagcagaaaacctctcaggtgtctgtagaactcgctcagtcatatagttccgccatcccgagtagcggttaccctcctagcaccaccaagatcaaatcctgtagcactgaacagccactgacctcaacgaaaacacccaaacctcagtctattattccccccgttcagacattatcttacagtaaaccgttacacaatcagtcctctgtcattagtggccaggcgcagatctatagcacagcgcagttgccgtccctgctaagcgtgtcacaaagccaaaattatggactcgttcagccacacaatgtcccatccatcgtgcattcacaggtctacagaagcagcaaggtggagaagctcccaccactatacaaaaccctgacgttttcagggtccagtcaaaccgtaacccctgagaaccagacactaaactattccagcaaccagcaagaggtgttatcaagcgtcacgaatgaaaactaccctgcccagactcgggacctgtcttcggtctcccagtcacaaagttattcttcggggcattctcaggggctttcacccgtttctcaaacccaggtgtcttattcctcccagagtcaggtcctgtcagtcgtgtccttatctgagtcatatgccagtggcgaatcactgacactcaccgcacccagcctgtcatattctagtgcttcgcgggctcagaatcttccagatagttctcccacacagaactacatttccatgcactcatcccagaatgtgcagactcaggagtcaagctctccccaaagccagaagttcctccccgcagtacaatctagttctttcgcttcaagcactcattgccagacactccagaataacattacctccccagaccctaagtcttacgcagaaagaaagctggattccgatgtatacccatccagcaaacaggaagacggcttcccaatgcaggaattacaggtgcttcaaccccaggccagccttgagagcagcacccaaaggttgagcgatggggaaattaacgcgcaggaatctacatataaagtgtccaaagcagacgatagatattctcagagtgtcattaggagcaacagtcgcctggaagaccaggtgataggagtggctctgcaagcgtccaagaaggaagaatctgtcgtcggatctgtaacacagctgaatcaacagattggccaggtgaataacgctgccacattggatctgaaaaactccaccaatctcatccaaacaccccaaatccgtctcaacaccaaggacttgaaacagcagcatccactgattcttaaagttcatgaaagcaaggttcaggaacaacacgatcagatcatcaacgccagctctcagatccagatacccaaccacgcactcgggcacggccaccaggcttcattacccaacacacaagttctgctcgattctgcctgcgatcttcaaattcttcagcagagtatcctgcaagctggcctaggacaggtaaaggcatcgctgcaggcccagagagtgcaaagccctcagcaaattgtacacccctttctgcagatggagggccatgtcattcagtccaatggggaccatagtcagcagcaactgcacccacaaaacagtgaggtgatgaagatggatctgtccgaatcctccaaacctctgcagcagcacctcacgaccaagggccacttctctgaaactaatcaacatgattccaaaaaccaattcgtgtcacttgggtctatgtgcttccccgaggccgttctcctctcggacgagaggaatatcctgagtaatgttgatgacatactggccgcgacagccgcggcctgcggtgtgacccccaccgatttctcaaagtctactagtaacgaaaccatgcaggccgtggaagatggcgattccaaatcccatttccaacagtcactggacgtgcgccatgtaaccagcgatttcaacagcatgaccgcgaccgtgggaaagcctcagaacattaatgacaccagcctaaacgggaatcaggtcaccgttaacctgtcgcctgttccagccctgcaatcgaagatgactctggaccagcaacatatagagactccaggccaaaacatccccactaaagtcacttcagctgtggtcggaccatcccatgaagtgcaggagcagagcagcggaccctttaaaaagcaaagtgctaccaacttggagtcagaggaggacagcgaagcgccggtggatagcaccctgaataacaatcgaaaccaagaattcgtcagctccagcagatccatcagcggggagaacgctacgagcgaatccgagtttacattagggggagatgattcaggagtttcaatgaacccagctcggtccgccttagctttgctcgccatggcacaatcgggggacgcggtatccgtaaaaatcgaggaggagaatcaggacctgatgcactttaacctccagaagaagcgcgcaaaggggaaggggcaggttaaggaggaagacaattcaaaccaaaagcagctcaagagaccagcccagggaaaaaggcagaacccgcgtggaactgatatttatctgccatatactcctcctagttcggagtcctgtcacgatgggtaccaacaccaagagaagatgagacagaaaatcaaggaggtcgaggagaagcagcctgaagtcaaaaccggatttattgctagcttcctggactttctcaaatccggacctaaacagcaattctcaacactcgctgtgcggatgcccaatcgtactagacgtcctggcacccagatggtaagaaccttttgcccacctcccctccccaagccaagcagcactacacccacgcctctggtgtctgagacaggtggcaattccccatccgacaaggtggacaatgagctcaagaacctcgagcacttaagctccttctctagcgacgaagatgaccccggatattctcaagatgcgtataagtccgtcagtacccccctcacaacattagacgctacaagcgacaaaaagaagaaaaccgaagcattacaggtggcgaccaccagcccaacggcgaatactacaggtaccgccaccacgagtagcacaacagtgggagccgtgaaacaagaacctttacacagtacctcgtacgctgtgaatatactggaaaatatctctagttctgagtccagcaaacctatagagctagatggccttccatctgaccagttcgcaaaaggccaggataccgttgctatcgaaggcttcaccgacgaggaagacacggagtccggaggggagggtcagtaccgggaacgggatgagttcgtggtcaagatcgaagacatcgaaacgttcaaagaggccttaaaaacaggcaaagaaccaccagctatatggaaggtgcagaaggccctgcttcagaagtttgtgcccgaaattagggatggccaaagagagttcgccgctacaaactcttacctggggtatttcggcgatgcaaaatctaaatacaagagaatttacgttaagttcatcgagaatgcaaacaagaaggaatatgttcgcgtctgtagtaagaagccaagaaacaagccctcccaaaccatcagaacagtgcaggccaaaccctcctcatcaagcaaaacttctgatccactggcgagtaagacgaccaccaccaaagctcccagtgttaaacccaaggtgaaacagcccaaagtcaaagcagagccgcctcccaagaagcggaaaaaatggaaagaagaattcagctcctctcaatccgattcctcccccgaaatccacacctcttcgtcagacgacgaggagtttgagccacccgctcctttcgtaacccgctttctgaatacaagagccatgaaggaaacattcaagtcatacatggaactcctggtctctatcgccctcgaccctgataccatgcaggccctagaaaagtcaaatgacgagctgttgcttccacatatgaagaagattgacggtatgttgaacgacaaccggaaacgcctcctgctgaatcttcacctcgaccagtccttcaaaaatgctcttgagtcctttcccgaactgaccattatcacgcgggacagcaaggctaagtccggcgggacagccatatccaaaattaaaatgaacggcaaggcctataataagaagacactgagaacctctaagactaccaccaaatccgcacaggagttcgctgttgacccagaaaagattcaattatacagcctgtaccactctcttcaccactataagtaccacgtttacctgatctgtaaggatgagatctcaagtgtgcaaaagaagaatgaagatctcggacaggaagaaattgtgcagctctgtatgaaaaatgtgaaatgggtggaagacctgttcgagaagttcggggaactcctgaatcatgtgcagcaaaagtgcagctag

SEQ ID NO: 47844 - DNA, 195 bp, Artificial Sequence
  Description of Artificial Sequence: Synthetic coding sequence
atgaacttcctgagcaccgccgagagccggaccgcccaggccgccgcttccgggacaacactgttgccgcaattcagagccccctcatggcagacagggatgcacagcagcgctgccactgaacttttcgctaccggccctctgcctagtacgggtacactgccaccctcccttagcgcctaccagcacccttag

SEQ ID NO: 47845 - DNA, 4992 bp, Artificial Sequence
  Description of Artificial Sequence: Synthetic coding sequence
atgaaggacgccgccgaggagctgagcttcgcccgggtgctgctgcaacgcgtcgatgagcttgagaaactgttcaaagatagagagcaattcttggaattggtgagccgcaagcttagtctggtcccaggtgccgaggaggtgacaatggttacctgggaggaactggagcaggccatcacagatgggtggcgcgctagccaggctggatctgaaaccctgatgggatttagcaaacacggaggcttcacaagcttgacaagcccagagggtaccctctccggtgatagtaccaaacagccttcaatagaacaggcactcgattcagcaagcggtctcggtcccgacagaacagcatcaggctctggcggaaccgcacacccaagcgacggcgtcagctcccgcgagcagagtaaggtgccatctgggactggacggcaacagcaaccgagggcacgagatgaggctggcgtgcctcggttgcatcagtcgagcacgttccaattcaagagcgactcggatagacacagatcccgcgaaaagctgacaagcacccagccaagaaggaacgccaggcctggacccgtgcaacaggacctcccattggcccgcgaccagccaagctccgtccctgccagccaatctcaggtgcacttgcggcccgaccgccgaggcctcgagcccacaggtatgaaccaacctggtctcgtgcccgctagcacgtacccccacggcgtggtgcctctgagtatgggtcagcttggtgtaccccccccggagatggacgatcgtgagctgatcccgttcgtcgtagatgagcagcgcatgctgcccccatctgtccccggcagagatcagcagggcttagaactcccttctacagatcagcacggtttagtgtctgtgtcagcttatcagcatggaatgactttccccggaaccgaccagaggtccatggagcccctgggaatggaccagcgcggctgcgttatcagcggcatggggcagcagggcctcgtgccgcctggtatcgatcagcaaggcttgacgctgcctgttgtagatcagcacggtctggtcctacccttcaccgaccagcacggcctggtctccccaggactgatgccgatttccgctgaccaacagggttttgtccaaccttcccttgaagccacaggctttatccaacctggcactgaacagcatgaccttatacaatctggacggtttcagcgggccctggtgcagcgaggggcctatcagcccggcttggtccagcctggtgcagaccagcggggcctggtcagacctggcatggatcagagcggcttggctcagccgggcgccgatcagcgcgggctcgtatggcctggcatggaccagtctggtctcgcgcagcctgggcgggatcagcatgggcttatccagccaggaaccgggcaacatgatctggtgcagagcggaaccggacagggcgtgctggtgcaaccaggtgtcgaccagcctggaatggtccagccaggacggtttcagcgcgcactggtccagccgggagcgtaccagcctggcttagtccagcccggagcagatcagattgatgtcgtgcaacctggagcggatcaacatggcctggtgcagagcggtgccgaccagtcagatcttgctcagccaggggccgttcaacacgggctcgtgcagcctggggtggaccagagaggcctggcgcaacccagagcagatcatcaaaggggcttggtccccccaggcgctgaccaaaggggacttgttcaacccggagcagatcagcatggcttggtgcagccaggcgtggaccagcatggcctggctcagcccggggaggtccagcgatctctggtgcaacccggcattgtccaacggggactagtacagccaggcgccgttcaacgcggactggttcagcctggtgccgtgcagcgcggtctggtgcagccaggagtcgatcagagaggcctcgtgcagccaggggccgttcagcgggggctggttcagccaggcgccgtccagcacggattggtccaacccggggctgaccagaggggcttggttcagcctggggttgatcagcgcgggttagtgcagccgggcgtcgaccagagaggcctagttcagcccggcatggaccagagagggctgattcagcccggcgctgaccaaccaggactggtccagcctggggctggtcagctgggcatggtgcaacctggaatcggacagcagggaatggttcaaccacaggctgatcctcacggcttggtgcagcccggagcctacccattggggctggtgcagccaggagcctacctccacgacctgagccagtccgggacctacccgcgtggcctggtgcaaccaggaatggatcagtacggactgagacagccaggggcctaccaacccgggctgattgccccaggcaccaaactacgaggttcaagcacctttcaggcggatagcaccgggttcatttccgtcaggccttaccaacacggtatggtaccgcccggccgcgagcagtacgggcaagtctccccactgctcgcctcacagggcttagcctctccggggattgatagacgcagcttggtaccccccgagacctaccagcagggccttatgcatcctgggacagatcagcattccccaataccccttagcactggtttgggctcaacccatcctgatcaacagcatgtggcatcgcccggtccgggggaacatgaccaggtctacccagacgccgcccaacatggacacgccttcagtctgtttgactcccatgactcaatgtacccgggctacaggggacccggatatttgtccgctgaccagcacggtcaggaggggcttgatcctaatcggacccgcgcatccgacagacacggcatacctgctcagaaagctccaggtcaggatgtgaccctgttccgttcacccgatagtgtggacagagtactgtctgagggctcagaggtatcctcggaagttctcagcgagcgaagaaatagcttgagacgtatgtctagttctttcccaacagccgtggagaccttccacctgatgggcgagttaagctcactttatgtggggctgaaggaatctatgaaggatctggatgaagaacaggctggccagaccgacctagaaaagattcagttcctgctggcccagatggtaaagcgtacaataccgccagaactgcaggagcagcttaaaacggtgaaaaccctcgctaaagaggtgtggcaggagaaggccaaggtggaacgccttcaaagaattttggagggcgaagggaaccaggaagctggaaaggaactgaaggccggtgaactccggctccagctgggcgtcctgcgggtgaccgtggctgatatcgagaaggaattggccgaacttagagaatctcaggatcgtggcaaagctgcgatggaaaattccgtgtcggaagcaagtctctacctgcaggatcagctggacaagctccgaatgataattgaatccatgctcacatcttctagtactttgctttctatgtctatggcacctcataaagctcacactcttgcgcctggccagatcgacccagaggccacctgtcccgcatgctcacttgacgtgtctcaccaggtgagcactctggtgcgccggtacgagcaattgcaggacatggttaacagcttggctgtgtcccgaccaagcaagaaggccaagctccagagacaagacgaggagctgctgggcagggtgcagtctgccatccttcaggttcagggggactgcgagaaacttaatattactactagcaacctcatcgaggaccatcgccaaaaacagaaggatatcgctatgctgtaccaagggttagagaagcttgagaaggaaaaagcgaatcgagaacatctcgaaatggaaattgacgtcaaagccgataagtcagccctcgctacaaaggtgtcccgcgtgcaattcgacgccactacagaacagctgaaccatatgatgcaggagcttgtggctaagatgtcgggacaggagcaggactggcaaaagatgctggatcggttgctgacggaaatggacaataaacttgatcgacttgaactagaccccgtcaagcagctgctcgaggatagatggaagtccctgagacagcagctcagagaacggccacctctgtaccaggctgatgaagctgccgcaatgcggcgccagctgctcgctcacttccattgtctatcttgcgataggccattggagacccccgtcacaggccacgcaattcctgtgactcccgctggccccggcctccccggccaccatagcataagaccttatacagtgttcgagttggagcaggtccggcagcacagtcgaaatctaaagttaggcagcgccttcccccgaggggatcttgcacagatggaacagtcagtaggcagacttaggtccatgcattcaaagatgctaatgaatattgaaaaggtgcagatacacttcgggggctcgacgaaagcgagctcgcagatcattagagagctcctccatgcacagtgtctcggttccccctgctacaaaagagtaaccgacatggccgattacacctactccacagttcctagacgctgcggcggctcacacacgctgacttatccatatcatagatctagaccacagcacctgccaagaggcttataccccaccgaagaaatccagattgcaatgaaacatgacgaagttgacatcctcgggctggatggacatatttataaggggcggatggacacgcggctgccaggcattctccggaaagattcttctggcactagcaagcgcaaatctcagcagccccggccccatgtacacagaccgccatccttgagctctaatggccagcttccatcaagaccacagtctgcccagatttcagcgggcaacacctccgagcgctag

SEQ ID NO: 47846 - DNA, 4290 bp, Artificial Sequence
  Description of Artificial Sequence: Synthetic coding sequence
atgaaggacgccgccgaggagctgagcttcgcccgggtgctgctgcagagggttgatgagcttgagaagttatttaaagatagggagcagtttctggagctggtgtcccgcaagttgagcttggtgccaggcgcagaggaggtcacaatggttacgtgggaggagctggagcaagccatcaccgatgggtggcgcgcttctcaggccggttctgagaccctgatgggattctcaaagcatggaggattcacatccctcacaagtcccgagggcacactgtccggggactctactaaacagccaagcatagaacaggcactggactcggcaagtggcctgggccccgacagaactgcatccggcagcggtggcaccgcgcatcctagtgacggagtgtcttctagggaacagtctaaggtgccatccggcacagggaggcagcagcagcctcgagccagagatgaggctggtgtgcccaggctgcatcaaagctctacgttccagttcaagagcgatagtgacagacatcggagtcgagagaaactgaccagcacccagccccggagaaacgcacgtcccggacccgtgcaacaggatctgcctcttgcacgggatcaaccctctagcgtccctgccagccagtctcaggtccatctacgccccgatcggaggggccttgaaccgacggggatgaaccagcctggcctcgtgcctgctagtacttacccccatggagtggtgccactgagtatgggacagctcggagtacccccaccagaaatggatgatagggaactgatccctttcgtggtcgatgagcagcgtatgcttccccccagcgtgcccggcagagatcagcagggcttggaactgccgtcaactgatcagcacgggctcgtcagcgtcagtgcttatcagcacggcatgactttccctggaactgatcaacgatctatggagccgttgggtatggaccaacgaggttgtgtgatcagcggcatgggccagcaaggccttgtgccgccaggcattgaccaacagggcctgacactgcccgttgttgatcagcatggcctcgttcttccgtttactgaccaacacggccttgtctccccaggacttatgccgatctctgctgatcagcagggatttgtgcagcccagcctggaggctaccggtttcattcaacctggtaccgagcagcacgatctgatccaatcaggcaggtttcaacgagcattggtccagaggggggcatatcaacctgggctggtccagcccggcgcggatcaacgcgggctcgtgcggcctgggatggatcaaagcgggttagcccagccaggcgccgaccagcggggactggtttggcccggtatggatcagtccgggctggcacagcctggacgtgaccagcacggcttaatccaacctgggaccggacagcacgacctggtgcaatcaggcacaggtcagggtgtcctcgtgcaaccaggggtcgaccaaccgggcatggtacaacccggtcgcttccagagagccctcgtgcagccaggggcataccagcccggcctagttcagcccggcgccgatcagattgatgtcgtccagcccggggctgatcagcatggtctggtgcagagcggagctgatcagagcgacctcgcacagcccggagcagtccagcacggactcgtgcaaccaggggttgaccaacgtggactcgcgcagccccgtgccgatcatcagagagggttggtgccccctggcgcagatcagcgcggtttagtgcagcctggggccgatcagcatggcttagtgcagcctggggtggaccagcacggactcgcccaacctggtgaggttcagcgctccttagtccagccaggaatagtccagcgcggactggtgcagcccggtgctgtgcagagaggcttggtccagcccggcgccgtccagagaggactcgtgcaacccggcgtcgaccaacggggcctcgtgcagcctggcgccgtccagcgcggcttggtccagccaggagccgtgcagcatggtctcgtacagccaggagcagaccaacgcggccttgtccagccaggcgtggatcaacgaggtctggtgcagcccggcgtggatcagcgcggcttggttcagcccggaatggaccagagaggtctgatccaaccaggggccgatcaacccgggctagtgcagcccggggccgggcagctgggtatggtgcagcctgggattggccaacagggcatggtgcagccacaggccgacccacatggcctagtgcagcctggggcctacccactcggcctagttcaacccggcgcttacctccacgacttatcccagagcggcacttatccaagggggctggttcagcctggcatggatcaatacggtctcagacagcccggtgcgtatcaaccaggactgatcgcccccgggacaaagctccgcggctccagcacttttcaggctgactctaccggatttatatctgtgcgcccctaccagcacgggatggtgccccctgggagggagcagtatgggcaggttagccctctactggcaagtcagggccttgcatcgccagggatagataggaggagcctggtgcctcctgagacatatcaacaggggctcatgcatccaggaaccgaccagcattccccaatccccctatccaccgggctgggcagcacccaccctgatcaacaacacgttgctagccccggaccgggcgagcacgatcaggtgtacccagatgctgctcagcacggtcacgccttcagcctgtttgatagtcatgactcaatgtacccaggctatcgtggacccggctacctgtccgctgatcaacacggccaggaggggctcgaccccaacaggacccgggcttccgacagacacggcattccagcccagaaggcccctggccaggacgttacccttttccgaagcccggacagcgttgaccgcgtgctgtccgagggatcagaagtgtcatcggaggttctgtctgaaaggcggaacagcctgcgaagaatgtctagctcatttcctacagccgtcgaaaccttccacctgatgggcgagctgtcctccctttatgtgggcctgaaggagagcatgaaggatttagatgaggaacaagcagggcagactgatctggagaaaattcaattcctcctggcccaaatggtcaaaagaaccatcccccctgagcttcaagagcagttgaagacagtaaaaactttagctaaagaggtctggcaagagaaggccaaagttgaacggctacaaagaatcctagagggggaaggtaaccaggaagctggcaaagaactgaaggccggtgaacttcgtctgcagctgggcgttctgcgcgttaccgtcgccgatatcgaaaaggagctggccgaactgagggaatctcaggatcgcgggaaggcagctatggagaacagcgtctcggaggccagcttatacctacaagatcaactggataagcttcgcatgattatcgagagcatgctgacaagttcaagtactttgctgtccatgtcaatggctccacataaagcacataccctagctcccgggcaaatcgaccccgaggccacatgtccagcctgtagcctagacgtgtctcaccaggtatctacgttggtgaggcgctacgagcagttgcaggatatggtcaattcactcgccgtgagccgcccctccaagaaagccaaactgcagcgtcaggatgaggaattgctgggccgagtacagtctgccattctgcaggtccagggcgactgcgaaaagctgaatatcacaacaagcaacctgatcgaggatcatcgccagaagcaaaaagatattgcaatgttatatcagggcctggagaagctcgagaaagaaaaggcaaaccgtgagcatctcgagatggagattgacgttaaagccgacaaatcagcattagccacaaaagtgtcgcgtgttcagttcgacgccacgactgaacagctaaaccacatgatgcaggagcttgtagccaaaatgtctggccaggagcaagattggcagaaaatgctggaccgtctgcttacagaaatggataataaactgccaggtatcctgaggaaagactcttcgggtacatcgaaaaggaaaagccagcagcccagaccccatgtacaccggccaccatcactcagctctaatggtcagttaccttctcggcctcagtccgcgcaaatttccgcaggcaacacctccgagagatag

SEQ ID NO: 47847 - DNA, 2331 bp, Artificial Sequence
  Description of Artificial Sequence: Synthetic coding sequence
atgaacaacagcctggagaacaccatcagcttcgaggagtacatcagagttaaagctagatccgtgcctcaacatcgcatgaaagagttcttagatagcctggcgtcaaaaggaccagaagccctacaggaattccaacaaaccgccacaactactatggtgtaccaacagggcggcaattgtatctacaccgattccactgaggtggccggcagtctcttggaactggcttgccccgtcaccacatcagtgcagcctcaaacccaacaggagcagcagattcaggtccagcagccccagcaggttcaagtccaggttcaggtccaacagagccctcaacaggtgtccgcacagttatccccccagctcacggtccaccagccaacggagcagcccatccaagtacaggttcagatccagggccaggcccctcagagtgccgcccccagtatccagaccccctcacttcaatcaccttctcccagccagttgcaggccgcccaaatccaagtgcaacatgttcaagctgctcaacaaatccaggcagcagaaatccccgaagagcacatcccccatcagcagatccaggcacaactcgtggctggacagagcctagccggcggtcagcagatacaaatccagaccgtcggcgctctgtctcccccaccaagccagcagggatccccccgcgagggcgaacggagagtggggacagcttcggtcctgcagcccgtaaaaaagcgcaaggttgacatgcctattaccgtttcttacgccattagtggccaacctgtagccaccgtcctggctatcccacaggggcagcagcagagctatgtcagcctcagacctgatcttctgacagttgacagcgcccatctttatagtgccaccggcacaataacaagtccaactggcgaaacctggactatcccagtgtatagcgcccagccccgtggagacccccagcaacagtccattacacatattgctataccccaggaggcctataatgcagtgcacgtttctgggtcgcccactgccctggccgcggtcaaacttgaagatgacaaagaaaagatggtgggaaccacatcagtcgtcaaaaacagccacgaggaagttgtacagacactcgccaacagtctgtttccagcccagttcatgaacgggaatattcacatccctgtagccgttcaagccgtggccggtacctatcagaacactgcacagaccgttcacatttgggatccccagcagcagcctcagcagcagactccacaggagcagacaccgcccccgcagcagcagcaacagcagctacaggtgacgtgctctgctcagaccgtgcaagttgcagaggtcgaaccccaaagccagccacaaccttccccagagttgttgttaccaaatagcttgaagcccgaagaggggctggaggtgtggaagaattgggctcagacgaagaatgcggagctggagaaggacgcccagaaccgactagcgccgattggcaggcgccagttgctgcggttccaggaagatctgattagctcagccgttgccgaacttaattatggattgtgcctcatgactagagaagctaggaatggcgagggtgagccatacgaccctgatgtactgtattacatattcttatgtatccagaaatatctgtttgaaaatggtcgggtggatgatattttttcagatctgtattacgtgagatttaccgagtggctgcacgaggtgttgaaggacgtgcaaccgagagtcacaccactgggatacgtccttcccagccatgtaaccgaagagatgctttgggaatgtaaacagctgggcgctcattcaccgtccactttactcactacgttaatgttcttcaatacaaagtattttctcttgaaaactgtagatcagcatatgaagctcgcattttccaaggtgctgcgccaaaccaaaaagaacccttcaaatcccaaagataaatctacttcgattcgataccttaaggccttggggatccaccagacaggccagaaagtcacggatgatatgtacgccgaacagacagagaacccagagaaccccctgagatgtcccatcaagctatatgatttttacttgttcaaatgcccccagtctgtgaagggtaggaacgataccttctatctgaccccagaaccggtcgttgcacctaattcccccatatggtacagtgtccagcctatttcccgcgagcagatggggcaaatgctgaccaggattcttgtgattcgggaaatccaagaggcaatcgcagtggcaaatgctagtactatgcactag

SEQ ID NO: 47848 - DNA, 2331 bp, Artificial Sequence
  Description of Artificial Sequence: Synthetic coding sequence
atgaacaacagcctggagaacaccatcagcttcgaggagtacatcagagtgaaagcccggtctgtcccacagcatcgaatgaaggagtttctggacagcctggcctctaaaggaccggaagccttacaggaatttcaacagaccgcaactaccaccatggtttaccaacaagggggcaactgcatttataccgactctacagaggtggcaggctcgcttctcgagctggcatgcccagttacaacctcagtgcagcctcagacgcaacaggagcagcagatacaggttcaacaaccacaacaggtgcaggtccaggtgcaagtccagcagtctccgcagcaggtatctgcacagctgtctccgcaattgaccgtgcaccagcctaccgagcaacccatccaagtacaggtgcagatccagggacaggccccacaaagcgccgcaccctcaatccagacacccagcctgcagagccctagccctagtcaactccaggcggctcaaattcaagtgcagcatgtgcaagccgcgcagcagatccaggcagctgaaatacccgaagagcacattccccatcaacaaatacaggcccagctcgtcgcaggccagtcactcgcaggagggcagcaaatccaaattcagacagttggcgcacttagtcccccaccttcccagcagggaagccctcgggaaggcgagcgccgggtgggaacggccagcgtcctgcagcccgtcaagaagcggaaagtagatatgcctataaccgtgtcatatgccatctcaggacaaccagtggccacagtgctcgccattccacagggccagcagcagagctatgtgtccctcaggcctgatctgctaacggtggactcagcccacctctattcggccaccggaacaatcacctcacccactggagagacttggaccatccccgtgtattcggctcaacctagaggggacccccagcaacaatcaattacacacatagccattcctcaggaagcctacaatgcggtacacgtgagtggcagtcccactgcgctcgctgccgtgaaactggaagatgacaaagagaaaatggtcggaactaccagcgttgtcaagaattcccatgaggaagtcgtccagaccctggctaactccttatttccagctcagtttatgaatggcaacattcatatccctgtggctgtgcaggcagtggctgggacctatcagaatacagcccaaacagtccacatctgggacccacagcagcagccccagcagcagaccccccaggaacagaccccgcctccacagcagcagcaacaacagctgcaggtgacctgtagcgcgcagaccgtgcaggttgccgaggtggagccacagtcacagccccagccttcaccagagctgcttctccccaactcccttaagccagaagagggcctggaggtgtggaaaaattgggcccaaacgaagaacgcagagcttgagaaagatgcccagaatcggttggccccaatcggtagaagacagctcctgcgcttccaggaggacttgatttcctctgccgtagcagagctcaattacgggctttgcctcatgactcgcgaagcacgaaacggcgagggagaaccctacgaccctgacgttctgtattacatcttcttgtgcattcaaaaataccttttcgaaaatggccgtgtggacgacatcttcagcgacctgtactacgtgcgattcactgaatggctgcacgaggtgctcaaggacgtgcaacccagagtaacccctctggggtatgtcttgccttctcacgtgacagaggaaatgctgtgggaatgcaagcagctcggggctcacagtccttcaaccctgctgactaccctgatgttctttaatacaaaatatttcctgcttaaaaccgtagaccagcatatgaagctcgcattcagtaaagtgttgaggcagaccaaaaagaaccccagcaaccccaaagataagtctacttccatccgttaccttaaagcactaggaatacatcaaactggtcagaaggttaccgatgacatgtacgccgagcagaccgagaatcctgagaatccactgcgctgccctatcaagctgtacgacttctacttatttaagtgtccgcagagcgtgaaggggaggaatgacactttttacctaacaccagaacctgtagtggccccgaactcacccatctggtactctgttcagcccatctcaagagagcagatggggcagatgctgacgcgaattctagttatccgagagatacaggaggccatcgctgtggcaaacgcaagcaccatgcactag

SEQ ID NO: 47849 - DNA, 2331 bp, Artificial Sequence
  Description of Artificial Sequence: Synthetic coding sequence
atgaacaacagcctggagaacaccatcagcttcgaggagtacatccgcgtgaaggcaagaagcgtgccgcagcaccgaatgaaggagttcctggattcacttgctagcaagggtcccgaggcacttcaagagttccaacaaacagctaccaccactatggtctaccagcaagggggcaactgcatatataccgactccacagaagtcgccggatccctcctggaactggcctgccctgtgaccacttcggtgcagccccaaacacaacaggagcagcagattcaggttcagcagccacagcaggtgcaggtccaagtgcaggtgcagcagtcacctcagcaggtcagcgcccagctgtcaccccagctgaccgttcaccagcccacagagcagcccattcaggtgcaggtgcagatccaaggccaagccccccagtcagctgccccttcaattcaaacaccctcactccagagtccttcgcccagtcagctccaggctgctcagatccaagtgcagcacgtgcaggccgctcagcagatccaagccgccgagatcccagaggagcacatccctcatcagcaaattcaggcgcagttagtcgctggccagagcctggccggaggccagcagattcaaattcagactgtgggtgccctgtcaccgccaccatcacagcaggggtctccgcgggagggagagcgccgtgtggggacggcaagtgtcctgcagcccgtgaaaaaacgcaaagtggatatgcccattactgtgtcatatgctattagcggccagccagtggccacagtgctggctattccccaaggtcagcaacaaagttatgtgagcttacgccctgatctgcttactgtggatagcgctcatctgtatagtgccactggcactattacctcacccaccggggaaacatggactatccccgtctacagtgcccagccacggggcgaccctcagcaacagagcatcacgcacatcgccattccacaggaggcatacaacgcggtgcacgtttcgggatctcccacggccctcgccgccgtgaagttggaggatgataaagaaaagatggtcggtactaccagcgttgtcaagaactcccacgaagaggtagtgcagacactggccaattccctgttccccgctcagtttatgaatggcaatatccacatccccgttgccgtccaagctgttgctgggacctaccagaacactgctcagaccgtgcacatctgggacccccagcagcagccacagcagcagacaccacaggaacaaaccccaccgccccagcagcagcaacagcagttacaggtgacgtgctctgcccaaacggttcaggtggccgaagtggagcctcagagccaacctcagccaagcccggaactgttattacctaattccctcaagccagaagagggcttagaagtctggaaaaactgggcccagacaaagaacgccgaactggaaaaggacgcacagaataggttggcgcccatcggacggcgccagttgcttaggttccaggaggacctgatctcaagcgctgtggctgaactgaattatgggctgtgtctgatgacacgagaggcccgcaatggagagggagaaccttatgatcccgatgtcctgtactacatttttctttgcattcagaaatatctgttcgaaaacggcagagtagacgacatcttcagtgatctatattacgtaagatttaccgagtggctgcatgaggtgcttaaagacgttcaaccccgcgtaacccccctggggtatgttttgccatcgcacgtgacagaggaaatgctctgggaatgtaagcagttgggcgcccacagcccttcaacgctgctcacaacacttatgttctttaacacaaaatattttttgctgaagaccgttgaccagcacatgaagctcgccttttccaaggtgttacgtcagaccaagaaaaacccttcaaatcccaaggacaaaagcacatcaattagatatctgaaggcactagggatccatcagacaggacaaaaagttacagatgacatgtacgctgagcagacagagaacccagagaaccctctccggtgccctatcaagctgtatgacttctacttgtttaagtgcccccagagtgtgaaggggcgtaacgacacattctacttgacaccagagcctgtagtggctccaaactcacccatctggtactctgtccaaccaattagtagagagcagatgggtcagatgctcacgcggattctggtaatcagggagatccaggaagcaattgctgtggctaacgcttccaccatgcattag

SEQ ID NO: 47850 - DNA, 747 bp, Artificial Sequence
  Description of Artificial Sequence: Synthetic coding sequence
atggaggaccccgagaagaagctgaaccagaagagcgacggcaagccaaggaaggtgaggttcaaaatctccagcagttacagtgggcgcgtcctcaagcaggtgttcgaagatggtcaggagctggagtcacccaaggaagagtacccccattctttcctgcaggagagcctggaaactatggatggagtctatggtagcggtgaagtgcctcggcctcagatgtgcagcccaaagctcaccgctcagaggattagcgtttttcgggaggggaatgcctatacactggcggggggtcagcccagattcaacgattataaggcaaatgatcacaagcctctgcctatcatagacttcggtaaaatcatcatctatactaacaacttgaagattattagaacccccatggacaagcgggattttgtaaggaaaattcttcagaaagaggaagaggcagaagaagagtctttgatgaacaaggaggagtcttatggaggtcgagatcagcatgatagacctctcgtggaagctgagtctaccctgccacagaatcgctatacccaggaaggagacatccccgaggacagttgttttcactgcagggggagcggttccgccacctgcagcctctgccatgggagcaagtttagcatgctggccaataggtttaaagaatcgtatagggccctgcgctgccccgcatgcaatgagaacggacttcagccctgccagatttgtaaccagtag

SEQ ID NO: 47851 - DNA, 666 bp, Artificial Sequence
  Description of Artificial Sequence: Synthetic coding sequence
  Description of Combined DNA/RNA Molecule: Synthetic coding sequence
atgttccagcagttccaggccagctgcctggtgctgttcttcctggtgggcttcgcccaacagacgctcaaaccccagaatcggaaggttgactgtaataagggcgtaacgggcaccatttacgagtatggagccctgaccctcaacggagaggaatatattcagtttaagcagtttgcaggtaagcacgttttattcgtcaacgtggcggcctatugagggttggctgcgcagtacccagaattaaacgcactgcaggaagagctcaagaacttcggcgtgatcgtcctcgcgtttccctgcaatcagtttggtaaacaggagccaggcaccaactcagaaatccttttaggattgaaatatgtctgtccaggtagtggatttgttccaagcttccagcttttcgagaagggagacgttaacggcgaaaaggaacagaaagtctttacatttctgaaaaattcctgtcctcccacctcagacctgctgggctcttctagccaattgttttgggagcctatgaaggtgcacgacataagatggaacttcgaaaagttcctggtgggccctgatggcgtccccgtgatgcactggttccaccaagctcctgtgtccaccgtcaaatccgatattcttgagtatcttaagcagtttaacactcattag

SEQ ID NO: 47852 - DNA, 216 bp, Artificial Sequence
  Description of Artificial Sequence: Synthetic coding sequence
ctgaccagcttccgggtggtgcacaccatccccatgatcaagagcttcttcaattacctgagccccaagcatttaaaatttcaggtggactgcaacaaaggggtgaccggcacaatttacgagtacggtgctctcaccctgaatggtgaggagtatatccagtttaagcaatttgctggcaagcacgttctctttgtgaatgtggccgcttattag

SEQ ID NO: 47853 - DNA, 1590 bp, Artificial Sequence
  Description of Artificial Sequence: Synthetic coding sequence
atgagcggcctgctgaccgaccccgagcagcgggcccaggagcccaggtacccaggattcgtgttagggttggatgtggggtcgagcgttattcgatgccatgtatacgatagagctgctcgggtgtgcgggtcttcagtacagaaagttgaaaatctgtacccacaaatcggatgggtggaaatagaccccgatgttctctggattcagtttgttgctgtaataaaggaggccgtgaaagcagccgggattcagatgaatcagatagttggactggggatctctacacaaagagcaactttcattacctggaacaaaaagacggggaatcatttccacaactttatcagctggcaggatctccgggcagtcgagctggttaaatcttggaataactccctcctcatgaagatattccactctagctgccgtgtgctccatttttttacccggagcaagaggttgttcactgcttctctgtttactttcacaacgcagcagaccagcctcaggcttgtctggatactccagaatctaacagaagtgcagaaggccgtggaggaggaaaactgttgcttcggaaccatagatacatggctgttgtacaagctaacaaaaggatctgtttacgcgacagatttctcaaacgcctcgacaacgggcctgtttgatccatacaagatgtgttggtctgggatgatcacaagtctgatctccatacccctctccctgctcccccccgtgcgggacacctctcacaattttggaagtgttgacgaggagattttcggcgttcccatccccatcgtagcactggtcgctgaccagcagtcagcgatgtttggggagtgctgtttccagaccggcgatgttaagttaactatgggcactggaacattcctggacatcaacactggcaatagcctccaacagacaaccggggggttctatccactaatcgggtggaagatcgggcaggaggtggtgtgtctggcagaatcaaacgccggggatacaggaactgccatcaaatgggcccagcagctcgatctctttacagacgcagctgaaaccgagaagatggcaaaatcactggaggattcagagggtgtgtgcttcgtgcccagcttctccgggctgcaagcacccctcaacgacccctgggcatgcgcttcgttcatgggactgaaacctagcacctcgaaatatcacctggtcagggctattctagagtcaattgcctttcgtaacaagcagttgtacgagatgatgaaaaaggaaattcatatcccagtgcgaaaaattcgggccgatggtggggtgtgcaaaaatgggtttgtgatgcagatgacttcagaccttatcaacgagaatattgatcggccagccgatatcgacatgtcatgcttgggagctgccagcctggcaggattggctgtcggcttctggacagataaggaagaattgaaaaagctgcggcaaagtgaggtcgtgttcaaaccccagaagaaatgccaggaatacgagatgagcctggaaaattgggccaaagccgtgaagcggagtatgaactggtataataaaacttag

SEQ ID NO: 47854 - DNA, 906 bp, Artificial Sequence
  Description of Artificial Sequence: Synthetic coding sequence
atgagcggcctgctgaccgaccccgagcagcgggcccaggagccccgctacccaggttttgtgctgggccttgacgtgggctctagcgtcattcgctgtcacgtctacgatcgcgcagcacgagtatgtggcagctcagtgcagaaagtagaaaatctgtatccacaaatagggtgggtcgaaatcgatccagatgttttatggatacagttcgttgctgtgattaaggaagccgtgaaagccgctggtatccagatgaaccaaatcgtggggcttggtatctccacccaacgggctacatttattacttggaataagaaaactggtaaccattttcacaacttcataagctggcaggacctgcgggcagtggaactggtcaagagctggaacaattcactgctgatgaagatatttcattccagctgccgcgtgctccattttttcactagatcaaagaggctcttcacggcctcgctatttacctttacgacgcagcagacctcactcagactggtctggatcttgcagaatttgaccgaagtgcagaaagcagtcgaggaagagaactgctgcttcggcaccatagatacctggctgctctacaaacttactaaggggagcgtgtacgccacagacttttcaaacgccagcaccacagggttattcgatccgtacaaaatgtgttggtccgggatgatcactagccttatttcaataccgttatcccttctgccgccagtgcgggacacctcacacaattttggcagcgtagacgaggaaatctttggcgtgcctattccgattgtggcactcctgaaagttcctgggtacgatcagaatatttgctacatatttgggaagggtactatcgaacctgttttttaccatggcagtactctctag

SEQ ID NO: 47855 - DNA, 360 bp, Artificial Sequence
  Description of Artificial Sequence: Synthetic coding sequence
atgagcgtgaccgaccaggccttcgtgaccctggccaccgacgacatctattgtcagggggcactcgtgttaggccagtccctgagacgccacagactgactaggaaattagtagtccttatcacaccccaggtcagctccctgctgagggacatggatgaggcaggtaaccatgatagtgagcaaaccatagccggtattgaaaatcaaactctccatgtgttgacccatagatgggagctgaacaatgagaatacatggactcagggcggcgagcaccatacactggagcctgtggtcggtcggggagagggtggtggcatcgcactcggagacatccccaatgtaaatgatgagtag

SEQ ID NO: 47856 - DNA, 291 bp, Artificial Sequence
  Description of Artificial Sequence: Synthetic coding sequence
atgagcggcagccacagcgtgacccaggccggcgtggagtggtacaaccattcttctctgcaaccacagacaccccggctcaaatacccccccacatctgcgtcacaagtggcagtgaccacagtcacggatcaggcattcgtgacccttgcaacagacgatatttactgccaaggagccttggttctgggccagagcttgcgacgacatcgtctgacccgtaaactggtggttctcatcaccccccaggtgagctctctgctgcgggtgtctctggtagcccaggcgtag

SEQ ID NO: 47857 - DNA, 195 bp, Artificial Sequence
  Description of Artificial Sequence: Synthetic coding sequence
atgagcgtgaccgaccaggccttcgtgaccctggccaccgacgacatctactgccagggcgctctggttctgggacagtctctccggcggcaccggctgacacggaagctggtggtgttgatcacgccccaagtctcatctttgctgcgccccgccgccagcctggtcctgtcccgtgtgtcgtctcgcccctag

SEQ ID NO: 47858 - DNA, 192 bp, Artificial Sequence
  Description of Artificial Sequence: Synthetic coding sequence
atgagcgtgaccgaccaggccttcgtgaccctggccaccgacgacatttactgccagggcgccttggttctcgggcagagcctgcgtcggcataggttgactcgcaaactggttgtccttatcactccacaggtctcgtcccttctcagtctgagtaagagatgcaagatctctagttcgcaccttgactag

SEQ ID NO: 47859 - DNA, 966 bp, Artificial Sequence
  Description of Artificial Sequence: Synthetic coding sequence
atgagccccagccccaccgccctgttctgcctgggcctgtgcctgggcagagtgcccgcacagagcggacctctccccaagccctcgctgcaagctcttcccagctcactcgtcccactggaaaagcccgtgactctgcgctgccaggggccgccgggcgtggatctgtaccggttggagaaactgtcatcctctcggtaccaggaccaggctgttctctttatacctgccatgaaacgcagtctcgcggggcggtaccgctgtagctaccaaaacggatcactttggtcgctacctagtgaccagctcgagcttgtcgcaacaggagtgttcgctaaacccagtttgtctgctcagccaggacccgctgtttcatcaggaggagatgtgactctccagtgtcagacccggtacggatttgatcagtttgccctctacaaagaaggtgaccctgcgccctacaagaatccagaaagatggtacagggccagtttccctataatcactgtgacagctgcgcatagtggtacctacaggtgctactctttttcaagtcgagacccctacctatggagcgcgccatcagatcctcttgaactggtagtaaccgaattcagcgaagctaccgctgagcttactgtgagtttcaccaatgaagtttttacaacggagacgtctcgctccatcactgcgtcaccaaaagaaagcgactccccagctgggcccgctcgccaatattacaccaagggaaatttagttaggatctgcttgggggccgtgattttgataatccttgccgggttcctcgctgaggactggcactctagacgtaagcgcctgcgtcaccgagggagagcagtccagcgtcctttacccccactcccacccctccccctgacgcgtaaatccaacggagggcaggacggcggccggcaggacgtccatagccggggcctgtgctcttag

SEQ ID NO: 47860 - DNA, 966 bp, Artificial Sequence
  Description of Artificial Sequence: Synthetic coding sequence
atgagccccagccccaccgccctgttctgcctgggcctgtgcctggggagagtacccgcccagtccgggcctctgcctaaaccaagccttcaggcactaccttcttccttggttcctctcgagaagcccgtgactctgcgctgccaggggccgccgggtgtggatctctaccggctggagaagctgagctcgtctcgatatcaggatcaggctgtgcttttcatccccgccatgaaacgttctctagccggccggtaccgatgctcttaccagaacggttctctgtggagcttgccatctgaccagctcgaactggttgctaccggagtcttcgctaagccctctttatccgcacagccgggccccgcggtttccagtggcggagatgtgactctgcagtgtcaaactcggtacggcttcgaccaatttgcactgtacaaagagggagaccccgcgccatacaagaatcctgaacggtggtaccgcgcctcttttccgatcattacagttacggcagcgcacagcggtacgtaccgatgctactctttcagctctcgtgatccctacctatggagtgcccctagtgaccctttagaattagtcgtcacagagttctccgaggcgaccgctgagctcactgtaagcttcaccaacgaagtattcacaaccgagacatcaagaagcataacggcatcccccaaagaaagcgactcaccagccggccccgctcggcagtactatacaaaaggcaacctggtgcggatctgcctgggagcagtcattcttataatccttgcgggatttttagctgaggactggcactctcgcaggaagcggctaagacaccggggccgggcagtccaacgaccacttccgcccctgccgccactgccactcaccaggaaaagcaatggcggtcaggacggtggcagacaggacgtgcattcacgcggcctgtgctcttag

SEQ ID NO: 47861 - DNA, 966 bp, Artificial Sequence
  Description of Artificial Sequence: Synthetic coding sequence
atgagccccagccccaccgccctgttctgcctgggcctgtgcctgggacgagttcctgcccagtcaggaccgctacccaagccttctctgcaggcactgcccagcagtctagttccactggagaaaccagtgactctgcgttgccaagggccacctggcgtggacctctacagactggaaaagctctcttcaagtcgttatcaggatcaggcagtgctgttcattcctgcaatgaagaggagtctggccggcaggtacagatgcagctatcagaatggcagcttgtggagcttgccttccgaccaactggagctggtggctaccggcgtctttgctaaacctagtcttagcgcccaacctgggcctgccgtttcctcgggtggagacgtgactttacagtgtcagacacggtacggcttcgatcagttcgcactgtataaggagggagatccagccccatataaaaaccccgagcgctggtacagggctagctttcctattatcactgtgactgctgcccatagcggaacctatagatgttattccttttcaagtcgggacccgtatctttggtctgctccttctgatcccctggagctggtcgtcaccgagttcagcgaagctaccgccgagctcactgtgtccttcacgaacgaggtctttaccaccgaaaccagtcgttccatcactgcctcccctaaggaatccgattcccctgcaggccctgcccgccagtattatactaagggcaatttggttcgcatatgcctgggggccgtgatattaattatacttgctgggttcctcgccgaggactggcactcccgtaggaagcgacttcgacataggggtcgggctgtgcagaggcccctgcctcccctgccccccttgcccctgaccagaaagtcaaatggagggcaggacggcgggagacaagatgtacactcccgaggcctgtgttcgtag

SEQ ID NO: 47862 - DNA, 966 bp, Artificial Sequence
  Description of Artificial Sequence: Synthetic coding sequence
atgagccccagccccaccgccctgttctgcctgggcctgtgcctggggcgggtgcctgcacagtccggccccctcccgaaaccttccctgcaggccctcccgagtagccttgtgccattagaaaagcccgtgacgttaagatgccaggggccacctggcgtggacttatatcgtctagaaaagctgtcttctagccgataccaggaccaagctgtcttgtttattcccgcaatgaagagatcactggccggtcggtatagatgtagctatcagaatggctccctatggtccctaccttccgatcagctcgagctcgtcgccaccggcgtcttcgccaagcctagtctgtctgctcagccaggacccgccgtctcctccggtggtgatgtaaccttacagtgtcagacacggtatggatttgaccaatttgccctctacaaagagggggatcccgccccttacaagaatccggagcgatggtaccgagcttcctttcccataataaccgtcactgccgcccattcgggcacgtataggtgctatagcttttctagccgcgatccctatctgtggtcagccccatccgatccgcttgagctggtggttacggaattttccgaggcaactgctgagttaactgtctcatttacgaacgaagtgtttaccaccgagactagccggtcaattacagcctccccgaaggagtcagactcccccgccgggcctgcacggcagtactacaccaaagggaacctggtcaggatatgtcttggggccgtgatactcatcattctggctggctttctggctgaagactggcactcaagaagaaagagactgcgacaccgagggcgggccgtccaacgccccctgccacccctgcccccccttccactgacaaggaaatcaaatggtggacaagatgggggcaggcaggacgtccactccagagggttatgcagttag

SEQ ID NO: 47863 - DNA, 966 bp, Artificial Sequence
  Description of Artificial Sequence: Synthetic coding sequence
atgagccccagccccaccgccctgttctgcctgggcctgtgcctgggccgagtaccagcccagagtggacccctgccaaagccatccctgcaggcgttgccgtcaagcttggttccgctggaaaaacctgttaccttgcgttgtcagggtcctcctggagtggacctttacaggctggagaagctttcctcttcccgctatcaggaccaggctgtgctgtttatccctgccatgaaacgctcccttgcagggcgatatcggtgctcataccagaacggatcactgtggagtctgccgtcagatcagttagagctggtggccaccggcgttttcgccaagccttcgctaagtgcgcagcccgggccggccgtgtcatccggaggagacgtcactctgcagtgccagacaaggtatgggtttgaccaattcgctctatataaggaaggggacccagctccttataaaaacccggagcgttggtacagggcgagctttccaatcataacagtcacagcagcgcattccggcacttacaggtgctacagtttcagctcccgcgatccatacctgtggtctgcaccaagcgatccactggaacttgtcgtaaccgaattctccgaggctaccgcagaactgaccgtttcctttaccaacgaggtcttcaccacagaaacatcacggtctattacagcctcccccaaggaatccgactccccagcaggacccgcacgacagtactacaccaaaggaaatttagtgcggatttgcctgggcgccgtcatcttgatcatactggccggctttctggccgaagattggcactcacggaggaaacggctgcgacaccggggccgggccgtgcaaaggcctctccctccattgcctccccttccgctgacaagaaagtcaaacggcggacaagacggcgggcgacaggatgtgcattctagaggactgtgtagctag

SEQ ID NO: 47864 - DNA, 966 bp, Artificial Sequence
  Description of Artificial Sequence: Synthetic coding sequence
atgagccccagccccaccgccctgttctgcctgggcctgtgcctgggcagagttccagcccagtccgggccgttgcctaagccatctctgcaggctctccccagcagtctcgtgcctttggagaagcccgttaccttgcggtgccagggcccccctggggtcgatctctaccgcctcgaaaagctgagtagttccaggtaccaggatcaggctgtactgttcatcccagcgatgaagcggtctttagcgggccgataccgctgctcgtatcaaaacggatctctctggtccctgccatctgaccagcttgagcttgtcgctactggtgtatttgccaaaccaagcttatcggctcaaccagggccagcagtgagttcaggaggcgatgtaacccttcagtgtcagactaggtatggcttcgaccagttcgccctgtataaggaaggcgatccagccccttataagaatcctgagcggtggtacagggcttcatttccgattattaccgtcacggccgcacactcagggacatatcgctgttactcattcagttcccgggacccctatctctggagtgcaccatccgacccactggaactggtggttactgaattcagcgaggccacggcagagctgaccgtatccttcacaaacgaggtattcactacagaaacttctaggtccatcacagcctcgccaaaggagtctgactcgcctgctggacctgctagacagtattatacaaagggtaacctggtaagaatctgtttaggagctgtcatccttataatactcgccggattcctcgctgaggattggcatagcaggagaaaacgcctgcggcaccgcggccgagccgtgcaacggcccctcccccctctgccccccctcccacttactcgcaagagcaatggtgggcaagacggaggccgccaggacgtgcacagtcgtggactgtgtagctag

SEQ ID NO: 47865 - DNA, 966 bp, Artificial Sequence
  Description of Artificial Sequence: Synthetic coding sequence
atgagccccagccccaccgccctgttctgcctgggcctgtgcctgggtcgtgtgcctgcccagtctggacccctgcccaagccaagcctgcaggctctgcctagctccctcgtgcctcttgagaaacctgtgactctacgctgccagggacctcccggcgttgacctgtataggttagagaaactatcaagttcccgataccaagatcaagccgtgctgttcattccagccatgaaacggtccctcgcgggtcgatatagatgctcttatcaaaatgggagcctctggagtttaccttctgatcaactcgaactcgttgctaccggagtttttgctaagccatctctgtccgcccagcctggaccagctgtgagcagcgggggagatgttactctccaatgccagacgcgctacgggtttgatcagttcgccctgtataaggagggggacccagccccttataaaaaccccgagcgctggtaccgcgcaagttttcctattataacagtgaccgccgcacattccggtacataccgatgctattccttcagttcgcgtgacccctacctctggtccgcgcccagtgatcctctggagcttgtggtcactgaattctccgaggcgaccgccgagctcactgtgagtttcacaaacgaggttttcacaacagagacttctcgtagtattaccgcctcacctaaggagtcagattcccctgctgggcccgctaggcagtactacactaaagggaatctcgtcaggatctgcctcggtgctgtaatactcatcatcctagctggctttctcgctgaggattggcactcccgccgcaaaagactgaggcaccgcggaagggccgtgcagagaccgttaccacctctgccgcctctcccgctcacacgcaaatcaaacggagggcaggacggagggagacaggatgtacatagccgggggctgtgttcttag

SEQ ID NO: 47866 - DNA, 966 bp, Artificial Sequence
  Description of Artificial Sequence: Synthetic coding sequence
atgagccccagccccaccgccctgttctgcctgggcctgtgcctgggacgtgttccagcgcagtcagggcctctaccaaaaccgtccttacaagccctccccagcagtctcgttcctttggaaaagccagtgacactccgctgtcaaggcccgcccggagtggatctatacagactcgaaaagctgtcgtcttccaggtaccaggaccaggcggtcctattcatccccgccatgaagcgttctctcgctggacgctatcgatgttcgtatcaaaacggctccttgtggtctctgccgtccgatcagttggagctggtggctaccggagtgttcgctaaacctagcctgtcagcacagccaggccctgcagtttcctccgggggcgacgtgacattacagtgtcaaacaagatatggcttcgaccagttcgccttgtacaaagaaggggatcccgctccgtataagaacccagaaaggtggtacagagcttcatttcccattatcaccgtcaccgccgctcactcaggaacttatcgatgttatagcttctcctctagagatccatatctgtggtccgctccatccgatcccctagagttggtggtaaccgaattctcggaggcaacagccgaactgaccgtcagcttcacaaatgaagtttttaccacagagacaagtaggagcatcactgcttcaccaaaagaaagcgactcgcccgccgggccagcaagacagtactatacgaaaggtaatttagtgcggatctgtctgggggccgtcatcctgattattctcgccggattcctggccgaagactggcactctcgccgaaagagactgcgtcaccgcggtcgcgcggtgcagaggcccctcccaccgcttccccccttgcctctgacccgtaagagcaacgggggccaagacggtggccggcaggacgtgcactctcgcggactgtgttcttag

SEQ ID NO: 47867 - DNA, 1116 bp, Artificial Sequence
  Description of Artificial Sequence: Synthetic coding sequence
atgagcttccggaaggtgaacatcatcatcctggtgctggccgtggccttgttcctgctagtccttcatcacaatttcctgtcgctatcatccctcctacggaatgaagtgacagattctggcatcgtagggcctcagcccattgatttcgttcccaacgctctgcgtcatgccgttgatggcagacaggaggagatcccagtggtcattgcagcctccgaggataggctgggtggagccatagcggccataaactctatccagcataacacacgcagcaatgttatcttttatattgttaccctcaacaacacagccgatcacctgaggtcttggttaaactcagactctctgaagtctatccggtacaagatagtcaactttgatcctaagctgctggaaggaaaagtgaaagaggatccagaccaaggggaatcaatgaaacctctgaccttcgctagattctacttacccattttggtgccttctgcaaaaaaggcaatatatatggacgacgacgtaatcgtccagggggacattctagccctctacaatacagccctcaagcctggccatgcggctgcgttcagcgaagattgcgactctgcctcaactaaggtggtgattaggggggcagggaatcagtataattacatcggttacttagactacaagaaggagcgcatccgaaaattgtctatgaaggcaagcacatgctccttcaatccaggcgtgtttgtggcaaacctgaccgagtggaaaagacaaaacatcactaaccaactcgaaaagtggatgaaactgaatgtggaggaagggctgtactctaggactctggctggtagcatcaccactccccctctccttatcgtgttttaccaacaacattccacgatcgatcctatgtggaatgtgaggcatttggggtctagtgcgggcaagaggtattcccctcagtttgtgaaagccgctaagctgctccactggaacggccacctgaaaccttggggtaggacggctagttacactgacgtatgggagaagtggtacatacctgacccgactgggaaatttaatcttattagacgatacacagagatctctaatattaaatag

SEQ ID NO: 47868 - DNA, 1116 bp, Artificial Sequence
  Description of Artificial Sequence: Synthetic coding sequence
atgagcttccggaaggtgaacatcatcatcctggtgctggccgtggcactgttcctcctcgtgctgcaccacaactttctgtctctaagctcactactgaggaatgaagtcacggactccggcatcgttgggccacaaccgatagattttgtccctaacgccctgcggcacgccgtggatggccggcaagaggagattcccgtagtaatagcggcgtcggaggatcgactgggaggcgccatcgccgcgatcaactctattcagcataacacgagaagcaacgtcatcttttacatcgttacacttaacaataccgcggaccacttgagatcatggcttaatagcgatagcctgaagtccatccgctacaagatcgtgaacttcgatcctaaactgctggagggcaaggtcaaagaggaccctgatcagggagaaagcatgaaaccactcacctttgcccgcttctatttgcctatcctagtgccgagcgcaaagaaggccatctacatggatgacgacgttatcgtgcagggtgacatcctggccctttacaacacagctttgaagcccggtcacgccgccgctttcagcgaggattgcgactccgcctcaaccaaggttgttatcaggggggccgggaaccagtacaattacattggctaccttgattataagaaagagcgcatcaggaaactttcaatgaaagccagtacttgcagcttcaatcctggtgtgttcgtcgcaaacctgactgaatggaaacgccagaatattacaaatcaattggagaaatggatgaaactgaacgttgaagaaggactatatagtcggactttagcaggctccattactaccccccctctgttgattgtgttctaccaacagcactctacaatcgacccgatgtggaatgtcaggcacctggggagctcagcgggtaagagatacagtcctcaatttgtgaaagccgccaagctgctgcactggaatgggcaccttaagccctggggaaggaccgccagctataccgacgtgtgggagaagtggtatatccctgatccaaccggcaagtttaacctcatccgcaggtacaccgagattagtaatataaaatag

SEQ ID NO: 47869 - DNA, 681 bp, Artificial Sequence
  Description of Artificial Sequence: Synthetic coding sequence
atggacgacgacgtgatcgtgcagggcgacatcctggccctgtacaacacagcactcaagccaggacatgccgccgcttttagtgaagattgcgattccgcgtcaacaaaggttgtaattaggggggcgggcaatcaatacaactacatcggatatttggactataagaaggaacgtattcggaagctgtcaatgaaagccagcacttgttcctttaaccctggtgtgttcgtcgccaacttgacagagtggaaaagacaaaacattacaaaccagcttgaaaaatggatgaagttgaatgtggaagaaggactgtattcaaggactctggccggttctattacgacaccacccttgctgatcgtcttttatcagcagcatagcacaatagacccaatgtggaacccccctccttggtttcagtgttggaagacgatatttacatccgtttgcaaaggctgccaagtgacccattggaacggtcacctgaagccctggggccgcacagcaagctacacctgcttgggaaaaatggtttacagccggccaaacaggcagattcagcctaatcctaagatttacagagatctgaagcacaaagttaagcagaatctgaactgcaagcaggcattcctgaggaaaagctggaagattgcctgcgtcgggtccaattcttgttag

SEQ ID NO: 47870 - DNA, 1116 bp, Artificial Sequence
  Description of Artificial Sequence: Synthetic coding sequence
atgagcttccggaaggtgaacatcatcatcctggtgctggccgtggctctgttcctccttgttctccatcacaactttctgtccctcagttcccttctgagaaacgaggttaccgacagtggcatagttggtccccaaccaatcgacttcgtgcctaatgccctgaggcatgctgtagacggcagacaggaggagatccctgttgtgatcgccgcgagcgaggaccgcctcggcggagccattgctgccattaactccatccagcacaacacccgctctaacgttatcttttatattgtcacactcaacaacaccgctgaccatttgaggagttggctgaattccgactcattaaaatccattcgttataagattgtgaatttcgaccctaaactcttggaggggaaggtgaaagaagatcccgaccagggggaatctatgaagcctctcacatttgcacgcttctacctgccgatcctggttccctccgccaaaaaagcaatttatatggatgatgatgtcatcgtccagggcgatattctggccctctacaatacagctctgaagcccggccatgctgccgccttttcagaggactgtgactctgcatcgaccaaggtggtcattcgaggagccggcaaccagtataattatattggctatctcgactataagaaagagcggattaggaagctgtctatgaaggcctcaacgtgcagctttaacccgggagtgttcgtcgccaacctgaccgagtggaaacgacagaatataactaaccagctcgaaaagtggatgaagctcaacgtggaagaaggtctctacagtagaaccttggccggctccattaccactccacctctgctgattgttttctaccaacaacattccaccattgatccaatgtggaatgtgcggcatttgggtagtagcgctggtaaacgctattcaccacagtttgtcaaagcggccaagctcctgcactggaacgggcacctaaaaccctgggggagaacagctagctataccgacgtctgggaaaagtggtatataccggatccaaccggaaaatttaacctcattagaagatacactgagatatcaaacatcaagtag

SEQ ID NO: 47871 - DNA, 93 bp, Artificial Sequence
  Description of Artificial Sequence: Synthetic coding sequence
atgagcttccggaaggtgaacatcatcatcctggtgctggccgtggcactgtttttactggtgctacatcataatttcctctctctctcatag

SEQ ID NO: 47872 - DNA, 1116 bp, Artificial Sequence
  Description of Artificial Sequence: Synthetic coding sequence
atgagcttccggaaggtgaacatcatcatcctggtgctggccgtggccctgttcctcctggtccttcatcacaacttcctttctctctccagtttgttaagaaacgaagtgaccgattccgggatagtggggcctcaaccaatcgactttgtccccaacgcactgagacacgctgtcgatggaaggcaggaggaaataccggttgtgatcgcagcaagcgaggacagacttggtggtgccattgctgctatcaactctatacagcacaatacacgctcaaacgtgattttttacatcgtgaccctcaacaatacagcggaccacttgcggtcctggctgaattcagattcactgaagtcaatacggtacaaaatcgtaaacttcgatccaaaactgttagaaggcaaagtgaaggaagatcccgaccagggtgaaagcatgaagcccctcacatttgctcggttctacctcccgattctggtgccttccgcaaagaaggccatctacatggacgatgacgtgattgttcagggggatatcctggccctgtataacacagccctgaagcccggtcacgctgctgctttcagtgaggactgtgactcagcttctaccaaagtggtgatcaggggagcggggaaccagtacaattacatcggttacctggactacaagaaggagcgaattcgcaaactgtcaatgaaggcttcgacatgcagcttcaatccgggcgtattcgttgctaaccttaccgagtggaaacggcaaaatatcacaaatcagctcgagaagtggatgaagctgaacgtggaggagggactctactcacgcacattggctggtagcatcaccacgccacctctgctcatcgtcttctaccagcaacactccactattgatcccatgtggaatgtgcggcacctcgggtcaagtgcgggcaagcgctactcacctcagttcgtcaaagccgctaagctgctacattggaatgggcacctcaagccctggggacgtaccgctagctacacagatgtgtgggaaaaatggtacatcccggatccaactggtaaatttaacctgataaggaggtataccgagattagcaacataaagtag

SEQ ID NO: 47873 - DNA, 525 bp, Artificial Sequence
  Description of Artificial Sequence: Synthetic coding sequence
atgagcttccggaaggtgaacatcatcatcctggtgctggccgtggcactctttttgcttgtactgcaccataactttctgagtctttcctctctgctgagaaatgaagtgacggactcgggcatcgtgggtccccagcctatcgactttgttcctaatgcccttcggcacgcagtagatggcaggcaggaggaaatccctgtggtcattgcggcttctgaggatagactgggtggagctattgctgctattaattcgatccaacacaacaccagatccaacgttattttctacattgtgaccttgaataataccgctgatcacttgcgttcatggcttaactctgatagcctcaagagcatcaggtataagattgtgaactttgatccaaagctgctcgaaggaaaagtgaaagaagatccggaccagggtgagtcaatgaagccgctgacctttgcccgtttttatttgccaattctggtaccatcagccaagaaggctatttatatggatgacgacgtatag

SEQ ID NO: 47874 - DNA, 189 bp, Artificial Sequence
  Description of Artificial Sequence: Synthetic coding sequence
atgagcttccggaaggtgaacatcatcatcctggtgctggccgtggcattattcttacttgttcttcatcacaacttcctcagtctgtcctcattattgcgcaacgaggtaacggacagtgggatagttggaccccagcccattgactttgtccccaatgccctgaggcacgccgtagacggccgctag

SEQ ID NO: 47875 - DNA, 333 bp, Artificial Sequence
  Description of Artificial Sequence: Synthetic coding sequence
atgagcttccggaaggtgaacatcatcatcctggtgctggccgtggccctgttcttgctggtgcttcatcacaactttttgagcctgtcctctctgctgcgaaatgaggtgaccgattccggtatcgtggggccccagcctattgatttcgtgcctaatgcccttaggcatgccgttgacggacgccaggaggagattcctgtggtgattgccgcgtcagaggatcgcctgggtggggcgattgccgctatcaattccattcagcacaatactagaagcaatgtcatcttttatatcgtcacactgaacaatactgctgatcacttgcgttag

SEQ ID NO: 47876 - DNA, 1116 bp, Artificial Sequence
  Description of Artificial Sequence: Synthetic coding sequence
atgagcttccggaaggtgaacatcatcatcctggtgctggccgtggcgctattcctcttagttctccaccacaattttttatccctctcttctttactcagaaatgaggtcactgactcaggaattgtgggacctcagcccatagactttgtgcccaatgcactcaggcacgcagtagacggacgccaagaggagattcctgtggttattgcagcctccgaggatagactaggaggagccatcgctgcgatcaattcaattcaacacaataccagaagcaatgttatcttctatattgtgacactgaacaataccgctgaccacctcaggagctggctaaactctgactccttaaagagcattagatataagatcgtgaactttgatccaaaactgctggagggaaaggtgaaagaagaccccgatcagggagagtcaatgaaaccactgactttcgcccgcttctatctgcccatcctggtgcctagcgccaagaaagccatctatatggatgatgacgtgatagtacaaggggatatccttgctctgtacaataccgcgttaaagcccggacatgcagccgcattcagcgaagattgcgattccgcctccactaaggtcgtcatccgcggtgctgggaaccagtacaattatattggatatctcgactataagaaggagagaatcagaaagttaagcatgaaggcttctacatgctcttttaaccctggggtgttcgtggccaatttgacggagtggaagagacagaacattaccaaccaattagaaaaatggatgaagctcaacgtggaggaggggctgtacagtcgtacactcgccggtagcattactacacccccacttctgatcgtgttctatcagcagcatagcactattgatccaatgtggaatgttagacacttgggcagctcagcgggcaagcgctatagtccacagtttgttaaagccgcaaagctgctgcactggaatgggcatctgaagccgtggggcaggacagcctcttacaccgatgtgtgggaaaaatggtatatccctgacccgacaggcaagttcaatctcatccggcgctacaccgagatttcaaacatcaagtag

SEQ ID NO: 47877 - DNA, 270 bp, Artificial Sequence
  Description of Artificial Sequence: Synthetic coding sequence
atgagcttccggaaggtgaacatcatcatcctggtgctggccgtggcgctattcctcctggttctccaccacaacttcctgtctctctccagtctgctgcgcaacgaagttacagattcgggaatcgtaggtccccagcctatagactttgtgcccaatgctttgcggcacgctgtggatggacggcaggaggaaattcctgtcgtgatcgctgcctccgaggatcggctgggtggggcaatcgccgctatcaatagcattcagcactag

SEQ ID NO: 47878 - DNA, 192 bp, Artificial Sequence
  Description of Artificial Sequence: Synthetic coding sequence
atgagcttccggaaggtgaacatcatcatcctggtgctggccgtggcactgttcctgcttgtcctccatcataattttctaagcctgtcatcattgctgcgcaatgaagttaccgactctggcatagtggggccacaaccaattgattttgttccgaatgcccttcgccacgccgtggatggacggcagtag

SEQ ID NO: 47879 - DNA, 483 bp, Artificial Sequence
  Description of Artificial Sequence: Synthetic coding sequence
atgctgcggcacctgcccagccggctgcccgtgaagatgtggggccgcacacttgagaaacagtcctggagggattcctcccaaaccccacccccctgcctgatccggaggttggatcacatagtgatgactgtcaaatccattaaagataccaccatgttctacagtaagatcttgggaatggaagtaatgacattcaaggaggacaggaaagctctctgctttggcgaccagaagtttaacttgcatgaagtagggaaggaattcgagcccaaggccgcacaccccgtgcctggtagtttagatatctgcttaattaccgaggtccctctggaggagatgatccagcatctcaaagcctgtgatgtgcccatcgaagagggaccagtgccgaggacaggagcaaaagggcccattatgtccatctatttcagagatcccgatagaaacctcatagaggtaagcaactatatcagctcgtag

SEQ ID NO: 47880 - DNA, 384 bp, Artificial Sequence
  Description of Artificial Sequence: Synthetic coding sequence
tgaatccggcggctggaccacatcgtgatgaccgtgaagagcatcaaagatacaaccatgttctattctaaaatcttggggatggaagttatgaccttcaaggaggatcgcaaagccctgtgcttcggagaccagaaatttaacctccacgaagtcggaaaagaattcgagcccaaggctgcccaccctgtacccggctctctggacatctgtctcatcacggaggtccccttggaagaaatgatacagcacctgaaggcctgcgacgtgcccatcgaggaaggacccgtgccccggactggggccaagggcccaataatgtcaatctattttagggaccccgatcgcaacctgattgaagtgagtaactacatcagcagctag

SEQ ID NO: 47881 - DNA, 2082 bp, Artificial Sequence
  Description of Artificial Sequence: Synthetic coding sequence
atgtggccccagccctacctgcccccccaccccatgatgctggaggagtctagacagaacaagcttgccgccgcaaaaaagaagctaaaggagtatcagcaacgcaaatcccctggaattccagcaggcgccaagacaaaaaagaaaaagacagattcatctccagagaccactacgtcaggagggtgccacagtccaggggattcccagtaccaggagctggccgtggctctggaatcgtcgtccgttaccatctctcagctcaatgaaaatattgagagcctcaaacagcagaaaaaacaagtcgagcaccagctcgaagaggcaaagaagacaaataacgagatacacaaggcccagatggaaaggctagaaactatcaacatccttacacttgagaaagctgatctcaaaacaacactttatcacaccaaaagggccgcccgtcatttcgaagaggaatctaaggatctagcagggaggctccagtactctcttcagaggatacaggaactcgaacgagcactctgtgctgtgtcaacacagcagcaagaagaggataggtcctcatcatgccgcgaagctgtcctacaacggtggctccagcagacgataaaagaacgcgcactgctgaatgcgcatgtgacgcaagtcacagaaagcctgaaacaggtgcaactggaaagagatgagtatgctaagcatatcaagggcgaacgtgccagatggcaggagcgcatgtggaagatgagcgtggaggcaaggaccctaaaggaggagaagaagcgggacatccaccgaatccaagaactcgagcgtagcctttccgaacttaagaatcaaatggccgagcctccttcgctggcaccccctgccgttacctccgtggtggagcaacttcaagatgaggctaagcaccttcggcaggaggtggagggattagaaggaaaattgcagtcacaagtggagaacaatcaggccttgtcactactgtctaaagaacagaagcaaagactacaggagcaagaagaaatgctgcgggaacaggaggctcagagggtgagagaacaagaacggctctgtgagcagaacgaacgtctgagggaacagcaaaagacactccaggagcagggagaacgtctgagaaaacaagagcagcgactacgcaaacaggaggagcgtctccgcaaggaggaggagcggttgcagaaacaggaaaagcgcttgtgggaccaggaggaacggctttggaagaaagaggagcgtttacagaagcaggaggagcgcctagctctctctcagaatcataagctggataagcaactggcagaaccccagtgctccttcgaagatcttaacaacgaaaagaaaagcgcgctgcagttggagcagcaagtgaaggagttgcaagagaaattggacgaagagcacctggaggcggcatcacaccagaaccaacagttggaaacacagctctcattagttgccttgccaggagaaggagatggtgggcagcatctcgactcggaagaagaagaagccccccgaccaactcctaatatccctgaagatctggaatctagggaagcgacctcctcatttatggacctcccaaaggaaaaggctgacgggactgagcaagttgaacggcgcgaactgggctttgtacagcctagcggggtaacggatggcatgcgcgagagcttcacagtgtatgaaagtcagggagccgttcccaacacacgtcatcaggagatggaggatgtaattcggttagctcagaaggaggaggaaatgaaggtgaagctgttagagcttcaggaactagttttaccactggtcgggaaccacgaggggcatggcaagtttctgatagctgcacaaaacccggccgatgagcctactcccggggcccctgccccgcaagagctcggggctgcaggcgagcaggatgtgttctacgaagtctcccttgacaacaacgtcgaacccgcaccgggcgctgcacgcgagggtagccctcatgacaaccctactgttcagcaaattgtgcagctgtcaccggtaatgcaggatacctag

SEQ ID NO: 47882 - DNA, 2082 bp, Artificial Sequence
  Description of Artificial Sequence: Synthetic coding sequence
atgtggccccagccctacctgcccccccaccccatgatgctggaggaatctcgccagaacaaactggccgcagccaaaaagaaacttaaagagtaccagcagcggaaatctcctggcattcccgccggggccaagactaagaagaagaagactgattcatcccctgaaactactactagtggcggaggtcattcccccggcgactctcagtaccaggaactggctgttgctctggaatcaagttcagtcacaataagccagctgaacgaaaatattgagtcattgaagcaacagaaaaagcaggtagagcatcaactggaagaggcaaagaagacaaataacgagatacataaagcgcagatggagagacttgaaacaattaacatattgacattggaaaaggcagacctgaaaacaacactgtatcacactaaaagagccgcccgacactttgaggaagagtccaaggacctggccggaaggctgcagtacagtctgcagcgtatccaagaacttgagcgcgccctttgtgccgttagtacacagcagcaggaagaggatcgctcgtcctcctgcagggaagcggtcctgcatcgaagactgcagcagaccataaaagagcgggcgctcctgaatgctcacgtgacacaggtgactgaatctcttaagcaggtgcagctggaaagggacgagtatgcaaagcacattaaaggcgaacgcgctcgatggcaggagagaatgtggaagatgagcgtcgaagcacggactttaaaagaagaaaaaaagcgcgacatacaccgtattcaggaattagaacgatctctgagtgagctgaaaaatcagatggcgaagccccccagcctagctcctccagccgtgacatcagtagtcgagcaattgcaggacgaggctaagcatctgagacaggaggtcgaaggcctggaaggcaaactgcagtcccaggtggaaaacaaccaggcactgtcactcctgagcaaggaacaaaagcagcgattacaggagcaggaggaaatgctccgtgagcaggaagttcagcgggttcgggagcaggaaagactttgtgagcaaaatgagcgactgagagagcagcaaaaaaccctgcaggaacaaggagagcgcctccgaaagcaagagcagagactgagaaaacaggaagagcggctgaggaaggaggaagaacgtctccagaagcaggagaaacgcctgtgggaccaggaggaacgactctggaagaaagaagagagacttcagaagcaggaggagaggctagccttaagtcagaatcacaagttggacaagcagctagctgaaccccagtgctcttttgaggatttaaataacgagaagaaatcagctctgcagctggagcaacaggtcaaagagcttcaggagaaattggacgaggagcacttggaagccgccagtcagcaaaatcagcagcttgaaacccaactgagtctggttgcacttcctggtgaaggcgacggcgggcagcatttggatagcgaggaagaggaggcaccgagacccaccccaaacattccggaggacctggaaagcagggaagccacttcttccttcatggacctgccaaaagaaaaagccgacggaactgaacaggtggaaaggcgggagcttggattcgtgcaaccttccggggtgacagacggtatgagagagagttttactgtatacgagagccagggagctgttcctaacacgcgccatcaggagatggaggatgttatacgtctggctcagaaggaggaagagatgaaggttaagttactggaattgcaagagttggtcctgcccttagtaggcaatcatgaaggccacgggaaattcctcattgccgctcaaaacccagccgacgagcctaccccaggggcaccggctccccaggagttgggagcagcaggtgaacaggacgatttctatgaagtttctctggataataatgttgagcctgcaccaggcgcagcccgcgaaggttcaccccacgacaatcccacagttcaacagatcgtccagctctcccccgtaatgcaggacacatag

SEQ ID NO: 47883 - DNA, 2082 bp, Artificial Sequence
  Description of Artificial Sequence: Synthetic coding sequence
atgtggccccagccctacctgcccccccaccccatgatgctggaggaaagccggcaaaataagcttgctgcagccaaaaagaaattgaaggagtatcagcagagaaaatctccagggatcccagcgggtgctaagactaaaaagaaaaaaaccgacagctctcctgagaccaccactagtgggggtggccattcccctggcgatagccaataccaggagctggctgtggcactggagagctcaagcgtaaccatcaatcagctaaacgagaacatcgagtcacttaaacagcaaaagaagcaggtggaacaccagctggaagaggccaagaaaacgaacaatgaaatccataaagcccagatggagcagttggagacaattaatatcctcactttggagaaggctgatctcaaaactaccctttaccatactaaaagggccgcacggcatttcgaggaggagtccaaggatctggcaggacgcctgcagtacagcctgcagcggattcaagagttagaacgggccttaagtgccgttagcacccagcagcaagaagaagaccgcagcagcagctgtcgtgaagccgtgttgcaacggaggttacagcagacaatcaaagagcgtgcattactgaacgcccacgtaacccaggtgactgaaagcctgaagcaggttcaactggagagggacgagtatgctaaacacatcaagggggaaagggcccgctggcaagagcggatgtggaaaatgtccgttgaggcaaggacattgaaggaagagaaaaaacgtgacatccacaggattcaggagctggagcggtctctctccgagttgaagaatcagatggcagaacctccctcacttgccccaccagccgttaccagcgtggtcgaacagctccaggacgaggcaaaacacctgaggcaagaggttgagggcttggagggcaaactccagtcacaagtggagaataatcaggctctgagtctcttgtccaaggagcagaagcaaaggttgcaggagcaggaggaaatgctccgggaacaagaggcacagagggtgcgcgagcaggagcgtctctgtgaacaaaatgagcgcctccgggaacagcagaagaccttacaagagcagggtgagaggttaaggaaacaggaacagcgtctgaggaaacaagaggaaagactccgaaaagaagaagaaaggctccaaaaacaagagaagcgtctatgggaccaggaggagaggctttggaaaaaggaagagaggctgcagaaacaggaggagcgattggctctgtcccaaaaccacaaactggacaaacagcttgctgaaccccaatgctctttcgaagatttaaacaatgaaaaaaagtccgccctccagctggaacagcaggtcaaagaactgcaggaaaagctcgacgaggagcacctggaagccgcgagccagcggaaccagcagctggagacgcagttgagcctggtggctttgccaggcgagggcgacggaggccagcacctggatagtgaagaagaggaggcccctagacccacgcctaacatccccgaggaccttgaatctagggaggctacttcatccttcatggatctgcccaaggaaaaagccgacggcacagagcaggtcgagcgaagggaactggggtttgtgcagcccagtggggttactgacggaatgcgggagtcctttactgtgtatgagagtcaaggagcagtgcccaacacaagacatcaggaaatggaagacgtgatccggttggctcagaaggaggaggagatgaaggttaagctcctggaactgcaagagcttgtattgccgctcgtaggcaaccatgagggacacggaaaattcctgatagcggcgcagaatcctgctgatgagccaacgcctggggcgcccgctccacaggagctgggggccgcaggagaacaggatgatttctacgaggtctccctcgacaacaacgtcgagcccgcgccaggcgctgcgagagaaggcagtccacatgacaatcctccggtgcaacagatagtccagcttagccctgtcatgcaggacacctag

SEQ ID NO: 47884 - DNA, 2082 bp, Artificial Sequence
  Description of Artificial Sequence: Synthetic coding sequence
atgtggccccagccctacctgcccccccaccccatgatgctggaggagtcacgacaaaacaaacttgccgccgccaaaaaaaaactgaaggagtaccagcagagaaaatcgccgggtattcctgctggagccaagactaagaaaaaaaaaacagactcatcacccgaaacaaccacgtccggggggggtcactcaccaggagactcccagtaccaggaattggccgtcgcccttgaatcttcgtccgttaccatcaaccagctaaacgaaaatatcgagtcactcaagcagcaaaaaaaacaggtcgaacaccaattggaggaagcaaagaagacaaacaatgagattcataaagcacagatggaacaactggagactatcaacatcttgaccttggaaaaagccgatctgaaaactactctttatcacactaagagagctgctcggcatttcgaggaagaaagcaaagacctggctggcagactgcagtatagcctccaacatattcaggaactggagagagccctatgtgctgtgagcactcaacagcaggaggaggaccgctcctcgtcttgcagggaggctgtgttgcaaaggagacttcagcaaaccattaaagagagagcccttctcaacgcccacgtgacccaagttaccgaaagcctgaagcaggtccagctggaacgggatgaatatgccaaacacataaagggcgaacgagccagatggcaggagcggatgtggaagatgtcagttgaagcgcgaaccctgaaagaggaaaagaaacgcgatatacaccgcattcaagaactcgaaaggtcgcttagcgagctaaaaaatcagatggcagagccgccgagcttagctccccccgccgtcacaagtgtcgttgaacagctgcaggatgaagccaagcatttacggcaggaggtggaaggactggaaggcaagctgcaaagccaggtggagaacaatcaagccctctctcttctgagtaaagaacagaaacagagattgcaggagcaagaagagatgctgcgcgagcaggaggcgcagcgagtaagagagcaggagcgcctgtgcgagcagaatgagaggctgcgggagcagcagaaaaccctgcaagagcagggggaaagactaaggaaacaggagcaacgcctccgcaaacaagaggagcggctaagaaaggaagaagaaagattgcagaagcaggaaaagagactctgggaccaagaggagcgattgtggaaaaaagaggaaagactgcagaagcaggaagagcgacttgctctaagtcagaaccacaagctggacaagcaactagccgaaccccagtgcagttttgaggatttgaacaatgaaaagaagtccgccctccagctggagcagcaggttaaagaattgcaggagaagttggacgaggagcatctcgaagccgcctcacaaagaaatcagcagttggaaactcagctgagtttggtggccctgcctggagagggggacggagggcagcacctggattccgaagaggaggaagctccccgccctacaccgaatatccccgaggatttggagagtcgagaggccacttcctccttcatggacctgcctaaagaaaaggcggatggcacagaacaagtcgagcggcgcgaactcggatttgtccaaccgtctggagtgacggacggcatgagggagagtttcacagtatacgagagccagggagccgtgccaaacaccagacaccaggagatggaggatgtgataaggctggcgcagaaggaagaggagatgaaggtaaagctcctggagttgcaggagctcgtgctgccgctagttggcaaccacgaggggcatggcaaatttctcatagccgctcagaacccagcagatgaaccaactccaggcgcccctgccccacaagaactcggcgctgcaggggaacaggacgtgttttacgaggttagcttagacaataacgttgagccagcacctggggttgcaagggaagggtcccctcacaataaccccactgtgcagcagattgtgcagctttcccccgtgatgcaggacacatag

SEQ ID NO: 47885 - DNA, 2007 bp, Artificial Sequence
  Description of Artificial Sequence: Synthetic coding sequence
atgctgatgtggccccagccccacctgcccacccacccccacctgcccacgcacccgcatctgcccactcacccccaccttcccacacacccccacttgcctactcacccacatctacccacccacccccacctgccaacccaccccatgatgagtaaagagacacgtcaatctaaactcgccgaggccaaagagcaactgacggatcatcatccacagacaaatccctctgtcgggaccgccgcttctgacactaaaaagaaaaagatcaacaatggaacaaaccctgagacaacaactagcggtggctgtcattcacctgaggatgagcaaaaagcaagccaccagcatcaggaagcgctcagacgggaattggaagcacaggtacataccatcaggattttgacatgtcagaaaacagagcttcagatggctctgtactatagccagcatgccgtgaagcaactagagggcgaggcccgagaccttatttcccgcctccacgactcatggaagtttgcaggcgaactggagcaggccttgtcagcggtcgctacacagaagaagaaggcagacaggtacattgaagagttaaccaaggagagagatgctttgagtctggagctgtacagaaatacaattactgatgaggaactgaaggagaaaaacgctaagctgcaggaaaagctgcagcttgtagagagtgaaaagtcggagatacagcttaacgttaaggagttgaaaaggaaactggagcgggctaagcttctcctgcctcagcagcagcttcaagccgaagccgatcacctgggcaaagagctgcagagtgtctcagctaaactgcaagctcaggttgaggagaacgagctctggaaccggttaaaccagcagcaggaggagaaaatgtggcgccaggaagagaagatccaggagtgggaggaaaaaattcaagaacaagaagaaaagattagagaacaggaggagaaaatcagggagcaagaggagaagatgcgccggcaggaagaaatgatgtgggaaaaagaagagaagatgcgacggcaggaggaaatgatgtgggagaaagaagagaagatgcgcaggctggaggagatgatgtgggagaaggaggaaaagatccgggagctcgaggagaaaatgcatgagcaggagaagattagagaacaggaagagaaaagacaggaagaagaaaagattcgagagcaggagaagcgccaggagcaggaagccaagatgtggcgtcaggaagaaaaaatacgggaacaggaggagaaaatcagagagcaggaaaaaaaaatgtggcgtcaagaggaaaagatccatgagcaagagaagattcgcgaggaagagaaacgacaggaacaggaggaaatgtggagacaggaggaaaaaatacgggagcaggaagaaatttggagacagaaggagaagatgcacgaacaggagaaaatcaggaagcaggaggaaaaagtctggaggcaggaagaaaaaatgcatgatcaagaagagaagatacgggagcaagaggaaaagatgtggcgccaagaggaaaaaattagagagcaggaggaaaagatcagagagcaggaggaaaagatccgggagcaggaagagatgatgcaggaacaggaagaaaagatgggcgaacaggaggaaaaaatgcaggagcaggagaagatgcgtagacaggaggagaaaatccgtgagcaagaggagaaaataagagagcagaaggagaagatccgcgagcaggaggagaaaatttgggaacaggaggagaaaattcgggagcaggaagagatgatgcaggaacaggaagaaaagatgtgggagcaggaagaaaagatgtgtgaacaggaagagaagatgcaagagcaggaagagaagatgaggcggcaggaggaaaagatgtgggaacaggaagtgcgcctgaggcagcaggaggaaaagatgcaagagcaccaggaacatctggaggctgctatctag

SEQ ID NO: 47886 - DNA, 1857 bp, Artificial Sequence
  Description of Artificial Sequence: Synthetic coding sequence
atgatgagcaaggagacccggcagagcaagctggccgaggccaaggagcaacttacggaccatcacccccaaaccaatccatcagttggcactgcagcaagcgacaccaagaagaagaagataaacaatggaacaaaccccgagactacaactagtggcggctgccactctcccgaagacgaacaaaaggcgtcacaccagcaccaggaggcgctgagacgggagctggaggcgcaggtccacacaatccggattctcacatgccagaagacagagctccagatggctctgtattactcgcagcatgccgtaaaacaattagaaggggaggcacgggatctgatcagccggcttcatgacagttggaaattcgccggcgaactcgagcaagcactgtccgctgttgccacccagaagaagaaagccgacagatatatagaggaacttactaaagagcgcgacgccctctctctggaactctacaggaatactataaccgacgaggagttgaaggagaaaaacgcgaagctccaggagaaactgcagttggtggaaagtgagaaaagcgagatacagcttaacgtgaaagagctgaaacgcaagctggaacgcgcgaagctactcctgcctcagcagctgcaggctgaagctgatcacctcggaaaggagctgcagagtgtctccgctaagctccaggcccaagttgaagagaacgaattatggaatcgcttgaatcagcagcaagaggagaaaatgtggaggcaggaagaaaagattcaggagtgggaggagaagattcaggagcaggaggagaaaatccgcgagcaggaggagaagattagggaacaagaagagaagatgcggcgccaggaagagatgatgtgggagaaagaggagaagatgcgacggcaagaagaaatgatgtgggagaaggaggaaaagatgcggagactggaggagatgatgtgggagaaggaggaaaagatccgtgaactggaggagaaaatgcacgagcaggagaagatcagagagcaagaggagaagaggcaagaggaagagaagattcgcgaacaggaaaagaggcaggaacaggaagcaaagatgtggagacaggaggagaagattcgcgagcaggaggagaagattagagagcaggaaaagaagatgtggcgtcaggaagagaagatccacgagcaagaaaagataagagaggaggaaaagcgccaagaacaggaagagatgtggagacaggaggagaagataagggagcaggaagagatttggcgccagaaagaaaaaatgcacgaacaagaaaaaattcgcaaacaggaggagaaagtctggaggcaggaagaaaaaatgcatgaccaggaggagaagattagagagcaagaggaaaaaatgtggcgccaggaagagaagattagagaacaggaggagaagatcagagagcaggaagagaagatcagggaacaggaggaaatgatgcaagaacaggaagagaaaatgggagagcaagaggagaagatgcaggaacaagagaagatgcgtaggcaggaggagaagatccgagagcaggaggagaaaatcagggagcagaaagagaagataagagagcaggaagagaaaatctgggaacaggaagagaagatacgtgaacaggaggagatgatgcaggagcaagaagagaagatgtgggagcaagaagagaagatgtgtgagcaggaagagaaaatgcaggagcaagaagagaaaatgaggaggcaagaagagaagatgtgggagcaagaagtgcgcttacgacagcaagaggaaaagatgcaggaacaccaagagcatctggaagcagccatatag

SEQ ID NO: 47887 - DNA, 1143 bp, Artificial Sequence
  Description of Artificial Sequence: Synthetic coding sequence
atgtggccccagccccggctgcccccccaccccgccatgagcgagaagacccaacagggaaagctcgccgctgccaagaagaaactaaaggcgtactggcaacgcaaaagtcctggtattcctgctggtgcaaatagaaagaagaaggtgaacgggtcctcacccgataccgcaacaagtggagggtaccactcgccgggagattccgccactgggatatacggggagggcagggctagctcaaccaccctgcaggacctggaatcccagtatcaggaactcgccgtggcactggattcctcctcagccataatctcccagctcactgaaaatatcaacagtctggtgcgcacatcaaaagaggaaaagaaacatgagattcacctagttcaaaaattaggcaggagcctcttcaaactgaagaaccagaccgctgaacctctggcccccgaacctcctgccggcccatcaaaggttgagcagctccaggatgagaccaatcacctcagaaaagagttggaaagcgtcggccgacagctgcaagctgaggtggaaaacaatcagatgctctcactcctcaatcggaggcaggaggagcggctgagggaacaggaggagagactacacgagcaggaggagagattgcatgagcaggaggaacgcctgtgcgagcaggaagagcgtctgtgtgaacaagaggaacgactccgtgagcaagaagagagactgcgtgagcaggaggaacgcctccacgaacaggaagaacgattgtgcgaacaagaagagcggctgtgtgagcaggaggagcggttgtgcgagcaggagaaattgccaggccaagagcggcttctggaggaggtagaaaaacttctcgaacaggagagacggcaggaagaacaagagaggctcttagagcgcgaacggctctggactagatggagatcctcttggagtcggagaggtttcggtaatagaatgcggggctgtggcagcagacgtttatgcggtagctggaggggctgcgggagctggcgaggatgtggttcttggcgcggctgcggcagttggagaggctgctggagctggggcggcaagccgtgtacatctagcggacccagccacgcggcggcctctcgaagctag

SEQ ID NO: 47888 - DNA, 1440 bp, Artificial Sequence
  Description of Artificial Sequence: Synthetic coding sequence
atgtggccccagccccggctgcccccccaccccgccatgagcgagaagacacaacagggtaagctggcggctgcgaagaaaaagctgaaggcttattggcagaggaagtcacccggcattcccgccggggccaaccggaagaaaaaagtgaatgggtcgtcacctgacaccgcgacctccgggggctaccactcccccggcgattcggctactgggatctacggggaagggcgcgcaagtagcaccacactgcaggacctagagagccagtatcaagagttggcagtagccctggacagcagcagcgcaatcatttcacagttgacagaaaatataaactcattggtcagaactagcaaggaggagaagaaacacgagatccacctggtccagaagctcggtcggtcactttttaaactgaaaaatcaaaccgccgaaccgctggcgccagaaccgcctgccggtccatctaaagtggagcaacttcaggatgaaaccaatcacttgcgcaaagaactagagtccgtaggtcgccagctccaagcagaagtggaaaataatcagatgctcagtctgcttaaccggcgccaagaggagcgacttagagagcaggaagaaagactgcatgaacaggaggaacggctccacgaacaggaggaaaggttgtgcgaacaggaggagcgtttgtgcgagcaagaagagaggctgagagaacaggaagaacgcctccgagaacaagaggaaagactgcacgagcaggaagaacgactctgtgaacaggaggaacgcttatgcgagcaagaggagagactctgtgaacaagaaaaattgcctggacaggagcgtctcctggaagaagtggagaaacttctagaacaagagcgacgtcaagaggagcaagaacggttactcgaacgcgagcggctactggatgaagtagaggagcttctggagcaagaaaggctccgacagcaagatgaaagattatggcagcaagagaccttacgagagctcgaaagactgcgtgagctggaacgactcagggagcttgagaggctgcgggagctggagaggatgctggagctcgggtgggaagccttgtatgagcagcgcgctgaacctagaagcggtttcgaagaactcaacaatgagaataagagcaccctgcagttggagcaacaggtcaaggaactcgagaagtccgggggagccgaagagcccaggggttcagaatcagcagccgctgctcgccccgtgccaggcgcgccagtgccacagggagcttggatgtgtggtcaagcgggttggactccacaggaacacccgggcttatcaggggaggccgtgggcacgggagaagctgctggaggggcagaggaggccgcctgccatagctttcgggcggctgagaatagggagctgaatattacgataatctag

SEQ ID NO: 47889 - DNA, 1953 bp, Artificial Sequence
  Description of Artificial Sequence: Synthetic coding sequence
atgtggccccagccccacctgcccccccaccccatgatgagcgagaaaaccaggcaaaacaagttggctgaggcaaaaaagaagttcacggattaccggcaatggaacatcgctggcgtcggcacgagagcaactgacaccaaaaagaagaaaatcaataatggaaccaaccctgagaccaccacatcggaagggtgccatagcccggaggacacccagcagaaccgcgcccagctcaaagaggagaagaaggcaagccaccaacaccaggaggctctgcgcagggagattgaggcccaggaccataccattcggatacttacatgccagaaaacagagctggaaaccgcactgtattatagccaggacgcagctcggaagttcgaggacggcaaccttggcaccccaagttctttcaacctggcattatcccaggcctttcggggcagcccgctcggctgcgtttccacctcactgatccccggggaatcaaaggacctcgcgggtagactgcatcattcttggcactttgcgggcgagcttcaacgggccttgtctgcagtgtccacatggcataaaaaggcagacaggtatattgaggaactgaccaaagagagagacgccctgtccctggagctgtatcgcaatacgattacgaacgaagagctcaaaaagaagaacgctgagctgcaggaaaaattgagattagccgagagcgagaagagcgaaatccagctcaacgtgaaagaattgaagaggaagctcgagcgggccaagttccttcttcctcaggtacagactaatactctccaggaggaaatgtggagacaggaggaggaactgcgtgagcaggagaaaaagatacgaaagcaggaggagaagatgtggcgccaggaagaacgcctgcgcgaacaagaaggcaaaatgagggagcaggaggagaagatgcggcgccaagaaaagaggctgcgcgagcaagaaaaggagcttcgcgagcaggaaaaggagttgcgagagcaaaagaaactgcgggaacaggaggagcagatgcaggaacaggaggaaaaaatgtgggaacaagaggaaaagatgagagagcaggaggagaagatgtggagacaagaggagcgtttgtgggagcaggaaaaacagatgcgagaacaggaacagaagatgagggatcaggaggagcgtatgtgggagcaggatgaaaggctaagggagaaagaggagcgcatgcgggagcaggagaagatgtgggagcaggtggagaagatgagggaagagaagaagatgcaggagcaggaaaagaaaactcgggatcaggaggagaagatgcaggaggaggagcgcatccgggaaagggagaaaaaaatgcgcgaagaagaagaaaccatgcgtgaacaggaggaaaagatgcagaaacaggaggagaacatgtgggaacaggaagagaaagagtggcagcaacagcgtctgccggagcagaaagaaaaactgtgggagcaggaaaaaatgcaggagcaggaggaaaagatctgggagcaggaagagaagattcgggaccaggaggaaatgtgggggcaggagaagaaaatgtggagacaggaaaagatgcgggaacaagaagatgaaatgagagaaaaggaggagcgaattcgcgaccagaaggagaagatgcaggagagactccccgagcacgaggagcgctgttccgaaccctgcttgcccccatctaaagtgctttgtaatatgtcgcataccggctccgtcgaacctgctggaggcgaggcaggcgagggtagtccacaggacaacccaacagcacaggagataatgcagctattctgcggcatgaagaacgcccagcagtgtcctggcctcggcagcacatcttgcatccccttcttctaccggggagataagcgcaaaatgaagataataaacatctag

SEQ ID NO: 47890 - DNA, 945 bp, Artificial Sequence
  Description of Artificial Sequence: Synthetic coding sequence
atgtggcggcaggaggaggagctgcgggagcaggagaagaagatcaggaaacaagaggagaagatgtggcgccaggaggaacgcctcagggagcaggagggtaaaatgagggagcaggaggagaagatgaggcggcaagagaagcggctacgggaacaggaaaaggaactccgcgaacaggaaaaagagctgagggaacagaaaaagctgcgtgaacaggaagagcagatgcaggagcaggaggaaaagatgtgggagcaggaggagaagatgagagaacaggaagaaaaaatgtggcgccaggaagagcggctgtgggagcaggaaaagcagatgagggagcaagagcagaaaatgagggaccaggaagagagaatgtgggaacaggatgaacgactccgtgaaaaagaggaacgaatgcgtgagcaggaaaagatgtgggagcaggtggagaaaatgagagaagagaagaaaatgcaggagcaagaaaagaagactcgcgaccaagaagagaagatgcaggaggaagagagaatccgcgaacgggagaagaagatgcgtgaagaagaagagaccatgcgagaacaggaggagaaaatgcagaagcaggaggaaaatatgtgggagcaggaggagaaggagtggcagcagcaacggttgccagagcagaaagaaaagctgtgggaacaggagaaaatgcaggagcaggaggaaaaaatctgggaacaggaggaaaaaatacgagaccaggaagagatgtggggacaggaaaagaagatgtggagacaggagaaaatgcgggagcaagaggatgtcggagccgggggagatgctcgtgaaggcggagaggatacccgatctgaacgggaagatgccggagaagcagccagagcaagaggtgcggtgctgcgcgccctgcccccatccctccagtccagcctgtag

SEQ ID NO: 47891 - DNA, 753 bp, Artificial Sequence
  Description of Artificial Sequence: Synthetic coding sequence
atgctgagcctgctgaaccggcggcaggaggagcggctgcgggagcaggaggaaagactgagagaacaagaggagcgtcttcgagaacaggaggagagattgtgtgagcaggaggagcggctgagggaacaagaggagcggctctgcgagcaggaaaagttaccgggtcaagaaagattgctggaggaggttgaaaagcttcttgaacaggagaggcgacaggaggagcaggagaggttattagagcgcgaacgactgctggaggaagttgaaaagctgcttgagcaggagcggcttcgacagcaggatgagcggttgtggcagcaggagacgttacaggaattggaaaggctgagggagttagaaagattgcgcgaactagagcgtatgctggagctgggctgggaagccctgtacgaacagcgcgctgagccgagaagcgggtttgaggaactgaacaacgaaaacaagtccactctgcagttggagcaacaggtcaaagaactgaagaagagcggaggcgcagaagaacccaggggatccgagtctgccgccgccgcaagacccgtggctggggctcccgtgccacagggggcgtggatgtgcggccaagccggctggacccctcaggagcaccccggactttccggcgaggctgtgggcaccggcgaggcagccggcggggccggcgaagccgcctgccacagcttccgtgccgcagagaaccgcgaactcaatattaccatcatttag

SEQ ID NO: 47892 - DNA, 348 bp, Artificial Sequence
  Description of Artificial Sequence: Synthetic coding sequence
cacctgcggctgcggcagcaggacgagcggctgtggcagcaggagactctccaggagctggaacgactaagggaattggagagacttagagagctggagagaatgctggaacttgggtgggaggccctgtatgaacagcgagctgaaccccgctcaggcttcgaggagttgaacaatgaaaacaagtcaacactgcagctggaacagcaggttaaggagctaaagaagagtggggagttaaaggaaacagtgacctccgacccatcaaagaaaatgtgggaggccggcacttccctgtggggcggtgaggtccctggccatagacagctgcagcctggagaccgatag

SEQ ID NO: 47893 - DNA, 2253 bp, Artificial Sequence
  Description of Artificial Sequence: Synthetic coding sequence
atgctgatgtggccccagccccacctgcccacccacccccacctgccaacacaccctcacctgccaacccaccctcatctgcctactcatccacacctaccaacacacccccatttaccaacgcatccacacctgccaacccatcccatgatgtctaaggaaacccgccagtccaagcttgctgaagccaaggagcagttgaccgatcaccacccacagacaaaccccagcgtgggaaccgccgcgtccgacaccaaaaagaaaaaaattaacaacggcacaaatccagaaacgaccacctccggcggttgtcactccccagaggatgaacagaaggcatctcatcaacatcaggaagccctgcgcagggagctcgaggcacaggtgcacacaatcagaatcctgacttgccagaagactgagctgcagatggcgctgtattactcccaacatgcggtgaagcaattagagggcgaagctcgcgacttgatttctcgcctgcacgatagctggaaattcgccggggaactggagcaggccctgagcgctgtggccactcagaaaaaaaaggcagatagatacatagaggaacttaccaaagagcgagacgccctgtccttggaactttaccgaaacacgattacagacgaggaactgaaggagaaaaatgccaagttacaggaaaaactgcagctcgtggagtcagaaaaaagcgagattcagctgaatgtgaaagaactgaagcggaagctggagcgtgcaaagctgctgttaccacaacaacagttgcaggctgaagcagatcaccttgggaaggagctgcagagcgttagtgccaagcttcaggcacaggttgaggaaaatgagctctggaatagactgaaccagcagcaagaagagaaaatgtggcggcaggaagagaagatacaggagtgggaagaaaaaatccaggaacaggaggagaagatcagagagcaggaggagaagatcagagagcaggaagaaaagatgagaaggcaagaggagatgatgtgggagaaagaagaaaagatgagacgacaggaagagatgatgtgggagaaggaagagaagatgaggcgccaagaggagatgatgtgggaaaaagaggaaaaaatgaggaggcaggaggaaatgatgtgggaaaaagaggagaaaatcagggaactagaggagaaaatgcacgagcaggagaagatcagggagcaggaggaaaagaggcaagaggaagagaaaataagagaacaggagaagcgccaggagcaggaagcaaagatgtggaggcaggaggagaagatccgggagcaggaggagaaaattagagaacaggagaaaaaaatgtggcgccaagaggaaaagatccacgaacaggagaaaatccgtgaggaggaaaaacggcaagagcaggaagagatgtggagacaggaagaaaagatacatgaacaggaagaaatctggcgccaaaaggagaaaatgcacgaacaggaggagaaaatacgcaaacaggaggagaaagtttggcggcaagaagagaaaatccgcgagcaggaagaaaaaataagagagcaggaagaaaaaatgtggaggcaggaagaaaagatccgggaacaagaggaaatgtggagagaggaagaaaagatgcatgaacaagaaaaaatctgggaagaggagaagcgccaggagcaggaggacaagatgtggaggcaggaggaaaagatacgcgagcaagaggagaaggtttggcgccaggaggagaagattagggagcaagaagagaagcgccaggaacaggaggaaaagatgtggaagcaggaggagaagatccgggaacaggaggagaaaattcaggagcaagaagagaaaatccgggaacaagaggaaaaaattcgcgagcaagaggaaatgactcaggaacaggaagaaaaaatgggtgaacaagaggaaaagatgtgcgagcaggaagaaaagatgcaagagcaggaagagaccatgtggcggcaagaggaaaagattcgagagcaggagaagaagatcagggagcaggaggagaagatacgagagcaggaggaaatgatgcaagagcaggaagagaagatgtgggagcaagaagaaaagatgtgcgaacaggaggagaagatgcaggaacaggaggaaaaaatgagacggcaggaggagaagatgtgggagcaagaggtgcgcctccgtcagcaggaggaaaagatgcaggaacactag

SEQ ID NO: 47894 - DNA, 1299 bp, Artificial Sequence
  Description of Artificial Sequence: Synthetic coding sequence
atgtggccccagccccggctgcccccccaccccgccatgagcgagaaaacacagcaagggaagctggccgccgcaaagaaaaaactcaaagcgtactggcaaaggaaatcaccaggcataccagccggagctaacagaaagaagaaggtcaatggctcctccccagacaccgctacctccgggggttatcactctccgggagattcagccactgggatatatggcgagggacgggccagttccaccaccctgcaggacctcgaaagccagtaccaggaactcgcagtcgccctggatagttcttcagccatcattagtcagctgaccgaaaacatcaatagcctagtgcggacttccaaagaggagaaaaagcacgaaatacatctggtacaaaagttaggacgctctctgtttaagcttaagaaccagaccgccgagccacttgcaccacagccaccagctggaccaagcaaagtggaacagctgcaggatgagacaaaccacctgcgtaaagaacttgagtccgtaggtaggcaacttcaggccgaagtggagaacaatcagatgctgtcactgttgaacagaaggcaagaggagaggttgcgcgagcaggaggaacggctgcgtgagcaagaggagcgcctttgcgagcaggaagagcgcctctgcgagcaggaagaacgacttagagagcaggaggaacgattgtgcgagcaggaaaaacttcctggccaagagcgtctccttgaggaagtggaaaagttgctgaagcaggagcggagacaagaggaacaggagaggctgctggagcgggagaggctgctggatgaagttgaggagctgctagagcaggagagacttcgtcaacaggacgagcgactctggcagcaggaaactctgcgagagctggagagactgcgagagcttgaaaggatgctggagttggggtgggaggcactgtacgagcagcgggccgagccccgtagcgggtttgaagaattaaacaacgagaataagagcactctccagctggagcagcaggtgaaggagctcgagaaatccggaggtgctgaagagcctagaggtagcgagagcgcagctgctgccaggccagtaccaggagcgcctgtgcctcagggcgcatggatgtgtgggcaggccggatggacacctcaggagcatcccggcctcagcggggaagccgttgggaccggcgaagctgctggtggcgccggcgaggcagcgtgtcattcatttcgcgccgctgagaacagggaattgaacatcactatcatctag

SEQ ID NO: 47895 - DNA, 1812 bp, Artificial Sequence
  Description of Artificial Sequence: Synthetic coding sequence
atggccgaggagaccggccagagcaagctggccgccgccaagaagaagttcaaagaatactggcagaggaacaggccaggagtgcctgcggccgcaaagcgcaacacaaaggcaaatggaagcagtcctgagacggctgcatccggcggctgtcactcttctgaggcgtcatcaagcgcttcctccagcctccacgcccgacagagcccgtgtcaggaacaggctgcggtcctgaactcacggtctattaagatctcgaggctcaacgatacgataaaatcattgaagcagcagaaaaagcaggtggagcaccagttggaagaggaaaagaaggcgaacaacgagaagcagaaggccgagcgcgaattggagggacaaattcaaagactgaacactgaaaagaaaaaacttaacacagatctgtaccatatgaaacactctctgcggtatttcgaggaggaaagtaaagatctcgcgggtcgtttacagaggtcttctcagcggatcggcgaacttgaatggagtctgtgtgcagttgccgctactcagaagaagaagcctgacggtttctcctcaagatccaaagcactgttgaagcgacaattggagcagtcgatcagagaacagatactactgaaaggacacgttacacaactgaaagaatcattgaaggaggtgcagttagaaagggatcagtacgccgagcagatcaagggagaacgtgcccaatggcagcagaggatgaggaaaatgtcccaggaagtctgtactctgaaagaagagaagaagcatgacactcatcgtgttgaggaactcgagcgaagtctgtctcgattgaagaaccagatggcagaacccctgcctcccgacgctcctgcagtctcctcagaggtggaactccaggacctgcggaaggagctggaaagggtagcaggcgaattacaggcacaggtcgaaaataatcagtgcatctccctactaaacaggggacagaaagagcgactgcgagaacaagaggaacgactacaagagcagcaggagaggctgagagaacgagagaagcgcctgcagcaactcgctgaacctcagagcgacttagaggagcttaagcatgagaacaagtccgccctgcagctcgagcagcaggtcaaggagcttcaggagaagctcgggcaggtaatggagacactaacctccgctgagaaggaacccgaagctgcagtgccggccagtgggacgggcggagagagctcaggccttatggacttgctcgaagaaaaggctgaccttagagagcatgtggagaagctggagcttgggttcatccagtatagaagagaacggtgtcaccaaaaggtgcatcggcttttgactgaacccggggactccgctaaggacgccagccctggcggaggacaccaccaggccggaccaggccagggcggggaagagggggaggctgccggcgcggccggggacggagtcgctgcatgcggcagttattccgagggccacggcaaattcctcgctgccgcacgcaatccggcagccgaaccatccccaggcgctcccgcgccgcaagagctcggtgccgcagacaagcatggagatttatgcgaggcatcgctcactaattcggtggagcctgcccagggagaggctagggaggggtctagccaagacaatcctaccgcccagcctgtggttcagttattgggagagatgcaggaccaccaagaacaccctggtctggggagtaactgctgcgtgccttgtttctgctgggcctggctgccccgccggcgcaggtag

SEQ ID NO: 47896 - DNA, 1812 bp, Artificial Sequence
  Description of Artificial Sequence: Synthetic coding sequence
atggccgaggagaccggccagagcaagctggccgccgccaagaagaagtttaaagagtattggcagcgaaatcgccctggcgttcctgctgcagccaagaggaacactaaagccaacggcagttctccagaaaccgccgcatccggcgggtgccattcatctgaagcctcatcttcagcctctagttctcttcacgcacgacaatccccctgccaggagcaggctgctgtgctgaacagtcgttctatcaagatcagtcgtctgaatgacaccataaagtctctaaaacaacagaaaaaacaggtggagcatcagttggaagaggagaagaaggccaacaatgagaaacagaaggcggaacgagagctggagggccagattcagcgtctaaacactgagaaaaaaaagcttaacacagacctctatcacatgaagcactctctgaggtacttcgaagaggagagtaaagaccttgccggcaggctgcagcggtcctcacagcgcattggggaattggagtggagcctttgtgccgtggcagctacacaaaagaagaaacctgatggtttctcctctcgatctaaggccttgctcaaacgtcagctggagcagtcaatcagggaacaaattttactcaaaggacacgtgacacagctgaaggagtctctcaaggaggtacagttggagagagatcagtacgctgagcaaattaagggtgagagggcacagtggcaacagcggatgcgcaagatgtctcaggaagtgtgtactctaaaggaggaaaagaagcatgacacgcacagggtggaggagctagaaaggtcattgtctcggctcaagaaccaaatggccgagcctctcccaccagatgcacccgccgtttcctctgaggtggagctccaggacctacgaaaggaactggaaagagtagccggggaacttcaggcccaggtggagaacaatcagtgtatctcactgctcaacagggggcagaaggagaggctgagagaacaggaagagaggctgcaggagcagcaggagcggctgcgggagcgggagaaacgtctccagcaactggctgagcctcagtcagatctggaggagctcaaacatgagaacaagagcgcactgcaactggaacagcaggtcaaggaacttcaggagaaattggggcaagtgatggaaacacttacttccgctgagaaggagcccgaagctgccgtcccagcatctgggacaggaggagaaagcagcggtttgatggatctgttggaagaaaaagcagatctacgtgagcacgtggagaaactggaactagggttcattcagtatcgcagggaaaggtgccatcagaaggtccacagactactcaccgagcccggcgactcggccaaggacgcctctcccggcggggggcaccaccaggctgggcccggacagggcggagaagagggtgaagcggctggcgcggccggggatggtgttgccgcctgcgggtcatatagtgaaggtcacggcaagtttttagctgccgcaaggaacccagcggccgaaccatccccaggagccccagctcctcaggaactgggagctgcagacaagcacggagacctttgcgaagcctcgctgaccaacagtgtcgaacctgcacagggtgaagcccgcgagggttcttcccaagacaatcccaccgcgcagccagtcgtgcagctcttgggagagatgcaggaccatcaggagcaccccggcctcggttcaaactgttgcgtgccgtgcttttgttgggcgtggctgcccaggcggagacgttag

SEQ ID NO: 47897 - DNA, 1902 bp, Artificial Sequence
  Description of Artificial Sequence: Synthetic coding sequence
atgctgcccgtggacggcgaggagcggaagagcgagggcagcgacacagaaggcgaccggacaagcccctgcgccggccctacaagctccgcaactctgaaggatctagaggtgggtggctctgggcgaagatgtagtgatccggctgggcaaccttccaacctcttgccccaacgagggctcggggcacctctgcctgccgagaccgcccatacccaacccagccccaatgataggagcctgtatctgagccccaagagcagctctgccagcagttctctgcacgctcggcaaagcccttgtcaggagcaagcggccgtcttgaactcccgatcaatcaagatcagtcgactgaacgacacaataaaatccctgaagcaacaaaagaaacaggtggaacaccaactggaggaggagaaaaaggcaaataacgaaaaacagaaggcagaaagggagttggaggggcagatccagcggttgaacaccgaaaagaaaaagctgaacacagatctgtaccacatgaagcattcacttcggtacttcgaggaggaaagtaaggacctcgccgggcgcctgcaaagatcaagtcagagaataggggagctggaatggtcactctgtgccgtggcggccacgcagaagaaaaagcccgacggattctcgtctcgttccaaagctctcctgaagaggcagcttgaacaatctataagggagcagatcctgctgaaaggacacgttacacagctgaaagagagcttaaaggaggtccaactcgaacgcgaccagtacgccgagcaaatcaaaggcgaacgagcgcagtggcagcaacgcatgagaaagatgtcccaagaagtctgcacactgaaagaggagaaaaagcatgacacccacagagtcgaagagttggaacgctctctctcccggctgaaaaatcagatggcagaaccactccccccagacgctcccgccgtgtcttccgaagttgaattacaggacttgagaaaggagctggaacgggtcgcaggcgaacttcaggctcaggtcgagaataaccagtgcatcagcctgctcaaccgcggacaaaaagagcgcctgcgcgaacaggaagaaaggctacaagagcagcaagaaaggttacgcgagcgagagaagaggttgcagcaactggcagagccacagtccgacttggaagaactcaagcatgaaaataagagcgcgctgcagctggagcagcaggtcaaagaactgcaggaaaagctgggccaggtgatggaaaccctcacctccgcggaaaaagagccagaggccgcagtcccagcatctggaactggcggtgagtcatccggactaatggacctcctggaggagaaggccgatctgagggagcatgtggagaagctcgaactgggattcatccagtacaggcgggagcgttgtcatcagaaggtgcaccggctgcttactgaaccaggtgattccgccaaggacgcgagtcccggcggggggcaccaccaggctggaccaggccagggtggcgaagaaggggaggctgcaggcgccgccggagatggagtggcagcctgtggaagttatagcgaaggccatggtaagttcctggcggctgccagaaatccagccgccgagccctcaccaggggctcctgcacctcaagaactgggcgcagctgataagcacggagatctctgtgaagcctctctcacgaattcggtggagcctgcccagggagaggcgagggaggggtcatcgcaggacaacccaaccgctcaacctgtagtccagctcttgggggaaatgcaagaccatcaggagcaccctgggcttggtagcaactgttgcgtcccatgtttttgctgggcctggctgccccgaaggaggcgatag

SEQ ID NO: 47898 - DNA, 1383 bp, Artificial Sequence
  Description of Artificial Sequence: Synthetic coding sequence
atgaagcacagcctgcggtacttcgaggaggagagcaaggacctggccggaaggttgcagcgcagctcccagaggattggggagttagagtggtccctgtgtgccgtggcagctacacagaaaaaaaagccggacggtttctcgtcccggtctaaggcattattaaagagacagttggagcagagtattcgggagcagatcctcttgaaaggccacgtgactcagctgaaagaaagtctaaaggaagtgcagctcgaacgggaccagtatgccgagcaaataaagggtgaaagggcgcagtggcagcaacggatgagaaagatgtcccaggaagtctgcacccttaaggaggagaagaagcacgacacgcatcgcgtggaggaactagagcggtcactgtcacgcctgaagaaccagatggccgaacccctcccacccgacgcccctgccgtatcttccgaggtagagctacaagatttaagaaaggagctggagagagtagctggtgaactgcaagctcaagttgagaacaatcaatgcatcagtttgctgaatcgtggacagaaggagaggctgagagagcaggaagaaagactgcaagagcagcaagagagattacgggagcgagaaaaaaggctgcagcagctcgccgagcctcagtctgacctagaggagctcaaacacgagaataagtctgccctgcaactggagcagcaggtgaaggaactccaggaaaaattgggccaggtgatggagacactgacatcagctgaaaaagagcccgaagccgcggtgcctgctagcggaacaggcggggagtcaagcgggctgatggacctgctcgaagagaaagcagaccttcgcgagcatgttgagaaattggagttggggtttatccagtaccggagggagcggtgtcaccagaaggttcaccggttgcttaccgagcccggcgatagcgccaaagacgcttcacctggcggcggacaccaccaggctgggcccggccagggtggagaagagggcgaggctgccggagcagctggcgacggcgtggcagcttgtgggagctacagcgagggtcacggcaaatttttagctgcagcacggaatccggcagcagaaccatctcctggagcccccgcacctcaggaactaggagccgcggataagcatggcgatctatgtgaggcatctctgaccaactcagtcgaaccggctcaaggcgaggccagggaagggtcctcacaggataacccaaccgctcagcctgtggtccagctactcggcgagatgcaggaccaccaagagcatcccgggctcggttccaattgctgcgtgccatgcttctgctgggcctggctccccaggcgcaggcgttag

SEQ ID NO: 47899 - DNA, 1899 bp, Artificial Sequence
  Description of Artificial Sequence: Synthetic coding sequence
atggccgaggagacccagcacaacaagctggccgccgccaagaagaagctgaaggagtattggcaaaaaaattcacctcgcgtgccagccggggccaaccgaaacaggaagacaaacggctccattccacagacggctacgtccggaggttgccaaccgcctggggacagcgccacaggctttcaccgagaaggaccaacaagctctgctacattgaaggatctggaaagcccctgccaggaacgtgctgtggtgctggacagtagatcagtggaaatatcccagttgaagaatactatcaagagtctgaagcaacaaaaaaaacaggtggaacatcaattggaggaggagaagaaagcaaacattaagaagcagaaagcaaagagagtgctcgaggtgcagattcagaccctgaacattcagaaagaagaactgaacacggacctctatcatatgaaaagatcactcagatacttcgaagaaaaaagcaaagatttagccgtacgcttacagcattccttgcagagaaaaggggagttggagagcgttctgagcgacgtgatggcaacccagaagaaaaaagcgaaccagctgtcctccccctccaaggctggaacagagtggaagctggaacagagcatgagggaggaggcgctgcttaaggtgcagttaacccaacttaaggagagcttccagcaattgcagctggagaggcacgagtatgctgagcacctgaaaggtgagcgcgctcggtggcagcagagaatgagaaaaatgtcacaggaaatctgcacactgaagaaggagaaacaacaagacatgaggcgggtcgaaaagctggagagatctctgtcaaagctgaaaaaccaaatggctgagccactgccacccgaaccccctgccgtacccagcgaagttgaactacagcatctgagaaaagaactcgagcgtgtcgccggcgctctgcaggcccaggtgaagaacaaccagcgaatcagtctgctcaaccgcggccaggaagagagaattcgcgaacaagaagaacggttgcgtaagcaggaggaacgcatccaggaacagcacaaatcactgcagcagctggccaagccacagtctgttttcgaagaacctaataacgagaacaaatccgctctgcaactcgaacaacaggtgaaagagctccaggaaaaactgggggaagaacatttagaagccgcatcacagcagaaccaacagctcacagcgcagctgtctctgatggccctccccggagaaggccatggaggggagcacctggattcagagggcgaggaagcacctcagcccatgccctctgttccagaagatctggaaagccgagaggcaatgagcagcttcatggaccacctggaagaaaaggccgatcttagcgagctggtcaaaaaaaaggaattatgctttatacaccactggcgagagcgttgccaccagaaaactcatcaccttctctcagaacctggggggagggcgaaagacgcagcattaggtggcggtcaccaccaggctggtgctcagggaggagacgaaggtgaagcagccggagccgccgcagatggcatcgcagcttactccaactacaataatggacataggaagttcttggccgctgcacacaaccccgctgacgaaccgggccctggagctcctgctccacaggagctgggggccgctgacaaacacggagatctgtgtgaagttagcctcacttctagcgcacagggggaggcaagggaagaccctcttctcgataagcccacagcccagcctatcgtccaggatcatcaggaacaccccggtctcgggtccaactgctgcgtgccctttttctgttgggcctggctgccccgcaggaggcggtag

SEQ ID NO: 47900 - DNA, 1338 bp, Artificial Sequence
  Description of Artificial Sequence: Synthetic coding sequence
atggccacccagaagaagaaggccaaccagctgagcagccggagcaaagcccgtacggagtggaaactagaacagagcatgcgtgaggaagccctgctcaaggttcagctgacccaattcaaggaatcctttcagcaggtgcaactggagcgggatgaatactcagagcatctgaagggcgagagggcaaggtggcagcagaggatgagaaaaatgagccaggagatctgcaccctaaagaaagaaaagcaacaggatatgcgtcgggtggaaaagttggaacggtctctgtccaagctgaaaaaccagatggccgagcctctgcctccggaacccccagccgtcccctctgaagttgaactccagcatctaagaaaagaactcgaacgagttgccggcgaacttcaggcccaggtcaagaacaatcagaggatctctttattgaatcagcggcaggaagagaggatacgcgaacaggaggaaagattacgtaagcaggaggagcgaattcaggagcagcataagtctctgcaacagctggcaaagccccagagcgtgttcaaggaacctaataatgaaaataagaatgctctgcaattggaacagcaggtcaaggagctgcaagagaagctgggggaggagcatctggaggctgcaagccagcagaaccagcagctgaccgcgcagttaagtcttatggctctcccgggagagggccacggaggagaacatcttgactctgaaggcgaagaagcgcccagaccaatgccttcagtcccagaggacccagagtcacgtgaggcgatgtcttccttcatggaccatctggaagagaaggcggatttgagcgagcttgtgaagaaaaaggagctatgcttcatccaccactggagggagagatgtcaccagaagacccaccacctcctcagcgaaccaggtgggagagccaaggatgctgcccttggcggcggacatcaccaggccggggcccaggggggcgatgagggcgaagctgcaggagccgccgctgacggaattgcagcatactctaattacaacaatggacaccgcaaatttctggctgctgcgcataactcggccgacgagccaggaccaggtgcgcctgccccccaggagttgggcgcagctgacaagcacggccacctgtgcgaggtgagtttgacttcttctgcccagggggaggcccgggaagatcctctactcgataagcctaccgcccaacccatcgtgcaggaccatcaggaacaccctggcctgggctccaattgttgcgtgccttttctgtgttgggcatggctgcccagacgtaggcgttag

SEQ ID NO: 47901 - DNA, 1299 bp, Artificial Sequence
  Description of Artificial Sequence: Synthetic coding sequence
atgtggccccagccccggctgcccccccaccccgccatgagcgagaaaacccagcaaggtaaactggctgccgccaagaagaaactgaaggcttactggcaacgcaagtctcctggtatccccgcgggcgccaaccggaagaaaaaagttaacggtagctccccagatactgccacaagcggcggttaccactctcctggagattctgcaacaggcatatacggcgagggacgggcttcttcaactacactccaggacctcgaaagccagtaccaggaactggccgttgccctggattccagcagcgcaatcatatcccagcttaccgaaaatatcaattccttagtccgaaccagcaaagaggagaaaaaacatgagattcacctcgtgcagaaactcgggcgaagtcttttcaaactaaaaaatcagaccgctgagcccctggctccgcagcctcccgctggtccgtctaaggttgagcagcttcaggatgaaactaaccatctgcggaaggagctcgagtctgtgggccgccagctgcaggcagaggtcgaaaataaccagatgctgagcctgctgaacagacggcaggaggagcgactccgggagcaggaggaaaggctgagggaacaggaggagaggctctgcgaacaagaggagaggctctgtgagcaagaggagagactgagagagcaggaggaacgcctgtgcgagcaggagaagttgcctggacaggagagattgctcgaggaagtcgaaaagttgttgaagcaggagcgccggcaagaggagcaggagagactcctggagcgcgagagactgctggacgaggtagaggaactgctcgagcaggaacgtctgcgtcagcaggatgaaagactctggcagcaagagactctgcgcgaactggagcgcctgcgtgagctcgaaagaatgctggagctcgggtgggaggccctctatgaacagcgtgcagagccaaggagtggctttgaggagttgaataacgaaaacaagtcaactttacagcttgagcaacaggtgaaggaactggaaaaatccggaggggccgaggaaccccgcggatctgagtctgccgctgccgctcgcccagtgcccggggccccggtgccacagggagcgtggatgtgcgggcaagcagggtggaccccccaggagcaccctggtctgtccggagaggctgtaggcaccggcgaggctgccggaggtgccggtgaggcagcctgccacagctttcgcgccgctgagaatcgcgagttgaacatcaccattatttag

SEQ ID NO: 47902 - DNA, 1896 bp, Artificial Sequence
  Description of Artificial Sequence: Synthetic coding sequence
atggccgaggagacccagcacaacaagctggccgccgccaagaagaagctgaaggaatactggcagaaaaatcggccaagggttcccgccggagttaacagaaaccgtaaaaccaacggatccattccagagactgctacgtctgggggttgccagcctcccggcgacagcgctactggatttcaccgcgagggccctactagcagtgcaaccttgaaagacctggagtcgccttgtcaggagagggccgtggtgcttgacagcacttcagtgaagattagtcgtctaaagaacaccattaagagcctgaaacagcagaaaaagcaggtagaacaccagctcgaagaggagaagaaggccaacaacgaaaggcagaaggccgagagagtgctggaggtgcagattcagactctcatcatccagaaagaggagctgaacaccgatctctaccatatggaacggagcctccgctacttcgaagaggagtcaaaagatcttgctgtaaggctgcagcactctctgcagtgcaagggcgaacttgagcgcgccctgtctgcggtcatcgccacagaaaagaaaaaggctaatcaacttagctcttgctcaaaagctcataccgagtgggagcttgagcagagcctccaagatcaggctctgctgaaagcccagctgacacagctaaaagagagcttccagcagttgcagctggagcgggatgagtgtgccgaacatattgaaggggagcgagctagatggcaccagcgcatgtcaaaaatgtcacaggagatctgcaccctcaaaaaggagaagcaggacatgaggtgggttgagcaactggaatggtctctgtctaagctgaagaaccagactgctgaacccctacccccagaacccccagcggtcccaagcgaagtcgagcttcagcatttgagaaaggaactcgagcgtgtggcgggagagctccagtctcaagtgaagaataaccagcatatttccttgttgaatcggcgacaggaggagcgaatccgggagcaggaggagaggctgcggaagcaggaggagagactgcaggagcagcatgagaagttgcggcaactcgcaaagcctcaatccgtgtttgaggagctgaacaacgagaacaagtccactctgcaactggagcagcaggtgaaagagttacaggagaagctgggggaggagcatctggaagtggctagccagcagaaccagcagctcacagcacagttgtcacttatggctttgccaggagagggccacggaggcgaacacctcgattccgagggcgaggaggcaccccagccaatgccatcagtgcccgaggatccagagtctagagaagcaatgtcctcctttatggatcacttgaaagagaaagccgatctaagcgagttactgaagaagcaggaacttcgattcatccagtactggcaagagaggtgtcatcagaagattcatcacctgcttagtgagcccggaggccgagcgaaggatgccgcactgggggggggccaccaccaagccggtgcccaaggaggtgacgaaggagaggcggctggggctgctgctgatggcatagccgcctactcaaattacaataacggtcatcggaaattcctcgctgctgcccacaattctgcagatgaaccaggaccaggcgcccctgcacctcaggaattgggagccgcagataagcacggagacttgagggaggtgaccctaacctccagtgcgcagggggaggcccgggaggaccctctgctcgataagcctactgctcagccaattgttcaagaccatcaggagcatccaggactgggctcaaactgttgcgttccgctattctgctgggcgtggcttccccgccgcaggcgttag

SEQ ID NO: 47903 - DNA, 885 bp, Artificial Sequence
  Description of Artificial Sequence: Synthetic coding sequence
atggccgaggagacccagcacaacaagctggccgccgccaagaagaaactaaaagaatattggcagaaaaacagaccccgggtgccagctggagtcaatagaaaccggaagacaaacggaagcatcccagaaacggcaaccagcggggggtgccagcccccaggcgacagcgccacagggttccaccgtgagggtcctacatccagcgctactctcaaagatctggagagcccttgtcaggagagggccgtggtgctggactccacgagtgttaaaatttcccgactcaagaatactattaagagcctaatctgcactttaaagaaggaaaagcaggatatgaggtgggtggagcagttagaatggtcacttagtaagctgaaaaatcagacggccgaaccgcttcctccagagccccctgcggttcccagcgaggtcgagctgcagcacctacgcaaagagttagaaagggtcgccggagagctgcagtcccaggttaagaacaatcagcacatttccctgctcaacaggcgacaggaggaacgaatacgagagcaggaggaacggttgagaaaacaggaagaacgcctccaggaacaacatgaaaagctgcgacagttggcaaaaccccagagtgtctttgaagagctaaataatgagaacaagagtactttgcagcttgagcagcaggtgaaggagcttcaggaaaagctgggggaagtaaaagaaacagaaacctccacgccaagcaaaaaaggatgggaagccggcagctccctcctgggcggcgaggtcccgggccagcgtcagctccccgcctggggcctcgtgacgaccgcgccccgcagggcagtgctgcgcctatttctcacttcttgtctgtag

SEQ ID NO: 47904 - DNA, 519 bp, Artificial Sequence
  Description of Artificial Sequence: Synthetic coding sequence
atggccggcgccgcccccaccaccgccttcggccaggccgtgatcggaccgccaggctctggcaaaacgacctattgcctgggaatgtcagagttcctgagagcactgggaaggagagtcgctgttgtgaatcttgacccagcaaacgaggggctgccctatgatattttttcccagatggcacaatgggacttgagactgaccgctgtccacctcgtcgactcccattattgcacggaccccgcaaaattcatctcagtactctgtaccagtttggcgaccatgctgcatgttgagctgccccacataaacctgctgagcaaaatggacctcattgaacactatggcaagctggccttcaatctggactattacaccgaagtgttggatctctcatacttgctagatcacctagcgtcggacccgttcttccgccactatcgacagctcaatgagaaactggtgcagctgattgaggactatagtcttgtgtctttcatacctctgaacatccagtag

SEQ ID NO: 47905 - DNA, 396 bp, Artificial Sequence
  Description of Artificial Sequence: Synthetic coding sequence
atgctggccggcctggagctgctgaccagcgccttcaacctggactattacacagaggtgctggatctcagttatctcttggatcatctggcctctgacccgttcttccggcactaccgccagctgaatgagaagttagtgcaattaatcgaggattacagtctcgttagtttcattcctctgaacatccaggacaaggagagtatccagcgcgtgcttcaggctgtcgataaggccaacggatattgtttcagggcccaggagcaacgctccttagaggccatgatgtctgccgctatgggcgccgattttcacttctctagcacactaggaatccaggaaaagtatctggcaccctccaatcagtcagtagagcaggaggctatgcagctctag

SEQ ID NO: 47906 - DNA, 933 bp, Artificial Sequence
  Description of Artificial Sequence: Synthetic coding sequence
atggccggcgccgcccccaccaccgccttcggccaggccgtgatcgggccacctggctcagggaagacaacctattgcttgggcatgtctgaattcctgcgagccttaggccggcgtgtcgcggtggtcaacctcgatcccgcgaacgaggggcttccgtacgagtgcgcagtggatgtgggcgaactcgtgggcctaggtgatgttatggacgctctgaggttaggcccaaatggaggcttgctctactgtatggagtacttagaggccaacctcgattggctccgtgcaaagcttgatcctctgcgtggccattatttcctgttcgattgccccggacaggttgagttgtgtacgcaccatggagctcttcgctctatatttagtcaaatggcgcagtgggacctgcgtttaacggcagtccacctggttgacagtcactactgcacagatcccgcaaagtttatctctgtgctgtgcacgtccctggccacaatgttgcatgtggagctgcctcatatcaacctgctctcaaagatggacctgatcgaacactacggcaaactcgccttcaacctggactactacaccgaggtgctggatctgagttacttgttggatcatctggcctccgatccattttttaggcactatcgacagcttaacgagaaactggtgcaattgatcgaagactactcacttgtgtcatttattccactgaacattcaggataaagagtcgattcagcgggtgctgcaggccgtggacaaggctaacgggtactgctttagagcacaggaacagagaagcttagaggccatgatgtccgcagcaatgggggccgacttccatttcagctcaacactgggcattcaagaaaaatacttagctccctccaatcagagtgtcgaacaggaagctatgcagctgtag

SEQ ID NO: 47907 - DNA, 519 bp, Artificial Sequence
  Description of Artificial Sequence: Synthetic coding sequence
atggccggcgccgcccccaccaccgccttcggccaggccgtgatcggaccacctggcagtggcaagacaacttactgccttggcatgtctgaatttctgagagcgcttggacggcgagttgcagtcgtcaacctggatcctgctaacgaaggcttgccctatgacatcttctcacagatggcccagtgggaccttcggttaacagctgtacaccttgtggactcgcactattgcactgatcctgctaagttcatatcagtcctctgcaccagtctggcaaccatgttgcacgttgaacttccccacatcaaccttttatctaaaatggatctcattgaacactacggtaagttggcattcaacctggactactacaccgaagtacttgacctgagttatcttctggatcacctggcaagtgaccccttctttcgccattaccggcagctgaatgaaaaactcgtccagttgatcgaagactacagtctggtgtctttcatacccctcaatattcagtag

SEQ ID NO: 47908 - DNA, 537 bp, Artificial Sequence
  Description of Artificial Sequence: Synthetic coding sequence
atgcccgcctaccacagcagcctgatggaccccgacaccaagctgattggtaacatggccctcctccccatacggagccagtttaagggccccgctccaagggagaccaaggacactgatatcgtcgacgaggctatctattatttcaaggctaatgtgttttttaagaactatgaaataaaaaatgaggctgatagaaccctcatctacatcaccctgtacattagcgagtgcctaaagaaactccagaagtgcaactccaagagtcagggtgagaaggagatgtacacgctcggaatcaccaatttccccatcccgggcgagcccgggttcccattgaatgctatttacgccaagccagctaacaaacaggaagacgaggtcatgcgggcttatcttcagcaactgcgccaggaaacgggtcttcgcctgtgtgaaaaggttttcgaccctcaaaatgacaagccaagcaagtggtggacgtgcttcgtaaagcgccagtttatgaataagagcctgagcggccctggtcagtag

SEQ ID NO: 47909 - DNA, 885 bp, Artificial Sequence
  Description of Artificial Sequence: Synthetic coding sequence
atgccccggtacgcccagctggtgatgggccccgccggcagcggcaaagtcagaatctgtggggacaaagagagaaaaagcacctattgtgctacaatggtgcagcactgcgaggcactgaatcggagtgtacaggttgtgaacctagatccagcagccgagcactttaactactcagtcatggctgatattcgcgagcttattgaagtcgatgatgtaatggaggacgactccctgcgcttcggcccaaatggcgggcttgtgttctgtatggagtactttgctaacaacttcgattggctcgagaattgtctgggccatgtggaggacgattacatcctgtttgattgtcccggccaaattgaactgtatacccatctgccggtcatgaagcaattggtccaacagctggagcagtgggaattccgagtctgtggggtgttcctggttgacagccagttcatggtcgaaagtttcaaatttatctctggcatcctagccgctctctctgccatgattagcttggagatccctcaggtaaatatcatgaccaagatggacctgctttccaaaaaagcaaagaaagagattgagaagtttctggacccagacatgtacagtctgctggaggactctacgtcagatttaaggagcaagaagttcaaaaagctgaccaaggctatttgcgggctcattgacgattacagtatggttcggttcctgccctatgatcaatccgatgaggaaagtatgaatatcgtgctgcaacacatcgacttcgcaattcaatatggcgaggacctcgagtttaaagaacccaaggaaagggaggatgagtcgagctctatgtttgacgaatatttccaggagtgtcaggatgaatag

SEQ ID NO: 47910 - DNA, 972 bp, Artificial Sequence
  Description of Artificial Sequence: Synthetic coding sequence
atgctgcccaagacccggggcgccttccacttcagcatccccgacccccagcacatatgcaaaagtcgaggcagcccctacagatctaacgtctgtacacagacaactgacagatccacatggagaaaggacgcggaattatacctgctgagcgtcatcactcagtccacctattgcgcgaccatggttcagcactgcgaagctctgaaccggagtgtgcaggttgtaaatctcgacccagctgctgagcactttaattactcagtaatggccgacatccgcgagcttatagaagttgacgatgttatggaggatgacagtctccgcttcggaccaaatggggggctggtgttctgtatggagtatttcgcgaacaatttcgattggctcgagaattgtttgggtcacgttgaggatgactatatactgtttgactgtcccggccagatcgaactatatacacacctgcccgtgatgaaacagctggtacagcagttagagcagtgggaattccgggtgtgtggcgtgtttttagtggactcacagttcatggtggaatcatttaagtttatctcaggcatcctggcggctctgtctgcgatgatctcgctggagattccacaggttaacatcatgaccaagatggacctgctctcaaagaaagctaaaaaagaaatcgagaagtttttggacccagatatgtattccctgttggaggactccacatctgacttgagaagcaagaagttcaaaaaattgacgaaagcgatatgtggtctcattgatgattacagcatggtccggtttcttccttatgaccagtccgatgaggaaagcatgaacattgtgttacagcatattgacttcgcaattcaatatggcgaggatcttgagtttaaagaacccaaggagagagaggatgagtccagctctatgttcgacgagtattttcaggagtgtcaggacgaatag

SEQ ID NO: 47911 - DNA, 2331 bp, Artificial Sequence
  Description of Artificial Sequence: Synthetic coding sequence
atgggcaccgtgcccgaccccctgcggagcgccaagaccagcctgatagcagcatcgggcaaggaggacgaccttggagagccccaggcagcctctccacgacaccgtcctgcactcctctgcaaaaacgccaatggcttttctggggccccggctgagcctgatctgagccccagagcagccgctgaagctctgatgcaggtgtgtgagcacgagactacccagcctgacatgtcaagtcctggggtgtttaacgaggtacaaaaagctcctgctacattcaattctcccggtaacccacagctgccaggttccagtcagcccgctgccagcgcaccctcatctgctgccggccgggatctgatacacactcccctgaccatgccagccaatcagcatacctgtcagagcattccaggggaccaacctaatgctatcacaagcagcatgcccgaggactctctcatgcgcagtcaacgcactagcaatagggaacaaccagaaaagccctcttgcccagtggggggcgttctgagctcttctaaggaccaggtttcctgcgagtttccaagccccgagaccattcagggaacagtccagaccccggttaccgccgctcgcgtggtttctcacagcagtagtcctgtgggcgggcctgagggggagcggcagggcgctatctgcgactcggagatgcgaagctgcaagcccctaactcgtgagagtggttgctcggagaacaaacagccaagtgtcacagcatccgggccgcagggcactacctctgtgaccccgcagccaacgcctctcaccagcgagccaagcgcctgtccacctggtccagaaaaagtgccacttcccgcgcaaaggcaaatgagccgtttcaaggaggcctccacgatgaccaatcaggctgaatccgagataaaagaggtccccagtcgggcctggcaggacgcggaggtccaggccgtggcctcagtggagagtaggtcagtaagtacctctccatctatactaacagcgttcttaaaagaaagcagggctcccgaacacttcgaacaagaacagcttagggtgatatgccattcctcaggctctcacactctagaattaagtgatagcacattggcccctcaggaatcttcccaatgtcctgggattatgcctcaggtgcatattcaggccgctgccgccgagtcgaccgctttccagagggagaacaaactggccagtcttccagggggcgtgctgaagaccagctccatcaacctcgtaagctcaaatgcacagcacacatgcaaagaggatgggcggttagccggaatgacgccagtgcgcgaagaatcgactgccaaaaaacttgccggcactaactcttcatccctgaaagccacggcaatcgaccagatttcgatctctgcctgttcacaagctgagaccagttatggcctgggtaaatttgagacaaggccgtcagaatttgccgagaaaactacgaatggacacaaaactgacccagattgcaaactctcggattcttgcggctccatctcaaaggccgatcatagtggatcccttgatcctacaaacaagggtgatgcaagagagaagaagcctgcctcaccccaagtagtcaaggaaaaggagagtacgggcacggacacatcagatgccaaaaccctgctgctgaatcccaagagccaagaatctgggggaacagaatccgccgccaatccgaccccgtcgccaatcaggaaaaaccaggaatccaccctcgaggagaaccggcaaaccaagactgccacatccctgagccttcctagcgatccaatgggggacagcagccccgggtctggcaaaaaaacaccctcacgctccgtgaaagcttctccgcgacggccgagtagggtgtccgagtttctgaaagaacagaaattaaatgtgacagccgcagcagctcaggtcggcctcaccccgggagacaagaagaagcaactcggtgccgactctaaactccagctgaaacaaagtaaacgggttagagatgtcgtctgggacgaacaagggatgacctgggaggtttacggggccagcctggatgctgagtctctcggaattgctatccagaatcatttacaaaggcagatcagagagcacgaaaagttaataaagactcagaatagccagactcgaaggagtatatcatcagacacatcatctaataaaaaactgcgtggacgacagcacagcgtcttccagtcaatgctgcagaacttcagaaggcccaactgctgcgttcggcccgcaccctcttctgtgcttgactag

SEQ ID NO: 47912 - DNA, 1299 bp, Artificial Sequence
  Description of Artificial Sequence: Synthetic coding sequence
atgaccgagctgcagcaggacgtggaggacaccaagcccgccaaggtcctgggcaaaagagaaagtaagctgggcagcgctcactccgaagcagaaaatggagtggaggaaaagaaaaaagcgtgtcggagtccaactgcgcaatccccgacaccctctgtggaggccgattcccccgatcaaaagaaaatcataagcttatggtccaaatcttcttttgacggagcaagtctggctagtgacaagaacgactgtaaaaccgagagcaagaatgatccaaaaacggaaaggaagaagagttcttcgtcctcacagtataaggctaacatgcattttcacaaactgttcctgtctgtccccactgaagagcccctgaaacagagttttacatgcgccttacaaaaagaaatcctttaccagggcaagctgttcgtatctgagaactggatttgtttccactcaaaagtcttcgggaaagacaccaagatctccattccagccttctcggtcacattaatcaaaaaaacaaagactgccctccttgtgcctaacgccctcatcatcgctaccgtgactgaccggtacatattcgtctccttattatcaagagattccacatacaagttgctcaaaagcgtatgtggacaccttgagaataccagtgttgggaatagcccaaatccgtcctcggctgaaaactcctttcgggctgaccgccctagttctctgccgctggattttaacgacgagtttagcgacttagatggcgttgttcagcagaggagacaggatatggagggctacagctctagtggatcacagacacccgaaagtgaaaattctagagacttccacgctacggagtctcagactgtcttaaatgtgagcaaaggagaagcgaaacctacacgcgcagacgcgcatgtgaacagggtgcccgagggaaaggcgaagagtttgccagtgcaggggctctctgaaacggtggggatcctgcataaagtgaagtcccaaaagtgcccgatgttgcaccatatcctgatcttctacgctatcgtggtgtgtgccctgattatctccactttttatatgagataccgcataaatactctcgaggagcagttggggctgctgaccagcattgtcgatacacacaatactgaacaagctgccccaagtgggcttcgcagccaggtacaatttaatgtcgaggtgctgtgtcaggagctcacagctaatatcgtgaaactggagaagattcagaataatctgcagaagctgttggagaacggggactag

SEQ ID NO: 47913 - DNA, 1323 bp, Artificial Sequence
  Description of Artificial Sequence: Synthetic coding sequence
atgtggaagacccagagcctgcggaagtgcagcggccggggccgggccaaccttgcccaaccaacgcaacgactacgaatggtttggcgaaggaagcgcaagccagccggcagacagcagcctaaccctcttccccacctgtggcgcagaacccctcagacccggcgcaaaagtctggcctatgcccatatcttttcacccaacctttgttttatccaagaccaagagagtaaaagctccttcgacggcgcgtccctagcttccgataagaacgactgcaaaacagaaagcaagaacgaccctaaaaccgagcggaagaagtcatcttcttcttcccagtataaagctaatatgcactttcacaagctattcctgtcagtgccaactgaggagcccctgaagcagtctttcacctgtgcgttacaaaaagagatactttaccaaggcaagctgttcgtcagcgagaattggatatgctttcatagcaaggtgttcggaaaagacaccaaaatttctatccctgctttctccgttacactgattaaaaagacgaaaaccgccctgctcgtcccaaatgccctgattattgcaactgtgacagatcggtatatcttcgtgtccctgttgagcagagacagtacttacaagctattgaagagtgtctgtgggcacctcgagaatacgtctgttggaaattcaccaaatcctagtagtgcagagaattcatttcgggcagacagacctagcagtctcccactagacttcaacgacgagttttctgatctcgatggtgtcgtccagcagcgccggcaagacatggagggatacagctctagcggtagtcaaacgcctgagagcgagaattcccgtgactttcatgccaccgaatcccagactgttttaaacgtgtcaaagggagaggccaagcccacgcgggctgacgcccacgttaatcgggtgccagaagggaaggctaagagtttgcctgtacagggcctttcagagacggtaggaatcttacataaggtgaaatcacagaaatgtcctatgctgcaccatatcctcatcttttatgccatcgtcgtctgcgccctaatcatcagcacattttacatgagatacaggattaatacgctcgaagagcagttaggcctgctgacaagcatcgtcgatactcataacactgagcaggccgcgccctcagggttacgatctcaagtgcagtttaatgttgaagtgttgtgccaagaactgactgctaatatcgtgaagttagaaaagatccagaataatttgcaaaaactgctggaaaacggagactag

SEQ ID NO: 47914 - DNA, 1116 bp, Artificial Sequence
  Description of Artificial Sequence: Synthetic coding sequence
atgaccgagctgcagcaggacgtggaggacaccaagcccgccaaggtccttgggaaaagggaaagtaagctgggcagcgcccatagtgaagctgagaatggggtggaggagaaaaaaaaggcctgtaggagcccaaccgcccaatcccctaccccatctgtggaggcagatagcccggaccagaaaaaaattattagtctctgtccctacttgctttccaagtccatgctgcactcaggccctcgttacaaagcgaacatgcactttcacaagctgtttctgagtgtccctactgaagaacctctcaagcagtccttcacttgcgctctgcagaaagagatcctgtatcaaggaaaattgttcgtcagcgagaattggatttgcttccactccaaggtgttcggcaaagataccaagatttctatccccgctttctccgttactctcatcaagaaaaccaagaccgccctgctcgtacccaacgcgctgattattgccacagtcaccgacagatatatctttgtgtccctgctcagcagggattccacgtataagcttctgaagtcagtctgtggacatctagaaaacacctctgtgggcaatagccctaaccccagctctgctgagaactcctttcgggccgacagaccatcgagcttgcctttggacttcaacgacgaattctccgacttggacggggtggtgcagcagcgccggcaagacatggaggggtacagcagtagtgggagccagaccccggaatctgaaaattcaagggtcgacttccatgctactgagtctcagacggtgcttaatgtcagtaagggcgaggctaagccaactcgtgcagatgctcatgtcaatcgcgtgcccgaagggaaggctaaatctctgcccgttcaaggcctgagtgagaccgtgggaatattacacaaagtcaaatcacaaaagtgcccaatgttacaccatatcttaatcttctacgccatcgtagtgtgtgccctcattatcagtactttttatatgagatacagaataaatactcttgaggagcaattgggactgctcacttccatcgtggatacccacaatactgaacagcaccacctggcctag

SEQ ID NO: 47915 - DNA, 879 bp, Artificial Sequence
  Description of Artificial Sequence: Synthetic coding sequence
atgagcaaggtgaagcggttccccttcttcttcagcagcgaggccgaaaatggggtcgaagagaagaaaaaagcatgtaggagccccactgctcaaagccccacaccaagtgtggaggcggattcacccgatcaaaagaagataatctccctgtggtcaaagagctccttcgatggagcaagcctggcgtcggacaaaaacgactgcaagaccgaaagtaagaatgacccaaagacagagcgtaagaaaagctcttcttcgtcccaatacaaggccaatatgcacttccataagttgtttctctcagtgccaacagaggagccacttaaacagtccttcacatgcgccctgcagaaggagattttataccagggcaagttgttcgtgagcgagaattggatatgttttcatagcaaggtattcggtaaagacacgaagataagcatccctgccttttcggttaccttgattaaaaaaactaagacagccctccttgtgcccaacgccctgattatcgcaaccgttacggacagatacatcttcgtgagtttgctaagccgggattccacatacaagttgctcaaaagcgtgtgtggacacctcgagaacacgtccgtaggtaattctccaaacccctccagcgcggagaattccttccgggctgaccggccatcctctcttccattggattttaatgatgaattcagtgatctagacggtgtagtgcaacaaagaagacaggacatggaaggctactcttcctccggcagtcagacacccgaaagcgagaacagccgtgacttccacgctaccgaatcccagacagtgttaaacgtgtccatctttttatactccatgcagcttctctccgtgcattag

SEQ ID NO: 47916 - DNA, 987 bp, Artificial Sequence
  Description of Artificial Sequence: Synthetic coding sequence
atgtacaaggccaacatgcacttccacaagctgttcctgagcgtgcccactgaagaaccactgaagcagtcattcacctgcgcgcttcagaaggagatcctgtatcagggcaagttgttcgttagcgagaactggatatgtttccatagtaaagtgttcggtaaggacacaaaaatatcaatcccagcctttagcgtcaccctcataaagaagaccaagacagcactgcttgtgccaaatgccctcataattgcgaccgtgactgaccgctacatttttgtgagcctccttagccgggactccacctacaagctcctgaaatctgtctgcggacacctggaaaatacgtccgtcggaaactctcctaacccatcctctgccgaaaacagttttagagcagaccggccctcatctttgccgctggactttaatgatgaatttagtgatttggatggcgtagttcagcagcgtcggcaagacatggagggatatagtagtagtggatctcagacccctgaatctgaaaattctagagacttccacgctactgaatctcagacggtgctgaatgtgtccaagggagaggctaagcccacgagagcagacgcccacgtcaatagagtgccagaggggaaggcgaaaagcctgcccgtccaagggttgagcgagacagtgggtattttgcataaggtgaagtcccagaagtgccctatgcttcaccacatcctgatcttttacgccatagttgtctgcgctctgatcatctctaccttttatatgaggtaccgcatcaacaccctggaggaacagctcggattgctgactagtatcgtcgatactcacaatacggaacaagcagcccctagcgggctcaggtcccaagtccaatttaatgtagaggtgctttgccaagaactgacagccaatatcgtgaaactggagaagatccagaataacctgcagaagcttttggagaatggcgattag

SEQ ID NO: 47917 - DNA, 1251 bp, Artificial Sequence
  Description of Artificial Sequence: Synthetic coding sequence
atgagcaaggtgaagcggttccccttcttcttcagcagcgaggccgagaatggagttgaagaaaagaaaaaagcgtgtaggagtccaactgcccagagccccaccccatccgtcgaggctgactctccggatcagaaaaaaatcatctccctttggtctaaaagttcctttgacggcgcttccctcgccagcgataaaaacgattgcaaaactgaatctaagaatgatcctaagacagagcggaaaaagtctagcagtagtagccagtacaaagccaatatgcattttcacaaactatttctcagcgtgcccacggaggaaccgctgaagcagagcttcacctgtgcactccagaaagagattctctatcaggggaagctgttcgtatcagagaattggatctgtttccatagtaaggttttcgggaaggatacaaagatctcaatccccgcattctctgtgacacttataaagaaaactaagaccgccctgctcgtccccaatgcacttattattgctaccgtgactgataggtacatattcgtgagcttgctgagccgagactccacctataaacttttaaaatcggtctgtggtcatctcgagaacacttccgtcggaaactcaccgaacccctcttcagccgagaacagcttcagggcagaccgcccaagtagtctgcctctcgattttaacgacgaattcagcgatctcgatggcgtcgtgcagcagcgacgacaagacatggaaggatattcgtccagcgggagccagacacccgaatctgaaaacagccgggacttccacgccacagagtctcaaacagtccttaatgtcagtaagggcgaggccaaacccactagagcggacgcccatgtgaatagagttcctgaaggcaaagctaaaagtctgcctgtgcagggcctgagcgagactgttgggatcctccataaagttaagtcccaaaagtgtccgatgctccaccacatcctgattttctacgcaatcgtagtctgtgccctgataatcagcacattctatatgcggtaccggattaacaccttagaggagcaactcggcctcctaacatcgatcgtagatactcataatacagaacaggcagcacctagcggcctacggagtcaagtgcagttcaacgtggaggtcctatgccaggaattgacagctaatattgtcaagcttgaaaaaattcagaataatctgcagaagctgttagaaaatggtgactag

SEQ ID NO: 47918 - DNA, 1344 bp, Artificial Sequence
  Description of Artificial Sequence: Synthetic coding sequence
atgacccggcggcagcaggtgctgcaggccaagcggagcatccagcagacctttcaggcacagctgatgccctggaaaagcatgtttcatggcagagaggtgaagccagtaggaccagatttagagctctctgaggctgaaaacggcgtcgaggagaaaaagaaggcctgcaggtctccaactgcacagtcaccaactccttctgtggaagctgactcaccagatcagaagaagatcatttccctgtggagtaagagcagtttcgacggcgcttcccttgcaagcgacaagaacgactgtaaaacagagtctaagaacgacccaaaaactgaacggaaaaagtctagctcgagcagccagtacaaggccaatatgcatttccataaattattcctcagtgtgccgacggaagagccactgaagcagtcttttacgtgtgcgctacagaaagagattctgtatcagggcaaactgtttgtctcagaaaactggatttgcttccattcaaaagtctttggaaaggatacaaagatcagcattccagcatttagtgtcacacttattaagaagacgaaaactgcattgttggttccaaatgcccttattattgctaccgtgacggacaggtacatctttgtaagtctcctttctagagactcaacatacaagctcctgaagagcgtgtgcggacacttggaaaacacatccgtaggaaatagccccaacccaagctcagctgaaaacagcttcagagccgacagacccagctcactgcctttggacttcaacgacgagttttctgatctcgacggtgtggttcagcagagaagacaagacatggaaggatatagcagctcgggctcgcagacccctgaatcggagaacagcagagatttccacgcaacggagagccagaccgtcctcaacgtgtctaagggcgaggcaaaaccaaccagagcggacgcccatgttaaccgagtgcccgagggaaaggcaaagtccctccctgtgcagggcttgtcagagacggtgggcattcttcacaaagtgaaatcccaaaaatgtcccatgctccatcatatcctgatcttctacgcaattgtcgtgtgcgcgctgattatcagtaccttctacatgaggtacagaattaacacgctcgaggagcagctgggactgcttacatccattgtggacactcataatacagaacaagctgccccttcagggctccgcagtcaggtgcagttcaacgtagaggtgctctgccaggaactcactgcgaacatcgttaagctggagaaaattcagaacaatctgcagaagctcctcgagaacggagactag

SEQ ID NO: 47919 - DNA, 1761 bp, Artificial Sequence
  Description of Artificial Sequence: Synthetic coding sequence
atgagcgccggcgacgccgtgtgcaccggctggctggtgaagagccctcctgagaggaagcttcagcggtacgcctggaggaaacggtggtttgtgctgaggcgggggaggatgtccgggaatcctgatgtcctggaatactataggaataaacactccagtaaaccaatacgggtcatcgacctgagtgagtgcgctgtttggaaacacgtagggccttcattcgtgagaaaagagttccagaacaattttgtgtttatagtcaaaacgacttcacgtactttttacctggtagcaaaaaccgaacaagagatgcaggtctgggtgcactccatctcacaagtttgtaacttgggtcaccttgaagatggagccgattctatggaaagcctttcttataccccaagctccctgcaaccttcgagcgcctcatctctcctcacagctcatgcagcctcctcctctctgcctagagacgacccgaacacgaacgccgtggcaacggaggagacccgctccgagtcggaactcctctttctgcctgactatctggtgctctccaactgcgagaccgggcggcttcaccatactagtcttccaaccagatgcgactcatggagcaactccgatagatctctggaacaggcctccttcgacgacgtgtttgtcgactgccttcagccacttccctcatcccatctggtccatccctcctgccatggctcaggagcccaagaggtcccttctagtcgccctcaggccgctttgatttggtcccgggaaattaatggaccccccagggatcacctctccagctccccgctgctggaatcgtctctgtcaagtaccatccaggtcgataagaatcaaggatcattgccttgcggcgcaaaggaactggacattatgtctaacacacctccacctaggccgcccaagccaagccacctgtcagaaagacggcaggaggaatggtctacccattccgggtcgaagaaacccgagtgcacactagtccctaggaggatctccctctcaggactagacaatatgcggacatggaaagcagatgtcgaagggcagtctctcaggcatagggataaacgattgagcttaaatttgccttgcagattctctcccatgtatccaaccgcgtccgcatcaattgaagattcctatgtgccaatgtccccacaggccggagcgtcgggtctggggccccactgcagtcctgacgattatattccgatgaactccggcagtataagcagtccactgcctgaattaccagcaaacctggaaccacccccagtgaacagagacctgaagccccagcggaaaagcaggccccccccactagacttgaggaatctgtcaataattcgcgagcacgcttctctcacgcggactaggacagtgccttgtagccggacctctttcctgagtccggaacggaatgggatcaacagtgctaggtttttcgctaatcccgtttcgcgcgaagatgaagagtcttatatcgagatggaagaacatcggaccgcaagctccctgtcgagcggcgcacttacgtggaccaagaaattctctctcgactatttggcccttgattttaactctgcatctcctgcccccatgcagcagaagctgctgctttcagaggaacaacgcgttgactacgtgcaggtggatgagcagaagacacaggcattgcagagcacgaagcaagagtggactgacgaaagacaatctaaagtttag

SEQ ID NO: 47920 - DNA, 1764 bp, Artificial Sequence
  Description of Artificial Sequence: Synthetic coding sequence
atgagcgccggcgacgccgtgtgcaccggctggctggtgaagagcccccctgagcgaaaactgcaaaggtacgcgtggcggaagagatggttcgtattgcgcagaggccgaatgtcaggcaaccccgatgtgcttgagtattaccggaataagcactcctcgaagccaatcagggtcatagatctttcagagtgtgccgtctggaagcacgttgggccctccttcgttcgcaaagagttccagaacaatttcgttttcattgtcaagacgactagtcgcacattttatctggtggcaaaaacggagcaggagatgcaggtttgggtacactcaatatcacaggtgtgcaatctggggcacctcgaggatggcgccgccgactctatggagtctctgagttacaccccatcaagtttacaaccctcgtcggcatcttcattactgaccgcccacgcggccagctcctcgctccccagggacgaccctaacaccaatgctgtggcgactgaagaaacacgcagtgaaagtgaactactcttcctgccggattatctggtgctgagcaactgcgaaacggggcgcttacatcacacgtctctccctacccggtgcgatagttggagcaatagtgataggagtttggagcaagcttcttttgacgacgtgtttgttgactgtttgcagccactcccttcatcgcatttggtgcaccctagctgccatgggagcggcgcccaggaggtgccctcatcacgtccccaggctgctttaatctggtcaagagagatcaacggacctcccagggaccacctcagctcttcaccactactggagagtagcctcagctcaaccattcaggtggataagaaccaggggagtctgccctgtggagccaaggaacttgacatcatgtcaaataccccaccaccaaggccccctaagccttcccatctttctgagcgtagacaggaggaatggagtacccattcagggtctaaaaaaccagaatgcaccttggtgcctcgtcggatctccctatcaggcttggacaacatgagaacctggaaggcagacgtcgaaggtcagagcctgcgccacagggacaaacgactgtctctgaacttgccatgcagatttagccctatgtatccaaccgcttccgccagcattgaggattcctacgttccaatgagtccccaggccggggctagcggccttggcccccactgcagtcctgatgattatatccccatgaactcaggcagtataagttccccccttcccgagcttccagccaatctggaacctccccctgtaaacagggatctcaagccacaacggaaaagcaggcctcctccccttgatctgcgcaacctgtccattatacgggagcacgctagcctgacgcgcactcgcaccgtaccctgctcccggacaagcttccttagccctgagcgcaacggaatcaactctgctaggtttttcgctaaccccgtgtcaagggaagatgaagagtcatatattgagatggaggaacatcgaacagcttcgtctctatcaagtggagctctcacatggacaaagaaatttagcctggattacctcgcattagactttaatagcgcttcaccagctccaatgcagcagaagctgttgctctctgaagagcagcgagtcgactatgttcaggtagatgaacaaaaaacgcaggccctgcagagtactaagcaggaatggaccgatgagaggcagtcaaaagtgtag

SEQ ID NO: 47921 - DNA, 1725 bp, Artificial Sequence
  Description of Artificial Sequence: Synthetic coding sequence
atgagcctgcccagccccagccccagccgggagctgtgcccccccgacccagccttcgcacctctctcttcctggccagggtcaggccccgctggaggatctacacggtctggtcacgttctgtactccggttggcttcgcaaatcacccccagagaaaaagctcaggctgttcgcctggcggaagcggtggttcatcttgaggcggggtcagacatcttctgatccagacgtactcgagtattataagaacgatggcagtaaaaaaccccttagaacgattaaccttaatctatgtgagcaactagacgtggacgtgaccctgaatttcaacaagaaggagattcagaaaggttacatgttcgatatcaagacttcagagagaaccttctaccttgtggcagaaacaagggaagacatgaacgaatgggtacagagtatctgccagatatgcggattccggcaggaggagtcgacaggcttcctcggcaatatttcatccgcttcgcacggcctttgctcttccccagcagaaccttcatgttcccaccagcacttgccccaggaacaggaacctacatcagaaccacccgtgagccactgcgtcccccccacatggccaatccccgcacccccaggatgcctgaggagtcaccaacacgcatctcagagagcagaacacgcaagatctgcctccttcagccagggttcggaggctccattcattatgcgaaggaacacagcaatgcaaaatttggcccaacacagcggctatagtgtggacggcgtgtcgggccacatccacggcttccactcactatcaaagccttcacaacataatgccgaatttcgtgggagcactcatcgcatcccctggtcgctggcttcccatggccatacccgcgggtcgcttactggctctgaggctgacaacgaagccagttccggaaagtatactcagcacggcggtggcaatgccagccgccctgccgaaagtatgcatgagggtgtctgttccttcctccctggccggacgcttgttggactatctgattcaatcgcgtccgagggctcatgtgtgcccatgaacccaggctcccccacactgcctgcagtgaagcaggcaggcgatgattcccaaggtgtgtgtatccccgttgggtcgtgcttggttcgctttgatctgctggggagccccttgactgagttgtccatgcaccaggatttgagccagggccacgaggttcaattaccacccgtaaacaggagcttgaagccaaaccagaaagccaatcctactccgcccaacctgcgaaacaaccgcgtgatcaacgagctgtctttcaagccacccgttacagagccttggtccgggacatcacacacctttgactcaagttcgagccagcaccccatctccacgcaatccataacaaacacggactccgaggactccggagaaaggtatctctttcccaacccggcgtccgcctttcccgtctctgggggcacttcctcctctgcaccccccaggtccactggaaacatccactacgccgcgcttgactttcaaccgagcaaaccctccatcggaagcgtgacgagcgggaagaaggttgattatgttcaggtcgatctcgagaaaacccaggccctccagaagaccatgcacgaacaaatgtgtctccgccagtccagtgaaccgcctcgtggtgcaaaactatag

SEQ ID NO: 47922 - DNA, 357 bp, Artificial Sequence
  Description of Artificial Sequence: Synthetic coding sequence
atggagagcgtggccctgtacagcttccaggccaccgagagcgacgaacttgcattcaataagggggataccctcaagatcctaaacatggaggacgaccagaattggtacaaggcagagctgagaggggtcgaagggttcatacctaagaattatattagagtcaaacctcacccctggtattcaggccgtatcagcaggcagttagctgaggagatcctgatgaaacgaaaccatctcggcgcctttctaattagggaatctgaatccagccccggcgagttctcggtttcggtcaataatcgggcacagcgtgggccttgcttagggccaaaatctcatagcaggctgggttag

SEQ ID NO: 47923 - DNA, 567 bp, Artificial Sequence
  Description of Artificial Sequence: Synthetic coding sequence
atggaggacgaccagaactggtacaaggccgagctgcggggcgtggaaggatttattccaaaaaattacattagagtgaaacctcacccttggtactctggcagaattagccgtcagctcgcggaggagatccttatgaagaggaatcatctcggggcattcctcatcagagagtcggagtcatcaccaggggagttttccgtgtctgttaattatggcgatcaagtgcaacatttcaaggtacttcgtgaggctagtggaaaatactttctgtgggaagagaagttcaacagcctgaatgaattggtggatttttataggactaccacaattgccaaaaagcggcaaatcttcctaagggatgaggaaccgctgctgaagtcccctggggcttgctttgcacaggcccagttcgatttctcagcacaagaccccagccaactgagctttcgcaggggtgatattatcgaagtacttgaaaggcccgatcctcattggtggcggggccgcagctgcggccgcgttggtttttttccaagaagctatgttcagcccgtccatctctag

SEQ ID NO: 47924 - DNA, 123 bp, Artificial Sequence
  Description of Artificial Sequence: Synthetic coding sequence
atgctgctgcgggagatcacctacagcatcacccccctgagcctgcacggaacttcactcctgaattgcaattggagggcaaccgggttggtgaccctcgaagggcatcgcccgtttcagtag

SEQ ID NO: 47925 - DNA, 801 bp, Artificial Sequence
  Description of Artificial Sequence: Synthetic coding sequence
atggtgctgagcggcgcccaggcccagatggaccagaaccccggctactaccaccaactgctgcagggtgagagaaatccacggctcgaggatgcaatcaggactgacttaaacaggacatttccagataacgtcaaatttcgcaagacaaccgacccctgtctgcagcgtacgctctacaatgtccttctggcttatggccatcacaaccagggcgttggatattgtcaagggatgaatttcatcgctggctatctgattctcataacgaataatgaggaagagagcttctggctcttggacgcgcttgtcggtaggattctacctgactactacagtccagccatgctgggcctcaagacggatcaggaggtcctgggggagctagtgcgcgctaagctccccgctgttggcgctttgatggaacgtctgggagtgctgtggactctcctggtgtcacgctggtttatctgtttgtttgtggacatcttacctgtggagaccgttctgcgcatttgggactgcttattcaatgagggttcaaaaatcatcttccgggtggccctgaccctcataaagcaacatcaggagctgatacttgaggccacctcagtaccagatatatgtgataagttcaagcagattaccaaaggtagctttgttatggaatgtcacacctttatgcaggtttgtggcgccgccaggggaagtgttccaagccagggagctcccccccatctgcagcccggcggatgcagcgaccaccccgaaggcgcgcaggacggccaccaatgggcctag

SEQ ID NO: 47926 - DNA, 1035 bp, Artificial Sequence
  Description of Artificial Sequence: Synthetic coding sequence
atgcagcccgccgagcggagccgggtgccccggatcgacccctacggcttcgaaagacctgaggattttgatgatgcagcctacgagaaattttttagttcctacctcgtcacattgaccagaagagcaatcaagtggtccaggctccttcagggcgggggcgtcccacgctcacgcacagtcaagcggtacgtgcggaaaggggtgcccctcgagcatcgtgcccgggtgtggatggtcctcagtggtgcccaagcccagatggaccaaaaccccggttattaccatcagctgcttcagggagaaagaaatcctcgcctagaagatgccatccggacggatttgaatcggacatttcccgataatgttaagttcagaaagacgaccgacccctgcttgcagagaactctctataatgtacttctggcgtatggccaccacaatcaaggggtggggtactgtcaaggtatgaattttattgcaggctaccttatattgataaccaataacgaggaggaatccttttggctgctggatgcattggtcgggcgtatcctcccggactactactcccccgcaatgctgggactgaagaccgatcaagaagtgttgggcgaattagtccgggctaaactgcctgccgtcggggccttgatggagcgcttgggagttctgtggacattgctcgtgtcaagatggttcatctgtttgttcgtcgacatactgccagtggaaaccgtactgcggatttgggactgtctgtttaacgaagggtcgaaaattatatttcgcgtcgctttaaccttaataaagcagcaccaggagctgatcctggaggcaacgtcagtgcccgatatctgtgataagttcaagcagattacaaaaggttcctttgtcatggaatgccacaccttcatgcaggtttgtggggctgccaggggaagcgttccgagccaaggcgctcccccacatctgcagccgggtggatgtagtgatcacccagagggtgctcaggacgggcaccagtgggcttag

SEQ ID NO: 47927 - DNA, 1011 bp, Artificial Sequence
  Description of Artificial Sequence: Synthetic coding sequence
atgcagcccgccgagcggagccgggtgccccggatcgacccctacgggttcgagcgaccagaggactttgacgacgcagcatacgagaaatttttcagctcatacctcgttactctcacccgacgggccattaagtggtcaagactgcttcagggtggaggggtacctcgaagcaggacggtgaagcgatacgtaagaaaaggtgttccattggagcaccgggctcgagtgtggatggtgttaagcggggcccaggcccagatggatcagaatcctggatactaccaccagctcctgcaaggtgaacggaaccctcggctcgaagatgctataaggacagatctcaataggaccttccccgataacgtgaaattccgcaagacaaccgacccctgtttgcagcgcaccctgtacaatgtgctcctggcctacggacatcacaatcagggcgtcgggtactgtcagggtatgaactttatcgctggatacctgatcctgataacaaacaacgaggaggaaagtttctggctgttggacgcccttgtgggtcgcatattgccagactactactcgcccgccatgcttgggctgaagacagaccaggaggtgcttggggaactagttagggcaaaactgccagcggtgggagccctcatggaaaggctgggtgttctatggactttactggtctcaagatggttcatatgtctgtttgtggacatccttcctgtggagactgtcctcaggatctgggactgcctgttcaatgagggcagcaagattatttttagggtggcgctgactctaataaaacagcaccaggaattgatactggaggccaccagtgtgccggatatatgcgacaagttcaagcaaattacgaagggaagcttcgtgatggagtgccacactttcatgcaaaagatcttcagtgagccaggttccctaagtatggccactgtggctaagctgagggaatcctgcagagctagactgttagctcaaggatag

SEQ ID NO: 47928 - DNA, 3654 bp, Artificial Sequence
  Description of Artificial Sequence: Synthetic coding sequence
atgaagggcatgagccacgagcccaagagccccagcctgggcatgttatccaccgctacacgaaccaccgctactgtgaatcccctgacacccagcccactgaacggtgccctggtgccttcagggagtcccgcgactagcagcgctctttcagcccaggccgcccctagctcaagctttgcagccgctctgcggaaactagctaagcaagcagaagagcctcggggttctagcttgtccagtgagtccagccccgtgagctctcctgcaacaaatcactcctcacctgcgtcgacaccaaaaagagtacctatggggccgatcatcgtgccaccagggggccactcagtgccaagtacgccgcccgtggtcactatcgcacccaccaagactgtcaacggcgtctggaggtccgaaagtcgacaggacgccggaagtaggtctagttctggcggcagagaacgcttaatcgtcgagcctcccctcccccaagagaaggcagggggccccgcaatcccaagtcacctgctcagcacaccctacccttttggcctctctcccagctccgtggtgcaggattctagatttccacccctgaacctacaaagacctgtgcaccacgtcgtccccccgagtaccgtgactgaggattacctgcgtagcttccgtccttaccacaccaccgacgaccttcggatgtcaagcctcccgcctctcggactggaccctgctacggccgctgcatactaccacccctcgtacctcgcaccacacccctttcctcatcctgcttttaggatggacgattcatactgcctctctgctctgcggtccccattctaccccatcccaacccctggttctctgcccccgctgcatccttcagccatgcaccttcatctgtccggggtgcgataccccccagaactctcccactcatcgctcgccgccctgcactctgagagaatgagcggactgagcgccgagcgtctgcaaatggacgaagagctcagacgggagcgggagagggagagggaaagagagagggaaagagaggccgaccgggaaagggaaaaagagagagaacgggagagagagaaggagagggagcaagagaaagagcgcgagcgggagaaagaacgagagagggagctggagcgccagagggagcagcgtgctcgagagaaggagttgttggccgcaaaggcccttgagcccagttttctgcctgttgcagaactgcacgggctgcgaggccacgctactgaggagcgcggaaagccaagtgagcaactgacccccacccgcgctgaaaaactgaaagacgcaggcctccaggccccaaaacccgtgcagcatccacttcatcccgttccaacccctcatcatacagtgccctccttgatcagtaatcacggcatcttctccctgccgtcttcgtcagccgctaccgctctgctcattcagaggacaaatgaagaagagaaatggctggcgagacagagacgcctgcggcaagagaaggaggacaggcagtcccaagtgtctgagtttcggcaacaggtgctcgaacagcatctcgacatgggtcggcctcctgtgccagcagaggccgagcacaggccagaatctactacccgccccgggccaaaccgtcatgagccaggagggcgcgatcctcctcagcactttggaggacctccaccactcatcagtcccaaaccccagttacacgcagctcctaccgccctgtggaacccggtttcattaatggataacactctggagacacggagagcggagtcacatagtctacactctcatcctgcggcgtttgaaccctcccgccaggccgctgttcctctggttaaggtcgaacgcgtgttttgtcctgagaaggcagaggaggggccccgtaagcgagagcctgccccgctggataaataccagccccccccacccccgcctcgcgagggtggatcactggagcatcagcccttcctgcccggacctgggcctttcctcgcggagctggaaaaatcaactcaaacaatcctcgggcaacagagagcatccctgccacaggccgcgaccttcggtgagctgtccggaccactcaaaccaggctctccttacagacctcctgtgcccagggcccctgacccagcctacatatatgacgaatttctgcagcagcggagaagactcgtctctaagttggatcttgaggagcgtaggcgccgcgaagcccaggagaagggatattactacgatttagacgattcctatgatgagagcgatgaagaggaggtaagggcccatctgcggtgtgtcgctgagcagcctcccctgaaattggacacctcctccgagaaactggaatttcttcaactgttcggcctcaccacccaacaacagaaagaagagttggttgctcagaagagaagaaaaaggcggaggatgttgcgagaaaggtcacctagtcctccaacaatacaatctaaacgtcagacaccaagtccgaggttagccctttccacaaggtacagccctgacgagatgaacaactcccccaattttgaagagaagaaaaaattcctgactattttcaatcttacccatattagcgccgaaaaacgaaaggataaagagaggctggtggagatgttacgagccatgaagcagaaagctctctccgccgcagtcgcagactctctgaccaatagtccccgggactccccagccgtgtcactgagtgaacctgcaacccaacaggcttcactggacgttgagaagccagtcggagtggctgcgtctctgtcagacattccaaaggccgccgagcccggcaaactggaacaggtgcggccccaggagctgtcaagggtgcaggagttggctcccgcctctggcgaaaaagcacggctgtctgaggcacccgggggcaagaagtctctctctatgcttcattatataagaggagcagcacccaaagacatacccgttcctctgagtcactccactaatggtaagagcaagccctgggagccttttgttgctgaagagttcgcccaccaatttcacgagagcgttctccagagcacccagaaggccctccaaaaacataaaggcagcgtggcggtgttgtccgccgagcagaatcacaaagtggacacctctgtccattacaacattccggaacttcaaagctcgagtcgcgcaccccccccccagcacaacggccagcaagaacctcctacggcacggaaggggccacctacacaagagttagacagagacagcgaggaggaggaggaggaagatgatgaggacggtgaggacgaggaagaggttccaaaacgtaagtggcagggaatagaagccgtgttcgaagcctatcaagagcatatagaggagcagaacctggagcggcaggtgctgcagacacaatgccgcagactagaggcaagacattacagtttgagtcttaccgccgagcaactgagccacagcgttgctgaactgaggtcacagaaacagaagatggtgtcagagcgggaaagactgcaggccgagctggatcatctgcgcaagtgtctggcccttcccgccatgcactggcctagaggctatcttaaggggtaccctcggtag

SEQ ID NO: 47929 - DNA, 3342 bp, Artificial Sequence
  Description of Artificial Sequence: Synthetic coding sequence
atgggccccatcatcgtgccccccggcggccacagcgtgcccagcaccccacccgtggtgaccattgccccaacgaaaacggtgaacggcgtgtggcggtctgaatcgcggcaggacgccggctcccggtcctcatccgggggacgcgagcgactcattgtcgagccaccattacctcaggagaaggccggggggcccgccatcccctcacatttactgtctactccctaccccttcggactgtcaccttcatctgtggtgcaggactcgcgctttccccccctgaatctacagaggccagtgcaccatgtagttcctccaagcacggtgacggaggactacctgagaagttttagaccataccacactaccgatgatctaagaatgtccagcctcccacctctcggcctggatcctgctactgccgccgcgtactatcacccgtcctatctagcccctcaccccttcccccatcctgccttccgtatggacgattcatactgcctatcggccctgagaagccccttttatcccatccctactcctgggtcactgccaccacttcatccttctgcaatgcacctgcacctctccggagtgcgatatccgcctgaactgagccactctagccttgcagccctgcactccgagagaatgtcaggcctgtccgcagaaaggttacagatggatgaagaattgcgacgcgagcgcgaacgggagcgcgagagggaaagggagcgggaggctgaccgagagcgcgagaaagagagagagcgagagagggagaaagaacgcgagcaggagaaggaaagagaaagggagaaggagcgcgagcgggaactggagcgtcaaagggagcagcgcgcgcgagaaaaggaactacttgctgcaaaggcactggagccttccttcctcccggtggccgaactccacggcctcagagggcacgccacagaggagcgggggaagccatcagagcagttgacccctacgagagcagagaaactgaaagacgcagggctgcaagcgcctaagcccgtgcagcatcctctgcatcctgttcccacccctcaccacaccgtccccagcttaatctctaaccacgggattttctctctgccgtcatcttcagccgcaactgctttgctgatccagaggactaacgaagaggaaaaatggcttgcccgccaacgccggctgcggcaagaaaaggaggataggcagagccaagtcagtgaattccggcagcaggtgctggagcagcacctggacatgggcagacccccagtacctgccgaggccgagcatcggcccgagtccacaacaagacctggacccaacagacacgaacctggcggaagagatccgcctcagcacttcggcggtcccccaccattgatctccccaaagccccaattacacgctgcacccaccgcactttggaacccagtcagtctgatggacaacacgctcgaaaccagacgcgccgagtcccattcgctccattctcatcccgccgcctttgagccctctcggcaggccgcagtgcccttagtgaaagtagagagggtgttctgtcccgaaaaggcggaggaaggccctaggaagcgcgagcccgcacctctggacaagtaccagccaccacctccccctccccgcgaaggcggctccttggaacatcagcctttcctccctggccccggccccttcctggcagaacttgaaaaaagcacacagacaatcctaggtcagcagagagcctcgctgcctcaagcagccactttcggcgaactgagcggaccgcttaaacccggctccccgtaccgcccgccagtgccccgcgcgcctgatcctgcttacatctacgatgagtttctccagcagaggagaaggcttgtaagtaagctggacctggaggagcgaagacgtagggaggcccaagagaaagggtattactacgatctcgacgactcctacgacgagagcgatgaagaagaggtgcgtgcacatttacggtgtgtggctgaacagcctccgctcaagcttgatactagttctgagaagctagagttcctacagttgtttggtctgacaacacagcagcaaaaagaggagttagtagcccagaagagacggaagagacgccgaatgctgagagagagatcgccgagtccacctaccatccagtctaagagacagaccccttcaccaagattggcattgagcaccaggtactcccctgacgaaatgaataatagccccaactttgaggaaaaaaagaaattcctgaccatctttaatctgacccatatctctgccgagaagcgaaaagacaaggagagacttgtggaaatgcttcgggcgatgaagcagaaagccctgagcgccgccgttgcggatagcctgacaaattctccgagggattcccctgccgtttcgctgagcgaacccgctactcagcaggcttcgctggacgttgagaagcccgtgggcgttgccgcctcgctatctgacattcctaaggcagccgaacctgggaagctggaacaagtccgccctcaggagttgagcagagtccaggaactagcaccggctagtggagagaaagcccggttatctgaggcccctggcggaaaaaagtctcttagcatgctgcactacatccgcggcgcagctccgaaggacataccagtgcctctaagtcattcaacgaatggaaagtcaaagccttgggagccgtttgtcgccgaagagttcgcacaccagtttcacgagagtgtgttacaaagcacacagaaagctcttcaaaaacataaaggctctgttgcggtgttaagcgctgaacaaaatcacaaggttgatacaagtgttcactacaacattcctgagctgcagtcgagctccagagcgcctcccccacagcacaatggccaacaggaaccccctaccgccaggaaaggtccaccaactcaggaattggaccgtgacagtgaggaagaggaggaagaggacgacgaagacggggaggacgaggaggaagtacctaaaaggaaatggcagggaattgaggctgtattcgaagcgtaccaagagcacattgaagaacagaacctcgagcggcaggttttacagacccagtgcaggcgactggaggctcgtcattattctctctcgttaactgctgaacagctcagccactcagtggccgagctgcggtcccagaaacagaagatggtgtccgagagagaaagactccaggcagaactcgatcacctcagaaagtgcctcgcgcttcccgccatgcattggccaagggggtacctgaaaggctaccctcgctag

SEQ ID NO: 47930 - DNA, 2463 bp, Artificial Sequence
  Description of Artificial Sequence: Synthetic coding sequence
atggtggtggacttctgccggcggttcgtggcccggagcctgtgcatcatactgatgaagcacttttgcagtagcagtgtttctgaggacctgggctgcagaagaggtgattttagtaggaaacactacggctcagtggagctgctgatttcgtcggatgctgacggggccattcagcgtgcaggccgcttcagagttgaaaatgggagttcggacgaaaatgcaaccgccctccctggtacctggcggcggacagatgtgcatctggaaaaccctgagtaccacactcggtggtatttcaagtattttttgggtcaggtccatcaaaactatattggtaatgacgcagagaaatcaccattcttcctatcagtcactctgagtgatcagaacaaccaacgggttccacaataccgagccatcctgtggcgaaagacagggacccagaagatctgtctcccatactcgcccactaagactctgtctgttaaatccattctttccgcaatgaatctcgacaagttcgagaagggaccgcgggagatattccatcccgagatccaaaaggatctgttggtcctggaggaacaggagggctctgtgaacttcaaattcggcgtgctgttcgctaaagacgggcagctgactgatgacgaaatgttcagcaacgaaattggttcagaaccattccagaagttcctgaacctcctaggcgacactataaccttaaagggttggaccggctatcggggcggtctagatacaaagaacgatactactgggattcattctgtctataccgtgtaccagggacatgagatcatgttccacgtttcaacaatgctaccttactcaaaggagaataagcagcaggtcgaacgcaagcgtcatattggaaacgacatcgtaacgatcgtctttcaggagggagaggaatccagtcctgctttcaagccctcgatgattcggagccattttacacacatttttgcactcgtccgatacaaccagcagaatgacaattatcgcctcaagatcttctccgaggagagcgtgccgttatttggaccacctctaccaacccctcccgtgttcacagaccatcaagagtttcgggatttcttgctggtgaagctgatcaatggagaaaaggccacgctggagacacccacatttgctcagaagcgccgccgcacgctggacatgcttatcaggtcactacaccaggacctcatgcccgacctccataagaatatgctgaaccgtcggagcttttctgacgtgttgccagagagccccaaatccgcacgcaaaaaagaagaggcccgccaggccgagttcgtcaggattggccaggcattgaaattgaaaagtatagtgcgaggggacgccccctctagtctagctgcatcagggatatgtaagaaagagccttgggaacctcagtgtttctgctcgaatttccctcatgaggccgtgtgcgcagacccctggggccaggctttactggttagtacggatgccggggtactgctggttgatgatgacctgcccagtgtgcccgtcttcgataggactcttccagtgaaacagatgcatgttctggaaacccttgatcttctcgtgctgcgggccgacaagggcaaggacgcccgcttgttcgttttccgcctgtcagcgctgcagaaggggctggagggtaagcaagccggtaaatccaggtctgactgtagagagaataagttagagaagaccaagggctgtcacctgtatgcaatcaatacacaccacagtcgggagttgcggatcgtggttgcaatccggaataaactcctcttaataactcgtaagcacaataagccttccggagtgacatcaacaagtctgctgtcacctctgagcgagtcccctgtcgaagaattccaatatattcgcgagatttgcttgagtgacagcccaatggtgatgactttggttgacggtccagctgaggaatccgacaacctgatctgcgtcgcgtataggcatcagtttgacgtagttaatgagagtaccggcgaggcgtttcgactacaccatgtggaggccaacagagtgaacttcgtggctgctattgatgtctacgaagatggagaggctggtcttctgctgtgctataactacagttgcatctacaagaaagtctgtccttttaatggaggtagttttctcgtacagccctctgccagtgactttcagttttgttggaaccaggccccatatgcaattgtttgtgcattcccctatctgctcgcttttaccactgattcgatggagatcagactggtggtaaatggcaatttagttcacaccgcagtcgtgcctcaattgcaactggtggcgtctagagttaagttcaaccagaagatatgtacgagattccatctggagacatcatgggccgaagctagcaatgacctgtag

SEQ ID NO: 47931 - DNA, 3042 bp, Artificial Sequence
  Description of Artificial Sequence: Synthetic coding sequence
atggtggtggacttctgccggcggttcgtggcccggagcctgtgcatcatcctcatgaagcatttttgctccagttcagtgtcagaagacctgggctgcagacgaggggattttagtcgtaaacactacggatccgtggagctcctgatttcctcagacgctgacggggccattcagcgggccgggcgctttcgggtcgaaaacggcagttcagacgaaaatgctacggcgctgcccggaacatggaggaggacagatgttcacctcgagaacccagaatatcatacccgctggtactttaaatattttttaggccaggtgcatcagaactacatcgggaacgatgccgagaaatcacctttcttcttatccgtaacattgagcgaccagaataatcagagggttccacaatatcgtgccattttgtggagaaaaaccggcactcagaagatatgtttaccatactcccccaccaaaacacttagtgtcaagtctatcctgtccgctatgaatctggacaaatttgagaaaggtcctagggagatcttccatcctgaaatccagaaagacctcctggtgttagaggaacaggagggaagtgtgaatttcaaatttggggtgttgtttgccaaggacgggcagttaaccgatgatgaaatgtttagtaacgaaatcgggtcagagccctttcaaaagtttctgaacctcctcggggacacgattacacttaaaggttggacaggatatcgcggcggactcgatacgaaaaatgacacaactggaattcacagtgtatacactgtttaccagggccacgagatcatgttccacgtcagcacaatgctcccatatagcaaagaaaacaaacagcaggtggaaaggaaaagacacatcgggaatgacatcgtcaccatcgtcttccaggagggcgaagaaagctcccccgccttcaagccttctatgatccgtagccacttcactcacatttttgccctagtccggtataaccagcagaatgacaactaccggctgaagatcttctctgaagaaagcgtgccactcttcgggccccccctcccgactcctccagttttcacggatcatcaggagtttcgagactttctgctggtaaagttgattaatggggaaaaagcgacattggaaacccctacctttgctcagaagaggaggaggaccctggacatgctcattagatccctgcaccaggatctgatgcctgatctgcataaaaacatgctcaaccggagatccttttccgacgtgctgccagagtctccaaaaagcgcgcggaagaaggaagaagctcgacaggctgagttcgtccgcattgggcaggcactgaaactgaagtccatcgtgcggggcgacgcaccttcgtctctggcagcctcaggcatctgcaagaaagaaccatgggagcctcagtgcttctgctctaacttccctcatgaagctgtctgcgccgatccctggggacaggctttactagtctctaccgatgcaggagtcttgctggtcgacgatgacctaccctccgtacccgtgttcgaccgcactctccccgttaaacagatgcacgttctggagaccctggatctcctcgtgctgagagccgataaaggtaaggatgctaggctttttgtgttcaggctgagcgctctgcagaagggcctggagggaaaacaagcagggaaaagtagatcagattgtagggaaaataaattagaaaagacaaaggggtgccatttatacgccataaacacccaccactcccgagagctcagaatcgtggttgcgattcggaacaaactgctcctgatcacaaggaagcacaacaaaccatctggggtaaccagcacaagcttgctgagcccactttccgaatcaccggtggaggagttccagtatatccgcgagatctgtcttagcgacagtcccatggtgatgaccttggtggatgggccagccgaggagagcgacaatttgatttgtgtagcctatcgacaccaattcgatgtggttaatgaatctactggagaagcgttccggctccatcacgtggaggccaatagagtgaacttcgtggctgcaattgacgtgtacgaagatggcgaagcaggattgcttctctgctacaactactcttgcatttataagaaagtctgtccattcaatggtgggagcttcctcgttcagccttccgcttccgacttccagttttgctggaatcaggccccctatgcaatcgtatgtgctttcccctacctgctggccttcactaccgacagcatggagatacgactggtggtcaacggcaacttagtgcacacagcagtggtgccccaactccagctggtggctagcagatctgatatctatttcacagctaccgctgccgtgaatgaagtctcgtcaggaggcagtagcaagggtgcaagcgcgagaaactccccccagacgccaccggggcgggacaccccagtcttcccgtcatcattgggagagggcgaaatacagtctaagaatctgtacaaaatccccctccggaacttggtgggccggagtatcgagagaccgctgaaatccccactggtctcaaaagtcatcacgccgccgacaccaatcagtgtcgggctcgcagccatccccgtaactcattcccttagcctgagcagaatggagatcaaggaaattgcctcaagaacaaggagggaactactcgggctctccgatgagggaggccctaaatctgagggtgctcccaaagcaaaatccaagcctagaaaacggctcgaggaatcccaggggggacccaagcccggcgcagtgagaagttctagctcagaccgaattccatctggttcattggaaagtgctagcacctcagaagcaaacccagaaggacattctgcaagctccgatcaggacccagttgcagacagagagggttcccccgtgtcgggctcctctccattccaacttacggcattttctgatgaggatatcatagatctaaaatag

SEQ ID NO: 47932 - DNA, 807 bp, Artificial Sequence
  Description of Artificial Sequence: Synthetic coding sequence
atggaccccctgaccaaggtgccctgcggcagccagatcgcccagacaatactgtggaaggcaaagtcttcactcagtttcgggatacagccacttcagacatggcccacgaaagaccctgaacttgagagtcaggtaaacctctccgttagcgaagacctcggctgtcggcgcggtgatttttccagaaagcactacggtagcgtcgagctcctgattagtagtgacgccgacggtgcaatacaaagggctggccgattccgcgtcgagaacggctcaagtgatgagaatgcaacagcacttcccggaacatggcgcagaaccgatgtccacttagagaacccagagtatcataccaggtggtatttcaagtactttctggggcaagtgcaccagaattacatcggtaacgacgccgagaaatcccccttttttctgagcgtgacgctctcagatcagaataatcagcgggttccccagtacagagcgatcctgtggaggaagaccgggactcagaaaatctgtctcccttacagtccaacaaagactctatccgtaaaatctattctgagcgcgatgaacctagacaagtttgagaaaggccccagagagattttccatcccgaaatccagaaggatctgctggtgctcgaggaacaggagggcagtgtgaacttcaaatttggggtgctctttgccaaggacggacagctcaccgatgatgagatgttctcgaacgagatcgggtcagagcccttccagaagtttctcaacttgctgggtgacaccattactttaaagggatag

SEQ ID NO: 47933 - DNA, 2976 bp, Artificial Sequence
  Description of Artificial Sequence: Synthetic coding sequence
atgaagagcagcgtgagcgaggacctgggctgccggcggggcgacttctccagaaagcactacggcagcgttgaattgctaatttcaagcgatgcggatggagctattcaacgagctggtcgattccgagtggagaatgggtcgtctgatgaaaatgcaactgccctgcccggcacatggcggcgaaccgacgtgcatttagaaaatcccgagtatcatactcgctggtacttcaagtactttcttggtcaggtacatcagaactacatcgggaacgatgccgagaagtctcctttcttcctgagcgtcaccttatccgaccagaacaaccaacgggtaccccagtatcgagctatactatggagaaagacgggaacccagaaaatttgtttaccctactcccccactaaaactctgagcgttaaatcaattctttccgcaatgaatctcgacaagtttgagaagggcccccgagaaatctttcatcccgagatccagaaagatttgttagtgttggaggaacaggagggatctgtgaactttaaatttggtgtcctgttcgcaaaagatggccaactcacggacgatgaaatgttctctaacgaaattgggtccgaacctttccagaagttcctcaatctcctgggagacaccatcactctcaaaggctggaccgggtatcgagggggcttagatactaaaaatgacactaccggaattcatagtgtttacacagtctaccagggtcatgagataatgtttcatgtgtccacgatgctaccctactccaaagaaaacaaacaacaggtggaacgcaaacggcatatcggcaacgatatcgtaacaatcgtgtttcaggaaggcgaagaaagcagcccggcttttaaaccgagtatgatcagatcccattttactcacatattcgcactggtgcgttataatcagcagaacgacaactacagactgaagatcttctctgaggagtcagttccactgttcgggcctcctctacccactccaccagtctttactgaccatcaggagttcagggattttttgctagttaaactaattaatggtgagaaagcgaccctcgaaacccccaccttcgcacagaagcgccgcagaactttggacatgctgatcaggtccctccatcaggaccttatgccggacctgcacaagaatatgttaaaccggaggtccttttcagacgtcctcccagagagcccaaagtcagcaaggaaaaaggaagaagctcggcaggccgaatttgtgaggatcggtcaggcactgaaacttaaaagcatcgtgcgaggtgacgccccatcatctttagcagcatccggcatatgcaaaaaagagccctgggagccccagtgtttctgctctaatttcccccatgaagcagtttgtgctgacccatgggggcaggctttgctagtgagcactgacgccggagtactcttagtggatgacgatctcccttccgtgccagtgttcgacagaaccctgcctgtgaagcagatgcacgtccttgagacccttgatttgctagtcttacgggcagacaagggaaaagacgccaggctgttcgtgttccgactcagtgcattgcagaagggtttggagggaaaacaggctggaaaaagtcggtccgactgccgcgaaaataaactggaaaaaacaaagggatgccacttatacgcgatcaatacacatcacagtcgggagctccgcattgtggtcgccatcagaaataagctgctgctgataacgcgcaaacacaataaaccttccggcgtcacttctactagcctgctatctcctcttagcgagtctccggtcgaggaattccagtacatcagagaaatttgcttgtccgacagcccaatggtcatgacgttagtggacgggcctgcagaggaaagcgataacctgatttgcgtggcctacagacaccagtttgatgtggtgaatgaaagtacaggagaggcttttagactgcaccatgtggaggcaaacagggtcaattttgtagcggctatcgacgtgtacgaggatggcgaggcagggctcttactgtgctataattatagctgcatttataagaaggtttgtcccttcaatggtggctcctttctggtgcaaccttccgccagcgactttcagttctgctggaaccaggcaccctatgctatcgtgtgcgcatttccatacttgctagcttttaccactgattcaatggagatacggctcgttgtgaatggaaacctggtgcataccgccgtggttcctcaactgcagctggttgcgtccaggtctgatatctactttaccgcaaccgccgctgtcaatgaggtcagcagcggtggctccagcaagggggcaagtgcacgcaatagccctcaaacacctcctgggagggacacaccagtgtttccatcgtctctcggcgaaggcgagatccagagcaagaacctctacaagattcccttgagaaacctggtgggcagaagcatcgaaagacctctaaaatcccctttggtgtcaaaagtgattacaccccctactcccatttcagtgggactcgccgctattccagtgacgcattcattaagcctgagtcggatggagattaaagaaatcgcctcccggacgaggcgcgaattactcggtttatccgatgagggaggccccaagtcagagggggccccaaaggctaagagtaaaccccggaagagactcgaggagtcccagggtggcccaaagcccggggcagtacgtagctcatctagcgaccgcattccatccggtagcctcgaatcagctagcacatccgaagctaatcccgaggggcacagcgcctccagtgatcaggatcctgtcgccgaccgggaaggttcacccgtgagcggtagcagcccctttcagctgactgcttttagtgatgaagacataatcgacctcaaatag

SEQ ID NO: 47934 - DNA, 807 bp, Artificial Sequence
  Description of Artificial Sequence: Synthetic coding sequence
atggaccccctgaccaaggtgccctgcggcagccagatcgcccagacaatcctgtggaaagccaaaagctctctgagctttggcattcagcccttgcagacatggcctactaaagaccccgaactggagagccaggtgaacctgagcgtttctgaagacctgggatgccggcggggggacttctcccgaaagcactatggaagcgtggaacttttgatttcaagcgatgccgatggtgccattcagagggcaggcagatttagagtcgaaaatggaagcagtgacgagaacgccacagccctacctggcacatggagacgcaccgatgttcatctggagaaccctgaatatcacacccgttggtactttaagtacttcctcggccaagtccatcagaattacatcgggaacgacgctgagaaaagtcctttcttcctctctgtgactctaagtgaccagaataatcagagggttccacagtaccgggccattctgtggcgcaaaacaggaacgcaaaagatttgtctcccttactctccaacaaagaccctgagcgttaagtcaatactttcagctatgaatttggacaagtttgagaaagggccccgtgagattttccatcccgagatccagaaagacctgctcgtgctggaagaacaggagggctccgtgaatttcaaattcggcgtcctgttcgccaaggatgggcagctgacagatgatgagatgtttagcaacgagattggttccgagccttttcagaaatttctgaatctgctgggcgacactattactctcaagggttag

SEQ ID NO: 47935 - DNA, 903 bp, Artificial Sequence
  Description of Artificial Sequence: Synthetic coding sequence
atggccgagagcgaggaccggagcctgcggatcgtgctggtgggcaagaccggttctggaaagagcgcaaccgccaatacgattctgggagaagagatcttcgacagtcgtattgccgctcaggcagttaccaagaactgccagaaggctagccgggagtggcaaggtagagacctgctggtagttgacacgccagggctgtttgacaccaaggagtctcttgatactacatgcaaggagatttcccggtgtatcatttcttcatgtccaggcccccacgccattgtcctcgtgttgctgcttggtaggtacacagaggaagagcaaaaaacagtcgccctcattaaggctgtgtttggaaagagcgccatgaagcacatggtgattttatttacacggaaggaggaacttgaaggccaaagtttccatgatttcatagccgatgcagacgtggggcttaagtctattgtgaaggaatgtggcaatcggtgttgtgctttcagtaactctaaaaagacttctaaagcagagaaagagtcacaggtgcaagagctggtcgagctgattgagaaaatggtccaatgcaacgagggagcctatttttccgacgatatctacaaggacacagaagagcgcctaaaacaaagagaggaggtgctcagaaaaatatacaccgaccaactgaatgaagaaattaaactcgttgaggaggataagcacaaatccgaggaggaaaaagaaaaagagattaagttattgaagttaaaatatgacgagaagattaagaatattcgcgaggaggccgaaaggaatatcttcaaggatgtattcaatagaatctggaaaatgctgtcagaaatctggcatagatttcttagcaaatgcaaattctacagctcatag

SEQ ID NO: 47936 - DNA, 207 bp, Artificial Sequence
  Description of Artificial Sequence: Synthetic coding sequence
atgagcggcttcagcagcgtggccgccaccaagaaggtggtgcagcaactccagctggaagcaggtctcaatagcgtcaaggttagtcaagcggccgcagacctgaagcaattttgtctccagaacgcccagcatgatccgctgctgactggagtctcttctagtacaaatccgttccgaccgcagaaggtctgcagttttctgtag

SEQ ID NO: 47937 - DNA, 1569 bp, Artificial Sequence
  Description of Artificial Sequence: Synthetic coding sequence
atggtgcggagcggcaagaacggcgacctgcacctgaagcagatcgcttattacaagagaaccggcgaataccactccacaactttgccgagcgaaaggagcggaatccgacgagccgccaaaaagtttgttttcaaggagaagaagcttttttatgtcggtaaagacagaaagcaaaaccggctggtcatcgtatccgaggaagaaaaaaagaaggtgctccgcgaatgtcatgaaaatgatagtggagctcatcacggtatcagtagaactctaaccctcgttgagtccaactattattggacgtccgttacaaacgatgttaaacagtgggtatacgcttgtcaacactgccaagtcgcaaaaaacacggtgatagtggcaccaaagcagcacctgcttaaggtcgaaaacccctggtccctggtcaccgtggacctcatgggacccttccatacttccaaccgaagccacgtgtacgctataataatgactgacctgtttaccaagtggatcgtgatcctgcccttgtgcgacgtctccgccagtgaggtgagcaaagcgatcattaacatattcttcctctacggacccccacagaaaattataatggatcagcgggatgagttcatacagcaaatcaacatcgagctatataggttgttcggcatcaagcagatcgtgataagccatacaagtggtaccgtgaaccccactgagagcacccccaacaccatcaaggctttcctctccaaacattgcgcggatcaccccaacaactgggacgaccacctcagcgcagtgtctttcgcttttaatgtgacacacttagaaccaacaaagaatactccctacttccagatgttttctcggaacccgtacatgcctgagacgagcgatagcttgcacgaagtagacggtgacaacacgtccatgtttgccaaaattctggacgcaattaaggaagctgacaagattatggagaacaaaactacatctcttgggcagatggaaaataacaacttggacgagctgaataagtcaaagatcattgtcaagaaaaagcccaaacagctgaatccttttcacctcaaggtggggcatgaggtgcttcgccagagaaaaaactggtggaaagatggcaggtttcagtccgagtgggttggcccctgcgtaattgattacattaccgagagtggatgtgcagtgcttagagataacaccggtgttcgcctgaagcggcccattaaaatgtcccatctcaaaccctatatacgggagtcaagtgaacaagagagtctttatttgctgcaaggcagcgtggtggccgatcatgattatattgggttacccgagatccctattggcgcttatcaggccaacatcctggtggaggatgccaccattggaatagtcgataacgagcttctcacctcctccaaagacagggagctgctcgaatacagaaacactaaaatctcaccactgattgacgatcattcctcactcgagaaacagacgttttcactccttgactctagcaatcaagtcctggagtatctctcttag

SEQ ID NO: 47938 - DNA, 669 bp, Artificial Sequence
  Description of Artificial Sequence: Synthetic coding sequence
atggtgcggagcggcaagaacggcgacctgcacctgaagcagatcgcctattacaaacgaaccggtgaataccacagtacgaccctaccatcagaacggtcaggaatccgccgagccgctaaaaagtttgtattcaaggaaaaaaagctgttttacgttggtaaggacagaaagcaaaataggctggtgatcgtttcagaagaggagaagaagaaagtgctgcgggaatgccacgagaacgattcaggagcccaccacgggatttcccggacattaactctcgttgagtctaactattactggacttccgtcaccaatgatgtaaaacagtgggtctacgcatgccagcattgtcaggtggccaaaaacacggtcattgtcgcacccaaacagcacctgttgaaagtcgagaatccctggtctctggtgaccgtagatctgatgggaccctttcacacctccaatcgttcccatgtttacgctatcattatgactgatctattcaccaagtggattgtaatattgccgctctgcgacgtaagcgcatccgaggtgtctaaggcaattataaacattttcttcctctatgggcctccccagaaaattatcatggatcagcgagacgagttcattcaacaaaaggtgttcattagctgcaaagtgcagtag

SEQ ID NO: 47939 - DNA, 687 bp, Artificial Sequence
  Description of Artificial Sequence: Synthetic coding sequence
atggccgcccccccccagcccgtgacccacctgatcttcgacatggacggcctcctactagacacagagcgactgtactcggtcgtctttcaagagatttgtaatcgctacgataagaagtactcttgggacgtgaaatctctggtgatgggcaagaaagctctcgaggcggcacagatcattatcgatgttctccagttgcctatgtcgaaggaagaactggtggaagagtctcagacaaaactgaaggaggtcttcccaacggcagcactcatgcccggagctgagaaactgattattcacctgagaaaacacgggatcccctttgccttagcaaccagctcaggtagcgcctctttcgacatgaagacctctcgccataaagagttcttcagtctcttcagtcatatcgtgttgggcgatgaccccgaagtgcagcacggcaagcccgacccagacatctttctcgcgtgcgctaagaggttctccccgccacccgcgatggagaaatgtctggtgttcgaggatgcacccaatggggtggaggccgcactcgccgccggcatgcaggtagtgatggttcccgacggaaacctcagcagggatttaactacaaaggccacgctggtgctgaatagcctgcaggactttcagccagagttatttggacttccaagctatgagtag

SEQ ID NO: 47940 - DNA, 756 bp, Artificial Sequence
  Description of Artificial Sequence: Synthetic coding sequence
atggccgcccccccccagcccgtgacccacctgatcttcgacatggatggactgctcctaggctacacaggatcaattgtggccgccgcaagcggagaatcttcgcgtggactccagagcagatggacagacacagagaggctctactccgtagtttttcaggagatctgcaataggtacgacaagaagtattcctgggatgttaaaagcttagttatgggaaaaaaggccttggaggctgcccagattataatagacgtgcttcagctgcctatgtccaaggaggagctcgtagaagaatcccaaacgaaactcaaggaagtatttcctacagccgccctgatgccaggggccgagaaactgatcattcacctgaggaagcacgggattccgttcgcactcgctacatcttccggcagcgcatcttttgacatgaagacctcgcgacataaagaatttttcagcctgtttagccacatcgttctgggcgacgacccagaggtgcaacacggcaaacctgatcccgatatattcctcgcctgcgcgaagcgcttcagccctccccccgccatggagaaatgcctggtcttcgaagatgcaccaaacggcgttgaagctgctcttgcggctggcatgcaggtcgtgatggtgcctgacggtaatctgtctcgtgacctaactaccaaggccaccctagtgctgaatagtcttcaggacttccagccagagctgtttgggttgcctagttatgaatag

SEQ ID NO: 47941 - DNA, 627 bp, Artificial Sequence
  Description of Artificial Sequence: Synthetic coding sequence
atggccgcccccccccagcccgtgacccacctgatcttcgacatggacgggttactcctcgataccgaacgattgtactccgttgtgtttcaggagatctgtaataggtacgataagaaatactcctgggacgttaaatcactcgtaatgggaaagaaggctctggaggcagcccagatcataatcgacgttctgcagctgcccatgtctaaggaagaactagtcgaagagtctcagaccaagcttaaggaggtgttccctacagccgccttgatgccaggggcggagaaactgatcatccacctgaggaagcacggtattcctttcgcccttgcgacaagttcaggctcagcctcctttgacatgaagaccagtaggcataaggaatttttttccctcttcagtcacatcgtgctgggagacgatcctgaggtgcagcacggcaaacccgaccccgacatctttctcgcttgtgctaagagattctctcctccccccgccatggagaagtcttcaatccaccgacccaggctgctgactgcccagaagtgccaaggttgccgcgatcctttttccgcattgttgctcctctgcaaccagttgctcctttgttccgatgacacatag

SEQ ID NO: 47942 - DNA, 735 bp, Artificial Sequence
  Description of Artificial Sequence: Synthetic coding sequence
atggccgcccccccccagcccgtgacccacctgatcttcgacggcagaacgtcttccggttgggtggtagccgctgcctccggcaggagttgcgtaggtgtgggcacggataccgagagactatattcagtggtatttcaggaaatatgtaaccgctatgataagaaatattcatgggacgtcaaatccctcgtgatgggcaaaaaagctctggaagccgctcagataataatagacgtcttgcagctacccatgagcaaggaagagctggttgaagagtcacaaacaaagctcaaggaagtatttccgactgccgcgctcatgcctggcgctgaaaaactcattatccatctgcgcaagcacgggatccctttcgcactcgctactagctctggcagcgctagtttcgatatgaagacttcccgccacaaggagttctttagcctgtttagtcacattgtgctgggcgatgacccagaggtacaacacgggaaacccgacccagatatattccttgcctgcgctaaacgtttctctcctcctccagccatggagaaatgtctcgtttttgaggatgcacccaacggcgtggaagcggccctcgcagctgggatgcaggtggtaatggtacccgacggtaacctgagcagagaccttacaaccaaagccactctagtgctgaatagtctccaggatttccagccagaactgtttggtttgccctcttatgaatag

SEQ ID NO: 47943 - DNA, 558 bp, Artificial Sequence
  Description of Artificial Sequence: Synthetic coding sequence
atggccgcccccccccagcccgtgacccacctgatcttcgacatggatggcttgctgcttgacactgagagattatactccgttgtttttcaggagatctgcaacagatacgataagaaatactcatgggatgtgaaaagcctagttatgggtgctgagaagctgataattcatctgagaaaacacgggatacctttcgctttagctaccagctccgggtcagccagctttgacatgaaaacatcaaggcacaaggagtttttcagtttgttttcacatatagtgctgggcgacgatcctgaagtccagcacggcaaacccgacccagatatctttctggcctgtgccaaacgtttttctcccccacctgctatggaaaagtgtctggttttcgaggatgcccctaacggggtggaggccgccttagccgccggaatgcaagtggtgatggtgcctgatggcaatctgtcacgcgacttaacgaccaaagcgacgctggtgctgaactcactgcaggactttcagccggaactgtttgggttgcctagctacgagtag

SEQ ID NO: 47944 - DNA, 780 bp, Artificial Sequence
  Description of Artificial Sequence: Synthetic coding sequence
atggccgcctgccgggccctgaaggccgtgctggtggacctgagcggtaccctgcacattgaggatgccgccgtgcctggggcccaggaggctctgaagcgcctgcggggggcatccgtgatcattagattcgtgacgaatacaacaaaagaaagcaagcaggacctcttggagaggctcaggaagctggagttcgatatctctgaggacgagatttttacctcgctgactgctgcaagaagccttctcgagaggaagcaggttcggcccatgctgttggtggacgacagagcattgcccgattttaagggcatccagacaagcgatcccaatgccgttgtcatgggtctggcaccagagcactttcactaccagattctaaatcaagcattcagactcttgctggatggagcgcctctaatcgctatccataaagcacgctattataagcgaaaagatggactagctctcggccctggtcctttcgtgactgcactcgaatacgcaactgacactaaggcaaccgtcgtcgggaaaccagagaaaacattctttctggaagccctgcggggcactggttgtgagccggaggaggccgtgatgataggggatgactgtagagacgatgtgggcggggcccaagacgtcgggatgctcgggatcctcgtgaaaacgggcaaatatcgggcatctgatgaagaaaagatcaatcctcccccgtacttgacgtgcgaatccttcccccacgcagtcgatcacattctgcagcacttactgtag

SEQ ID NO: 47945 - DNA, 132 bp, Artificial Sequence
  Description of Artificial Sequence: Synthetic coding sequence
atggccatccccatcaccgtgctggactgcgacctgctgctgtacggccgaggccataggactcttgatcgtttcaagttggacgatgtaaccgatgaatatctgatgtccatgtatggtttcccaagatag

SEQ ID NO: 47946 - DNA, 255 bp, Artificial Sequence
  Description of Artificial Sequence: Synthetic coding sequence
atgaagcgggagcccaagaacctgagcagcgagcaggtgctgaagccaacatatagccagtctaagcccaatagaattagactgtactattggggccttggactgaatctgagagcagcagcgtctgaagccaaccgcatggaaagcaaaaaggtcggtaagcgcttgggcgccggaaagcagcagatgggggccgagctgactgaacagcatatggcccgcatttctcttcccgcgaagatcttgggatattag

SEQ ID NO: 47947 - DNA, 180 bp, Artificial Sequence
  Description of Artificial Sequence: Synthetic coding sequence
atgcagaccggcggctgcgagcccaagcaccggcggatgtgccccgacgatagctctgagaatattatgaagtggcgaaccttcctacccgaggagagaaccgtcacacaggctggcgacgtcacccatactttgggttcaaaaggccctaaagccggggtgccatttacgggcccatag

SEQ ID NO: 47948 - DNA, 369 bp, Artificial Sequence
  Description of Artificial Sequence: Synthetic coding sequence
atggtggtggtggagaagggcgccagcctgatgagccgggccagcctgatgcccgcccaggcacgggctcccttccaacgcttgcgggactgcagagggccagctgactcaagccatgcttttaagcttcagtgtttcccttcccactgccgtaggcccccttgggtcatctctcggaaaggacgagccatcaataagtactcgatttgtatcagctgcgtggcgctacatttggaaatcagcttcatttggcagctgcttcagaatgagcctaatctcgaaggcggcctggggcgattcatgctggccagcttgtcactgcagcaggtgatatcaatactagcattcactcgtgtgaagcagctgtag

SEQ ID NO: 47949 - DNA, 183 bp, Artificial Sequence
  Description of Artificial Sequence: Synthetic coding sequence
atggccctgccctgcggcatgggcaccgcctggtacctggacagcaccgagaatgctcttactgtgaatgttccaagggctcagaatcataaggcctcccacaactccatgtggaagcttggatcacatttttattgtatcttacttgtgacaaaagaccctccaggatttaccatggtatag

SEQ ID NO: 47950 - DNA, 393 bp, Artificial Sequence
  Description of Artificial Sequence: Synthetic coding sequence
atgagcctgtgcagcctgctgagcccccggagcggcttccggtgctgctgcgctgcaccccccccccccgcccaacctcaccaggaagcccagggcgggttggtagagctgcttatgcacgccgccgccagaaagactctattcaattttccacctgctccatcacgcgcctcgcctggccatagggtggcttgccagcccgacagggcaaggaagtccggcagttgggccgtggctcagcggcgccgtgaacaggaagaggccggcgcccgcgccggcgccgtggacccgctgggattgccccttgttagttccatctcgtgcgtgcagcactgtaacttggcggccggcgtgcaaacaggacgaccccctgcatcctcaacggactgctag

SEQ ID NO: 47951 - DNA, 162 bp, Artificial Sequence
  Description of Artificial Sequence: Synthetic coding sequence
gccacccaggacctgcagttccggatccggcggccccggccccccgccagaggccgcgggggggaaacaagatcttgtgacctcggccggtgccatctgaagggcctagaccttctcgaagccagaacggctgaggaagacggtgagagaaacgctaggtag

SEQ ID NO: 47952 - DNA, 414 bp, Artificial Sequence
  Description of Artificial Sequence: Synthetic coding sequence
atgttccacttcttccggaagccccccgagagcaagaagcccagcgtgcctgaaaccgaggctgatggctttgtgcttttgggtgacactacagacgagcaacgcatgaccgccaggggcaaaacatcagacatcgaggcaaaccagcctctcgagacaaacaaagaaaactccagttctgtgaccgtcagcgaccccgagatggaaaataaagcggggcagactcttgagaattcatccctcatggctgagctgctcagcgatgtgccatttacattagcgccacatgtacttgccgttcaggggactattactgacctcccagatcatttgctcagttatgatggctctgaaaacctctccagattctggtatgatttcactctggaaaacagcgtattgtgtgattcttag

SEQ ID NO: 47953 - DNA, 876 bp, Artificial Sequence
  Description of Artificial Sequence: Synthetic coding sequence
atgcccggcaagctgctgcccgagaagtgcgccctgatgtggctgcacttaggcacccgcgctccccagcgccctaaacgggagtcccggggcttcccaggctggggatgtagaacgggccaggccttaccatgccgagctcgcccacccgcccccgcgccttcacatccatctagcagcctctccctcacacccggacctggcagcccacggcaaactggccccccctgccaaaccgtggctgcactgtacggactgggagcatggcaatcacactgcggagggggtgtgggttgccacggtcagggacgacaacctcttgggtgccagggctggtggagcactctaaacccatatctacttgaatctccaggcctgttccatactagatcatgtgggaagctctgggacccaaaggcggtgctgatatcaggggtgactagtagtcacagtagccttggcagcccaggaactagacccggcgtgagtctctgcaaagaactgccgggctgttgggccgagctgtgctgcaggccaaggaaaatgacaaagaaggatagagcagaaccccacctcccgttgcttggcggtccagaaggcgctcgagcccagcagtcgccgattcttcacagcctggggtcaaagcgcctccccaggtgtgggtggcagttgcttacatcaagcggaggcgccgcaggaggtctgtgcccgatggggcatcgccgggaaaaggacgggggccgagtgtgcacattgggccgaacaggcggccgacacagacccgaacaggttgcttgggcccacgagaagggagtgagcgaaacgggatgtcttagccagatgccaggtgtggatgaagcggacgagtggcagtag

SEQ ID NO: 47954 - DNA, 234 bp, Artificial Sequence
  Description of Artificial Sequence: Synthetic coding sequence
atgaaggcccccggcctggcccaggccgccgtggccgaggagaccccggactgggcaccagagctgtgcccctcctccgaagccagatcacctgaacctcccgcaaaccggctacaagactttgacacgctcgtgactgtcgggaaacaattggaggcgatatgcgtgaagaagaacgtagatctgctggcccggatgcaaaggcgagaacgcctgctgatacggtgctggtag

SEQ ID NO: 47955 - DNA, 414 bp, Artificial Sequence
  Description of Artificial Sequence: Synthetic coding sequence
atgaccagccccctggtgttcgccagcctgagccccgacgccatggccaaaatgctggaaatggccgccctcaacgtcgggaccatcagaattagcctcaataccgaacccaggccacctgtgattactcagctagccccatcgcctgaaaccttacctttctgccctgaatggggcgcggagaaccagtctcgacatctgaagctccccccatttttcatctgtaggtgccgtggaccactataccaggaagagtctttatcagagatccactgccactctggactgttcctggatcagttaagcctccccactcctttctcctctctgtcagtgagtctcattcactggaccttcatttcaacgaagtacgtgccaggcatcatgctcgccttcgggggcactaataagtag

SEQ ID NO: 47956 - DNA, 141 bp, Artificial Sequence
  Description of Artificial Sequence: Synthetic coding sequence
cgggagggccacgccgacggcaacatccccgccggccccggcctgtgcagcccgcagctgttgctgcccggcggccagctgttctgggcacccgaggtgcttcggtctccattccctggacccgggacgccttctgcatag

SEQ ID NO: 47957 - DNA, 444 bp, Artificial Sequence
  Description of Artificial Sequence: Synthetic coding sequence
atgggcctgctgagcctgatcctgttcctgggcgccaaggtgaccaccgccaacaaaacagattccttcctctttagcaccggcctcacggttcttagtagccctgggctaaagatgcgggtgttgggctgtcctcccacacccccacagctgacccaaggccacaccagtgggtatgtggatctgcacaagggcccttttctgtcccctatgcgccatcctagggggcatacaggtccccagatacttccacaggcatgggagcccatcggccgtcgggtgcgccagtgccgcgggccccagactttccttaaagggccagagtccaagtattttagactctgccggccagacgtgctctgttgcaagacccagttctgctattgctctagtaaggcggccatcgacaacagcgaggtaaatgagtgcgtagtgtcacagtag

SEQ ID NO: 47958 - DNA, 84 bp, Artificial Sequence
  Description of Artificial Sequence: Synthetic coding sequence
gacatcctgcagcacaaccaccccgtggtgggcctgctgcaggtgggtagcgaacatggttccgaggaagccgcactctcttag

SEQ ID NO: 47959 - DNA, 555 bp, Artificial Sequence
  Description of Artificial Sequence: Synthetic coding sequence
atgcccgtgaagggcgccagcagcctgctgttcctgcccctgcccccttcagcgtggcagctgtgtctcttgtctaagcgccgggtgcaccctatccggactccgttaccatttcactcttggatcaaagctttggtcatctcaaaccagaaagtgcccgagcgtgagaggcccgagggaaccggtgttctgtctgatggctgtttgggccagtcgcaggagggcgaacccttgctgagccctcctgcccttgcgcattttcccttacatgctagatgctgcggatcatcttgggcctggcccggctcagccggcgaagcaattcgtatggtaagcggggccccttttctctgcttccttgatggcctcgacgggctcccctgcagtagccctatggctgccctgcccgcaccaatggccgcactgcccgcccgacgacagcgtcaggagcacattgaaggaggcagtcagggctgcggagttagatcccctgccccatgtcggggcaaacccgggtccgccacatccagcacactccgattatgtcctgcctag

SEQ ID NO: 47960 - DNA, 417 bp, Artificial Sequence
  Description of Artificial Sequence: Synthetic coding sequence
atgctggagaagtggcgggagaccgaggaggcccggggcctgctgacaaggacgcagccgaccgcctcagggcctccttgctcccatgcccacagccagttattgctggaccggctgaagggcaatctcgcacgacgcggaggtgtgggccgcgcttccttagaaaccgtcttatggcgaccaggggaaactgctttttatccgcagcattggggagagcaagccagtatccctgccttcgcctgcaggccgtcatcattcccactcaaggcctacccagcagcccccgccctccggaatgcgctgctcagttatcaactgtgggagcgacaggatcggttggccagtggaagacggggtagacactgtctgccgtctggcccaggaccccaccgttaccctcagctgcaagattag

SEQ ID NO: 47961 - DNA, 429 bp, Artificial Sequence
  Description of Artificial Sequence: Synthetic coding sequence
atgggcctgtaccacgtgggccaggccggcctggagctgctgacctctagcgacccgccaacctcagctagccagaatgccgagataaccggcgtcagtcacagggcccaaagtaaggcccataacctgcagcgcaaattgcgactgtcacataagagttcccctccctgcacctacacgcagcatgccggaggcgttgattctcaccctcttacccaggatatgtgtgtcatagttaatgttatagccagaccttttgacaaatgcaactgtgacatctacctgggattagcgtctgagctgttcgtcgtctcctgggtccagcttaccgttccctatcattggatacagaccctgggcaacgtgatcctcttttgcctggacactgctcatagagggcattgcgacatagcaggacactgtacttag

SEQ ID NO: 47962 - DNA, 303 bp, Artificial Sequence
  Description of Artificial Sequence: Synthetic coding sequence
atgcggcccaagcacctgcagggcatcgcccccgaggtgttccggactcccaccggatctcacggacaaatgcctggccaacctctccaaagagggcacgctttggatattaggcctccactccgccctcatcctctgatctcagggcacgcccttagaggtgacagatggcaaacaccagccctcgctctagggccagcgctatgcggctttgtgcctgctcactgggtgctgactgtgcctccgccacaaagacccagtattccgtcaaggagtgctgatacctgtcccgcttcccgttag

SEQ ID NO: 47963 - DNA, 246 bp, Artificial Sequence
  Description of Artificial Sequence: Synthetic coding sequence
atggtgttcctgaactacaagtgcaccacccccctgatcctgctgctccccagtcagatccctcggtcttacaagcaggattggttgctatactgcagcaagctgatttctttggcctaccacgcatttcttatttttatgccaagcctgatgatgttctctctcttagagatctaccacattctgctgcctcagctcctcttgcaggtaaatttcttgctcaaagcagagcccgatcagatctag

SEQ ID NO: 47964 - DNA, 435 bp, Artificial Sequence
  Description of Artificial Sequence: Synthetic coding sequence
atgaaggtgagcagcctgacccggcagcagcggcccccccagggcacagaggccggcactcgaggaggggggccaggaaggctgtctcccgaaaggtgcaggctgctggatagtccccttcagctccagggccccgcatccctgccacagccagggggccgggaaagggctgtggcgactcctccacaggcaacccgtagaggtggctctgagagaacccgggactctctgctgggtgccgttgggccgtcgggggccaagcggccgtttttttcaagtgcccttcctaagggttgcagacgcgtaggcgccacatggggaccgagacagcgcggatggggtaacgccacagggggacctggtgagggcgcacgccgttcgcgccccgaccctcaagcactgttttggcatgcgccacacctgagagcccagtag

SEQ ID NO: 47965 - DNA, 318 bp, Artificial Sequence
  Description of Artificial Sequence: Synthetic coding sequence
atggcccactgcagcctggacctgagcggcagcggcgacccccccactagcacatcccaggttgcacgcactatcggagcctgccatcacgtccaactgatattcgttttctttggggagacgggattccatcacgtggctcccttggtgctggagctgctggattcctcagacccaccaacactggcctcccagagcggtggcaaccggcacgagccccctcaccgtgccctgaagcacatcttcctaaagcatatctggctattctccttctatttccatcagaacgggcatgaggaaacgatggatcagatctag

SEQ ID NO: 47966 - DNA, 396 bp, Artificial Sequence
  Description of Artificial Sequence: Synthetic coding sequence
atgcccttctggcggctggacaagctgagccccggcggcgtgaagcggttacgggttacccaaccggccacaggaactggcgtggtaaggagccagtgtcagaagtgggtgaaggagctcggtaacgtccctcgactggcagcccgaaagccaggtctcggagtccctggatcttccggggcagtcaagcggcagggacagaagtgggtgaaggaattaggaaatatcccacgcctcgcagtgggaagagatcaggggctggggtcacttgaccccgggtctgccacggaactgctctgtgactgttccgtcccattgctgcctctttctgggggataccgaaaggccgacgtagcccatcatcccgcgtgtgcaattgtgtggctgcactattag

SEQ ID NO: 47967 - DNA, 444 bp, Artificial Sequence
  Description of Artificial Sequence: Synthetic coding sequence
atggtgaccggcccctgcctgacctgcgtgagcagcctgatcgagagggcaagtcccaatcaccccaccaataaaggacttacactattaccttggcttgagtgcagcggaccgataatagctcattgctcactcgactttcccgcctcagtagatccacccaccttaatctctagggtggccggaaccgctggcttgctaatcttgaggttctcgtccgccagcgcgaatccagaaaccgctcgccccatccctcctttgccctgtccaccaccccggcttttgcacatgaagacaacccgcatgaagacattcatgatgatacattttcatctgatgaacaagttgcaggaaatcatccaggaagaacggcacggcgggatgctcgaatcactcctaagcttaaaagtcggaaatcccggatcatgcagctgctctcactag

SEQ ID NO: 47968 - DNA, 204 bp, Artificial Sequence
  Description of Artificial Sequence: Synthetic coding sequence
atgttccacctgtgcaagctgaaccccagctacctgaagatcacctgcggcaagcggagtaagcagatcaccccaacctattacccctcccgcctgccccccgtcaaaaggaagttttctgtttatgatgccaaactgactatcgtgcatctttccactttttctattgaagatttccctctgtacctctcaatggccgggtag

SEQ ID NO: 47969 - DNA, 423 bp, Artificial Sequence
  Description of Artificial Sequence: Synthetic coding sequence
atgggcagcgaggccgcccagctgctggaggccgccgacttcgccgctcggaaacataggcagcagcgccgcaaggaccccgagggcactccctatatcaatcacccaatcggggtcgctaggatcctaacacacgaggctggcatcacggacattgtagtgctccaggctgctctattgcatgataccgtagaagacacagatacgacacttgacgaggttgaactgcattttggtgctcaggttcgccgcctagtggaggaggtaacagatgacaaaacattaccgaaactggaacggaagaggctccaggtggagcaggctccccacagttccccaggagctaaactggtcaagctcgctgataagttgtataatctgcgggatctcaatcgatgcacacccgaggtgaaaatccagtag

SEQ ID NO: 47970 - DNA, 540 bp, Artificial Sequence
  Description of Artificial Sequence: Synthetic coding sequence
atgggcagcgaggccgcccagctgctggaggccgccgacttcgccgcacgcaagcaccgccagcagcgtcggaaggatcccgaggggaccccttatataaatcaccccatcggggtggctagaatcttgacacatgaggccggcattaccgacatcgtggtgcttcaggctgcactcctacacgacaccgtagaagatacggacacaaccttggatgaagtggaattgcactttggggcacaggtacgtcggctggtggaagaagttacagatgataagacccttcccaagttagagcggaagaggctccaggtggagcaggcgcctcatagttccccaggcgccaaactcgtcaaactggcggacaagctatataacctccgtgacctgaaccgctgtactcccgaagggtggtctgagcaccgggtccaagagtacttcgaatgggctgcccaggtcgtgaagggccttcaaggaactaatcggcagttggaagaggctctcaaacaccttttcaagcagagggggctgaccatctag

SEQ ID NO: 47971 - DNA, 1632 bp, Artificial Sequence
  Description of Artificial Sequence: Synthetic coding sequence
atgcccaaccccaagaacagcaagggcggccggaagaacaagcgggctaactcctccggtgacgaacaggagaatggcgctggagccctggccgcagcaggagctgcaggtgccgccgcaggcggtgccctggctgccgctgccggttgcggagcagcagctgcaggagcacctggcgctggcggggcagcaggggccggcggcgccggcacaggagccgccaacgcagctgccgcagccggagctgctgcagctggcgatgccaaaaatgaagctccttgcgcaacccctctgatctgctcctttggcagacccgttgacctggagaaagacgactaccagaaggtagtgtgtaataacgagcattgcccatgttctacttggatgcatctgcagtgcttctatgagtgggagtcctctatcctggtgcagttcaattgcatcgggagagctaggagttggaatgaaaaacaatgtcgacagaacatgtggacgaagaaaggctatgacttggctttccgcttctgctcctgtcgatgtggccagggacatctgaagaaagacaccgattggtaccaggtgaaacgcatgcaggatgagaagaaaaaaaagagcgggagcgagaaaaacactggccggccaccaggcgaagcagcagaggaggctaagaagtgccggcctcccaacaagccacagaaaggtccctcgcacgacttaccccgcagacatagcatggacaggcaaaacagtcaagaaaaggcggtgggcgctgccgcttacggagctcgatctccaggcggctcgcctgggcagtctccaccgaccgggtattctatcctctcaccagcgcatttcagcggtccaagatcttctagataccttggcgaattcttgaagaatgccattcatctggaaccccataagaaggcaatggcagggggccatgtgttccgcaacgctcattttgactactcaccggccgggctcgctgtacaccggggcggacacttcgacacacccgtccagtttttgcgcaggctagatctttcagaactactgacccatatcccacggcataagctcaacaccttccacgtgcggatggaggacgacgcacaggtgggccagggggaagatctgcggaaatttatactggccgctctcagcgcctcccatagaaacgttgtgaattgcgccctgtgtcatagggctctccctgtatttgaacagttccccctcgtggacgggactctgtttctgtccccatccagacatgatgaaattgaatatgacgttccttgccacctgcagggccggctgatgcatctgtacgccgtatgtgttgactgccttgagggcgtgcataagatcatttgtattaaatgtaagagccgctgggacggatcctggcaccaactgggaactatgtatacgtacgatatcctagccgcatcgccttgttgccaggcccggttgaactgcaagcactgcggcaagcctgtgattgacgtgcgaattggcatgcaatacttttccgagtatagtaatgtgcagcagtgcccgcactgtggcaacctggattaccattttgtgaagccattttcttcctttaaggtgttggaagcttactag

SEQ ID NO: 47972 - DNA, 2568 bp, Artificial Sequence
  Description of Artificial Sequence: Synthetic coding sequence
atggccgccctgggcgtggccgaggccgtggccgccccccaccccgctgagggcgccgagactgccgaagcagtagagctctccagagccctgtctcgcctgctgcccggtctcgaagcggattcgaagccagggcgccgacgcgccctggaggcactgaggcgcgcgctcgaggagcctgggcccgcagccgaccccacagctttccaggggccttgggcccgcctactgctgcccaggttgctgaggtgtctgtccgatcctgctgagggttgcagagctctcgcggtgcacctgctggacctaggcctgagacgtgcggctcggccaagagatgcactgcctcgtcttttgcctgcgctcgctgctagactggcgggaccggtgcccgctcgaaggccccctgaggcctgcgaagaactgaggctcgccctcgtccagctgctgggcttagccgtcgatctgtgtggcgcagcactggccccgcatctggatgacgcactaagggccctgcgctgctcccttctcgaccctttcgctgccgttcgcagagagagctgctcttgtgccgctgcgttagcccaggcgacacccgaccattttcacatgcaaagcgagagtctcatcggcccactcatgcagaccatctcacatcaacattggaaggtcagagtcgccgctatcgaagccactggcgctgtgatccattttggaaacggcaagagtgtcgacgatgttctgtcgcactttgcccagaggttgttcgatgacgtgccacaggtgcgcagggccgttgcgtccgtagtgggcgggtggctcctctgcctcagggacaggtatagcttcttccacaagctgatcccgctgttactatcttccctgaacgacgaagtgccggaagttcggcaactggctgcgagtctctgggaagacgtgggtctccaatggcagaaagaaaatgaggaagatttgaaggacaaactggacttcgcgccccccacgcccccccactatcctccgcacgagcggcggccggtactgggctgtagagaactggtgttcagaaatctatctaagatcctcccagcattatgccatgatattactgactgggtcgttggtacgcgggtcaaaagcgctcagctgcttcctgtgcttctgcttcacgcggaggatcacgccacacagcatctggaagtcgtcctcagaacactatttcaggcctgcaccgatgaagaagccgcagtcgtccagtcgtgcacccggtccgcggagctcgtgggcaccttcgtctccccagaggtgtttctcaagctgatactctccacgctgaaaaaaacaccgagcgctagcggtttacttgtcctggcatctgcgatgcggggctgccccagggaagcgctgcaaccacacctcgcagccatcgcgacagagctggcacaagcgcatatctgccaggcgagcgaaaatgacctgtacctcgaacgccttctgctgtgtgtgcaggccttggtgtccgtgtgtcacgaagactgcggagtagctagcttgcaacttctcgacgtgcttctgaccatcgtagctctggctggcgctactggcctgcgggacaaagctcaggaaacaatggactcacttgcaatggtagaaggggtcagttcctgtcaggacttgtacagaaagcatatcggacctctgctggaacgcgtgactgcttctcaccttgattggaccgctcactctccagagctgttgcagttctccgtgatagttgcacagagcggaccggctctgggggaggcacttccacatgtggtgcccaccttacgtgcctgcttacagccctctcaagatccccagatgaggctcaagctgttcagcattttgagcaccgttcttctgcgtgctactgacactattaattcacagggccagttccctagttacctcgaaactgtgactaaggacattctggcccccaacctgcagtggcacgccggaaggactgcagctgccatacgcaccgcagccgtttcttgcctgtgggccctcaccagttccgaagttctctctgccgagcagatcagggacgtgcaggaaacgttgatgccgcaggtactgaccaccctggaggaggattcgaagatgaccaggctcatttcatgccgtattattaatacattcttgaaaacctcaggcggaatgaccgatccggagaaattgattagaatttacccggagctgctcaagcggctagacgacgtcagcaatgatgtgcgaatggctgccgcctccactctagtgacatggctacagtgcgtgaagggtgcaaatgccaaatcgtattaccagagctccgtgcagtacctatacagagaattactggttcatctggatgatccagaacgagccatccaagatgcaatcctggaagtgctcaaagaagggagcggcctgttccctgacttgctcgtcagggagaccgaggctgtcatacataaacacaggtctgcgacctattgcgaacaactgctccagcatgttcaagcagtgcccgctacacaatag

SEQ ID NO: 47973 - DNA, 2532 bp, Artificial Sequence
  Description of Artificial Sequence: Synthetic coding sequence
atggccgccctgggcgtggccgaggccgtggccgccccccaccccgcagaaggcgcggaaaccgcggaagccgtggagctctccagggccctctctcgcctgctgcctgggctggaagccgacagtaaaccaggccggcgtcgagctttggaagcactgcgaagggcgctcgaggaacctggacccgcggccgatccaaccgcttttcagggtccttgggctaggctactactgcctcgactgttgcgctgtctgtccgatcccgctgagggctgcagagccctagcagtgcacctgctggatctgggattgcgcagggcagctcgcccgcgggatgccctcccgagactcctacctgcacttgctgctcgactggccggaccagtgccagcgcgtcgccccccagaggcctgcgaagagctgcggctggcgctggtgcagctgctcggtttggcggtggatctgtgcggggctgcactcgcccctcaccttgatgacgccctccgggcactcaggtgttcccttctggatccctttgccgccgtgaggcgggagtcttgctcatgcgctgcagcgcttgcgcaggccaccccagaccatttccacatgcagtcagagtcccttattggcccgctgatgcagaccatctcgcatcagcactggaaagtgcgtgtggccgccattgaggccacaggagcagtcattcacttcggaaacggaaagagtgtggatgatgtcctgtcccacttcgcgcaacgcctcttcgacgatgttccccaagtccgacgtgcagttgcctcggtcgttggcggctggctgttatgtctgcgggaccgctattctttcttccataaactgatacctctgctgctctctagccttaatgacgaggtccctgaggttagacaactggccgcctcactttgggaagacgtggggctgcagtggcagaaagagaatgaggaggatttgaaggacaaactagatttcgcccctccaacacccccacactaccctcctcacgaacgacgtccggttcttgggtgtcgagagctggtattcaggaacctctctaaaattttacccgccctgtgccatgacataaccgactgggtggttggaacccgagtcaagtctgctcagttgctgcctgtactcctgctgcatgctgaagaccacgctacccagcacctcgaagtcgtacttcgaacactgtttcaggcgtgcactgatgaggaggctgcggtcgtccagagctgcactcgaagcgcagaactagtgggaacatttgtatcgccagaagtgttcctgaagctaatcttgtccaccctcaagaagaccccaagcgccagtgggctcttggtgctggcatcggccatgagggggtgtcccagagaagccctgcaaccccacctggctgcgatagcgacagagttggcccaggcgcacatatgccaggcatccgagaatgacctgtatcttgagcgattactgctatgtgtccaggccctcgtcagtgtgtgtcatgaggattgtggcgtagcaagcctgcagctgctggatgtgctgctcactatagttgctttagccggcgcgacaggtcttcgcgataaggctcaggaaacaatggattcgcttgctatggtcgagggcgtgtctagttgtcaggacttatatcggaagcacatagggcctctgctggaacgagtcaccgccagccaccttgattggactgcccactctccggaactcttacagttttccgtcatagtcgcgcagagcgggcctgcgctcggtgaagccctcccacacgtcgtgccaaccctgagggcctgcctccagcctagtcaggaccctcaaatgcgactgaaactgttctctatcctgagcactgtgctgttgcgggccaccgatacgattaactctcaaggccaattccctagttaccttgaaacagtaaccaaggatatcctcgccccgaacctgcaatggcatgccggcaggactgcggccgccatcaggacggccgcagtcagctgcctgtgggccctgactagttccgaagttctgagcgcagaacaaattcgcgatgtccaggagacacttatgccacaggttcttactactctggaagaggacagcaaaatgactaggttgatcagctgcaggataatcaatactttccttaaaacgtctgggggtatgaccgaccctgaaaagctaattcgcatctaccccgaacttttgaagcggttggacgatgtctcaaacgatgtaagaatggcggctgcatcaactttagttacatggttgcagtgcgttaagggagcaaatgccaagagctattaccagagctccgttcaatatttatacagagaactcctcgtacatctggacgaccccgagcgtgcgattcaggacgccatcctggatgttcccggcagtccgtctcctagcgccatgatcggaagcttcctcagaccccctcatccctggagaacagtgtcccagctaaatctgttctccagttag

SEQ ID NO: 47974 - DNA, 1806 bp, Artificial Sequence
  Description of Artificial Sequence: Synthetic coding sequence
atggacagcttcagcgaggtgcggcgggccgtggccagcgtggtggggggctggcttttgtgcctgcgtgacagatactcattcttccacaaactgatccccctcctacttagtagccttaacgatgaagtccctgaggtgaggcagcttgcagcctccctgtgggaggatgtagggctacaatggcaaaaggaaaatgaggaagatttaaaagataagttggattttgccccaccaactccaccgcactatccacctcacgagaggcgaccagtgctaggctgccgggaactggtcttcaggaacctgagcaagattctgcctgcactatgccacgacataacggattgggtcgtcggcacacgcgtgaagagcgcccagcttctgcccgtgctgctcctgcacgcagaagatcatgcaacccagcacctcgaagtggttctccgtactttgtttcaagcctgcactgatgaagaggccgctgtggtacagagttgtactagaagtgcagagctcgtcgggacctttgtgtcccctgaagtctttctcaagcttattctgtccacactcaaaaagacaccttccgcatcaggtttgttagtgttagcttcagcaatgcgtgggtgccccagagaggccttgcagccacacttagcggccatcgctaccgagctggctcaggcccacatctgccaggcttccgagaatgatttgtatctggagcgactcctactatgtgttcaggcactcgtctccgtgtgtcatgaagattgcggagtcgccagtttgcaactcttagacgtgctcctgaccatcgtcgctcttgccggggccactggtctgcgggacaaggcccaagagacgatggactccctagccatggttgagggggtgagctcttgtcaagacctgtaccgcaaacatatcggaccactcttagaacgggtcactgcctcccatctagattggacagcccattccccagagctcctccaatttagcgttatcgtggctcaaagcggacctgcactgggtgaggctctgccccatgtcgtgccaacactgagggcgtgtcttcagccttcccaagacccacagatgaggttgaaactcttcagcatcctctcgaccgttctactgagagcgacagatactatcaactctcagggacagttcccttcctatctggagacagtgaccaaagacattctggcccccaacctccagtggcacgccggtcgcactgcagctgccattagaactgctgcggtgtcctgcttgtgggcacttacgagttctgaggtattatcagccgaacagatccgagatgtccaggagactctcatgcctcaggtccttactacattagaggaagactctaaaatgactcgactgattagctgcaggattatcaacacctttctaaaaactagcggagggatgactgatcccgaaaagcttatccgtatttatccggaactgttaaagcggctcgatgacgtcagcaacgatgttcgcatggctgcagcttctacgctcgttacgtggctgcaatgcgtgaagggcgccaatgctaagtcctattatcaatcctccgtgcaatacctttacagggagctgctcgtgcatcttgacgacccagaaagagcgattcaggatgcgattttggaagtgctgaaagaaggtagcggcctgttcccagacttgcttgtcagggagacagaggctgtgattcataaacatcgcagcgccacgtattgcgagcagcttctacagcacgtgcaagctgtgcccgctacccagtag

SEQ ID NO: 47975 - DNA, 2043 bp, Artificial Sequence
  Description of Artificial Sequence: Synthetic coding sequence
atgggcaagagccggaccaagcggttcaagcggccccagttcagcccgaccggtgattgccaggctgaggctgccgctgctgccaatggaacgggcggagaggaagacgacggcccagcggctgaactgcttgaaaagctacagcacccatctgctgaggttcgtgaatgtgcctgtgccggtctagcaagactggtgcagcaacgccccgcactgcctggattggctagacgcgacgcagtccgcagactgggtccccttttactggatcctagcctcgcggttcgggaaactgcagccggcgcacttcgaaatctgagcgcgtgcggggggttcgaggtttgtgacgacatggtgaccaaggatattatgacccctctggtcgccttgctgaaggaatgctccgccggactggattcgaacgagatgagcctgcaagagaaaaaagaccagaacagaaactctatcgagaacatagctaacgaaaccgtcaatgtgttatggaacatctgtgaatgttcctcccgggctgtgagtattttcaataaggagggctgcttagaaatcgttctgaagtatctgtctcgattccccacaaacgttgacctagccatcagtgtcgcatactgcttacagactgtaaccgaggacaacccagagcttctgaagagcttttcagcaaccgctctgaacatgttagagagtgctctgctgtcacccgtgagttcgatggagtctctgctgctgaaaacccttgtggctggcaccatatggaatctgaaggacattatcccctgcaagagccaagcagaaattattaatgcgctgttgaagatcctgagcgaagtgctgggcatggacgccggcgaaatggtcatccagatgaaggaagccgagacccaaaggttaaaaactgctgcagaggccgaagagattctggaaaatacgaatggcgatgatctgattgaagacgacgagatggaaggcatctctcacaagaggcgggtgcgaaggaaaacctttgtgagtgacctcctcccaccgaccgacaaggagttgagagagaccatcgccctgctgacggcgcagcagactgccctggagatcatcgtaaacatgtgctgtaacgaagatccgtcagatgatgaatgggaggaactaagctctagcgatgaatcagatgcttttatggaaaattcctttagcgagtgcggcggacaattattctcccctctgtgcttgtctcacgaagttcataccgcccttaccaactacctgatacctaagaaaatcttcgagaagaccgcctttcccaactccatcgccgtggacctgtgctccaggaaccccacatggaaaccactgatcaggaaaatgaatacaatccagtgccgcgcgttgttttgcctgcagtccctcgtatcactgcttgatgtggaacatctgggtggggcagccgccctacagaccctggctcagcatctttcccagctgctgttctctcaacccgattttgcaaagcatgtcgattttcttgaggccattagctctgcgctgcgggcattactgcagacaatggcaagcaagaatatttcccaatgtatgacccctgaccagcttatgactctgtgtaaggctggaattcatagctcgaatgtcggggtgcgtgtcaacgtagtgagcattctgggaattactggcagtgtgctggcaaaagaggacggtactttagagaccctgaagaacattggctgctttcttctggaggtaactacaaaggaccccagtctggttgtggctggagaagccctcgacgccctgtttgatgtctttgcggacggcaaagaggccgaaagggcttcgatccaaatcaagctgttaagtgctctgaaggagtttcagcccgtgttcaaaatgaagatcagaaaagagggtcgcgggaattattctacagaccagctgtgcgtcctggataacgttaaaatgaatctgcgacgtttcattgcgtatcaggaaacagtggaaaagagactgacctcttag

SEQ ID NO: 47976 - DNA, 3081 bp, Artificial Sequence
  Description of Artificial Sequence: Synthetic coding sequence
atgacccggacccagaagggcaagaccttcctgccccactgcttctaccagtcactcccaccacgcctaggctgggggatgatactgaattacagcaaactcaaaggcaaggaagaatgcgcgtcggtttccagtgtgccaatggtcttttttagttcccagtacaggctccataggaagtctcagtacctgaagatggccgccgcaaatctgacctttagccaggaagtggtttggcagagagggctcccaagtatcccctactcacagtacagcttcgaccacctgtacaatacaaatgacataattcacactccccagatccgtaaggccaggcctcaaaaaccagtgagctttaagttcttaggaagtagttccccattgaccggagatactagtctggccgtgaagaccgaaagctctgccaatccagagaagaagctgaaaaaatcaaagcccgcttctacggtgcgggaggcacccaggcccctgatccatcatccctgcatgcacccggatatgctggggaggccaccttcattagatgtgaacctcgaggagagagaagcttggttactgccccctgagaaggaagcacgtgcatgggaggctaccgtcttagaaaaattaaatgaaaggactgcccgttggattcaatccaagcggccaagaaggcctggcgcttcaccgaataagtggcaatcctttttgagacaacagtacgattggtctcatattcgcgacgagctcacctccgccagtgacctagagctcctcaaacagttagaggcggaggaaacagctgaattcgaggatcagtcggtgattctgccacctcaggagaagaagaagcccgagcttctcctgcccgtgtattacaggctgccatcttactttcagcaggccgagactgttgagatcatgcccggaaataagtcgaccgaagatatccatgaaaagacatcacttagtcagccccagacccagtcatactttcgacaggttacgccacgggctggaaaatttgcatattccaccgataatacctttgaacaggaaatctactttgatgaagttcaaatcattcaccagatcggcgccaagagagatcagattgtgctggaaaatcttaacaggtataacaaacagctgtccaaggttttcccagaaacccctgagaagtggagcgctcaggccatacccgaagcttcgtacaggccagtgcaaggcgccctgaggtggactgccctgccaactcctgcaaaagacatgctgctgcaagtgggcgagaaggatgtgcctattaagacccggaggctgaaaaagcaggccaagtccctgcaagaagacgtgacctgggagctggtggtgctaagaaggatgcttaaagagtggaaaacggcttgggctctgatcatcgaatggcaccacgaaactgttgagaacctgttacagagcctcggcgacctgcacgatgatgtacggattaaagccattacaacctgcgcaacagccgcccttgaacgacctcgcatagcaacatcccagcgggattcggacaaaaccattcaggatctcccagaagttttgcttccagcactagaagctgctctgtgcgataaaaatgcccacgtgcgcatggctgccgccatatgccaatatgcaattcagagtcataatccactggcccgaaatataatgcagactgcactgctgaagggtaactccgtggattcgtgggccgccgcacagtgcctggctttggaagggaccgctacctatcctgtgataaaaaggattctacatcagctgtttaccaagaagaatgaggataccgaggagcagtcttacatattactctcatatctgtccgaaaagaccacgctaatccacactatgctggccgtggagctcaactcctgccagtggaagaataggattgtcgcctgccaggccttttcaaggatctccggaaacgtgtgcttggacatgaagcataaactgattcagctcatgtggaatgattggaataaggaggtgaggcgtgcagcagcacaggctctaggtcagatgtcccttggcaaggaggtccacgacattatccgggtgaagctagggcagggcaacagccaggagcgcgtggaggccctctatctgataggagagttgaagctgatgactgcgaaactcctcccaagcttcttacactgtttcagtgacgactttaccgcggtacgcagagctgcctgcttagcggccggcgctttacagattagagacaaaatggtgctggaatgcttgttgaatctgatgcaaagagacccttattggaagataaaagcctttgctattcgcgctcttggccagattgggcaggtgagtcctgagctaaccgacttgctgttgtgggccatccactacgaggaaagccccggcgtacgattagaagcttgtcggtcaattttggccctgaagttgcaaggtgatagagtgcgcgacacattcctcgatgtccttttgcttgagaatcacgacgccgtgctgaaggagatgtatcaaacaatgaagattctcaatctcggaaacgagggaaatcaagagatgctgcaggaaatcaaaaatagaatcaaaactctttcccagaaggacctcctgacacacaagattctaaaactggagatggtgatgggaaaagtccgcgaagaggccaagagagtatacttgaaacctaaaggtgagcagggcccactcaccctccaaacactgctgcaagagactttccaggatgagatggtcctgccccgcagaccgagcgaagtctgtgacacagaagccgtaatcaaacccgtgaaacctagagcaccaaatccttggctgcaatctagtgtgccaggcttaacaactcggtctaaagtgcgctccagtctcgtcaaagacttgcgcaccagtcccgaaaagagaatagcagtgggccctttccggagcgactatcccgcactgtatctaggcaagttttccgagaggactttcttttcacccattatgtcctcaccctccgggaagaagggcgcccacctttag

SEQ ID NO: 47977 - DNA, 3081 bp, Artificial Sequence
  Description of Artificial Sequence: Synthetic coding sequence
atgacccggacccagaagggcaagaccttcctgccccactgcttctatcagtcgctaccgccgcgccttgggtgggggatgattctcaattattctaaactgaaggggaaagaggagtgtgcttcagttagcagcgtgccaatggtctttttttcatcacagtataggttacatcgtaagagtcagtacctgaaaatggcagcagcaaaccttaccttcagtcaggaagtggtctggcagcgaggactgccctccatcccttactctcagtatagctttgaccacctgtacaataccaatgacatcattcatactccacaaatcaggaaggccaggccccaaaaacctgtttcattcaaatttcttggcagctctagcccattgacaggagatactagccttgccgtgaagaccgaatcttcagccaatcccgagaagaagctgaagaagtctaaacctgcttctaccgttagggaagctccacgacctttgatccatcatccttgtatgcatcctgacatgcttggtaggccacccagcctggatgttaacctagaggagagggaggcctggttgttgccacctgaaaaggaggcccgggcttgggaggctacagttttggagaaattgaacgaacggaccgccaggtggattcagtcaaaacgcccccggcggccaggggcctcacctaacaaatggcagtcttttctgaggcagcagtacgattggagtcacattcgcgatgaactaacttctgccagcgaccttgaattactaaaacagctcgaagccgaagagaccgctgagttcgaggatcagagcgtgatactgcccccacaggaaaaaaagaaaccggagctgttgctgcctgtatactaccggctcccttcatactttcagcaggccgaaacagtcgagataatgcccggaaacaagtctacagaggacatacacgagaagacaagccttagtcagccccagacccagagctatttcagacaagttactccaagggctggaaagtttgcctattccaccgacaacactttcgagcaggagatttactttgatgaggtgcaaataattcaccagattggcgccaaaagagaccaaattgtgttagaaaatctgaacagatacaacaagcagctgtctaaggttttccctgaaaccccagagaaatggtctgcccaggccatccccgaggcatcctatagacccgtacaaggagccttacgatggaccgccctgcccacaccagctaaggatatgctgttacaagttggtgagaaggatgtacccatcaaaactcgcaggctaaagaagcaggcaaagagcttgcaggaagatgtgacttgggagctggtggtcctccggagaatgctgaaagaatggaagacggcctgggctctgattattgagtggcatcacgagactgtcgagaatctgctgcagagtttgggcgatctgcatgatgacgtgagaataaaagctatcactacatgcgctacagcggctcttgagaggcccaggattgccactagtcaacgcgacagcgataagactatccaagacctgcccgaggtcctgctgccagctctggaggccgccctctgcgacaaaaatgcccacgtgaggatggcagcagccatttgtcaatacgccatacagtcccacaatccattggccagaaatatcatgcagaccgctttactgaaagggaattctgtggattcttgggctgctgcccagtgcttggctctggagggcacggcaacctaccctgtaatcaagaggattctccaccagttattcacaaagaagaacgaggataccgaggaacagagctacatcctgctatcttacctcagcgagaaaacaacattgattcatactatgttagccgtggagttaaactcatgccagtggaagaacaggatcgttgcttgccaagcttttagtaggatatcagggaatgtctgtttggacatgaaacacaaattgatccagctcatgtggaatgactggaacaaagaggtgcgccgcgccgccgcccaggctcttgggcaaatgtccctgggcaaagaagtgcacgatataatacgggtgaagcttgggcaaggcaattcccaggagcgtgtggaagcgctctacctcatcggagagctgaagttgatgaccgccaaattgttgccatcctttcttcattgtttctcggatgacttcaccgccgtcaggagagcagcgtgcctcgctgcaggcgcacttcagatacgggacaaaatggtgttagagtgcctgctgaacttaatgcagcgcgacccatattggaaaattaaggctttcgctatcagggctctcggacagatcggccaggtgagccccgaactcaccgacctcctactctgggctatccattatgaggagtctccaggggttaggctcgaagcttgcaggtctatactagccctgaagcttcaaggcgaccgggtacgcgacaccttcctggacgtcctcctcctagaaaaccacgatgccgtgctgaaggagatgtaccaaaccatgaagattctgaatctgggcaacgaagggaaccaggagatgctgcaggagataaaaaatagaatcaaaacattatctcagaaggacttacttacacataaaatactcaagttagagatggttatgggcaaggtgcgggaggaggcaaagcgcgtgtacctcaagcccaagggggagcagggacctctaacccttcagaccctgctccaagaaacgttccaggatgagatggtacttccaaggcgaccaagcgaagtctgtgatactgaggcagtgattaagcccgtcaagcctcgagcacctaacccctggcttcagagttcggtgcctggtcttactaccagatccaaggtccgtagtagcctcgtgaaggatttaaggactagtccggaaaagagaatcgcagtgggtcctttccgttcagattaccctgctctttaccttgggaagttttctgaacgaacgttcttctcaccaatcatgtcgagtccgtcaggcaagaaaggcgcgcacctctag

SEQ ID NO: 47978 - DNA, 576 bp, Artificial Sequence
  Description of Artificial Sequence: Synthetic coding sequence
atgacccggacccagaagggcaagaccttcctgccccactgcttctaccagtccctccccccacgactggggtgggggatgattttaaattactctaaactcaagggcaaagaggagtgcgcgtcggtgagctctgtccctatggtttttttctcttctcaatataggctgcaccggaagtcccagtacttaaaaatggcagccgcaaatcttacatttagccaagaggttgtttggcagcggggactgcctagtatcccatattcacagtatagttttgaccatctgtacaacacaaatgacataattcacacaccccagatccgcaaagccaggccacaaaagcccgtctcctttaagtttcttggatcatcaagtccactgacgggggacacttcactggctgtcaagacggagtcctccgcaaatccagaaaagaaacttaagaaaagtaagccagcttcaaccgtgagagaggccccccggcctctgatccaccatccgtgcatgcatccggacatgctgggccgacccccctcactggatgtcaacctggaggagcgcgaggcatggtag

SEQ ID NO: 47979 - DNA, 120 bp, Artificial Sequence
  Description of Artificial Sequence: Synthetic coding sequence
atgacccggacccagaagggcaagaccttcctgccccactgcttctatcagagtttgcctccccggctgggctgggggatgattctgaactactcaaaactaaagggtaaggaagagtag

SEQ ID NO: 47980 - DNA, 2940 bp, Artificial Sequence
  Description of Artificial Sequence: Synthetic coding sequence
atggtgttcttcagcagccagtaccggctgcaccggaagagccagtatcttaaaatggccgctgctaacctgacttttagtcaagaagtggtgtggcagagggggctcccaagtatcccttactcccaatattccttcgaccacctgtacaacacgaacgacattattcacactccacagattcggaaagcacggccccaaaagccagtgtcttttaaattcctggggtcttcctcaccactgaccggggacactagcctggccgtgaagactgaaagctctgccaatcctgagaagaaacttaagaaatctaaacctgcatccacagttagggaagctccacgcccactaattcaccacccctgcatgcaccccgacatgctagggcgccccccctctctggacgtcaacctggaagaaagggaagcctggctgctacccccagaaaaggaggcacgagcatgggaagcgacagttctggaaaagctcaatgagcggaccgccagatggattcaaagcaaacgaccgaggagaccgggtgcatccccaaataagtggcaatctttccttcggcagcaatacgattggagccacatccgagacgagctcacctctgcgtcagacctcgagcttctgaaacagcttgaagcggaagagacagctgagttcgaggatcaatctgtgattctaccacctcaggaaaaaaaaaagccggagctcctactgcctgtgtattataggctccctagctatttccaacaagctgagacagttgaaatcatgcccggcaacaaatccacagaggacatacacgagaaaacttctctctctcagccccagacacaaagctactttaggcaggtgacccccagagccggtaagttcgcgtattccacagataacacctttgagcaggaaatttacttcgatgaagttcagatcatccatcagatcggagccaagcgtgatcagatcgtccttgaaaacctgaaccgctacaacaagcagctcagcaaggtcttccctgagacaccagaaaaatggtccgcccaggcgatccctgaagcctcctatcggcccgtacaaggagccctgcgttggacggccttaccaacccccgccaaagacatgttgcttcaggtcggtgaaaaggacgttcccatcaaaactagaagattgaagaaacaggcgaagtcactgcaggaggacgtcacttgggagctggtggtcctacgacgcatgttgaaggagtggaaaacagcctgggccctgattatcgaatggcatcacgagacagtggagaacttgttgcagagccttggcgacctgcacgatgatgtgagaatcaaggccataactacgtgtgctacagccgctctcgagcgtcctaggatagccactagccagcgggattccgacaaaaccatccaagatctacctgaggtgttgctccctgccctcgaagctgccttatgtgacaagaacgcccacgtacgaatggccgcggccatatgtcaatacgcaattcagtctcataatccactcgctcggaatatcatgcagacagcgttactcaagggcaactcagtggacagctgggcggcggcccagtgcctggctctggaagggaccgctacctatcccgttattaagcgaatactacatcagctcttcactaaaaaaaacgaggatactgaagaacagtcctacattctcctgtcttacctgagcgagaagactaccctcattcacactatgttagctgtcgagctgaactcatgtcaatggaagaatcggatcgtggcttgtcaagctttcagccgcatctccgggaacgtgtgcctggacatgaagcataagctaatccagctgatgtggaacgattggaataaagaggtgagaagagcagccgcccaggctttgggtcagatgtccctggggaaagaggtacacgacattatccgggtgaagttgggacaagggaattctcaggaaagggtagaagccctttatctgatcggtgagctgaagctgatgacggctaaacttcttccaagctttctgcactgcttttcagacgactttaccgctgttaggcgagccgcttgtttggccgccggcgctttgcagatcagggacaaaatggtcctagaatgtctccttaatctgatgcagcgcgatccatactggaaaatcaaggcatttgccattagagcactggggcagatcgggcaggtttctcctgagctcaccgacctgctcttatgggccattcattacgaagaaagtccaggagtacggctggaggcttgcagatctatcttggctctcaagctccagggggacagagtccgagacacatttctcgacgtacttctactggagaatcacgatgcggtgctgaaagaaatgtatcagacaatgaagattctgaacctggggaacgagggaaatcaggagatgctgcaagagattaaaaaccgtatcaagactctttcccagaaggatcttctgacccataaaatcttgaagctcgagatggtcatgggcaaggtccgcgaagaagccaaaagagtctatcttaagccgaagggtgaacaggggccgctcaccctccaaaccctcctgcaagaaacattccaggacgaaatggtgctccctaggagaccttccgaggtgtgcgatactgaggccgtcattaaaccggtgaaaccccgcgctcccaacccctggctacagtcttctgtgcccgggctcactacccgcagcaaggtgcgctcctctctggtcaaagaccttcgaacttctcccgagaagcgaatcgctgtgggcccgttcaggtctgactaccccgctttgtatctaggcaaatttagcgagcgcactttctttagcccgattatgtcatctccatctggaaaaaaaggggcacacctttag

SEQ ID NO: 47981 - DNA, 6123 bp, Artificial Sequence
  Description of Artificial Sequence: Synthetic coding sequence
atggagctggcccacagcctgctgctgaacgaggaggcctacaaccagcttggtgaggtgcagaaggccgagtttatatttgaatggctccggtatctagaaaagctactgctggccacctccagaaacgatgttcgggagaaacaaaagacgctggtagagcaattgctgtccctactaaactctagccccgggccgcccactagaaagcttttggcaaaaaatctcgccatcctctacagcattggggatacattttcagtacacgaggccatcgataagtgcaacgaccttataaggagcaaagatgacagtcctagctatctccccaccaagttagcggctgtggtatgtctggggagtctatataagaagctggggagaatcctgggcaatacctttaccgataccgtcggcaatattcttaaagccatgaagtccgccgaatctcaaggcagatatgagataatgttaagcctgcaaaatatcctgaatggcctgggcgctgccgcggccccctgccaccgagacgtgtacaaggccgcacggtcctgtctcacggatagaagcatggccgttcgctgtgccgctgccaaaaacgaggctatattcatgtggtccactgatttagatagcgtggctactttatgtttcaagtcattcgaggggagtaactacgatgtgcggatttctgtgtcaaagttgctgggaatcattctggctaaggccgtgatatcgaagcatccaggcacagctgcttcccgacagtcgatccgcagggtgagcttagaggaagtgctagagttgctaggaaccggcttcctgcgcggtagcagcgggtttctgagagcctccggagatatgctcaagggtactagttcagtttccagggatgttcgcgtaggcgtgacacaggcttatgtcgtattcgtgtcgactctcggcggcgcctggcttgaaaaaaactttgccgccttcttttcgcacatcttatccctggccagcccttcacacccgaaggccacacaaacacaaatcgacgctgtgtgttgtaggcgctgcgtatccttcatcctgagaacaaccatcggggggctcttaggggaaaaggcgcagctagccgccgtaaaggacatttgccaagctatctggaagctcaaaaaagtgatggatgccgtgatgtccgacgggaacctagagacgagactggggagcacagacgtcgccgcttcacagcacatgttagtgtgcgcgttacaggagcttggcaatctcatacacaacctgggtactactgcagcacctctgctccaggattcgtctaccgggttactggattcaatcctctccgtgatcctgcatccatctatcagcgtaagactcgcagccgcttggtgcctccactgcatcgctgttgccctgccaagctatctcactcccctgctcgaccgttgcctggagagattgacgggtcacaaatcgagccccgaggccgtgaccggcttctctttcgccgttgcggccctcctaggggcagtaaaacattgccccctcgggatccctcacggcaaaggaaagatcattatgacccttgccgaggacctgctctgttctgcagctcagaactctcggctcagcgcccagagaacgcaggccggatggttattgattagtgccctgatgacactcgggcccgcagtggtctcgcatcatctggctcgggtgttgctcctgtggaaatgtgtgtttccggccagccccaaagatttggagacagagaagtcaagaggcgactcctttacttggcaggtcactcttgagggcagagccggagcactctgcgctatcaagtcatttgtttcacattgcggagacctgctcaccgaagaggttactcagcgtctcctcccaccactgccctgcgccgtggaccttctgacacaactgagctccatcttgaagatgtatggatctccactcaagacgccatcagttgtgtacaggcagcggttatatgagttgctgatactactgcctcccgagacttacgaagggaacctctgcgccattctccgtgagctggctgccgatctgacagccccagacatccaggttgcggctagcacgtttttgctcccgcctttatgccaccaggatgatctgttgattttgtcccccttcctccaagagaccgatcatcggtttatcgaggagcagctgctcctcggcaatggcgtggcgtgtggctcgttagaatatgatccatactctatttacgagaaggacgtggaaggggacagcgtgccaaaacccctgccacccgcactgtccgtgatatcatccgcttctaagctctttggggtggtgtgcgcccatgtgggtgagacgcagaggttgctgattctggaacagctacttgattcaatcaagcacaccaaaggtgcgcgccagcaggttgtccagctccacgtcgtgagcagcgtgagttccttccttaagtacgttgcagggtctaaaggctgtctcgggcccgaggagatgaaaagatttgcgctgacccttgtgatgggcgctttagagtctcccaatccacttctgagatgtgccgctgccgaaagttgggcgcggctggcccaggttgtcgacgatggtgcattcactgctggtcttgcccaagtgagctttgacaagcttaagagcgcccgcgacgttgttacccggaccgggcattccctcgccctaggaagccttcataggtaccttgggggaattagctcatcacaacatctcaacagttgcatcgggattctgtatactctagcccaggattccacctcgccagatgtgcaaacctgggccctgcattcgttgtcactaattatagattctgccggcccactgtactatgtgcatgtcgagcctactctaagtctgatcatcatgcttctgctgaatgtgccacccacgcatgcggaagtccaccagtccctgggaaggtgtctgaatgccctcatcaccaccctgggacccgaactgcagggcaatagcacttccatcagcacactgaggactagttgcctgcttggctgtgccgtgatgcaagataatccggattgccttgtgcaggcacaggcgatcagctgtctacagcaactccacatgttcgcgcctcgccatgttaacctgtcaagcctggtgagttgtctgtgcgtgaatctgtgctctccctatctgctgctgaggcgtgccgtgctcgcttgcctcaggcaactggtgcaaagagaggctgccgaggtatctgagcatgccgtgatgctagctaaggacagtcgcgaggaactgacacccgatgccaatatcagggaggttgggctcgagggtgcactgttgatcctcttggataaagagaccgacgagcgcctgtgtcacgacatcaaagaaaccctcaactatatgctgacctctatggccgtcgaaaaactgtcactgtggctgaaactttgtaaagatgtgttggccgccagcgccgacttcactgcggtgacatgcgtcgacacaatgcaggaagaagaaggagacaagggcgatgatgcaagtgtactgacaacaaggagagacgaaaagtcacacccctttacaaatccaagatgggctactagagtgttcgcggccgagtgtgtgtgtcgcatcattaaccagtgcgaaaacgccaactccgcccattttgacatagctttagcacaggagatgaagaagcgcgactcccggaatgactttctggtgctgcacctggccgacctcataagaatggctttcatggccgccacagatcattccgatcaacttagactttccggattagaaatgttgctagtagtcattagacggttcgccactgtgcctgagcccgaattcccgggccatgtgatactggagcagtaccaggccaacgtaggcgcggctctgaggcccgcatttacctctgagacccctcctgatgtgacggccaaagcctgtcaggtctgctctgcgtggattgctagtggggtggtatctgacctgaatgatctcagaagagttcatcagctgctggtgagtagcctgacaaaaatccaggctggcaaggaggccctgtctcatctgtacaatgagagtgcgtccactatggaaatactggctgtattgaaagcgtgggccgaggtgtacatcatcgctgtgcaaaggcacaaaaaccaccggcagccgctcaagactacaacctgcctcgaggacgggatccgcaatgggtcttgttcctccgatggactcttagatctggtctacgctgacttaggcaccctgtcccgactttggctggccgcacttcaagacttcgccttgctgacactgccttccgagtttgccagtcagctccccgcagaggggggggccttttacactgccgagacttcggaaaacgccaaacttcattactacaattcatgggccctgattctgcacgcaacagcactctggcttacatctaccggatttgtcgtggcggaccctgatgagggagcatccaatttgtccaggccagtgacccctaccagtatgtgccagggctcttcctccggagccacaattaaatctcccgaggatgtctacacggaccggtttcacctcatcttgggcatatctgtggaatttctgtgctctctgcggtccgacgcaaccatggagagcatcaccgcatgccttcacgctctgcaggccttactcgacgtgccgtggccacgctcaaagatcgggtcggatcaggaccttggcatcgagctgctcaacgtactgcaccgagtgatcttgacaagggagtcgccatccattcagctcgcgagtcttgaggtagtcaggcaaatcatttgcgctgcgcaggagcatgtgaaagaaaagcggcggtccgcagaggtagacgacggagccgcagaaaaagagaccctccctgaatttggcgaagggaaggacaccggcggccttgtgccaggaaagtccctggttttcgctactctcgagctgtgcgtgtgtatccttgtgcgacagcttcccgagctcaacccaaaactcaccggctcaccaggcgtgaaggccacgaagccccagattctgctggaggatggctcgcgcctagtgtcggctgccctagtgattttgtccgagctgcctgccgtgtgctcacccgagggttctatttccatcctacctaccatactgtacctgacaatcggtgtcctgagggaaactgctgtgaagctgcccgggggccagctgtctagtactgttgccgcatctctccaggccctcaagggaatactgtcatcgcctatggcccgggcggagaagtctagaactgcatggaccgatctcctgagaagcgctctgaccacaattctggattgctgggaccccgtggatgaaacccatcaagagctggacgaggtgagtttgctcactgccatcaccgtattcattctatccaccagccccgaagtcacgactatcccttgccttcagaagcgttgtatcgacaaattcaaagccacattagagataaaggatccggttgttcaaattaaaacttaccagctgctgcactccatctttcagtacccgaaccccgccgtttcctacccatacatctactccctggcgagttgcataatggagaaactacaggagatagataagagaaagccggagaataccgccgaactcgagatcttccaagaaggaataaaggtgctcgagacactggttacagtcgctgaggagcatcaccgcgcacagctggttgcatgtctgttaccaatcttaatatcatttctcctggatgaaaactcactcggctctgccacatctatcatgcggaatcttcatgacttcgctttacagaatttgatgcagatcggcccgcagtactcatctgtgtttaaaagccttgtggccagctccccggccctgaaagcgcggctggaggccgcaatcaagggcaaccaggagtccgttaaagttaagatacctacatctaagtataccaaatcacccggcaaaaactctagcatccaattgaagacaagtttcttgtag

SEQ ID NO: 47982 - DNA, 3423 bp, Artificial Sequence
  Description of Artificial Sequence: Synthetic coding sequence
atggagctggcccacagcctgctgctgaacgaggaggcctacaaccagctgggggaagtgcagaaggcagaatttatattcgaatggctgcgttacctggagaaacttttattggcaacctcccgaaatgacgtgagagaaaagcagaaaacgcttgtggagcaattgttgagcttgctcaactccagcccgggaccacccacccggaagcttctggctaagaatctggctattctgtactctatcggagatactttttctgttcacgaggcaatcgacaaatgcaacgatctgatcagatctaaggacgactcgccatcttacctgccaactaagctagctgcagtcgtgtgtttgggttctctgtataagaagctcggaagaatcttggggaacaccttcacggataccgtgggtaacatcctgaaagctatgaagagcgccgagagtcaaggccgttacgaaatcatgctgagcctgcaaaacattttaaatggcttgggagcagctgctgccccgtgccatcgggatgtgtacaaggccgcccgcagttgcctgaccgaccggtccatggccgttagatgtgccgccgcaaaatgcttattagagctccagaatgaggcgatttttatgtggtctaccgatcttgatagcgttgccacactctgtttcaagtcgttcgagggcagtaactatgacgtgcggataagtgtgtctaaactgctgggtatcatcttggcaaaggccgtcatttcgaaacacccggggacggctgctagtcgccagtcaatccgcagagtctccctagaagaagtgctggagctactgggaacgggttttctccggggttccagcggcttcctccgagccagcggggatatgcttaagggcacgtcaagcgtgtccagggatgtgcgagtcggggtcacacaagcctatgtagtgttcgtgtcaaccttgggtggagcctggttagaaaaaaacttcgcagcttttttcagtcacatactgagcctcgccagtcctagtcaccccaaagccacacagacccagatagatgctgtctgttgccgccgttgtgtgtcttttattctgagaacgacaatcggcggactgctgggcgagaaagcccagctggctgctgtcaaggatatctgtcaggccatatggaagctcaaaaaagtaatggatgctgtcatgagcgacggtaacctagagacccggttaggaagcaccgacgtggccgcgtcccagcacatgctggtctgcgctctgcaagagctggggaatcttatccacaatctcggaactaccgctgcaccgctactccaggactcctccacagggctcctggatagtattctgtcagttatccttcatccatcaattagcgtcagactggctgcagcttggtgtctccactgcatcgcagttgcgctgcccagctatttgacacccttgttggacagatgcctggaacgtctcaccggtcacaagagttcaccagaggccgtgactggcttttcattcgctgtggcggccctactcggcgctgtaaagcactgcccccttgggattccacacggaaaaggcaagattataatgaccctagctgaggatctgctgtgcagcgccgcacagaattcacgactctctgcccaaaggactcaggcgggctggctgctaattagtgctcttatgacactgggcccggccgtagtgtctcaccacctggcccgagtgctcctcctgtggaagtgcgtctttccggcgagccctaaagaccttgaaactgaaaaaagccgaggcgactcctttacatggcaagtaacactggaaggccgagccggcgccctgtgtgccatcaagtcgtttgtgtcccactgtggcgatcttctaaccgaggaggtaacgcaacgactgctcccccctctaccctgcgccgtcgacctcctgacacagttatcctccatacttaagatgtatggttcacctctgaaaacccccagcgtagtctaccgccagcggctatatgagctgctgatcctgctgccacccgagacttacgaaggtaatttatgcgcaatacttagagaacttgcagctgacctgacagctccagatatccaggttgctgcaagcactttcctcctcccacccctatgtcatcaagacgatctgcttatcctctctccctttttgcaagagacggaccacaggttcatcgaggagcagctgctgttgggtaacggagtagcatgcggcagcctcgagtatgacccttacagcatctatgagaaggatgtagaaggggactctgtccccaagccactgccgcctgccctgagcgttatctcgtcagcctctaaactgttcggggttgtgtgcgcccacgtaggcgagacccaaagacttctgatcctggagcagctgcttgactccatcaagcacacaaagggagccagacagcaggtggtacagttgcatgtcgtgtcctcggtgagttcattcttaaagtacgtagccggcagtaaaggttgcttaggccctgaggaaatgaagagatttgcgttgacattggtcatgggggctctggaatctcccaacccactgctcagatgtgccgctgcagaatcatgggcacgactggcacaggtcgtcgatgacggagccttcaccgccggactggcacaggtatcctttgacaagcttaaatctgcacgggatgttgtgacccgaacaggccacagcctcgcattgggcagtctgcacaggtatctaggcggcatttcctcctcccagcacctcaatagttgtattggcattctgtataccctggcgcaggactcgacaagtccggacgtacagacgtgggctcttcacagcctcagcctgatcatcgactcagcagggcccctctactacgtacacgtggagcccaccctgagcttgatcatcatgttactcctcaacgtccctcctacacacgctgaggtccaccagtccttagggcggtgcctgaatgccctcatcacaaccctgggacccgaacttcagggtaactctacctcaatcagtacccttcgcacctcatgtctcctcggctgtgccgtgatgcaggataaccctgattgtctggtccaggcgcaggcaatatcttgcttgcagcagcttcacatgttcgccccgcgacacgttaacctgtccagccttgtaagttgcctgtgtgttaatctttgtagcccctatctcttgctgcggcgagccgtgctggcttgcctgcggcaactcgtccagcgggaggcggcagaggtttctgagcacgccgtgatgctcgcaaaggactcccgcgaggaactgacgcctgtgtttaccgcctcttccccaggtgtggactctatctgcaggaatcatcttgaatag

SEQ ID NO: 47983 - DNA, 5898 bp, Artificial Sequence
  Description of Artificial Sequence: Synthetic coding sequence
atggagctggcccacagcctgctgctgaacgaggaggcctacaaccagcttggagaggtccagaaggctgaattcatctttgaatggctgaggtacttagagaagctcctcctggctacgtcccgaaatgacgtgagagagaagcagaaaacactcgttgaacaactgctgagtctccttaatagtagtcccggaccgcctaccaggaaactgctggctaaaaacctggccatcctttattctattggcgacacctttagcgtccatgaggcaattgacaagtgtaacgaccttatccggagcaaagatgacagcccaagttatttgcccactaagcttgcagccgtggtgtgccttggctccctgtataagaaattgggaagaattctgggaaacaccttcactgacacggttgggaatattctgaaggccatgaaatcagcagagagccaaggtcggtatgagatcatgcttagtttacagaacatcttaaacggtttaggcgcggctgccgctccctgccaccgtgatgtgtacaaggccgccaggagttgcctgaccgaccgatcaatggcagtacgctgtgccgcggccaagaatgaggctatattcatgtggtctacagacttagatagtgtggcaactctctgtttcaagagcttcgagggttctaattacgatgtgaggatatccgttagcaaactccttggcattattctcgccaaggccgtgattagcaaacaccctggcacggcagcatcccgccagtccatccgccgtgtcagtctggaagaggtgctcgagctgttaggtacagggtttctgcgcggcagctcaggatttctgcgcgcttctggagacatgctgaaaggaacctccagtgtgtctcgcgatgtgagggtgggcgtgacccaggcctatgttgtgtttgtctccactctcggtggagcctggctggaaaagaacttcgcggcgttcttctcgcatattctaagtttggcctctccttctcatcctaaggctacccaaacccaaatagatgctgtgtgttgcaggagatgcgttagctttattctgagaacaacaatagggggccttctgggcgaaaaggctcaactggcggccgtcaaagacatctgtcaagccatttggaaacttaaaaaagttatggacgctgtgatgagtgatgggaatctcgagacccggttgggttctaccgacgtggccgcctctcagcatatgttagtgtgcgcactgcaagagctggggaatctcattcacaatctgggaactaccgccgctccacttctgcaggactccagtacaggccttttagactccatcctgagtgtgatactgcacccgagtatttccgttcgccttgcggctgcctggtgcctccactgcatcgccgtggccttgccctcttatttgacgccactactcgacaggtgcctcgaacgcctgaccggccacaagagctcccccgaggccgttactgggttttccttcgctgtcgcagctctgctgggcgcggtcaagcattgccctctgggtattccccacggtaaagggaaaatcattatgaccttggcagaagacctactttgttcagccgcgcaaaattcacgtctgtcggcccaaagaactcaggccgggtggttgttgattagcgcactgatgacgttgggcccagcggtggtcagccatcatctagcaagggttctgctgctctggaagtgtgttttccccgccagtcccaaagatcttgaaaccgaaaagagccggggggacagctttacctggcaggtgaccttagagggcagggccggcgccctgtgcgctatcaagtcctttgttagtcactgcggtgatctgctgaccgaggaagtgacacagcgcctgctgccccccctaccatgcgctgtagatctgctcactcagttatcctctatcctgaagatgtacggcagccccttaaagactccaagtgtggtgtaccgacagcgtttatacgaattgcttattctcctgccaccagaaacttatgagggaaatctatgcgctatcctcagagagctcgctgccgacttaacagccccagatatccaagttgccgcctctacgtttcttctgccaccgctgtgccaccaggacgacctgctgattctgtctccctttctgcaagagacggaccatagattcatcgaggaacagttgctgttggggaatggagtagcttgcggctcccttgagtatgacccctacagtatttatgaaaaagacgttgaaggagattcagtccccaagccattacctcccgcgctgtcagtgatctcttccgcttcaaaattatttggcgtggtgtgtgcacatgtgggcgaaacgcagcgactgctcatattagagcagctattagactcaatcaaacatacgaagggagcccggcagcaggtcgtgcaactccatgtggtgagtagcgtgagctctttccttaaatacgtcgccggctccaagggctgcttaggtcccgaggaaatgaagcggtttgccctgacactggtgatgggggctttggagagccccaatcccctgctccgttgtgctgcagctgaatcttgggcgcggctcgctcaagtggttgacgatggcgcattcaccgccgggctggctcaagtttcgtttgacaagttgaaatctgcccgtgacgtagtaacccgcaccggacactccttagcattgggatcattacacaggtacctcggggggatttcatcctcgcagcacttgaattcctgcattggcattctctacacattggcgcaggatagcacgagtcctgacgttcagacttgggccctccattccttaagcttaattattgacagtgccgggcccctgtactacgtgcacgtagaacctacattgtcgctgatcattatgttgctactgaacgtaccccctactcacgcagaggtccaccaaagtttgggccggtgtctcaatgctcttatcactactctcggaccagagcttcaaggaaactccaccagtatttctaccctcagaacaagctgtttgttgggctgtgctgtgatgcaggacaatccagattgcctggtccaggcgcaggctatctcatgcttgcaacaactccacatgtttgcccctcgccacgtaaatctgagttctcttgtgagctgcctttgtgtcaacctgtgtagtccttatttattgctgcggagagcagtgctcgcctgcctgcggcagctggtgcaacgagaggccgcagaggttagcgaacacgcggtgatgcttgcgaaagatagtcgggaagagctcacaccagatgctaacatacgggaagtgggcctggaaggagctctcctgatcttgctggataaggagacagacgaacgtctgtgtcacgatattaaagaaacacttaactacatgctcaccagcatggccgtggagaaactgtctctttggcttaaactgtgcaaggacgtcctggccgcctccgctgactttaccgctgtaacttgcgtggacaccatgcaagaagaagagggagataaaggcgacgacgcatcggtattaacgacgcgcagggacgaaaagtcacaccccttcaccaaccctaggtgggcgaccagagtgttcgccgctgagtgtgtatgtagaataattaaccagtgtgagaacgccaatagcgcacactttgacatcgctctggctcaggagatgaagaagcgtgacagtaggaatgacttcctggttctgcacctagccgatctcattagaatggcattcatggctgccacggatcactctgatcagcttcgtctgagcggattggaaatgttgctggttgtaattaggcgtttcgcgaccgtgcctgaacccgagttcccaggccatgtgattttggaacagtatcaggcaaatgtaggggctgctctgcgcccggcctttaccagcgagacccctcccgacgttaccgctaaggcctgccaggtgtgttcagcatggatcgcatcaggggtggtgtctgaccttaacgacctgcggcgggtccatcagctattagtcagctccctcaccaaaatccaggcaggtaaggaagccctgtcgcacttatacaatgagtctgcatcgaccatggaaatactggcagtactgaaggcttgggcggaagtgtacataattgcggttcagcgacataaaaatcaccggcagccactcaagaccaccacctgcttggaggatggaattaggaacggatcatgttcctcagacgggttgctggatcttgtctacgcggacctgggaacactaagccgcctctggctggctgcgctccaagactttgcattactaaccctgccttctgaattcgcgagccagcttcccgcggagggcggtgctttctacaccgcggagaccagtgagaatgccaagttacattattataattcttgggctcttatcctgcacgccactgcactctggctgacgtccacaggatttgttgttgcggaccccgacgagggggcttcaaacttgtcacggcccgtgaccccaacaagcatgtgccagggatcatcgtctggagccacaatcaagagcccagaggacgtttacacggacagattccatctgattcttggaatcagtgtcgaattcctatgctccctccggtctgacgcaaccatggaatctatcacggcgtgcttgcacgccctgcaggctttgttggacgtgccatggcccaggtctaaaataggcagcgaccaagacctgggtatcgaactactcaacgtgttacatcgcgtgattctgactcgggaaagcccctctatccagttagcctccctggaggtggtgaggcagatcatctgtgcggcacaggaacacgtaaaggagaaacggagatcagccgaggtagatgacggagctgccgagaaagagactctgccggagtttggcgaagggaaagacacaggtggtctcgtccctggcaagagtctggtgttcgccacgctggagttgtgtgtgtgtatattggtcaggcaactccccgaactgaatccaaagctaaccggaagtccaggcgttaaggccaccaagcctcagatactacttgaggacggctcacgactggtcagtgccgccctggtgattctgtctgaacttcccgccgtgtgctcgccagaagtggacgagacacatcaggaactggacgaggtttcactgctgaccgctattaccgtattcattctctccaccagccctgaggtaacaacaataccgtgcctccagaagcggtgtatcgacaaatttaaagcaaccctggaaatcaaggacccagtggttcaaattaaaacatatcaactgttgcactcgatcttccagtacccgaaccccgccgtatcttacccgtatatctattcgctggcctcatgcataatggagaaactgcaagaaatcgataagcgaaaaccagagaacaccgctgagctggaaatctttcaagagggaattaaggtacttgagacactcgtgacagtggccgaagagcaccatcgggcccagctggtggcgtgcctactacccattctgatttcatttctgctagatgagaacagcttagggagcgcaacctctataatgaggaacctgcatgactttgcgctccagaatctcatgcagatcggtcctcaatatagctcagtattcaagtccctcgtggctagctcccctgccctcaaagcacgattggaggccgctatcaaaggaaaccaggaatccgtaaaggtgaagatcccgacgtccaaatacaccaagagtcctggaaagaactcctcaatccagctgaagacctccttcctctag

SEQ ID NO: 47984 - DNA, 5262 bp, Artificial Sequence
  Description of Artificial Sequence: Synthetic coding sequence
atgctgaagggcaccagcagcgtgagccgggacgtgcgggtgggcgtaacccaggcctacgtggtattcgtttctacgctggggggtgcctggttggaaaagaattttgccgcgttctttagccacatcctgagtcttgcctcaccgagtcaccccaaagccactcaaacccagattgatgctgtgtgttgcaggcgctgtgtttcctttatcctgaggacaacgatcggcggacttttgggcgagaaggctcaactggctgccgtcaaggatatttgccaagctatttggaaactgaaaaaagtcatggatgccgtgatgtccgacgggaatctggaaacaaggctaggatcgacagacgtggccgccagccaacatatgctggtatgcgcgctgcaagagctgggtaacctgatccacaacctcggaacaaccgctgccccactcctgcaagattcctccacaggattgttagactctatcctgtccgtcatcttgcacccctcaatcagtgttagactcgccgccgcttggtgtctgcattgtattgcagtcgcgctgccatcttaccttacacccctgctcgaccggtgcttagaaaggctgaccggccacaagagctctcccgaggccgtcacaggcttctccttcgccgtggcagccctcttgggggccgtgaagcattgtccactaggtattccacacggcaaggggaaaattattatgactctggccgaggacttactatgctctgccgcacagaactctcggctcagtgctcaaaggacccaggctggttggctcctcatttccgccctaatgacactggggcctgctgtggtgtcgcaccacctggcgcgagtgctgcttttgtggaaatgcgttttccccgcaagccccaaagatttagagaccgaaaagagtagaggggattcctttacctggcaggttactctcgaaggccgagccggcgccttatgtgcgatcaaaagctttgtctcgcattgcggcgatttgttaacagaagaggtcactcagcgcttgctaccccctcttccatgcgccgtagacctgctgacacagctctcaagcatactcaagatgtacggatcccccttaaagaccccgtctgtggtgtaccggcaaaggctatacgagcttttaatcctgctgcctcccgaaacttatgaagggaacctctgcgctatcttgcgagagctggctgccgacctgactgcgcccgacattcaggtagctgctagcaccttcctcctcccccctctatgccaccaagatgatctcctgatcctgtctcctttcctgcaggagactgatcatcgatttatagaagaacaactgctcctcggcaacggggtcgcttgcggctcattagagtatgatccctactccatctacgagaaagatgtcgaaggagatagtgtgcccaaaccactgcccccggcgctgagtgtcatctcatctgcatccaaactgttcggtgtcgtgtgcgcgcacgttggcgagacgcaacgcctcctcattctggaacagttgctggattctatcaaacacaccaagggtgcacggcagcaggtagtgcagctgcatgtggtgtctagtgtttcctcattcctaaaatacgtggccggcagcaaaggctgcttgggccctgaggaaatgaagagattcgccctgaccttggttatgggagccctggaatcgccaaaccccttgctgaggtgtgctgccgcagagtcatgggccagactcgcccaggtcgtcgacgatggcgctttcaccgccggattagcccaggtgagctttgataagctgaagagtgcgagagatgttgtcactcgtactggccacagcctggctctgggcagcctccaccgttaccttggagggatcagttcatcccagcatctcaacagttgtatcgggattctatacacactggctcaagattcaaccagtccagacgtccagacatgggccctccacagcctttctcttatcatagactcggctgggcctctgtattatgtgcatgtggaacccaccctttccttaatcatcatgttgctactgaatgtgccccctacacacgctgaagtacaccagagtctgggtcggtgtctaaacgccctgattacaaccctcggacctgaactccagggaaactcgacctctatctcaacactccgaaccagttgtctgctgggatgcgctgtgatgcaggacaatcctgactgtctagtccaggcgcaagcaatctcctgtctgcagcagttgcatatgttcgctccacggcacgtgaacctcagctctttagtgtcctgtctctgcgtgaatctgtgctccccatacctgttgctgcgacgcgccgttttggcctgcctccgacagctggtccagagagaagccgccgaagtgagcgagcacgccgtaatgctagcaaaggactcccgggaagagcttacacccgatgcaaatattcgggaagtgggcctcgagggcgccctgctgattttacttgacaaggagaccgatgagaggctgtgtcacgacattaaggagactctgaactatatgttaacctccatggcggtagagaaactgagtctatggttaaaactgtgtaaggacgttcttgctgcaagcgccgatttcaccgcggtgacatgtgtggataccatgcaagaagaagaaggcgataagggcgatgacgcctccgttctgaccaccaggcgggacgagaaaagccatccatttaccaaccctaggtgggcaactagggtcttcgccgctgagtgcgtttgtagaataattaaccagtgcgaaaatgctaactccgcccacttcgatatcgcattagcacaggagatgaagaaacgtgactccaggaatgattttctggtcttgcacctggcagatttgatcaggatggcgtttatggccgctacagatcattctgaccagctgcggctgagtgggctagagatgctgcttgtggtaatcaggcggttcgccaccgtacccgagcccgagtttccggggcacgtcatcctggagcagtaccaggccaacgtcggtgccgcgctcaggcctgcattcaccagtgagacccctcctgatgtgactgccaaggcctgccaagtgtgtagcgcctggattgcttcaggggtcgtgtcagacctaaacgatctgaggcgcgttcaccagcttctggtgtctagcctcactaagattcaagcaggaaaagaggcgctgtcacacctttataacgagagtgccagcaccatggaaatcctggcagtgctcaaggcttgggctgaagtgtacatcattgccgtgcaacgccacaaaaatcacagacaacccctgaaaacaacaacatgcctggaagatggtattcggaatggtagctgcagcagtgatgggttgcttgatctcgtctatgcagacttgggaactctgagtcggctgtggcttgcagccctgcaggactttgctctgctgaccctcccttcggagtttgcatcccagcttccggctgaaggaggtgcattttatacagccgaaacctcagaaaatgccaagctgcattattacaactcctgggctttgattctgcatgccacagcgttgtggctgacttctaccggcttcgtagtggccgatccagacgaaggagcatccaatctctcaagacccgtcactccgacgagtatgtgtcagggctccagctccggtgcgacaatcaaaagtcccgaggatgtctacaccgacagattccacctgatcctaggcatatcagttgaatttctgtgttccctcaggagcgatgcaacgatggaatccatcacagcttgtctgcacgcgcttcaggctctccttgatgtcccttggccgcgcagcaaaattgggagtgatcaagatctaggaatcgagttgttgaacgtgctccacagggtaattttaacccgtgagagcccatccattcagctcgcctctctcgaggtggtacgccagattatttgcgccgcccaggaacacgtcaaggagaagagacggtccgcagaagtggacgacggtgcggcggaaaaggagactcttcctgaatttggggaagggaaagacactggaggcctggtgcctggcaagagccttgtgtttgctacgctggagctttgtgtttgcattcttgtgaggcagcttccggagttgaatccaaaattaaccggaagcccaggggtgaaagcaactaaaccccagattctgctggaggatggctcacggcttgtgagtgccgccttggtaatcctatcagagttgcccgccgtctgtagccccgaaggcagtatctctattctgcccaccatcctctacttaactatcggtgtgctacgggagacagctgttaaactgcccgggggacaactgagcagcaccgtcgccgccagcctccaagcgttgaaaggcattctgtcttctcctatggctcgcgctgagaagtcaagaactgcctggactgatttgttgcggtctgcactgacaaccatcctcgattgctgggacccggtggacgagacacatcaagagctcgacgaggtctccctactcaccgccatcacggtgttcatcctctccacgagtccagaggttaccacaatcccctgtctgcagaagcgttgcatagacaaattcaaagctactctggaaatcaaggatcccgtggttcagatcaagacataccagttgctgcactccatctttcagtatccaaacccggcggtgtcctatccttatatttacagcctggctagttgcattatggaaaagttacaggaaattgataaacgaaagccagaaaataccgccgaattggagatttttcaggaggggattaaggttttggagacactggttacagtcgccgaggaacaccaccgcgcccagctcgtcgcttgcctacttcctattctgatctctttcctcttggacgagaattcactgggctccgcgacatcaatcatgcgaaacctgcatgatttcgcactacaaaatctcatgcaaatcggaccccaatatagttctgtgttcaaatccctcgtggcgagctccccagccctaaaggctaggctggaggctgccatcaaagggaatcaggagtctgtgaaggtaaaaattcctacgtccaaatacaccaagtctcccgggaaaaacagctcaatccaactcaaaacctcatttttgtag

SEQ ID NO: 47985 - DNA, 6141 bp, Artificial Sequence
  Description of Artificial Sequence: Synthetic coding sequence
atggagctggcccacagcctgctgctgaacgaggaggcctacaaccaattgggcgaagttcagaaggccgagtttatcttcgagtggctccgctatctcgaaaagctactcctggcgacttcacgtaacgatgttagagagaagcagaaaacccttgtggagcagttgctgtccttgttgaatagttcgccgggaccgccaactaggaagctgctggctaagaatctcgccattctatactctataggtgataccttttccgtacatgaggctatagacaagtgcaatgaccttatccgcagtaaggatgattcaccgagctacttgccaactaagttggccgctgtcgtgtgtctgggatctttgtacaaaaaactggggagaatattaggcaatacgtttacggacaccgtcggaaatatcctaaaagcaatgaaaagcgcagaaagtcaggggcggtatgagataatgctcagtctgcagaacatccttaatggattaggtgcagctgctgcaccttgtcaccgggacgtgtacaaggccgcccggagttgtttgactgacaggtctatggcagtgagatgcgctgcggcaaagtgtctgcttgaattgcagaatgaagccatattcatgtggagcactgaccttgactcggtagccacactttgtttcaagagcttcgagggcagcaattatgacgtgagaattagcgtatcaaagctgctcggaataattttggcgaaggcagtaatatcaaagcaccccgggacggcagccagccgccagagtatcagaagggtcagcctggaagaagttttggagttactaggaacgggcttcctgcgtggcagtagcggattcctgagagcttctggggacatgctaaagggtacgtcctctgtaagtcgggatgtccgagttggggtgacgcaagcctatgttgtgtttgtgagcactctgggcggtgcatggcttgagaagaacttcgccgccttcttttcacatatactctcactggcatctccaagccaccctaaggctacgcagacccaaatagatgccgtctgctgtagaaggtgcgtctccttcatcctgcggaccacgatcggggggttactgggagagaaggcgcagctagccgccgtgaaagacatctgtcaggcaatttggaagttaaagaaagtaatggatgctgtgatgagcgatggtaacctggagaccagacttggatctacagatgttgctgcctcccaacatatgcttgtctgtgcactccaagaactgggcaacctgattcataacctcgggactactgctgccccacttctccaggactcatctacgggcctcctggactccatcctgtcggttattctccacccatccattagtgtgcgtctggcggccgcctggtgcctgcactgcatagccgtggcactgccgtcctatctgactcccctgctggacaggtgtttagagcggctgacaggccacaaaagttcacctgaggccgttacaggtttctcctttgcggtggccgcccttcttggagccgtgaagcattgtcctctaggaattccacacggaaagggtaaaattattatgacgttggcggaggacctgctctgtagtgccgcccagaattctcgcttaagcgcccaacggacacaggcaggttggctgttaatctccgcacttatgacattgggacccgcagtggtgtcccaccacttggctagggttttgctcctgtggaaatgcgtattcccagcatcgccaaaggatttggagacagagaaatccaggggggatagcttcacctggcaggtgacgttggagggaagggccggtgccctatgtgcaatcaagtccttcgtctcccactgcggtgacctactgacagaagaggtgacccagagacttttaccacctttgccctgcgcagtggatctgttgactcaactgtcttcaatcctgaaaatgtacgggagcccactcaagaccccaagtgttgtctacagacagcggctctacgagctactgatcctgctcccgcctgaaacgtatgaggggaacctctgcgccattctgagagaactggcagctgatttgacagcccccgacattcaggtggcggcgtccacgtttcttctccctcctctatgccatcaggatgacctgctgatcctatccccattcttacaggaaacggatcataggttcatcgaggaacagctgttattaggaaatggcgtcgcctgcggatcgttagaatatgacccttatagtatctacgaaaaggatgtggaaggtgactccgtaccaaagccacttcctcccgccttgagtgttatctcctccgccagtaaacttttcggcgttgtgtgcgcccacgtgggagagactcagagacttttgatcttggagcaactacttgactccattaagcacaccaaaggagcacgccagcaggtggtccagttacatgttgtgagctctgtctcgagttttctcaaatatgtagctggaagcaagggatgcctcggccctgaggagatgaagcgcttcgcccttacccttgtgatgggagctctggaatcaccaaacccgctgttgcgatgtgctgctgccgaatcctgggcaagattggctcaggtggttgacgacggcgcttttacagccggtctcgcacaggtgtccttcgataaattgaagagtgctcgggacgttgtaacaagaaccggacacagcttggcacttggaagcttacaccgctacctaggcggcatctcaagtagccagcatctgaactcctgcatagggatcctctacactctcgctcaggatagcacttccccggacgttcagacctgggctctccattcactgagcttaattatagactctgcagggcctctgtattacgttcacgtggagccgacactgtcgctcataataatgctgctgctgaacgtcccacctacccacgcagaggtccatcagagtctggggagatgcctgaatgctttgatcactaccctgggccctgaactccagggtaacagcacaagtatctctacactccggaccagctgtctcctgggctgtgctgttatgcaggataatccagattgtctggtgcaggcccaggccatttcgtgtctccagcagctgcatatgtttgctccccggcatgtcaatctcagcagcctggtcagctgtctgtgtgtgaatctttgctccccttatctgttgctccgccgggcagttctcgcttgcctccgccagctcgtccagagggaagctgccgaggtgtccgagcatgcagtgatgctcgccaaagactcaagggaagagctcacccccgacgctaatatcagggaagtgggtctggagggggcactgttgatcctgctcgacaaggaaaccgacgaacgcctctgccacgacataaaagagactctgaactatatgctgacaagtatggctgttgaaaaactgagcctgtggctgaaactttgcaaggatgtcctggcagcctctgctgatttcactgctgtgacctgcgtagatacaatgcaggaggaggaaggagacaaaggggacgatgcgagcgttctgacaacacgtcgggacgaaaagtcccaccccttcacaaacccacgatgggcgaccagagtgttcgcggctgaatgcgtgtgtcggatcattaaccaatgcgagaatgcgaacagtgcccacttcgatatcgccctggcccaggagatgaagaagcgggactcccggaatgacttcctggttttgcacctcgcagacctcatccgcatggccttcatggccgccacagatcatagtgaccagctgcggttgagtgggctcgaaatgctacttgtggttattcgcaggtttgcaactgttcccgagcccgagtttcctggccacgtgatactcgaacagtaccaggcaaacgtgggagccgctctgcgccctgcattcacatcagaaactccaccagacgtcacggctaaggcatgccaggtttgcagtgcttggattgcctcgggggtggtaagcgatctgaacgatttgagaagggttcatcaactgctcgtgtcaagcttgactaaaatccaggctggaaaggaggcgctgagtcatttatacaacgaatcagcctcaactatggaaatccttgccgtacttaaggcatgggctgaggtgtacataatcgccgtacaacggcacaagaaccacagacagccgcttaagaccacaacgtgcttggaagatggaatcagaaatggttcatgttcctccgacggactcctagacctggtgtacgctgacctgggcactttatccaggctgtggcttgccgctcttcaggacttcgccctcttgacccttcctagcgaatttgcgagccaattgcccgcagaaggtggggccttctatactgccgaaacatcagagaatgccaagctgcattactataacagctgggcccttatcttgcacgccactgcgctgtggctgacctccaccgggtttgtcgtggcggatccggatgaaggtgcctcaaacctttccagaccagtgaccccaactagtatgtgccaagggtcatcatcaggtgcaaccatcaagagtcctgaggacgtctatactgatcgatttcatctgatcctcggcatctccgttgagttcctgtgtagcctccgttccgacgcaacaatggagagtatcactgcttgcctgcatgccttacaggctctgttggatgtgccatggcccagaagcaagattggtagcgatcaggatctgggcattgaactgcttaatgtgctccatcgggtgatccttactcgagaaagcccctctatccaactggcttccctggaggtagtgcggcaaatcatttgtgccgcacaagagcatgtgaaggaaaagcgaaggagtgcggaggtcgatgacggagccgctgagaaggagaccctacctgaattcggagaaggcaaagataccggaggtctggtaccaggcaaaagtctcgtgttcgccactttagagctctgtgtgtgtatactggtgcgccaattgccggagcttaaccctaaattgacaggctcacccggtgtgaaagctactaaaccacagatcctgttggaagatggaagtagacttgtttccgcagccttagtcattctgtcagagctgccagcggtgtgctcccctgagggatctatctcaatcctcccaacgatcctttacctgaccatcggtgttttgagggaaaccgctgtaaaactcccaggcggacagttgagttccactgtggccgcatccctgcaggcattaaaaggaatcctgtcctcacctatggcgcgggcggagaagtcccggactgcttggaccgacttactccggtctgccctgaccactatcttagactgctgggatcctgtggatgaaacgcaccaggagttagatgaagtttccttactgactgccataacggtgtttatcctctctacatctccagaagtgaccaccattccatgccttcagaaaaggtgcatcgataagttcaaggcaaccctggagattaaagatccagtggtgcagattaaaacatatcagcttcttcactccattttccagtacccaaacccagccgtgtcgtatccctatatctattcgcttgcgagctgtataatggagaagctgcaggaaattgacaaacggaaacccgaaaacacagcagagctggaaatatttcaagagggtatcaaggttttagagacgcttgttaccgtagcggaagaacatcatcgagcccagttggtcgcctgcttgctgccgattctgatatcattcctgctcgatgagaatagcctcggatctgccacatcaatcatgaggaacctgcatgactttgccttgcagaatcttatgcagataggtccacaatactctagcgtctttaagtctctggttgcctcttcaccagcccttaaggctaggctggaagctgccatcaagggcaaccaggaaagcgtgaaagtgaagatacccacatctaagtatactaagtctccgggtaaaaatagcagtattcagctaaaaacatcattcctgtag

SEQ ID NO: 47986 - DNA, 2223 bp, Artificial Sequence
  Description of Artificial Sequence: Synthetic coding sequence
atggccgccttcagcgagatgggcgtgatgcccgagatcgcccaggcagtggaagaaatggattggctgctgccaacagacatacaggcagagtctatccctctaatactgggtggaggtgatgtcctgatggcggctgagaccggttccggaaaaaccggcgcattctccattccagttattcagattgtgtacgaaaccctcaaggatcagcaggaggggaagaagggcaagaccactataaaaacaggcgcatctgtacttaataaatggcagatgaacccatatgataggggaagtgcgtttgctattgggagcgacggcctgtgttgccagtcgagagaggttaaggagtggcacgggtgtagggcgacaaagggcctcatgaaagggaaacactactacgaggtcagctgccatgaccagggtttgtgtcgggtgggatggtctaccatgcaggccagccttgacctggggaccgacaagtttgggttcggctttgggggaaccggcaagaaatcacacaataaacaattcgataactacggtgaagagttcactatgcacgacaccataggttgttatctggatatagataagggccacgtgaagttcagcaagaacggcaaagatctgggactcgcgtttgagatcccaccccatatgaagaaccaggccctgttcccagcctgtgtcctaaagaacgcagagctgaagtttaatttcggcgaggaagaatttaaattcccaccgaaggatggctttgtcgccctgtccaaggcgccagatgggtacattgtaaaaagccagcactccgggaacgcacaggtcacgcaaaccaagttcctccctaacgctcccaaagccctcatagtggagccctctcgggaactggctgagcagaccctgaataacatcaaacagttcaaaaagtatatagacaaccccaagctgagagagttactgattatcggtggggtcgccgctagagaccagctgagtgtgcttgaaaacggcgttgacattgtggttggcaccccgggtaggcttgatgacctggtatcaactggcaagctcaatttgtcacaggttaggttcctcgtcctagacgaggccgacggactactcagccaggggtattcagacttcattaaccgtatgcacaaccagatccctcaggtaacatccgatggcaaacgtttacaggtgatcgtgtgctccgcaacgctccatagtttcgatgtcaagaagctgtcagaaaagattatgcatttcccaacctgggtcgatctcaagggtgaggatagtgttccagataccgtgcaccacgtagtagtaccagtaaacccgaagacagatcgcctgtgggagcgtctggggaaatcacacatccggactgacgatgtgcatgccaaagacaacacacggccaggcgcaaattctccagagatgtggtcagaagctataaaaatcctgaagggggagtatgcagttagggccattaaagagcataagatggatcaagcaatcatcttctgccgcacgaagattgattgtgataacctggaacaatacttcattcagcagggtggtgggcctgataaaaaaggccaccagtttagctgtgtttgtctccacggtgatagaaaacctcatgaacgaaagcaaaacttggagagatttaagaagggagacgtgaggttccttatatgcactgatgtggccgctcgcgggatcgacatccacggcgtgccctacgtgatcaacgtgaccctgcctgatgagaagcagaactatgtccatcgcattgggagggtgggaagggctgaacgaatgggactggccatctcgctggtggcaactgaaaaagagaaggtgtggtaccacgtttgcagtagcaggggtaagggctgttataatactcggctgaaagaggatggaggctgcacaatttggtacaacgagatgcagctgttgtcagaaatcgaggagcatctcaattgtaccatttcccaggtcgagccagatatcaaagtcccagtcgacgagtttgacggaaaggtcacgtacgggcagaaacgcgcggctggggggggttcttataagggccatgtggatatcctcgcaccaactgtccaagagctggcggccttggaaaaggaagcccagactagctttcttcatctgggctatttgcccaaccagctgtttcgcacgttctag

SEQ ID NO: 47987 - DNA, 5949 bp, Artificial Sequence
  Description of Artificial Sequence: Synthetic coding sequence
atggagctggcccacagcctgctgctgaacgaggaggccctggcccagatcacagaggcaaaaaggcccgtattcattttcgagtggctgcgttttcttgacaaagtactggttgctgctaacaaaaccgacgtcaaggaaaagcagaaaaagctggtcgaacaactgacgggtctcatctcatctagcccgggcccaccaacccggaagttgctggccaagaatttggctgccctgtactccattggagacaccttcactgttttccagactctggacaaatgcaacgacataatacgaaataaagacgacaccgctgcctacctgcctacgaagctggcagccgtggcctgcgtgggcgccttttacgaaaaaatgggacgaatgcttggctccgccttcccggagaccgttaacaatctgctcaaaagtcttaaatccgcagaaagccagggcagatccgaaatcctgatgtctctgcagaaagtcctgagcggcctcggtggtgctgccgccagcagccatagagatatctacaaaaatgcacgttctttgctgacagataggtcgatggctgtgagatgtgctgttgctaagtgcctgctggaattgcagaatgaggccgtattcatgtggacagctgaactggaaaatattgccaccctgtgcttcaaggcactcgagaacagtaattacggcgtacgggttgctgtctctaaactgcttggcaccgtgatggccacagccctgatgccgaaacaggcaaccgttatgcggcagaatgttaagcgggctacctttgatgaggtattggagttgatggccaccggattcttgaggggaggcagcggctttctgaagtcaggtggcgaaatgcttaaagtcggaggtagcgtgaaccgggaagtccgcgtaggcgtgacgcaggcatacgtcgtctttgtgactacgcttggtggtcagtggcttgagagatccttcgccacctttttatctcacgtgctggacctggtctcccatccccgggccacccaaacccatgtcgaggcagtctactcccgaaggtgtgtttccttcatattgagggctaccgtgggctcgctactaggagagaaggcgcaaattgccgcagcgaaagaaatctgtcaggcgatcggtaagcagatgaaagccgtggaggctgtcgtaaatgacacaagcggcgagaataaatccggggctgccgatatcgccgcctctcaacacgtcatggtttgcgcactgcaggagctgggatcgctggtccagagtctcaacgcgacggcgtccccgctgattcaggaggcttcgattggattactggaaattgtcaccagcgtcctgctgcacccatctatggcagcccgactagctgctgcctggtgtttgcgttgcgtcgccgtggctctgcccttccaattgactccctttctggataggtgcgctgaacgactgaacaacctgaagacctcacctgaagccgtgtcagggtatagctttgccatggcagcgctgttgggcggggttcaccaatgtccactcgggatacctcatgcaaagggaaaaatggtcgtatccattgcagaggacctcctgagaacggctgcccagaattctcgattgagcctgcagaggacacaggccggctggctactcctgggcgcactgatgaccttaggcccatctgtagtacggtatcacctccctaagatgctcctgctgtggcgtaatgtgttccctagaagtctgaaagaactagaagcagagaaggccaggggcgacagcttcacatggcaagtaaccctggaggggagggccggcgctctgtgtgccatgcgctcttttgtggcacactgtccagaattgttgaccgaagatgtgattagaaagcttatgactcccatagagtgcgctatgactatgatgagtcatattccgagtgttatgaaggcgcatggcgcccacctcaaggcctctgccgccatggtgaggttgagactgtacgatatcttggccctacttcccccaaaaacttacgaaggcagcttcaatgccctgttgcgagagttggtcgccgaatttaccctgaccgataattcagcaaacacaacaacttccctgttacgctccctgtgtcactacgatgacagtgtcttactagggtcctggcttcaggagaccgatcacaaatcgattgaggaccagctgcagcccaattccgccagtggcagcggcgccttggagcacgacccaagcagcatctaccttcggatccctgctggtgaggccgtgccagggccactccctttgggagtgtcagtcattgacgcaagtgtggctttattcggcgtggtttttcctcacgtttcatataaacaccgtctgcagatgctcgatcattttgccgagtgcgtcaagcaggctaagggagtgaggcaacaggccgtgcaacttaatatttttacagcagtactgtcagccctcaaaggtctcgcagagaataaatcgaccttagggcctgaggaggtgcgaaaatctgctctgacactcgtgatggggccccttgacaatcctaacccaattctccgctgtgctgcgggagaagcactgggtcgcatggctcaggtggtcggagaggctacgttcatcgccaggatggctcagtacagttttgacaagctgaaatccgctagagacgtcgtgtctcgcaccggtcacagcctggcactggggtgcctacacaggtacgtgggaggtattgggtctggtcagcacctgaaaacttccgtgtctatcctgctagctctcgcccaagatggcacgagccccgaagtgcaaacatggtctctacattctttggctctgattgttgactcctcagggcctatgtacagggggtacgtggagcccaccctgtccttggttctcactttgctgttaaccgttcccccttcgcacacagaggtgcaccaatgtcttggtcgctgccttggagcaattattacgacggtcggccctgagcttcaaggaaacggcgccacaaccagcacaatccggagttcatgtctggtgggatgtgctattactcaggaccatagtgactcactggtccaagccgctgccattagctgcttacagcagctgcatatgtttgccccccgacacgtgaatctgtcctctctagtaccctcgttgtgcgtgcacctttgctcaagccacctgttgttgcgaagagcagccgtagcgtgcctgcgacagttggcgcagcgcgaggctgctgaagtatgcgagtatgctatgtcactggccaaaaacaccggcgataaggagtcaagctccgcaaatgttagtccctttgcccctggagtgtcttccagaaccgacatccactgcaggcaccagggagtaaatatcaccgagaccggtcttgagggcctgctcttcgggatgctcgacagagaaactgacagaaagctctgctcagatattcatgatacgctgggacatatgctgtcgtctttggctgtcgaaaagctttctcattggttgatgttatgtaaggacgttctggccgccagttctgatatgtctaccgctaccctactctcatccggaaaggatgaggaggctgaaaaaaaagacgagatggatgacgacaccatgttcaccaccctaggagaagaagacaagagcaaacctttcgtcgcccccaggtgggcaacgagagtcttcgctgcggattgcttgtgtcgcatcattaacctctgcgagaatgccgaccaggcgcattttgatctcgccttggcacgcagtgctaagctccggaacccaactaatgatcttctcgtcctccacttgagcgatcttattaggatggcttttatggcggcgacagatcattctaaccagctgaggatggctggccttcaggccttggaagacattatcaaaaaattcgccagtgtcccagaacccgagttccccgggcacgttattctggagcagtaccaggccaacgtcggcgctgcccttcgcccggccttctcccaggatacgccttctgacataatcgctaaggcctgtcaggtatgttctacctggatcggcagcggtgttgtaagcgacctgaacgacctccgacgagttcataatctcctggtaagctcattggacaaggttcaggcagggaagggctccagtagtcaattatacagagaatccgcaaccaccatggagaaactggccgtgctgaaggcctgggccgaggtgtatgtcgtggcaatgaacataaagaaagaggctgagtcaaaaccaaagcgtgccattaagaatactgacgacgacgatgacgactgcggcaccatagacgagctacccccggactccctcatcaccctggtacagccggagcttcctactctgtcacgtctgtggttggctgcactgaaggactacgcactcctcactttacctgccgagttctcctctcagctccctcccgacgggggagcgttctatacccccgaaactatcgacacagcacgcttacactacagaaacagctgggcgccaatcctgcacgctgtggcgctgtggttaaactcaacgggtttcacatgttcagagagcaccgaagctgctgctattagcgggttacaaaagcggagtacctcggtgaacctaaaccaggcttctggcgccgtcggctccgcgaaatcactgcccgaaattaataaggaccgcatgcatttgatcctgggggtgtcgatccagtttttgtgcagccctcgaccagaggaaccaatcgagcatgtgactgcttgtctgcaagccctgcatactctgttggattctccgtacgcaagggttcacatcgcggaagaccagctcattggtgttgagctgctcagtgtgcttcatcgcctgttgcttacttggaacccatctagtgtccagctactggtgaccggcgtggtccagcaaatcgtgcgcgctgcgcaggactatctgcaggagaagagaaatactttgcgctgtatgactatattgcctaccatcttattcctgatcgccagaatattgaaagataccgccatcaaaagtgctgacaaccaggtgccaccccctgtatccgccgccctccagggcatcaagtcaatcgtcaccttgtcaatggccaagacagaggccggagtgcagaaacagtggactgctttgatcagatctactctcgcttgcattctggagtattcccagcctgaagacagtgtgcctacccctgacgaggtctcgatgctcacagcgatcgcgctgtttttgtggtcagcaagcaacgagatcataggagttcagtccctgcagaatggatgcatgaatcgctttaagaatgctctcaatagctgcgacccctgggtccaagcaaagtgttatcagctcttgcttagcgtgttccagcactctaatcgcgcgctgagcactccatacattcactccttggcacctatcgtggtcgagaagttgaaagctgtggagcggaaccgaccagcatccaatatcgaactgcttgcggtgcaggaagggataaaggtgttggaaacactcgtggccctgggtgaagaacagaacagggttcagcttctggcactcctagttcccacgctgatatcctacctcctggatgaaaactcattcgccagcgcatcctctgcatccaaagatctccatgagttcgccctccagaatcttatgcacatcggccccctgtacccccacgcctttaaaaccgtgatgggcgccgcacccgagctcaaggtgcgcctcgaaactgccgtgcgagcttcccaggcaagcaaggcaaaggccgccgcgcggcaaccagctccggccattcacagcgccccaactatcaaactgaaaacaagctttttctag

SEQ ID NO: 47988 - DNA, 2307 bp, Artificial Sequence
  Description of Artificial Sequence: Synthetic coding sequence
atggagctggcccacagcctgctgctgaacgaggaggccctggcccagatcacggaagccaagcggcccgtgttcatattcgagtggctccggtttctggacaaggtgctcgtcgcagctaataagactgacgtcaaggagaaacagaagaagctggtggagcagctgaccggactgatttccagcagccctggccctccaactagaaagctgttggcaaaaaacctagcggccctctactcaataggcgacacttttaccgttttccaaacattagataagtgcaatgatatcataagaaacaaagatgatacagctgcgtacctacccacaaagctggcagccgttgcatgtgtgggagcattttacgaaaaaatgggccggatgctcggaagcgctttccctgagactgttaacaacctacttaaatccttaaagtccgccgaatcacagggaagatccgagattctcatgtcactccagaaggtccttagtggtctcggcggcgcagctgcgagtagtcatcgagacatctataagaatgcacggtcacttttgaccgaccgcagcatggccgtcaggtgcgcggtcgcaaaatgcttgttagagctacagaacgaggctgtgttcatgtggaccgctgagctggagaatatcgccacactgtgttttaaggcactcgagaacagcaattacggcgtgcgggttgccgtgtccaagcttctgggcacagttatggcaacagctctcatgccaaagcaggcaactgtgatgaggcaaaacgtaaaacgagctacattcgacgaggtgctcgagctgatggcaacgggattcctcagaggcggctctggcttcttgaaatccgggggagaaatgcttaaggtgggcggatcggtgaatagagaggttagggtcggcgtgactcaagcatatgtcgtctttgtcacgaccctaggtggccagtggctggagcgctccttcgctacattcctgagtcacgtcctcgatctggttagccaccctcgagcaactcaaactcacgtggaagctgtgtacagccggcgatgtgttagctttatcctgcgggctactgtgggttctctcctgggcgaaaaggcacaaatcgccgctgccaaggaaatatgccaggcaatcgggaagcagatgaaagctgttgaagccgtggtgaatgatacaagcggagaaaataaatctggggccgcagacattgcagcctctcaacacgtgatggtctgtgccctccaggagcttggctccttggtccagtctctgaatgctaccgctagccctttaatccaggaggctagcatcggcttgctagagatagtaacttcagtgctcctacacccgagcatggccgctagactggccgccgcttggtgcctgagatgcgtggccgttgcactgcccttccagctcacgccatttctggatcggtgcgctgagcggctgaacaacctgaagacttctcctgaagcagtctccgggtattcattcgctatggccgccttgctgggaggggtgcatcaatgtcccttgggaatccctcacgccaaggggaagatggtggtatcaatcgctgaagacttgctgaggaccgccgcccagaacagtcggctgtccctgcagagaacccaggctgggtggctcctgctgggggcactgatgactctaggcccatcagtcgtgagatatcacctgcctaagatgctccttctatggcggaatgtgttcccgaggtccctgaaggaattggaagccgagaaagcccgcggggattctttcacttggcaggtgaccctggagggacgcgcgggcgcactgtgcgctatgcgcagttttgtggcccactgccctgagctcctgaccgaggacgtgatcaggaagctgatgaccccaatcgagtgcgcaatgactatgatgagtcatatcccaagcgtgatgaaagcccacggggcccacctgaaagcttcagcagccatggtccggcttcgcttgtacgatatcctggctttgctgccacccaagacctacgaggggtctttcaacgccctcttacgggagctcgtggccgagttcaccctgaccgacaactctgccaacaccacaacttctctgcttcgctcactctgccactacgatgacagcgtccttctgggctcttggttgcaggagaccgatcacaaatcaatcgaggatcagttgcaacccaactccgccagcgggtccggagcgctggaacatgatccctccagcatctaccttcttctgttcctggtacattag

SEQ ID NO: 47989 - DNA, 3546 bp, Artificial Sequence
  Description of Artificial Sequence: Synthetic coding sequence
atggccgccgtgcaggtggtgggcagctggcccagcgtgcagcccagagaagcgccaagggaggccatacctgaaagaggcaacggcttccgactgttatccgcgaggctgtgcgcgcttcggcccgacgacagctcaagcgcacgtacagagatccacctcttgttcgatcaacttatttcagaaaattatagtgagggaagtggcgtcgctcccgaggacgtctccgctttattagttcaagcctgtaggcttgtccccctcaatcaaaatcacctggttagcaaggtgtctcagttaatccatcacctgctgaatcggctccaggtgatcgtggatgagcaacacttggactttctcttagcctacacgatcagcgctatacaccagtgctcctcgtggacgcaccgtgaaattttacaagctcttgccgctctggtgtactgcaacggctcaaagtgccagaagtatctcccagagctcctggggaataccggcttactaatgaagctaagtgaccttgcccagagcgatccagaagtgcgccgggcagccgtgcactgcatggccaacctctgcttatccgtgcccggccagccctatttagaggaaccatatcagaacgtgtgttttcaggctttcctgacaattcttcaatctcccaaatcatccgacatggatgacatcaccttctgtatgctattgcaaaacgccctgaaagggattcaaagcctgcttaatgggggacgtatgaagcttactcagacagacgaattgggggctctcctggcagtcctaaagaaattcatgtttcatggcttgccggggctgaacattgagatgcctacggtgctctacccaacaccactgccccagtacgacggccgcactccaatcaagccccagcaatcagaatccagcgcaagtagaccaaccctcaacaaaaagaagaagtctaaagtgaaacctaaaaaaatccagcaaggcgaagaggaggaaaaggaaagtagcggcgagattgaggccgctccagtgaccggaactgggcgtgtaaatctgcacgaagggaacacatggtgtccctcctcccttggcgtgcagtcactaccccttgatggtagcggcgcagccgaaaaagacggcgtctcctcatcttttagtagctccagttggaaacgagtgagctccagtgaaagcgacttttccgatgctgagggcggcatgcagagcaaaatgaggagctatcaggcgaaggtccggcagggggctttggtctgtttcctaagcacgatcaaatccatcgagaaaaaagtgctgtatggttactggtccgcttttattcctgacaccccagaactgggttctccacaaagcgtatcccttatgacactgacactgaaggacccttctccaaagactcgcgcttgtgcccttcaggtcctctctgctatcttggaggggtccaaacagttcctctcagtggctgaggacacctcagaccaccgcagagcgttcaccccgttttctgtcatgatagcttgctcaattcgagagttgcatcggtgcttgctactagcgttagtcgcggagtcctcttcccagactgtgactcagatcattaagtgcctggcgaacctggtgtccaatgcaccctacgatcgcttgaagctgagcctcctgaccaaggtgtggaaccagatcaagccctacatcaggcacaaggacgtcaacgtgcgcgtgtccagcctgacactcctaggcgcaatcgtctctactcatgcacccctccctgaggtccagctgcttttgcagcagccatgcagctcaggattgggcaattcaaacagtgccactcctcacctgtccccaccggactggtggaaaaaagcccccgctggaccttcgctagaggagacctcagtgagttccccgaagggctccagcgaaccatgctggctgatcaggctttgtatatccattgtggtgctgccaaaagaagactcatgttcagggagtgatgccggctccgccgcaggctcaacctacgaacccagccccatgagactggaggctctacaggtactgaccctcctggccagagggtacttttcaatgacccaggcatacctgatggaattgggcgaagtgatctgtaaatgtatgggcgaagccgacccctctatccaactgcacggagcgaagctgctggaggagttagggaccggcctgatccagcagtacaagccagactccacggcagctcctgaccagcgagccccggtgtttttagtggtgatgttctggacaatgatgttgaacggccctctgccgcgtgccctgcaaaacagtgagcaccccaccttacaagcatccgcctgcgatgccctttctagtatactgccagaggctttttccaacctgcctaatgatagacagatgttatgtatcacagtactgctgggcctaaacgactccaaaaaccgactggtcaaggccgccacttcacgggccctgggcgtgtatgttctgttcccttgcctgaggcaggacgtcattttcgttgcggatgcagcaaatgccatcctgatgtccctggaagataagagccttaacgtccgtgctaaggcagcctggagcttgggtaacctgaccgatactctgatcgtgaacatggagacccccgatcccagcttccaggaggaattcagtggcctgctgctccttaagatgctccggtctgcaattgaagcctccaaagacaaagataaagtcaagagtaatgcggtccgcgcgctcggcaacctgctgcatttcttgcagcctagccatatagagaagccgactttcgccgagatcattgaagagagcatacaagccctcattagtaccgtgctgacagaagccgctatgaaggttaggtggaacgcctgttacgccatgggtaacgttttcaaaaacccggccctgccgctcggcactgctccatggaccagtcaggcctacaatgctcttacttccgtcgtgacaagttgcaaaaactttaaagtgagaatccgaagcgcagcggccttatcggtgccaggtaagagggaacaatacggctctgttgatcagtacgcgcggatttggaatgcactagtgacagccctgcagaagagtgaggacaccatcgacttcctggagttcaagtactgtgtgagcttgcgtacccagatctgccaggctctcatccacctgctgtctctggcgtcagccagtgatctaccatgtatgaaggagacactggagctctccgggaatatggtgcagtcatacatcctgcagtttctgaaaagcggggccgaaggcgacgacactggcgctccccacagtcctcaggagcgagatcaaatggtgaggatggcactgaagcatatgggcagcattcaggcgcctactggagacacggctcgccgggccattatgggctttttggaggaaattctggccgtatgtttcgacagctctgggagtcagggggcgctccccggactgactaaccagtag

SEQ ID NO: 47990 - DNA, 2751 bp, Artificial Sequence
  Description of Artificial Sequence: Synthetic coding sequence
atgagcaagtacctgcccgagctgctgggcaacaccggcctgctgatgaagctgagtgatcttgcccagagtgacccagaagtacgtcgggcagcagtgcattgcatggcaaacctctgccttagcgtgcccggccagccctatctcgaggagccttaccagaacgtgtgttttcaagcgttcctgaccattctccagtcacccaaatcctctgacatggacgatatcactttttgtatgttgcttcagaatgcacttaaaggaatccaatccctcctgaatggaggtaggatgaaactcacccagactgatgaactaggggccctgctcgccgtgttaaagaaattcatgttccatggattgcccggtttgaacatcgaaatgcctacagttctctatcccactcccctgccgcagtacgatggaaggacaccgatcaagccccagcaaagcgagagctcagcgagccggcccaccttaaataagaaaaagaaaagcaaagtaaagcccaaaaaaatccaacaaggggaggaagaagaaaaggagtcaagtggtgaaatcgaggccgccccggtcactggcactggaagagtgaatctccacgaaggcaacacctggtgtcctagcagcttaggcgtgcagagcctgccgttggacgggtccggtgccgccgaaaaagacggcgtgagctccagtttctcttcatcaagttggaagcgcgtgtcttcatctgagtctgacttttccgacgcagaaggcggcatgcagagtaagatgcgctcttaccaggccaaagtcaggcagggagccttggtgtgttttctatctaccattaagagtatcgagaaaaaagtgctgtatggctattggagcgcctttatcccagatacacctgaactgggttccccgcagtctgtgtcattgatgaccctgacactgaaggatccttcgccaaagacgcgcgcctgcgcattacaagtgctgtctgctatcttggaaggatcgaagcagtttttgagtgtggctgaagacacctctgaccatcggcgcgccttcaccccctttagcgttatgattgcatgttctatccgggaactgcatcgctgcctgctgctcgcgctggtggctgagtcctcttcacaaacagtcacacaaatcatcaagtgtctcgcaaacctggtaagtaatgctccttatgaccgactgaaactgagcctgctgactaaggtctggaaccaaatcaaaccctacattaggcataaggacgtaaatgtgagggtctcttccttaacgctattaggcgcaattgtctctacccatgctcctctccctgaagtgcaattacttctgcagcaaccatgttcttctggcctaggtaattccaactctgcgactccacatctgagtccacctgattggtggaaaaaagcacccgccggcccaagtttggaggaaacttcagttagctcacccaagggcagcagcgaaccatgttggttgattcgattgtgcattagcattgtggtgctgccaaaggaggatagttgcagcgggagcgacgctggctcagccgcgggctcgacttatgaaccgtccccaatgcggttggaggcattttcgaatcttcccaacgaccggcagatgttgtgtatcaccgtgttgctcggcttaaacgattctaaaaacagactggttaaggccgccacttcaagagctctgggagtatatgtcttattcccttgcctgaggcaggatgttatcttcgttgccgacgctgccaatgcaatattgatgagcctggaagataagagcctcaacgtccgagcgaaagccgcctggagcttgggcaacctgaccgatacgctgatcgttaatatggaaacacccgacccaagttttcaagaagaattttcagggcttctgctcttaaagatgctgcggtcagccatagaggcttcgaaagacaaggataaagtcaagtcgaacgcggtgcgcgccctcggaaacctgctccatttcctacagccaagccacatcgaaaaacccaccttcgccgaaatcatcgaagaaagcatacaagccctgatcagcaccgtcctgactgaggccgctatgaaggttagatggaatgcctgttatgctatgggcaacgtgtttaagaatccagccctgccattgggaaccgccccctggacaagtcaggcttataatgctttgacctctgtggtcaccagttgtaagaatttcaaggtacgcatcagatcagcagctgctttatcagtgccaggtaaacgcgaacagtacggtagcgttgaccaatacgctcgtatttggaacgcattagtgacggccttacagaagtctgaagacacaattgattttctcgagttcaagtactgcgtgtcacttaggacccaaatctgtcaggccctcatccatctgctttcccttgctagcgcttcggatctgccctgtatgaaagagaccctggaactgagtggaaacatggtccagtcctacatcctgcagttcctgaaaagtggggctgagggcgatgacactggtgccccccactccccacaagaaagagaccaaatggtccgcatggctctgaaacacatgggtagcatccaagcacccaccggagatacagctaggcgcgctatcatgggtttcctggaggaaatcctggccgtgtgcttcgactcctctggctcacagggagccttgcctgggttgacaaaccagtag

SEQ ID NO: 47991 - DNA, 4926 bp, Artificial Sequence
  Description of Artificial Sequence: Synthetic coding sequence
atgaccgagagcagcatgaagaagctggccagcaccctgctggacgccattactgataaggacccgctcgtacaggagcaagtctgcagcgccctctgctcactcggcgaggcgcgccccgtggaaaccctccgcgcatgtgaagagtatctgcgacaacatgacaagctcgcgcacccatacagggcagctgtcctcagagccatggagagggtactttctagccgggcctctgagctggataaggatactgctagtaccatcattctgctggcatcttcagaaatgacgaaaaccaaggacctcgtgtgggactggcagcaggctgccagcggcgtgctggtggctgtgggtcgacaatttattagtaaggttatggaagagctgctccgcagactgcacccgggaactttgccacattgcgccgttctgcataccctcgccagcctgtcagtagctaatgcctttggggtggtgccattcctgcctagcgttctgagctccctgctgccagtgttgggagttgccaaacaagacaccgtcagagttgcattttgcagcgcccttcagaggttttccgagggtgctttggagtatctggctaacctggaccgggccccagatccaaccgtcagaaaagacgccttcgcaactgacatcttctccgcctacgacgtgttgttccaccagtggcttcagagccgcgaagctaaactgcggctcgcggtggtcgaggcactaggaccaatgtctcaccttctgccatctgaacgcttggaggaacagctccctaagcttttgcccggaattctggcattatacaagaaacatgctgagacgttctacctatccaagagtcttgggcaaatcctagaggccgcggtgagtgttggaagcaggactcttgagactcagctcgacgcattgttagctgcattgcattctcaaatctgcgtgccagtagaatcctcatcacctctcgtgatgagcaatcagaaagaggtacttcgctgtttcactgtgctcgcttgttcctcacccgatcgcctgctcgcatttctgctgccaaggctggatacaagcaacgaacgtaccagggtcggcactctgcaggtggttcggcacgtgatcaattcagcagccgcccagatggaggacaagaagcctttcatcctgagtagcatgagactgccgctgcttgataccaactctaaggtgaagagggctgtagtgcaagttatctccgccatggcacatcatggatacctggagcagcctggtggggaggccatgatcgagtatattgtgcagcagtgcgctctcccgccagaacaggagcccgagaaacccggtcctggctcaaaggatcctaaggctgattccgtaagagcgatttcagttaggaccctgtatctggtgtccactactgtcgataggatgagccacgttctgtggccatatctccttcagtttcttacacccgtgagattcactggcgccctaactcccctttgccgatcactggtgcatctggctcaaaaacgacaagaggcaggcgccgatgcctttcttattcagtacgacgctcacgctagcttacccagcccctatgccgttaccggacggcttcttgtggtgtcttcctccccatacctgggagacgggcgcggcgccgcggccctgagactgctctccgtgctccatcctaatatacaccccctgctgggccagcactgggagaccaccgtgcctctgctgctgggctacttagatgagcatactgaggagactttgcctcaggaagagtgggaagagaaactccttatgttcctcagggatacactggcaattatcagtgataacgcgtggatttgtcaactgtcactggagttgtgtaggcaacttccatgttatgacgaagcccctcaggaaaagaacttcctctacaaatgcataggaaccaccctgggagcagctagtagcaaagaggtggtgcgaaaacatctacaggaacttcttgagaccgcgcgatatcaggaggaagcggagcgggaaggtctcgcatgctgctttggtatttgcgctattagccacctggaggataccctggcccaactggaagattttgttcgaagcgaggtgttccgaaagagtatcgggatactgaacattttcaaggaccgatctgagaatgaggtggaaaaagtgaagagtgctctcattctctgctatggccatgttgcagcacgagcacctcgtgaactggtgttggctaaggtcgagtccgatatactgcggaacatctgccagcacttcagcacaaaggtgctgggcattaaagtggagaccaaggatcccgcgcttaaattgtgtcttgtgcagtctgtgtgcatggtctcacgagccatttgcagcagtacacaggctgggagcttccactttacacgcaaagccgaactggtcgctcaaatgatggagttcatcagagccgagcccccggatagcctgaggacaccaattcgcaaaaaggctatgcttacctgtacctacctggtgtccgtggagccggccctggatgaacaagcgcgagccgacgtgattcatggttgtcttcacagcattatggcactcctgcccgagcccaaagaagaggacggcggctgccagaagtccctgtatttagagactttacatgctctagaagatctgctcacctcccttctgcaacggaacatgacacctcaggggctgcagattatgattgaacacctctccccgtggattaagtcacccaggggacacgaacgcgctcgtgctctggggctgtccgccctgctgctgcgttattttttggagcatctacgggtctcagctttggtgccattccacaatctcggactcctcatcggtctgtttagtccccgatgtgccgacctttggccggcaacacggcaggaggcagtggactgcgtatatagccttctgtatctgcagttgggctatgaaggctttagtagggattatcgggacgatgttgccgagagactgctctcactgaaggacggcctggtccaccctgacccagccattctgttccacacttgtcactcggtagggcagattattgccaaacgactgccaccagatcagttgatatcgttactgctgaccatgtttgaggctctaggggacccagagaagaattgttcacgtgcggccactgtgatgatcaattgcttacttcaggagcgtggaggagtgctacaggaaaaagtgcccgaaattgtgtctgtacttcggtctaagttgcaggaagcccagggagaacacgtcctccctgccgctcagcactcagtctatcttttggctacccagcattgcgccgctgtggtgagttcattgctgggcagccctctaccactggactcacacacatgtatgctttggagagctctggctgtcgaacctcgattggcagcacaagtgttgggtctcctgctcgagaagatgtccagggacgtgccatttaaggagtcaagggcttttctcctcggacgaactccagatagagtggcaactctgttacccctgtccgctacatgtgcactgttcgaagtgatgagcacgcccgccgctggacccgcggtgctggagctgtacccacagctgtttgtggttctattgctgcgcgtgtcctgcacagtcggggtgcagctccctcgcaacctgcaggcccaggagaggcgaggagcgagtcctgcactggccacccgtaacctcgagccatgctccagcgctgtcgataccttacgcagcatgctgctgcgcagtggctcagaagacgtagtccagcgaatggacttggaaggtggatgggaattattgaggacatcagctggccacgaggagggcgcgaccaggctggctcgggctatggccgaacatgccggtccacggctccctctagtgttgaaaacgttggcgtgcacacactcttctgcttacgagaaccaaagggtgaccactaccgcatttttggcagagttactcaactcaaacgtcgctaacgaccttatgctcttggactccctgctggaatccctcgccgcacgacagaaagacacatgtgcatccgttaggaggctggttttgcgtggcctggctaacttagcaagtgggtgcccagacaaggtacgtactcatggccctcagcttctaaccgctatgattggtggtcttgatgatggagacaatccccacagtcctgtggccctcgaagccatgcttgggctggcccgattagtccaccttgtcgagtcctgggacctgcggagcggactgttacacgtcgcgatccgaataagaccttttttcgactctgagaaaatggagtttcgaaccgctagcatcagactctttggtcacctgaacaaggtgtgccatggtgattgtgaggacgttttcctcgatcaagtggtgggagggttggccccactgttgctgcacctgcaggatccacaggctaccgtggcatccgcctgccggtttgccctcagaatgtgtggtccaaacctcgcgtgtgaagagctaagcgccgcctttcagaagcatctccaggaagggcgagcgctccatttcggggagttcctgaacaccacatgcaagcacctcatgcaccatttcccagacttactagggagactgctaactacatgcctcttttatttcaagagctcttgggagaatgtgcgtgcagccgctcctctgttcacaggttttctcgtcctgcactctgagccaaggcagcaacctcaggtagacctggatcaactcatcgctgccttgcagatcctactaaaggacccggcccccgaagtgcgcacccgagctgcggaagctttggggcggctcgtgaagctggcctag

SEQ ID NO: 47992 - DNA, 1023 bp, Artificial Sequence
  Description of Artificial Sequence: Synthetic coding sequence
atggagcgggtgctgagcagccgggccagcgagctggacaaggacaccgcctcaacaattattctcttggcatcatcagaaatgacaaaaactaaagatctcgtgtgggattggcagcaggccgcttcgggcgtcttagtagctgttggaagacagtttattagcaaggtgatggaggagctgcttaggcggttgcacccaggaactttgccacactgtgcggttcttcacacgcttgccagcctttccgtggctaacgcattcggcgtggtcccatttctgccaagtgtccttagtagtctccttccagtcctgggggtagccaagcaggatactgtgcgtgttgccttctgctcggccttgcagcgctttagtgagggagcacttgagtaccttgccaacctggatcgcgcccctgaccctacagtaagaaaagatgccttcgccactgacattttcagcgcttatgacgtgttatttcatcagtggctgcagagcagagaagctaaactccgattggccgtcgtggaggctctcgggccgatgtcacacctgctacctagcgaacggctcgaggaacagctgcctaagctcctgcccgggatcttagcgctctataagaaacacgctgagaccttctacctcagtaagagcctgggccagattctcgaggctgccgtcagcgtaggctctcgcactctggagactcaactcgacgcgctcctggccgccctccacagccagatctgcgtgcccgtggagtcttcttctccactcgtgatgagcaaccaaaaggaagtgctgcggtgctttaccgtccttgcctgctcatcccctgataggctgctcgcgtttctgctgcccaggctcgatacaagtaatgaaaggactagagtaggaactctacaggtcgtgcgccatgtaatcaattcagctggggaatgcttacatgccagcctcgcagccacccctggccacgttcaggacggtgccggccccgggcggctgtgcccatctaaatag

SEQ ID NO: 47993 - DNA, 4926 bp, Artificial Sequence
  Description of Artificial Sequence: Synthetic coding sequence
atgaccgagagcagcatgaagaagctggccagcaccctgctggacgccattacggataaagacccgttggtgcaggagcaagtctgtagcgctctctgtagcctcggggaggcccggcccgtggagaccctccgtgcatgtgaggaatacctcaggcagcatgataagctggcacacccttatagagcggccgtattaagggccatggagcgggtcctgtcctccagagcctccgagctcgacaaggacaccgcgtccactatcatcttgctcgcttcttctgagatgactaaaactaaagatctggtctgggactggcagcaggctgcttcaggagtgctcgtggccgtgggcaggcagttcatcagcaaggtgatggaggagctcctgaggcggctccaccctggtaccctgccacattgtgccgtgttgcacacgctggcttccctgagcgtcgccaatgcattcggcgtcgtgccatttttgccatcagttttaagctccctgctgccagtccttggggtggccaagcaggacacagtgcgcgttgctttttgctctgcccttcagcgcttcagtgaaggcgctctggagtacctagctaacctcgacagggcccccgaccctacagtgcgaaaagacgcgtttgcgaccgacatttttagcgcctacgacgtcttattccatcagtggctgcagagcagggaggctaaactcagacttgcagtggtcgaggctctcggcccgatgtcccatttgctaccttctgagcgtctggaggagcaacttcctaaactgctgcctggcatcctggccctctataaaaagcatgccgaaactttttacctgagtaagtctcttggccaaatcctggaggccgcagtctctgtggggagcaggacgcttgaaacccaactggatgccttgctcgcggctctgcactcgcagatttgcgtgccggtggaaagcagttctcctttagtgatgtccaatcaaaaggaggtgttaaggtgcttcactgtgctggcttgtagcagtcccgatcggctcctggcgttcctgctgccgcgactggatacctcaaacgaacgcacaagagtaggtacactgcaggttgtgaggcacgttataaatagtgctgccgcgcagatggaagacaaaaagcctttcatcctctcaagcatgaggttacccctgcttgataccaacagtaaagtcaagagggcggtggtccaagtgatctctgctatggctcaccatggctacctggagcaaccaggcggggaagcaatgattgaatacattgtccagcagtgtgctctgccccctgagcaggagccagagaagccagggccaggtagtaaagatccgaaggccgattccgtcagggctatcagtgtgcgcaccctttaccttgtctccactactgtggatcggatgtcgcatgtcctgtggccgtatctgctccaatttctgacccctgtacgattcactggcgctctgacccctttgtgtcgtagcctcgtgcatttggcccagaaacgccaggaagccggtgcagatgctttcctcatccaatatgatgcccacgcttctctcccttcaccttatgccgtgacgggacgactgctggtggtctcgtccagcccctaccttggagacggcagaggcgcggcagctctgaggttgttgtcagtgctacaccctaatatccatcctctgctgggccagcactgggagacaaccgtgccactgttgcttggatacttagacgaacataccgaggagactctaccccaagaggagtgggaagagaagctgctgatgtttctccgagacactctggccattatttcagacaatgcctggatatgtcaactgtctcttgaactgtgcaggcaacttccatgctatgacgaagctccacaggagaagaactttctctacaaatgtataggaactaccctgggcgccgcgagctctaaagaagtggtgagaaagcatctccaggagcttctggagactgctcgataccaggaggaggccgaacgagaggggctggcttgttgcttcggaatctgcgccatctctcacttggaagatactctggcccaacttgaggacttcgttcggtccgaggtcttcaggaaaagcataggtattttgaatattttcaaggaccgctccgaaaatgaagtggagaaggtcaagagcgcactgatcctttgttacgggcatgtcgcagcacgcgcccccagggagctggtcctggctaaggtcgagtcagatatcttgcggaacatctgccagcacttctctaccaaggtgctcggcattaaggtcgaaactaaggatcctgcgttaaaactttgtctggtacagtcggtgtgtatggtttctagagcgatttgcagctctacacaagcgggcagtttccactttaccagaaaagctgagctcgtggcccagatgatggagtttatccgagccgaacctcccgattccctccggaccccaatccggaaaaaggcgatgctaacctgtacctacctggtgtctgtagagccggcactcgacgagcaggcacgggcggatgtaatccacgggtgcctccactccatcatggccctgctccccgaaccaaaagaggaagacggtggctgtcagaaatccctttacctggagacgctacatgcgctggaggatctgctaacctctctgttacaacgtaacatgacccctcagggtctccagatcatgattgaacatctgtccccttggataaaatcgcccagagggcacgaaagggcaagagcccttgggctcagcgcgctgcttcttagatatttcctggagcatcttcgcgtcagtgcactagttcctttccataacctgggcctcctgattgggctcttctcccccagatgtgcagacctttggcctgcaacccggcaggaggccgtggactgtgtgtactctctcctctatttgcaactaggatacgagggcttttcgagggattacagagatgacgtggccgaaagactgctgagtcttaaagatggactggtacaccctgacccagcaatcttgttccatacgtgccacagtgtcggacagatcatagcgaagagactgcctcctgaccagcttatctctctcctgctcaccatgtttgaggccctgggggatcctgaaaagaattgttcacgcgccgcaacagtgatgattaactgcctgctgcaggaacgaggaggggtgctgcaggaaaaagtaccggagatcgtgagtgtgctaaggagcaaactacaggaggcccagggagagcacgtcctgcccgcagcgcagcactccgtgtatctgttggccacccagcactgcgcagcagttgtgagctctctcctcggctcacccctgcctttggactcccacacctgcatgctgtggcgtgccctagcggttgaacccaggttggctgctcaggtgctgggactgctgcttgaaaaaatgagtagagacgtcccattcaaggaatcacgggcctttctgctgggccgtacccccgatcgggtcgcaacgttgctgccactctccgctacgtgcgccttgttcgaggttatgtccacccccgccgccgggccggctgtgttggagctgtacccacagcttttcgtggttctacttctacgggtaagctgtacagtgggagtccagctgccgaggaacctgcaagcgcaagagcgccgtggcgcaagtccggccctggctacccgaaacctggaaccatgttccagcgcggtggacactctgcgaagcatgctcctccgctccggatcggaggatgtggtccagcgtatggatttggaggggggctgggaattgctgcgcaccagtgccggacatgaggaaggggccactagactggctagggctatggctgagcacgccggaccaagacttcctcttgttctcaaaaccctcgcatgtacacatagctctgcgtatgagaatcagcgggtgaccaccacagcgtttctagccgaactgttgaatagcaatgttgcgaatgacctgatgctactggacagcctgcttgaatcccttgcagctaggcagaaagatacctgtgcttcggtgcgacgcctggtgctaagggggctagctaacctcgccagcggttgtcccgacaaggtgaggacacatggtccccagttgctcacagctatgatcggcggcctggacgatggggataacccacactcgcctgttgcattagaggccatgcttggtttggcccgtctcgtccacctggtggagtcgtgggacctgcggagcgggctcttgcatgtcgctatccgcatccgcccattttttgacagcgaaaaaatggagttccgcactgcctccatccgactctttggccacctgaataaagtctgccatggtgactgtgaggatgtttttttggaccaagtggtagggggactggccccactgctcctacacctgcaggacccgcaggccactgttgccagcgcatgtagatttgctcttagaatgtgtggacccaacctggcttgcgaggaactgtccgcggcattccagaaacatctgcaagaagggagagcgctccattttggagaattcctgaacactacgtgcaagcatctgatgcaccacttccctgatctactagggaggctgttgacaacctgtttgttctacttcaagtcctcatgggaaaatgtgcgggcagcagctcctctctttacgggctttcttgtgctgcattccgaaccccggcagcagccacaagttgacttagatcagttgattgccgccctgcagatccttctcaaggatccagcccccgaggtacggacaagggccgccgaggccctgggacgattggtcaaactggcatag

SEQ ID NO: 47994 - DNA, 1653 bp, Artificial Sequence
  Description of Artificial Sequence: Synthetic coding sequence
atgatcaactgcctgctgcaggagcggggcggcgtgctgcaggagaaggtgccagagatcgtgagtgttctcaggtccaagctacaggaagctcagggagaacacgtactacccgccgcccagcactccgtttatctgctcgccacccaacactgtgccgcagtggtgtcttcgctcttgggaagcccattgcctctcgatagccatacatgcatgttgtggagggctctggctgtggagccccgactggcggctcaagtcctggggttgctgctggagaaaatgtcccgtgacgtgccgttcaaggagtccagggcatttctgctaggtagaactccagaccgagtggcaactcttctccccctgagtgctacttgtgctctgtttgaagtgatgagcacaccagccgctggcccggctgtgctagaactttaccctcagttattcgtggtcttgctgctacgtgtttcgtgcaccgtaggtgtccagctgccccgtaacctccaggcacaagaacgacgaggcgcatcccccgctttggctacgcgtaacctggagccttgtagctcagcggtggatacactacggtcaatgctacttcggagcggaagcgaggatgttgtgcaaaggatggatctcgaaggcggatgggagctccttcgaacctccgctggccatgaggagggcgcaactcggctcgctcgggccatggccgaacacgcagggcctcgtctccccttggtactgaaaaccctggcatgcacgcactccagcgcctacgagaatcagcgggttacaacgaccgccttcctggctgaattgctaaacagcaacgtagcgaacgacttgatgctacttgattccctgttggagtcccttgctgccaggcagaaggatacttgtgcaagcgttcggcgcttagtcctacggggactggccaacctggcatcaggctgtcccgataaggtccggacccacgggccgcagctgctgacggccatgattggaggcctggacgacggcgataacccccatagccctgtggccctggaggcaatgttggggctggctagactggtgcacctggtcgagtcttgggatctccggtccggactactgcacgttgcaatccgcatcaggcccttttttgactcagagaagatggaatttcgcaccgcatccatccgactcttcggacatctgaacaaggtgtgccacggggattgtgaagatgtctttctcgaccaggtcgtgggaggactagccccacttctgctgcacctgcaggacccccaggccaccgtggcaagcgcatgccgtttcgcactgcggatgtgcggacctaatctcgcctgtgaggaactgtcggctgcattccagaagcacctccaggagggacgcgcacttcactttggggaattcttaaacactacatgtaagcaccttatgcatcattttcccgaccttctaggtaggctgctcaccacttgtcttttttacttcaagagctcctgggaaaacgtcagggctgctgcgcctttatttactggcttcctggtgctgcattctgaacccaggcagcagccacaggtcgaccttgaccagctgattgccgcgccgctgttatacccacagcggagtagatcctgttag

SEQ ID NO: 47995 - DNA, 1269 bp, Artificial Sequence
  Description of Artificial Sequence: Synthetic coding sequence
atgaccgagagcagcatgaagaagctggccagcaccctgctggacgcaattactgataaagaccctctggtgcaggaacaggtgtgctctgcactatgtagcctaggcgaagccagaccagtggaaactctgagagcctgtgaggaatacttgcggcagcatgacaagttagctcatccctaccgagccgccgtcctgcgggccatggaacgggtgcttagttcgcgcgcatcagagcttgacaaggacactgcgtctacgataatcttgctggccagctccgaaatgaccaaaactaaagacctggtttgggactggcagcaagcagccagcggtgtgctggtggccgtcggacgacaattcatctccaaggtcatggaggagctgctgcgtcgactgcacccaggaactctgccgcactgtgcggtgctacataccctagcttccctgagcgttgctaatgccttcggggtggtccccttcctacccagcgtgcttagctctctgttacctgtcctcggagtcgctaagcaagatacagttagagtcgcgttctgtagcgcattacagcgtttcagtgaaggagctctggagtatttagccaatctggaccgcgcccccgaccccactgttcggaaagatgcttttgccacggatatatttagcgcgtacgatgtcctgtttcatcagtggcttcagagcagggaggccaagttacgattagcagtagtggaggccctaggcccaatgagccatctactaccctccgaaagactcgaagaacagctcccaaagctgctgccaggaattctcgcactctataagaaacacgctgagaccttctacctgagtaagtccctggggcagatactagaggcagccgtttctgttgggagccgaactctggagacgcagctggacgctctgctggccgctctacattctcagatctgcgtccccgtcgaatcatcgagtccactggtgatgtccaaccaaaaagaggttctgagatgctttactgttctggcctgttcttcgcccgaccggctgttggcattcctactgccgagacttgacactagcaacgagcgcacccgtgtggggactctacaagtggttaggcacgtcatcaactccgccggatccacaaatactaggataacactgatgctaccgagcgccgtcacaagactgaagcacgaggattgtccagccagagccgcacctcagccagcagaccttacggcggctcctgcatctgtggcctag

SEQ ID NO: 47996 - DNA, 4926 bp, Artificial Sequence
  Description of Artificial Sequence: Synthetic coding sequence
atgaccgagagcagcatgaagaagctggccagcaccctgctggacgcaattaccgataaagaccccctggtgcaggagcaggtgtgttcagccctgtgctctcttggggaggcccgccccgtcgagactttgcgggcctgcgaggagtatcttagacagcatgacaagctggcacacccttatagagcagcagtgctgagagcaatggaacgcgtgttatcatctagggcttctgaactggataaggacactgcctctactattatcttgctggccagtagcgagatgaccaagacgaaggatctggtctgggactggcagcaggctgcttcaggggtgctggtggctgtgggccgccaatttatctctaaggtcatggaggaattactgaggcgtttacatcctggaaccttaccacattgtgccgtgttgcatacccttgccagcctgtctgtcgccaatgctttcggtgtggtgccttttttacctagcgttctaagtagcttgttgcccgtcttaggagtggccaagcaggatacagtgcgcgtggccttctgttcggcactgcaaaggttctctgagggagctttggagtacttggcaaaccttgacagggcacccgatcctaccgtaaggaaggatgcgtttgctaccgatattttcagcgcctatgacgtgctgttccaccagtggctgcagagtcgcgaagctaaactccgactagcggtggtagaagcattgggtcctatgtcccacctcctgccgtcggaaaggctcgaggagcaattgccaaaactgcttccaggcattctggcactgtacaaaaaacatgctgagactttctacttaagcaaaagtctgggtcagattctggaagcagccgtgtctgtgggcagcagaacactagagacgcagcttgatgctctgcttgctgccctgcacagccaaatttgtgtcccggtcgagagttcttcccccctggttatgagcaaccagaaggaagtgttacgatgtttcacagtactggcatgtagcagccccgacagactccttgcatttttgcttccccgactggatacgagtaacgaacggacccgggtcgggactctgcaggtggtaagacatgtgatcaattcagccgcagctcaaatggaggacaaaaaacccttcatcctgagctcaatgagacttcctttgttggacaccaatagtaaggtcaaacgcgccgtggttcaggtaatttctgcaatggcccaccacggttacctggaacagccaggaggcgaagctatgatagagtacatcgtacagcagtgcgcattaccgccggagcaggaacccgaaaaacctgggcccggttctaaagatccaaaagctgactctgtaagggctatctctgtgcggactctgtatctcgtatctacaacagtagacaggatgtcacacgtgctttggccatatctgctccagttcctgacaccggtgcgcttcaccggcgccctgaccccgctgtgccgcagcctggtccacctggcccagaaaagacaagaagccggggcagacgcctttctaattcagtatgacgcacacgccagtttaccaagcccctatgcagttactggacggctcctggtagtttcaagtagtccatatctgggtgatggcagaggcgccgcagccctccgtctcctgagcgtactacatcccaatatccaccctttgctgggtcagcattgggaaaccaccgtcccactacttcttggttacctagatgaacacaccgaggagaccttaccccaagaagagtgggaggagaaactgctcatgttccttagggacacactggccatcatatctgacaatgcctggatctgtcagctgagtctcgagctctgccgacagttgccatgttacgacgaggcaccacaggaaaagaattttctgtataaatgtatcgggaccaccttgggagccgcgtcatccaaagaggttgtgaggaaacacttacaggagttgctggaaacagctcgctatcaggaggaggcagaacgcgagggcctggcgtgttgttttggtatttgtgccatctctcacctggaagacacactcgcccagctggaggactttgtgcgaagcgaagtgtttcgcaagtccattggaatcctgaacatcttcaaagaccggtccgagaacgaagtggagaaggtcaagagtgcccttatcctatgttacgggcatgtagccgcccgtgcaccgagagaattggtgcttgccaaagttgaatctgacattctgagaaatatatgtcagcacttctctaccaaagtactaggcattaaagtggaaactaaggatcctgccctgaaactgtgcctcgtccaaagcgtgtgcatggtttctagggccatctgttcctcgacccaggccggttcattccactttactcggaaggctgagctggtggctcagatgatggaatttatccgagccgaaccccctgactcactcagaaccccaatcaggaagaaggccatgctgacttgcacctatttagttagcgtcgaaccagccctggatgaacaggcccgggccgacgtcatccacggatgtctgcattccatcatggcactcttgcctgaacccaaggaagaagatggcggttgccaaaagagcctatacctggagactctgcatgctctcgaggacctcctgacctccctcctgcagcgaaatatgactcctcagggccttcagataatgatcgaacacctgagtccttggatcaagtcaccccggggacatgaacgcgccagggcactgggtctatccgccctgctcttgcgttactttctggaacacctacgtgtttcagcactagtgccgtttcacaatctaggcctcctcatcggactattttctccacgttgtgccgacctgtggcccgcaacccggcaggaagcagtggactgcgtatattccttgctatatctgcagctcggatacgaggggtttagccgagactatcgagatgacgtagccgagcgtctactgtctctgaaggacgggttagtgcaccccgaccctgcaatactcttccatacctgccattccgtgggacagataatcgccaagcgattgcccccggaccaactcatttccctgttactcaccatgttcgaggctctgggagatccagagaagaactgttctcgtgcggccactgtcatgatcaactgcttactacaagagaggggcggcgtgctacaggagaaggtcccagagattgtctcagttttgcggtctaagctgcaggaagcccaaggagagcacgttttgcccgcagcccagcacagcgtgtacttgctagctacgcaacactgcgctgctgttgtctccagtctcctgggcagtcctctgcccttggacagtcacacctgcatgctctggagagcgcttgccgtcgagccccggcttgccgcacaggtgttagggctcctgctggagaagatgagcagggatgttcccttcaaggaatctagagctttcctgctcggccgcactccagacagggtggctaccctgctacccctctctgctacatgcgctctctttgaagtgatgagcaccccagcagcgggtccggcagtgctggaactgtacccccagctgttcgtggtgctcctcctaagagtctcctgtacagttggtgtccagttgcctagaaacttgcaagcacaggaaaggcggggtgcctcgccagcactggccacacgcaatctggaaccttgctcttcagctgttgatacactcagaagtatgctccttagatccgggagtgaggacgtcgtgcaacggatggatctggaaggagggtgggagctactgcggacctccgctggccacgaggaaggcgctactaggttagctagggctatggcggagcacgctgggcccagactgcctctggtcttaaagacgctggcctgtactcactcttcagcatatgaaaaccagcgtgtgaccacaacggcttttctagcagagcttctgaactccaatgtcgcaaacgatttaatgctcttggattccttactagagtccttggcagctcggcagaaggatacatgcgcttctgtgcgtagactagtgcttcgtggcctggccaacttggcctcaggatgtcctgacaaagtcagaacccacggtccccagcttttgactgcgatgatcgggggcctggacgatggagacaatcctcactcacccgtggctcttgaggctatgctcgggttggcgcgtcttgtccacctagtggagtcttgggatctgagaagtgggctgcttcacgtggcaatacggattaggcctttcttcgactctgagaagatggagttcaggactgctagtattcggctctttggacacctgaataaagtctgtcatggggactgcgaggacgtgtttcttgaccaggtagtcggcgggttggcacccttattgctgcatctacaggatccccaggcgacagtggcgagcgcctgccgctttgcattgcggatgtgtgggcccaacctcgcgtgcgaggaactgtcagccgcttttcagaagcacctccaggaaggccgcgcactacactttggggagtttctgaatactacctgtaaacacttaatgcatcacttccccgatctgctcggacgcctactgactacttgcctgttctattttaaatcctcttgggaaaacgtacgtgctgccgcacctctctttaccgggtttcttgtactccacagtgaaccaagacagcaaccgcaagtcgatctggatcagttaattgctgcactccaaattctgctgaaggatcccgccccagaggtacgaacacgcgcggccgaagctctcggcaggctagtgaagctggcatag

SEQ ID NO: 47997 - DNA, 1848 bp, Artificial Sequence
  Description of Artificial Sequence: Synthetic coding sequence
atgcggatcatcgccaagcggctgccccccgaccagctgatcagcctgctgctgactatgttcgaagcactcggggatcccgaaaaaaattgttctcgggccgcaactgtgatgatcaactgtttactgcaggagagagggggagtcctccaggaaaaagtgccagaaatagtgtcggtgcttaggtccaagttgcaggaggcccagggcgagcatgtcctgcctgcagcccaacatagcgtgtatctcctcgctacccagcattgcgcggctgttgtgagtagcctgttaggatcacccctaccactcgatagccacacatgcatgctctggcgggcactggctgtggaaccccggctagcagcgcaagttttgggccttctgttggagaagatgtcccgcgacgttccctttaaggagagcagagccttcctgctggggcgcaccccagaccgcgtggccaccttactgcctcttagcgccacatgtgccctgttcgaggtgatgagtactcctgctgccgggcccgccgtgcttgaactgtatcctcagttgtttgtcgtcctcctgttgagggtatcctgcactgtaggagtccaactgccgaggaacctccaagcccaggaaagacgtggcgcttcgcccgctctcgccacgaggaatcttgaaccttgttcctcagcagtggacactcttcgatctatgttattgagaagcggctccgaggacgtggtgcagcggatggatctggagggaggctgggagctgctgaggacttctgctggccatgaagaaggcgctacccgtctggcacgcgctatggccgagcatgcaggcccccgcctgcctctggtcctcaaaacccttgcttgtacccactcaagcgcgtacgaaaaccagcgagttacgactaccgccttcctggccgaactgctgaatagtaatgtcgcaaatgaccttatgttactagactctctcctggagtctctcgctgctaggcagaaggatacgtgcgcaagcgtacggcggcttgtgcttcgcgggctggccaacttggcctccggatgccccgacaaggtgaggactcacggacctcagctgctgactgccatgatcgggggtctggacgatggggacaaccctcactccccggtcgccttggaagccatgcttggactcgcaaggcttgtgcacctcgttgagagctgggatttaagatctggcctgcttcacgtggctattagaattagaccttttttcgacagtgaaaaaatggaatttcgcacagcctccatcaggctgttcgggcaccttaacaaggtctgtcatggagattgtgaagatgttttcctggatcaggtcgtcggcggattggccccgttgcttctgcatctccaggatccacaagcgaccgtggccagtgcttgccgctttgctctacgaatgtgtggacccaatctggcatgcgaagagctttccgcggcatttcagaagcacctccaggaaggccgagcactgcactttggcgaattcctaaatacaacatgcaaacatcttatgcatcacttcccggacttgctaggcaggctcctgaccacctgcctgttttattttaagtcatcttgggagaatgtgcgagccgccgcgccactcttcaccggaaaacatcacccactgcctcacccccatgccgcgagacaaccgcggttgatgcctcctctgcatagggtgccaggcgcagctctgggcgctcaagcggctgccgccggtggtccgggcccagctcactgtggtgccccagacccagctgaagggcctggcccccgtggtgccgatgagggatgctag

SEQ ID NO: 47998 - DNA, 4926 bp, Artificial Sequence
  Description of Artificial Sequence: Synthetic coding sequence
atgaccgagagcagcatgaagaagctggccagcaccctgctggacgcaattacagataaggatcccctggtgcaggaacaggtctgcagcgcgctctgttctctcggcgaggccaggcccgtcgagactctgcgcgcatgcgaggagtatctgcggcagcatgataaactggctcatccttacagggccgccgttttacgggccatggagagagtgctcagttctagagcctcagagcttgacaaggataccgcgagcactattatcctcctagcatcttccgagatgactaaaaccaaagatttagtgtgggactggcagcaggctgctagcggcgtccttgtggctgttggaagacaatttatcagcaaggtgatggaagagctgcttcgccgactgcaccccggaaccctgccacactgcgctgtcctgcatactttggcctccctctctgtcgccaatgcgttcggcgtggtccccttcctgccctcggtgctgagttcattgttgccagtgctgggtgtggcaaagcaggataccgtgagggtggccttttgctccgcactgcagcgcttttcagagggagctctggaatatttggcgaacctggacagggcccctgatccaaccgttcgtaaggacgccttcgcaacagatatcttcagcgcatacgacgtattgtttcaccagtggcttcagtcccgcgaagctaaactacgtcttgctgtggttgaagctctgggacccatgagccacctgctccccagcgagagattggaggagcaattgcccaagttgttgccaggaattctcgccctatataagaaacatgccgaaaccttctacctgagcaagtctctggggcaaattctggaagcagccgtgagtgttggaagccggacactggagactcagctggatgccctgctcgccgctctgcactcgcagatttgcgtccccgtcgagagcagttccccactcgtgatgtccaaccaaaaggaagtcctgcgttgctttaccgtgctggcatgttcctcacctgaccggctcctagcttttctcctgccacgattggatacctctaatgagaggacccgggttggcaccctgcaggtggtgcgccacgtcattaattcagcggcagcacagatggaggacaaaaaaccctttatattatcctccatgaggctacccttgttagacaccaactctaaagtgaagagagcggtcgtccaggtgatatcagcaatggcccaccatggttacctggagcaaccgggaggtgaggctatgatcgaatacattgtccagcagtgcgccctgcccccagaacaagaaccggagaaaccaggtcccgggagtaaggaccctaaggccgattcagtccgggctatatccgttagaactctttatctagtgtcgacaacggtcgatcgcatgtcacacgttttgtggccatatcttctgcagtttttgacacccgtgcgcttcactggggctctcacccccctctgtcgctctcttgtccatcttgcccagaagaggcaagaagcaggtgcagatgcgttcctgatccagtacgatgcccatgcctccctgcctagcccctatgccgtgactggacggctgctggtcgtgtcttccagcccttatcttggcgacgggaggggggcagctgctctccggcttctatccgtattgcatcccaacatccaccctctgctcggccagcattgggaaactacggtgcctcttctccttgggtacctggatgaacacactgaggagacactcccccaggaggaatgggaggaaaagctacttatgttcctacgggacaccctggccatcatctcagacaacgcatggatttgtcagctctcactggagttatgcaggcagctcccctgctatgatgaagcgccccaggagaagaactttctttacaaatgcattggaacaacccttggagctgcttccagcaaggaagtggtaaggaaacacctacaagagctactagaaaccgccaggtaccaggaagaggcggaacgagagggactggcatgttgtttcggtatatgtgccatttcacacctcgaagacacgctggctcagcttgaggatttcgtccgtagcgaggtgttcaggaagagtatcgggattctcaatatttttaaggatagatctgagaatgaagtggaaaaggtgaagtcggccttgatcctgtgttacggccacgtggcagcaagagctccgcgcgaactagtgttggctaaggtcgagtcggatatcttacggaatatttgccagcatttttctaccaaagtgctgggcatcaaagtggagaccaaagaccccgccctcaaactgtgtctagtccagtcggtctgtatggtatccagagctatttgcagctccactcaggctggatctttccactttactcgcaaagctgaactagtagcccagatgatggagtttattcgtgccgaaccacccgattctctgagaactcccatcagaaaaaaggctatgctgacatgtacttacctggtcagcgtggagcccgcactggacgaacaggcccgcgccgatgtgatccacggctgcctccactctatcatggcgttgctaccagagcctaaagaggaagatggcggctgtcagaaaagtctgtatctggagacactgcatgcactggaggacctcctaacatctcttctgcagcggaacatgacacctcagggactgcagatcatgatagagcatctgtccccatggatcaagtctcccagggggcacgagagagctagggctctcggtcttagcgccttacttctgaggtacttcttagaacacctgcgggtgtccgccctcgtgccttttcacaatttgggccttctgatcggactattttcacccagatgcgctgacttgtggcctgctacacgacaggaagctgtggattgcgtgtacagcctcctttacctccaattgggctacgaaggctttagtagggattacagagatgatgtggctgagaggctgctttctctgaaagatggcctggtccacccagaccccgcgatattatttcacacctgccactccgtaggtcagattattgcgaagagattgccccccgatcaacttatctcattgctcctcacgatgttcgaagccctgggcgatccggagaagaattgtagccgcgcggctaccgtgatgatcaactgtctgttgcaggagagaggcggcgttctccaagagaaggtccctgagatagtgagtgtgctgcgaagcaagctacaggaagctcagggcgaacatgtcttaccagcagcccagcactccgtataccttttggccacccagcactgcgccgccgttgtgtcttccctgctgggttcccccctgccattagattcccacacttgcatgctctggcgcgccttggcagtggaacctcgcctggcagcccaggtacttgggctactgctcgagaagatgtctcgcgacgtgcctttcaaggaatctagggcctttcttctgggacgaacaccggaccgagtggcaacacttttgcccctgagtgcaacatgcgctctgttcgaggtcatgagcacccctgccgccggccctgctgttctcgagctctacccacagctcttcgtcgtattgctgctaagagtgagttgtacggtcggagtgcagctgccgaggaacctccaggcacaagaacgccgtggagcatctccagccctggctaccagaaatctggagccctgctcaagcgctgttgacaccctacggtctatgctgctgaggtctgggagtgaggatgtggtgcagcgcatggacctggagggagggtgggaactgctgaggacaagcgccggtcacgaagaaggtgccacgagactggcaagagctatggccgaacatgcaggcccccgcctgcctctggtcctgaaaacacttgcttgcacacacagttcggcttatgaaaaccagcgggtgactacaaccgccttcctcgccgaacttctgaactctaatgtggctaacgatttaatgcttttggattcccttctggaaagtctggcagcacgtcagaaggacacctgcgcctctgtgagacgactcgtcctgcggggattggctaaccttgcttctggatgccccgacaaagttcggacccatggtcctcaactgcttaccgcgatgatcggcggattagatgacggcgacaatcctcatagtcctgtggccctggaggccatgctgggcctggctagactagttcaccttgtcgagtcatgggatctgcgatctggcctgttacatgtggcaattaggatcaggcccttttttgactctgaaaaaatggagttccgtacagcaagcattcgtttattcggccatttgaacaaagtttgccatggggactgcgaggacgtgtttctggaccaagtggtaggtggccttgccccactcctgctgcacctgcaggacccacaggccaccgttgcatccgcctgcagattcgccctgcggatgtgcggtccgaatctcgcttgcgaagaattgtcagctgcctttcagaagcacctgcaggagggaagggccctgcattttggagaatttcttaataccacctgtaagcacctcatgcaccactttcctgacctactagggcgcttgctgaccacatgcctgttctactttaagagctcttgggaaaatgtgcgggctgcggcacccctttttacaggattcctggtgctacattccgagcctagacagcagccccaggtggaccttgatcagttgatagccgcactgcagattctgctgaaagaccccgcacccgaggtcagaacccgagccgctgaggccttgggcagactggttaaactcgcctag

SEQ ID NO: 47999 - DNA, 3873 bp, Artificial Sequence
  Description of Artificial Sequence: Synthetic coding sequence
atgaaggccagcagctgcttcctgatcctggcccacagcaaccccggggaattaatggaattcttcgatgagcaagtgcgcagcaataatgaggcgatcagagtgggaatcctcactttactccggctcgcagttaacgcggatgagcctcggctgcgcgatcacatcataagtattgagcgcactgtgaagatcgtgatgggcgatctgagcaccaaagtacggaatagcgtattattgctgatccagactatgtgtgaaaagtcctatattgaagcacgagaggggtggcctctgatcgattacgtgttcagccagttcgccacactgaataggaacctggagaagcccgtgaaaactaatttccacgagaatgagaaggaggaagagtctgtccgcgagactagtcttgaagtgcttaagacactcgacccattagttataggcatgcctcaagtgctttggccgagaatcctgaccttcgtcgtgccggcagaatatacagaggccctggagcctctcttctccattataagaattctcattatggcagaagagaagaaacagcacagtgcaaaggaaagcaccgccctggtagtatcaacgggcgcagtgaagctgccaagtcctcagcagttactagctcgcctcttagtcatcagcatgcccgcaagtttgggtgagctgagaggggccggggcgatcggattattaaaaattctccccgagatcatccacccgaagctggttgacctctggaagactcgactgccagaattgctacaacctctggaggggaaaaacattagtaccgtcctgtgggaaactatgctgcttcagcagctgctgaaagagtccctttggaagatcagtgacgtggcctggaccattcagttaactcaggactttaagcagcagatgggcagctacagcaataacagcacagagaaaaagttcctctggaaagcactcgggaccacgctcgcctgctgtcaggactcggatttcgtcaatagccagattaaggaattcttgaccgcccctaaccagttgggcgaccagaggcagggtattacgagtattctagggtattgcgcagaaaaccaccttgatattgtgcttaaagtgttgaagaccttccagaatcaagagaagttttttatgaataggtgcaaaagcctgtttagcgggaaaaaatctctcacaaagaccgacgttatggtgatttacggtgctgtggctctgcatgcaccaaagaaacaactactctcccggctcaaccaggatattattagtcaggtactgagcctgcatggccagtgttcccaggtgctcggaatgtccgttatgaataaggacatggacctgcagatgtcctttacccgttccatcaccgagattggcatcgctgttcaagacgctgaagaccaagggtttcaattctcatataaagagatgctaataggctacatgttggacttcattagagacgagcctctggactccctggcttcaccaatccggtggaaggcgctcatcgcgatacgatatcttagtaaactgaagcctcagttgagtctacaggatcacctgaatatactggaagagaacataaggcgcctgctgccgttgcccccactcgaaaatctcaaatctgagggacagaccgacaaagacaaggagcacattcagtttctttacgagaggtcaatggatgctctggggaagctccttaaaactatgatgtgggataatgttaacgcagaggactgccaagagatgttcaaccttctccagatgtggctggtgtcccagaaggagtgggaaagagaacgagccttccagatcaccgccaaggtgctcactaacgacatagaagccccggagaattttaaaatcggctcactgctcgggctactagctcctcactcctgcgacaccctccccaccatccggcaagcagcagcaagctcaactatcggtctgttctatattaaggggattcatctcgaagtggaacggctgcaaggcctgcaggaaggcctggagtccgatgatgtgcaggtgcaaatcaagatctcatcaaaaattgccaagatcgtcagtaaattcataccgaacgaagagattctgatgtttcttgaggaaatgctggatgggctcgagtcactaaatcccacatgtaccaaagcatgcgggatatggatgattacagtgctcaaacagcagggtgccgctttggaggaccagctgttagaaatactgggtactatctaccatcacatgccagtactccgtcaaaaggaggaatcattccagtttattttggaggctatttcccaaatagcctccttccacatggatacggtggtagttaatctgctgcagaaaccgctgccattcgaccgcgacactaaaacactgtggaaggccctggcggaaaagcctgcgtcttctgggaagcttttgcaggctctgatcgacaagctggagactgagcttgaggatgacattgcgagagtcgaggcaattagtgtagcttgcgccatgtatgaggtaataagtatgggcacctccgtaactggcctgtatcctgaactgttcacactgctgttgaaactggtcagttgtactctggggcaaaagatgcttacttgtccttggtctcacagaagacatgtgatgcagcagggcgaacaacagcagatcccagacccctgcaggctgtctacagccactctcaagtgcctgcaagcccaggccatgagggagggactggctaaagagagcgacgagggcgacaacctctggacactcctgtcatcgccctcaacccatcatatcggagtctgctctcttgcgcgaagtatggccgtctggcagcatggagtcattctggacattatggaacagttgttaagttcactgacgtcttcttctgaaaactaccgcattactggtgcagccttcttctctgagctgatgaaggagccgatcttgtggaagcacggaaacctgagaaacgtcctcatcctcatggaccagagcgcttgggactccaacgccactctacgccagatggccatacgtggtctcggtaataccgccagtggggctccccataaagtgaaaaagcataaacagctgatgctggagagtattatacgtggcctctatcatctggcccggaccgaggttgtgtgcgaaagtttgaaagctttaaaaaaaattttggaactgttgacagatcgcgacgtgtccttttatttcaaggagattgtgctccaaacccggactttctttgaagatgagcaggacgacgtacgcctcactgccatcttcctcttcgaggacttagcccccctcacggggcgaagatggaaaatcttttttgcagaggagatcaaaaaatctcttatcagctttctgctccacctgtgggatcctaaccccaagattggcgttgcatgcagagatgtcctgatggtgtgtatccctttcctggggttacaggagttgtacggcgtgctggatagattgcttgatcaggatctgcctcgggcccgcgatttttaccggcaattctgcgtcaagcttgccaagaagaaccaggagatcctctggatattacacacacattctttcacatttttcactagtacatgggaagtcattagaagtgctgcggtgaaactgaccgacgccgtggtgctgaatttgacaagccagtatgtggagctgcttgatagggaacagcttactaccaggctgcaggcactacgccaggatccatgcatctctgtgcagagggctgcagaggctgcattgcagacactccttcgtaggtgtaaggaaactagcattcccctgtag

SEQ ID NO: 48000 - DNA, 4758 bp, Artificial Sequence
  Description of Artificial Sequence: Synthetic coding sequence
atgaccctgagcaccgaggagagcatcgagatgttcggcgacatcaatcttactctcggtatgcttaacaaagaagacattgttaacaaagaagacatctactcccatttgacatctgtgattcaaaacacggatatattggacgatgccattgtccaacggctaatttactatgcatccaaggatatgagagataacaatatgctccgggaaattagaatgctggctggagaggtgctcgttagtctcgctgcccatgactttaatagtgttatgtacgaggttcaatccaattttaggatactggaactaccagacgagtttgttgttcttgcactcgctgaactcgcgaccagctatgtctctcagagcataccttttatgatgatgaccctgctgacgatgcagactatgcttaggctcgcagaagacgagcggatgaaaggcacgttctgcattgcactggagaaattttctaaggcaatatacaaatacgtgaaccactggagggacttcccttacccacgcctcgacgccaatcgactctcggataaaattttcatgttgttctggtacattatggaaaagtgggcgccactggcaagcccaatgcagaccctgagcattgtcaaggcccacgggcccaccgtttccctccttctgcaccgagaagactttcgcggatatgctctggggcaggtgccatggttgctcaaccagtataaggacaaggagatagattttcatgtgacccagtcactaaagcagatcctgactgccgcagtgttgtatgacattgggctgcctagatccctgcgcagaagtatcttcatcaacttgctgcagcaaatttgtcgggcccccgagcctccagttaaagagaatgagatgaaagcaagcagctgttttctgatactggcccacagtaaccccggtgaattgatggaatttttcgacgaacaggtgcgcagcaacaacgaagctattagagtcggaattttgaccctgctgaggctcgccgtcaacgccgacgaaccccgactccgtgatcatatcataagcatcgagcggaccgtaaaaatcgtgatgggagacttgagcacaaaggtgcgtaacagcgtgcttctgttgattcagaccatgtgtgagaagagctatatcgaggctagggaaggatggcctctcattgattatgtctttagccagttcgctaccctgaatagaaacctcgaaaaacccgtgaagacaaactttcatgaaaacgagaaagaagaggagagtgtccgagagacatcattggaggttcttaagaccttggaccccttagtcattggaatgccacaggtcttatggcccaggatcctgaccttcgtggtgccagcagagtataccgaggccctggagccgctctttagtattatcagaatattaatcatggccgaggagaaaaaacagcactccgccaaagagagtacagctctcgtggtttctactggagctgtaaaattaccatcccctcagcagcttctcgcgcgattgttggtgatcagtatgcctgccagcctgggcgaactccggggagccggcgccatcggacttctgaagatccttcccgagataattcacccaaaactggtggacttgtggaaaacgcgacttccggagctgctccaacccttggaaggaaagaacattagcaccgtgctttgggagacaatgctcctgcaactgctcaaagagagcctttggaagataagcgacgttgcctggaccatacaattgacccaggatttcaagcagcagatggggtcgtattctaacaactcaaccgaaaagaagtttctctggaaggctttggggaccaccctcgcctgttgtcaggactctgacttcgttaactcgcaaatcaaagagttcctgaccgcccccaatcagctgggggaccagaggcagggaatcacctcaatcctcggctactgtgctgaaaaccatctcgacattgtgcttaaggttctgaaaaccttccagaatcaagagaaattctttatgaatcgatgcaaatcactcttctctgggaagaagagcctgaccaagacggacgtgatggttatttacggcgctgtggcactccacgcccctaaaaaacagctcttgagcagattgaatcaggacatcatctcccaagtgctgtctctgcatggccagtgtagccaggtgctcggaatgtcagtgatgaacaaagacatggacttacagatgtcttttaccaggagcatcaccgaaattgggattgccgtgcaggatgccgaagaccaaggctttcagttctcatataaagagatgctcatcgggtacatgctggacttcatccgggacgaacccctggacagtctggcctcacctatccggtggaaagctttaattgcgatcaggtacctcagcaaactgaagccccagctttccctccaggatcatcttaacatactggaagaaaatattcgccggctgttacccttgcctcccttagagaacttgaagtctgagggccagactgacaaggataaggagcacattcagttcctgtacgaacgcagcatggatgctctgggtaagctcttgaagaccatgatgtgggacaacgttaatgccgaggattgtcaggagatgttcaacctactgcagatgtggctagtcagccaaaaggaatgggagcgggaacgcgcctttcagatcaccgctaaagtgctcaccaatgatattgaggctccagaaaattttaagataggctctctgcttggcttgctggcaccccatagttgcgacacccttccaacaatccggcaggccgccgcatccagcactattggcttgttctacattaagggcatccaccttgaagtggagcgacttcaaggactgcaggagggccttgaatcggacgatgtccaggtccagatcaagatcagcagtaaaatagctaagatcgtctcaaagtttattccaaacgaagagatacttatgtttctggaggaaatgttagacggcctggaaagcctgaaccccacctgtacaaaagcttgcggtatctggatgataactgttctgaagcagcagggtgccgcccttgaggatcagctgctggaaatccttggcacgatttaccaccacatgcctgtgctgcggcagaaggaagagagtttccagtttatactagaagcaattagccagatcgcgagcttccacatggacactgtggtggttaaccttctccagaaaccattgcctttcgatagagatacaaagacactttggaaagcactcgctgagaagcccgcctcaagcggaaagcttctccaggccctgatagacaaacttgaaactgaacttgaagacgatatcgctcgcgttgaagctattagtgttgcctgcgcaatgtatgaggtgatcagtatggggacaagcgtgactggactgtatcctgagctgttcacactcctactcaagcttgtgagctgtactctcggacaaaagatgcttacttgtccatggagtcacaggcgccacgtgatgcagcagggagagcagcagcaaattcctgacccttgtcgtttgtcaacagctaccctgaagtgcctacaggcccaagctatgcgcgaaggcctcgcaaaagagagcgacgagggggacaacctttggactctgctgtcctcgcccagcacacatcacatcggcgtgtgttcattagctcgatccatggctgtgtggcaacatggtgtcatcctcgatattatggagcagttgctctcctctctgacctcttcatccgagaattacagaataaccggcgcagcattcttctctgaattgatgaaagaacctatcctgtggaagcatggcaatttgcgtaacgtgttgatactgatggatcagagtgcttgggactcaaacgccaccctgaggcaaatggcaattagaggactgggcaatacagccagcggagccccacataaggttaagaaacacaagcaactcatgttggaaagcattatcagggggctatatcacttagcaaggactgaggtcgtgtgcgagagtctcaaagccctaaaaaagatattggagctcctaacagatagagacgtgagtttttatttcaaagagatcgtgttgcagactcggaccttctttgaggatgaacaggacgatgtgaggctgaccgctatctttttattcgaggacctggcccccttgaccggtaggcggtggaaaattttcttcgctgaggaaatcaaaaagtccctcatttccttcctgctgcacctgtgggaccccaacccgaaaataggtgtcgcctgtcgagatgttctcatggtatgcatcccctttctgggactacaggagctgtacggtgttctagatcgcctcctcgatcaagacctccctcgagctcgagatttttatcgacaattttgcgttaagctggccaagaagaatcaggagatcctctggattttgcacacccattcatttacgttcttcacctccacatgggaagttatccggtccgctgctgtcaaactgacagatgctgtggtgcttaacctcaccagccagtacgtagaactgttggacagagagcagctgaccactaggctgcaggcactgaggcaggacccctgtattagcgtccaaagggctgctgaggcggccctgcagactctgcttcgaaggtgtaaagagactagcatccccttatag

SEQ ID NO: 48001 - DNA, 225 bp, Artificial Sequence
  Description of Artificial Sequence: Synthetic coding sequence
atggacgtgcggggccccgaggcccccggcggccgggccctgcgggatgctgctgaaaatctgttccaggagttgcaggaacatttccaagccctgaccgctacactcaatttgagaatggaggagatgggcaacagaatcgaagacttgcagaagaacgtcaaggatctgatggttcaggccggaatcgagaatagcatcaaggagcaaatgctgaagacttag

SEQ ID NO: 48002 - DNA, 549 bp, Artificial Sequence
  Description of Artificial Sequence: Synthetic coding sequence
atgagcggccggagcgtgccccacgcccaccccgccaccgccgagtatgaatttgcaaatccttccaggctgggggagcaacggttcggcgaggggctgctgccagaggaaatcctgacccccacactgtaccatggctattatgtgcggccaagagccgccccagctggagaggggagtcgcgcaggagcctctgaactcagattgagtgaagggaaatttcaagcttttctcgacgtctctcatttcacgcccgacgaggtcactgtaagaaccgtggacaatctgctggaggtgagcgctcgacacccccagcgactggaccgccacgggttcgtctctagagaattctgcagaacgtatgtacttcccgccgacgtagatccttggagagtccgagcagctctgtcacatgatggaattctgaacttagaagccccaagaggtgggcgacacctcgacacagaagtgaacgaggtgtacattagcttgttacctgcccctccagacccagaggaagaggaggaagccgccattgtcgagccctag

SEQ ID NO: 48003 - DNA, 435 bp, Artificial Sequence
  Description of Artificial Sequence: Synthetic coding sequence
atgcggaagatcgacctgtgcctgagcagcgagggcagcgaggtgattctggccacgtcaagcgacgagaaacacccgcccgagaacattatcgatggcaatcccgaaaccttttggacgactaccggtatgttcccgcaggaattcattatctgtttccataagcatgtcagaatcgagaggcttgtgatccagtcatatttcgttcagacactgaagattgaaaagagcaccagcaaggagccagtggatttcgagcagtggatcgaaaaggatttagtgcatacagaaggtcagctccagaacgaggagattgttgcccatgacgggtcagccacctacctaagatttatcattgtgtccgcatttgatcatttcgccagtgtacattccgtttcagccgaaggcactgtggtgtctaacctgtctagctag

SEQ ID NO: 48004 - DNA, 225 bp, Artificial Sequence
  Description of Artificial Sequence: Synthetic coding sequence
atgcggaagatcgacctgtgcctgagcagcgagggcagcgaggtgatcctggccaccagctcagatgaaaagcaccccccagaaaacatcattgacggcaaccccgaaacgttttggaccaccacggggatgttccctcaggagttcatcatatgttttcataaacacgtgcgcattgagcggttggtgattcagtcctacttcgggaagcagattctgcactag

SEQ ID NO: 48005 - DNA, 339 bp, Artificial Sequence
  Description of Artificial Sequence: Synthetic coding sequence
atgcggaagatcgacctgtgcctgagcagcgagggcagcgaggtgattctggctacctctagcgacgaaaagcaccctcctgagaatattattgacggcaacccagaaaccttctggaccactactggaatgtttcctcaggagttcataatctgtttccataaacacgtgcggattgagcgcctggtgatccagagctacttcgtacagaccctgaaaatcgagaagtccacctctaaggaacccgtagattttgagcaatggatcgagaaggatcttgttcatacagaggggcagctgcaaaatgaagagatcgtggtatccgagtacactctttag

SEQ ID NO: 48006 - DNA, 435 bp, Artificial Sequence
  Description of Artificial Sequence: Synthetic coding sequence
atgcggaagatcgacctgtgcctgagcagcgagggcagcgaggtgattctggctacctcctctgatgagaaacacccaccggagaacataatagatggcaaccctgagaccttttggaccaccactggcatgtttccgcaggagttcatcatctgtttccataagcatgttagaatcgagcgtctcgtgatacagagctatttcgttcagacccttaaaattgagaaatctacatcaaaagaacctgtcgacttcgaacaatggattgaaaaagacctggtgcataccgagggccagcttcagaacgaggaaattgtggcccatgatgggagcgctacctacctacggtttatcatcgtaagcgcctttgaccattttgcgagcgtgcatagcgtctcggccgaaggaacggttgtgtcgaatctctctagttag

SEQ ID NO: 48007 - DNA, 417 bp, Artificial Sequence
  Description of Artificial Sequence: Synthetic coding sequence
atgggcgtgagcaaccagggctgcagccggaacgcccggcaccagaaggcacgaagtatgcccttgcaagaccagcatctggcactagctatcctgctggaattggctgtgcagaggggaacactctcacagatgctcagcgctattctcctgctcctccagctttgggattctcgggcccaggagacagataacgaacggtccgcacagggcacatcaaccctgctcctgagccttctgcagacgttccagagtatcatctgcggaaaagacacccctccttccgagggtaatatgcacttactgtccggccctttgtcacctagcgagtcatttctgcggtacctgactttacataagaccacatccctgcctctgatttgtaacaagcgacagctactttcctggcccatctag

SEQ ID NO: 48008 - DNA, 7839 bp, Artificial Sequence
  Description of Artificial Sequence: Synthetic coding sequence
atggccgacgtggaccccgacaccctgctggagtggctgcagatgggacagggagatgaaagggatatgcagctcatcgcactggaacaactgtgcatgctgcttctgatgagcgataacgtggaccgctgtttcgagacctgcccccctcggacctttctgcccgccctgtgcaaaattttcctcgacgagtcggcaccagataatgttttggaggtaaccgctagggctatcacttattacctggatgttagcgcagagtgcacgagaaggatcgtaggggttgatggcgccattaaagccctttgtaaccggctagttgttgtcgaactgaacaatcgaaccagccgtgatctggcagagcagtgtgttaaggtcctggaactcatatgcactagagagagtggagcagtcttcgaagcagggggcctgaattgcgtactcaccttcatccgcgatagcggacatttagttcataaagatacactgcactctgccatggccgtggtgagtcgactttgtggcaagatggagccccaggacagcagcctcgagatctgcgttgaaagcctgtcctctctgctgaaacatgaagaccaccaggtgtcagatggggcactgaggtgtttcgctagcctcgctgatcgcttcacccgacggggtgtggacccggctcctctggccaaacacggactgaccgaagaactgttgtcacggatggccgctgcgggcggtactgtgtccgggccttcatctgcatgtaagcccggcaggagcacgaccggcgcgccttctacgaccgccgactccaaactgtcaaatcaggtgtcaaccattgtctctctgctcagtaccctgtgtcgcggatcaccagtcgtgacacatgatctccttaggtcagagctgccagacagcatcgaaagcgccctgcagggcgatgaacgctgtgtgctcgatacgatgaggctcgttgacctgctgctggtgttattatttgaaggacgcaaggccctgcctaaatcctcagcaggctcaactgggcggattcccggtctgcggcggctggactcttccggagagcggagtcaccgccagttgatcgactgcatccggtcgaaggacaccgatgcactgatcgacgcaatcgataccggggccttcgaggtgaatttcatggatgacgtcgggcagacactgctcaactgggcttccgcctttggaacccaggagatggtggaatttctgtgcgaaaggggtgccgacgttaatcgagggcagcgaagctcttctctacattacgctgcctgtttcggaaggccccaggtggcaaagacactcctacggcacggagccaatccagacctgcgggacgaggatggcaagacccccctcgacaaggctcgcgaaaggggtcacagcgaagtggttgccattctgcagtcacctggtgattggatgtgccccgtgaacaagggtgacgacaaaaaaaagaaggataccaataaggatgaagaggaatgcaatgagcccaagggggacccagagatggcccctatataccttaagagactcctcccggtttttgctcagacttttcagcagaccatgctgccctccatacggaaggcttctttggctctgataagaaagatgatacacttttgttctgaggcacttctgaaggaggtgtgtgactctgacgttggtcataacttaccaaccatcctagtggaaattaccgcaacagtccttgatcaggaagacgatgacgatggccatctcctggcattgcaaatcattagagacttggtggacaagggcggggacatttttttggaccaactggcacggctaggcgtcatatcaaaagtttccacactggcaggtccttctagtgacgatgagaacgaagaggagagcaagcccgagaaggaagatgaaccacaggaggatgctaaggagctgcagcaggggaaaccctaccactggagagattggagcataataagaggaagggattgcctgtacatttggtctgatgcagccgccctagagctatcaaatggatccaacggctggttccgatttatactggatggaaagcttgctactatgtatagttccggtagcccagaaggcggttctgactcctcagagtcgagaagcgagttccttgagaagctgcagagagctcgcggacaggtgaaaccatcgacaagtagccagcctatactgagtgctcctgggcctactaagcttactgttgggaactggtccctgacttgtctgaaggagggagagatcgctattcataacagtgatgggcagcaggcaactatcctcaaggaagacctgccaggtttcgtgttcgaatctaatcgcggcaccaagcatagtttcaccgcggagacgagcctcgggagcgaattcgtcactggttggaccggtaagcgcggccgtaaactgaaatccaaactcgaaaaaaccaagcagaaagtaagaacaatggctcgcgatctgtatgacgaccacttcaaggcagttgaatctatgccccgaggggttgtagtcacgctgaggaatatcgctacccaactggagagtagctgggagttgcatacgaacaggcagtgtatcgaatctgaaaacacgtggagagatctcatgaaaaccgctttggagaatctgattgtgctgttgaaggatgaaaacacaattagcccatatgaaatgtgctcctctggattagtgcaggcattgctgactgtactcaacaatgtttcactgagttccagtaaggagcagaaatactcttttacgccttctgttgagattaacgtgttcaagaccgccttcagcgaaaacgaagacgacgagagcagaccagcggtggcacttatccggaaactgatcgcagttctggaaagcattgaacggctgcccttacacctgtatgatacacccggaagcacttacaatctccagattcttacacgacgactgagatttagactggagcgcgcacccggggaaacagccctgatcgatcgtaccgggcggatgctaaagatggagcccttggcaacagtagagtcccttgagcaatatttgctgaagatggtggcgaagcagtggtatgacttcgaccgaagcagtttcgtgttcgtgcggaaactccgggaggggcagaatttcatctttagacatcagcatgactttgatgagaatggaataatctattggattgggaccaacgctaagactgcctacgagtgggtcaacccagctgcatatggtttggtagttgtgaccagctcagaagggcgcaacctgccctatgggagactggaagatatcctttccagagataatagtgccctcaattgtcacagtaatgacgacaagaacgcgtggttcgccattgacctgggcctgtgggtgatcccaagcgcctatacgctccggcatgcacgcggatatgggcggtcagccctgaggaattgggtttttcaggtcagcaaggacggacagaactggactagtttatatacccatgtcgatgactgctctttaaatgagccagggtcaaccgctacatggcccctggacccccctaaggatgagaagcagggttggcggcacgtaaggatcaagcagatggggaaaaatgcctcagggcagactcactatctgtctctaagcgggtttgagctttacggcaccgtcaacggagtctgcgaggatcagcttgggaaggcggccaaggaagccgaggctaacctgcgtagacagaggcggttagtgcgaagtcaagtgctgaaatatatggtgccaggcgccagagttattcgggggctggactggaaatggcgagatcaagatggatcaccccagggggagggtacagtgactggagaactccataatggttggatcgacgtgacctgggatgcaggcgggagtaacagttacagaatgggagccgaagggaagtttgatctaaaacttgccccagggtatgaccctgacacggtggccagcccaaaaccagttagcagtacagtgtcagggaccacccagtcctggtcttccctggtaaaaaacaactgtccggataaaacgagcgctgcggccggaagttcctctcgcaagggaagctccagctcggtttgctcggttgcctccagttctgacatctcacttggaagcactaagactgagaggcgaagtgagatcgtgatggaacacagcatcgtgagcggcgctgatgtgcatgagccaatcgtggtgcttagttctgcggagaacgtgcctcagactgaggtggggagctctagttcggccagcacgagcactcttacagcagagacaggatccgagaacgcggaacggaagcttggacctgactcgtctgtcagaactcccggagagagcagtgccataagcatgggcatcgtgagcgtcagcagccctgacgtttctagcgtgagtgaactgacaaacaaggaagctgcctcccagaggcctctgtcttcaagcgcgagcaatcgcctgtccgtttcatctctcctcgccgccggcgcccccatgtccagctccgcctctgtgcctaatctgtcgtcacgcgagacaagcagcctggagagttttgttcggagggtcgcgaacatcgccaggactaacgccacaaataacatgaatttaagccgatcttctagtgacaataatactaatacgttgggccggaacgtaatgtccacagctacatccccacttatgggggcccagagttttcctaacctgactacccccggtacaactagtactgtcaccatgtctaccagttctgtgacaagctcctccaatgtggccacagcgacaacagtcctgtccgttgggcaatccttgagcaataccctgaccacatcattaacctcaacatccagcgaaagtgataccggacaggaggcggaatatagtctttatgactttctcgattcatgcagagcatcaacactcctcgctgaacttgacgacgacgaagaccttccagagcccgacgaagaggatgatgagaatgaggacgataatcaggaggatcaagagtacgaagaagtcatgatcctccgcagaccctctcttcagcgccgggcgggctctcgctcagatgtgacccatcacgctgtcaccagccagctaccccaagtccccgccggtgccggttctcggcccatcggggaacaggaggaagaggaatacgaaacaaaaggcggacgacgacgcacctgggacgatgattacgtactcaagcggcagttctctgccctggtccccgcctttgatccccggccaggccgcaccaacgtgcaacagaccactgatctggagatccctccaccaggcactcctcactctgagctcctggaggaggtggagtgtaccccttccccccgcctggctttgacactgaaggtgacgggtctgggcaccacccgcgaagtcgaactgcccttaactaatttcaggagcacaatcttctactacgttcagaagctgctccaactgagttgcaacggcaatgtaaaaagcgataagctccggcgaatttgggaacctacctacacaattatgtatcgagagatgaaagatagtgacaaggagaaggagaatgggaagatgggctgctggagtatagagcacgtggaacagtacctcgggacagacgagcttccaaagaatgacctgatcacctacttgcaaaaaaacgccgatgccgcattcctccgccattggaaactcacagggaccaacaaatctatccgaaagaatagaaactgttctcagcttattgcggcttataaggacttttgtgagcatggaactaagtcaggcttgaaccaaggagcaatcagcacactgcagagctcagacatacttaacctcactaaggaacaaccacaggccaaggcggggaatggacagaactcttgtggcgtcgaggacgtgctgcagctgttacggatactttacatcgttgccagtgacccctatagtagaatttcacaggaggacggcgacgagcaactccagtttaccttcccccctgacgaattcacttcaaagaaaatcacaactaaaatcctgcaacaaattgaagagcctctggcactcgcatcaggcgcactgcccgattggtgcgagcagcttactagcaaatgtcctttcctgatcccatttgaaactcgccagctgtattttacttgcaccgcttttggggcatctagagcaattgtttggctgcaaaaccggagagaagccaccgtggagagaaccagaacaactagctctgttcgccgggacgatccaggggagtttcgtgtgggcagactcaaacatgaacgggttaaagtcccacgtggtgaatccttgatggagtgggctgaaaatgttatgcagatacacgccgataggaagtcagtcctggaggttgagttcctgggagaggaaggtaccggcctgggtcccacgctggaattttacgccttggttgctgcggaatttcagcggaccgacctgggcgcatggctctgtgacgataattttcccgatgacgaatcgcgccatgtggacctgggcggaggactgaaaccgcccggatattacgtccagaggagctgcggtctgtttacagcccccttcccacaggatagtgatgagttggaaaggattacaaagctctttcattttctgggcatttttcttgcaaaatgcatccaggacaatcggctggtggacctgccaatatcaaagcctttcttcaaattaatgtgcatgggggacattaaatccaacatgtcaaagctgatctacgagtccaggggagatagagatctccactgcactgagagccagtcagaagctagcacagaagaaggtcacgatagcctaagcgtagggagcttcgaggaggatagtaagtccgagttcattctggacccaccgaaacccaagccgcctgcctggtttaacggaatccttacttgggaggacttcgagctggtcaatcctcatagagcgcgattcctgaaggaaattaaggacctcgctattaaacgtcggcagatactgtccaataagggcctgtctgaggacgagaagaatacaaagctgcaggaactggtgcttaagaatcccagcggctccggtccacccctctcaattgaggacctgggcctgaatttccagttttgccctagcagtcgaatctacggttttactgccgtcgatctgaagccaagcggtgaagatgagatgattaccatggataatgcagaggagtatgtcgacttaatgtttgacttttgtatgcacaccggcatccagaaacaaatggaggcctttcgcgacggattcaataaagtgttccctatggagaaactgtcctcgttctcacacgaagaggtacagatgatcctttgcggcaatcaatcacctagttgggccgccgaggacattattaattataccgagccaaagttaggatatacgagagatagccctggctttctgcgattcgtgagggtgctttgcggcatgtcatccgacgaaagaaaagccttccttcagttcacgactgggtgcagtaccttacctcctggaggcctggccaatctccatcccaggctgacggtggtgagaaaggtcgacgctaccgatgcttcatacccctcggttaatacctgtgtgcactacctgaagctgcctgaatactcctctgaagagattatgcgggaacggttgcttgctgctaccatggaaaaagggtttcatctcaattag

SEQ ID NO: 48009 - DNA, 516 bp, Artificial Sequence
  Description of Artificial Sequence: Synthetic coding sequence
aaggtgttcctgaaggccgtggccggcaactaccacatcttccggcataccgggatacagaaacagatggaagccttcagggacgggttcaataaggtgttcccaatggaaaagttgagttcttttagccacgaagaggtccaaatgatcctctgcggtaatcagagtccgtcttgggctgccgaggacattatcaactataccgaaccaaaactgggatacacccgcgactcccctggctttctgagatttgtgagggtgctgtgtggcatgagtagcgatgagaggaaggcattcctgcagtttactactggctgtagcacgctgccccctggtggactggctaacctacaccctagactcactgtcgtgcgcaaggtcgacgctacggatgcgagctatccttctgtgaacacttgtgttcattacttaaagttacccgaatactcctctgaagagatcatgcgcgaacgcctgctggctgcaactatggagaagggtttccatttgaattag

SEQ ID NO: 48010 - DNA, 7833 bp, Artificial Sequence
  Description of Artificial Sequence: Synthetic coding sequence
atggccgacgtggaccccgacaccctgctggagtggctgcagatggggcagggggacgaacgcgatatgcaactcattgcgctggaacagttgtgcatgctgctgttaatgtctgataatgtggatagatgtttcgaaacatgccccccgcgcacatttctccctgccttatgtaaaatcttcctggacgaatcagcacctgacaacgtattggaggtcacggcccgcgccatcacttactacctggacgtctccgctgagtgcacccggcggatcgttggagtcgacggtgccataaaggccctgtgcaaccgtctcgtggtggtggaactaaacaataggaccagtagagacctggcagaacagtgcgtgaaagtgttggagctgatatgtacacgggagagtggcgcagtatttgaggccggcgggctcaattgcgttctgacatttatccgagactcaggtcatctagtgcacaaagatacactgcactccgcgatggctgtcgtgtcgcgcctgtgtggaaagatggagcctcaagactcgtccctggagatctgtgtcgagtcgctgtctagtctgctcaagcacgaggaccaccaggtctctgatggggccctgcgatgttttgccagtctggcagatagatttacccgcagaggcgtcgatccagcacccctggctaagcacgggctgacggaagagctccttagtagaatggccgctgcaggcggtacagtgtctggaccaagcagcgcttgtaagcctggacgctcaacaacaggggctccctcaacaaccgcagacagtaaactcagtaaccaggtgagcacgatcgtgagtctgttatctactctgtgccgggggtcacccgtagtgacacatgatcttctgcgcagcgaactgccagactccatcgaatccgctctgcagggagacgagcgctgtgtgctggacactatgcgtctggttgatctcctcctcgttttgctgtttgagggacgtaaggcccttcctaaatcctcagctgggtccacaggtcgtataccaggccttaggcgtctcgactcctccggcgagcggagtcacagacagctgatcgattgtatcagaagcaaggatacagatgctctcatcgacgcaatcgatacaggggctttcgaggtgaattttatggacgacgtgggtcagacactcttgaactgggcttctgcgttcggtactcaggaaatggtggagtttttatgcgaacgcggcgctgacgtcaacagagggcagcgctcatctagccttcactatgccgcctgcttcgggagaccgcaggtcgctaaaactctactgaggcacggcgccaacccggacttgcgggacgaggacggcaaaactcctctggataaagcacgagaaagagggcactcagaggttgtggccattttgcagtcccctggggactggatgtgtcccgtgaataaaggagacgacaaaaaaaaaaaggatactaacaaggacgaagaggaatgtaatgaacctaaaggcgaccccgaaatggctcctatctacctgaagcggttacttcctgtgtttgcacaaacctttcagcagactatgctgccctccatacgcaaggcctctctggcactaataaggaagatgatccacttctgttctgaagcactacttaaggaagtctgcgactctgatgtgggccacaatctcccgactatattagtagagatcaccgcgaccgtgttagatcaggaagatgatgatgatggccacttgcttgcactgcaaattataagggacctggtggacaaaggcggggacatttttctcgaccagctagcccgccttggggtgattagtaaggtttcaacacttgctggacctagttctgacgacgaaaatgaagaggagagtaagcctgagaaagaggacgaacctcaggaagacgctaaagagctgcagcagggtaagccgtatcattggagagattggtcaattatccgcgggagagactgcctgtacatctggtcggatgctgcggctttagaactcagcaacgggtctaacggttggttccgttttatactggatggtaaactggcaacaatgtactcttctggaagcccagagggaggaagtgacagctcagagtcccgtagtgagtttctcgaaaagttacagagggctcgaggccaggtgaaaccctctacaagctctcagccaatactcagtgcccctgggcccaccaagcttacggtgggtaactggtcacttacatgcctgaaggagggtgagattgccattcacaactcagatgggcaacaggcaacaattctgaaagaggacctacccggctttgtatttgagtccaacagaggcacaaagcacagcttcactgctgaaacatcacttggttcagagttcgttacgggttggaccggcaagcgggggcgaaagcttaagagcaagctagagaaaaccaagcagaaggtacgcacaatggcaagagacctttacgatgatcactttaaagctgtagaatctatgccaagaggagttgttgtgacactgagaaatattgccactcagctggaaagctcctgggaactccatacaaatcggcagtgcatagaatcggagaacacctggagagatctaatgaagacagcgctggaaaaccttatagtactgttgaaggacgaaaatacaatttccccgtacgagatgtgctctagcggccttgtccaggccttgctgactgtgctgaacaattcaatggatcttgacatgaagcaggattgcagccagctagttgaacgaatcaacgttttcaagactgccttttctgagaatgaggatgacgagagccggccagccgtcgcacttatcagaaaactcatagctgtgctagaatccatcgaacgcctgcccctgcacctgtacgacactcctggcagtacatataatctacaaatcctgaccagaagacttaggtttagactcgaacgcgcgccaggtgaaactgcactcatcgacaggaccgggaggatgctgaaaatggagccgctggcaactgtggaatcactagaacagtacttactcaagatggtagctaaacagtggtatgacttcgaccgttcctctttcgtcttcgtgcgcaagctgcgagaaggtcaaaactttatattccgccaccagcacgattttgatgaaaatggtataatctactggattgggactaatgccaagactgcctatgagtgggttaaccctgccgcctacggcttggtggtcgtgacttcctctgaaggacggaacctgccatatggccgcctggaggacatattgtccagggacaactctgcattaaattgccacagcaacgacgataagaacgcctggtttgccatcgatctaggcttgtgggtaataccttcggcatatacactgaggcacgcacggggctatgggcggagtgcactccgtaattgggtcttccaggttagcaaggatggccaaaactggacatctctctacactcacgtcgatgactgctctctgaacgagccgggttccacagctacgtggcccttggatccccctaaagatgagaagcagggttggaggcacgtgaggatcaaacagatgggcaagaatgccagcggccagacccactacctttcactgtccgggtttgaactgtacggtaccgtgaatggggtgtgtgaggaccagcttggaaaagcagccaaggaagccgaagctaacttacgccgacaacgaaggttagtgaggtctcaggtgctcaagtacatggttcccggagcccgagtgatacgcggactggattggaagtggcgagaccaggacgggtctccacagggggaagggacagttaccggtgagctccacaatggatggatcgatgtaacatgggatgcgggcgggtcaaacagttaccgcatgggagctgagggaaaatttgacctgaagttggcacctggctacgaccccgatacggtcgctagccccaaacccgttagctctacggtgtctgggactacacagagctggtcgagcctggtgaagaacaactgtccagataagacatcggctgccgctgggagcagctctcgaaagggttcaagcagctcagtctgctccgtcgcctcaagcagcgacattagtctgggcagtacaaagactgagaggaggtctgagatcgtcatggaacatagcatcgtatctggggcagacgttcatgagccaattgtggtgttatcaagcgcagagaacgtaccccaaacggaagtagggtccagtagctccgcctctacttccaccctcacggccgaaaccggaagcgaaaacgccgagaggaagctgggcccagattcctctgtgcggaccccaggagagagttcggcaatctccatgggcattgtaagcgttagtagtcccgatgtctcttccgtctcagaattgactaacaaagaggccgcctcacagcgtcctctatcttcatcagcaagtaatcgactgtccgtctccagcctcctagccgctggtgcccctatgagtagcagtgcctcggtgccaaatctaagtagtcgcgaaacctcatccctggaatctttcgtgaggagggtggcgaatatcgccagaactaacgcaacaaacaacatgaatctctcccgtagcagctcagacaacaatacaaacacgctgggccgcaacgttatgagtaccgccacctccccgctcatgggagcgcaaagcttcccaaacctcaccacacccggcactacctctaccgtcacgatgtctacctcttccgttacaagttcctccaacgtggccaccgcaaccaccgttttatcagtaggacagtcccttagcaacacattaacgacttctttgacatccacttcctcagaaagcgacacaggccaggaggcagagtacagcttatatgactttctcgatagctgtagagccagtactctgctcgctgagctggacgacgacgaagatttaccggagccggacgaggaagatgatgagaatgaggatgacaatcaggaggatcaggagtatgaggaagtgatgatcctgcgccggccatccctgcagcgtcgggccgggtcgcgaagcgacgtcacccatcacgcggtcacgagccagctgccacaggtcccggccggcgccgggagtagaccaattggcgagcaggaggaggaggagtatgagacaaaagggggtagaaggagaacatgggacgacgactatgtgctgaaaaggcagttctctgccctggtgccggcatttgaccccaggcctgggagaacaaacgtacagcagacaaccgatctggagatcccgcccccgggaacccctcatagcgaactcctggaggaagtggagtgcacgcctagtcctcggctggcactgactcttaaggtgaccggactcggcaccacccgcgaggtggaattgccactcactaacttcagatcaaccatcttctattacgtccagaagctgttgcaactctcctgtaacggaaacgtgaagtccgacaagcttaggcgaatttgggagccgacgtatacaattatgtatagggagatgaaggactcagataaagagaaagagaacggaaaaatgggttgttggtctatagaacacgttgagcaatatctggggactgacgaactcccaaagaatgatctgataacttatctacagaagaatgccgatgctgccttccttcgacactggaagctcacaggcaccaacaagtcgatcagaaagaaccgtaactgctcgcagctgattgcagcttacaaagacttctgcgaacacggtaccaaaagcggacttaatcagggagcaatcagtacactgcaatcctctgatattctgaacctaacaaaggaacagccccaagccaaggccggcaatggccagaactcttgcggcgtagaagatgtactgcagctgctgaggattttatatatcgtggcaagcgacccttattcacggataagtcaagaggacggggacgagcagcttcagttcactttccctccggacgaatttacaagcaagaagattacaacaaaaatcctgcaacagattgaagagccactggccctggcatccggtgccctgcctgattggtgcgagcaactgacctccaaatgcccattccttattccttttgagacaagacagctgtatttcacctgcaccgctttcggcgcttccagagctatcgtgtggttgcagaacagaagggaagctactgtagagcgaaccaggactacttcctcagtaagaagagacgaccctggagagtttcgcgtcggacgcctgaaacacgagagggttaaagtccctaggggggagagcctgatggagtgggccgaaaacgtgatgcagattcacgcagatcgaaagagcgttctggaggtcgagtttctaggagaggaagggacaggtctgggacctacactggaattctacgctttggtggctgccgagttccaacgaactgatctcggggcctggctctgcgacgacaatttccccgacgacgagtcaaggcacgtggaccttggaggcggtctgaagcccccaggctactatgttcagcggagctgcggactgtttactgcgccattcccacaggatagcgacgaacttgaacgaatcaccaaacttttccacttccttggaatctttctcgccaagtgcatccaggacaataggttagtggatctacccatcagcaaaccgttctttaagcttatgtgcatgggggatataaaatcgaatatgtccaagctcatttatgagtcaagaggagacagagacctgcattgcacagagtcccagtccgaggcctctacagaggaaggacatgactccttgtccgttggttctttcgaggaagattcaaagtctgaattcattttggacccacccaagcccaaaccgccagcttggttcaacggaattctgacttgggaggactttgagctggtgaaccctcaccgtgcccggtttttgaaagagattaaagatctggctatcaagcgccggcagatcctatcaaataagggccttagtgaggacgaaaaaaatacaaagctccaggagctggtcctcaaaaatccgagcgggtcgggtccacccctgagtatcgaggacttgggtttaaatttccagttctgccctagctctcgcatttatggtttcactgccgtggacctgaagccatctggagaagacgaaatgatcacgatggataatgcagaagagtacgttgatttgatgtttgacttttgcatgcataccggcatccagaagcagatggaggcatttcgggatgggttcaataaggtttttccgatggagaagttaagcagtttcagccatgaagaagttcagatgattctgtgtggaaaccagagcccttcatgggctgccgaggacattattaactacaccgaacctaagttggggtacactcgagacagtcccgggtttcttagattcgtgagagtgctgtgtgggatgagctccgatgaaaggaaagcgttcctccagtttacaacgggttgctctacccttccacccggcggactggctaacctccacccgagacttacagtggtgagaaaggtggatgccacagacgcttcctatccaagcgtcaatacttgtgtgcattacctgaaactgccagagtattcttccgaggagattatgagagaaagactcctggcagcgacgatggagaaaggctttcatctgaactag

SEQ ID NO: 48011 - DNA, 7833 bp, Artificial Sequence
  Description of Artificial Sequence: Synthetic coding sequence
atggccgacgtggaccccgacaccctgctggagtggctgcagatgggccaaggcgacgaacgagacatgcagctgattgctctggaacagctgtgtatgttgctgctgatgagcgacaacgtcgatcgttgcttcgagacatgccccccgaggacattcctacccgctctatgcaagattttcctggacgagtccgccccagataacgtgctggaagttaccgcacgggcaattacgtactatttggacgtgtctgctgagtgcacaaggcgcatcgtgggagtggatggagccattaaggctctgtgcaacagacttgtcgttgtagagctgaataaccggacgagtagggacctggccgaacagtgtgtgaaggtgctcgagttgatctgtaccagggaaagcggtgccgttttcgaggcggggggtctgaactgtgtattgacattcataagggacagcggccatctggtgcacaaggacacactgcacagcgctatggcagtggtatctcggctctgcggtaagatggagcctcaggacagcagcctggagatctgtgtggagagtttgtccagtctgctcaaacacgaggaccaccaggtctccgacggcgctctaaggtgttttgcttcccttgcagaccgctttacccggaggggtgttgaccccgctcccctcgccaagcatggtctcactgaggagctcctgagccgaatggcagccgcaggaggaacagtgtccggaccatcatcggcctgtaagccagggcggtctacgaccggggcaccttctaccactgcagattccaagctttctaatcaggtgagcaccatagtgtccctgctcagcaccctttgtcggggctctcctgtggtgacccacgacctgctgcgatcggagttacccgactcaattgagtcagcactgcaaggggacgaacgatgcgttcttgacaccatgcggctggttgacttactgctcgtcctcttgttcgaaggcagaaaggctttacctaagtcttcggctgggtcaacgggaagaattcctgggctgcggcggttggatagtagcggggaacgcagccaccgccagctcatagattgtattcggtccaaggatacagacgcccttattgacgccatcgacacgggcgcattcgaggtaaacttcatggacgatgtggggcagactctgttgaattgggcgtctgccttcggaacacaggaaatggtggagtttctgtgtgagagaggcgcggatgtcaataggggccaacgctcaagcagccttcactacgcagcatgcttcgggagaccacaagtggccaagaccttgctgagacatggtgcgaatcccgacctccgggatgaagacggaaagactcctctggataaggccagagagcgtggacacagtgaggtcgtggccatcctccaatcacccggagattggatgtgtcccgtgaacaaaggtgatgataagaagaaaaaggataccaataaggatgaggaggagtgtaacgaacctaaaggcgacccagagatggccccaatttatctcaaacgcctgcttccggtctttgcccaaacttttcagcagaccatgctgccttccatcagaaaggctagtcttgcactgattagaaagatgattcacttctgtagtgaggccctgttaaaggaggtttgtgattctgatgtcggccacaatttgcccactatcctcgtcgaaataacggctacggtgttagatcaggaggatgacgacgacggccacctgttggctctgcagattatcagagacttggtggacaagggtggggatatcttcctggatcaactagccagattgggggtgataagcaaagtgtcaacacttgccggccctagctcagatgacgaaaacgaagaggaatcaaagccggagaaagaggatgagccccaggaggacgccaaagagttgcagcaaggaaaaccatatcactggagggattggagcatcattcgtgggagagactgtctgtacatctggagtgacgcggctgcattggaactgtctaacggcagcaatggctggttcaggttcatcttagacggaaagctggctacgatgtattcctctgggagtcctgaaggaggctcggattccagcgagtcacgctctgagtttcttgagaaactacagagggcccggggacaagtgaaaccaagcacaagcagccagccaatactatctgctcctggcccaacaaagctgacagtgggaaactggtctttgacctgccttaaagagggggagatcgctattcacaactccgatggccagcaggctaccatcctgaaggaggacctccccgggtttgtctttgaaagcaaccgaggaacaaaacattcgtttactgccgagaccagcctcggcagcgaatttgtgactggatggacgggtaagagaggcaggaaactcaaatccaaacttgaaaaaaccaagcaaaaagtgcggaccatggccagagatctgtatgatgaccattttaaggcggtcgaaagtatgcccaggggagtggtcgtaactctccgcaacattgctacgcagctggagtcttcgtgggagttgcatacaaatagacagtgtattgaatctgaaaatacctggagagaccttatgaagactgctctggagaatcttatcgtgctgctgaaagacgaaaatacaatcagtccgtatgagatgtgtagcagcggactagtgcaagccctactgaccgtcctgaacaactctatggatctggacatgaagcaagactgtagccagctggtggagcggatcaacgtgttcaaaaccgctttctctgagaacgaagatgatgaatcacgtcccgccgtcgctctgatcagaaagctgatcgccgtgttagaatccatcgagagattacctctccacctctacgatacaccgggatccacgtataacctgcagatcctaaccaggcggctacggtttcggctggaacgagcacctggtgagacagccctcatcgaccggactggtaggatgctgaagatggagcccctggcaacggttgaatccctggagcagtacttgcttaaaatggtggctaaacaatggtatgacttcgacagaagtagcttcgtctttgtacggaagttgagagaaggccagaactttattttccggcaccagcacgatttcgacgaaaatggaatcatttactggatcggtactaacgccaagaccgcctatgagtgggtgaatcccgcagcctatgggttagttgtggtgaccagttctgaaggccgcaacctcccgtatgggcggctggaggatatcctcagtcgggataactcagctttgaactgtcatagcaacgacgacaagaatgcatggtttgccatcgatctgggtttgtgggtaattccctcggcgtacacacttcgacacgccagggggtacggaaggagcgcacttcgtaactgggtgtttcaggttagtaaggatggccaaaactggacgtcattgtacacccacgttgatgactgtagcctgaatgaacccgggagcaccgccacctggccgctggacccccctaaggacgaaaagcagggttggcggcacgtacgcatcaagcagatggggaaaaatgcgagtggccagacacattatttgtcgttgtctggctttgaactttatgggacggtgaacggcgtctgtgaggatcagctgggtaaggctgccaaggaggcagaggccaatttacgaagacagagaaggctggtccggtcccaggtgctcaagtatatggtgcccggggccagagtaatccgaggtttagactggaaatggagggatcaggacgggtctcctcagggggaaggcaccgtcaccggcgagttacacaacggatggattgatgttacatgggatgccggcggatctaattcttacaggatgggcgcagaggggaagttcgatctaaagttagcccctggctacgatccggatacggttgcttctcccaagcctgtgagttccacagtgagcggcacgacccaaagctggagctcgctggtgaagaataactgtccggataaaactagtgctgctgccgggtcctctagccggaaaggatcctcctcctccgtgtgctcagtggcttcaagttctgatattagtttaggcagtacaaagaccgaacgcagaagcgaaatcgttatggaacatagcatagttagcggggccgacgttcacgagcctattgttgtgctgtcgagcgccgagaatgtaccacagactgaagtaggtagcagttcgtcagccagcacctccactctgaccgctgagaccggcagtgagaacgccgagcgtaagctcggacccgactcttctgtgcgcactcctggggagagctctgccatcagcatgggtatagtgtctgtctctagcccagatgtgagtagtgtttccgaattgaccaacaaggaagcagcttcccagaggccccttagttcttcagcaagcaatcgcctgagcgtctcctctctcttggcggcaggcgccccaatgtcatcttccgccagcgtccctaatctgtcttcaagagagacatcatccctggagtcttttgtcagacgtgtggccaatatcgctcgaacaaatgccaccaacaacatgaacttatcacggagttcctcagataacaacacgaacaccctggggcgcaatgttatgtcgaccgccacctctcccctaatgggcgcccaaagtttccctaatcttaccacacccggtaccacgtcaacagtaacgatgagtacatctagtgtgacctcaagttccaatgtggcaaccgctacaaccgtactaagtgtggggcaaagtcttagcaatacgctgaccacttccctcacatccacttcttccgagagtgataccggacaagaagcagaatattctctctatgacttccttgactcttgcagagcaagcactctgctggcagagctggacgacgatgaagacctccccgaaccggacgaagaagacgacgaaaacgaggacgataaccaggaggatcaagagtatgaggaagttatgatcctccgcaggcctagcctgcagcgcagagcaggcagccgaagtgatgtcacgcatcacgccgtgactagtcagctcccccaggtccctgcaggcgctggctccaggcccattggagagcaggaggaggaggagtacgagacgaaggggggtcggcgaaggacctgggatgacgactacgttttgaagcggcagttctccgcattagtccctgcttttgacccgaggcccggccggacaaacgtgcagcagactactgacttggaaatacccccgcctggtactccccatagcgagttactagaagaagtagagtgcaccccatcccctagactagccctgactctgaaagtgacagggctaggaactacacgggaagtggagctccctcttacaaattttagatctactatattctactatgtgcagaaactgctgcaacttagctgcaatggcaacgtcaagagcgacaaattgaggagaatctgggagccgacctacacaattatgtatagggaaatgaaggattcagataaggagaaggagaatggcaagatgggctgctggtcaatagagcatgtcgagcagtacctaggcactgatgagttgcccaagaatgaccttattacctacctacagaagaacgccgatgctgcttttctccgccactggaagctaacaggaacaaataaatccatacgcaaaaatagaaattgttctcagttgatcgcggcttacaaggacttctgcgagcacgggaccaagagtggactgaaccaaggagctataagcaccctccaatcttctgatatactgaaccttacaaaagaacaaccccaggcaaaggccggcaatggacagaattcatgcggagttgaggacgtgttgcagctgctccgcatactgtatattgtggcaagtgacccctattcaagaatatctcaggaagatggagatgagcagttgcagttcactttcccccccgacgagtttaccagcaagaagatcaccacaaaaatccttcagcagatagaggagcccctggctctggcaagcggggctctgccggactggtgtgaacagctcactagcaagtgtcccttcctgatcccgtttgagacccggcagctatacttcacgtgtacggctttcggcgccagccgcgcgatcgtctggctgcagaatagaagagaggccactgttgagcggacccgcactacatcttcagtacgaagggacgaccccggggagttccgggtcggcagactgaagcatgagcgggttaaagttccccgcggggaaagccttatggagtgggccgagaacgttatgcaaattcacgccgatagaaaaagtgtgttggaagtggagtttttaggagaggaaggaacagggctagggccgacattggagttttacgccttggtggctgctgagtttcagcgtacggacctgggcgcttggctatgcgatgataatttccccgatgacgagtcccggcatgtggatctgggtgggggtttaaagcctcccggctattacgtacagagatcgtgtggactctttacagcacctttccctcaggactccgatgaactggagcgaattaccaaactcttccattttttgggaatttttctggccaaatgtatccaggataaccggctggtggacttgcctattagcaagccgttttttaagctgatgtgcatgggagatattaaaagcaatatgtcaaagctaatctacgaatcaagaggagatagagacctgcattgcaccgagtcacagtcagaggcaagcaccgaggagggccacgactctctgtctgtgggatctttcgaagaagactctaaatccgaattcattttggacccgcccaagcctaagccgccagcctggtttaatggcatccttacatgggaagactttgagctagtgaatcctcaccgggcgaggttcctgaaggaaatcaaagacctcgctattaaacggagacagatcctctccaacaaaggcctgtcagaagatgagaaaaacaccaagcttcaggagctggttctgaagaacccctctggctccgggccccccctgagcatagaagatttggggttgaattttcagttctgccccagttcaaggatctacggatttactgccgtggatctgaaacccagcggagaggacgagatgattacgatggacaatgcagaggaatacgtggacctgatgtttgatttttgcatgcatacgggtatacaaaagcagatggaggcctttagggacggcttcaacaaagtctttcctatggagaaactgtccagtttttcacacgaagaggtacagatgatcctgtgcggcaaccagagcccttcttgggctgccgaagacataattaattacacagagcctaagctcggctacacgagagactcacctgggtttctgaggttcgtgagggtactgtgcggaatgtcatccgatgagcgcaaagcattccttcagtttaccacgggatgctcaaccctcccacctggcggtctggcgaacctacacccccggttgacagtcgtgagaaaggtggacgccaccgacgcttcctacccatcagtgaatacctgtgtgcactacctgaagctgcctgagtactcctccgaagaaatcatgagggaaaggttgcttgctgctaccatggagaaggggtttcacttaaactag

SEQ ID NO: 48012 - DNA, 2781 bp, Artificial Sequence
  Description of Artificial Sequence: Synthetic coding sequence
atggccgacgtggaccccgacaccctgctggagtggctgcagatgggccagggagacgagcgtgacatgcagcttattgccctcgagcagctgtgtatgttgcttctgatgtccgataacgttgatcggtgttttgaaacttgtccaccgcggactttcttgcctgctctgtgcaaaatcttccttgatgaatcagcccctgacaacgtcctggaggtgaccgcaagggctattacctactatctggacgtctccgccgaatgcacaagacgaattgtgggtgtcgacggcgctattaaagcactgtgtaatagactcgtcgttgtggagctgaataacaggacctctagagatctggccgagcagtgcgtgaaagtactggagctgatttgcacaagggagagcggcgccgtgttcgaggccggtggactgaattgcgtactcaccttcattagagactccggccatctagtccacaaggacactctccattccgcaatggcagtggtgtcgcgcctctgtggcaaaatggagccccaggatagttccctggagatctgcgtggaatccctgtcgagcctcctaaagcacgaagatcaccaggtgagtgacggcgccctgagatgttttgcttccttggcggaccggttcacccgccggggcgtggatcccgcaccgttggctaagcatggcttaaccgaagagttgctgtctagaatggccgcggccggcgggaccgttagcggacccagctccgcatgcaaacctgggcgaagcactaccggggcgccttccaccaccgcagacagcaagttgagcaatcaggtctcgacaatcgttagcctcctgtcgactctctgcaggggaagcccagtggtaactcatgatcttctgcgttctgagctgcctgactccattgagagtgctctccagggcgatgaaaggtgcgtgttggacaccatgagactggtggacctgctgctagtgctgttgttcgagggccgcaaagccctccccaagagctcagctgggtccaccggaagaatacccgggcttaggagattggatagctccggagagcggtcccaccgccagctaatcgattgtattcggtccaaggatacggacgcgcttatcgatgcgattgacaccggcgcatttgaggtgaacttcatggatgatgtaggacagacactgctcaattgggctagcgcgtttggtacacaggaaatggtagagtttctttgcgaaagaggcgccgacgtgaaccgaggtcaaaggagtagcagcctgcattacgctgcttgcttcggccggccccaggtcgccaaaacccttctcaggcatggggccaatcctgatctacgggatgaggacggtaaaacccctctcgacaaggccagggagagaggacatagtgaagtcgtggccatcctgcaaagcccaggggactggatgtgtccagttaacaaaggcgacgataagaagaaaaaggataccaacaaagatgaggaagagtgtaatgagccaaagggggatcctgaaatggctccaatttaccttaagcggctcctgcctgttttcgcacagactttccagcagactatgctgccaagcatcagaaaggcatctctggccctgatccgaaaaatgattcatttttgtagtgaggccctcttgaaagaggtctgtgatagcgacgtcggacataatctccccactatcttggtggaaataacagcaactgtgttggaccaggaggacgacgacgatggacacctgctagcattgcagataatccgcgacttggtcgataaaggaggcgacatcttcttggaccaacttgcccgtttgggcgtgatatcaaaagtgagcactctagccggccctagtagcgacgacgagaatgaagaagagtcaaagccggagaaggaggatgagcctcaagaggacgccaaggaactccaacaaggtaaaccctatcactggcgagactggtcaatcattcgtggacgggattgcttgtatatctggagcgacgcggcagcgctcgagctgtccaacggttctaacgggtggttcagatttattcttgacggtaagctggcgacaatgtacagctcaggcagtcctgagggaggatccgactctagcgaatctcgctcggagtttctggagaagctgcagagagctagggggcaagtgaagcctagcacatcttcccaacccatcttatccgcacctggccccaccaaactgactgtggggaattggagccttacctgcctgaaggaaggtgagattgccattcataatagtgacggccaacaagcaactatcctcaaggaggacctgccaggattcgtcttcgaatccaaccgtggtacgaagcactcttttactgccgaaacctccctgggctctgaattcgtaacggggtggacagggaaacggggacgcaaactgaagtcaaagctggagaaaaccaaacagaaggtccgtactatggcgcgggatctgtacgacgatcacttcaaggccgtggaatccatgcctcggggagttgtggttaccctaaggaatatcgccacccagctggagagtagctgggaactccacacgaatcggcagtgtattgagagcgaaaatacatggcgcgacttgatgaagacagctctcgaaaacctgatcgtccttcttaaagatgagaacaccatcagcccatacgaaatgtgctcatccggtctggtccaggccctgctgactgtgttaaacaattag

SEQ ID NO: 48013 - DNA, 2331 bp, Artificial Sequence
  Description of Artificial Sequence: Synthetic coding sequence
atgagcgaggccgtgcgggtgcccagccccgccacccccctggtggttgccgctcctgcgcccgaggaacgtaaaggtaaagagagtgagcgcgagaagttgccgcccattgtgtcagcaggcgctggggccaccgcagggcttgacaggggcgccaagggtcagattagcacttttagtagttttattagtgcagtgtcccccaagaaggaagcggctgagaatcggagctcacctgcacatcttgtattccccaatataaagaacgtgcgggagccaccgccaatttgtcttgacgtccggcaaaaacagagaacctcaatggatgcatcctccagcgaaatgaaggcgccagtcctcccggagccaatccttcctattcagccgaaaacagtgaaagacttccaggaagacgtggagaaagtgaaatcaagcggggactggaaggcagtccacgacttctatctgaccacttttgactccttcccagagctgaacgcagcgttcaagaaggacgccacagcctcttttaacacaatcgaggactccggaatcaatgctaagtttgtcaatgcagtgtatgacacattgctaaacacacctcaagacgtgcagaagacggtgctgaaagggatcatcaatagcttgctgcgggaatggaaggggcctagaactaaggacgacctgagggcatactttatcctgttgcaaaacccacagttcaataatacctctacgtacgtcatttacgcccacctgctccgccagattgccacgcttgttgaggccgatcaccacttcctggttcactggttcaaaaaactcagccagaagcgctttaagcagcttgtagagagactgctgcagtttatatcactgagactgttcccggcaaaacccgaggaattcccccctattaccaagtgttcctggtggataccctccgccgctaaggtgctggccctgctcaacactgcaaacaacctggtacatcctcctctaataccctacaccgatttttataatagcactctcgatcatatcgatctgatggaagagtatcatacctggcagaatttcggaaacagccataggttttcattctgtcaatacccttttgttatctctgtagcagccaagaaaatcatcatccagcgcgactccgagcagcagatgataaatattgctagacagagcctcgtggataaggtgtcaagacggcagagaccagacatgaatattctgtttctgaatatgaaagtgcggaggactcacttagtgtccgactcactcgacgagctaacgcggaaaagggctgatttaaagaagaagctcaaagtgacctttgtgggtgaagccggcctagatatggggggtttgacaaaggaatggtttctcctactgatccgccagatcttccatccggattatggaatgtttacttaccataaagactcccactgccattggttctccagcttcaaatgtgacaactactctgagttccggctagtgggcattctgatgggactggccgtgtacaactccattacactggacatccgcttccctccctgttgctacaagaaactgctgagtcctccaattattccaagcgaccagaatataccagtggggatttgcaacgtaaccgttgacgacctgtgccagataatgccagagctggctcacggcttgtcagaactactttcacatgaaggcaacgtagaggaagacttttactcaactttccaagtcttccaggaggaattcggcattataaaaagctacaatcttaaacctgggggggacaaaataagtgtgacaaatcagaatcggaaggaatatgttcagctgtacaccgacttccttctcaataagtccatctacaaacagtttgcagccttttattacggatttcactctgtatgtgctagtaatgcacttatgctgctgcgtccagaagaagttgagattctggtgtgtggcagtccagacttagacatgcacgcacttcagaggtctactcaatatgacgggtatgccaaaactgaccttacaatcaagtacttctgggacgtcgtgctgggctttcccctcgacttgcagaagaaattactgcacttcacaaccgggtcagatcgcgtgcctgtgggggggatggcggacctaaatttcaaaatcagcaagaatgaaacatcaaccaactgcctgcctgttgctcacacatgctttaaccagttgtgtcttcccccttacaaaagtaaaaaggacctcaaacaaaaactcatcatcggcataagtaattctgaggggtttggattggagtag

SEQ ID NO: 48014 - DNA, 1281 bp, Artificial Sequence
  Description of Artificial Sequence: Synthetic coding sequence
atggaggagtaccacacctggcagaacttcggcaacagccaccggtttagcttttgccagtacccatttgtcataagcgttgccgcaaagaagataataatccagcgcgatagcgaacagcagatgataaatattgcacggcagtctctggtggacaaagtgtctcgacggcagagacctgacatgaacatcctgtttttgaacatgaaagtgagacgtacgcacttagtaagtgactctctggacgagttgactcggaagcgcgccgacctgaaaaaaaaactgaaggttactttcgtcggcgaggctgggctcgacatgggtgggctgactaaggagtggttccttttgctgatcagacagatatttcatcctgattacgggatgttcacctaccataaggactcacactgccactggttctctagtttcaagtgtgataattactcagaatttagacttgtgggaatcctcatgggcctggcagtgtataactctattacgctggatattcggtttcccccgtgctgctataaaaagcttctgagcccccccattatacctagcgaccagaatatccctgtcggaatctgcaacgtaacggtcgacgacctctgtcagattatgcccgaactggctcatggcctttccgaattgctcagccacgagggaaacgtcgaagaagacttctatagtacgtttcaggtctttcaggaggagtttggaataattaagtcatacaatttaaagcctggtggcgacaagatttcagtgacaaaccagaatcgcaaggaatatgtgcaactgtacaccgacttcctgctcaacaagtcgatctacaagcagttcgctgctttttattacggtttccattccgtatgtgcgtccaatgcactaatgctgctcaggccagaggaggtcgaaatcctggtttgtggatctccagacttagatatgcatgccctgcaaagaagtacccagtacgatgggtacgctaaaacagatctgactattaagtacttctgggacgtggtactgggattcccgttagacttacaaaaaaaactgctgcactttaccaccggaagcgaccgcgtgccggtgggaggaatggctgacctcaacttcaagatcagtaaaaatgaaacatcaactaattgtctcccggtagcgcatacttgtttcaaccaactgtgtctgcccccttataaatccaagaaggacctgaaacagaagctcattataggcatctccaactccgagggctttgggctcgagtag

SEQ ID NO: 48015 - DNA, 444 bp, Artificial Sequence
  Description of Artificial Sequence: Synthetic coding sequence
ctgagccagaagcggttcaagcagctggtggagcggctgctgcagtttatcagtttgcggctgtttccagccaaaccagaagaattccccccaattacgaaatgcagctggtggattccaagtgcggctaaggtgctggcactcctgaatactgccaataatctggtccatccacccctaattccatacaccgacttttacaatagcacactcgaccacatcgatctcatggaagagtatcacacgtggcagaacttcgggaactcccacagaatggccgtgcgcatcaaacgcaattacacgcataccatcatactatacatggtaaagcacaatcctaaggttatgttctacatcgccacccggggaacgctggactcactgagcataatccttctcaaaatacaccactttgctttctcttttttccaccttttatcatag

SEQ ID NO: 48016 - DNA, 624 bp, Artificial Sequence
  Description of Artificial Sequence: Synthetic coding sequence
atgagcgaggccgtgcgggtgcccagccccgccacccccctggtggttgccgcccccgctcccgaggaacggaagggcaaggagtcagagcgtgagaaactcccgccaatcgtaagtgccggtgctggtgctacagcagggctggaccggggcgctaagggccaaatctccaccttttctagctttatcagtgcggtgtctcctaaaaaggaggctgcggagaataggtctagccctgcccatctcgtattcccgaatataaagaacgtcagagagccaccgcctatctgtcttgacgtccggcagaaacagagaaccagcatggacgcttcatcatcagagatgaaagcgcctgtcttaccggagccaatcctccccattcagcctaaaaccgtcaaagactttcaagaggacgtcgaaaaagtcaagtcgagcggggattggaaagcagtccacgacttttaccttaccacctttgactcgtttcccgagctcaacgccgcgttcaaaaaagacgcaaccgcttcctttaacacgatcgaggacagcggtataaacgccaaattcgtaaatgccgtctacgacacactgcttaacaccgtctccatcatgacctgcaagtag

SEQ ID NO: 48017 - DNA, 2343 bp, Artificial Sequence
  Description of Artificial Sequence: Synthetic coding sequence
atgagcgaggccgtgcgggtgcccagccccgccacccccctggtggtcgccgcccctgcccccgaggagaggaaaggaaaagagtcagagcgcgaaaagctcccccctattgtgtctgccggggccggcgccacagccggacttgatcgaggcgccaaggggcagatctcaacgtttagctcattcatatcggccgtctctccaaaaaaagaagctgccgagaatcgttccagtcccgcacatctggtttttccaaacattaagaatgttagagaacctccacccatctgtttagatgtaaggcagaagcaacgaaccagtatggacgcctcctcctccgaaatgaaggcacccgtgctgcctgaacctatccttccgattcagcctaagacagttaaagatttccaggaggacgtcgaaaaggtgaagagttcgggagactggaaagctgtgcatgacttttacttgactacattcgattcattccctgaattgaacgcagctttcaaaaaggacgctactgccagttttaacacaatcgaggactctgggataaacgccaaattcgtgaatgccgtttacgacaccctgttgaatacaccccaggacgttcagaaaacagtcctgaaaggcatcattaattcacttcttcgggaatggaagggaccacgtacgaaagatgatctccgagcttatttcatcctgctgcagaatccccagttcaacaataccagcacatatgttatctacgcccacctcctaaggcagatcgcaactctagttgaagctgatcatcattttcttgtacattggtttaaaaagcagtacagcaggcttagtcagaagcgctttaaacagttagtggagaggctacttcaattcatcagcctgaggctgttccccgccaagccagaggaattcccgcccattaccaaatgttcttggtggatcccttcagcggctaaggttctggcattactgaatacagcaaacaacctggtccacccaccccttatcccgtacacagatttttacaattcaacactggatcacattgatctgatggaagagtatcacacatggcagaacttcggaaatagtcaccggtttagtttttgccagtacccttttgtgatcagtgtggcagcgaaaaaaattatcatccagcgtgacagtgagcagcagatgatcaacattgctcggcagagtctggtagataaagtgagccggcgacagaggccagatatgaatatcctgttcctgaacatgaaagtgagacgcacacacctcgtctctgatagcctcgatgagctgactcgcaaacgcgccgacttaaagaagaagctgaaagtgacattcgtaggagaggctggtctggacatggggggcttaactaaggagtggttcctgttactcattaggcagatcttccaccctgattacggtatgtttacgtaccacaaagattcacactgccactggttctcttctttcaagtgcgacaattacagcgaatttagacttgtggggatcctgatggggttagccgtctacaactccataactctggatattagattccccccctgttgttacaagaagctgcttagcccgccgataattcccagcgatcagaatatccccgtgggaatctgcaacgtgactgtagacgatttgtgtcagataatgccggagttagcacatggtctgtccgagctcctgtcccacgagggaaatgttgaggaggacttctactcgacctttcaggtgtttcaggaggaattcgggataatcaagtcctacaatctgaagcctggcggagacaaaatcagtgtgactaaccagaacaggaaagaatatgtccagctgtacacagattttctccttaacaaatccatttacaagcaattcgccgctttttactacggatttcactcagtctgcgcttccaacgctctgatgctgctacgccccgaagaagtggagattctggtttgcggtagtccagatcttgacatgcatgccctccagagatccacccagtatgatgggtatgccaagactgacctgacaattaagtacttttgggacgtggtgcttggattccctctggacttgcaaaaaaagctgctccattttacaaccggtagcgaccgcgtgcccgtgggtggtatggcagacctcaactttaagatcagtaagaacgaaacctccacaaattgtctgccagtggctcatacctgtttcaatcagctgtgcctcccgccttataagtctaaaaaagaccttaagcagaaactaattatcggtatcagtaacagcgagggcttcggactggagtag

SEQ ID NO: 48018 - DNA, 1098 bp, Artificial Sequence
  Description of Artificial Sequence: Synthetic coding sequence
atgaacatcctgttcctgaacatgaaggtgcggcggacccacctggtgtccgattctctggatgaactgactaggaagcgcgccgatctcaaaaaaaagctgaaagttacctttgtgggcgaggctgggctggatatgggaggcctgacaaaggaatggttcctcctgctgatcaggcaaattttccaccctgattacggcatgtttacctaccataaggactcacattgtcattggttctcatcgttcaaatgtgataattattccgaattccggctcgtcggaattctcatgggcctagccgtgtacaactccattacgcttgacatacggttccccccttgttgttataaaaaattactctcccctcctattatcccatcagatcaaaatatacccgtgggcatttgcaatgtgaccgtcgatgacttgtgccagattatgccagaactggctcatggcttgagtgaactcctcagccatgagggcaacgtggaagaggatttttattctacgttccaggtcttccaggaggagtttggaatcatcaagtcatacaatctgaagcccggcggagataagatttccgtgacgaatcagaaccggaaagagtatgtacagttatatactgacttcctgctgaataagtcaatatacaagcagtttgcggcattctattacggattccatagtgtctgcgcctctaatgctctgatgctactgaggcctgaagaagtcgagatccttgtttgcggctcacctgatctcgatatgcatgctctgcaacggagtacgcagtacgacgggtacgctaagacggacctgacaattaagtatttctgggatgtggtgttaggctttcctttagaccttcagaagaaactcttacattttaccaccgggtcggacagagtgccagttggcggaatggccgatcttaatttcaagataagcaaaaacgagacctccacaaactgcttacccgtggcacacacgtgttttaaccaactgtgtctccccccgtacaaatctaaaaaggatcttaaacagaagctcataatagggatttcgaatagtgaaggctttggcctggaatag

SEQ ID NO: 48019 - DNA, 3306 bp, Artificial Sequence
  Description of Artificial Sequence: Synthetic coding sequence
atggacgagtgcggcagccggatccggcggcgggtgagcctgcccaaaagaaaccgacccagtctaggctgtatcttcggcgctccgacagccgccgaactcgttcccggtgacgaggggaaagaagaagaggaaatggtagcagaaaacaggaggcggaaaaccgctggggttcttccggtggaggtgcagcccctgcttctgtcggacagccctgaatgtctggtgttaggcggaggagacacgaatccagacctcctacgccatatgcctaccgaccggggggtcggtgaccaacctaatgatagtgaagtagacatgttcggagactatgacagcttcacagagaactctttcattgcccaggttgacgacctcgagcagaagtatatgcagctgcctgagcacaagaagcacgcaactgacttcgccaccgagaacctgtgctctgagtcgatcaaaaacaagctttccattaccacaattggcaacctgaccgagttacaaactgataagcacacagagaatcagagcggctacgagggcgtcaccattgagcctggggccgacctgctgtatgatgttccgagtagccaggcgatttacttcgagaatcttcagaactcttcaaacgatctaggagaccatagcatgaaagaacgggactggaagtcatccagccataatacagttaatgaagagcttccgcacaattgtatcgaacagccacagcagaacgatgaatcatcctccaaggttcggacctccagcgacatgaatcgaaggaagtccatcaaagaccacctcaaaaatgcaatgaccggcaacgccaaggcacaaacccctatcttctctcgttctaagcaattgaaagataccttgcttagcgaagaaatcaatgtagccaagaaaaccgtggagagcagctcaaacgatctgggtcctttttatagcttgccaagcaaagtgcgagacctctatgcgcagttcaagggaattgaaaaactgtatgaatggcagcatacctgcctgaccctgaatagtgtccaggagcggaagaacctgatttactcgcttcccacctcaggagggaagacactagtcgccgagattctaatgttgcaagagttgctgtgctgcagaaaggacgtcctgatgattcttccttatgtggcaattgttcaggagaaaataagtgggctgagctccttcggtattgagctgggcttttttgtcgaagaatacgcaggctccaaagggcgctttcctccaaccaaacgccgggaaaagaaatcattgtacatagctacaatcgagaaagggcactctcttgtgaattctcttatagagaccggtcggattgacagcctgggcctggtggtcgttgacgagctgcatatgatcggggaggggtcccgcggcgcaactcttgaaatgacgcttgccaagatcctgtacacaagtaaaacaactcagattataggtatgtccgccaccttaaataatgtggaggatcttcagaagtttctacaggccgagtattatactagtcagttcagaccagtcgagctgaaagagtacctgaaaattaacgacaccatctatgaggttgacagcaaagccgagaacggaatgaccttcagcagactccttaattataagtacagcgacaccctgaaaaagatggatccggaccacttagttgcattagttaccgaagtaatacctaattacagttgcttggtcttctgtcccagcaaaaaaaattgcgagaatgtagctgagatgatctgtaaattcctgtctaaggaatacctaaaacacaaagaaaaggagaaatgcgaagtcatcaaaaatcttaaaaatattggaaatggaaatttatgcccggtgctcaaacgaaccatcccgtttggagttgcctatcatcactccgggttaacttcagatgaacggaaattgcttgaagaggcatacagtactggagttctctgtcttttcacttgtaccagcaccctggccgccggtgtgaatctgcccgcacggcgagtcattctcagggcgccctatgtagctaaagaattcctcaagagaaaccagtataaacagatgatcggcagggctggccgggcaggcatagatacaattggcgagtcaattcttatcttacaggagaaggacaaacagcaggtgttagagctgattacaaaacccctcgaaaactgttatagccaccttgtgcaggagtttaccaaaggaatccagacactcttcctctccttgattggacttaaaattgccacaaatctggacgatatctatcactttatgaatggtacgttttttggagtgcaacagaaggtattgctgaaggagaaaagcctgtgggagataaccgtggagtctctgcggtacctgacagaaaaaggccttcttcagaaagataccatttataagagcgaggaggaagtgcaatataacttccatatcaccaaactggggagggccagcttcaaaggaacgattgacctagcatactgtgatatcctgtacagggacttgaaaaaaggactggaaggactggtcctggagtctcttttgcatcttatttacttgactacgccttacgatctggtctcacagtgtaatcctgactggatgatttactttcggcagtttagtcaacttagccccgcagagcagaatgtggctgctattctgggggtttccgagtccttcatcggaaaaaaagcaagcggacaagctatcggcaagaaggtggataagaacgtggtgaacagactatacttatcatttgtcttgtacacgctactcaaggagaccaatatctggactgtttccgagaagtttaacatgccccggggctacatacagaacctccttactggaaccgcgagcttcagttcatgcgtgctccacttttgcgaagagctggaggagttctgggtgtaccgtgctctactggttgagcttaccaaaaagctcacatattgtgtaaaggcagaattgattccactgatggaagtcactggagtgctcgagggacgagccaaacagctgtatagtgctggatacaaaagcctcatgcatcttgccaacgctaaccccgaagtgctggtgcgaactatcgatcatctctctcgacgacaggctaagcagattgtatcaagcgctaaaatgctgctccatgagaaggcagaagcgctgcaagaggaagtggaagagttactccgtctccccagtgatttccccggggctgttgcctcgtcgacagataaggcctag

SEQ ID NO: 48020 - DNA, 546 bp, Artificial Sequence
  Description of Artificial Sequence: Synthetic coding sequence
atgaccaccaccaccaccttcaagggcgtggaccccaacagccggaacagtagtagggtgctccgtccgcctggtggcgggagcaatttctcactgggcttcgacgagcccacagagcagccggtccgcaaaaacaaaatggcctctaacatattcggaacacctgaggagaaccaggccagctgggccaagtccgccggcgccaagtcctctgggggaagagaagaccttgaatcttctggactccagagacgaaattcctccgaggcctcttcaggggatttcctggacttgaaaaagatgtggactcaaacctgccaggccgcctgggggcgggtaaaacgcagtccgtgtctgctacgactatgtcctgcacggtggccaaggccacagtgtcatccagaggagattccattagcagcttctccagcttcctcttgggtaagctctgactgcccagaaaggtgtagatctgtttgcttcctacatgcctgcgagctccataatctttccttaaccgtacacctgctggatttatttcactag

SEQ ID NO: 48021 - DNA, 327 bp, Artificial Sequence
  Description of Artificial Sequence: Synthetic coding sequence
atggccagcaacatcttcggcacccccgaggagaaccaggccagctgggcgaaatcagctggggctaagagctctggtggtcgcgaagatctggaaagcagcggactgcagcggcggaactcttcagaagccagtagcggcgatttcctggatctgaagaccagcggtgggaagattgaaaatgtcgatactgacctcccaggcagccttggacagtctgaggagaagccagttcccgcagcccccgtgccttcaccggtcgcaccagcacctgtccccagcaggcgcaacccccctgggggaaagagctcactggttctcggttag

SEQ ID NO: 48022 - DNA, 327 bp, Artificial Sequence
  Description of Artificial Sequence: Synthetic coding sequence
atggccagcaacatcttcggcacccccgaggagaaccaggccagctgggcaaaatcggccggagcaaagagtagtggcggacgggaagatctggaatccagcgggctgcagaggcggaactcatcagaagcctccagcggcgacttcctggatctcaagggggagggagacatacacgagaatgtcgatacagatctgcccggaagtctcggccagagtgaagaaaaacctgtccctgcggctcccgtgcctagcccggttgcacctgccccggtcccctctcgcaggaatccacccggcgggaagagctctcttgtcctgggctag

SEQ ID NO: 48023 - DNA, 465 bp, Artificial Sequence
  Description of Artificial Sequence: Synthetic coding sequence
atgaccaccaccaccaccttcaagggcgtggaccccaacagccggaatagttccagggtactgaggcccccgggagggggaagtaacttctccctgggctttgatgagcccacagagcagccagtgagaaaaaacaagatggccagtaatatcttcggaacccccgaagagaatcaggccagctgggcaaaatcagcaggcgccaagtcctctggggggcgggaagatctggagagctctggcctgcaacggcggaacagcagtgaggcttcctcaggcgatttccttgatcttaaaggagagggcgatattcatgaaaatgtcgatactgatttgcctgggtcattgggacagtcagaggagaaaccagttcccgctgctcccgtcccatccccagtggcacccgcaccagtgccttccaggcgtaacccccccgggggtaaaagttctcttgttctgggctag

SEQ ID NO: 48024 - DNA, 198 bp, Artificial Sequence
  Description of Artificial Sequence: Synthetic coding sequence
atgcagagcgaggtgcagcggcagcccgaccggagcatccagaaccctttgaccgtcggatcacacactccttgtctgaccccccctacaatgagctgcaacaacagccaggtctggtggtgtgtgcccgtcgtcccagccacatgggagcctgaggctgggggctctcttgagagctcctcctcgaggctgcagtag

SEQ ID NO: 48025 - DNA, 663 bp, Artificial Sequence
  Description of Artificial Sequence: Synthetic coding sequence
atggccctgagcagcgtgggccgggcctggtgcccccccggcttcatccgccaaaatggcgtctgcaccgatctcgacgagtgcagggttagaaacctatgccagcatgcttgccggaacacagaggggagctatcagtgtctttgcccggccggatataggctgctccccagtggaaagaattgccaggacattaatgagtgcgaagaggagtcaattgagtgcggtcctggccagatgtgttttaacacaagggggtcataccagtgcgtagatactccatgccccgcaacttatagacaagggccatcaccaggcacatgtttccgtcgttgctcccaggactgtggaaccggcgggccctctacccttcaatacaggctgttacctctgcctctgggtgttagagcccaccacgatgtcgcacggctgactgctttttcagaagtgggcgtgcctgctaacaggacggagctgtcgatgttagagcccgaccctcggtcaccctttgctctgcgtccactccgggcgggactcggggcagtatacacccggagagccctaacccgcgctggtctctacagactcacggttcgcgcagcagctcctaggcatcagtctgtgtttgtgctactgatcgcagtgagtccctatccatactag

SEQ ID NO: 48026 - DNA, 990 bp, Artificial Sequence
  Description of Artificial Sequence: Synthetic coding sequence
atgatggcccccgtggtgctgacctgccacagcaccggcatccccgctccaactgtatcctggagcaaggccggtgctcagcttggcgctcgcggatcaggctacagggtgtcacctagtggtgccctcgagataggtcaggcactccctatccacgctgggagatatacttgctcggctcggaatagcgctggtgtggcacacaagcatgtttttctgaccgtgcaggcatctcccgttgttaaacccctcccctccgtggtgagggccgtagctgaggaggaggtgctcttgccgtgcgaggcttcaggtatccccagacccactattacatggcaaaaagaggggttaaacgtcgcaactggagtgagtacgcaggtgctgcctggggggcaactgagaatcgcacacgcctctcctgaagacgcaggaaattacctctgtatcgccaagaattccgccggttccgccatggggaagacccgcctggttgtgcaggttcctcccgtgatcgagaatggtctcccagatctgtctacgaccgagggaagtcacgcctttcttccatgtaaggccagggggtcacctgaacctaacataacctgggacaaggacggccagcctgtttcaggagccgagggcaaattcacaattcagcccagcggggagctcctggtgaaaaatttggagggtcaggatgcaggtacttacacttgcacagctgaaaacgccgtgggccgagctcgacgtagagttcatctgacaatattagtactgccggtgttcactacccttccaggcgaccggtcactgcgactcggagatcgcctttggctgcgatgtgcggcccgcggatcaccaacaccacgaatcggctggactgtgaacgacaggccagttaccggtctgggccttctgggtatggggggcacggagagtcaagacacgggaaggctgagacgagaagggcgctggggtgaccccacttag

SEQ ID NO: 48027 - DNA, 462 bp, Artificial Sequence
  Description of Artificial Sequence: Synthetic coding sequence
atgcggggcgccagcgcccggccccccctgctgggcagcgaggagcctttctgcccagcctcccgatctgtaagggaagggggaggtggagtttccccacctcccggccagcctccatgtccagaggggcgttggggcggacagccaccagcccgtcctgccgacccttccggcagagaagtaggtggctccgccccgtgccccgcttcccggccagtgcgcgaagtaagaggtgcatccgcacgccccccactgcttggctccgaagagcccctgtgccccgcctcacgccccatttgggagggcgggggcggtgtgtcgcctcccccatgccagcccccctgtcccgggggccgcggcgccagtgcaagaccgccactcctgggcaatgaggaacccttgtgtccagccactaccccctctggccgatgtacgcagcaactcgttgagaacggtccatag

SEQ ID NO: 48028 - DNA, 1866 bp, Artificial Sequence
  Description of Artificial Sequence: Synthetic coding sequence
atgagccccgtgttccccatgctgaccgtgctgaccatgttctactatatctgtctccgtcggcgggcccggaccgccacacgtggagagatgatgaacacacaccgtgccattgagtcaaacagccagacatcccctctcaacgctgaggtggttcagtatgccaaggaggtcgtggacttctcctctcactatggaagcgaaaactcaatgtcgtataccatgtggaacctagccggggtgcctaatgtcttcccaagctcaggcgactttacacagaccgcagtgtttcgcacatacggtacatggtgggaccagtgtccctctgcttccttacctttcaagagaactccacccaactttcagtcccaggactacgttgagttaacatttgagcagcaggtttaccctactgctgtccacgttctcgaaacttaccatcccggggccgtaattcgtatcctggcttgcagcgcaaatccgtactcccccaacccccctgctgaagtccgctgggaaatcctgtggtcagagcgtccaaccaaagttaacgcctcccaagccaggcagttcaagccgtgtatcaagcagatcaattttcctacaaatctgatcaggctggaggtgaatagttctctgctggaatactataccgagttggacgccgtggtgctccatggcgtcaaggacaagcccgtgctgtctctgaagacatcacttattgatatgaatgatatcgaagacgatgcctacgctgaaaaggatggctgcggaatggattctctcaataagaaattctcgtctgctgtactgggggaagggccaaacaacggttatttcgataaactgccgtatgagctgatccagctcattctgaatcatctgacactccccgatctctgccgtttagcccagacgtgtaagttgctcagccagcactgctgtgacccactgcaatatatccacctaaacctacaaccctattgggctaagttggacgatactagcctcgagtttttacagtcccgctgtacgctcgtgcagtggctgaatctttcatggactgggaacaggggctttatttccgtagcaggatttagccggtttctaaaagtatgtggttccgaattggtgcggctggaacttagctgcagtcacttcctgaacgaaacatgcttggaagtgatcagcgagatgtgtccgaatctccaagcactcaacctgagttcctgtgataaactccctccacaggcatttaaccacattgcgaagctgtgctctttaaagcgacttgtcctctacagaaccaaggtcgagcagaccgctcttctatctatactcaacttttgcagtgaactgcaacacttgtcattaggctcctgtgtgatgattgaagactatgacgtgattgcttcaatgattggcgccaaatgcaaaaagttgaggaccttggatttgtggagatgcaaaaacattactgaaaatgggatcgctgagctcgcgagcggatgcccgctacttgaagagttagacttggggtggtgtcccacactgcagagcagtacaggttgtttcacaagactggcccaccagcttccaaacctgcagaaactgttccttacagccaaccggagtgtctgcgacaccgacatagacgagttggcctgcaattgtacccggttgcagcaactggacatattagggactaggatggtcagcccagcatccctaaggaaactactggaatcatgcaaggatctaagtctccttgatgtgagcttctgtagccagatcgacaatagggccgttctggagctgaatgctagttttccaaaggttttcattaagaagagcttcactcagtag

SEQ ID NO: 48029 - DNA, 756 bp, Artificial Sequence
  Description of Artificial Sequence: Synthetic coding sequence
atgagcgcctacggcatgcccatgtacaagagcggcgacctggtgtttgctaagctgaaagggtacgcgcattggccggcaagaatagagcatatgactcagcccaatcgctatcaagtttttttttttggtacacatgaaactgcatttctgtcccctaagcgactttttccttacaaggaatgcaaagaaaagttcggtaagccgaacaagcgtagaggattctctgccggcctctgggaaatcgagaataatcctaccgttcaggcctcagactgcccgctggctagtgagaaagggtcaggcgacggcccatggcctgagcctgaagcagccgagggcgacgaagataaacccacgcatgcagggggtggcggtgacgagctgggaaagcctgatgacgataaacccaccgaagaggaaaaggggcctttaaagcggagcgcaggcgacccaccagaagacgctcctaaacgcccaaaagaggccgcacctgaccaggaggaggaggcggaagctgaaagagcagccgaagctgaacgggcagccgccgcggcagccgcaaccgccgtagatgaggagtcaccattcctggtggccgttgaaaatgggagtgccccctccgagcctggcctcgtgtgtgagccccctcagcctgaggaggaggagctgagagaggaagaagtggccgacgaggaggcttctcaggagtggcacgccgaagctcctggagggggagacagagactccctgtag

SEQ ID NO: 48030 - DNA, 345 bp, Artificial Sequence
  Description of Artificial Sequence: Synthetic coding sequence
atgttcggcgcctgctacaagcagcccctgaagcccagcggcagcgagcctcccgctgaggagtgcagaatgaccccccgtcatgcaggatgtgatgtgactgagatgcaaaggattctgagtcagcccacctttactgagcacctattgagggccgtgtgcactaaacttgccaatatgtacagtaccagtactgattgccgcgagcactgtaggcgaggaatgaaggctaaacagcttaaggccgaggctggcaggtcctgccaacgcaagggcgtgccaatccagactccaagggagcactcctggatttcatgtaagaaagagttcgaggccaacccctag

SEQ ID NO: 48031 - DNA, 231 bp, Artificial Sequence
  Description of Artificial Sequence: Synthetic coding sequence
atgttcggcgcctgctacaagcagcccctgaagcccagcggcagcgagcccccggctgaagagtgtaggatgaccccgcgccatgcaggctgtgatgtgaccgaaatgcagcggatcctgagccagccgacctttaccgagcaccttttgagggccgtgctgtctacggagagggggccttaccctgaccccaagagagcctttcttgacctgctacaggagcgcatatag

SEQ ID NO: 48032 - DNA, 366 bp, Artificial Sequence
  Description of Artificial Sequence: Synthetic coding sequence
atgttcggcgcctgctacaagcagcccctgaagcccagcggcagcgagccacctgcagaagaatgtaggatgacaccacgccacgccggttgcgacgttaccgagatgcagaggattctctctcagccaaccttcaccgagcatctgctgagagccgtgtgtctggtgaacggaaagggctcactatcaagaccacaagagagcatcctgggttctctcgccaggaagaatctgcgccgcattcatcgagtgtccctggtgatgtgtgtgcggcctctgtccccctcaaaagcaattatcagtcctgttacatgcatgtatacctctcgctggccagaagctagcgaggagtcgcaaaagaaatag

SEQ ID NO: 48033 - DNA, 465 bp, Artificial Sequence
  Description of Artificial Sequence: Synthetic coding sequence
atgttcggcgcctgctacaagcagcccctgaagcccagcggcagcgaacctcccgccgaggagtgtagaatgacaccccgtcacgccggctgcgacgtcaccgagatgcagcgaattctgtcgcagcccaccttcactgagcacttgctgcgcgcggtttgcactaagctcgccaatatgtattccacaagtactgattgtagggagcattgccgccgaggcatgaaagcaaagcagctaaaagccgaagccggtagaggcctggtaaatggcaagggctccctgagtcgcccccaagagtcaattttaggatccctggcgagaaagaacctgcgacggatccatcgggtgtctctggtgatgtgcgtccgacctctgagtccttcaaaggccatcatttctccggttacatgtatgtatacttcgcgctggccggaagccagtgaggagagccagaagaagtag

SEQ ID NO: 48034 - DNA, 345 bp, Artificial Sequence
  Description of Artificial Sequence: Synthetic coding sequence
atgttcggcgcctgctacaagcagcccctgaagcccagcggcagcgagccgccggctgaagagtgtcgtatgacccctcggcatgctggttgcgacgtcacggagatgcagcgcattctgtcccagccaaccttcacagagcacctccttagagccgtctgcactaaactcgctaacatgtattctaccagtaccgattgccgggagcattgccgtaggggcatgaaggccaaacagctgaaggcagaagcgggcagaagctgccagagaaagggtgtgccaatccaaacccctcgcgagcactcctggatctcgtgcaagaaagagttcgaggctaacccgtag

SEQ ID NO: 48035 - DNA, 1350 bp, Artificial Sequence
  Description of Artificial Sequence: Synthetic coding sequence
atgatgctgagcaccgagggccgggagggcttcgtggtgaaggtgcgaggtttgccttggagttgttctgcggacgaagtgatgaggtttttttctgactgcaagatccagaacggcacaagtggaattcgcttcatatatactcgggaaggacgcccatctggagaagccttcgtggagctcgagtcagaggaggaggtgaagctagcacttaagaaggatcgagagacaatgggccacaggtacgtggaagtatttaagagcaatagtgtagagatggactgggttctgaagcacacaggtccaaacagcccagatacagctaatgatggtttcgtgcgtttgcgaggattgcccttcgggtgctctaaggaggaaatcgtgcaattcttttccggcttggaaatcgtcccaaacggcatgactttacctgttgacttccagggcagaagcacaggggaggcattcgtacagttcgcatctcaggagatcgcggaaaaagctttgaaaaagcataaggagcgcatcggacaccgttatatcgagattttcaagtcctcacgggcagaggttcgaacccactacgaccctccgcggaagctgatggccatgcaacggccgggcccctacgaccggcctggcgccggcagagggtacaatagcattggtaggggggcgggctttgagaggatgagaagaggagcatacggaggcggctacggaggatacgatgattacggcggctacaatgacgggtacggcttcggttccgacagattcggtcgcgatttaaactactgcttttcgggcatgagcgatcatcggtacggggacggcggcagttcctttcagtctactacaggtcattgcgttcacatgaggggcctcccttaccgcgccacggaaaacgatatctacaatttttttagtccgttgaaccccatgcgtgtccatatagaaattggcccagatggtagagtgactggtgaagcggacgtggaatttgctacacatgaagacgccgtcgccgccatggctaaagacaaggccaacatgcagcacagatatgttgagcttttcttgaactccactgcaggtacaagcggaggcgcctacgatcactcctacgtggaactcttccttaactctaccgctggcgcctcaggaggggcctatggatcgcagatgatgggcggaatgggtctgtcgaaccagtctagctatgggggccccgcctctcagcaactgagtggtggatatggtggcggatacggagggcagagctccatgtccgggtacgaccaagtactccaggagaattcatccgattaccagtcaaacctggcatag

SEQ ID NO: 48036 - DNA, 1656 bp, Artificial Sequence
  Description of Artificial Sequence: Synthetic coding sequence
atggacgagggcgtgaacttcaagcccaccgaggccggccggctgatggcctggtactacattactttcgagactgttaagaaattttacaccattagcggcaaagaaactctcagtgacctcgtcacattgattgccgggtgcaaagaatttcttgacatacagctccgaatcaacgaaaagaagacgcttaacacattaaacaaggatccaaatcggattaccatccgctttcccatggaaggccgaatcaagacccgtgagatgaaggttaattgcctgatccaggcccagctgggttgcatccccattcaggactttgccctgacccaagacacggctaagatctttaggcacggatcccgtatcactaggtggttatccgacttcgtagctgcccaggaaaagaaattcgcggtcttactcaactctttgattcttgctaagtgcttccggtgtaagttgtgggaaaacagcctgcatgtgtcaaagcagctggaaaaaatcggaattacactgagcaacgcaatagtgaacgccggcctgacctcgttcaagaaaatcgaggaaacggacgctcgagagcttgaactcatcctgaacagacaccccccatttgggactcagattaaagaaaccgtaatgtatcttccaaagtacgaactaaaggtggaacagattactcgttatagtgatacgaccgcagagattctggtcacggtgatccttagaaatttcgaacagcttcagacgaaacgtaccgcctccgattcacattatgtgacgctgattataggtgatgcagacaatcaagtggtgtacttgcataaaataacagattcagtgctactcaaggccggaagctgggccaagaaaattgccgtgaaacgcgccctaaaatccgaagacctttctattaatctgatctcttccgagttcgttggcctggacatacaacagaaactcacagtgttctatctggaaccaaaaagatttggcaatcagatcacaatgcagcggaagagcgagactcagatctcccattcaaagcacagtgatatcagcaccatagcgggtcccaataagggtactactgcgtccaagaagcctgggaatagagaatgtaatcacctatgcaaatccaagcatacctgtggccacgactgttgcaagatcggggtagctcagaaatctgagatcaaggagtccactatcagctcttacctgtcagaccttaggaaccgcaatgccgtgagtagcgtcccgcccgtgaagcgcttaaaaatacaaatgaacaaatctcaatccgtcgacctgaaggagtttggatttacaccaaaacccagcctccctagtatttccagaagtgagtacttgaacatttcagaattacctattatggagcagtgggaccagcccgaaatctacggaaaggtgcgtcaagagccatcagaatatcaggacaaggaggtattgaacgtgaactttgaactggggaatgaagtctgggacgatttcgatgacgaaaatctggaagtgacttccttctctaccgatactgagaaaaccaaaatttcggtgctgttccaccatatgcggtgccggattttcctgtaccagatattgctatgtccttctagcgtgcaccctccgtag

SEQ ID NO: 48037 - DNA, 2493 bp, Artificial Sequence
  Description of Artificial Sequence: Synthetic coding sequence
atgatcgcctgcttcctgtggaagatctgcttcctgaagaaccagatgaagcttaagatggccccaatcaaagccctttgctcccaacggtttgatgactggaaagaaaaattcggcccaatcggccttaactgcaaagagcttaccggggataccgtgatggacgatctatttgagattcagcacgcccacatcatcatgaccaccccggagaagtgggactctatgactcgaaaatggagagataactccctcgtgcagttggtgcggctttttctcattgacgaagtgcacatcgtgaaagacgagaaccgcggtcctacgttggaggtagttgtctcgaggatgaagacagtacagtctgtgtctcagacattgaagaacacttccaccgcaatcccaatgaggttcgtagccgtcagcgctaccattccaaatgccgaggatattgccgagtggctgagcgatggcgagcggcccgccgtgtgcctgaagatggacgagtctcaccggccagttaagttgcagaaagttgtcttgggtttcccttgctctagcaatcagactgagtttaagttcgatctcactttgaattacaaaatcgcttccgttatacagatgtactcggaccagaagcccaccttggttttttgtgctacacggaaaggggtgcagcaggctgccagcgtactcgtaaaggatgcaaagtttatcatgaccgtggagcagaagcaacggctgcagaaatacgcctactctgtgcgggattctaagttaagggacattctgaaggatggagctgcctatcaccatgccggaatggagctgtccgaccggaaagtggtcgagggagcttttactgtgggcgatctcccagtgctgtttaccacatctaccctggcgatgggcgtgaacctcccagcacacctagtggtcataaagtctacgatgcattatgcaggcggcttgttcgaggaatactccgagactgacatcctgcagatgattggcagagctgggaggccccagtttgataccacagctacagccgtcatcatgacgcgcttgtcaactagagataagtacattcagatgctcgcttgtagagataccgttgagagctctctacaccggcacttaatcgaacacctgaatgccgagatagtgttgcacaccattacggacgtcaacattgcagttgaatggatcaggagcacattgctctacattagagctttgaaaaacccgtcgcactatggattcgccagcgggcttaacaaggacggcatcgaggctaagctgcaggaactgtgcctcaagaatctaaatgatctgagttccttggacctcattaagatggatgaaggagtaaattttaaacctacagaggccggacgcttgatggcatggtattacattactttcgagacggttaagaagttctacacaatatccggcaaagaaactctcagtgacctggttactttgattgccggatgcaaggagttcctggacattcaactcaggattaatgagaaaaaaacccttaataccctgaacaaagatcccaaccggattactattaggtttcctatggaggggagaataaagactagggaaatgaaagtgaattgcctgatacaagctcagcttggatgtatccccatccaagactttgctctgactcaggataccgctaagatttttaggcacggaagccggattacccgttggctgagtgacttcgtagctgcacaggagaagaaatttgccgtgctcctcaattcactgatcttagctaagtgtttccgttgcaagctgtgggagaattcactccacgtctctaaacagctcgagaagattggcatcactctctcgaatgctattgtgaatgccggattgaccagttttaaaaagattgaggaaaccgacgccagggaactggaactgattttaaataggcaccctccatttggcacacagattaaggaaaccgtgatgtatcttcctaagtacgagctcaaggtggaacagataactcggtactcagacacaactgccgaaattctcgtgaccgtcattctgaggaatttcgagcagctccagacaaaaaggaccgcctctgacagccattacgtgaccctgatcattggcgatgcagataaccaggtagtgtatctccataagatcacggactcagttctgctgaaggccgggtcttgggccaagaaaattgccgtgaaacgcgccttaaaatccgaggacttgtccatcaatctgatcagtagcgaattcgttgggttagacatacagcagaagctcacagtcttctacctggaacccaagcggttcggcaatcagatcacaatgcaaaggaaaagtgagacccagatcagccatagtaagcattctgatatatcaaccattgctggccccaacaaaggaaccaccgcaagcaagacatgggagccgcgaatgcagagcagcctgtag

SEQ ID NO: 48038 - DNA, 3345 bp, Artificial Sequence
  Description of Artificial Sequence: Synthetic coding sequence
atggaggtgcccctgccctggctgaacatcaagatcgtgtacatggcacctattaaggccttgtgttctcaaagatttgatgactggaaggagaaattcggtccaatcgggcttaactgtaaagaactcacaggggatacagtgatggatgatctctttgaaatccagcacgcacacatcattatgactacacccgagaagtgggatagcatgactcgcaaatggcgagataactctctggtgcagctggtgcgtctttttctgatcgacgaggtgcatatagttaaggatgagaaccgaggtcctaccttagaggtggtggtgagtcggatgaagactgtgcagtcagtcagtcagactctcaagaacacctccacggcgatacccatgagatttgtcgctgtatctgccactatcccaaacgcagaggacatcgcagaatggcttagcgatggcgaacgcccggccgtctgcctgaaaatggacgagtcccataggcccgtgaagctccagaaggtagttctcggctttccttgctcctctaaccaaaccgaatttaaatttgatttgacactaaactataagatcgccagcgtgattcaaatgtactccgaccagaagcccacactcgttttctgtgcaactagaaagggggtgcagcaggccgcctctgtgctggtgaaagacgctaaattcatcatgactgttgagcaaaagcagcgcctgcagaaatacgcatacagcgtgagggattccaagctgcgcgatatcctcaaggatggcgctgcctatcaccatgctggcatggagcttagcgatcgaaaggtcgttgaaggagccttcaccgttggtgacctgcccgtactgtttaccacttctacccttgcaatgggggtgaacttgccggcccacttggttgtcatcaagagtacaatgcactatgccggcggattatttgaagagtacagcgagacggatattcttcagatgattggtcgcgcagggagaccacagtttgatactactgcaactgctgtcataatgactaggctttcaacaagggataaatacatccagatgctagcgtgcagagatactgtagaaagctccctgcatcgtcacctgattgagcacctgaatgccgagatcgttctgcataccatcactgatgtgaatatcgcagtggagtggataagaagtaccctgctctacatcagggcacttaaaaatccatcacactacggctttgctagcgggcttaacaaagatggaattgaggccaagctgcaggagctttgcctgaagaacctgaatgatttgtcttctctcgaccttatcaagatggacgagggagtgaactttaaaccaacggaggccggccgactcatggcctggtactatatcaccttcgaaacagtaaaaaagttctatactatctccggaaaggagactttgtctgacttggttacgcttatcgccgggtgtaaggaattcctggacatccaactgcgcattaatgagaaaaaaaccctgaatacactcaacaaagatcccaaccggattaccatcagatttcccatggagggacggattaaaacgcgcgaaatgaaggttaattgtctaatccaggcacaactgggatgcattccgattcaggacttcgccctcacacaggacacggcaaaaattttcagacacggttccagaattaccaggtggctcagtgatttcgtcgctgcccaagaaaagaaattcgccgtgctactgaacagcctgatccttgctaagtgcttccgatgcaaactgtgggagaatagccttcacgtctcaaagcagctcgaaaagatcggtattacactctctaatgctattgtgaacgctgggctcacatctttcaagaaaatcgaggagaccgacgccagggaacttgaactgatcctcaacagacacccccccttcgggacccagatcaaggaaacagtaatgtacctgcctaagtacgagcttaaagttgaacagattacaagatatagcgacaccacagctgaaattctcgtcacggtgatcctccggaattttgaacaactgcaaaccaagagaactgcctccgattcccactacgtaactcttatcatcggcgacgctgataaccaggttgtatacctgcacaagatcacagactcagttcttctgaaggcaggtagctgggctaagaaaatcgcagtcaaacgtgctctgaaaagtgaagatctgtcaataaatcttatttcctccgagtttgttggacttgacatccagcagaagctcactgtgttttacctggagcccaaaagattcggaaaccagattacgatgcagagaaaatctgaaactcagataagtcattctaaacacagcgacatctcgacaatcgctggacctaacaaaggaactactgcatccaagaagccaggaaacagggagtgcaatcacctgtgtaagtccaagcacacctgcggacatgattgctgtaagatcggagtggctcagaagagcgagataaaagagtctaccatctcctcatacctaagcgatctcaggaaccgcaatgccgtgtctagcgtgccccctgtgaaacggctgaaaatccagatgaataagtctcagagcgtagacctcaaggagtttggcttcacacccaagccttctttaccaagcatctctagatccgagtacctcaatatctctgagctgcctatcatggagcagtgggaccagcctgaaatttatggcaaggtgaggcaagaaccttctgagtaccaagacaaggaggtacttaatgtcaacttcgagctgggcaatgaagtctgggatgatttcgacgacgagaatctggaggtgacttcctttagcacggataccgagaagactaaaatttctggcttcggtaacacactctccagttctacgagaggtagcaagcttccccttcaggagtcaaaatccaagttccagagagagatgagcaacagtttcgtgagctcccacgagatgagcgatatttctctgtccaacagtgcaatgcccaagttttccgcctcaagcatgacaaagttaccccagcaagccggaaatgcagttatagtacacttccaggagcggaagcctcaaaacctgtctccagagatagaaaaacagtgtttcactttcagtgagaaaaaccccaattcttccaattataagaaagtggattttttcatcagaaactctgaatgcaagaaggaggttgatttctctatgtaccaccctgacgacgaagcagatgaaatgaaatcgcttctgggcatttttgacgggatcttctag

SEQ ID NO: 48039 - DNA, 4308 bp, Artificial Sequence
  Description of Artificial Sequence: Synthetic coding sequence
atgctgaagagcaacgactgcctgttcagcctggagaacctgttcttcgaaaagcccgacgaggtggaaaatcacccagataacgagaagtccctggattggtttctcccaccagcgccgctcataagtgagatccccgacacacaagaattggaggaagagctggaatcacacaagctgcttggccaggaaaaaagacctaagatgctgacttcgaacttgaaaataacaaatgaagacactaactacatttccctcacccaaaagtttcaattcgcgtttccctccgataaatatgagcaagacgatctgaacctggagggtgtgggaaacaacgatctctcccatattgctggtaagcttacctacgcctcccagaagtataagaaccacataggaaccgaaatcgcaccagaaaagagtgtgcctgacgacacaaaactggtgaattttgcagaggacaagggagaatcaacaagcgtgtttcggaagagactgttcaagattagtgacaatattcatggaagtgcatattccaatgacaacgagttagattcccatattggaagtgtaaagatcgtccagacggaaatgaataaggggaaatcccggaattacagcaattctaaacagaagtttcagtactctgccaatgtgtttacagccaacaatgcattcagcgcctcggagattggcgaggggatgttcaaggcgccttctttttccgtggcctttcagccacacgatattcaggaggtcacagagaacggtttaggtagtctgaaagctgttactgaaattcctgcaaaattcagatccatcttcaaagagtttccatatttcaactacattcagtcaaaagcatttgacgatttattgtataccgaccgtaactttgtgatctgcgcccctacagggtctgggaagacagtggttttcgagttggcgattacgagattactaatggaagtgccactgccttggcttaatatcaaaatcgtctacatggcaccgattaaggcattgtgttcccagcgatttgacgattggaaggagaagttcggtcccataggtctcaactgtaaggaactcacaggtgatacagtcatggatgatctcttcgagattcagcacgcacatataattatgaccacacctgagaagtgggatagcatgacacgtaaatggcgcgacaattcactggtgcagctggtaagactttttctgatcgacgaagtgcacatagtcaaggatgaaaatcgaggccccacgctggaggtggtggtgagcagaatgaagactgtgcagtccgtatcccagaccctcaaaaatactagcaccgctatacctatgcgcttcgttgcagtctctgccaccataccaaacgctgaggatatcgccgaatggctgagcgatggcgagcgaccagccgtttgtctcaagatggacgagtcacacaggcccgtcaagttacagaaggtcgtgctgggatttccgtgttcctccaatcagactgaatttaaatttgacctgactcttaattacaaaattgccagtgttattcagatgtacagcgaccagaaaccaaccctggtattctgtgctacacgcaaaggagtacagcaggccgctagcgtgcttgtgaaagacgccaaattcataatgacagtggagcagaaacagaggctccagaaatacgcttacagtgtgagggatagtaagctgcgtgatattttgaaggacggcgccgcttaccaccatgctgggatggagctctctgatagaaaagtggttgagggagctttcaccgtgggggacctccccgtcctcttcactacgagtacactagccatgggggtgaatctgccggcacatctagtcgtgattaagtcaactatgcactatgcgggcggactgtttgaagaatactctgaaacagacattctccagatgatcggcagggcgggacgtccacagttcgataccaccgccacggctgtgatcatgactcgcttgagtacccgcgataagtatatccagatgctagcctgtagggacacagttgagagctccttgcatcggcacctcatcgagcatcttaacgcagaaattgtactacataccatcacagatgtgaatatagctgtggagtggattcggagtaccctcctgtacattagagccctgaagaacccatcccattatggcttcgcgtccggcctgaacaaggacgggatcgaggcaaagctccaagagctctgcttgaagaatctgaatgatctgagtagtctcgacctcattaaaatggacgaaggggtgaattttaaacccaccgaagctggaaggctgatggcctggtactatatcactttcgagacagttaagaagttttacactatttccggcaaagagaccctatcagacctcgtgacccttattgctggttgcaaggaattcctagatattcagctgcgcattaacgaaaaaaagaccctaaacacactgaacaaagatcccaatcgaataacgatacggttccccatggagggccggataaagacccgggagatgaaggttaactgtctaattcaagctcaacttggctgcatcccaattcaggattttgcattgacacaggatactgctaaaatctttagacacgggagcagaataacacggtggctctccgattttgttgctgctcaagaaaaaaagttcgccgtgctgctaaattcacttatcctggccaagtgttttcggtgtaagctctgggagaatagcctgcacgtttcaaaacagcttgagaaaatcgggatcacattgagcaacgccattgtgaacgccggtctaacgagcttcaagaagattgaagagaccgatgcgcgcgagctggagttgatcctgaaccggcatccaccttttggaactcagatcaaggaaactgtaatgtacctgccaaagtacgaactcaaggtggagcaaatcactcggtactcagacaccacggccgagatcctcgtaaccgtgatactgagaaacttcgagcagcttcaaacaaagcgcacggccagcgactctcactatgtcacacttatcatcggtgatgctgacaaccaggtagtgtatctgcacaagatcaccgacagcgtgcttctgaaggcggggtcctgggcaaaaaagatcgccgtgaagcgtgctctaaagtccgaagacctctccatcaatttgattagttctgaatttgtgggacttgatattcagcagaagcttaccgtattttacctggagcccaagaggtttggaaatcaaatcacgatgcagcgaaagtcagagacccagatctcccacagcaagcactctgacatttctacaatcgctgggcccaataaggggactactgccagcaagaaaccaggcaatagggagtgcaaccatttgtgtaagtccaagcacacctgtggtcacgactgctgcaagatcggagtggcccaaaaatcagaaatcaaggagtctaccataagttcttacctctccgaccttcggaatagaaacgccgtgtcttctgtcccacctgtcaagcgcctgaaaatccagatgaataaaagtcagagtgtggatctcaaagaatttggctttactcccaaaccatctttgcccagcatctccagatctgaatacttaaatatttctgaattgccaatcatggagcaatgggaccagccggaaatctatggaaaggtacggcaggagccaagcgagtatcaggacaaggaagttctcaatgtgaacttcgagctaggtaatgaggtttgggatgacttcgacgacgaaaacttggaagttacatctttcagtacggataccgagaagacgaaaatcagcgggtttggcaataccttgagtagctccacacgcggcagcaaactgccactccaggaatcgaagtccaaattccagagggaaatgtcaaactcgtttgtatctagtcatgaaatgagtgacatctcgctcagcaacagcgctatgcccaagttttcagcctcttcaatgacgaagctgcctcagcaggccggaaacgctgtgatcgtgcacttccaggagagaaaacctcagaatttatcgccagaaattgagaaacagtgcttcacatttagcgaaaaaaacccgaattcttcgaactataagaaggtggatttcttcatcaggaactcagagtgcaagaaggaagtggacttttctatgtatcatcccgacgacgaagccgacgaaatgaaatctttgctggggatctttgacgggattttttag

SEQ ID NO: 48040 - DNA, 417 bp, Artificial Sequence
  Description of Artificial Sequence: Synthetic coding sequence
atgctgaagagcaacgactgcctgttcagcctggagaacctgttcttcgaaaagcccgacgaggtggagaaccatcccgataatgagaaaagcctagactggtttcttccacctgcccctctgatctccgagatcccagacacacaggaacttgaggaggaactcgagagccacaaactgctcggacaggaaaagcgacccaagatgctgacaagtaatctgaagatcaccaacgaagataccaactatataagtttaacgcagaaatttcagtttgcattcccttccgataagtacgagcaggacgacctaaacctcgaaggagttgggaacaatgatttgtcccacatagccggcaaactgacttatgcatctcagaaatacaagaatcacattggcacagaaattgcgccttag

SEQ ID NO: 48041 - DNA, 2187 bp, Artificial Sequence
  Description of Artificial Sequence: Synthetic coding sequence
agccaggcctggcggagcagcgagggcctgatcaaccggcggagcactggcctgggcgccgtgcggagagaaatctatgataaggttcagttttcaacgatgttaaagagcaacgactgcttgtttagcttagagaacctgttcttcgaaaaacccgatgaggtggaaaatcacccagataacgagaaatccctggactggttcttaccaccggcaccactgatcagcgagattccggatactcaggaactcgaggaagagctggagtcgcacaaactcttaggtcaagaaaagcgtcccaagatgttgacttccaaccttaaaatcacaaatgaggacactaattatatcagtcttacgcagaaatttcaattcgcatttcctagtgacaagtatgaacaggatgacctcaacctggagggtgtgggcaataacgatttaagccacattgcagggaagctgacgtacgccagccagaaatacaaaaaccatatcggtactgagatcgcccctgagaagtctgtgcctgatgacaccaagttggtgaactttgcagaggataagggcgagtcgacaagcgtcttccgcaaaagactgttcaaaatctccgacaatatccacggttccgcatacagcaacgacaatgaactggatagtcatatcggctcagtgaagatcgttcagaccgagatgaacaagggaaagtcccgtaactactccaactctaaacaaaagttccagtactcagctaatgtgttcaccgcaaataacgctttcagcgcatccgagataggcgaaggaatgtttaaagctcctagcttttccgtggcttttcaacctcacgatatccaagaagtcaccgaaaatggcctgggctccctcaaggcagtgacagagattccagcgaagttcagatccatctttaaggaatttccatactttaattatattcagtctaaggcttttgatgacctgctatataccgacaggaatttcgttatctgtgcgccaaccggctcagggaaaacagtggtgttcgagttggctatcactcgtttactcatggaggtgccactgccctggctcaacatcaagattgtctatatggctcccatcaaagcactctgcagccagcgattcgatgattggaaggaaaagtttggccccattgggcttaactgcaaggagcttaccggggacaccgtaatggacgacctgtttgaaatccagcacgcccacattattatgactacacctgaaaagtgggactccatgactcgcaaatggcgggacaactcattggtgcaactggtacgattattcctcattgacgaagttcacatcgtgaaggacgagaatagagggcccactctcgaggttgtagtgtcaagaatgaagactgtccagagcgtaagtcagacgctgaagaacacctctacagccatccctatgaggttcgtggccgtttccgccaccatcccgaatgcggaggatatcgccgaatggctgtccgacggcgaacgacccgctgtgtgtctcaagatggacgaatcccacaggcctgtgaagctccagaaagtggtgttggggttcccttgctcttccaaccagacggagtttaaatttgatctcacactgaattataaaatcgcgtccgtcatccagatgtattcggaccagaaacccacgctggtattttgtgcaactcgcaaaggcgtccagcaggccgccagtgttcttgttaaggacgctaaattcatcatgactgtggaacagaaacagaggctgcagaaatatgcctactccgtgcgggatagtaaactgcgggacatactgaaggatggggcagcataccaccacgcaggcatggaattgagtgaccgaaaagttgtcgagggcgcctttacggtgggggacctacctgtgctgttcactacaagcacgctagcaatgggagtaaatctcccagctcatctggtcgtgataaagtcaactatgcactacgcagggggactttttgaggagtatagcgagaccgatatcctgcagatgattgggcgggccggaaggcctcaattcgacaccacagccactgctgtgataatgacgagactgtccacacgtgacaagtacattcagatgctggcatgtagagatactgttgagtcccgactacatgcacattag

SEQ ID NO: 48042 - DNA, 294 bp, Artificial Sequence
  Description of Artificial Sequence: Synthetic coding sequence
atgagcagcgacaaccagtggagcgccgacgaggacgagggccagctatccagacttattcgcaagagtagggactccccctttgtcccaatcggcatcgccggctttgtgaccgtggttagctgtggtttgtacaaattgaaatatcgcagggatcagaagatgagcatacacctgatacacatgcgggtagcagcccagggcttcgtggttggcgccgttacactgggtgtgctgtacagtatgtataaagattacattagacccagattctttagtgaatcaaaaaaatag

SEQ ID NO: 48043 - DNA, 603 bp, Artificial Sequence
  Description of Artificial Sequence: Synthetic coding sequence
atggccaagggcgaccccaagaagcccaagggcaagatgagcgcctacgccttctttgtccaaacttgtagggaggagcataaaaaaaagaatcctgaggtgcccgttaatttcgcagaatttagcaagaaatgcagcgaaaggtggaaaaccatgtctgggaaagagaaatcaaaattcgatgaaatggctaaggcggataaggtaagatacgatagggagatgaaagattatgggcctgctaagggcggaaagaagaaaaaggaccctaatgccccaaaacgcccgccatctggcttctttctgttctgctctgaatttcgtccaaaaatcaagagtactaatcccggcatcagcatcggtgacgtggctaaaaagttgggggagatgtggaacaacttgaatgacagtgagaagcagccttatattactaaggctgcaaaacttaaagagaagtacgagaaggacgtggcagattacaagtcgaaagggaaattcgatggggccaaagggcccgccaaagttgctcgcaagaaggtggaggaagaggacgaggaagaggaagaagaggaggaggaggaagaagaggaagaggatgagtag

SEQ ID NO: 48044 - DNA, 267 bp, Artificial Sequence
  Description of Artificial Sequence: Synthetic coding sequence
atgcccaagcggaaggccaagggcgacgccaagggcgacaaggccaagagaagatccacaagactatctgccaaaccagccccccccaagccccagccgaaacctaagaaggctcctgcaaagaagggagagaagattcccaagggcaaaaaaggcaaagctgatgccgggaaagagggtaacaacccggccgaaaacggggatgctaagaccgaccaggctcagaaggctgaaggggccggagtggcgaaagctagtgatgaatag

SEQ ID NO: 48045 - DNA, 576 bp, Artificial Sequence
  Description of Artificial Sequence: Synthetic coding sequence
atgggcaagaccaacagcaagctggcccccgaggtgctggaggacctggtgcagaatacggaattcagtgagcaggagctcaaacagtggtacaaagggtttttgaaagattgtccctccgggatccttaatcttgaggaatttcaacagctctacatcaagttcttcccttacggtgacgcctcaaagttcgcacagcacgccttccggactttcgataaaaatggggacggaaccattgactttcgagagttcatttgcgcgttatccgtcacgtctcgggggagcttcgagcagaaacttaattgggccttcgaaatgtatgaccttgacggcgacggcaggatcacgcgcctggagatgttggaaatcattgaggcaatttataagatggtgggaactgtgattatgatgaggatgaatcaagacggactcacacctcaacagcgtgtcgataaaatcttcaagaagatggatcaagacaaagatgaccagattaccctcgaagagttcaaggaggccgcaaagtccgatccgtccattgtgctgctcctgcaatgtgatatgcagaagtag

SEQ ID NO: 48046 - DNA, 552 bp, Artificial Sequence
  Description of Artificial Sequence: Synthetic coding sequence
atgggcaagaccaacagcaagctggcccccgaggtgctggaggacctcgtgcagaacacagaattttccgaacaggaactcaaagactgtccgagtggtatattaaacctggaagaattccagcagctctatataaagttcttcccgtatggcgacgcatccaaattcgcccagcatgcttttagaacatttgataaaaacggcgatgggactattgatttcagggagtttatatgcgccctaagtgtgacatcaagggggtccttcgagcagaaactcaattgggcgttcgagatgtacgacctagatggggatgggcgcattacaaggcttgagatgctggaaatcatcgaggccatctacaagatggttggaaccgtaattatgatgagaatgaaccaggatggcttgacgccgcaacagcgggtcgataagatctttaagaaaatggaccaggacaaagacgaccaaataactctggaggaattcaaagaagcagccaagtccgacccctccatcgtgctgttgctccagtgcgacatgcagaaatag

SEQ ID NO: 48047 - DNA, 1065 bp, Artificial Sequence
  Description of Artificial Sequence: Synthetic coding sequence
atggccgaggtgctgcggaccctggccggcaagcccaagtgccacgccctccgccctatgatcctctttctcatcatgctcgtgttggtcctgtttgggtatggagtcctctcaccaagaagcctgatgcccggatccctggagcgaggattttgtatggcggtgcgagagccagaccatctacagcgcgtgtccttgcccagaatggtgtatccacagcccaaagtcctgactccctgcaggaaggatgtgctggtagtgacaccatggctcgcacccattgtgtgggaaggtactttcaatatagatattctgaatgagcagttccgcttgcaaaatacaacaatcgggctgactgtcttcgcaatcaaaaaatacgtggccttccttaaactttttctggagacggccgagaagcatttcatggtgggacaccgagtgcactactatgtgttcacagaccagcttgccgccgttccccgcgtaaccctgggaaccggacgtcagctctccgtcctggaggtacgggcttacaagcgctggcaagacgtgagcatgaggcgtatggaaatgattagcgacttctgcgaacggcgatttctgtctgaggttgactacctggtgtgcgtcgacgtagacatggagtttcgcgaccatgtaggcgtggagatactgacccctttgttcggcactctgcatccgggcttttacgggtccagccgcgaagcttttacatatgaaaggagaccacaatctcaggcgtacatccctaaggatgagggtgacttttattacctgggggggttcttcggagggtccgtgcaagaggtgcagcgccttactagggcctgtcaccaggctatgatggtggaccaggctaacggtattgaggccgtctggcacgacgagtctcatcttaacaaatacctgctcagacataaaccaacaaaggttctttctccagaatacctgtgggatcagcagctgctaggatggcctgcggttcttagaaaactgcgctttaccgcggtgccgaagaaccaccaggccgtgcggaacccttag

SEQ ID NO: 48048 - DNA, 126 bp, Artificial Sequence
  Description of Artificial Sequence: Synthetic coding sequence
ctggaggagcagcccgagtgccgggaggagaagcggggcagcctgcatgtgtggaagagcgaacttgtcgaagtcgaagatgatgtgtacctccgccatagtagctccctaacatatcggctctag

SEQ ID NO: 48049 - DNA, 3648 bp, Artificial Sequence
  Description of Artificial Sequence: Synthetic coding sequence
atgaccagcaccggccaggacagcaccaccacccggcagcggcggtccaggcagaacccacagagcccccctcaagacagcagcgtgaccagcaagcgtaacattaaaaagggtgccgtgccacgctcaatccccaatctcgcagaggttaagaagaaaggcaagatgaagaagttgggtcaggctatggaagaagatctgatcgtaggcttgcagggcatggatttgaacctggaggctgaggcacttgcggggaccggattagtgctggatgagcagctcaacgaatttcactgtctctgggacgattcttttcctgagggacccgaacggttacatgctattaaagagcagctaattcaggaggggttgttggatcgttgcgtgtcgttccaggccagattcgccgaaaaagaagagcttatgctggttcacagtttagagtatattgacttgatggagactacacagtacatgaacgagggggagctcagagtcctggctgacacttacgacagtgtgtacctccacccaaattcatactcctgtgcctgcttggccagtggcagcgtccttaggctggttgatgccgtgctcggggctgagatccggaacggaatggcaatcatacgaccacctgggcaccatgcacaacactctctgatggacggctactgtatgtttaaccacgtggccgtcgccgctcgctatgcccagcagaaacaccggattcgccgggtgctgattgtcgactgggacgtgcaccacggacagggcactcaattcaccttcgatcaggatccttcagtactttacttttccatccaccgatacgagcaggggaggttctggcctcacttgaaggccagtaattggagcaccacaggcttcggacaaggtcagggctacacaattaacgtgccttggaatcaagttgggatgcgagacgctgactatatcgcagcttttctacacgttctcctgcctgttgcactggagtttcagcctcagctcgtgctggtagccgctgggttcgatgccctgcagggtgatccaaagggcgaaatggctgccaccccagccggatttgctcaacttacccatctcctcatgggtttggctgggggtaaacttatcctgtcgcttgaggggggttacaacctgcgcgccctcgccgagggagtgtccgcctcactgcatactctgctcggagatccatgcccaatgctcgagagtccaggggcgccgtgtcgttccgctcaggcctccgttagctgtgctcttgaggcgctggagcccttctgggaggttctggtacggagtactgagactgtggaacgtgacaatatggaagaggacaatgttgaggagtcagaggaagaggggccctgggagcccccagtgctccctatactgacgtggcccgtgctgcagtccagaactgggctggtctatgatcaaaatatgatgaatcattgcaatctgtgggatagtcatcaccccgaggtgccacagcgcattctgagaattatgtgcagactcgaagagcttgggttagcgggtaggtgcctaacactgacgcctagaccggccacagaggcagaactcctgacctgccactccgcagagtacgtggggcacctgcgagcaacagaaaagatgaaaacccgagaactgcaccgcgaatcgtcaaacttcgacagtatttatatttgcccctccacctttgcttgcgcacagttagcaactggcgcagcctgtcgactggtggaagccgtcctgagcggagaagtgctgaacggtgctgcggtggttcggcccccaggccaccacgcagagcaagatgcagcatgtgggttctgctttttcaactctgtcgccgtcgcggccaggcatgcgcagacgatttctggacatgctttaagaattttaatcgttgattgggatgtgcaccacggtaatggaactcaacacatgtttgaagatgacccatcagtgctctacgtttccttgcaccgatacgaccatgggaccttcttccctatgggtgacgagggcgcctcttctcaaatcgggcgggccgctggcaccggattcaccgtgaatgtggcctggaacggtcctaggatgggggacgcggactacttagcagcttggcatcgcttggttctccccatcgcttacgaattcaatcctgagctggtcctggtgtcagcggggtttgatgcagcaaggggtgatcccttgggcggctgtcaggtgtctcctgaagggtatgcacatctaacccatctgctgatgggacttgcctctgggcgaatcatccttatcctggagggcggctacaacctgacttcgattagcgaatcaatggccgcatgcacccggagccttcttggagatcccccacccctgctgaccctcccccgcccaccactttcaggagcgctggcatctatcacagagacaattcaagtccaccggcgttactggcgcagcttgagagtcatgaaggtcgaggatagagagggaccctcctctagcaaactcgtgaccaaaaaagcacctcagccagctaaaccaagactggctgagcgtatgacaactcgggagaaaaaggtgcttgaggcaggcatgggcaaggtgaccagcgcatctttcggggaagaatcaactccaggccagaccaatagcgaaacagccgtggtggcactgacacaggatcagccaagtgaggctgctacaggcggagctacccttgctcagaccatcagcgaagctgctattgggggcgcaatgcttggacagaccaccagtgaagaagccgtgggcggcgcaacaccagaccagactactagcgaggaaacagttgggggagccatactagatcagactacctctgaggatgcagtgggaggcgccaccctgggccagactacttcagaagaggctgtcggcggcgccaccctggcacagactacttctgaagcggctatggagggcgccaccctggaccaaactacatcagaagaagccccgggcggtacggaactgatacagacacccctggcctcctccacggaccatcaaactcctcctacctcccccgtgcaaggcacgacacctcaaatatccccctctactttgattggctcattaagaactctcgagctggggagcgagtcccaaggtgcaagcgaaagccaggcccccggcgaggagaatctactgggagaagcagccggaggccaagatatggccgattcgatgttaatgcaggggagtcggggcctgactgatcaagcgattttttatgcagtcacgccgctgccttggtgccctcaccttgttgccgtgtgtccaatccctgccgcaggcttggatgtgacccaaccgtgtggcgattgtggcaccatccaggaaaactgggtctgtctgtcctgctaccaggtgtattgcggtaggtatatcaatggccacatgctgcagcaccacgggaattccggtcacccactagttttgagttacatcgatctgtccgcatggtgctactactgccaggcctatgtccaccatcaagcacttcttgacgttaaaaatattgcgcatcaaaataagttcggtgaggacatgcctcacccccattag

SEQ ID NO: 48050 - DNA, 312 bp, Artificial Sequence
  Description of Artificial Sequence: Synthetic coding sequence
atgagcggccggggcaagggcggcaagggcctgggcaagggcggcgccaaaaggcaccgcaaagtgctgagagataatattcaaggtatcacaaaacctgcgattaggagactggctaggcgtggtggggttaagagaatctctgggttgatttatgaggagacacggggcgtgctcaaagtctttctcgaaaacgtgatccgcgacgccgtgacttacactgagcatgctaagaggaagactgtaacagccatggacgtcgtgtacgcacttaaaagacaggggagaaccctgtacggcttcggcgggtag

SEQ ID NO: 48051 - DNA, 312 bp, Artificial Sequence
  Description of Artificial Sequence: Synthetic coding sequence
atgagcggccggggcaagggcggcaagggcctgggcaagggcggcgcgaagcggcacagaaaagtcctaagggataatatccaaggaatcacaaaaccagccatcagacgattggctcgcagagggggtgtaaaacgcatctcgggactcatttatgaagagactcgcggcgttctgaaagttttcctggagaatgtgattcgcgacgctgtgacgtacaccgagcatgccaaacggaagacagttacggcaatggacgtggtgtacgcgctgaagcgccaagggagaactctctacgggttcggtggctag

SEQ ID NO: 48052 - DNA, 2145 bp, Artificial Sequence
  Description of Artificial Sequence: Synthetic coding sequence
atgcccgccgccgccggcgacggcctgctgggcgagcccgccgcccctggtgggggcggaggagctgaagacgcggctcgccctgccgctgcttgtgaagggtccttcttgcccgcctgggtatctggcgtgcctcgcgaaagacttagggacttccaacaccataagagagttggaaattatctgatcgggagccggaagcttggcgaggggagcttcgccaaagtccgggaaggactccatgtgctcacaggggaaaaagtagctattaaggtgatagacaaaaagcgggcgaagaaggacacttatgtcactaagaatttacgcagggaggggcagatccagcagatgatcaggcatcctaatattacccagctgctggatatactggaaactgaaaactcttactacctggtcatggagctttgcccaggaggaaatttgatgcataaaatctatgaaaagaagaggctagaggagagcgaggcaaggaggtacatcaggcagttaatcagcgccgtggaacatcttcatagggctggcgttgtgcacagggacctgaagatcgagaaccttctgttagacgaagacaataacattaagctcattgactttggactgagtaactgcgcaggaatacttggctatagtgacccttttagcacacagtgcggttcaccagcttatgccgcacctgagctgcttgcccggaaaaagtacggccctaaaatcgatgtctggtcaataggggttaatatgtacgccatgctcactggcacacttccattcactgtggaaccttttagcctgagggccttgtatcagaagatggtggacaaagagatgaatccactgccgacacagctgagtacgggcgcgatctctttcctcaggtcactgctggaacccgaccccgtgaagcgccccaacatccagcaagccctggctaaccgctggctcaatgaaaattacacaggcaaggtgccttgcaatgtgacttaccctaaccggatttccctcgaggacctctcccccagcgttgtcctgcacatgacagagaaactgggttataagaacagtgatgttataaacacagttctcagtaatcgagcatgccacatcctggccatttattttctccttaataagaaacttgagaggtatttatctggaaagagtgacatacaagattccctgtgctacaagacacgcctgtaccagatagaaaagtatagggcaccaaaggagtcatacgaagccagcctagatacctggacacgggatctggaattccatgcggtccaggacaagaaacccaaggaacaggagaagcggggtgactttcttcacagaccgtttagtaaaaagctcgacaaaaatctcccctcacataagcagccttcaggttccctgatgacacaaatccagaacaccaaggccttactcaaagacagaaaggcgagcaagagctcctttcccgataaagattcattcggctgtaggaacattttcagaaaaacttcggactccaattgcgtcgcgtcctccagtatggagttcatccctgttcccccgccccggactccacggattgtgaagaagcccgagccgcatcagcctggtcctgggtccacagggattcctcacaaggaagatccactgatgctggacatggttagaagctttgagtctgttgacagggacgatcatgtcgaggtgctctcaccatcccaccactatcgcattctgaactcgcctgtatcgctggcacgcaggaattcctccgaaagaacactttctccagggttgcctagtggctcaatgtcccccttacacactcccttgcatcccacccttgttagctttgcccatgaagataaaaatagcccaccaaaggaagaggggttatgctgcccacctcctgttccgagcaatgggccaatgcagccgctcggtagcccaaactgtgtaaagagccggggacgctttcccatgatggggatcggacagatgctccggaagcgccatcagagtctacagccatcagccgatagacccctcgaggcctcgctaccaccgttgcaacccctggcacccgtaaatctcgcctttgacatggcggacggagtgaaaactcaatgttag

SEQ ID NO: 48053 - DNA, 762 bp, Artificial Sequence
  Description of Artificial Sequence: Synthetic coding sequence
atgggcctgagccccggcgccgagggcgagtacgccctgcggctgccacggattccgcccccccttccaaaaccagcttccagaacggcgtccaccgggccgaaggatcagccgcctgcactccgccgctcggccgtcccccatagtggattgaacagtatttcgccactcgagctggaggagtctgttgggttcgccgccctggtccagcttccggctaagcagcctcctcccggcacgctggagcaaggccgaagcatacagcagggtgagaaagctgtcgtttcacttgaaactactcctagccagaaggccgactggagctctattcctaaacccgaaaacgagggcaagctcatcaagcaagcggccgaagggaagccccggccgcggccgggcgacttaattgagattttcagaatcggctacgaacactgggccatttatgtggaagatgactgcgttgtccacctcgcccccccttccgaggagtttgaggtcggctctatcacttctatctttagtaaccgcgctgtggtgaaatactcccggcttgaagacgtcttgcatggctgttcctggaaggtgaacaataagctggatgggacctacctgcccctccctgttgataagatcatccagcgcacaaagaagatggtgaataagattgtccagtatagcctcatcgaaggcaactgtcgggctaggcctgacggaagaagcgaaggctgttggtcaagctatttcagttgcagtggctag

SEQ ID NO: 48054 - DNA, 810 bp, Artificial Sequence
  Description of Artificial Sequence: Synthetic coding sequence
atgggcctgagccccggcgccgagggcgagtacgccctgcggctgcccagaataccccccccgttgccaaaacctgccagccggaccgcttccaccggcccaaaagatcaacctccggcactcaggcgctcagccgtgccccattccgaagaaagcgtgggattcgcagccctagtacagctgccagctaagcagcccccaccaggcactttggaacagggccggtccattcagcagggagagaaagctgtggttagcctggaaaccaccccttcccaaaaggccgattggtcgtcaattccgaaacctgaaaatgagggcaaattgattaagcaagctgctgagggcaagccaaggcctcgccctggtgacctgatcgagatcttccggatcggttatgagcactgggcaatatatgtggaggacgattgtgtggtccacttggcccccccatcagaagagttcgaggtaggctcaatcaccagcatattttctaatagagcagtggtcaaatacagtaggctggaagatgttctacacggctgttcttggaaggtcaacaataaactcgacgggacctacctgcctcttcccgtggacaagatcatccagcgcaccaagaagatggtaaacaaaatcgtgcagtatagcctcatagagggaaactgcgagcacttcgtgaatggactcaggtacggcgtgccgaggtcacagcaggtcgaacatgcactgatggaaggtgctaaagccgccggggccgtgataagcgcggtcgttgactctataaagccgaaacccattaccgcctag

SEQ ID NO: 48055 - DNA, 840 bp, Artificial Sequence
  Description of Artificial Sequence: Synthetic coding sequence
atgggcctgagccccggcgccgagggcgagtacgccctgcggctgccaaggatcccgcctccccttccaaagcctgccagtaggaccgcgtctactggccctaaagatcaacctcccgccctgcggaggagcgccgttccccactctggtcttaattctattagccccctcgaactggaggagagtgtgggtttcgccgcccttgtgcagcttccagccaagcagccacctcccggtactctagaacagggcagatccatccagcagggcgaaaaggcggtagtttccttagaaacaactccctcgcagaaagcagactggtcctctatccccaaacctgaaaatgaaggaaaacttataaaacaggccgcagagggcaagcccagaccgaggcctggggatctgatagaaatattccggatcggttacgagcattgggcaatttacgtagaggacgattgtgtggtccacttggcccctcctagtgaggaattcgaagtcggatccatcacttccatatttagtaatcgcgctgtggtgaaatactcacgcctggaggatgtcctgcatggctgcagctggaaggtcaataacaaactcgacggaacttatttgcccttgcccgtggacaagattatacaaagaacaaagaaaatggtgaataaaatcgtgcagtacagtctgatagagggcaactgtgagcatttcgtgaatggtctgcggtacggagtcccaagatcccagcaggttgaacacgccctgatggagggcgccaaggccgctggcgccgtaatctcagcggtcgtggactccatcaagcctaagcctataaccgcgtag

SEQ ID NO: 48056 - DNA, 2961 bp, Artificial Sequence
  Description of Artificial Sequence: Synthetic coding sequence
atggaccggatggccagcagcatgaagcaggtgcccaaccccctgcccaaagtgctgtcacgccgcggcgtcggcgccggcttggaagcagcagagagggagtcttttgagcgtacccagacggtgtcaattaacaaggccattaacacgcaagaggtcgcagtgaaggaaaaacatgccaggacctgcatactcggaacccatcacgagaagggcgctcagacattttggagcgtagtcaaccggctgcctctctcaagtaacgctgtcctgtgctggaagttttgtcacgtcttccacaaacttctcagagatggccacccgaatgtgctgaaggacagtctgcgctatcgaaatgaattatctgatatgagccgtatgtgggggcacttgagcgaggggtacgggcagctctgcagcatctacctgaaactgctccggaccaagatggagtatcatacgaagaacccacgcttccccgggaacctccaaatgtcagatcgccagttggatgaagccggtgaatcagatgttaataattttttccaactcaccgttgagatgttcgactacctggagtgcgaactgaatctctttcagacggtgtttaacagcctcgacatgagtaggagcgtcagcgtcaccgctgcaggtcaatgtcgactcgcacccctgatccaagtgatcctcgactgcagtcatctctacgattacacagtgaagctgttattcaaacttcattcttgtctccccgccgatacactgcagggccatagggacagatttatggagcagtttactaagctgaaggatctgttctaccggagctccaatctccagtactttaagaggcttattcagattcctcagctgcccgaaaatcccccaaattttctgagagcgagtgccctgtccgaacacatctccccggtcgtggttattcctgctgaggccagctcccccgacagtgaacctgtgctggagaaggacgacctaatggacatggatgcttctcagcagaaccttttcgacaacaagtttgacgatattttcggttcctctttttcatctgatcccttcaactttaacagccaaaatggagtgaacaaggacgagaaggatcatttgatcgagagactatatcgagaaatttctggtctcaaagcccagcttgaaaacatgaaaaccgaatcccagcgcgtggtgctgcagttgaagggacacgtgagcgagctggaagctgatttggccgaacagcaacatctgcgtcagcaggcagccgatgactgcgaattcttgcgcgctgagctcgacgaactccgacgacagagagaggataccgagaaagcccagagatctttatcagagattgaaagaaaggctcaggctaacgagcaaagatacagcaaactgaaggaaaaatactccgagctggttcagaaccacgccgacctgctccgtaaaaatgccgaggtgacaaagcaagtttctatggccagacaagcgcaggtggacctggagagggagaagaaggaactggaagactctcttgagcgaatatctgatcaaggccagcggaaaacccaagagcagctggaggtgctggagtcactaaagcaggagctcgccacttcccagagggagctgcaggtgctgcaagggagtctcgaaacaagtgcccaatccgaagccaattgggcagcagaattcgcggagctcgaaaaagagagggactccctcgtgtcgggcgccgcccacagagaggaagagttgagcgccctcaggaaggaactccaagatactcaactcaagctcgcctccaccgaagaaagcatgtgtcaacttgctaaagatcagagaaagatgcttctggttggcagccgcaaagctgctgagcaggtcatccaagacgcattgaaccaattggaagaaccccccctgatcagttgcgctggatccgccgaccatctgcttagtacggtgacttccatcagcagctgcatcgaacagttggaaaagtcctggtcccagtatctggcttgtcctgaagatattagcggtctgttgcactccatcactcttcttgcccatctgacttccgacgccatcgcccatggtgctacaacatgcctgcgcgcccctccagaacctgccgacagtctgaccgaggcttgtaaacaatacggtagggagacactcgcgtatctggcctctctggaggaggagggatccctggaaaatgctgactcaacggccatgaggaattgcctgagcaaaatcaaggctatcggcgaagaactcctgccccggggactcgacatcaagcaagaggagctcggggatctggttgacaaggaaatggcagctacaagtgcagctattgagactgcaacggcaaggattgaaggaacagccagtcccaaagaattttacgccaagaatagccgctggacagaaggtttgatttcagcctcaaaggcagtgggatggggagcaacagtcatggtcgatgctgctgatcttgtagttcagggccgcggtaaatttgaagagctgatggtgtgcagccacgaaatagcggcctctaccgcccagctggttgccgcgagcaaagttaaggcagacaaggacagcccgaacttggctcaactacagcaggcctcccggggcgtgaatcaagctacagcgggagttgtggccagtacaatcagcggcaagtcccaaattgaggagacagataacatggatttctcatcgatgactctgacgcagatcaaacggcaggagatggacagccaggtgagagtgttagagctggagaacgagctccaaaaggaacgacaaaaactgggcgaactgcgaaaaaagcattacgagctggcaggcgtagcggagggatgggaggaaggaaccgaggcaagcccccccactctgcaggaggtggtcactgagaaagaatag

SEQ ID NO: 48057 - DNA, 1308 bp, Artificial Sequence
  Description of Artificial Sequence: Synthetic coding sequence
atggccgcccacctgctgcccatctgcgccctgttcctgaccctgctggatatggcgcagggatttagaggtccactgctgcctaaccggccattcacaacagtttggaatgctaatacccagtggtgtttggaacggcacggagttgacgttgatgtgtccgtgttcgacgtcgtggcgaatcccggtcagaccttcagagggcctgatatgacgatcttttacagctctcagttagggacatatccgtactacacacccaccggagaaccagtgttcggagggctcccccagaatgctagcttgatagctcacctcgcaaggaccttccaggatatcctggcagcaatcccagctcctgacttcagtggcctggccgtcatagactgggaggcatggcggccccggtgggccttcaattgggatacaaaggatatttataggcagagatctcgagctcttgtccaggctcagcacccagattggccagcaccacaagtggaggccgtcgcccaggaccaattccaaggtgccgctcgcgcctggatggctggcaccctgcaactcggccgcgcacttcgccctcgcggactgtggggattctatggcttcccagactgttacaattatgatttcctgtcccccaattatactggacagtgcccctccgggatcagggcccagaatgaccaactcgggtggctctggggtcaatctagggccctgtacccctctatctacatgcctgccgttttggagggaactggtaagagccagatgtacgtccagcatagagtggctgaggcattccgtgtcgctgtggccgccggagacccaaacctgcccgtgcttccttacgtgcagattttttacgataccactaaccacttcctacccctggatgagctggaacactctctaggcgaatctgcggctcagggagctgccggcgttgtgctttgggtctcctgggagaatactagaaccaaagagagttgccaagctatcaaagaatacatggacactactctcggtccattcattctcaatgtcacctctggcgctctgctttgctcacaggcattgtgtagtgggcacgggcgatgcgtgcgtcgcacttcccatcccaaagctctgctactgttgaacccggcgagtttctctatacagctgacaccaggcgggggcccattaagcctgagaggcgccctcagcctggaggaccaggctcagatggctgtcgagtttaagtgcagatgctaccccggatggcaggctccgtggtgcgagagaaaatctatgtggtag

SEQ ID NO: 48058 - DNA, 1308 bp, Artificial Sequence
  Description of Artificial Sequence: Synthetic coding sequence
atggccgcccacctgctgcccatctgcgccctgttcctgaccctgctagacatggcgcagggttttcgcgggccattgcttccaaatcgccctttcactacagtatggaatgccaacactcagtggtgtttggagcggcacggcgtagacgtcgatgtctcggtttttgacgtggtggccaatcccggacagacgtttcgggggcccgacatgacaatcttctattcgtctcagctaggcacttacccatattacaccccaacaggagaacccgtctttggtggactcccccaaaacgcttctctgatcgcacacctagcaagaacatttcaggatatcctcgcggccattccagccccagatttctccgggctcgctgtcattgattgggaggcctggcgacctagatgggcctttaattgggacactaaggacatctatagacagaggtcaagagccctcgtgcaggcccagcatccggattggcctgccccgcaggttgaggcagtcgcccaagaccaattccagggcgcagcacgcgcatggatggcagggaccctgcagctcggccgagcactcaggccacgcggtttatggggcttctatggatttcccgactgctataattacgacttcttatctccgaactacactgggcagtgtccttctgggattcgcgctcagaatgatcagctcggctggttgtggggccaatcccgggccttataccccagcatttatatgcccgccgtgcttgagggaaccggtaagtctcagatgtacgtccagcaccgggtagctgaagcttttcgagtggctgtggctgctggggatcccaatctgcccgttctgccctacgtgcagattttctacgacaccactaaccacttccttcctctcgatgaactggagcattctctgggcgaaagcgccgcccagggagcagctggagtggtgctatgggtctcatgggaaaacactagaacgaaagagagctgtcaggcaattaaagaatacatggacactacgctcgggccattcatcttaaacgtgacctctggggcgttgctctgctcccaagccctgtgttctgggcatggccggtgcgtccggcgcacatcccaccccaaagcactcctactgctgaacccggcatctttcagtattcagcttaccccagggggtggccctttatcactccggggcgcactttccctcgaagaccaggcccagatggccgtggaattcaaatgccgatgctatcctggctggcaggccccatggtgcgaaaggaagtcaatgtggtag

SEQ ID NO: 48059 - DNA, 1422 bp, Artificial Sequence
  Description of Artificial Sequence: Synthetic coding sequence
atgcgggccggccccggccccaccgtgaccctggccctggtgctggctgtatcttgggctatggaactgaaacccacagcgccccctatattcaccggccggcctttcgtggtggcctgggacgttcccactcaggactgtgggccaaggctcaaagtgccattggaccttaatgctttcgatgtgcaggccagtcccaacgaagggttcgtgaatcaaaatataactatcttctaccgggaccggctcggtctatacccgcggtttgactccgccggcagaagcgtccacggaggtgtgccccagaatgtgtctttatgggcacacaggaaaatgctgcagaagagagtcgagcattatataagaacacaggagtcagctgggctcgccgtgattgactgggaggattggcgacccgtgtgggtcagaaattggcaagacaaagacgtctacagacggctttctaggcaactagtggcttctcgccaccccgactggcctccagacaggatcgtcaagcaggcacagtatgaattcgaatttgccgctcagcagttcatgttagaaacactgcgctatgtgaaggcggtgagacccagacatctgtgggggttttacctgttcccggactgctacaaccacgattatgtgcagaattgggagagttataccggcaggtgtcctgatgttgaggtggcacgcaatgaccagttggcgtggctctgggccgaatccactgccctgtttccaagcgtctatctggacgaaaccctggctagctccaggcatgggcgtaatttcgtcagctttcgcgtccaagaagccctaagagtggccagaacacaccacgctaaccacgcattacctgtgtatgtctttacccgcccaacatactctagacggcttacaggtttgtccgaaatggacctgatctcgaccattggcgagagcgccgcactgggtgcggctggagttatactgtggggtgatgccgggtatactaccagcacagaaacatgtcagtacttgaaagactatttgacccgtttgttggtgccatatgtagtgaatgtgtcttgggctacacagtattgtagcagagcccagtgtcatggccatggccggtgcgtccgacggaacccctctgcatcaacgtttctacatctgagcactaacagcttccggctggtgccagggcacgcacccggggagccccagctgaggccggtcggagagttatcctgggctgatattgaccatttgcagactcacttcaggtgtcagtgctacctcggttggagcggagaacaatgccagtgggatcatcgacaggccgccggcggagcgtctgaggcttgggctggcagccacttgacctctctgctggcgctcgccgcactcgcgttcacatggacgctgtag

SEQ ID NO: 48060 - DNA, 1422 bp, Artificial Sequence
  Description of Artificial Sequence: Synthetic coding sequence
atgcgggccggccccggccccaccgtgaccctggccctggtgctggccgtgagctgggccatggagctcaaacctactgcaccaccaatatttaccggcaggccattcgttgtagcatgggacgtccccacacaggactgtggcccaaggctgaaggtccccctagatctcaacgcatttgacgtccaggctagccctaatgaaggattcgtaaaccagaatataactattttttaccgggatcgacttggcctgtatccccgcttcgattccgccgggcgttctgtccacggaggcgtgccccagaacgtgtcactatgggcccaccgcaaaatgctccaaaaacgcgttgagcattacatcagaactcaggaaagcgccggactagccgttatcgactgggaggactggaggcctgtatgggtgaggaattggcaggacaaggacgtataccgcaggctgtcacggcagctggtagcttctcgccacccggattggcccccagaccggattgtcaaacaagcccagtacgagtttgaatttgctgctcaacaatttatgcttgaaaccttgcggtacgtgaaagcagtgaggccacggcacctctggggcttctacttgtttccagattgctataatcatgactatgtccagaactgggagtcatacacaggcagatgtccggacgtggaagttgctaggaatgaccagctagcatggctttgggcagaatccacagccctttttcccagcgtttatctggacgagacgttggcgagtagccgacacggtagaaacttcgtcagtttccgtgttcaggaagcgctgcgcgtcgctcgaacccatcacgctaaccacgccctaccagtgtatgtattcacaaggcccacttacagcagaaggctgactggattaagcgagatggatttgattagcacaattggggaaagcgccgccctcggtgccgccggagtgattctttggggagacgctggttacaccacaagcaccgaaacttgtcagtacctcaaggattatctcactcgactgctggtcccatacgtcgttaacgtgagttgggccacacagtattgctcgagggctcagtgtcatggtcacggacgctgtgtgcgaagaaacccgtcagccagcacctttttgcatcttagcaccaattcttttcgacttgttccgggccatgctcctggagagcctcagttgcggcccgtgggcgaactgtcctgggctgatattgatcacctccagactcatttccggtgtcagtgttacctgggatggtccggggagcagtgtcagtgggatcaccggcaggctgcagggggagccagcgaggcttgggcaggcagccacctcacatccttacttgccctggccgccctggccttcacctggactctctag

SEQ ID NO: 48061 - DNA, 1164 bp, Artificial Sequence
  Description of Artificial Sequence: Synthetic coding sequence
atgaccacccagctgggccccgccctggtgctgggcgtggccctgtgccttggctgcggccagcctctaccacaggttcccgagcgccccttctcagtgctttggaatgtgcccagtgcccattgtgaggctcgcttcggcgtgcacctgccgctgaatgctcttggaattattgcaaatcgaggccagcacttccacggccaaaatatgacaatcttctacaagaatcaattggggttgtacccctactttggtcctagaggcaccgcccataacggaggtatcccacaggcactgcctctggacagacatttggcccttgctgcttatcagatccaccactcactgcggccaggttttgcaggtccagcagtgcttgactgggaagagtggtgtccactctgggccggaaattggggacggagacgggcatatcaggctgcatcatgggcatgggcccaacaagtgttccctgacctcgatccacaagagcaactttacaaagcgtataccggattcgaacaggctgcaagagctctaatggaagataccctgagagtagcacaagccctgagaccacacggcctgtggggcttctaccattaccctgcatgtggaaatggatggcactccatggccagtaactataccggacgttgtcatgcagccaccctagcgagaaatacccagcttcattggctctgggccgcctcttccgcgctctttccatctatctacttgccccctcgacttccaccggcgcaccaccaggcctttgtgagacataggctcgaagaagcctttagagtggccctggtaggccatcggcacccactgccagtcctggcgtatgtacgacttacccaccggcgttctggcaggtttttgagtcaggaagaatgctggcatctgcacgactatctggtggatactctggggccttacgttatcaatgtcaccagggcagctatggcatgtagccaccagagatgtcatggccacgggcgatgtgctcgccgggatcctggccagatggaagccttcctccatttgtggcccgacgggtctcttggagactggaagtccttctcctgccattgttattggggatgggccgggccaacatgtcaagaacccagaccaggccccaaagaggcggtatag

SEQ ID NO: 48062 - DNA, 612 bp, Artificial Sequence
  Description of Artificial Sequence: Synthetic coding sequence
atgaaggtgaaggtgatccccgtgctggaggacaactacatgtacctagtgatcgaggagctgacccgagaagccgtcgccgtggatgtggccgttccaaagcgacttctagagattgtgggtagagagggtgtgagtcttacagcagtactaacaacacatcaccactgggaccacgccaggggaaacccagaactggccagactgaggcccggactagcagtcctgggcgctgacgagaggatcttcagtctcaccagacgcctagcacacggggaggagttgagggtttctgcccggtcccgagaagggcggggtggcagaccagggtctacaaggccacaccgatctgcatgctcgtcagccgcggtcagaggacatcctagagccctcccccctgatgctaggccccaccgaagaccacacgaactactccctgtgggtgggcgcctgcctggacctacaaggcccgtgcttggaagacgggccgtcggaggcaggctccgccttgtccccgggggacaaagacccgccgatgtgcctgagccggggagggccgggtatccagcccctagggacgaaggcgttctacggccccgggcgcacgcttag

SEQ ID NO: 48063 - DNA, 849 bp, Artificial Sequence
  Description of Artificial Sequence: Synthetic coding sequence
atgaaggtgaaggtgatccccgtgctggaggacaactacatgtacctcgtgatagaagagctgacacgggaagccgtggccgtcgatgttgcggtgcccaagcggttactggagatcgtagggcgagaaggtgtttcactgacagcggtactaactacccatcatcattgggatcatgcccggggcaacccagagctggccaggctgcggccgggactggcagtgctcggggccgacgagagaatatttagtctaacacgacggcttgcgcatggcgaagagctacgcttcggcgccattcatgtcaggtgcttactgacacctggccacactgccgggcacatgtcatactttctgtgggaagatgactgtcctgatccacctgctctattcagtggtgatgctttatctgtggctgggtgcggctcctgcttggaagggagcgcccagcagatgtaccagagcttggccgagctaggaaccctgcctcctgaaactaaagtgttctgcggccacgaacatactttgtctaatctagagttcgcccagaaagtcgagccctgcaacgatcacgtgagggccaagctgtcgtgggcgaagaaacgggatgaggacgacgttcctaccgtcccctcaacactgggggaggagagactctacaatcccttccttagggtcgcggaagagcctgtgcggaaatttacaggtaaagcagtgcctgcagatgtcttagaggcgctctgtaaagagcgcgcacggttcgagcaagccggagaaccccggcaaccacaggccagggccctgttggcattgcagtgggggctgctgtcagctgctccgcatgactag

SEQ ID NO: 48064 - DNA, 609 bp, Artificial Sequence
  Description of Artificial Sequence: Synthetic coding sequence
atgaaggtgaaggtgatccccgtgctggaggacaactacatgtacctcgtgattgaagaactgactagagaggccgtggcagtggacgtcgccgtaccaaaacggctcctggagatcgtgggccgtgaaggcgtctctctgacagctgtcttgacgactcatcatcattgggatcacgcccgaggcaatcccgaactggctaggctaaggccgggactcgcagtgctgggcgcggatgaaaggatcttctccctcacacgaaggctcgcacacggagaagagctaaggttcggggccatccacgtgaggtgtctcctgactcccggccataccgcaggccacatgtcctactttttgtgggaggacgactgtccagaccctccggctttgttttctgggactaggtcggctgagagggcacatccggcctccagacggccaagacccatttgcagtgaccccccctcacccgcccgtcgccgtgccgttggcggcaggcttagattagtgcccggaggccaacgcccagccgatgtccctgaaccggggcgtgcagggtatcctgccccgcgggacgagggtgttttacgcccaagagcacacgcttag

SEQ ID NO: 48065 - DNA, 507 bp, Artificial Sequence
  Description of Artificial Sequence: Synthetic coding sequence
atgttccccctgatcagcagccaccacctgtggtggggcggcctgagacgaacagtttgccttaacttgcccgtcctcaccctccaacattttcagcacatgcacatcaaagtcggcgatagggccgagctgagaagagcattcacgcagactgacgtggccaccttttcggaactcaccggagacgtgaatccgctgcatctcaacgaagacttcgccaagcatacaaaattcgggaatacgatagtccatggggtgctcattaatggtctcatctctgctctcctgggcactaagatgccaggccctggctgcgtatttttgtcacaggaaatctcctttccagcgccactgtacatcggggaggtggtcctagccagtgctgaggtgaagaagctcaaacgatttatcgctatcatcgcggtgtcttgcagcgtgatagagagcaagaagaccgttatggaaggttgggtgaaggtgatggtgcccgaagcttccaagtcctag

SEQ ID NO: 48066 - DNA, 1164 bp, Artificial Sequence
  Description of Artificial Sequence: Synthetic coding sequence
atgaaccggcaccacctgcaggaccacttcctggagatcgacaagaaaaattgctgcgtgtttcgggatgactttattgcaaaagttttgcctcccgtgctgggactggagtttatcttcggcttgctgggaaatggcttggctctgtggattttttgtttccatttgaagtcttggaaatcctctcgaatcttcctttttaacctagccgtggcagacttcttgctgatcatatgtctcccattcgtgatggattattatgtgcgccgcagcgattggaagttcggagacatcccatgtcgattagtcctctttatgtttgcaatgaatcggcaaggctccataattttcctgactgttgtggctgtggaccgatacttccgcgtggtgcacccccaccatgccttaaacaagatatctaattggactgccgcaattatctcttgtctgctctgggggattaccgtggggctgactgtacatctgttgaagaaaaagctgctcatccagaatggcaccgcgaatgtgtgcatatctttttctatttgccacacctttaggtggcacgaggcaatgtttttactggaattcttcctaccgttaggaatcattctcttctgttctgcgcgcattatctggtcactgcgccaacggcaaatggataggcacgctaagataaagcgggctattacttttatcatggtggtggccatcgtattcgtgatctgttttcttccatcagtggtggtgaggattcacatcttttggctcttgcacacttcaggtacgcagaattgtgaggtgtatcgttctgtggatctcgcgttctttatcactctgagcttcacctatatgaatagcatgctggatccggttgtttactacttcagctcaccttccttccccaacttcttttctacgcttatcaatagatgccttcaacgtaagattactggcgaaccggataataatagatcaacaagcgtcgaactgaccggtgatcctaataaaacacggggagcgcccgaagctcttatagcgaactccggcgaaccgtggtctccatcatatctgggcccaacgtcaaacaaccacagcaagaagggacactgtcatcaagaacccgcctccttagagaaacagttaggctgctgtattgaatag

SEQ ID NO: 48067 - DNA, 966 bp, Artificial Sequence
  Description of Artificial Sequence: Synthetic coding sequence
atgagcggcaacggcaacgccgccgccaccgccgaggagaacagccctaagatgagagtgataagggtcggaacccggaagtctcagctcgcacgcatccaaaccgattctgtcgtggccacactcaaagcttcttatccaggcctccagttcgaaatcatcgccatgagcacaaccggggataaaatccttgacactgccttgagcaaaataggtgaaaagagtcttttcacaaaagagctggagcacgccttggaaaagaacgaagttgatttagtcgtgcactctctgaaagaccttcccaccgttctgccacccgggttcaccattggcgccatttgcaagcgcgaaaaccctcatgacgccgttgtctttcacccaaaattcgtcggcaagactcttgagacactgcctgaaaagagcgtcgtgggcacctcaagcctgcgacgagccgctcagttacaaagaaaattccctcatctggagtttaggagcatcagagggaatctcaacactaggttgcgtaaactcgacgaacaacaggaattctctgctatcatcttggcaaccgctggactacaaagaatgggctggcataacagggttggccagattctgcacccagaggaatgtatgtacgctgtgggccaggaggggggctgttccgttcccgtggctgtgcatacggccatgaaggacggacaattatatctgacgggcggggtgtggagccttgacggtagtgactctatccaggaaacaatgcaggctacaattcacgtcccagcccagcacgaagatgggcccgaagatgacccccagctcgttggtattaccgcgcgcaatattcctcgcgggccccagcttgccgcccagaatctggggatttctcttgctaatctgctcctcagtaaaggagccaagaatatcctggatgtcgctcgccagttgaacgatgcccattag

SEQ ID NO: 48068 - DNA, 1035 bp, Artificial Sequence
  Description of Artificial Sequence: Synthetic coding sequence
atgcgggtgatccgggtgggcacccggaagagccagctggcccggattcaaacggattccgtggtagctacactgaaagcatcttaccccggcttgcagtttgagataatcgctatgtccacaaccggggataaaatcttagacacagctctgagcaaaattggagagaagtccttgttcacaaaagaacttgaacatgccctggaaaagaatgaagtggacctggtagtgcacagtctgaaagaccttcccacagtgctgcctccaggctttactattggggcaatctgcaagagggagaatccacacgatgccgtcgtcttccaccccaagttcgtcggcaagactctcgaaacactccctgagaaatctgtcgtaggcacgtcaagccttcggcgggctgcccagttgcagcgaaaattcccgcacctggagtttcgctcaatacgcgggaatttaaacactcggctgcggaagctggatgagcagcaagaattctctgcaatcattttggctactgcaggcctgcagcgtatgggatggcacaatagggtgggacagattctccaccctgaagaatgtatgtatgcagtgggacagggggcccttggagtggaagttagggccaaagaccaggatatcctcgatctagtgggcgttttgcatgaccctgaaaccctgcttcggtgcattgcggaacgggcctttctgaggcaccttgagggcggttgtagtgtcccagtagcggtgcacaccgccatgaaggacgggcagctttacttaacaggcggtgtttggtccttggacgggtccgactccattcaggaaaccatgcaggcaaccatacacgtgcccgcccagcacgaagatggaccagaggatgatccacagcttgtgggcatcacggcccgaaatattccaaggggcccacagcttgctgcacagaacctgggcatctcattagcgaatctcctgctgagcaaaggcgcaaagaatatcttggacgtggctaggcagctgaacgacgctcactag

SEQ ID NO: 48069 - DNA, 915 bp, Artificial Sequence
  Description of Artificial Sequence: Synthetic coding sequence
atgcgggtgatccgggtgggcacccggaagagccagctggcccggatccagacagacagcgttgttgcaacactcaaagccagctatcctgggctccagtttgagataatagctatgagcaccaccggagataaaattctggacaccgccctgagcaagatcggcgaaaaaagcctgttcacaaaggaactggagcacgcacttgagaaaaacgaggtggatttggttgtccactctttgaaggatctcccaactgtgcttcctccagggtttaccatcggggcgatatgcaagagagaaaatccacatgatgcagtggttttccatccgaaatttgtcggcaagaccctggagaccttacctgagaagtccgttgttggcacttcgagtctaagaagagctgctcagctccagaggaagttccctcatctggaattccgtagtatcagaggaaatcttaatactaggctaaggaagctggacgagcaacaggagttcagcgcaatcatcttggcaactgccggtttgcaaagaatgggatggcataaccgtgtgggacagatactccacccggaggaatgcatgtacgcagtgggacaggagggcgggtgtagcgtgcctgtggcggtccacacggccatgaaggacgggcaactctacctcacgggtggcgtatggtcactcgatgggtctgactccatacaggaaactatgcaggccaccatccacgtgcctgctcaacatgaagatggaccggaggatgatccacagctggttggcataaccgcacgcaatatcccgcgagggcctcagctggctgctcagaatctcggaatttcactggcaaatctgctgctttccaagggggcgaagaatattctggacgtggcacgtcaactgaatgatgcacactag

SEQ ID NO: 48070 - DNA, 834 bp, Artificial Sequence
  Description of Artificial Sequence: Synthetic coding sequence
atggcccccctgcggttcagcgccaacctgagctggctgttccccgaattatctggcctccctgccagggtgcgtgccgcaggtagctccgggtttgaggccgtagaggtggcttggccctacgccgaaactccagaggcccttgctagagctgcgagagaagctggcctgcgtctggtgctgataaacactccgcctggagatcaggagaagggagaaatgggattgggggccgtaccgggtagacaagccgcatttagggaaggtttagaacaggccgtccgatacgccaaagccctggggtgcccccgcattcatctcatggccgggcgggtcccccagggcgccgatcggatcgctgttaaggcagaaatggaggctgtttttctagagaatcttcgccatgctgctggcgtcctggcccaagaagatctcgtgggactgctggaaccaataaataccagaattaccgacccacagtacttccttgacacacctcagcaggccgccgctattctccagaaagtgggtcggccgaacctccagcttcagatggacattttccattggcagattatggacgggaatctcaccgggaatattagggagttcttacccatcgtgggccatgtgcaggtagcccaggttcctggccgcggtgaacctagttcaccaggcgagttaaatttcccttatctcttccagctgctggaggacgagggatacaagggattcgtaggttgcgagtaccagcccaggggggataccgtagaggggctcagttggctgcggtcttactgggatcggcggggtcatccagaagcggggcagtag

SEQ ID NO: 48071 - DNA, 690 bp, Artificial Sequence
  Description of Artificial Sequence: Synthetic coding sequence
atgggcctgggcgccgtgcccggccggcaggccgccttccgggagggtctggagcaggccgtgaggagcgggcactgcctgatgggaaggaagttatctgtgccttgcaaaggagcagtagcccgcggaggcctcgtgtacctggctgctttccttaggctcgacatgattcatctcatggcagggcgggtgccccagggggctgaccggatcgcagtcaaagctgaaatggaggccgtcttcctggaaaatctgaggcatgcggcaggcgtgctggcacaagaggaccttgtggggctgctggaacctataaacacccgcattactgatccacaatacttccttgacactccacagcaggctgctgctatcttgcagaaggtcggccgcccaaatctgcaactgcagatggatatatttcattggcagatcatggacggaaacttgaccggcaacatccgagagttcctgccaattgtggggcacgtccaggtggctcaagtgccaggccggggagaacccagttctccaggcgagcttaacttcccatacctgttccagttgctggaggacgagggctataagggattcgtgggctgcgagtaccaaccaaggggagacacggtagaaggcctatcttggcttagaagctactgggataggcggggacaccccgaggctggccagtag

SEQ ID NO: 48072 - DNA, 615 bp, Artificial Sequence
  Description of Artificial Sequence: Synthetic coding sequence
atgggcctgggcgccgtgcccggccggcaggccgccttccgggagggcttggagcaggccgttcgttatgcgaaggccctgggctgccccaggattcatctcatggccggcagggtgccgcagggagccgacagaatagccgtaaaggccgaaatggaagctgtcttcctggagaacttgcgccatgctgccggggttctagcccaggaggatctggttgggctcctggagccgattaacacacgcataacagatccccagtattttctggacacaccgcagcaggccgccgccatcctgcagaaggtgggcagacctaaccttcaactgcagatggacatttttcactggcagatcatggatggtaacctgactggcaacataagagaattcctccccatagtaggccatgtgcaggtggcccaggtgccaggccggggagagccgagttctcctggagagctcaatttcccttacctgttccagctgctcgaggatgagggttataaggggttcgttggctgcgagtatcagccacggggagacactgtggaaggtcttagctggttaagaagctattgggatcggcgcggccatccagaagccggtcagtag

SEQ ID NO: 48073 - DNA, 744 bp, Artificial Sequence
  Description of Artificial Sequence: Synthetic coding sequence
atggcccccctgcggttcagcgccaacctgagctggctgttccccgaactcagtggcttgcccgcacgggtgagggccgctggctctagcgggttcgaagctgtggaggtcgcctggccctatgcagagacccccgaagccttggcccgcgcagcccgagaggctggtctgcggttggtcttaatcaacaccccaccaggagaccaggagaagggtgaaatggggttgggggccgtccctggccgtcaggccgcctttcgtgagggactggagcaggcggtcagatatgcgaaggcccttggatgtcctcggattcacttgatggcagggagagttcctcagggcgccgatcgcattgccgttaaagccgagatggaagccgtttttttggaaaacttgagacacgccgcgggcgtgttagcacaggaggatcttgttgggctgctggaacctatcaatacgagaataaccgatcctcagtattttctggacactcctcagcaggctgcagcaatcctgcaaaaggtggggaggccaaatttacaacttcaaatggacatttttcattggcagattatggacgggaacctgacaggaaatatacgggagttcctaccgattgtaggacatgtccaagttgcacaggtgccaggtagaggagagccatcctcccccggcgagctcaattttccttatctgttccaattactcgaggatgaaggctataaaggttttgtcgggtag

SEQ ID NO: 48074 - DNA, 909 bp, Artificial Sequence
  Description of Artificial Sequence: Synthetic coding sequence
atggcccccctgcggttcagcgccaacctgagctggctgttccccgaactgtctggactgcccgcccgcgtaagggccgcaggcagctctggatttgaagccgtagaagtggcctggccgtacgccgagacccccgaagctttggccagggcagctagagaagccgggctgcggctggtgctgattaataccccgccaggcgaccaagaaaaaggcgagatgggactcggagcagtgcctggtagacaggctgcctttcgcgagggcttggagcaggctgttcggagtgggcattgtttgatgggcaggaagctctccgttccttgtaaaggcgccgtcgcgcgcgggggactggtgtacctggccgcttttctgcggctcgatatgatccatttgatggctggccgcgtgccccagggagctgacagaattgcagtcaaagccgaaatggaagccgttttcctggagaatctacggcacgctgcaggcgtacttgcgcaagaagatttagtgggtctgttagagcctattaacacacggattacagatccacagtactttctagacacacctcagcaagcagccgctatcctccagaaagtcggccggcccaacttgcagttacaaatggatatttttcattggcaaattatggatggaaatctcacgggtaatatccgcgagttcctccccatcgtggggcacgtacaggtagcacaagtacctggtcggggggaaccaagtagccccggggagctcaacttcccatatctgtttcaattgctcgaagacgaaggttataagggatttgtcggatgcgagtatcagccaagaggagatactgtggaaggcctgagctggttaagatcctattgggacaggcggggccaccctgaggccgggcagtag

SEQ ID NO: 48075 - DNA, 162 bp, Artificial Sequence
  Description of Artificial Sequence: Synthetic coding sequence
atgtgcagctactaccacatgaagaagcggagcgtgagcggctgcaatattactatctttgctgtcatgtttagccacctgtcagcgggaaaatcaccctgtggcaaccaggctaatgtgctgtgtatctcacggctcgagtttgttcagtatcagtcctag

SEQ ID NO: 48076 - DNA, 1011 bp, Artificial Sequence
  Description of Artificial Sequence: Synthetic coding sequence
atgcccccccccgcccccggcgcccggctgcggctgctggccgccgcagccttggccggcctcgccgtgatttcccgcgggctgctttcccagagcctcgagttcaatagccccgccgacaattataccgtgtgcgagggcgataatgctacactttcgtgctttatagacgaacatgttactcgggtggcctggttgaatagatcgaatattctgtacgcaggaaacgatcgatggacctcggatcctcgcgttaggttgctcatcaacacacccgaggagttttccattcttatcaccgaggtgggcctgggggatgaggggctgtacacatgtagcttccagacccggcaccagccgtacaccacacaggtgtatttgatcgtgcatgtgcccgcgagaatagtaaatatttctagccctgtaacggttaatgagggagggaacgtgaaccttctgtgtctggctgtggggcggccggaaccaacggttacttggaggcaactgagggacggctttaccagcgagggcgagatcctagaaatctccgatatccagaggggtcaggcgggagagtacgaatgcgtcacccacaatggtgttaactctgccccagactctaggagggtgctagtgaccgtcaattacccacccactatcacggatgtgaccagtgcccgcaccgctctgggtcgagcagcattgcttagatgtgaggcaatggctgttccaccggctgattttcagtggtacaaggacgacagactcctgagttcgggcactgctgaaggcttaaaagtgcagacggaacgaacacggagtatgttactgtttgcaaacgtatccgcgcgccattacggaaactatacctgcagagctgcaaatcggcttggcgccagctcagcctcaatgaggctcctgcgacccggatcactcgaaaacagcgcgccccggcccccgggactactggccctgctgtcggcactggggtggctctggtggcgtatgtag

SEQ ID NO: 48077 - DNA, 1215 bp, Artificial Sequence
  Description of Artificial Sequence: Synthetic coding sequence
atggagtgcgccctggacgcccagagcctgatcagcatcagcctgcggaaaatacattcatccaggacccagcgtggtgggatcaaattacacaaaaatctgctggtaagctatgtgctccgcaatgccaggcagctgtatctctccgagaggtatgcggagctgtatcgccggcagcaacaacagcagcagcaacaacctcctcaccatcaacatcagcacctcgcttacgctgccccagggatgcccgcaagtgccgccgacttcggtccacttcaactgggtgggggcggagatgccgaggccagagaaccggctgctcgccaccagttgcaccagcttcaccagctgcatcagcttcacttacaacagcagctccaccagcaccagcatcccgcgcctcgtgggtgtgccgcagcagccgcggctggtgctccggccggcggcgccggcgccttgtcagaactgcctggctgtgcagctctgcaacctccccacggagcaccacatagaggccaaccccttgagccgctgcagccgggtccggccccactgccccttcctctgcccccccctgccccagccgccttgtgcccccgagatccgagggcgcccgcagcctgctccgcccctcctggtgcagcacctccagccgcagctgcttcaccccctgcctccccagctcccgcctcaagccccggattctaccgcggagcatatccaacccccagtgactttggccttcattgttccagtcaaacaaccgtgttagatctggacactcatgtagtaactaccgtggagaatggttacctgcaccaggattgctgcgccagtgcccactgcccctgctgtggccagggcgccccagggccagggctggcatccgcggcaggttgtaagcggaagtactatcccgggcaggaggaagaggaggacgacgaggaggacgctggcggtcttggtgctgaacctccaggcggcgcgccattcgctccatgtaaacgtgcacggttcgaagatttctgcccagattcgtctcccgacgccagtaacataagtaatctcatctctatttttggtagcggcttctcgggacttgtttcaagacagccggattctagtgagcagcctcctccgttgaacggccaactttgcgcaaagcaagctctcgccagccttggcgcctggactagagcaatcgtcgccttctag

SEQ ID NO: 48078 - DNA, 1392 bp, Artificial Sequence
  Description of Artificial Sequence: Synthetic coding sequence
atggccaccagcaagctgcccgtggtgcccggcgaggaggagaacaccatactgatggctaaagagcggttggaggccctgaggactgctttcgagagcggcgatttaccccaggccgctagtcacctccaggaactactggcctccacggaaagtataaggctggaggtgggagtgacgggcgagtctggagccggtaagtctagcttaattaatgctcttaggggtctggaagcagaggatcccggcgccgccctcactggcgtcatggagacaactatgcaaccctcaccttacccacaccctcagtttcctgatgtcactctgtgggacctgccaggcgctggttcaccgggctgcccagcagataagtatcttaagcaggtggacttttctcggtatgacttttttcttttggtttcaccccggcgttgtggtgccgtggagacaagactcgccgccgagatactgtgccaggggaagaaattttacttcgtccggactaaggtggacgaagatcttgcagctaccaggacccaacgcccatctgggtttcgggaggcggccgtgctacaggagattcgagaccactgcgcagagcgcctgcgcgaggcaggagtcgcagatccacgcatcttcctcgtgtcaaatctgtcccccgcaaggtacgacttcccaacgcttgtctcaacatgggaacacgatctgccttctcaccgccgacatgcaggccttcttagtcttcccgatatttctcttgaggccctgcagaaaaagaaggcaatgctgcaggagcaagttctgaagactgcactggtgcttggcgtcatccaggcgcttcccgttcctggactggccgccgcttatgacgacgccctcctcatccattcccttaggggctatcacagaagctttggcctggatgacgactccctggccaagctcgctgaacaggtcggcaaacaggcaggggatctccgtagcgtcatcaggtcacccctcgcaaatgaggttagccccgaaaccgtgctgaggctgtactctcagtcttccgatggggctatgagagtcgcccgagcattcgagcgcgggatccctgtgtttggaactctggtggcagggggcatctcatttggtgcggtctatactatgctccagggttgcctgaatgaaatggcagaggacgcccagagggtgaggattaaggctctggaggacgatgagcctcaacccgaggtgagcctggaggtcgctagcgacaacggcgtggagaaaggcggtagcggggaagggggcggtgaggaggccccacttagtacctgtaggaaacttggtcttttacttaagtacattctggacagctggaaaaagcacgactccgaggagaagtag

SEQ ID NO: 48079 - DNA, 1872 bp, Artificial Sequence
  Description of Artificial Sequence: Synthetic coding sequence
atgccccccccccagggcgacgtgaccgccctgttcctgggcccccccggactggggaaaagcgccctcattgcagcattgtgcgacaaggatgtggagacgctagaagctcctgaaggccggcctgatagcggcgtgcccagcttacgagctgcgggcccaggtctgttcctgggagagctgtcatgtccacccgcagcccctggaccctgggccgccgaggctaatgtgttggtgcttgtcttgccagggcccgagggcaatggggaacccctggcacctgccctcggagaggctgctttggctgcgctggcgagggggacgccgctacttgctgttcggaacctgagaccaggagactctcagacagccgctcaggctagagatcaaacggcagccctgctgaactccgctgggcttggggccgctgacctgttcgtgctccctgctaactgcgggtccagcgacggctgcgaagagcttgaaaggttacgagccgccctgcagtcgcaagcagaagccctgcgacgcttgttgcccccagcacaggacggttttgaagtattgggggccgcagaattggaggccgtgcgggaagcatttgagaccggcggcctcgaggcagcgctgtcctgggtgaggtcaggactcgagcgcctgggctctgcacgcctggatctagctgttgcgggcaaggccgacgtggggctcgtagtcgatatgttgctgggactggatcctggggaccctggtgctgccccggcaagcgttcccacggccccaacaccattccctgctcctgaacgccctaacgtggtcctctggaccgtgcccttaggacacacaggtacagccacgaccgcagctgctgcttctcaccccacgcactacgacgccctgattctggtgactcctggcgcccccaccgagaaagactgggcccaggtgcaagcactgctcctgccagacgcacctcttgtttgtgttcgaactgacggggagggagaggaccctgaatgtctgggtgaaggaaagatggagaatccgaaaggtgagtcattgaaaaacgcggggggcggggggttggaaaacgcactgagcaaaggccgggaaaagtgctccgccggaagccagaaggctggctccggtgagggacccgggaaagcggggagcgaaggactgcagcaggtggtcggcatgaagaagagtggtggaggcgacagtgagagggccgctgctctgagtccagaagatgagacttgggaagtcttagaggaagcaccgcctcccgtttttccgctgagacctgggggcttgcccggactttgcgagtggctgaggcgggccctgccaccggcacaggccggcgccctgttgctggccctgcctcccgctagtccaagcgcggcgaggacgaaggctgccgcactgcgcgctggcgcatggcggccagccttgcttgcctcattagccgctgctgcagcaccacttcccgggttgggatgggcctgcgacgtggccctgctacgcggtcagctggctgaatggcgtagaggcctcgggctggagccgactgcactggccagacgggagagagctctcgggctggccagtggagaactggcagcccgggctcactttcccggcccagttacacgcgccgaggtcgaagcaaggttaggggcctgggccggtgagggaacggctggtggtgccgctctgggtgctttgtcatttctctggcccgcaggcggcgccgcagccaccggaggactggggtaccgcgctgctcacggggttctgcttcaggccctcgacgagatgcgagcagatgcagaagccgtgctcgcgcctcccgagccagcccaatag

SEQ ID NO: 48080 - DNA, 3981 bp, Artificial Sequence
  Description of Artificial Sequence: Synthetic coding sequence
atgaccaccatccacagccggcagatgctgcaggagcacgtgagcatggagttttcatcttccaccacacacgttcagactttttctcagactaccaaaattgtgggggaggaagttgtgagaagaaaatcttcatctatcgtggaatttttctccttggtgacaagaagttcaaatatccccgctggagactccgtgcctgagttcgtggaaaaaccacaaccagtcaccgctcctgagggagacaaagccgtgttcagagcccgggtgcagggcaatgcaaagcctcatatctcttggaaacgtgaatctggtatcccaatcaaagagagtgcaaagattttctacgattcaatcaacaaagagcacgtcctcaaactcgaaccacttacgagtgacgattcagacaactataagtgcatagcatccaacgatcacgccgatgcgatatataccgtttccctcctcgtgacggaggggcaagaaaaaatggatttcaagaagatgttaaaaaaaagggccccacccgctcctaaaaaaaaacagaagaaagtggctaacgaaaaggagatgcttgagatcctgtctaaggtaccaaagaaagattttgaaaaggtatgcatggagtatggcttcacggactttagagggctcctgcgcaaattgaaagagatgaagaaaaaggtcgaagttgaggctattaggatcctgaaacccctcgaggacaaggaaactaaggtagataccacagtcgtgttcgactgtatcatggaactgaaggaccccaatgtcaaaatgatttggatcaagggcaccgaacctcttcgaattcaatactcccttgggaaatacgatgtgaaacaaatggggacaaaatacatgctcgtaatcagcaatgtgaatatgaacgatgccggaatttattccctctccgtgggtgacaaacggatgagcgcggagttgaccgtcctagacgaaccactgaagtttctcggcgagatgaagcccgtaaaggtcactgaacgccagactgccgtttttgagattcggctgtcaaagaaggaaccaaactttgtttggaagttcaatggcaaggaacttaagagagacgataagtacgagattactgtaagtgaggatggacttacccacactcttaagattaaggacgctagattgtccgactcaggcgagtttagcgccgaggcaggcaacttagtccagaaggctcaactaacagtggatagaatacctatcaagtttgtgtctaatttaaagaacgtgcgagtcaaagagaggtctcgcgcgtgtctcgaatgcgaactgaccagtaaggatgtaactctgagatggaagaaggatggacaactcctgatgcacggtaccaagtactctatgaaccacgaaggaaaaagagccgagctcataatcgaagatgctcaactctccgatggtggcgaatacacggtcgtggcgatgcaggatggcgatccgacggagtattacagtacagctattgtcacagttgaggagagacttgcaactgttaaaagcggcatgagcgacgttcatgctgccacgggctctcccgccgagctctgcgtcgtgctcaacgatgaaaaagttgagggagtttggctcaaggatggcaaagagattacagatctgccaggcatgcagatagtgaagcagggagcggtgcataagctaatattcccttctatgggcccagagcacgaaggcaagtacacatttcgggccaaaggcacagagtctgaggcatctgtattcattgcagatcctcccaccatcgatccctccgtactagaggccctcgccgcgcacgcaatcacagtgaaagtggggcatacggctcacatcaaggtgccttttcgaggtaaacctctgccaaaagtgacatggtacaaggacggtatggaggttaccgaggaggagagagtctcaatggaaaggggagaagaccaggctctccttactatcagtaattgtgtgcgcgaggattccggcctgattctcctcaagctgaaaaatgatcacggctccgccaccgcaacactgcacctgtctgtgcttgacagaccgaaacctccccagggccgggttgagttcctggaactgtccgggtcttgcgttcacatgaagtggaaggcccccaaggacaacgggggccgccccgtgactcagtttattgtggagcgccgtgctgtgggcaagaagtcttggattaaaattggggaggtggatggcaaggtgaccaatttctctaccaataaggttgaggagggcaaggcataccagttcaggatcttggccgtgaattcagagggggtcagcgacccactggagaccgaggaggtgttcgcaggtaatcccatcgaaccacccggttttgcctcccaacctcaggtcactgatgtgactaaagaagccgttacaatcacctggaacgcccctacccaggatggaggtgcaccagtactcggctacatcgtagagcgcaggaagaaagggtcaaatttgtgggttccagttaacaaagaccccatccagggtaccaagtgcacggtggacggtctgttggaagacactgagtatgagttcagggtgatcgcagtgaataaggccggaccaggacaaccatctgtgccgagctctagcgtggttgccaaggacccggtcaaaccccccggactggtgcaagaccttcatgtctcggactcttccaatagctccattagtctagcgtggcgcgagccagccgagggcgatccaccctcagggtacattctcgagatgcgggctgaggatactaaagaatggtcaaagtgcaccaagataccgatatcaggaacttgctacacagtcgggggacttatagaaagacaaaagtactttttccgcatccgagcagtgaatgaagctggcgtgggagaacctgtggaactggacaagggagtccgtgccatgccgcccccggctgctcctaagtttgacttaagtgcccggctgaagagccacatggtggtcagggccggtacagctctctgcattcacgctgcgttttcggggtccccccctcctgatgtaatatggcagaaggatggcgtgccaaccaaaggtcgtgagaccatcactaaatcgaagaaccactcccagtttctgatcaattcaacaaaacgctccgattctggagtgtacaggatcttgctgcagaatgaattcggggaggccaggtacgacattcacgtgagagttgccgattttcccaggcctccgacaaacctgcgtctgttcgaggaagtccccaacaccgtgacacttacatggaatcactcccccgacgtgcaggaggacggtgaggctcactacattatcatgaagagagatgcctcaactgctacctggtatactgccgccgaacgagtgttctcaaacaagtataccgttactggtttgctgcccggacggaaatattactttagggtcgtggccaggaatgagatcggggattccgaacctctcgactcgcgggacacttggctgatcaacaaggaccagatacaggacctgtccgcaaaattgaaaccatatgagaaaaaagactggaggcatgctccccgcttcgtgacccctctgaagcctcataccgtcctgcgcggtcaggactgcactatgacatgtgcgtttctgggtaatcctcgacctacggtaacattgtacaagggggatgttaacattactgctaatagtaagttttggtataactcgacgagcggcgtttgtacattggttatccctacctgcaccctgaaggacagcggagattatagcgttctggttgagaatgagctgggcaaggataggtcatcctgtacacttaccgtttacgacaaagacgataaatcagtcgttgcttccataacggagtctttgcagaaaaagtcgaagcatcttatgtag

SEQ ID NO: 48081 - DNA, 1827 bp, Artificial Sequence
  Description of Artificial Sequence: Synthetic coding sequence
atgggctggcagcccatgggcgagaactggggctgcctggaggagatgctgaatgaggaccagagccgagagcctcctggacacctagggtccaggagaagcggaaaggatggcagactggatatttatggcgagcggcgcgacgccacacggagtagcacctctcgatacaaaccaggcactggttccttcagcaaggatgcgcaaggcccaatgggccattttagccaaggtcttgcagatatggaggtccagcccggggaagctgctaccctgtcctgcacgttgacttctgacttaggacccggcacatggttcaaggatggagtgaaattgacaacccaagatggagtcatttttaagcaggacggcctggtgcatagtctgttcatcacccatgtccagggaacacaggccggacgatataccttcgtcgcgggcgaccagcagtcagaggctacgttgacagtgcaggattcccctaccatagcccccgatgtgaccgaaaaactccgagagcctctggtggtgaaggccggtaaacctgtgatcgttaaaataccattccaatctcacttgcctatccaggctgcgtggcgtaaggacggcgctgaggtggtcggctccagcgacagggaggcccaggtggacctcggagacggctacactcgtctgtgccttccctctgctggacggaaagactgtggccagtactccgtgaccctcaggtcagagggtggctcggtccaggctgaattaaccctgcaggtcatagacaaaccagacccaccgcaaggtcccatggaggtgcaggactgccaccgcgccggggtgtgtctgcgctggagaccacctcgagataatggaggcagaactgtcgagtgttatgtggtggaacgacggcaagccggacgaagcacctggcttaaggttggtgaggcacctgccgacagtacaaccttcactgacgctcatgtggaacctggcagaaaatacacctttcgcgttagggcggttacgtcggagggggctggcgaggcactggaatctgaagagatcctggtggcacccgaagccttaccgaaagcccctagcgccccggccattctatctgcgtcatctcagggtataacactaacctggactgccccccgggggccaggcagtgcccacattctggggtatctgattgaaagacgcaagaaagggagcaatacttggacggcagtcaacgaccagcccgtgcctgagcgaagatggacagtggctgatgtgcgacagggatgtcagtatgaattccgagtcacagctgtggctccctctgggccgggcgaacccggtccgccgtccgacgccgtctttgcaagggaccccatgcggccccctggtctggtgcggaatctgcaggtaaccgatcgttcaaacacctctattactctctcatgggcaggtcccgatacgcaggagggggacgaagctcaggggtacgtggtggagctgtgctccagcgactctctgcagtggctgccttgccacgtaggcacagtgccagtgaccacctacaccgcaaaaggcctacggcctggtgagggctacttcgtgcgggtgactgctgtgaatgagggcgggcaaagtcagcccagcgcattggacactttggtgcaggctatgcccgtgaccgtgtgtccaaagttcctggtggatagctctactaaagacctgttgacagtgaaggtcggtgataccgtacgcgtgcccgtcagttttgagcacgcacgcaggcctctgggtccttcgacatgtaggaggacttgcctaggtcggtag

SEQ ID NO: 48082 - DNA, 11127 bp, Artificial Sequence
  Description of Artificial Sequence: Synthetic coding sequence
atggccggcaagctgcggaagagccacatccccggcgtgagcatctggcagttggtggaggaaatacctgaaggctgctctacccctgattttgagcagaagcccgtcacctctgccctgccagaggggaaaaacgcggtcttccgagctgtagtctgtggggaaccacgcccagaggtgagatggcagaacagcaagggagatctgtccgactccagcaaatataaaatttcttcttcgccaggtagtaaagaacacgtgctgcagataaacaaactcactggtgaagacacggatctctacagatgtactgctgtcaatgcatatggggaggccgcttgctccgtgcgccttacagttatcgaagttggctttcggaagaacagaaaacgacatagagagccgcaggaagacctccgcaaagaactgatggacttccgaaaactgcttaaaaaacgtgcccctcctgcaccgaaaaagaaaatggacctggagcagatttggcagcttctaatgaccgccgacagaaaggactacgagaaaatctgcctcaagtacgggatcgtagattaccggggaatgctccggagactgcaggaaatgaagaaagaacaggaagacaaaatggctcagtatatcaatacaatttcatcgctgaggcatatacgcgtgactaaggatggaaatgcaaagttcgatctggaactcgatctgaaggactctcagtccaaaatttatctgtacaaagatggggaaatgatcccttatggattcaacaaccaaacaaagcactgtctgcgaagactgggtaagagatatgagttccaaattcaagacctgcggcctgaggattcaggcatttatcaggttaaggtcgaagacgccgtggtgttttctacagagctggaagcatctgcaatcccaccaagggtggtggtgcctctggccgagacacattgtgaagaacagggtgatgccgtattcgagtgcaccctcagctccccttgcccttcagccgcctggcacttccgtcacaggctcctacacccttcagataagtacgaggtttatgtcagccccgacggtctaacccatcggttagttgtccggggcgccagattttcagacatgggaccgtactccttgggcaccggattgtacaccagttcagcatggctggtcgtggaagccggtaaggacaaagatctccaatctacttcggccgatcataaactccaaaggcagggcgcgcaggcctccggagctgaggaaagtggatctattgagagccaaggggagaaatcaagggagcaaggaccgcgcggtgggtccctggaaggggcaggaccagcaagcggtctgcaacatatcgcctcccccgaccgcgacgggcttggccgccatggatatagcctcatgggtgataagggtacagccgactcagcttggggacccggtcaggaaggagaagggtttccagtggccgaagggagtagagccaccctgccgcgggaaaatcagtcccaccgggaaggaggatgggctcggtctctcgcagagaggccacatcttcagggtgaaagctctgagagtggtctcggcctacctgaaaaacagcagcaggatcggggccgcgactctaacagcgacgaatgctggcggaaagctgggggctgggaggctggatcttcccgtctgcaggctggaggattggggtccagccgtgaggggaaagaacataggggcgattcagggagacaactggataggcacgctcctgaacagttgtgggatgccagattgggtcccggaaggggaaaaagcgacttgcaggggtgtcagtcagacccggttggcagctggccgaggggcaaacaaatcgaaatttcccaagatgattcgcttgcagagatggatagaggagatgctcctagtagggagcggggccgcggtattgtggtgtggggcgggggaactgggctgggagaggccggcgattccaacggtgcgggaggacctgggaccctggagttgacgggtgggcgggggtctgggtccaaagtagggatggcccccgagagttgggggagtcaaggtggcagggacgcagactatggagaggctcggggttactggggttccggcgaactgctggagcagatccctggcggtaaagattttcaggagccctccatcagtggcggccgcaagttcctgttgggcgacgggagcccagagataaaggcagaagacagtctgcaggaggccgatggcatctgcagaggcgagtctgttgttaccggttctgcttacaaaaccgggcctggtgggcctggcgatcccagagggtgtgagggggtcttacaagagctgcgcggccgggacggtcaagaaacagcctgggccagcggcgaagtcgagtacgatcccagatcatttcagagtagtcaaggctggacagccggccacagggccgccggcggcataggtagaattgagagcaagggcacttctccatgggacgacaccccatccagcctgaggaagaccggtgcacaccacgggccaggtgtattaggccctagcgggggccaggagggtatgggaggcatatgggtcgccggtctcacagagagtggacaaggggtggatgcccggtctcattggctgtcccgggcgcctgggttgggtgctcagggttctggtggcactctcggcgataaaaaggggctcaggggacctggctccattggcagcgaacctgatttctggaatgggtcgggtagttcccgagtaaagggaccacgcggtgagaccggctataaggatggtctggaaggaccgggtcggatggagtcccggtacgagggtgggcttggctattcaagggaaattagcagcaagtctggtgcaggatattcttatggaagcggcgtacccggcgagatgggaagtggacacggggctggctgtcgggtttcacccagagcccccgctggggttgagtcagaggaggggggtggctacaggcacggaagtggcgcccccgggggtgtgtggagtgggaacgaggactcaggacccgcaggggggggatctggcagagtcgccagcctgaagaacggttccggtggacccgatggggcccccatgaatgacacacggaactgggcaagcgcatgtcaagccggtatggatccacggggtggacaccattccgacggcgggttgggcagcccaggagtgaccggaagcgccgggcggggcggcctgaaggcacccggcgtcgtcgagacggtgggcatgggatgtgtcgaagctgagccggagtcctctgggcggatccgcccgtggggacagaccggaaattacggaggctttcgcgcctccgaggcactcggagctttcggcgagggggggtacgaggacggttcggggggccccggtgccatgggtccagggtcattgcgagccgggtccaaggtgggagagggcgacggcaccagatgcccaggtgcgaaagccagtggagctggggcaggctaccgggatgacacaaggcatcctgaatctctcgccccccataacggggccgctagcggatcacaatgggcttatggcgccgggaacgtgctggggtatgaggacggctctgagcttcctggcccacagggaactggagtcaggacagcctacggagagcgaagtcggggtcttggacctcgttcgacagggcctggcggggaagccggattccgggacgggtctggaggactgcaggggatgggctccgccgacgggccaggctgccgcaagggcatcggaagcagcggagagatgggttcagtggacaaggagggctacaagaaagacctcggagcgcccgaaaacatgggctccggcagcaaagcagattatagagatggggtcgggggatctggcgccatgggctcaatggacgaagctggctaccggaaggatcttggagcccccgaaggtatttccagcggctctaaagcggactatcggggaggactgcaagactcccgcgaagccgggtctggcagtaaagccgactattcaggtggcctgaagggtagtagagagattgggtcaatggacgagaccgataacaggaaggacctgggggtgcccgagggaatgggggcggggtaccgagctggactgcggggccccggtgaaatgggctcactcgatgaatcggggcaccggaatggaattggtggatatggggagatgggttccggttaccgcgaggacctcggggcccccgaaggaatggggaccggttctaaggccggctacagagatgggctgcggggcagcggagagatgagatcaatggacgaagcgggttataggaagaatttgggcgcgcccgagagaatggatagcggatcgaaggccggttacaggggtggcctgaggggatcaggagagatgggcctgattgaggcaggttatcgcaaggatctgggcgtgtctgagggaggcggctcaggcagtaaagcggggtaccgcggcggtttaggatcaggagaaatgggcagcgtagataaggccggatatagaaaggacctgggggcctcagaggccatcggaagcggatccaaagctgggttcacagacggtttagggggaagtgaggagatgggctctgtaaataaggctggctacaggaaagatctaggcgcccctaagggaatgggtagcggttctaaggctagctttagagacggactcggcggaagcggagaaatgggtagcgtgaatgaagctggctacaggaaggacctgggcgttcccgagggaataggaagcgggagcaaagcaggctttcgagatggcttaggaggatccgaggagatggggtctgtcaataaggccgggtatcgcaaggatctgggagcgcccaagggcattggtagtgggtcaaaagctgggttcagggacggactgggctcttcgggtgagatgggctctatggacgaagcggggtaccgtaaaaacctgggagctccggagggcatcggaagtggctccaaggctggctttagagacggattgggatcgtcagtggaaatgggatcggttaacgaagcaggctaccggaaagatctgggggctcccgagggcatgggctccggctcgaaggcaggattccgggacggtttgggcggttctggagaaatgggcagcgtcaatgaggccggatatagaaaggacttaggggcgccgaaaggaatcggatcgggtagtaaggctgacttcagagatgccctgggatctagtggagagatgggtagcatggatgaagccggctatcgaaaggacctctgggctcctgaagggattggttcaggtagtaaagcgggcttccgggatggacttgggtcttctgttgaaatgggaagtgtcaacgaggccggatatcggaaagatctaggtgcaccagaaggcatgggatccgggtcgaaagccggctttagagacggcctgggaggatccggggagatgggatccgtcaacgaggccgggtatcgcaaggacttaggcgcccccaagggcatcgggtctggatctaaagctgactttcgagacgctctggggtccagcggtgaaatgggaagcatggacgaggccggttatagaaaggacctgtgggcacctgagggcatagggtctggatccaaagcaggctttcgggatgggctggggagtagtgtagaaatggggagtgtaaatgaggccggttatagaaaagacctcggggctcccgagggcatgggttctggctcaaaagagggttttagggacggtctggggggttcagaagagatgggttccgtaaataaggctggataccgaaaggacctcggagcccccaagggcatgggttccggttcaaaggaggggtttagagatgggctcggtggcagcgaagagatgggctctatggacgaagcaggataccgtaaggacctgggcgccccggagggcatcggaagtgggtcaaaagctggattccgcgacggactgggtggctccgaggaaatgcgcagcatggacgaggccggataccgaaaagacctcggagcccccgagcgcatcggcagcggatccaaagcaggattccgcgatgggctcgggtccagtgtggaaatgggttctgttaatgaggcaggctaccgaaaggatcttggcgcaccgaaaggcatggggagtggatcgaagactggtttccgcgatgggctcggagggtccgaagagatggagagtatggatgaagctggttatcggaaggacctaggcgcaccggagggcatcggcagtggatcgaaagccggatttcgagatggtctgggctcgagcaccgagatggggtcagttaatgaggccggatatcgaaaggatctgggggcgccgaagggaatgggaagcgaaagcaaggcaggctttagggacgggctcggatcttccggtgaaatgggttcaatggatgaggctggataccggaaagacctgggagcacctgagggcatgggttcaggcagcaaggccggttttagagacggacttggaggctctgaggagatggggtcggtcaacaaagccggctacaggaaagaccttggggcgcccaagggcatgggatcaggcagtaaagccggcttccgcgacggacttggatccagcggcgagatgggttctatggacgaggctgactaccggaaggatctcggcgcgccagaagagatgggtagcggctcctacaccgattatagaaatggactcggtagctcggggaagatctcaagtggcgacgaggcaggatacaagaacgtgctcgggggctccggccgaaacccattgggatctgaggccggctcccgtggtagccttgaggactcaggctatatcctctcgtggaatgaggcaggatctagacaggggtttggcggcacgagcgggatgggctcgggatcagaagtctcttatcgggggggatccgggggcagcggggagactggtcctgagggaaagatgggatatggagatggctcaggacggttaggcgtgccagggagcctggcggggatcggccacgaagcgggccccagaggccacaaggctatgggacatcgcagtgggtactgggtcgcctcagagggagatacaaatagtaaggatggccctgagcgcgcgagagaaaccaggctagtggacggcgccgggcctggcgtggaacctggtatggccgggatgccgggaaccgccgggggaatggcccatcgcgacagcctgcgcggtacaggcgtgctgggctcacagggggggcgccaaactctgagcgatgagcgcggatcaacaaaggacctgggcggttacggtacaagcggaatcccggaggccagtgaggcagcaggtgcgaaaggaaagccagacgtgaaagaatggcaagactctagcggcacccctggttctagtagggataggggggccccaagggtgaaggatcgcagtcctgaccaggccggcattatgggagcttctggttttctggatggcaagggcgccgttgaaggagagacatgggctggcatggcggccctcggttccggatacgagagagatatttggaaggccggccctgggatgaccgatcgtggcagagtagcgggccagggtgggctcgcctcgcagggagggggagattcactgttgggaggacgccgggtgggttccggttcttccgtgggcacagggcaggatctcgactctggctctatgcccggaggccgagggaaaagcacttctggccctgccgacaggcagggaacgagcaacgcttgggccccagactgggaaaatcagggctttagccaaggcagcattgacgcgggcaaacagccagccggcagcagagcgagcggatcactgcaggagaaagacgctgcgttcggaggcactcacgagggccccggcggcttcaaaggtggagagggcgccccaggacaggaagctgccgggggctgcaggtccccatggtccttggattccaagggaagcagcccaggacggggatcttctgtggacgctgaggattcaggtatcttagggaagggtaatagcacggaatggggaaacgctctcacacccaagccgggagagagtggccctcagggtgcctggaatggtttagacggaccttttggcaggaaggcctctcgcgaccggtctgggggcacgcaagacctaagctctcagcggggaaagggacagaggggaggcaagagatcgcttggcgaacagggatccctggaagccgagaacggggaagtgcaggggcccggcgccctcaaggaggacgagggccagggtgtggaggaagctggtagaagtggccggaggcccggctccttgagatctagatcccaggcccagtctggtgctgaggtggggggcggcaagcgcaggggcgcagacgaggctggctccatgggctggcaaccgatgggcgaaaattgggggtgtctggaggagatgctgaatgaagatcagtctagggaacctccaggccatttgggatcgcggcggtctgggaaagacgggcgcctggatatttacggcgagcgaagggacgcaaccagatcctccacatcccgctacaagcctggtaccggttcattttcaaaggacgcccagggccccatggggcacttttcacagggcctggctgatatggaggtgcagcctggcgaggcagccaccttaagttgtacattaacttctgacctgggtccggggacatggttcaaggacggagtgaagttgacgacccaggatggcgtcatcttcaagcaggatggactcgtgcactccttatttattacgcacgttcagggtactcaggcaggccgctatacattcgtggctggagaccagcaaagtgaagccactctcaccgtccaggacagccccacgattgccccagacgttaccgaaaagttgcgtgagcctctggtggtcaaggccggcaaacctgttattgtgaaaattccattccagagtcacttgcccatacaggcggcatggcgcaaggacggcgctgaggttgtgggttctagcgaccgcgaggcccaggtggacctcggggatggctacacccgactgtgtctcccctccgctggcagaaaggactgtgggcaatactcagttactcttcgatcagaagggggatcggttcaagctgagctaaccctccaagtcatcgataaacccgatccaccccaggggccgatggaggtgcaagattgccaccgagccggggtttgcctgaggtggcggccgcctcgcgacaatggcgggcggactgtggaatgctatgtagtggaacgcaggcaggctgggcgatctacttggttgaaagtaggcgaggcccccgccgactcaactactttcacagatgcccatgtggagcccggccggaagtatacatttcgggtccgggccgtgacttctgagggcgcaggcgaagccctcgagtccgaagagatcctggtcgcaccagaagcactgccaaaagccccatcagcaccggccatactgagcgcatcatcccagggtattaccctgacttggacagctccacggggacccggtagcgcgcatatcctaggatacttaatagaaaggaggaagaaaggcagcaacacttggacagcagtcaatgaccagccagtgcctgagagacgctggacggttgcggatgtgaggcaaggttgccagtacgaatttcgagtgactgctgtggcgccatcaggccctggcgaacccggacctccaagcgatgcagttttcgcaagagaccccatgaggccccctggactcgttcggaacctccaggtgaccgatcgatctaatacttctattactctttcctgggctgggcccgacacacaggaaggggacgaggcccagggctatgtggtggaactttgctctagtgactccctgcagtggcttccctgccacgtgggcaccgtcccagtgactacctacactgctaagggtttgcgccctggagaaggatattttgtcagagtgactgccgttaacgagggggggcagagtcagccctccgcccttgatactctggtccaggcaatgccagttaccgtgtgccctaaattcctagtggactcttctacaaaagatctcttaaccgtgaaggtgggagacacagtccgtgtgcccgtgtcttttgaagcgatgcccatgcccgaagtcacgtggctgaaagatggattacccctccccaaacggtctgtgaccgtgaccaaggacggcctcacccagttgctgattcctgtggctgggcttagcgactcaggcttatatactgtcgtcctgcgaaccctccaaggaaaagaggttgcccactccttccggattcgcgtggctgcctgtccacaggcacccggccccattcacctccaggagaacgttcctgggacagtaaccgcagagtgggaaccttcaccagacgaagcacaggacgtgccgttacactatgctgttttcactagatctagcgcccacggcccctggcacgaggccgcagaccggatccataccaaccgctttacgctgttggggattcttccaggccacgagtatcactttcgcgtggttgccaaaaatgagttaggggcctccaaaccatcggatacgagtcagccatggtgtattcctcggcagagggaccgttttacagtgaaggctccatgttaccgcgaaccagatttatctcaaaagccccgatttctggtcggccttaggtcacatttgctcccacaaggctgcgaatgttgtatgtcctgcgcggttcagggatctccaaggccgcatgtcacctggtttaagaacgacaggtcacttgaaggaaacccagccgtttattcgacggacttgcttggcgtatgtagccttaccatcccatccgtaagccctaaagacagcggagagtataaagcagtcgcagaaaacaccctgggtcaggccgtgtcaactgcgacactcatagtgatcgagccatcaacttag

SEQ ID NO: 48083 - DNA, 1713 bp, Artificial Sequence
  Description of Artificial Sequence: Synthetic coding sequence
atggccggcaagctgcggaagagccacatccccggcgtgagcatctggcagcttgtggaggagatcccggagggctgttctacaccagattttgagcagaaaccagtcacttcagctctgcccgaagggaaaaacgctgtcttccgcgctgtggtttgtggcgagccccgacccgaggtccggtggcagaattccaagggagatctttcagactctagcaaatacaagatcagttcttcgcccggaagcaaagagcatgttctccaaatcaataagctgacgggggaggacactgacctctacagatgtactgcggtaaacgcatatggcgaagcagcgtgtagtgtgcgactgactgtgatagaggtgggatttcgtaagaatcgcaaaagacacagggaacctcaggaagatctgcggaaggagctgatggatttcagaaagctgctcaagaagagagcaccacccgctcctaagaagaaaatggatctggagcagatctggcagctgctgatgactgcggacagaaaagactacgaaaagatatgcctaaaatatggaattgttgactatcgcggcatgttgaggaggcttcaagaaatgaaaaaggaacaggaagacaaaatggcacagtacatcaacaccatcagctctctaagacacatcagagtcacaaaggacgggaacgctaagtttgatcttgagcttgacttgaaagatagccagtcaaaaatctatctttacaaggacggcgaaatgattccgtatggatttaacaatcagactaagcattgtttacgccgtttgggaaaaagatacgaatttcagatccaggatcttcggccagaagattctggaatctaccaagtcaaggtagaagatgctgtagtcttctctaccgagctcgaggcatctgccatacctcccagagttgtggtgcccttagccgagacccattgcgaagaacagggggacgcagtgttcgagtgtaccctgtcatccccgtgtcctagcgctgcatggcactttcggcatcgcctgctccatccatccgacaagtacgaggtttacgtgagcccggacgggcttacacaccgcttggtggtgcggggtgctcgattttctgacatgggaccatatagcctgggaaccggactgtatacgtcgtcagcatggctcgtggtcgaagccggcaaggataaagatttgcagtccacgtcagctgaccataaattgcagagtaggcgctccggcaaagacggaagactcgacatctacggcgaaaggcgggatgctacccggagctcaacctccagatataaaccagggacaggctcgttctctaaagatgcccagggaccgatgggacacttctcacagggacttgcagatatggaagttcagccaggcgaggctgctactctgtcatgtacgctcactagcgaccttgggcctgggacttggtttaaggacggtgtcaagcttaccacacaagacggagtgatctttaagcaggacgggcttgtgcactctctgttcatcacacatgtccagggcactcaggccggtcggtacacgtttgtagcaggggaccaacagtctgaggcaacccttacagtgcaggattcgccaacgattgctcctgatgtgactgaaaagctgcgggagccactggtcgtgaaggcgggaaagccaatacagacatatcactag

SEQ ID NO: 48084 - DNA, 1446 bp, Artificial Sequence
  Description of Artificial Sequence: Synthetic coding sequence
atgatgctgaagagcatcaccgagagcttcgccaccgccatccacggattaaaggttggtcaccttacggatcgcgtcatccagcgcagcaaacgcatgattctggatacattgggggccggatttctgggcactacaaccgaggtcttccatatcgcttcacagtattccaagatatattcctccaacatcagctcaacggtctgggggcaacccgatattagactcccccctacatatgcagcctttgtcaatggtgtcgccattcactctatggatttcgacgacacttggcatccagctacccatccttcaggcgccgtgctacccgtgttaaccgcactagccgaggcattaccacgcagccctaaattcagcggcctggacctgcttcttgctttcaatgtagggatagaggttcagggtcggctgctgcattttgccaaagaggctaatgacatgcctaagcgttttcatccgccctcagtcgttggtactctggggtccgcagccgccgccagcaagttcctggggctcagctcgaccaagtgtcgggaggcccttgcaatcgccgtgagtcacgccggggcccctatggcaaatgccgccactcagactaaacctctccacattggcaatgctgccaagcacggcatcgaagcagcctttttggcgatgctagggctccaggggaataaacaggtacttgatctagaggccggattcggagcattctatgccaactacagcccaaaggttcttccctctattgccagctactcgtggctccttgatcagcaagacgtggctttcaaacggttccctgcccatctttccacccactgggtggcagatgcggccgcatcagtgcggaaacatctcgtagccgaaagagcactgctgcccactgattatattaagcgcatcgtgctacgcattcctaacgttcaatacgtcaatagacccttcccagtctccgagcacgaggcaaggcatagctttcaatatgtggcatgtgccatgctgctggatggcgggattacagtgcccagctttcacgagtgccagatcaatcggcctcaggtaagggagctgctgagcaaggtggaactagaatatccccccgacaatctgcctagctttaacatactttactgcgagatctctgttacccttaaagacggtgcaacctttacagaccggtctgacacattttacgggcactggcggaaacctctatctcaggaggatctggaggaaaaattccgcgcaaacgccagcaaaatgctgtcttgggacaccgtggaatcactcatcaaaatcgtgaagaacctggaggatcttgaagactgctctgtactaactacactcctaaaaggccctagtccacccgaagttgcatctaatagcccagcatgcaataactccattactaacctctcttag

SEQ ID NO: 48085 - DNA, 1446 bp, Artificial Sequence
  Description of Artificial Sequence: Synthetic coding sequence
ttccccctgaagagcatcaccgagagcttcgccaccgccatccacgggctgaaggtggggcatctgaccgatcgcgtgatccagcgctccaaaagaatgatcttagacactctgggcgcaggattcttgggcactactacagaggtgtttcacattgcctcccagtactcaaaaatctactcttccaacatctcttctacagtgtggggtcagccagacatacgcctgcccccaacctatgccgcatttgtcaacggcgtggccatccactccatggatttcgacgatacatggcatcctgcaacgcatccttctggagctgtgctgcccgtgctgactgccctggccgaggctctgccacgttcccctaagttttccggactggacttactcctggcatttaacgtcggaattgaggttcagggccggctgctgcacttcgctaaagaagccaatgatatgccaaagaggtttcatcctccctctgtggtcggaacgttaggctcagcagctgcagcgagcaaattcctgggcctatctagcacgaaatgccgtgaagctctcgcaattgctgtgagccacgccggggcccctatggcgaatgcagcgacccagactaagcctctgcacatagggaatgccgccaagcacggaattgaagcggccttcctggcaatgctgggattgcaaggaaacaagcaggtactcgacttggaagccggatttggtgctttttatgcaaactactcaccgaaagttctgccttccatcgctagctattcttggctgctcgatcagcaggacgtagcatttaaaaggttccccgcacacttgagcactcactgggtggctgatgctgccgcatccgtgcgcaagcacttggtcgccgaacgcgccttgctacctaccgactatataaagcgcattgtccttcgaataccaaacgtgcagtacgtgaacagaccctttccagtatccgaacatgaggccagacactctttccagtatgtagcttgcgccatgctcctggatggaggaatcaccgtgccttccttccatgaatgtcaaatcaataggcctcaagtacgtgaattgctttccaaagtggagctggaatacccccccgacaacttgcctagctttaatatcctctattgcgagatttctgtcacgctgaaagacggagccacattcactgacaggtcagacaccttttacggccattggcgtaaacctctgagccaagaagatctcgaggagaagtttcgcgcaaacgccagcaagatgctgtcgtgggatacagttgagtcgctgataaagattgtgaaaaatcttgaagatctcgaggattgtagcgtgttaactaccctcctaaaaggcccttcccctcctgaggtggcgtcaaacagcccggcttgtaataactcaatcactaacttaagttag

SEQ ID NO: 48086 - DNA, 963 bp, Artificial Sequence
  Description of Artificial Sequence: Synthetic coding sequence
atggccgagggcgacgccggcagcgaccagcggcagaacgaggagatcgaagctatggcagctatatacggtgaggagtggtgtgtgattgatgattgtgcgaaaattttctgtatacgcattagcgacgacattgacgatcctaaatggacattgtgccttcaagtaatgttacctaacgaatatccaggtaccgctccacccatttatcaactgaacgctccatggctgaagggacaggagcgtgctgacttatctaactccctggaggaaatctatatccagaacatcggtgagtccatcctttacttgtgggtggaaaagatccgggatgtactaatacagaagtcccagatgacagagccggggcccgatgttaaaaagaagaccgaggaggaggacgtggaatgcgaggatgacctaattctagcctgtcagccggagagttctctgaaagccctggactttgatatatctgagacacgtaccgaagtggaggttgaagaactgccccctattgatcacggcatccctattaccgacagacggagtacattccaggcacaccttgctcctgtggtgtgccctaagcaggtgaagatggtgctgagcaagttgtacgagaacaagaagattgcaagtgcgactcataatatttacgcctataggatttattgcgaggataaacagaccttcctgcaggattgtgaagacgacggcgagactgcagccggtggcagactgttgcatctcatggaaattctcaatgtgaagaatgtaatggtggtggttagccggtggtacgggggcatcctgctcggcccagacagatttaagcatattaacaattgtgcaagaaacattctggtggagaagaattacacaaattccccggaggagtcttctaaggcccttggaaaaaataagaaggtccgcaaggacaaaaagcgcaatgaacactag

SEQ ID NO: 48087 - DNA, 492 bp, Artificial Sequence
  Description of Artificial Sequence: Synthetic coding sequence
atgagcaccaacgagaacgccaacacccaggccgcccacctgcacaggagcaagaacaagggcaaggattccacagagacacggcgacatcgcatcgaggttaacgtcgaattgcgaaaggcgaaaaaggatgaccagatgttgaagcggcggaatgtctcttcttttccagatgacgctacgtcgccactacaggagaactgcaataatcagactcccgccctacgggccattgggaatattgtgactggaacagatgaacaaacccaagtcgtgatcgatgccggtgctttggctgtttttccgtcattactgaccaaccccaagacaaacattcagaaggaggccacttggacgatgtccaatatcaccgcctctaggcaggatcagatccagcaagttgtcaatcacggtctagtaccttttctcgtgagcgatttgtcaaaaatcttacggcataagcgaaagctgtatggcccttggaattcttag

SEQ ID NO: 48088 - DNA, 156 bp, Artificial Sequence
  Description of Artificial Sequence: Synthetic coding sequence
atgagcggccccctgagccccgtgtgcagctgcccccagctgccctttatgctctccccctgtcacatgcaccaccaccctggccacgttgccctttcccagacggtatctccagcaagtcttcttacacagggtctcgggcttccacaacactag

SEQ ID NO: 48089 - DNA, 2775 bp, Artificial Sequence
  Description of Artificial Sequence: Synthetic coding sequence
atggagatcaaggaggagggcgccagcgaggagggccagcacttcctgccaaccgcacaggcgaatgatcccggtgactgccaattcacctctatccagaaaacacccaacgaaccgcaactggaattcatcttagcctgcaaggaccttgtggcgcccgtgagagatagaaagttgaatactctggtgcagattagtgtgattcatcccgttgaacagtcgcttacccggtactctagcacagagatcgtggaaggaacccgcgatcctctgttcctcaccggggtgacctttcctagtgaatacccaatatacgaggagacaaaaatcaagctaacagtgtacgatgtcaaagacaaaagccacgataccgtccgtacatccgtgctgcccgagcacaaggatcctccccccgaggttgggaggagctttcttggctacgcctccttcaaagtcggggagctcttgaagagcaaagaacagctactcgtgctgtctctgcggacctcggatggcggcaaggtggtgggtaccatagaagtgagcgttgtgaagatgggtgagatcgaggatggagaagcggaccacattaccacagacgtgcaaggccagaagtgtgccctcgtttgtgaatgcaccgcccctgaatcagtaagcggaaaagataatttgccttttctcaactccgtgctcaagaatccggtctgtaagctgtatcggttccctacatctgacaacaaatggatgcggattcgggaacagatgtccgagtcaattctaagctttcatattcccaaggaactcatcagtctccacattaaggaggatctgtgccggaatcaggaaatcaaagagcttggggaactgtcacctcactgggataatctccgcaagaacgtgctgacccattgcgaccaaatggttaatatgtaccaggatattttgaccgaactgtctaaggagacagggagctcgtttaagagctcttcttctaaaggtgagaaaacactcgagtttgttcccatcaacctgcatctgcagcgaatgcaagtgcatagcccccatctcaaggacgccttgtacgacgtcatcacagtcggggcgcctgccgcacacttccaaggctttaaaaatggcggactgcggaaattactacaccgctttgaaaccgaacgcaggaacactgggtaccagttcatctactattccccagaaaacacagcgaaggctaaggaggtgctttcaaatataaatcagctgcagcctttaatcgctacccatgccgacttactgctcaactcagctagccagcatagtccagattcattaaaaaactcattgaaaatgttgtccgagaagaccgagctgttcgttcatgcattcaaggaccagttggtgagatcagctctgctggccctgtacactgcccgtcccggaggaatcctcaagaaacctccaagtccaaaatcttcaacagaggaatccagtccccaagaccagcctcctgtcatgaggggccaggattcaattccacaccactccgattatgatgaagaagagtgggaccgtgtgtgggcaaacgtaggcaagtcactaaactgcatcattgcaatggttgataagcttatcgaaagggacggcgggtccgaagggagcggcggcaataacgatggtgaaaaagagccgtctctgactgatgctataccgagccatccccgcgaggactggtacgagcagctgtatccgctgatcctgacccttaaagattgcatgggcgaagtggtaaatcgcgcaaagcagtccctgacatttgtgctgctccaggaactggcatatagccttccgcagtgtttgatgctcacactcaggcgtgacatcgtgttttcccaggcgcttgctgggctggtgtgtggtttcattatcaagcttcagacctctctctacgaccctggatttctgcagcagcttcatacggtgggcctcatagttcagtacgaggggctcctttctacctactccgatgaaatcggcatgttggaggatatggctgtggggatctcggacctcaagaaggtggcatttaaaattattgaggccaagtctaacgatgttctaccagttatcactggccgtcgcgaacactacgtggtggaggtgaagctgcctgcgcgcatgttcgagagcctgcccctgcagatcaaggaggggcagctgctgcacgtctacccagtcctgtttaatgtcggaataaacgaacagcagacgttggctgaaaggttcggcgatgtgagtctgcaagagagcatcaatcaggaaaattttgaacttctgcaggagtattacaaaatcttcatggaaaagatgccgcctgattacatttcacacttccaggaacaaaacgacttaaaggcgctgctagagaacctgctacagaatatccagtctaaaaaaagaaagaacgtggagattatgtggttggccgcgactatctgtcgtaaactcaacgggattcgctttacatgctgcaaaagtgcgaaagatagaaccagtatgtcagttaccttggaacagtgttcaatccttagggatgagcatcaactccacaaggacttctttatcagggctttagattgtatgaggagggagggctgcagaattgagaacgtactgaaaaatatcaaatgtagaaagtacgcgtttaatatgctacagcttatggcctttcctaaatactatcgccctcctgagggtacatatgggaaagccgatacgtag

SEQ ID NO: 48090 - DNA, 2775 bp, Artificial Sequence
  Description of Artificial Sequence: Synthetic coding sequence
atggagatcaaggaggagggcgccagcgaggagggccagcacttcctgcctaccgcccaagccaacgaccctggtgactgtcagtttacctcaatccagaaaacccccaacgagccccagctggagtttatcttagcctgcaaggacctggtggcgcctgttcgcgaccgcaaactgaacacattggtgcaaatctctgttatccatccggttgaacagagtttgacccgctacagcagcactgagatcgttgagggcaccagggaccccctttttctgactggcgttactttccctagcgaatatcccatttacgaagaaaccaaaatcaagctgacagtgtacgatgtgaaagacaagtcccacgataccgtgagaacctccgtgctgccggagcacaaggatccccctcctgaagtggggcggtcttttctcggatatgcctccttcaaagtgggcgaattgttaaagtccaaggaacagcttttggtgctgtctctgaggacgagcgacggaggaaaagtggtcggcacgattgaggtatccgtcgttaagatgggggagattgaagacggagaagctgaccatattaccactgatgtacaaggtcagaagtgtgctttagtctgcgagtgcaccgcgcccgaatccgtaagcgggaaagacaatctgccgtttctgaacagcgtgttgaaaaacccagtctgtaagctgtaccgctttccgacaagtgacaacaaatggatgagaataagggagcagatgagcgagtcgatcctgagcttccatatccccaaagagttgatctcactgcacattaaggaagatctgtgccggaaccaggaaattaaagagttgggcgaactgtcccctcattgggataacttacgcaagaacgtactcacacactgcgaccagatggtgaatatgtaccaggatattctcacagaactcagtaaagagaccggcagcagctttaaatcctcctctagcaagggggagaaaaccctggaattcgtccccatcaacttgcaccttcagcgcatgcaagttcacagtccacacctgaaagacgccttgtacgatgttataaccgtgggagctccggcggcacacttccaggggttcaaaaatggtggtctgcgtaagcttctacaccgcttcgaaactgaacgccggaacacgggttatcagtttatttattactcgcctgagaacactgctaaggccaaggaggtgctgtctaatatcaatcagctgcagccccttattgcaacccacgctgatcttttgctgaactctgcctctcagcattcaccagactccctcaaaaactccttaaagatgcttagcgagaagaccgagcttttcgtgcatgcatttaaagaccagctcgtcagatccgccctcctcgccttatacacagcacgcccaggagggatcttaaaaaagccgccatcacctaaatcttctacagaggagtcgtctccgcaagaccagccaccagttatgaggggacaggacagtatcccgcatcattcagactatgatgaagaggaatgggaccgtgtgtgggctaacgtgggcaagtctctcaattgcattatcgctatggtggacaagttgattgagagagatggcggctcagaggggtcgggcggaaacaatgatggagagaaagagccctcactcacagacgccattccaagccacccccgggaagattggtatgagcagctgtatcctctcatcctcactttaaaggactgcatgggcgaagtggtcaacagagcgaagcagtcactgacattcgttctgttgcaggagctggcctactctttacctcagtgcctgatgctgacactgaggagagatattgtattctcacaggccttggccggtcttgtctgcggctttatcattaaactgcagacatctctgtacgaccccggctttttacagcaactccacaccgtggggttgattgtccagtacgaggggctcctgagcacatattcagacgaaattggaatgctcgaagacatggctgtcgggatttccgatttgaagaaagttgcctttaagatcatagaggccaagtctaatgatgtgttgccagtgataacagggcgcagggaacactacgttgtggaggttaagctgcccgcccgtatgttcgagtctctccctctccagattaaggaggggcagctgctgcatgtgtacccagttttattcaatgtcggaattaatgaacagcagaccttagctgaacgcttcggcgatgtcagtctgcaggagtccatcaaccaagagaacttcgaattactccaggagtactacaagatcttcatggagaagatgcctcctgattatatatcacatttccaggagcagaatgatctcaaagcgctgctcgagaatttgctccagaacatccagtcaaaaaagcggaagaatgtggaaatcatgtggctggctgcaacaatttgcaggaaactgaatggaattagatttacctgctgcaagagtgcgaaggacaggaccagcatgtccgtgactctggaacagtgttcaatcctccgggacgagcatcagctccataaggacttttttattcgggctttagattgtatgagacgggaaggctgccggatcgaaaatgttctgaagaacattaaatgtcgaaaatacgcattcaatatgttgcagctcatggcgttcccaaagtactaccggccccctgagggaacttatgggaaggcagatacttag

SEQ ID NO: 48091 - DNA, 120 bp, Artificial Sequence
  Description of Artificial Sequence: Synthetic coding sequence
atggagatcaaggaggagggcgccagcgaggagggccagcacttccttcccaccgcgcaggccaatgatcccggtgactgtcagtttacatctattcaaaagaccccaaacgaaccctag

SEQ ID NO: 48092 - DNA, 396 bp, Artificial Sequence
  Description of Artificial Sequence: Synthetic coding sequence
atggagatcaaggaggagggcgccagcgaggagggccagcacttcctgcccacagcacaggctaacgatcccggagactgccagttcacctccattcagaagaccccgaacgagccccaactggagttcattcttgcctgcaaggacctggtcgcccctgtgagagaccgcaaactgaacacacttgttcaaatatcggtaattcatccagttgagcaatcccttactaggtattcctccaccgaaattgtagaggggacgagagaccctctattcttgacaggggtcaccttcccatctgaatacccaatatatgaggaaacaaaaattaagctgaccgtgtatgacgtcaaggacaaatctcacgatactattgctaattccagccgcatctag

SEQ ID NO: 48093 - DNA, 255 bp, Artificial Sequence
  Description of Artificial Sequence: Synthetic coding sequence
atggagatcaaggaggagggcgccagcgaggagggccagcacttcctccccaccgcacaggctaatgacccgggtgattgtcagttcacaagtatccagaaaacccctaacgagcctcagctcgaattcatactcgcctgcaaagacttagtcgcaccagtccgggaccgaaaattgaacaccctggtccagatatccgttatccaccctgttgagcagtctctcaccaggtacagcagcaccgaaattgtgtag

SEQ ID NO: 48094 - DNA, 162 bp, Artificial Sequence
  Description of Artificial Sequence: Synthetic coding sequence
atggagatcaaggaggagggcgccagcgaggagggccagcacttcttaccaactgcacaagcaaatgacccaggcgattgtcagtttacaagtatacaaaagacacccaatgagccgcagctggagtttattctcgatttgaatcaggagctgcgagattag

SEQ ID NO: 48095 - DNA, 2775 bp, Artificial Sequence
  Description of Artificial Sequence: Synthetic coding sequence
atggagatcaaggaggagggcgccagcgaggagggccagcacttcttgcctacggcccaggctaatgatccaggggactgccaattcactagtatccagaagacccccaacgagccccagttggaattcattcttgcttgtaaggacctggtggcccctgtccgcgatcgtaagctgaacacgttagtacaaatcagtgtaatccaccctgtcgagcagagtctgaccagatactcttctaccgagatcgtagaggggactcgcgaccctctgttcctgaccggggttactttccctagtgagtaccccatttacgaggagaccaagattaagctcacagtttacgatgtgaaagataagtcacatgatacagtccgcactagcgtcttgcctgagcacaaagatcccccacccgaggtgggtcgatccttccttggatacgcgtcgttcaaagtaggcgagcttctcaaatcaaaagagcagttgctggttctgagcctacggacatctgacggaggaaaagtcgtcggcactattgaagtatctgtagtcaaaatgggcgagattgaagacggggaagccgatcatatcaccacagacgtgcagggacaaaaatgtgccctcgtgtgcgagtgcaccgctccggagtctgtcagcggcaaagataatcttccattcttgaatagcgtgttgaagaaccctgtgtgcaaactgtacaggttccctacaagtgacaataaatggatgcggattcgggagcaaatgagcgaaagcatcctgagttttcacattcccaaggagctaatctccttgcatataaaagaggatctctgccggaaccaggagattaaagaactcggagagctgtctccacattgggacaacctaagaaaaaacgtgctgacccactgtgatcagatggtgaatatgtaccaagacatcttgaccgaactttccaaggaaaccgggagctcgtttaaaagctcgtcctccaagggagagaagactttggagttcgtaccaatcaacttacaccttcaaaggatgcaggtgcattcaccccacctgaaggatgccctctatgacgtcatcactgtaggagccccggccgcccactttcagggtttcaaaaatggcggactgaggaagctgctgcaccgcttcgaaactgaacggcggaacaccggataccagttcatttactacagcccagaaaatactgccaaggccaaagaggtgctgtccaatatcaatcagttgcagcccttaatagcgactcatgcagacttacttttaaactccgcgagccaacattctccggattcactgaagaacagtcttaagatgttaagcgagaagactgaactgttcgtccacgcattcaaggatcaactcgtaaggagcgctctgcttgccctgtataccgcccggccaggcggcatcctgaaaaagcccccttctccgaaatcttcaactgaagagtcctctccacaggatcagcctcccgtcatgcgcggtcaggactccattccccatcacagcgattatgacgaagaagagtgggatagagtttgggccaacgtcggtaagtccctgaattgcatcatcgccatggtcgacaagttgatcgagcgcgatggaggcagtgaggggtctgggggcaataatgacggagaaaaggagccgagcctgactgacgccataccatcgcacccaagggaggactggtacgagcagctctacccacttatcctgaccctgaaagattgtatgggcgaagtggtgaaccgagccaagcagtcactgaccttcgttcttctgcaggagctggcttatagtctcccccaatgcctgatgctgacacttcgccgtgacatagtctttagtcaggctttagcaggattggtgtgtgggtttattattaaactccagacaagtctctatgaccccgggttcctccagcaactgcacaccgtcggccttatcgtccagtatgagggccttctttccacatactccgacgagatcggcatgctcgaggacatggccgttggcatcagcgatcttaagaaagtggcgttcaagattattgaggctaaaagtaacgacgtgctccccgtgatcactggccgtagggaacactatgtggtcgaggttaaattgccagcacgcatgttcgagtcattgccactacagatcaaggagggtcagctcctgcacgtgtatccggtgctttttaatgtaggtataaatgagcagcaaaccctggccgagcgcttcggcgatgtgagcctgcaggagagtattaatcaagaaaattttgagctcctccaggaatactataagatcttcatggaaaagatgcccccagattacatttcccatttccaagaacagaacgacctgaaggcacttctggaaaatctgctccagaacatccagtccaaaaaacggaaaaacgtcgaaataatgtggttggcagccacaatctgcaggaagctgaatggaatccggttcacttgttgcaagagtgctaaggaccgcacttctatgtcagtcacactggaacagtgcagtatccttcgcgacgagcaccaattgcacaaagattttttcattcgggcgctcgactgtatgcgccgggaaggttgtagaattgagaatgtgctgaaaaatattaagtgccgtaagtacgcttttaatatgttgcagttaatggcatttccaaagtattaccggcctccagagggcacctacggcaaagccgacacgtag

SEQ ID NO: 48096 - DNA, 2817 bp, Artificial Sequence
  Description of Artificial Sequence: Synthetic coding sequence
atggagatcaaggaggagggcgccagcgaggagggccagcacttccttccgacggcccaggcaaatgacccgggggactgccagttcacctctatccagaaaactccaaacgaaccccagctggagttcatcctggcctgcaaagatctggtagctcctgtaagggataggaaattgaataccttagtccagatttccgttatacaccctgtcgagcaatcattgacgaggtacagcagcacggagatcgtggagggtacgcgtgacccgctctttctaaccggcgtgaccttccctagtgagtatccaatctacgaagagacgaaaatcaaactaactgtgtatgacgtgaaagacaaatctcacgacacagtccgtacttctgttctgcccgagcacaaagacccccctccggaagtgggtaggtctttcttagggtatgcctcttttaaggtaggggaattgctcaagtccaaagagcagctgctcgttttgagcttacgaacttcagacggaggaaaggtcgttggcacaatcgaagtgtctgtggttaagatgggcgagattgaagatggtgaggctgaccacatcaccaccgatgtccagggacagaaatgcgctctggtctgcgaatgtacagcgcctgaatccgtctctggaaaagacaacttgcccttcttaaacagcgttctgaagaatcctgtgtgcaaactctaccgttttcccacttctgataataagtggatgaggatcagagagcagatgtctgaatccatcctgagtttccacatccctaaggagctgattagtttgcacatcaaagaggatctgtgccgaaaccaggaaatcaaagaactcggggaactgagtccccattgggataacttacggaaaaacgtacttactcattgtgaccagatggtaaacatgtaccaggatatcctgacagaactcagtaaggagacaggctccagctttaagtccagctcgagtaaaggggaaaagaccctagaatttgtacccatcaacctgcatcttcagaggatgcaggtgcattccccacacctgaaggatgctttatacgacgttatcactgtcggagcacccgccgctcacttccagggcttcaaaaacggcggattaaggaaactgttgcaccgcttcgagaccgagcgaaggaacacaggttaccagtttatttactatagtcctgaaaacacagcaaaggccaaagaggtgctctcaaacatcaatcaactgcaacccctcatcgccacccacgctgatctgctcttgaacagcgcatcacagcatagtccggattcactcaagaatagtctgaagatgttgagcgagaagacagaactgttcgtgcatgcctttaaggaccaactggttcgctctgctctgcttgctctgtatacagcaagacctggcgggatcctcaagaaacctccttcccccaagagcagcactgaggagtcatcaccacaagatcaaccacccgtgatgaggggtcaggattccatccctcatcacagcgactacgatgaggaggagtgggaccgcgtgtgggcaaatgtgggaaagagcctcaattgcatcattgcgatggtggataaactgattgagagggatgggggctccgaggggagtggtggaaacaacgacggggaaaaagaaccaagcctgactgacgccatccctagccacccaagagaggattggtacgagcaactataccctctaatcctgactctgaaggactgcatgggagaggtagtgaatagagctaagcagtccttgacgtttgtactcctgcaggagttggcctatagcttaccccagtgcctgatgctcacattacgaagggatatcgtcttttcacaggctctcgccggtctcgtctgtgggttcattataaagctgcagacaagcctgtatgacccggggttcctgcagcagctgcacaccgttggccttatcgtacagtatgagggtctcttaagtacctatagtgatgagataggtatgctcgaagatatggccgtgggcatcagcgacctgaagaaagtcgccttcaaaatcatcgaagccaaaagcaatgacgtgttgccagtaatcactggtcggagagagcactatgtggtggaggtgaaattgcccgcaaggatgtttgagagcctgccactgcagattaaggaagggcagctgcttcatgtgtatcctgtgttatttaacgttggtatcaatgaacaacagaccctcgctgagagattcggggatgtttccttgcaggagagtattaatcaagaaaactttgaactgctgcaggaatattacaagatattcatggaaaaaatgccacccgattacataagccacttccaggagcagaacgaccttaaggccctactagagaacttactgcagaatatccagagcaaaaaaagaaagaatgtggaaatcatgtggctcgccgccaccatttgcaggaagcttaatggcataagatttacctgttgcaagtcggctaaagaccgcacaagcatgagcgtcacactagaacagtgcagcatccttagggacgagcatcagcttcacaaggacttctttattcgtgctttagactgcatgaggagccgtcaaacacagggcgccctaaatgagtccgacgacccagaaaccggctgtttaaccgataacaaaccgacttccagacacttctaccccgtcgcactgcttctggttagctcacacctactcgtggtctggctgatcctcagcttggctctgctcctcgccaagtaccaatag

SEQ ID NO: 48097 - DNA, 2454 bp, Artificial Sequence
  Description of Artificial Sequence: Synthetic coding sequence
atggagatcaaggaggagggcgccagcgaggagggccagcacttcttgcctacagcccaggccaacgaccccggagattgccagtttactagcatccagaagacgccgaacgagccccagctggagtttatcctggcttgtaaggatctggtcgctccagtgagagatcgcaagttgaacactctcgtccagatctccgtcatccacccagtggagcagtcactaacgcggtattctagtaccgaaatcgtcgaaggaactagggacccgctgtttctgacaggcgtgacttttccttctgagtaccccatctatgaagagacgaaaatcaaactgacagtctacgacgtgaaagataaatcgcatgacacggtgaggacctcagttctccctgagcataaggatccgccacccgaggtgggccggagcttcctggggtatgcctcattcaaggtgggtgagttgctgaagtccaaggagcagctactggtcttaagccttcggacaagtgacggtgggaaagtagtcggtacaatcgaagtttcagtggtcaagatgggggagattgaggacggcgaggccgatcacataactacagatgtccagggccagaaatgcgcactggtttgcgagtgtaccgcacctgagtccgtgtcaggtaaggacaatcttcctttcctgaactctgtcctgaagaacccagtttgcaagctgtatcgcttccctacctctgataacaaatggatgcgtatcagagaacaaatgtccgagtctatcctgtcatttcacattccaaaggagttgatcagcctccacatcaaagaagacctttgtcggaatcaagagatcaaggaactgggagaactcagcccccactgggataacctccgcaaaaacgtactgacacactgcgatcagatggtaaacatgtaccaggacatcctgaccgagttaagtaaagagacaggctcatccttcaagtctagtagttctaagggcgagaaaacactggagtttgtaccaattaacctacatctgcagagaatgcaggtgcattcgcctcacctcaaggacgccctctacgatgtgattactgtaggcgcacctgcggcccactttcagggatttaagaacggtgggcttcggaagctcctacacaggtttgaaacagagcgccgcaacactggctaccaattcatctactactcgcccgaaaatacagccaaggcgaaagaggtcttatccaatattaaccagctgcaacctctcatcgctacccatgccgatctccttttaaattctgcttcacagcactctccagactctctgaagaactccctaaagatgctctcagaaaagacagaactgtttgtgcatgcgttcaaagatcagctcgtgagaagcgcattgctcgccctgtatacagctagaccaggggggatcctgaagaagccaccctctccaaaatccagcacggaagagagtagcccacaggatcagcctccggtgatgcgtggccaggattcaatcccgcaccactcggactacgacgaagaagaatgggaccgcgtgtgggccaacgtggggaaatcgctgaattgcatcattgctatggtggataagctgatcgaaagagacggaggatcagaggggagtgggggtaataacgacggggaaaaggaacccagtctcacagacgctataccaagccacccccgggaagactggtatgagcagctttatccactgattctgaccttaaaggactgtatgggcgaggttgtcaatagggctaagcagtcactgaccttcgtgttactccaggagctcgcatactctctgcctcagtgtctaatgttgacccttaggagagacatcgtgttctcccaagctttggccgggctggtatgtggctttatcatcaagttgcaaacatcattgtacgatccaggcttcttgcagcagctgcacaccgttggactgattgtccagtacgaggggctgctgagcacatatagcgatgaaatcgggatgttagaagatatggccgtcgggatatcagatctgaagaaagtggccttcaaaatcatcgaagctaagagtaacgatgttctcccggttattacggggagacgcgagcactatgtggtggaagttaagttgcccgcaagaatgtttgaatccctcccactgcagatcaaagaaggtcaactgcttcatgtgtatcctgtccttttcaatgtgggtattaacgagcagcaaacactcgccgaacggtttggggatgtgagtctacaggagagtatcaatcaggagaatttcgaactactgcaagagtactacaagatctttatggaaaaaatgcccccagactatattagccactttcaggaacagaacgacctgaaagcactgttggagaatctcctccagaatatacagtcaaaaaagtag

SEQ ID NO: 48098 - DNA, 2775 bp, Artificial Sequence
  Description of Artificial Sequence: Synthetic coding sequence
atggagatcaaggaggagggcgccagcgaggagggccagcacttcctaccgacggcccaggccaatgatcctggcgattgccagtttactagcattcaaaagactccaaacgagcctcagctggaatttatattggcatgcaaggacctggttgcccccgtgcgggatcgcaagctcaacaccttggtgcagatttccgtgattcacccggtcgaacagtctttgactaggtacagttcaaccgaaatcgtggagggtactcgcgaccccctgtttctgactggcgtgaccttccccagcgaatatcctatctatgaggagacaaagatcaaactcacagtctacgatgtcaaggacaagagtcacgacacagttcgcacatccgtgctgcccgagcacaaagaccccccccctgaggtgggcaggtcatttctgggctatgcctcttttaaagtaggcgaactgttgaaaagtaaggagcagttgctggtgctgagcttacgaacttccgatggggggaaggtcgtgggaacaatcgaagtgtccgtcgtgaagatgggggaaatcgaagacggtgaggccgaccacataaccaccgacgtccagggccagaaatgtgctctggtgtgcgaatgcaccgctcccgagtccgtcagcggaaaagacaacctgcctttcctgaattccgtactcaagaaccccgtctgtaagctataccggttccctacgtctgacaataagtggatgcgcatccgggaacagatgtcagaatccatcttatctttccacatccccaaggagctgatttcacttcatataaaggaggacctctgccggaatcaggaaataaaagagttgggggagttaagcccccactgggataatttgcgcaaaaatgtccttacacattgcgatcaaatggtgaacatgtaccaggatatattaaccgaactgagcaaggaaaccggaagcagcttcaagtcttcatcttctaaaggagagaagaccctcgagttcgtaccaataaatcttcacctgcagcggatgcaggttcacagtcctcatttgaaggacgcgctgtatgatgtgatcaccgtaggtgctcctgcggcgcactttcagggcttcaaaaacggaggcctcagaaagctgctgcaccgttttgaaacggagcgacgtaataccgggtatcagttcatttattactctccagagaatacagccaaggctaaagaagtgctctctaatattaaccaactgcaaccactcatagcaactcatgcagatctgctgctgaactctgcctcgcaacactcacctgactccctcaagaacagcctgaaaatgttgtcagagaagacagagcttttcgtccacgccttcaaggaccagttagtgcgatcagccctgctggccctgtacacggcccggcctggtggtattctcaagaagccgccctcccccaagtcctccactgaggagtcctcacctcaagatcagcctccagtcatgcggggacaggatagcatccctcaccactccgattacgacgaagaggaatgggatagagtctgggcaaacgtcggcaagagtctcaactgtatcatcgccatggttgacaagctcatcgaacgagatggaggatcagaggggtcagggggcaataatgatggagagaaagaaccttctcttactgacgcaatcccgagccacccacgcgaggattggtacgaacaactgtaccctttaatattgaccttaaaagactgtatgggtgaggtcgttaacagagccaagcagtcactgacatttgtgttgttacaggagctcgcgtattccctcccccagtgtcttatgctgacgttaagacgtgacatcgttttctcacaggcacttgccggccttgtgtgcggttttatcattaagcttcaaacaagtttgtacgaccccggattcctgcaacagttgcatacagtcggtttaatagtgcaatacgaaggcctgctcagcacctactcagatgagatcggcatgttggaggacatggctgtgggcatctccgatctgaaaaaggtcgcttttaaaattatcgaagcaaagagcaatgatgtcctgccagttatcaccggccggcgcgaacactatgttgtggaggtgaagctgccagccagaatgtttgaaagtttgcccctgcagatcaaagaggggcaactgctgcatgtctaccctgtgttgtttaacgttggcatcaacgagcagcagacactggctgagcgctttggcgacgtgtccctgcaggaaagcattaaccaggagaatttcgaactactgcaggagtactacaaaatattcatggaaaagatgccccctgattacatcagccacttccaggagcagaatgacctgaaagcgctactagaaaacctgttacagaacatacagtcaaaaaagcggaagaacgtggagattatgtggcttgccgccactatttgtcgcaagctaaatggcattaggttcacctgttgcaaatccgcaaaagacagaactagcatgtccgtgactctggaacaatgctcaattctgcgagatgagcaccagctgcataaagattttttcatccgcgctctcgattgcatgagaagggagggatgcaggattgaaaatgtgttgaagaacattaagtgccgcaagtacgccttcaatatgcttcagctcatggcctttccaaagtactatcgacccccagagggtacatacggaaaggccgatacatag

SEQ ID NO: 48099 - DNA, 1971 bp, Artificial Sequence
  Description of Artificial Sequence: Synthetic coding sequence
atgggcgagatcgaggacggcgaggccgaccacatcaccaccgacgtacaagggcaaaagtgtgccttggtgtgtgagtgcactgcaccggaaagcgtctctggcaaggacaaccttccttttctcaacagtgtactgaagaaccctgtctgcaaattatatcgcttcccaacctctgacaacaagtggatgagaattcgggagcagatgagtgaatcaatcctgagtttccatatacccaaggaacttataagcctgcacatcaaggaggacctctgtcggaatcaggagatcaaagaactcggagagctgtcaccacattgggataacctgcgtaagaacgtcctgacacattgcgaccagatggtgaacatgtaccaggatattttaactgaactgtccaaggaaacgggttcatcttttaagagctcttctagcaagggagagaagaccttggaattcgtgcccattaacctgcatcttcagcggatgcaggttcactcgccccatctgaaggatgcattgtacgatgtaatcacagtcggggctcccgcagcacacttccagggttttaagaatggcggcctgcgtaagctgctccatagattcgagacagaaagacggaataccggctatcagtttatttattacagtcccgagaacacggccaaggctaaggaagtgttatcaaacatcaatcaactgcagcccttgattgccacgcacgccgacctgttactgaattccgcgagtcagcactctcctgattcgctcaaaaattctctgaagatgttgtctgaaaaaacggaactgttcgtgcacgcctttaaagaccagctggtacgatccgccctgctcgcactgtacaccgcccgtccaggtggtatcctgaaaaaacccccttctccaaaatcaagcactgaggagtcctcacctcaggaccagccgccagtgatgcggggacaggactccataccacatcattccgactacgatgaggaagaatgggacagggtgtgggcgaacgtgggtaagagtttaaactgtatcatcgcaatggtcgataagctgatagaaagggatggagggtccgagggctcgggcggcaataacgacggtgagaaggaaccctcccttaccgacgctattcctagtcatccaagagaagactggtatgagcagttgtaccccctgattctcaccctaaaggactgtatgggagaagtggtgaatcgggctaagcagagcctcacattcgtgttgctgcaggagttggcatactccctgcctcaatgcttaatgctcactttgcgcagggatatcgttttcagccaagccttggccggtctcgtgtgtggattcatcatcaagttgcagacttccctctatgatcctggattcctgcagcagcttcacacggtagggttaatcgttcagtacgaaggcctcctgtctacttacagcgacgaaattggcatgctggaggacatggctgtgggaatcagtgacctgaagaaagttgctttcaaaataatcgaagctaagtcaaacgatgtattgcccgtgataacgggccgcagagaacattacgtagtagaagtcaaactgccagcccgaatgttcgaaagcttaccactccagatcaaagagggccagctgctacacgtatacccggtcctgttcaatgtgggcatcaatgaacagcaaaccctcgccgagcggtttggtgacgtaagcttgcaggagagcattaatcaggagaacttcgagctactgcaagaatattacaagattttcatggagaaaatgccgcccgattacatatcccacttccaggagcagaacgatttgaaggcactgctagagaacctgcttcagaacatacagtccaagaagaaagagtgcagaaattacgtggctggttgtaatgacctgccgcaaacagagtggtattcgtttcaccttctgtag

SEQ ID NO: 48100 - DNA, 2061 bp, Artificial Sequence
  Description of Artificial Sequence: Synthetic coding sequence
atgatccacttccaccccctgatcctgccccacgagcggagcttcctgggttatgcttcattcaaggtgggcgagctgttgaaatccaaggaacaactcttagtcttatccttgaggaccagtgacggaggaaaggttgttggaacaatcgaggtttctgtggtcaagatgggggagattgaagatggggaagcggatcatatcaccactgacgtgcagggacagaagtgcgctctggtctgtgagtgcactgccccagaatctgtcagtggcaaggataacctgccattcctgaatagcgttctgaagaatccagtctgtaagctttaccgcttcccgacttcagataacaaatggatgcgtatccgggagcagatgagtgagtctatactttccttccatatccccaaggagctgatcagcttacacatcaaggaagatctttgtaggaatcaggagataaaagaactaggcgagctctccccgcactgggataacctcaggaagaacgtcctgacccactgtgaccagatggtgaatatgtatcaggacatcctaacagaactatctaaggagacagggagtagcttcaaatctagctcgagcaaaggagagaagaccctcgagtttgtgcccatcaatttacacctgcaaaggatgcaggtgcactcgccccaccttaaggatgctctgtacgacgtgatcactgtaggagctcccgccgctcacttccagggatttaaaaacggggggctgaggaagctgctgcatcgcttcgagaccgaaagaagaaatactggctatcagtttatctattactcccccgagaatactgccaaggctaaggaagtgcttagtaatataaaccagctgcaaccactcatagctacacatgccgatctcctcctcaactcagcctctcagcactcccccgattcactgaaaaactcccttaaaatgttgtcagagaagacagagctgtttgtacacgcttttaaggatcaacttgtgcgcagcgctctgctggcactgtacacggcccggcctggcggtattcttaagaagccaccctcccctaagtcctccaccgaagaatcttccccccaggatcagcctcctgtgatgaggggccaggattcaataccccaccattccgactatgacgaggaggagtgggatcgagtgtgggccaacgttggtaaaagcctcaattgcatcatcgctatggtggataagctgatcgaaagagacggtggctcagagggaagcggaggcaacaacgacggagagaaggaaccctccctaacagacgctattcctagtcatccacgagaagactggtatgagcagttataccccctgattttaactctcaaggactgcatgggggaagtggtcaacagggcaaagcagtcactgacttttgtactgctgcaggagctggcttattctctgcctcagtgtctcatgctgacgttgagacgcgatattgtgttctctcaagccctcgccggactcgtttgtggtttcatcataaaactgcaaacttctctgtacgatcctggctttctgcagcagttgcacacggtgggcctgatagtccagtacgagggcctgctgtccacctactctgatgaaattggaatgcttgaggatatggcggttgggatctcagacctgaaaaaggttgcctttaagatcatagaggctaaaagtaatgatgtactgccagtaataacgggccggagggaacactacgtggttgaggtgaagcttcctgccaggatgtttgagagcttaccccttcagatcaaggagggccaactgttgcacgtttatcctgttctgtttaatgtcggcatcaacgagcagcagactctcgccgagaggtttggggatgtgtccctgcaagagtcaatcaatcaggaaaattttgagctgctgcaggagtactataaaatcttcatggaaaaaatgccccctgactatatctcccattttcaagaacagaacgatcttaaggcgctgctcgagaatctgcttcagaacattcaatcctag

SEQ ID NO: 48101 - DNA, 3399 bp, Artificial Sequence
  Description of Artificial Sequence: Synthetic coding sequence
atggagctgttccaggccaaggaccactacatcctgcagcagggcgagcgtgctttgtggtgtagtaggcgggacggtggactccagttgcggcccgctacagatttgttgttagcttggaaccctatctgcctggggttggttgagggggtgatcgggaaaatccagctgcacagtgacctgccttggtggcttatcctgatccgccaaaaggccctggttggcaagctgcccggcgaccatgaggtgtgcaaagtgacaaagatcgccgttcttagcttgagcgaaatggagccgcaagacttagagcttgaattgtgcaaaaagcaccatttcggaatcaacaagcccgagaaaatcattccctctccagacgattccaagttcttgctgaagacattcacccatatcaagagtaacgtctctgcacccaataagaagaaagtgaaggaaagcaaagaaaaggagaaattggagagacgtctgctggaagaactgctgaaaatgttcatggactctgaatccttttattacagcctcacctacgaccttacaaattccgtgcagagacaaagtaccggtgaaagggatgggcgacctctgtggcagaaggtagacgacaggtttttttggaacaagtacatgatacaggatctgacagagatcgggacccctgacgtggacttctggatcattccgatgatccaggggttcgtgcagatcgaagagttggtggtaaactatacagagtcttccgatgacgagaaatcctcccccgagacacctcctcaagaatccacatgtgtggatgatattcacccacggtttctggttgctctcatttccaggcggagccggcacagagctggaatgcgatacaagaggaggggcgtggacaagaatgggaatgtcgccaattatgtggagactgagcagttgatccacgtccataatcatactctgagttttgttcagacccggggatccgtccccgtgttttggagccaagtcggatatcgttataacccccggccacgcctggacagaagtgagaaggagacggtggcctacttctgtgctcatttcgaagaacagttaaatatttataaaaaacaggtcataataaatttagttgatcaggctgggcgggagaaaatcatcggagatgcctatctcaaacaggtgctcctgtttaataactcccacctgacctatgtctccttcgactttcacgagcactgtaggggcatgaaattcgaaaacgttcagacactgaccgacgcgatatacgatattatcttagatatgaagtggtgttgggtcgatgaagccggagtgatttgtaaacaagaggggatctttcgcgtcaattgtatggactgcctggatagaaccaacgtagtacaggctgcaattgcccgtgtggtgatggagcaacagttgaaaaagttaggtgtcatgccccctgaacagcccctgccagtaaagtgtaaccgcatttaccaaataatgtgggctaacaatggggacagtatctcaaggcagtatgctgggacagccgcactcaagggggacttcacccggacaggggagcgaaagctcgctggagtgatgaaggacggggtgaacagcgccaaccgctattacctgaataggtttaaagacgcttatagacaagccgttatcgatttgatgcaaggcattcccgtcactgaggacctatactcgatcttcactaaagagaaggagcacgaggccctgcataaggagaatcagcggtcccaccaggaactgataagtcagctattacagtcctacatgaagctgcttctgccagacgacgaaaagttccacgggggctgggcattgatcgattgtgacccatccttgatcgacgcaacgcatcgagatgtggatgtcctgctgctgctgtccaacagcgcctattatgtagcctactatgacgacgaggttgataaggtcaaccagtaccagcggctatctctcgaaaacctggagaagattgaaatcggacccgaaccgacactgttcggcaagcccaagttctcctgcatgagactacactacaggtacaaggaggcttcagggtatttccacacacttagagctgtcatgagaaaccctgaggaggatgggaaggataccctccagtgcatcgccgaaatgttgcagattaccaaacaagccatgggctcagacctacccattattgaaaagaagctggaacggaagtcatctaaaccccacgaggatattatcgggatccggtcccagaaccagggtagtcttgcccagggaaagaatttcctaatgagcaagttttcctcccttaaccagaaagtcaaacagacaaagagtaatgtgaacatcgggaatctccgtaaacttggcaatttcacaaagcccgagatgaaggtaaacttcctcaagccaaatctgaaggttaacctgtggaaatccgactccagcctggagactatggagaataccggggtcatggacaaggtccaagctgagtctgacggagatatgagttcggacaacgactcttatcactcagacgaattcctcaccaactccaaatctgatgaggacaggcagctcgccaacagcttagaaagcgtgggccccattgattatgtgctcccttcctgcggaatcatcgcatcggcgccccggctgggtagtcggtcacaaagtttaagctctacggatagttcagttcacgcaccctctgagatcaccgttgcccatggctccggcctagggaagggtcaagaaagtccactgaaaaagtccccttcagcaggcgacgtgcatatcctcactggcttcgccaagcccatggacatctactgccacagattcgtgcaggatgcacagaacaaagtcacccatctgtcggaaactaggagtgtgtctcagcaagctagccaggaacgtaaccagatgaccaaccaggtgagcaacgaaacccagtcagagagcacggaacagaccccttctaggcctagtcagctggatgtaagcctgtccgctaccggcccacaatttctgtccgtggagcccgctcacagtgtggcctcccagaaaacacccacctctgcctcttccatgctagaattagagactggactgcatgtgacacccagtccaagcgaaagttcaagttcccgggccgtctcgccattcgccaaaatcagatccagcatggtacaagtcgcttccatcacccaggccgggctaacccacggcatcaactttgctgtctccaaggtgcagaagtctccccctgaaccggaaattatcaaccaggtacaacagaacgagctgaaaaaaatgtttatccagtgccagacccggataatacagatctag

SEQ ID NO: 48102 - DNA, 1569 bp, Artificial Sequence
  Description of Artificial Sequence: Synthetic coding sequence
atgtgccacgacgtgatcttcatggcctggctgaagcagcagttcagtgaatgcacactcatcgacgctacccatagggatgtcgatgtgttactattgctgtcaaattccgcatattacgtggcgtactacgacgacgaggtggataaggtcaaccaatatcagcggctctcgctggagaatttggagaagattgagatcggacccgaaccgacattgtttgggaaaccgaagtttagttgtatgcggcttcactaccgttacaaggaagcctccggttattttcatacattgcgcgcagtgatgaggaatcccgaggaggacgggaaggacaccctgcagtgcattgcggaaatgttacagatcactaaacaagctatggggtctgacttgcctattattgagaagaaacttgagcgcaagtcttccaagcctcatgaagacatcattggcatccgatcgcagaatcagggatccttggcgcaaggcaagaacttcctcatgagcaaattttctagtctcaatcagaaggtgaaacagacgaagagcaatgttaatattgggaatctgcggaaactcggcaacttcacgaagccggaaatgaaggttaattttctgaaaccgaacctaaaggtaaatctgtggaaatcagactcctcactggagactatggaaaacacaggagtaatggataaagtgcaggccgagtccgacggcgacatgagctcggacaacgactcctaccattcagacgagttcttaactaactccaagagcgatgaagatcggcagctggccaacagtctggagtccgtgggtccaatagactacgttctgccctcttgtgggataatcgcttccgcacctaggctcggaagccggagtcagtccctgagttccacagactcgtctgtgcacgccccgtccgaaattactgtagctcatggaagtggcttgggcaaagggcaagaatcccctctcaaaaaatctccgtctgccggcgacgtgcacattctcaccggatttgccaaaccaatggatatctactgtcaccgcttcgttcaggatgcccaaaataaggtgacacacctctcagaaacccggtcagttagccagcaggcgtcccaggagagaaatcagatgaccaatcaagtctccaatgaaacacaatccgagagcaccgagcagacgccttcccgcccgtcccagctggacgtgtcactctcagccaccggcccacagttcctgagtgttgaacccgcccattctgtggcgtcccagaagacacctacaagcgcatcatcgatgcttgaattggagaccggtttacatgtgacccccagcccctccgaatccagctcctcccgggccgtgagcccattcgctaagataagatcttccatggttcaagtggcaagtatcacccaggctgggctcacacatgggattaacttcgccgtatcaaaggtgcagaagtcgcccccggaacccgagattatcaatcaagtgcagcagaacgaacttaaaaaaatgttcatccagtgtcagacgcggataatacaaatctag

SEQ ID NO: 48103 - DNA, 372 bp, Artificial Sequence
  Description of Artificial Sequence: Synthetic coding sequence
atggagccccaggacctggagctggagctgtgcaagaagcaccactttggcattaataaacccgaaaaaattataccatctcctgatgactcgaagttccttctaaaaacttttacgcacataaaaagtaacgtctcagcccctaacaaaaagaaggtaaaagagtctaaagaaaaggaaaagctcgaaagacgccttcttgaagaattactcaagatgtttatggattccgaaagcttttactactctctgacgtacgacttaaccaactccgtacagcgacagagtacaggagaacgcgacggcagacctctgtggcaaaaagtccctctcactgctcgcagggccgggttcgccctgggcaaaaaatag

SEQ ID NO: 48104 - DNA, 1128 bp, Artificial Sequence
  Description of Artificial Sequence: Synthetic coding sequence
atggagctgttccaggccaaggaccactacatcctgcagcagggcgagcgggcactgtggtgctcccgtcgcgatggcggattgcaactccgccccgctaccgacctgttgctggcctggaatcccatttgcctgggacttgtcgagggagtgattgggaagatacagctgcacagcgatctcccatggtggctgatactgatcaggcagaaggccctcgtaggaaagctacccggagatcacgaagtttgtaaagtgactaagatcgcggtgttgtctctctccgaaatggagcctcaggacctggaactggaattatgcaagaagcaccactttggtatcaacaaaccagagaagataataccgtccccagacgactccaagttcctgctgaagactttcacacacattaaatcaaacgtctccgcgccaaacaagaagaaggttaaggagtccaaagagaaagaaaaactcgagaggcgccttcttgaagagcttttaaaaatgtttatggactcggaaagcttctactattctctgacctacgatttaactaatagcgttcagcggcagagtacaggggaacgcgatgggaggcctctatggcagaaagttgacgatcgatttttttggaacaaatatatgattcaggatcttacagaaatcgggaccccagacgtcgacttctggatcataccaatgattcagggctttgtccagatcgaagagctcgttgtcaactacacggaatcatcagatgacgaaaaaagctccccagagacgccgccacaggaatcgacttgcgtggacgatatccatcccagatttctagtcgctctgatcagtaggaggtccagacaccgggccggcatgcgctataagaggcggggcgtagacaaaaatggcaacgtggccaattacgtcgaaactgaacaactgatccatgtgcacaaccataccctgagtttcgtccagacacggggatccgttcctgttttctggtcacaggtcggttacagatataatccacggccccgcctcgaccgcagcgagaaagaaacagttgcctatttctgcgcacacttcgaagaacaacttaatatatacaaaaagcagcaacaaaaatag

SEQ ID NO: 48105 - DNA, 507 bp, Artificial Sequence
  Description of Artificial Sequence: Synthetic coding sequence
atgagcaagcggaagtggcggggcttccggggcgcccagcaggagcgagcccagccccctgcagcatcaccccagccctgccccgcacctcacgcagggctacccgggggatcccgccgccgggcacctgcgcccgcagggcaacaacagatgcgggcagaaagtcggtcgggggcccagagacgcagggggtcagccaggcggggcgcgcacagagaggccggcggttgcgtccgggggaggacccgctcttctggaagcgagaggtccaacgccctgtggcaggctgtcgatgccgccgaggccctagcactcagttccccgcttaggcgcccctgggatcaggctcagcattttacgaacccagcaccattctccaagggaccgcagtcagctcctcccagtcctcccgcggggcggagacggcggggtgcggacctggccctgaccccgctggcaggcgaagggcatacccggtggaggcaaccgggcagacccggcaaatag

SEQ ID NO: 48106 - DNA, 3129 bp, Artificial Sequence
  Description of Artificial Sequence: Synthetic coding sequence
atggagctgcagaagggcaagggcgccgccgccgccgccgccgccagcggggcagctggaggtggcggcgggggcgcgggagctggagcccccggcgggggtcgtctgctgctcagtacatccttagatgctaaggatgagctcgaagagagactggagcggtgcatgtccattgtaacaagcatgactgccggtgtgagcgagcgagaggctaatgatgccttaaacgcatatgtctgtaaaggcctgccacagcacgaagagatctgtttaggtttatttactctgatcctcacagagccagcgcaggctcagaagtgctacagagatctggctctggtcagccgtgacggaatgaatattgtgctaaacaagataaatcagatcctcatggaaaagtatcttaagttgcaggacacgtgtcggacacaactggtgtggctcgtacgcgagctcgtcaaatcaggcgtcctgggggccgatggggtgtgcatgacatttatgaaacagatcgccggcggcgacgttactgcaaaaaatatctggctggctgaatctgtactcgacatacttaccgaacagcgagagtgggtattaaagtcctccatcctgatagccatggcggtgtatacctacctccgcctgatcgtggatcatcacggcacagctcagctgcaggcccttcggcaaaaagaggtcgacttctgcatctcattgcttagggagcgctttatggaatgcctgatgattggccgggacctggtgagattactgcagaatgtggcaagaatccccgaatttgaactgctgtggaaagacatcattcataaccctcaggcactgagtccccagtttacaggcatcctgcagctactccagtccagaacttcaaggaaatttttagcctgcagactgactcccgatatggagactaagctgctctttatgacatcaagggtgagattcggacagcagaaacgataccaggactggttccagagacaatatctgtccaccccagactcacaaagcctcagatgtgacctgatcagatatatctgtggtgtggtccacccaagcaatgaggtactgagctccgatatcctgccaagatgggcaatcatcggatggttgctcacaacatgcaccagcaacgtggccgccagtaatgccaagctcgccctgttttacgattggttgttcttctctcctgataaagacagtattatgaatatcgagcctgctatcctggtcatgcaccacagcatgaagccgcaccccgccattacggcaaccctcctggacttcatgtgtcgcatcatacccaatttctaccctcctctggagggacatgtacggcagggagtgttttcttcccttaatcatattgtggagaaaagggtgctggcccacctggcacccttattcgacaacccgaaactcgataaagagctgagagccatgttgcgggagaaatttcccgaattctgcagcagtccttcccctccagtcgaggtaaagatcgaagagcctgtttcaatggagatggacaatcatatgagcgacaaggatgagtcatgctatgacaatgctgaagcagccttttcggacgacgaggaagatctcaacagtaagggcaagaaacgagaatttcggttccaccctatcaaggaaaccgtggtggaggagcctgttgacattactccgtatcttgaccagttagacgagagtttgagagataaggttctccagctccagaagggctccgatactgaagcacaatgcgaagtgatgcaggaaatagtggaccaggtgctcgaagaagacttcgattcggaacaactgtctgttctggcctcttgcctccaggagttattcaaagctcatttcaggggagaggtccttcccgaagagattacagaggagtctctcgaggaatccgttggaaagccactgtatttgatttttcgcaacttgtgccagatgcaggaggacaactccagcttttctctcttactcgacctgttgagtgaactctaccagaagcagcctaagattgggtaccaccttctatactacttgagggcaagcaaagctgccgccggtaaaatgaacctctacgaaagtttcgcccaagcaacgcagctaggcgatctgcatacttgtcttatgatggacatgaaggcatgccaagaggacgacgtaaggctgctgtgtcaccttacgccctcaatctacacagaatttcccgatgaaacattgagatcaggcgaattactgaacatgatcgtggcagttatcgactccgcccaacttcaggagcttgtttgccacgttatgatgggcaatctggtaatgttcaggaaagatagtgtgttgaacatcctgatccaaagcctggactgggagacctttgaacagtattgcgcctggcagcttttcctcgctcataacatacctctagaaacaatcatacctatactgcagcatctgaagtacaaagaacatcctgaagctctcagctgcttgctgctgcagcttcgccgggaaaagccatctgaggagatggtgaagatggtcttgagcaggccctgccacccagacgaccagttcacgacgtcaatcttgaggcactggtgcatgaagcatgatgagctgctcgctgaacatataaagtcactgctcattaagaataattctttaccgcgaaagcgccaaagcctgaggtcttcatccagcaagctcgctcaattgacgctcgagcagatcctagagcatttagataacttaaggctcaacctgaccaacaccaagcagaatttcttttcccagacaccaatcttgcaggctcttcagcacgtccaggccagctgcgacgaggctcataagatgaaattcagcgatcttttttctctggctgaggagtatgaagatagttctacaaagccccctaagagcaggaggaaggccgcgttgagcagccctaggtcccgcaaaaatgcaacacagccaccaaatgctgaagaggagtcggggtcgtcgtcagcaagtgaagaggaggacacgaagcccaaaccaactaaaaggaagcgaaaaggcagtagcgccgtcgggtccgacagtgattag

SEQ ID NO: 48107 - DNA, 1224 bp, Artificial Sequence
  Description of Artificial Sequence: Synthetic coding sequence
atggagagcgccatcaccctgtggcagttcctgctgcagctgctgctggaccagaagcatgaacacctgatctgttggacatccaacgatggcgagttcaaactccttaaggctgaggaggtggctaagttgtgggggttgcgaaaaaacaagaccaacatgaattacgacaagctgtcaagggcattaagatattactacgataagaatatcataaaaaaggtcatagggcagaaattcgtatacaagtttgtgtcatttcccgaaatcctgaaaatggacccccacgccgttgaaatttcccgcgaatccttgttgctccaggacagcgactgcaaagctagccccgagggcagagaggcacataaacatggactcgctgctttgaggtccacctcgcgaaacgaatacatccactcaggcctgtacagctccttcacgataaactctttgcagaacccaccagatgcatttaaagccattaaaacagagaaactggaagaaccaccagaagactccccccctgtggaagaagttaggactgtaattcgcttcgtgacaaacaaaacagataagcacgtaacacgcccggtggtttctcttccctccacatccgaggcagcagcggcctctgcttttttggctagcagtgttagcgcgaagatctcttccctcatgctgcctaacgcggcctcaatttccagcgcgagtccattttcatcacgcagcccaagtctgtctccgaattcaccactccctagcgagcataggtcccttttcttggaggcggcctgccatgatagtgactccttagagccgctgaatctgagtagcggctccaaaaccaagtcaccgtctctgccacctaaggccaaaaagcctaagggactggaaataagcgcccctcccctggtgctctctggcacggacatcggctccattgcattgaacagccccgccctcccaagcggctcactcacacccgccttctttaccgcacagactcctaatgggcttcttctcaccccatcacccctgctgtccagcatccacttctggtcttcacttagtccggttgctcccctgagccccgcacggctccagggacccagcactctgtttcagtttcccaccctgttaaatggacacatgcctgtgcccattcctagtttagatcgggcagcgagtcctgtgctcctgagttctaactctcagaaaagctag

SEQ ID NO: 48108 - DNA, 813 bp, Artificial Sequence
  Description of Artificial Sequence: Synthetic coding sequence
atgctggagggccaggtggacagcctgagcgtgaccctgggccccctgggcttgccagagcttatggtgtcacaaccagggtgcgcctatgcaatccttctgtgtacctggaaaaaagacacaggctccccacctgcctccgaggggcccaccgatggatcgcgtgaaacacccgctgccagggacgtggtcctccaccagacatctggaagaatccataacaagaacgtgagcacacatttaatcggaaacatcaaacagggacacggaactgagtcttcaggtagcggactgttcgctctgtgtaccctggatgggactctcaaactaatggaagagatggaagaagctgataagctcctctggtcggtacaagtggatcaccaacttttcgctctggagaaactggatgttacagggaacggacatgaagaggtggtcgcctgtgcctgggacggccagacttacatcatagatcacaatagaacagtggtgcgatttcaagtagatgagaatataagggcattctgtgctggtctttacgcttgtaaggagggcaggaactcaccctgcctagtgtacgtcacattcaaccagaaaatctacgtctactgggaggtacagcttgagcggatggagtcaacaaacctcgttaagctgctcgagacaaagccagagtatcactccctgttgcaggagcttggcgtggaccctgatgacctccccgttacaagagcactccttcaccaaaccctgtatcaccctgatcaaccgccacagtgcgcaccaagtagcctccaggacccgacttag

SEQ ID NO: 48109 - DNA, 1008 bp, Artificial Sequence
  Description of Artificial Sequence: Synthetic coding sequence
atgcccaccttcgccggcagccaggagagccggagccagtggatcttagagcacatcccacgcgactgggacggagatgggtgccgagagctggtcgtgggatacacagaccgggttgtgcgtgcctttagatgggaggagctgggggagggtccagaacatcttacaggccagctggtgtccctgaagaagtggatgctcgaaggccaggtcgactccctcagtgtaactctcggacctctggggttgccggagctcatggtgagtcagcccggctgcgcttacgcaatcctcctgtgtacatggaagaaggatacaggctcccccccggcctccgaggggccaactgatgggtcgcgggagaccccagcagctcgcgacgtcgtgctccaccagacaagtggacggattcacaacaagaacgtctccacacacctcatcggtaacattaagcagggccacggcactgagtcgagcgggagtggtttgtttgcgttgtgcacccttgatggcactttgaagctcatggaagagatggaggaggccgacaagctcctgtggagtgtccaggtggaccatcagttgtttgccctagaaaagttggatgtgaccggcaatggtcacgaggaggtagtggcatgcgcatgggatggtcagacgtatatcattgaccataacagaactgtagtgcgcttccaggtcgacgagaatatcagggccttctgcgccgggctctatgcatgtaaggagggcaggaacagtccttgcctcgtttatgttacattcaaccagaaaatctacgtttactgggaagtacagcttgagcggatggaatccacgaacctcgttaagcttttggagacaaagcccgagtaccactcactgttacaggagttgggagtggatccggacgacttgcctgttacccgagctttacttcaccagactctctaccacccagaccaaccaccccaatgcgcccctagcagcctgcaagaccctacatag

SEQ ID NO: 48110 - DNA, 693 bp, Artificial Sequence
  Description of Artificial Sequence: Synthetic coding sequence
atgaagctgatcgtgggcatcggcggcatgaccaacggcggcaagacaacacttaccaattccctcttgagagctctgcctaactgctgcgtgatacaccaggacgacttttttaaaccacaggaccaaatagcagtgggggaggatgggtttaaacagtgggatgtgcttgaaagtctcgacatggaagctatgttagacacagtacaggcctggctctctagcccacagaagttcgccagagcacacggcgttagcgttcaacctgaagcgagtgacacccacatcctgctactggaggggtttcttctttattcctacaaaccactcgtggacttatacagtcggcgttattttctgacggtgccatacgaagaatgtaaatggcgtcgatctacgcgtaattataccgtgccagatcctccaggcctattcgacggacatgtttggcctatgtatcagaagtaccggcaagagatggaagccaatggagtcgaggttgtgtacctggacggcatgaaaagtcgcgaagagctattcagagaggtgctagaggacatacagaatagtctcttgaatcgatcccaggaaagcgcacccagtccggctagaccagctcgcactcagggtccgggccgaggatgcgggcacaggacagctagaccagcagcttctcaacaggactccatgtag

SEQ ID NO: 48111 - DNA, 561 bp, Artificial Sequence
  Description of Artificial Sequence: Synthetic coding sequence
atgaagctgatcgtgggcatcggcggcatgaccaacggcggcaagactacgttgaccaattcgctgttgcgggctctacccaactgctgtgtcattcaccaggacgacttttttaaaccacaggatcagatcgccgttggtgaggatgggtttaaacaatgggacgttctcgagtccctcgacatggaggctatgttggatactgtccaagcatggctgagttctccacagaagttcgcccgagctcatggggtctccgtccaacctgaggcctccgacactcacattcttctgctagagggattccttctgtacagttacaaataccaaaaatataggcaggagatggaggctaatggcgtcgaagtggtgtatctcgacggaatgaagtcccgcgaggaattgtttcgggaagtgctggaagacattcagaattccctcctcaatcgaagtcaggaaagtgctccatcacccgcccgccccgccagaacacagggaccagggagaggatgcggtcataggaccgcccgccccgcggcatcacagcaagacagcatgtag

SEQ ID NO: 48112 - DNA, 1425 bp, Artificial Sequence
  Description of Artificial Sequence: Synthetic coding sequence
atgagcgaggagagcgacggcaagctgatcgaggacagcctgatccagctgcgatgccacttcacttggaaacttttgatagaggcacctgaaattcccgacttggagaataggatctgggaagagatacagttcctagacactaagtacaacgttgggattcacaaccttctcgcatacgtgaagcaccttaagggtcagaatgaggaggctctggtgtcgctgaagaaagcagaggacctgatccagaaggagcacgccaaccaagccgacattagatcactggtgacctggggtaacttcgcctgggtgtattaccatatgggccgcctcgcagaggcacagacctacctggataaagtcgaaaacacgtgcaaaaagttcgcaaacccgtcacggtacagaatggagtgtcccgaagtagactgcgaggaaggctgggcgcttgccaaatgcggtggtaaaaactatgaacgggccaaaacatgcttcgagaaggctctggaaggcaatcccgagaaccctgagtttaacacgggctacgccatcaccgtgtatcggcttgacaagttcaataccgccagcggtagaaataaagctttcagcctgcacgtgcttaagagagcagtgcgtttaaatccagacgatgtgtatatccgggtcctgcttgccctgaagctgcaggacgaaggacaggaagccgaaggggaaaagtacatcgaagaggcccttaccagcatcagctcccaagcttatgttttccaatatgccgccaaattttaccggaggaaaggcagtgttgataaggcactggagctgttgaaaatggcgctggagacgacccccacaagtgcctttcttcatcaccagatgggactatgttatagagcacagatgatccaaatcaaggaagccacaaactggcagcccagaggacaggatcgtgaaaccgtcgataggttggtccagctggccatctgtaagttcgagaagacaatcatgctgaaaaggacttttgagatggcgtacgtggatctggcagagacgtacgccgagataggtcatcacaggaaggcagaggagcactttcagaaggggctacggatgaaaattttcgaagatcagcttaaacaggaaatacattatcattatggccggtttcaggagcaccacggtaaaagccaggataaagcgattacgcactacctgaaagggctgaaaatcgagaaaatgagccatagcagggaaaagttgttgaacgccctggagaaactggccaagaggtgtatacaccaaaatgttcgggttgtcgagagtgtgagcttgctcggtctgatacacaaattaaaaggtgaggtgtcagatgctctcctgtgctacgaacgggcactccgccttgccgctgacctgaaccccatcttttag

SEQ ID NO: 48113 - DNA, 1449 bp, Artificial Sequence
  Description of Artificial Sequence: Synthetic coding sequence
atgagcgagatccggaaggacaccctgaaggccatcctgctggagttggaatgtcactttacgtggaacctgctgaaggaggatatcgaccttttcgaggtagaggacaccatcggacagcagttggagttcctgaccaccaaaagtaggcttgccctttataatcttctcgcctacgtgaagcacctgaaggggcaaaacaaggatgcactggagtgcctggagcaggccgaggagataattcagcaggagcattctgataaggaagaagtgcggtctcttgtcacttggggtaactatgcttgggtgtattatcatatggatcagctggaggaggcacagaaatatacggggaaaattggcaacgtgtgtaaaaaactgagttccccctcaaattacaagctggaatgccccgagaccgattgtgaaaagggctgggccctcctgaagttcggtggaaagtactatcagaaggccaaggcagctttcgagaaggcactcgaggtggagcctgataaccccgaattcaatatcgggtacgctatcaccgtgtaccggttagatgatagcgacagggaggggtcagttaagtccttcagcctggggcctctgagaaaggctgtcacactcaatccagacaattcatacattaaggtgttcttggctttgaagcttcaggatgtacacgcagaggccgaaggcgagaaatatatagaggaaatcctggaccagatttcaagtcaaccgtacgtgctgcgttatgcagccaagttttatagaagaaagaattcctggaacaaggccttagagctcttaaagaaggccttggaagtcacacccacgtcttccttcttgcatcatcagatgggcttatgctatagagcgcagatgatacagattaagaaggcaacgcacaatcgcccaaaagggaaagataagttgaaggttgatgaattgatttcaagtgcaatatttcatttcaaagccgcgatggaaagggacagcatgtttgcctttgcatacacagatctcgccaatatgtatgcggagggcggccagtattctaacgcggaggacatcttccgaaaggcactccgactcgaaaatatcaccgacgaccataagcatcagatccattatcattacgggagatttcaagaattccatcgcaagtctgagaataccgccatacaccattacttggaggcactgaaggtcaaggatcgctccccacttcgcacaaaactgacatctgcactaaaaaagctgagcacaaaaagattgtgtcataacgctcttgatgtgcaaagcctctccgctctgggctttgtttataagctcgaaggcgagaaacgtcaggctgccgaatattacgaaaaggcccagaagatagatcccgagaatgcagagttcctgacagccttgtgtgagctacgcttaagtatatag

SEQ ID NO: 48114 - DNA, 1305 bp, Artificial Sequence
  Description of Artificial Sequence: Synthetic coding sequence
atgagcgagatccggaaggacaccctgaaggccatcctgctggagctcgagtgtcactttacatggaacctcttaaaggaggatatcgacctgttcgaggtggaggacacaatcggccagcaacttgagtttctcacgaccaaatcacgtctggcattatacaatttgctggcgtacgtgaagcaccttaagggccagaataaggacgcgcttgagtgcctggagcaagctgaagagatcattcaacaggagcactccgacaaagaggaagtccgcagcttagtgacctggggcaactacgcctgggtttactatcatatggaccagttggaggaagcccagaagtataccggcaaaatcgggaacgtttgcaaaaaactatcctcaccaagtaattacaagctggagtgcccagaaacggattgcgagaaagggtgggcattattgaaatttggagggaaatactaccagaaagcggtcacactgaaccctgataacagttacattaaggtgtttctcgctcttaagctccaggacgttcatgctgaggcagaaggggaaaaatacattgaggagatcctggaccaaatttcctctcagccttacgtgctccggtacgctgcaaaattctacaggagaaagaactcatggaacaaggccctggagctgctgaagaaggcgctggaagtcaccccaactagttccttccttcaccatcaaatgggtctgtgttatcgggcgcagatgattcagattaaaaaggctacacacaataggccaaaaggtaaagataagctcaaggtcgatgaactcattagttctgcaattttccactttaaggctgctatggagcgggactccatgttcgcctttgcctacacagacttggctaacatgtatgcggaaggcggtcaatatagcaatgctgaagatatcttcaggaaagcattaaggctggagaacatcaccgatgatcacaagcaccagatccactaccattacggccgattccaggagtttcaccggaagtctgagaacacagccatccatcactatcttgaagctttaaaggtgaaggacaggtccccactccggaccaaactaacatcagcactgaagaagcttagtaccaagagactatgccataacgctcttgatgttcagagcctttcagcgctcggatttgtctataagcttgagggcgagaagagacaggcagcagagtattatgagaaggcccagaaaattgatcctgaaaatgctgagtttctgaccgcactgtgcgaactaaggctcagcatttag

SEQ ID NO: 48115 - DNA, 2061 bp, Artificial Sequence
  Description of Artificial Sequence: Synthetic coding sequence
atgaagccccccttcctgctggccctggtggtgtgcagcgtggtgtcaaccaacctgaagatggtgtctaaacgtaactccgtggatggctgcatagactggtctgtagaccttaagacatatatggctcttgccggggaaccggttcgggttaaatgtgcactgttttacagttatatccgcacgaattatagcacggcacagagtaccggtctgcggctgatgtggtataaaaataagggggatctagaggaaccaattatcttttcggaagtacgaatgagtaaagaagaggactccatctggttccatagtgctgaagcccaggatagcggattctatacgtgtgtgctccgaaattcaacatattgtatgaaagtttccatgagtctcactgttgcggagaacgaaagcgggctctgttataatagtaggattagatatctcgaaaagagcgaggtgactaagaggaaggagatcagctgccctgatatggatgactttaaaaaaagcgaccaggagcctgacgtggtttggtacaaggaatgtaagcccaaaatgtggagaagtattattatacagaagggaaacgctctgttgatccaggaggtgcaagaagaggacggaggaaattacacatgcgaattaaagtacgagggaaagctagttcgcagaaccacagagctcaaggtgactgcactcttaaccgacaagccgcctaagccactgttcccaatggagaaccagccgtccgtgatcgatgtacaactgggcaaacctcttaacattccttgtaaggcattctttggtttcagcggcgagagcggcccgatgatctactggatgaagggcgaaaagtttattgaagagctggcagggcacatcagagaaggagagattcgtcttcttaaagaacatttaggagagaaagaagttgaacttgcgctgattttcgattcagttgtggaggcggatcttgcgaattacacttgccacgttgagaacagaaatggacgcaaacacgcctcggtcctgttgagaaaaaaagacttgatttacaagatcgagctggccggcggtctcggcgctatcttcctgcttctagtgctgctggtcgtgatttacaagtgttacaacatcgagctcatgttgttctatcgccagcatttcggagcagatgaaactaacgacgacaacaaagaatatgatgcttacttgtcctatactaaagttgatcaagacacactagattgtgataaccccgaagaggagcagtttgctttggaggtgttgcccgacgtgctggagaaacattacggctataaacttttcatcccggagcgcgatttaattccatccggaacctatatggaagacctcacaagatatgtggagcagtcccgccgactcatcattgtactgactcctgattatatccttcgacggggttggagtattttcgaactagaaagcaggttgcacaatatgctggtgtctggcgaaataaaagtgatcttgattgagtgtactgaactaaagggcaaggtgaactgccaggaagttgagtcccttaagagatcgattaagcttctgagcttaatcaagtggaaaggcagtaagagctcaaaactgaactccaagttctggaaacacctggtctacgagatgccaattaagaaaaaagagatgctgcccaggtgccacgtgctggattctgcagagcaggggttgttcggggaactgcaacccattccatctattgcgatgacatctacctcggctacactcgtttcttcacaggctgatttgccagagttccatccatctgattcaatgcagattagacactgttgccgaggatataagcacgaaatacccgccacaacgctcccagtcccatccttagggaaccaccacacttattgcaatctccctctgaccctgctgaatggccaattacctcttaataacactttaaaggatacacaggagttccaccgtaattcaagtttgcttccattatcatccaaagagctgtccttcacttcagacatttggtag

SEQ ID NO: 48116 - DNA, 1143 bp, Artificial Sequence
  Description of Artificial Sequence: Synthetic coding sequence
atggccttcgtgtgcctggccatcggctgcctgtacaccttcctgatttcaactacatttggatgtaccagtagttctgatacagaaattaaagtgaacccccctcaggatttcgagatcgtggatcccgggtacttagggtatttgtatcttcagtggcaaccccctttaagtctggaccatttcaaggagtgcaccgtagaatatgaattaaagtataggaacattgggtcagaaacttggaaaaccattataaccaagaatcttcactacaaggacgggttcgacctcaacaaaggaattgaggccaagatacacacgctcctcccatggcagtgtacaaacgggagcgaggtacagtcctcgtgggcggagacaacttactggatctcaccccaaggtatcccagagacaaaggtgcaggacatggactgtgtgtactataattggcaatacctcctttgctcctggaaacccggtatcggcgtcctcctcgataccaattataatttattttattggtacgaggggctggaccacgcgctgcagtgtgtggattatatcaaagctgacggccaaaatattggatgtaggttcccctacctagaggccagtgactacaaagatttctacatctgcgtgaatggtagctcggagaataaaccgatcagaagctcttattttaccttccagcttcagaacatagtaaaacccctgcctccagtgtatctcactttcacacgggaaagtagttgcgaaatcaaattgaagtggtctatccccctcggtcctattcccgctcgatgttttgattacgagattgaaataagggaggacgacactactctggtgaccgcaaccgtggagaacgagacctacacattgaagaccactaacgaaactcggcagctctgctttgtggtgagatctaaagtgaatatctattgctccgacgatggaatctggagcgagtggtctgataaacagtgttgggagggcgaagatctttccaagaaaacccttctgcggttttggttgccctttggattcattctcatattagtgatcttcgttactggtttactgctcaggaagccaaacacgtaccccaagatgatccctgaattcttttgtgatacctag

SEQ ID NO: 48117 - DNA, 1011 bp, Artificial Sequence
  Description of Artificial Sequence: Synthetic coding sequence
atgagccggagcgtgctggaggccctgaccagcagcaccgccatgcaatgcgtgccttctgatggctgcgccatgctgctacgcgtgcgtgcgtccattactctccacgagcggctgcgaggactggaggcatgcgccatgagtcttgatacccaggagactcagtgtcagagtgtgtgggtggcgagagcatctcacaggcaacagggaggccagcaacttcaggtgcacttcggctgttttgccgtatcagtggcacaacatctctatgtgaccctgagaaccatcccgcacttttgcggcgttcaactagatcagcggcacctcgtagaggctggcaaattgtcatactgggtggacagaaggcggaaagctatactggtgcaagtaccccgcgcctcaggctcccccgactactacctgcgcttatgtttaaaacgtttcacttgcgaggacgctggggccccagtgagagtgaccgctaatagcgtcagtcaggcggtgttcctgccctactctcaggaacttccatgcttatgcctcgagggctggtcggccaccccggatgctgtgcggattcagatatgtcctttcgagaatgatactgaggcactggaggtcctctgggacaccgtctattatcacccggagtcacaaaccctgtcctgggagccagcatgccccgtgagcggccatgttagtctttgctggagacccggcccaggagctgggtgtaggaaactgcagcaatcttcgcagctggtccataggcgggtccagtacccactcgtagacactcagccacagctttgtctgaaattttccacaagctggggatcatgggtcaggtgtccatttgaacaacggaggttccctactccacctacctctcggtgcacctgtgtcactgggggcagccatagcagcctgcccgccaacgcccactctagacccgcccgttcccttcagccgcaggtcacttggcaaccaccacttctgctcccatcctag

SEQ ID NO: 48118 - DNA, 1011 bp, Artificial Sequence
  Description of Artificial Sequence: Synthetic coding sequence
atgagccggagcgtgctggaggccctgaccagcagcaccgccatgcagtgtgtgccttctgacggatgtgcaatgcttctgagggtccgggcatcaatcactctccatgaacggctgaggggcttggaggcctgtgcaatgagtctggacactcaggaaacacagtgtcagagcgtgtgggtggcccgagcttcacatcggcaacagggagggcagcagctgcaggtccattttggttgttttgcagtttccgttgctcagcacttatacgttaccctgaggacgattccccacttctgtggcgtgcaacttgaccaaagacacctggtagaggcagggaaactgtcctactgggtggaccgacggcggaaggccattctcgtccaagtgccccgtgcctcaggctcgcctgactactaccttcgtctgtgtctcaagagatttacgtgcgaggacgctggagcccctgtaagggtgacagccaatagcgtgagccaagccgtattcttgccatatagccaagaactcccatgcctctgcctggaaggctggtcggccactcccgatgcggtgcgaatccagatttgtccctttgaaaatgacacagaggccctggaggtcctctgggacactgtgtactaccaccctgagtcccagacgctgagttgggaaccagcgtgcccagttagcggccatgtatccctgtgctggcgccctggtccgggcgctgggtgtcggaagctccaacaaagtagtcagctagtccatcgccgcgtccagtatccactcgttgatacccaaccccagttatgtctgaagttctccacttcttggggcagttgggtccgttgtccattcgagcaacgccgatttcctacaccacctacaagtcggtgtacttgtgttacgggcggttcgcactcctcccttccagcaaacgcacattctcggccagctcgatccctccaaccccaggtcacatggcagcctccactattactgcccagctag

SEQ ID NO: 48119 - DNA, 471 bp, Artificial Sequence
  Description of Artificial Sequence: Synthetic coding sequence
atgcggggcggcggcggcgtgcccctgatccacttcagcctgcccgtgtgctctccatttctgtatctgagtttacccgaaccccaagctaaacaccagcgtagaccaggatctgaacagggggctcatgtcgcttccgtggaccatcctcccgcatgtactgcattgggtggaccccgcaatgcgagaccgtcagccggggggtcactttttacttccctccagccctcagaagacacctccgagtggggtgccgagcccgcagacggggagaataaaaacgatgatactctctacacacctgacgatttgagtattcctgggcactttgttcccactgtgtgtcctgccgagacccttggttgtagtcgacttgaactgagtgtcatcgggttcgaagaaggacccagcatggggacagcagtgttccaactgcagtacctcctggacctgctaggcagtagattgtag

SEQ ID NO: 48120 - DNA, 1386 bp, Artificial Sequence
  Description of Artificial Sequence: Synthetic coding sequence
atggccctggccttcggctgcccccccggcggcggcggcggcggctgtccaggaggtggaggcggcggcggcggggccggccccggacccagtcctgtgactgcggccctgcgggatgatttagggtccaatattcacctgctgaagggactgaacgtgagatttcggtgctttctggccaaggttcatgagctggaaaggcgcaatagactactggaaaagcagctggaacagcagcagagcgaacgtgagagacgcctgcggtataagaccttttctcgggagcaggccgtccagactggaccagaacttttgaggcctccagctcccggtggtggccatggcctctctagcggagcagctgccggtgctaacgccaatgctgtcgcacttggagggctgccacccggggggggctcacaccctcaacactacggacgtctccccgggactatctggagttacacccaagtacgacgcaccggcggaggtggcgtggagaccgtgcaggggccaggtgtgtcatgggttcatccagacggtgtcggtgttcagatagataccataaccccggaaatccgggccctctataacgtgcttgccaaagtgaagcgcgaacgagatgagtacaaaagacggtgggaggaggaactggcaaaacgaatgaatctgcagacaatggtagacaccctgcaagaagccgcgcaggaggcggacgcaattcaggaagagatgaacgaaaagatcgagcggcttaaagcagagctcgtggtgtttaagggtctaatgagcgatgtcgtcccgaaaaagaaggaacgcaaagtggccagcgatgatgatataagcgaacaggatggggaggtgaatagattttcagacgacgaggtaggttccatgaatattacagatgaaatgaagcgcatgtttaaccaactgcgcgagacgtttgacttcgacgacgattgtgattccttgacttgggaggagaatgaggatacactgttgctctgggaagacttcacaaactgtaatcccaccattgacctacagggtgagcaagaggagaatctggggaatttgatacatgaaactgagagctttttcaaaaccagagacaaagaatatcaggagacgattggccagatcgagctggagttagctacagccaagagcgacatgaacaggcacttgcacgagtacatggagatgtgcagcatgaaacggggccttgacgttcagatggagacttgtcgccgattgattaaaggatccgccgaccgaaactctccatccccttcatctgtggcgtctagtgattctggtagcacagacgaaatccaagacgaatttgaaagggaggccgatgtcgagcccatggtttcatag

SEQ ID NO: 48121 - DNA, 1554 bp, Artificial Sequence
  Description of Artificial Sequence: Synthetic coding sequence
atggtgaacagcctgctgttcggcgagatggccctggccttcggctgccccccaggaggcggtggtggcggctgcccaggcggtggcggaggcgggggtggagccgggcctggaccatctccggtgaccgcagcactgagggacgacctgggcagcaacatccatctgcttaaaggtctgaacgtaagatttcggtgcttcttggctaaggtccacgaactggagcggcggaaccgcctgctggaaaaacaacttgaacagcagcagtctgaacgggaacgcaggttaagatacaagactttttcaagggaacaagcggtacagaccggccccgaactccttagaccaccagcaccaggggggggccatgggttgagcagtggcgcggccgcaggcgccaatgcaaatgccgtggccctgggaggactcccccctggcggcgggtcccacccccaacattatgggcgccttccgggtaccatctggagctatactcaagtgagacgaacagggggcggcggagtcgagacagttcagggacccggcgtgagctgggtgcaccctgacggcgtgggcgtccagattgacaccatcacacccgaaatacgagctctctataacgtcctggccaaggtcaagcgggagagggacgagtacaagagaaggtgggaagaagagttagccaagcggatgaacttgcagactatggtggacacactccaagaggcagcccaggaagctgatgcgatccaagaggaaatgaacgaaaaaattgaacggctcaaagctgaattagttgttttcaagggcctaatgagtgaccccatgactgatctcgacaccaagattcaggagaaggctatgaaggtggatatggatatctgccgccgcatagatatcaccgcaaaactgtgcgatgtcgcacagcaacgtaatagcgaagacgtcagcaaaatattccaggtggtgcctaaaaaaaaggaacggaaagtagcaagcgatgatgatatctccgagcaggatggagaagtgaaccggttctccgatgacgaagttggttccatgaacattacagacgagatgaagcgcatgttcaatcagctgcgggagacatttgactttgatgatgattgtgactccctgacctgggaagagaatgaggataccttactcctgtgggaagatttcacaaattgcaatcccaccatcgatctccagggagaacaggaggaaaacctgggcaaccttattcatgagacagaaagcttcttcaagaccagggacaaggaataccaggagactatcggacagattgagcttgagttggccacagctaagtcagacatgaatcggcacctacacgagtatatggaaatgtgctccatgaaaaggggattggatgtgcagatggagacttgcaggaggttgataaaagggagcgccgatcggaacagtccatccccttcaagtgtggcatcatccgacagtggaagtactgatgagatacaggacgaattcgaacgggaggccgatgtggagcctatggtgagttag

SEQ ID NO: 48122 - DNA, 1971 bp, Artificial Sequence
  Description of Artificial Sequence: Synthetic coding sequence
atggcccggatgtgcgtgaagacccagcggctggacgtggccaaggtatgcctgggaaatatggggcatgctcgaggggcacgtgccctccgagaggcggagcaagaaccagagttggaagctcgtgtagccgtgctagccacacagctcggaatgctcgaggatgccgaacagttgtaccgaaagtgcaaacgacatgatctccttaataagttctatcaggccgccggtcgatggcaggaagccctgcaggtcgcggaacatcatgatagggtacacttaaggagcacatatcatcgatacgccggccatctagaggcttccgccgattgtagccgggccctgtcttactacgaaaaaagcgacacccaccggtttgaggtccctcgaatgctctccgaggatcttccctccctagaactatacgtgaacaaaatgaaggataagaccctctggcggtggtgggcacaatatctcgaatcacaaggtgagatggacgctgcactgcattactacgagctcgcccgggaccacttttcactggtgcgtatccactgctttcaggggaacgttcagaaggctgctcagattgcgaacgaaacaggtaatcttgcggcctcttatcacctggcgcgacagtacgaaagccaagaggaggtaggtcaagccgtccacttttacacgcgggctcaggcctttaaaaacgccattagactatgtaaagagaacggcctggatgaccagctgatgaacctggctcttctctcgagtccggaagacatgattgaagctgctcgctactacgaagaaaagggcgtgcaaatggacagggcagtcatgctctatcacaaagctgggcacttttcaaaagctctggagctcgccttcgccacgcaacagtttgtggccctgcagcttatcgctgaggatctagatgaaacctcagatcccgccttgctcgcacggtgtagcgattttttcattgaacacagccagtacgaacgcgcagtggaactcctccttgcagcccgcaagtatcaagaggccctccaactttgcctgggccagaatatgagcataacagaggagatggctgagaagatgacagtggccaaggactcatccgacctacccgaagagagtagaagagaactcctggagcaaatcgcagattgctgtatgcggcaggggtcataccaccttgcaacgaagaaatatacccaggccggaaataagctgaaggcaatgagagccttgctcaagagcggagatacagagaagatcacttttttcgcgagtgtatcaagacagaaggagatttacattatggctgcaaattacctgcagagtctggactggagaaaggagcctgaaatcatgaaaaatataatcggcttctatacaaaaggacgtgctctggatctattagctggtttttatgatgcctgcgcacaggtggagattgatgagtatcagaactatgacaaggcacatggagccctgaccgaggcctataagtgtctcgcaaaggccaaggccaaatcgccccttgaccaggagacaagacttgcccagctgcaatcccggatggccctagtcaaaaggttcatacaggcccggcgtacatacaccgaagatcccaaagagtcaattaagcaatgtgagctcctcttggaggagccagacttggattccacgatcaggatcggagatgtgtatggctttcttgtcgagcattatgtacggaaggaggaatatcagaccgcgtatagattcctggaggaaatgcggcggaggctgcctctggctaatatgagttactatgtaagccctcaggcagtagatgccgtgcaccgaggcctgggcctgcccctccctcggaccgttccagaacaggtaagacataactcaatggaggacgcacgagaactcgacgaggaggtggttgaggaggccgacgacgacccctag

SEQ ID NO: 48123 - DNA, 4389 bp, Artificial Sequence
  Description of Artificial Sequence: Synthetic coding sequence
atggccctgtactacgaccaccagatcgaggcccccgacgccgccggtagcccaagctttatctcctggcatcctgttcacccgttcctagcagtcgcatacattagcactaccagcaccggatctgtggacatttatcttgaacaaggggaatgtgtcccggatacccacgtagagcgaccattccgggtggccagcctgtgttggcaccctacacgacttgtcctggccgtggggtgggaaaccggcgaagtcactgtcttcaacaagcaagacaaggagcagcatacaatgcctctcacgcataccgccgacattaccgtattgcggtggtccccatcaggcaactgtctattatccggtgatcgacttggcgtgcttctgttgtggcgtctggaccagaggggaagagttcagggtactcccctactcaaacacgagtatgggaagcacctgactcattgtatttttaggctgcccccaccaggcgaggatctcgtgcaattggctaaagccgccgtcagtggagatgagaaagcgttggacatgtttaactggaaaaaatcctcttccggaagcttgctgaagatgggcagtcatgagggcctgcttttctttgtgtccctgatggatggtacagtgcactatgtcgatgaaaaaggtaagacaacacaggtcgtgagcgcagactctacaatccagatgctcttttatatggaaaaaagagaagcactggtggtagtaaccgaaaacctgcgtttgtcgctgtacacagtgccgcctgagggcaaggcggaggaagtaatgaaggtaaaattaagtggcaaaacaggacgccgggctgacattgcattgattgagggcagcctgttggtcatggcagtaggcgaggctgccctgagattttgggacatcgagcggggagaaaattacattctgagtcccgacgagaagtttggcttcgaaaaaggagagaacatgaactgtgtgtgctactgcaaggttaagggtttattggctgccgggaccgatcgaggcagggtcgcgatgtggcggaaggtgcccgatttcctcggcagccccggagctgagggcaaggaccggtgggcgctgcagaccccaaccgagctccaaggaaacattacccaaatccagtggggatcacgcaagaacctgttggcagtcaattcggtcatcagcgtcgccattctgtcagagagagctatgtccagccattttcaccaacaggtagcagctatgcaggtctcaccgagtctgctcaatgtctgctttctttccacaggggttgctcactcactgcggaccgatatgcatatcagtggagtctttgccacaaaggatgcggtcgccgtctggaacggaagacaggtggccatctttgagttatctggcgctgccatccgcagcgctgggacttttctctgcgaaacaccagttttagccatgcatgaggaaaacgtctacacagtggaaagcaacagagtacaagtgaggacttggcagggaacagtcaaacagctgttgttgttcagcgaaacagaaggcaacccatgttttctggacatttgtggtaatttcctggtggtgggcacggatctcgctcacttcaagagttttgatctctcccggagagaggccaaagcgcactgttcgtgccgcagcctcgctgagttggtgcctggcgtcgggggcattgcaagcctccggtgttcatctagcggttctacaatcagcatccttccgtccaaagccgacaactctcccgattcaaaaatatgtttctacgacgtggagatggataccgtaaccgtttttgacttcaagaccggccagattgacaggcgggagactttgagctttaacgaacaggagacgaacaagagccacctttttgtggatgaaggcctcaagaactacgtaccagtaaaccatttttgggaccagtcagagcctcggctgttcgtgtgcgaggccgtgcaagaaacgccccgctcccagccacagagcgctaatgggcagccccaggacggccgcgctggtccagcagcagacgttctgatactgtccttttttatttccgaggagcatgggtttctgcttcatgagtcctttccaagacctgcaacaagtcactccctcctgggcatggaagtgccatattactattttacgcgcaaacctgaagaggcagatagggaggacgaagttgagcctggctgccaccacatacctcagatggtttctagacggccgctgcgcgatttcgtcggacttgaagactgtgacaaagccacacgggatgcaatgctgcacttttcattttttgtgacaattggcgatatggatgaagcttttaagtctatcaaacttattaagagcgaggccgtatgggagaacatggcaagaatgtgtgtcaaaacacaacggttagacgtggccaaggtgtgcctcggcaatatggggcacgcgcgtggcgctcgagcactgcgcgaggcagaacaggaaccagaactcgaggcgagagtggctgtgctggctacccaactgggtatgctcgaggatgcagagcagctctacaggaaatgcaaacgtcatgatctgctcaataaattttatcaggccgccggtagatggcaggaagccctccaagtggcagaacaccacgacagggtgcatttgagaagcacttatcatagatatgcgggccacctggaggcctctgcagactgcagtcgtgctctctcttattacgaaaaatctgacacccataggttcgaggtgccacggatgctatctgaggatctgccgtccctggagctgtacgtgaacaaaatgaaagacaaaaccctctggaggtggtgggctcagtacttggagagtcagggcgagatggatgccgcgctccactactacgagctcgccagagaccactttagtttggtgcgcatccactgtttccagggaaacgtccaaaaggctgcacagattgccaacgagaccgggaatctggctgcgtcttaccatctggcccgccagtacgagtcccaggaggaggtaggccaagcggtgcacttctacactcgcgcccaggcttttaagaatgccataagactatgcaaagagaacggcctggacgatcagctgatgaacctggctctgctgagtagcccggaagacatgatcgaagccgctcggtattacgaggagaagggcgtgcaaatggacagggccgttatgctgtaccataaggcagggcacttctccaaggccttggagctggcctttgcaacgcagcaatttgttgctctacagctcattgccgaagatcttgatgagacatccgaccccgccttgctagccaggtgtagcgatttttttattgaacactcccagtatgagcgagccgttgagctcttgctcgcagccagaaagtaccaggaagcattgcagctgtgtcttggccagaacatgtcgatcaccgaggaaatggcagagaagatgaccgtggccaaagattcttccgacttgccggaggagagccggcgggagctgctcgaacaaatcgccgattgttgtatgaggcaggggtcctatcatctggcaacgaagaagtacacccaggccggcaataagctgaaggcaatgagggccctcctaaagagcggagacaccgaaaaaatcaccttctttgcatccgtgagtcgccagaaagagatttacattatggcggcgaactacttacaaagcctggactggcgaaaggagccagagatcatgaaaaatattattggtttttacactaaaggaagggccctcgatctgctggcggggttctatgacgcctgcgcccaagtggagatagatgaataccagaattacgacaaggcccatggggccctcactgaggcatataagtgtctcgccaaagctaaggccaagtccccactggaccaggagaccagactggcccagctgcagagtcgcatggccctcgtcaaacgatttatacaggcccgacgtacctacacagaagatcctaaggagtcaatcaaacagtgtgagctcctgctggaggaacccgacctcgattccactatcagaatcggggacgtatatggcttcctggtggagcattatgtgcgcaaggaggagtatcagaccgcctatcggtttctggaagagatgagacgcagactgcctcttgctaatatgagctactatgtatctccccaggcggtcgacgccgtccaccgggggctgggtttacccctacctcggacggttccagagcaggtgaggcacaatagcatggaagacgctcgagaattggacgaagaagtggtggaggaggccgatgacgacccatag

SEQ ID NO: 48124 - DNA, 4389 bp, Artificial Sequence
  Description of Artificial Sequence: Synthetic coding sequence
atggccctgtactacgaccaccagatcgaggcccccgacgccgccgggtccccgtcctttatttcatggcatcccgttcatccattcctcgcggttgcttatatcagcaccacctcaacgggttccgtcgatatctacctggagcagggtgagtgcgtgcccgatactcatgtagaaagacccttcagggtggcatctctgtgctggcatcctacccggttggtgctggccgtggggtgggagaccggggaggtgactgtgttcaacaaacaagacaaagagcagcacactatgcccctgacccataccgccgacataactgtgttgcgatggagcccctcaggcaattgtcttctttccggggaccgtcttggagtcctgctcttgtggcggctggatcagcgtgggcgagtgcagggcacccctctccttaagcatgaatacggcaagcacctgacacactgtatcttccggctgccgcccccgggcgaggatctcgtccaattagcaaaggccgccgtgagcggagatgaaaaagcgctcgacatgttcaactggaagaagtcttcttctggatccctcttaaagatgggttctcatgaaggccttttgttcttcgtgtccctgatggatggtaccgtgcactatgtggacgaaaaaggcaagacaacacaggtcgtgtccgcagactccacgattcagatgctcttctacatggaaaagcgagaagctttggtggtggtcaccgagaatctcaggctcagtctatataccgtgcctccagaaggcaaagccgaggaagtgatgaaagtgaagctctctggcaagacaggccgcagggcagacatcgcactgatcgaaggcagtttactggtcatggctgtgggcgaggctgcactgagattctgggacatcgagcgcggtgaaaattacatcctatctccggatgagaaattcgggttcgaaaaaggggagaatatgaattgtgtctgctactgtaaagtgaagggtctgttggctgccgggacagaccggggaagggttgccatgtggcgaaaagtgcctgatttcctggggagcccaggagctgaaggcaaagatcgatgggccctccagacccccactgagctacaaggcaacatcacccaaattcaatggggtagtcgtaagaatttgctggctgttaactccgtcatctccgtggctatcctctcagagagggctatgagtagtcatttccatcagcaagttgccgccatgcaggtttccccatccttgctaaatgtgtgctttctgagcaccggtgtcgctcactcgctgagaactgatatgcacatctccggggtgtttgcgaccaaggacgccgtggccgtgtggaacgggcggcaagtagccatttttgagctttctggagcggcaattcgctctgccggcacattcctgtgcgagacaccagtcctggctatgcatgaagaaaacgtctataccgtcgaaagtaacagagtgcaggtccgaacttggcagggaaccgtgaagcagttgttgctgttcagtgagacggaaggaaatccttgctttctcgacatctgcggcaacttccttgtggtagggaccgatcttgcacactttaagtctttcgatctgtccagaagggaagctaaggcccactgctcatgtaggtctctggccgagctggtgccgggcgttgggggtatcgcctctctgaggtgttcctcatctggtagcacaatatccattcttccctctaaggcagacaactccccagatagtaagatctgcttttacgatgtggaaatggatactgtgactgtgttcgacttcaagactgggcagatcgatcgccgcgaaacgctcagctttaatgaacaagagacgaacaagagtcatctctttgtagatgaaggcctgaaaaactacgtccctgtgaatcatttttgggaccagagtgaaccccggttgttcgtgtgtgaagctgtccaagagacacctagatcccagcctcagagcgcaaacggacagccacaggatgggcgggctggtccggcggccgatgtgctaatactctctttcttcatcagcgaggagcacggattcttgttgcacgagagtttccctagacctgctaccagtcattctctgctggggatggaagtcccttactactactttaccaggaagcccgaggaagccgacagagaggacgaggtcgagcctggctgccatcacatcccgcagatggtctccagacggcctttgcgcgacttcgtcggactagaagattgtgataaagcaaccagagacgcgatgctccacttttctttcttcgtgacgattggagacatggatgaggctttcaagagcattaaactcataaagtcagaagctgtatgggagaatatggcccgcatgtgcgtcaagacgcaaagacttgacgtggctaaagtttgcttagggaacatgggccacgctcgaggcgctcgcgccctgagagaggccgagcaggaaccggaactcgaagccagggtggccgtcttggcaacgcagctgggcatgctggaggacgctgaacagctgtaccgaaagtgtaaaagacacgacctgctcaacaaattttatcaggctgccggccggtggcaagaagccctccaggtggccgaacaccatgaccgtgtacatctgcgctcgacctatcatcgatatgcggggcatctggaagcatcagccgattgttcacgcgccttgagttattacgagaaatccgatacacaccgcttcgaggtgcccaggatgctaagcgaggacttgcccagccttgagctatacgtaaacaagatgaaagacaaaacgttatggcggtggtgggcgcagtacctcgaaagccaaggcgagatggacgcagcccttcactactacgaattagctagggatcatttttcgcttgtcaggatccactgttttcagggaaacgtgcagaaagccgcccagatcgctaacgaaaccggcaatctggctgcgtcatatcatttggccagacagtatgaatcgcaggaggaggtgggacaggcagtgcacttctataccagggcacaagcgtttaagaatgccattcggttgtgcaaggaaaacggcctcgacgatcagctgatgaatttggccttactgtccagcccagaggacatgatcgaggccgcgaggtactacgaggagaagggcgtgcagatggatcgtgccgtaatgctttatcacaaagcggggcactttagtaaggcactggagctggcctttgccacccagcagtttgtagccctccaactgatcgctgaggacctggacgagacaagcgatcccgccctcttggcccgatgctccgattttttcatcgagcacagccagtatgagagagccgtggagctgctcctggccgcgcggaaataccaggaggccctgcagctgtgtctcggtcaaaacatgtcgatcaccgaggagatggctgagaaaatgaccgtcgcgaaggattcaagcgatctgcctgaagaatctcgtcgtgagcttcttgagcagattgccgattgctgcatgcgtcaagggtcataccatttggcaaccaaaaaatatacccaggcgggtaataagctgaaggccatgagagcactgttgaagagtggggacactgaaaaaatcaccttcttcgcttcagtgagtcgacagaaggaaatttatattatggctgctaactatttacaatctttggattggcgaaaagaacctgagattatgaagaacataattgggttttatacgaaggggcgtgccctcgacctccttgccggcttttacgatgcttgtgcccaggtcgaaatcgacgagtatcagaattacgacaaagcccacggtgctcttactgaggcctataaatgtctcgcgaaggctaaagccaagagcccccttgaccaggaaactaggctggctcagttacagagtcggatggctcttgttaagcggtttattcaggctagacgaacttacacagaagaccctaaagagtccattaagcaatgtgagctgttgttggaggagccagatctcgacagtactatccggataggagacgtatacgggtttttggtagaacactacgtgagaaaggaggaataccagactgcttatagatttctggaagagatgaggagaaggctgcccctggctaatatgtcatattatgtgagcccacaggctgttgacgcagtccaccgggggctaggtctccccttgcccagaacggtgcccgagcaggttcggcacaattctatggaggacgccagggagcttgatgaagaagtcgtggaggaagccgacgatgacccctag

SEQ ID NO: 48125 - DNA, 2406 bp, Artificial Sequence
  Description of Artificial Sequence: Synthetic coding sequence
atggccctgtactacgaccaccagatcgaggcccccgacgccgccggctctccctcttttatctcttggcaccctgtccatccctttctcgctgtagcctacatctctaccacctctaccggctccgtggatatctatcttgagcagggagagtgcgtgcccgacacccatgtagagcgtcctttccgcgtcgcttcgctgtgctggcaccctactcgactcgtgctggctgtgggctgggaaaccggcgaagtgaccgtgttcaacaagcaggacaaagaacagcacactatgcctttgacccacactgcagatattacagttctgagatggagtccctctggtaactgtctgctgtccggggaccggttaggggtgctactattatggcgcctggatcagcgaggacgcgtgcagggcacacccctactaaaacatgagtatggtaaacatctcacgcactgcatctttcgcctccccccgcctggggaggacctcgttcagttagccaaggctgccgtctctggcgatgagaaggctctggatatgtttaactggaagaaaagtagttccggttcccttctcaaaatgggctctcatgaggggctgctgttcttcgtctcgttgatggatggaacagtgcactatgtggacgagaagggcaagacaacccaggtcgtgtcggcggattcaaccattcagatgctgttctacatggagaagagagaagcactggtggttgtcaccgaaaacttgcgactaagcctgtacactgtgccaccagagggcaaggctgaagaagtaatgaaggtcaagctgagcggcaaaaccggcaggagagccgacattgctctgatcgaggggtctctgctcgtgatggccgtgggggaagccgcactgcggttttgggacatcgagcgcggcgaaaactatattctgtcacccgacgagaagtttggtttcgagaaaggagaaaatatgaactgcgtgtgctactgtaaagttaaggggctgctcgcagccggaacagataggggaagagtggctatgtggcggaaggtgcctgatttccttggctccccgggggccgagggcaaagatcggtgggctttgcagactccgacagagctgcaggggaatattacccagatacagtggggatctcgaaagaacctcctagctgtgaatagcgtgataagtgtggccatcctaagcgaacgggcaatgtcgtcccactttcaccagcaggtggcagctatgcaggtttcgccttcactgctgaatgtgtgcttcctgagtaccggagtggcccactcattgaggaccgacatgcatatctcaggggtgttcgccactaaggatgccgtcgccgtctggaacggcaggcaggtcgctatttttgagttaagcggagcagctatacgctcagccggcacattcttgtgtgaaactcctgtgttagcgatgcacgaggagaacgtgtataccgtggaaagcaatcgcgtccaggttagaacgtggcaggggactgtcaagcaactcctcctcttttccgaaacggaaggtaacccatgctttctggacatctgtggaaacttcctcgtagttggtacagacctagcccacttcaaatcctttgatctcagcagacgagaggctaaagcccactgctcctgccgaagtctggccgagctggtacctggcgttggtggtatcgcctcattacggtgtagttctagtggaagcaccatatccatcctccccagtaaggcggacaatagccccgactctaagatttgtttctacgacgtggagatggacacggtaactgtctttgattttaagactggtcagatcgaccgacgagaaactttgtccttcaatgaacaggagaccaacaaatcccacctatttgtcgacgagggccttaaaaactacgtgcctgtgaaccatttttgggaccagagcgagccacgactcttcgtctgcgaggccgttcaggaaacaccaagatcgcaacctcaaagcgccaacgggcagccgcaggacggccgtgcgggaccagctgcagatgtcctcattttgtctttcttcatctctgaggaacatggctttctacttcacgaaagcttcccccggccagcaacttctcactccctgctcgggatggaggtgccttactattacttcaccagaaagccagaggaagctgatagagaggatgaagtggaaccagggtgccatcacatcccacaaatggtgtcacggcggcctctgagggattttgtaggcttagaagactgtgacaaggccacacgagacgccatgcttcatttttctttctttgtgactataggcgacatggacgaagcttttaagagtatcaagctaattaagagggcgtag

SEQ ID NO: 48126 - DNA, 399 bp, Artificial Sequence
  Description of Artificial Sequence: Synthetic coding sequence
atggccaaggacatcctgggcgaggccggcctgcacttcgacgagctgaacaagctccgagttctggaccccgaggtcactcaacagaccattgagctgaaggaggagtgtaaagactttgtggacaagatcggccaatttcagaaaattgtcggcgggctgatcgaacttgttgaccagctcgcgaaggaggctgagaacgaaaaaatgaaggcaatcggcgcccggaatctcctgaaatccatagccaaacagcgagaggcgcagcagcagcagctccaagctctcattgctgagaaaaagatgcaactcgagagatacagggtggagtacgaggccctgtgcaaggtggaagccgagcagaacgagtttatcgaccagtttatctttcaaaagtag

SEQ ID NO: 48127 - DNA, 477 bp, Artificial Sequence
  Description of Artificial Sequence: Synthetic coding sequence
atgacccacctgctgctgaccgccaccgtgacccccagcgagcagaactcatccagggagccagggtgggagaccgcaatggccaaagatatcttaggcgaagctggtctgcactttgatgaactcaacaagctcagagtgttggatcctgaagtgacacagcagaccattgaattaaaagaagaatgcaaggactttgtggacaaaattggacagtttcagaagatagtgggaggcctaatagagctcgttgaccagttggctaaggaggcagaaaacgagaagatgaaggccatcggcgcgcgtaacctcctcaagagtatcgccaagcagagggaagctcagcagcagcaactccaggcactcatcgcggagaaaaaaatgcagctagaacgctacagagtcgaatacgaagctctgtgcaaggtagaagccgaacagaatgagtttattgaccaattcattttccagaagtag

SEQ ID NO: 48128 - DNA, 345 bp, Artificial Sequence
  Description of Artificial Sequence: Synthetic coding sequence
atggccaaggacatcctgggcgaggccggcctgcacttcgacgagctgaacaagctccgcgttctggatcctgaggtgactcagcagacgatagagctgaaagaggaatgcaaagatttcgtggacaaaatcgggcaattccagaagatagtgggaggcctcattgagctggtggatcagctcgctaaggaggcagaaaacgagaagatgaaagcaatcggagcacgcaatctgcttaaatcaatcgctaaacagagggaggcccagcagcagcagctccaggccttgatcgctgaaaagaaaatgcagcttgaacgcaatgaactgaaaatcagtcttctgtag

SEQ ID NO: 48129 - DNA, 399 bp, Artificial Sequence
  Description of Artificial Sequence: Synthetic coding sequence
atggccaaggacatcctgggcgaggccggcctgcacttcgacgagctcaacaaactgcgggtcctagatcctgaagtgacccagcagaccatcgagctaaaggaagaatgtaaggacttcgtggacaaaattggccaattccagaagattgttggagggctgatcgagctggtggatcagctggccaaagaggccgaaaatgagaagatgaaagcaattggcgcacgcaatctgctgaagagcatcgctaaacaacgcgaggcccagcagcagcagttgcaggctcttatcgccgagaagaaaatgcagttggaacggtaccgcgtagagtatgaggcattgtgtaaggtggaggccgagcagaacgagtttattgaccagttcattttccagaaatag

SEQ ID NO: 48130 - DNA, 216 bp, Artificial Sequence
  Description of Artificial Sequence: Synthetic coding sequence
gacatcctgggcgaggccggcctgcacttcgacgagctgaacaagttacgtgtgctggatccagaggtgactcagcagaccatagagctgaaggaggaatgcaaggactttgtagacaaaatcggacagttccaaaaaatcgttggcggacttatcgagttggtggaccagttggccaaggaggcagaaaatgaaaagatgaaggtctccggttag

SEQ ID NO: 48131 - DNA, 558 bp, Artificial Sequence
  Description of Artificial Sequence: Synthetic coding sequence
atggtgaagctggccgccaagtgcatcctggccgaccccgccgtggggaaaacagccctcgcccagatttttcgatctgatggcgcccatttccagaaatcatataccctcactacaggtatggacctcgttgtcaagaccgtgccagtgcctgatacgggcgattccgtggaattgtttatcttcgatagtgctggcaaggagctgttctcagaaatgctggataagctgtgggaaagccccaatgtcctgtgtctggtatatgatgtaacaaacgaggaaagtttcaataactgctctaaatggctagagaaggctcgtagccaggctcccggtatatcccttcctggcgtactggttggaaataagaccgatctggccgggaggcgcgccgtggattcggccgaggctcgtgcctgggcgctgggtcagggtttggaatgttttgaaacctctgtcaaggagatggagaattttgaagccccctttcattgccttgccaagcagtttcaccagttgtatcgagaaaaggtggaagtcttcagggctttggcatag

SEQ ID NO: 48132 - DNA, 390 bp, Artificial Sequence
  Description of Artificial Sequence: Synthetic coding sequence
tgaagcgacggcgcccacttccagaagagctacaccctgaccaccggcatggatctggtggtcaaaacagtaccagtgcctgacaccggcgattctgtggagctcttcattttcgactctgctggcaaggagctcttttcagaaatgttggataagctttgggagtccccaaatgttctgtgtctggtgtacgacgtcacaaacgaagagagcttcaataactgtagcaagtggctggaaaaggccagaagtcaggcccccggaatcagcttgcccggggtcctggtgggtaacaagactgatctcgctggacgtcgagccgtggactccgcagaggcccgggcctgggctctgggccaaggattggagtgtttcgagacaagcgtatag

SEQ ID NO: 48133 - DNA, 552 bp, Artificial Sequence
  Description of Artificial Sequence: Synthetic coding sequence
atggtgaagctggccgccaagtgcatcctggccgtgcccgtggacaaacgcttatcccgagcagaggtgtgttccggctgttgcgaagtttgccgctcagtttcctggacttgcgccctgccagcagcatccgaacaggtccccgtgagaggggacccagccgttggcaagacagccctcgcccagatcttccggtccgatggagcccattttcagaaatcttacacccttaccacgggcatggacctggtggtcaagaccgtcccagtgccagacaccggagactccgtcgaactctttattttcgatagcgcaggaaaggaattattttccgaaatgctggacaagttgtgggagagccccaacgtactgtgtctcgtatatgacgtcacaaatgaggagagcttcaataattgctccaagtggcttgagaaagcccgctcccaggctcctggaatttctctgcctggggttttagttggcaacaaaaccgatctggctggcaggcgagcggtagactcagccgaggcaagagcttgggccctggggtag

SEQ ID NO: 48134 - DNA, 351 bp, Artificial Sequence
  Description of Artificial Sequence: Synthetic coding sequence
atggtgaagctggccgccaagtgcatcctggccgaccccgccgtgggaaagacggcactggctcagatattccggagtgacggcgcacattttcagaagtcctatactttgacaaccggtatggatctagtcgtgaagactgtaccggtgccagacacaggcgacagtgttgagcttttcatctttgactcggctggtaaggagctgttctcagaaatgctagacaagctatgggagagccccaatgtgctgtgtctggtgtatgatgtaactaatgaagaaagtttcaacaactgctcaaaatggctggagaaggccaggtcgcaagcgcccggcatctctctgccgtag

SEQ ID NO: 48135 - DNA, 561 bp, Artificial Sequence
  Description of Artificial Sequence: Synthetic coding sequence
atggtgaagctggccgccaagtgcatcctggccggcgaccccgccgtgggcaaaacagcccttgctcaaatttttcgtagtgacggagcacactttcagaagtcttatacgttaaccaccggaatggacctagttgtgaaaacggttccagtgccggacaccggggactccgttgagttattcatttttgactccgctgggaaagagctgttctctgagatgctggacaagctttgggagtcacctaacgtgctgtgtttggtgtacgacgtgactaatgaagaaagcttcaataactgcagcaaatggctcgagaaagcacgatcccaagctcctgggatctcccttcctggcgttctcgtgggaaataaaacggatttagcaggtcgcagagctgtcgatagcgctgaggcccgcgcgtgggcgctggggcagggtctggagtgctttgagacttcagtcaaagaaatggaaaactttgaagcgccgttccactgtttagccaagcagttccatcagctttacagggaaaaggttgaggtttttcgtgccttggcctag

SEQ ID NO: 48136 - DNA, 156 bp, Artificial Sequence
  Description of Artificial Sequence: Synthetic coding sequence
atggacctggtggtgaagaccgtgcccgtgcccgacaccggcgacagcgtcgagttgttcatcttcgattccgccggcaaagaattattctctgaaatgcttgacaagctctgggaaagccctaacgtgctctgcctggtttacgacgtgacctag

SEQ ID NO: 48137 - DNA, 438 bp, Artificial Sequence
  Description of Artificial Sequence: Synthetic coding sequence
atggacctggtggtgaagaccgtgcccgtgcccgacaccggcgactcagttgagctgttcattttcgactctgccggaaaagaactattttccgaaatgctagacaagctctgggagtccccgaatgtgttatgtctggtttatgacgtgacgaatgaagagtcctttaacaactgcagcaagtggctggaaaaagccagatcgcaggctcctggcattagcctgcctggagtgctggtcggaaacaaaaccgatttggcaggtcggagggccgtcgactccgcggaggctcgggcatgggcgctggggcaaggtctcgagtgctttgaaacctccgtgaaggagatggaaaacttcgaggccccgtttcattgcttagcgaagcagtttcatcaactttatcgcgagaaagtcgaggtatttcgggctcttgcctag

SEQ ID NO: 48138 - DNA, 1314 bp, Artificial Sequence
  Description of Artificial Sequence: Synthetic coding sequence
atggagaaggagctgcggagcaccatcctgttcaacgcctacaagaaggagatcttcaccacaaacaatggctacaagagcatgcagaagaagctgcgaagcaattggaagatacagtctctcaaagacgagatcacctcagaaaagcttaatggcgtcaagctgtggattactgcaggacccagagagaagtttactgccgccgagttcgaaatcctcaagaaataccttgacactgggggagacgttttcgtgatgcttggagagggtggtgagtcgcgctttgacacaaatattaattttttgctggaggagtatggtatcatggttaacaacgacgcagtggtccggaatgtgtatcacaaatacttccatcccaaggaggcactggtttcctccggcgtactgaatagagaaatatcgcgggcggcaggaaaggctgttccaggcatcatcgacgaagaatcttcagggaataatgcacaagcactcacattcgtctatccttttggcgcaaccctgtccgtcatgaagccagctgttgcggtcctcagcaccggctctgtgtgcttccccctgaacaggccaatcctcgctttctaccattcaaagaatcaaggcgggaagctggcagtgctgggctcttgccacatgttctcagatcagtatctagataaagaagagaatagtaaaatcatggatgtagtatttcaatggttaaccacaggggatatccacttaaaccagatcgatgctgaagatcccgagatctctgattacatgatgctcccgtacacggctactctgagcaagagaaatcgggagtgtttacaggagtcagacgagatcccaagggacttcaccaccctattcgacttgagtattttccagctcgacactacttcgttccactcagtcatagaagcacatgagcagcttaacgtgaagcacgagcccctgcagctgattcaaccccaatttgagacgccccttccaaccctgcagccggctgtgttcccccccagctttcgcgaactgccgccaccgccgcttgagttatttgacctcgacgaaactttcagctcagagaaggcacgtctggcccaaattaccaacaaatgcaccgaggaggatctagaattttatgtgaggaagtgcggcgatatactgggtgtcaccagcaaattaccaaaggatcaacaggacgccaagcacatcctagagcacgtgttttttcaggttgtcgagtttaaaaagctgaatcaggaacacgatatcgacacctctgagactgctttccagaataatttctag

SEQ ID NO: 48139 - DNA, 1314 bp, Artificial Sequence
  Description of Artificial Sequence: Synthetic coding sequence
atggagaaggagctgcggagcaccatcctgttcaacgcctacaagaaagagatcttcaccactaacaatgggtacaaatcaatgcagaaaaagctacgctccaattggaagatacagagtctgaaagatgagattacatcggagaagttgaacggagtaaagctgtggatcactgcagggcctagggagaagttcacagcagcagagtttgaaattctgaagaaatacctcgatacagggggtgatgtgttcgtcatgctgggagagggtggggaaagtaggttcgacaccaacatcaacttcctacttgaggagtatgggattatggttaacaacgacgccgtggtcaggaatgtgtaccataaatactttcatcccaaggaggctctggtgtcatctggcgtgctgaatcgggaaatttcaagagctgccggaaaggccgtgcctggcatcatcgacgaagagagctccgggaacaacgcacaggcactgacttttgtttatccatttggtgcaacactatctgtgatgaaaccagccgttgccgtgctgtcaactggctccgtgtgttttcccctaaaccggccaatattggcgttctaccattcgaaaaatcagggggggaagttagctgtgctgggctcttgccacatgttctccgaccaataccttgataaagaagaaaactcaaaaatcatggatgtggtgttccagtggctcacaacaggagacatccatctgaatcagatcgatgcagaggaccccgaaatatcagattacatgatgctgccttatactgcgacgctgagcaagcgaaaccgagaatgtttgcaggaaagcgatgaaatccccagagactttactaccctgtttgacctctccatttttcagttagatacaaccagctttcatagtgtgatcgaggctcacgagcaactgaatgtaaagcatgagcccctacaactgattcaaccacagttcgaaacacccctgccgacgctccagcctgcagttttccctcccagcttccgcgagttacccccccctcctctggagctctttgatctcgacgagactttttcgtctgaaaaggcacgcctggcccagatcacaaataaatgcaccgaggaggacttagaattttacgtgcggaagtgcggcgacattttaggcgtcacctctaaactgccaaaggaccagcaggatgcaaaacacatcctggagcacgtcttcttccaggttgtggaatttaaaaaactcaatcaggagcatgatatcgacacatccgaaacggcgttccaaaacaacttctag

SEQ ID NO: 48140 - DNA, 1401 bp, Artificial Sequence
  Description of Artificial Sequence: Synthetic coding sequence
atggagcccgagctgctggtgcggaaggtgagcgccctgcaggcctgtgttaggggatttctggtccgccgacaattccagtccctgagagccgaatacgaggcaatcgtccgagaggttgaaggtgatcttggaacactgcagtggacggaaggtcgtattccacggccgcgcttcctgccagaaaaggcgaagtcacaccagacatggaaggcgggagacagggtcgctaatcctgagcaggggctatggaaccactttccatgtgaggagagcgaaggagaagcaacttgggaggaaatggttctcaagaagagcggggagtcatccgctaaccaaggatcgttgtgtcgggaccattcaagttggctgcagatgaaacagaacaggaaaccttctcaggagaagacccgcgatactacaaggatggagaaccccgaagcgactgatcaacgcttgccccatagccagcctcagctgcaggaactgcagtaccaccggtcccacctggctatggaactactttggctgcagcaagccatcaatagtaggaaggagtacttgctgctgaaacagacgctgcggagtcccgaggctggacccatccgggaggagcctcgggtgttcctagaacacggcgagcaagcctgtgagagggaccagtcacagccatctgcccccctcgaagaccaatcataccgcgaccggacgaccggggaattggagcaagaagatgattcatgtcaccgcgtcaagtcaccacacagaagcccaggcagcctggcaacgacacagaagaacatcgctggagctaagtgccgtgagccctgttactccaaaagcgggccaccttccagcattccctcgaattcgcaggccctgggcgaccgactcaccaaaggtcccgatgatgggcgtcaaacatttggcgggacctgcctgctgcagatgaagatactggaagaccaaaccccgcgaggattgaaaccgcgaaaccactgtcccaggaaaagcaggacgcagctttctgcactctacgaagacagtaatattaaggagatgagtcctcggaagctcgaccataaggaaccggattgtcgcacagtaaggacccaggagcttggactgtctgaagaccatattatctgggacgggacactgggagggccggaacactcggtgctggatttgtggcgcactaagccgcccaagggacaggccccaactgatcgtagctccagagacggaaccagcaatgaacctagccatgagggccaaaaaaaacagcggaccatcccttggcggtctaagtcccctgagatactgtctagtacaaaagctggatgtactggtgaggagcagtggagaggtaggccttggaagaccgagcccccggggtag

SEQ ID NO: 48141 - DNA, 1641 bp, Artificial Sequence
  Description of Artificial Sequence: Synthetic coding sequence
atggagcccgagctgctggtgcggaaggtgagcgccctgcaggtgagggggagggcgcgggggagtcaggacttttcttttagggaaattatggggtccagaacttggacatcacagcgggatgcgacgactttcagtcctctgactgcaaggcaaccactggaaattccagcagtcccaaatagagccgaggagtcatgggaccccagaacgccatgccccgctagaccccatagtcaccacactcttgcccctgaccagggtaacgggaagtctcttaaagcatgtgtccgaggcttcttggtgcgccggcagttccagagtctccgagctgagtacgaggcaatagtgcgtgaggttgagggggatctggggaccctgcagtggactgagggcagaatcccgcggccacgatttttgcccgagaaggccaaatcacatcaaacgtggaaagccggggacagggtggcaaacccagaacagggtttatggaatcacttcccttgtgaagaaagcgaaggagaggctacatgggaggagatggtgctgaaaaagtccggcgagtcctctgccaatcaggggtctctgtgtagagatcattcttcctggctacaaatgaagcagaataggaaacctagccaagagaaaacaagagacaccacccgcatggaaaaccccgaagccacagaccagagattaccgcattcacagcctcagcttcaggaacttcagtaccataggtctcatctcgccatggagctgctgtggctacagcaagctattaattctcgcaaagagtacttgcttctgaaacaaaccctgaggtcaccggaggccggccccataagagaagagcccagagtgtttctggaacacggtgagcaggcctgtgagcgcgatcagtcccagccatccgcacctttggaagatcagagttacagagacaggaccactggggaactcgagcaggaagacgattcctgtcaccgcgtgaaatctccacaccggtctccaggctctctcgccactacgcaaaaaaacattgctggagcaaaatgcagagagccatgttattcaaagtccggccctccttcaagtattccttcaaattcccaagctcttggggataggctgacaaaggggccggacgatggcaggcagaccttcggtggaacatgtctccttcagatgaagattctggaggatcagactccccgggggctgaaaccacgcaatcactgcccccggaagagtcggactcagctgtctgccttgtatgaggactcaaacatcaaagaaatgagcccacgtaagcttgaccacaaagagcccgactgccggacagtgcggactcaagaactgggactgtctgaagaccatattatatgggacgggacactgggcgggcccgagcacagtgttttggatttgtggcgcacaaagcctccaaaaggtcaggctccaactgaccgctcgtcgcgcgatggtacttccaacgagccctctcacgaggggcaaaagaagcagcggactatcccatggaggtccaagtctcccgagattctatcgagcactaaagccgggtgcacaggagaagagcagtggcgggggaggccctggaaaacggagcctcccggttag

SEQ ID NO: 48142 - DNA, 1044 bp, Artificial Sequence
  Description of Artificial Sequence: Synthetic coding sequence
atggccctggacatcctggccatggcccccctgtaccaggcccccgccatcaaccgaatcgggccaaaaaccgacccctctaagcggccagccgacccacttaagccacttgtccttagcagaacaaagctgaccacaattgaggctaagagaattatgtctatcctagacgaggcgatatacaaagtagagcttgtgaccctactgagctacgtggcctcaaaccgtgaggacatggagggcatgctcggtgaagacgttatgcgtgccgtacgcgaacacgaagatttgtgccaggtgctacttgaaaacgtccgctgtctgaaggaaaaagaaagacagttacaggagcagaaagaggccgaggaggagggttggctgcgagaccggttattgagcatcgagctacagaagagctctctttctcctctgatgcagcagattaaagactctaccaagaatgtgttacggctgctgctcagcaatccacaggctgcgcgattattgcaaatgcaaacgcagggcagaagtgccgaagcgcaaaactttatagactctctgatagagctgagaggcttcctctttgagaagctcttgacatcccccatggaggctcgggacaaggcccagttcttgcaagacatctcaaggcagaattccaataaccaacagataatcgacacactcgagaaggaattggcggagagaatgaagaatcggaacgctgaagaggagctggaagacctggacgctgttcacagagaggagaaaatcagcctggaggagctgcggcggagacataaggtcctcgtgggtgagttcgcacagatacgggaggaaagggaaatcaactctaagaaaaggatggaggcggagcaggaaatggtccgtatggtccgcgctgctactctgattcaggcactgtggaagggctacctggtaagatccctccttcgaagcaaaaaaaagcgcggaaagggaaaggctaaagataaagaaaaggggaagcagaaaggaaaagagaagggaaagggaaaaaaatag

SEQ ID NO: 48143 - DNA, 1110 bp, Artificial Sequence
  Description of Artificial Sequence: Synthetic coding sequence
atggccctggacatcctggccatggcccccctgtaccaggcccccgcaattaaccgcataggtccaaaaacggaccccagcaagcggcccgcggacccactcaaaccgctggtcctgagcagaacaaaacttactacaatcgaggccaaaagaattatgagtatcttggatgaagctatctacaaggtggagctggtcaccctgctgtcttacgtggcgtctaaccgagaagacatggagggcatgttgggggaggatgttatgagggccgttcgggaacatgaagacctttgccaggttctcctggagaacgtacggtgtctgaaggaaaaagagaggcagctgcaagagcagaaggaagcggaggaggagggctggctgagagacagactcttatctatagaactccagaagtcttctctgagccccctgatgcagcagatcaaagactctaccaagaatgttttacggctcctgctctcgaacccacaggctgcaagactactgcagatgcagacccagggccggagcgcggaggcccagaacttcatagatagtctcatagagcttcgcggtttcctgtttgaaaagttgctgacatctcctatggaggcccgggacaaggctcagtttctccaggatatttcgaggcagaactcgaataatcagcagataatcgacaccttggaaaaagagctggctgagcggatgaagaatcgcaatgcagaagtactttttcactcaatcgcagaaattactgaggaggccacccagattttttgttggctgggcttcagctctatgatcgatttcttctttaagatggaatctaggtcagtggtgcaaacaagagtccagtggtgcaacctggactctctgcagcccctacccccccggttcaagcgcttctcgcatcactcactgccctcaagctgggactacaggagaatgccaccccgccctgccaatttctgcattttctcccgcgatcgggtcacccctttcagctgcctgtctctcccatcttcgtgggactacaggtgccccccactctactcatcactggcagccgaacaggaccctgtgtcaaaaaagaaaggaaagcaatag

SEQ ID NO: 48144 - DNA, 1350 bp, Artificial Sequence
  Description of Artificial Sequence: Synthetic coding sequence
atggccctggacatcctggccatggcccccctgtaccaggcccccgccattaatcgaatcggtcctaagaccgaccccagtaagcggcccgccgaccctctcaaacctcttgtcttgagcaggacaaaacttactaccatagaggccaagcgcatcatgtcaattctggacgaagcaatttacaaagtcgagctggtgaccctgctgtcctacgtcgccagcaacagagaagatatggagggcatgctaggcgaggacgttatgcgggccgtccgggagcacgaagatctatgccaagtgttgctcgagaacgttcgatgtctgaaggagaaggagagacagttgcaagaacagaaagaagctgaggaggaggggtggctccgtgatcgtctcctgtctattgaattgcagaaatcgagtttgagtccattaatgcaacaaatcaaggactctaccaaaaacgttctgcgcctccttctgagcaatcctcaggctgctaggttactccagatgcagacccaggggcgtagtgctgaggcccagaactttatcgactccctgattgagctgcgaggattcctgttcgagaagctgctcacatcccctatggaagctcgcgacaaagcgcagtttctacaggatattagcagacaaaactcaaacaaccaacagattattgataccctggagaaagagctggctgagcgcatgaagaaccggaatgcagaagtggagaaggagaacttcgtgatccaggaactcaagaaccatctacaccaggtgctgaaattttccgaaaatagcttggtacgcaccaaacaagaggccgagaagcaacaaaaggctgacttcagggcgtctcaggcgagggtggccaaaattcagcaggagatactgcagcttcagtctcagttctacaacctagtgatggagaaccgggaggcagagcaggccctgcggaagaaaaagtacaaggtggagactgagatagagaattggattcaaaagtacgacaccgaaatgggggagaagcaggaggagctggaagatctggacgctgtgcaccgcgaagaaaagatctcactcgaagagttgcgcaggcgacacaaagtgctggtaggagaatttgcccagattagagaagagcgtgagatcaattcaaagaagaggatggaggctgagcaggagatggtacgaatggtgcgggccgcaacgctaatccaagccctttggaaaggctacctggtacgatctttgctgcggagcaagaagaagaggggaaaaggcaaagcaaaggacaaggaaaaagggaagcagaaaggcaaagagaagggaaagggcaagaagtag

SEQ ID NO: 48145 - DNA, 618 bp, Artificial Sequence
  Description of Artificial Sequence: Synthetic coding sequence
atggaggagaagcagccccagaagaccaaggagcccagcaaggaggacgaaccacagcagaaggaaatgcctacccatctaagtctgggagcggaatctaaagcagaggccaaaacccccgtgctcgtggaaacccagaccgtggacaatgctaacgaaaagagcgaaaagcctccggaaaaccaaaaaaagctgagtgataaggacactgtagccacaaaaatccaagcttggtggcgcggcacccttgtaagaagggcgctgctgcatgctgcactgtccgcgtgtattatccagtgctggtggcgcctgatcttgagcaaaatactcaagaagcgtagacaggccgccctggaagcatttagtcggaaagagtgggcagcagtgacattacagtctcaggccaggatgtggcgcattcggcgtagatactgccaggtcctgaacgccgtgagaatcatacaggcctactggaggtgtcggtcgtgcgctagcagaggattcattaaggggcaatacagggttaccgccaatcagttgcacctccagctggaaattctgctggactcaggaccttgcattgtgaccgagtgcatccctttttcaataaaggaatag

SEQ ID NO: 48146 - DNA, 249 bp, Artificial Sequence
  Description of Artificial Sequence: Synthetic coding sequence
atggaggagaagcagccccagaagaccaaggagcccagcaaggaggatgagccacagcaaaaagagatgcctactcacttatccctgggcgcagaaagcaaagcggaggccaagactcccgtgctagtcgagacacagacagtcgacaacgccaacgagaagagcgagaagcgcgtgtgtcagtggaatatggtcatcgtttccatggattggaagtcgctggagtcagaagatctgcgcaacctatag

SEQ ID NO: 48147 - DNA, 495 bp, Artificial Sequence
  Description of Artificial Sequence: Synthetic coding sequence
atgcgggtgcggttctgcaccaagggcaacctgatcctggtgatcattgaggatgtggaagaaagcatcgagtggaagactctgcagaaaaagaagcagcagaagattaaggaaaaactcaggatccgcaccaaggctgctgtaaagattcaagcttggtggagagggacgttagtgagacgcacattactgcacgctgccctgcgagcctggatcatccagtgctggtggcgtatgacactgagccgcgtgttagagaaaaagagacaggctgctctgatagcttatgcgacaagagagcgtgctgttatcaaactccagtctttggtccgcatgtggagggtccgctggagatactgccaggtgctgaacgccatttacatcatccagggccattggcaatgccacaattgtcagacatgcgctctgcttcagggccattgcgttgttaccgcaactcacctgcagtttcatattgaaatcatcaactcctag

SEQ ID NO: 48148 - DNA, 465 bp, Artificial Sequence
  Description of Artificial Sequence: Synthetic coding sequence
atgggcagcaagtgctgcaagggcggccccgacgaggacgccgtggagagacagcggcgtcaaaaactgcttcttgcgcagctgcaccatcggaaaagagtaaaggcggctgggcaaattcaggcctggtggaggggcgtcctcgtcaggaggaccttactagtggccgctcttcgtgcctggatgatacagtgctggtggagaactctagttcagagacgaattagacagaggcggcaagccctgttgcgtgtgtatgtaattcaggagcaagcgacagtcaagctccagagttgtatcaggatgtggcaatgtcgccagtgttataggcaaatgtgcaacgcactgtgcctgttccaagttcccgaaagctccttggcttttcagactgacggatttttacaagtccagtacgcgatccccagcaaacagcctgaattccacatagaaattctgagcatttag

SEQ ID NO: 48149 - DNA, 465 bp, Artificial Sequence
  Description of Artificial Sequence: Synthetic coding sequence
atgggcagcaagtgctgcaagggcggccccgacgaggacgccgtggagcggcaaaggcggcagaaactgcttctagcacaacttcaccaccggaagcgtgtcaaagctgccggtcagatccaggcatggtggcggggggtgttagtgaggaggacacttctcgtggccgcactgcgcgcctggatgattcagtgttggtggaggaccctagtccagcgtaggatccggcagagacgtcaagcactgctgcgcgtctacgtcatccaggagcaggctacggtgaagctccagagttgcatccgaatgtggcagtgtcggcagtgctatcgacaaatgtgtaatgccctgtgcttgtttcaagtcccagaatctagcctggcctttcagacagatggcttccttcaggtccagtatgcaatcccatctaagcaaccagagttccatatcgaaatactgtccatctag

SEQ ID NO: 48150 - DNA, 465 bp, Artificial Sequence
  Description of Artificial Sequence: Synthetic coding sequence
atgggcagcaagtgctgcaagggcggccccgacgaggacgccgtggaaaggcagagaaggcagaagcttctcctggcacagttgcaccataggaaacgggtaaaggctgcaggccagatccaggcctggtggaggggtgtactcgtaaggcgtactctgctcgttgctgccctgagggcttggatgatccaatgttggtggcgaaccctggtccagcgaaggatccgtcagcgcagacaggccctcctccgagtctacgtcattcaagaacaggccaccgtcaagctgcagtcatgcatcagaatgtggcagtgtaggcaatgctaccgacagatgtgtaatgctctttgcctatttcaggtccccgaaagttcccttgcatttcaaacagacggtttcctgcaggtccaatacgccattccctctaagcaacctgagtttcacatcgagattctgtccatctag

SEQ ID NO: 48151 - DNA, 465 bp, Artificial Sequence
  Description of Artificial Sequence: Synthetic coding sequence
atgggcagcaagtgctgcaagggcggccccgacgaggacgccgtggagaggcagagacgacagaagttacttctcgcacagctacaccatcgcaagagagtgaaagctgcagggcagatccaggcatggtggcgaggagtgctagttcggcgcacactgctcgttgctgcccttcgcgcatggatgatacaatgttggtggaggacactggtgcagagacggattaggcaacgccgccaagctctgctccgcgtgtatgttatccaggagcaggccactgtgaaacttcagtcctgtatccgtatgtggcagtgcagacaatgttacaggcaaatgtgcaacgcattgtgtctgtttcaagtgccagaaagctcgcttgcatttcaaacagatggattcctccaggtgcagtatgctattccgtctaaacagcctgagttccacatcgagatcctttccatttag

SEQ ID NO: 48152 - DNA, 366 bp, Artificial Sequence
  Description of Artificial Sequence: Synthetic coding sequence
accaagaagaagaagaagaagaagaagcggaaggagaagaagctgcgcgagcgctccgccgccgtcttcattcaggcctggtggagaggaatgctcgtccgaaggactctgctccacgcagcattgcgggcgtggattatacagtgttggtggcgtcaggtactcgaaaagctgctggcgaagcgtaggagaatggtcctggaattttacgttcagcaagaatgggctgccgtccgcttacagagctgggtgcgcatgtggtgtgtgcggcagaggtattgtagacttctgaacgctgttcgcattattcaagtctattggcgatggcacagctgtcatagccgggtatttattgagggccattag

SEQ ID NO: 48153 - DNA, 447 bp, Artificial Sequence
  Description of Artificial Sequence: Synthetic coding sequence
atgggccccgaggagaagaccatcatgaccgagcggagcgccgccgtgtttattcaagcctggtggcgcggaatgctggttcgacgaaccctgctccatgcagccctgagagcctggataatccagtgctggtggagacaggtgcttgaaaagctgctggccaagcggagaaggatggtacttgaattttatgtgcagcaagaatgggcagcagtaaggttgcagtcatgggttcggatgtggtgtgttaggcagaggtactgtcggttgctgaatgctgtgcggattattcaggtatattggcgttggcactcctgccactcaagggtttttatagaaggccactacgaactaaaggagaaccagttaaacattcagctggagatctccctgggactgcaggcttgtaaggtccagcagtgcataccgcttcctctgaaagagtag

SEQ ID NO: 48154 - DNA, 324 bp, Artificial Sequence
  Description of Artificial Sequence: Synthetic coding sequence
atggtgcggcggaccctgctgcaggccgccctgcgggcctgggtgattcaatgctggtggaggtccatgcaggcgaaaatgctggagcagaggcggcggctggcgcttaggctgtacacttgtcaggagtgggcggtcgtgaaggttcaagctcaggttagaatgtggcaggcccggcgtcggtttctgcaagctagacaggctgcttgcattattcaatcccactggcgatggcatgcgagtcaaactagaggtctgattcggggtcattatgaggtaagggcaagtcgactggaactagatattgagattttgatgacctag

SEQ ID NO: 48155 - DNA, 570 bp, Artificial Sequence
  Description of Artificial Sequence: Synthetic coding sequence
atggccgccccccggcagatccccagccacatcgtgcggctgaagccgtcttgctccacggactcttctttcacccgcacacctgtacccactgttagcctggcctctagggagctgcctgtgagcagctggcaagttaccgaaccgtccagtaaaaacttgtgggagcagatttgcaaggagtacgaagcagagcagcccccattccccgaaggatacaaggttaagcaggagcctgtcataaccgttgctcctgtggaggaaatgctcttccatgggttcagcgccgaacactattttcctgtctctcacttcactatgatcagtagaaccccttgtcctcaggacaaaagcgagactattaaccccaaaacctgttcacccaaagagtacctagagacctttattttcccggtgctacttcccggaatggcctctcttctacatcaggcaaagaaggagaaatgcttcgagccaactgcagctaatcctaccctagctccagctgataggcgcgggagcagccccctacactctattctgctcgaaagcttatgcggttcgctgtag

SEQ ID NO: 48156 - DNA, 864 bp, Artificial Sequence
  Description of Artificial Sequence: Synthetic coding sequence
atggccgccccccggcagatccccagccacatcgtgcggctgaagccttcatgctccactgacagctcgttcaccaggactccggtgccaaccgtttccctggcgagtcgagagctgcctgtgagcagttggcaggtaaccgagccttctagcaaaaatctgtgggagcagatatgcaaagaatacgaagcagagcagcccccttttcccgaagggtacaaggtgaagcaggagccagtgatcacagtggcacccgtggaagagatgttatttcatggctttagcgcggagcactacttcccggtgtcgcacttcaccatgatttcccgcactccatgcccacaggataagtctgagactatcaatccgaagacatgttctcctaaggagtaccttgaaacctttatctttcctgtcttattgcccggtatggcaagcctcctacaccaagcaaagaaggagaagtgttttgagcgaaaaaggacaaaatttatcgcttgcgattttttgaccgagtggttgtacaatcaaaatcctaagcgcgcaggcgagcccttcactgagttttttagcattccattcgtagaagaaaggctgaagcagcaccctcgccctccaattccactgtctctactacttactgaggaggaggccgcactctacatccaaagcttctggcgcgcgtgcgtcgtgcggtgcgatcccgagatccaggaactcaggcagtggcaaaagaagctccgggaagcaaagcatatccatcagcaggtgaagattttctgggccaaacaggagcagaaggtgaagtgcaagatggaagacgacgcggttcccgcagctaagatgaagattccatcgtcctag

SEQ ID NO: 48157 - DNA, 600 bp, Artificial Sequence
  Description of Artificial Sequence: Synthetic coding sequence
atgctgttccacggcttcagcgccgagcactacttccccgtgagccacttcacaatgatctctaggacaccctgcccgcaggataaatctgaaaccattaacccaaagacctgttcccccaaggaatacctcgaaaccttcatttttccagtgctcttgcctggtatggctagcctgctacaccaggctaaaaaggagaaatgctttgagaggaaaagaaccaagttcattgcctgtgacttcctaaccgagtggctctacaatcagaacccgaagcgagctggggagccattcaccgaattctttagtatcccattcgtggaggagcgcctcaagcagcacccacggccaccaatacccctgtcactgctgctgactgaagaagaggccgccctctacatccagagcttctggagagcctgtgtggtacgctgtgacccagaaatccaggaactcaggcagtggcagaaaaaactgcgggaggccaaacacattcatcagcaggtgaagattttctgggcaaagcaagaacagaaggtcaagtgcaagatggaggatgatgctgtgccagcagctaaaatgaagattccctcttcttag

SEQ ID NO: 48158 - DNA, 720 bp, Artificial Sequence
  Description of Artificial Sequence: Synthetic coding sequence
atggccgccccccggcagatccccagccacatcgtgcggctgaagcctagctgctccactgacagcagctttacaaggacacctgttccaactgtttcgttggcctcgagagagctcccagtatcctcctggcaggtaacagaaccttcaagtaagaacctgtgggagcagatctgcaaggaatatgaggcggaacagccaccattcccagaaggctataaagtgaagcaggaacctgtaattaccgtagcccctgtggaagagatgctcttccatggtttttccgccgagcactactttcccgtttctcacttcactatgataagtcgaaccccttgtcctcaggataaatcagaaaccataaatcccaaaacatgtagccctaaggagtatctcgagactttcatttttcctgtgctgctgccaggtatggcgagcttgcttcatcaggctaagaaagagaaatgtttcgaacggaaaaggacaaaattcattgcatgcgacttcctgacagagtggctgtacaatcagaatcctaagcgtgcaggtgagcccttcaccgaatttttctcaattcctttcgtcgaggaacgccttaagcagcaattcgctgtaattctcaggtttaagaattgcgtgtcagggaggcggaattttgctagaccttccacctttacatcgaagagtaagttctcaggtccaagtaagaataaaaagtag

SEQ ID NO: 48159 - DNA, 2460 bp, Artificial Sequence
  Description of Artificial Sequence: Synthetic coding sequence
atgtacaacaagatgtggcaccagacccaggaggccctgggcgccctgctggataaggagccccaaaagatgatcgagccccagagaaatcaggtgttcattttccagacactggctaccttttacgtcaagtatgtccagatatttaggaatctcgagaatgtgtatgaccagttcgtccacccgcagaaaagaatactcatccggaaagtcctggatggtgtgatgggtcggatcctcgagttgaaaaatgagatggtagagctggaactaactgagttccattatttcgatgacatcctccaagatcttaagcttgccccgcagcaactggatattcccattcctaagtatttcctgaaggagaagttagaggtgatcaaggggcgggaaaagattttagcacaaattttagccgattctggaatcgatacttctgacatgaaatatcctgttaaatccattccatttgatgaagccgtcaagctaatccaaatagctgagcgggctcgacagggtcgccttcgggctctgttcatgaaacagatttacctgcaagagtatcgggctaagcagtcgaagatgctgggcaaaaaggtcacggatacttgggccgccgcactgagaatccagaaagtgtggagacgattccatcagagaaaggagactgaaaaactgagagaagaggaaatgatcttcttgggcatgaatcccccccccctctttaatgaagttagcgccactgttatccaagctgagaaagtcgaccggctccgaaatgaagtgcagattaagcatgaggaagattatagggaggctctggtcacaatcaagaacgatctcaaactgattgagggggtggacattaaagagaatctccaggaccagattagacactggttcatcgagtgtagaaatctgaccggcacctttcccgactatcccgatgttgaagaaggcgggagcgccattattttcagtgataagacgatccagcaggttatcgaagacatcatcgccaaccaggaggaagaggaaaagaataagaagaaaaaaaagaaaaaggaaaagcagcctaaaaaagccaagaagcaaaaaaagggtacaaaggagaagaacaaggaggaagatgagaaatggaaaatgtcacctagcttatttctccctgcaatgaaggagggctgcaatgcttataaggagatatggatgaaaaaagacgaatcgtggaacttttcgcaggactatgatccagaactcattaaagaagagaagcgtaaagaactccagagcgagattcgcatacaggtcgacgagctgatgcgtcaagagctgaagaacctcaaactggctgtcgacagggagagggaaagacccgtaaaagccgggaaaaaaaaagataagaaaaagggtaagaagggaaaaaagaaagagaaaaaggccaaaaaggataaggacctcacggccgaccgcacaatagaatcgctgtataaggaactggtcgaagagggacttttgattcaggctctgaaagtaaatctctctgattatatcggcgagtacagctatcttggcaccacactgaggcaggtgagcatcgagccgatgcctagtctccttgatgtccggcagctaattaccctctacggcatttggccgcttggttctgctgcagttcatgagaaagcgcccttggttaaatccctcttactggcggggccgagcggcgttgggaagaagatgctggtgcacgcgatctgtaccgagacaggggccaacctgtttaatctctcctcctctaatattgctggcaagtatcctgggaaaaacgggcttcagatgatgcttcacgccgtttttaaagtggccaggcagctgcagccctcagtggtatggatcgaggacaccgaaaaaacgttctacaagaaagtgccgaacgcagaaaagatgaacgaaccaaaacggctgaaaaaacacctgcctcagatcttgaagctgttgaaacccgatgacaggattctgatcgtggggacgactcgtcggccatttgacgccgagctgcagtcattctgcaaggtgtatcaaaagattatcttagtccctaggcccgattacgcaagcagatacgtgttatggaagcagatcattgagagaaacggaggcgtactaacatccgcattgaatgtgagctgtctggcaaaagttacggacggcttcactcagggacatattgttgaggtagtgaaaggcgtcttgacagaccagcgtatccgccggcagatacacaagccgcttactgcagtggagttcatcacagctatcacctctatgaatccagtttacaaagaggaggaagagtcttttaagaactggtacgctaaaacccctctgggaaaaaagagagcgttagccatcaccggaggttctacagaaaaggccaaggacaagggcaagcgcaaatag

SEQ ID NO: 48160 - DNA, 2469 bp, Artificial Sequence
  Description of Artificial Sequence: Synthetic coding sequence
atgagcaacgccatgtacaacaagatgtggcaccagacccaggaggcgttgggagccctgctggataaggagccacagaaaatgatagaaccccagcggaaccaggtgtttatattccaaactttggcaactttctacgtgaagtatgtgcagattttccggaatcttgaaaatgtttatgaccagtttgttcacccccagaagagaattttgatacgcaaagtgctggacggagtcatggggcggattctcgagctgaagaatgaaatggtcgaactggagttgaccgaattccattatttcgacgatatcttgcaggacctaaagctggcaccacaacaactcgacatccccattcccaaatatttcttaaaggaaaagctggaggtgattaagggtcgcgaaaaaatccttgcacaaatcctggcagattccggaattgacacctccgacatgaagtaccccgtcaaatccattccctttgacgaggccgtcaagctcatccagatagcggagcgggcacgccaagggcgactcagagctctgtttatgaagcagatctacctgcaagaatacagggcaaagcagtccaagatgctcggaaaaaaggtaaccgatacctgggctgctgccctacggattcaaaaagtctggcgtcggttccatcaacgcaaggaaactgaaaaattgagagaggaagagatgatttttctcggcatgaaccctccccctctgtttaatgaagtgtctgccactgtcatccaagctgagaaggtcgataggctgagaaacgaggttcagatcaagcacgaggaggattacagagaagctctggtgactataaaaaacgatctgaagctgatcgagggggtggacattaaagaaaacctccaagatcagattcggcattggtttattgaatgtcgcaatctgactggcacctttccagattatccagatgtggaagagggcgggagcgccatcatcttttccgataagacaattcagcaggtcattgaggacataattgctaaccaggaggaagaggagaagaacaagaaaaagaagaaaaagaaagagaaacaacctaagaaggcgaaaaagcagaaaaaggggactaaggagaagaataaagaagaggatgagaagtggaagatgtctccatctctctttttgcccgctatgaaagagggctgtaacgcttataaggagatatggatgaagaaggatgaatcgtggaatttttcccaagactacgacccagaactgatcaaggaagagaagaggaaggaactccagagcgagattagaatccaagtagatgaactaatgaggcaggaactgaaaaatctgaagctggccgtggacagagaacgggagcgcccagtgaaagcaggaaagaaaaaagacaaaaaggggaagaagggaaagaaaaaggaaaaaaaggccaagaaggataaggatctcacagcagatagaacgattgagagtttgtataaagagcttgtagaagaagggctgttgatccaagctctgaaggtgaatctgagcgattacatcggagaatacagttacctgggcacaacactgcgtcaagttagtatcgagccgatgcctagcctgctggatgttaggcagctcattacgctgtacggcatctggccgttagggtcagcggccgttcacgagaaggcccctctggtgaagtcactcctcctggccggacccagcggtgtcggcaagaagatgcttgttcatgccatctgtactgagaccggcgcaaacctgttcaacctctccagtagcaacattgccggaaagtatcctggcaagaatggactgcaaatgatgctgcatgcagtgttcaaagtagcacgacagttgcagcccagtgtcgtgtggattgaggataccgagaagactttctacaaaaaggtgccaaacgccgaaaagatgaatgagcccaagaggctgaaaaagcatctcccgcagattctgaagctcctcaagcccgatgaccggatcttgatagttggaacaaccagacgcccatttgatgcggagctgcaatcattctgtaaagtgtaccagaaaattatcctggtgcctcggccagattacgcctcccgctatgtcctgtggaagcaaatcatcgaacggaatggtggcgtactgaccagcgccctcaatgtcagctgcctggccaaggtgacagatgggttcacccaaggccatatcgtcgaggtggttaagggtgtactgacagaccaacgtatcagaagacagatacataaacctctcaccgctgtcgaatttatcacagcaataacaagcatgaatccagtatacaaagaggaggaggaatcattcaagaattggtacgccaaaaccccactgggtaagaagcgggccctggccatcaccgggggctcgacagagaaggccaaagataaaggaaaacgaaagtag

SEQ ID NO: 48161 - DNA, 2013 bp, Artificial Sequence
  Description of Artificial Sequence: Synthetic coding sequence
atgtacaacaagatgtggcaccagacccaggaggccctgggcgccctcctggacaaagagccccagaaaatgatagagccccaaagaaatcaggtttttatctttcagacgctggcaaccttttacgtgaagtacgtgcaaatctttagaaatcttgagaatgtatacgatcaatttgtgcatccacaaaagcgaatcctgattagaaaggtgctggacggcgtgatggggcgcatcctcgagctcaaaaatgaaatggtagagctggagttgacagaatttcattacttcgacgacatattacaagatttaaagctcgcccctcagcagttagacatcccaatacccaaatattttctgaaagagaaactggaagtgataaaggggcgggagaagattcttgcacagattttggcagacagcgggattgacaccagcgatatgaaataccccgtcaaatctattccgttcgacgaagccgtcaaacttattcaaattgcggagcgagcccggcaggggcggttacgggcactattcatgaaacagatatatctgcaggaatatcgggcgaaacagtcaaaaatgttaggcaagaaggtgaccgacacctgggccgccgcactccgaatacagaaagtttggagaagatttcatcagcggaaagaaactgagaagctgcgagaggaagagatgatctttctgggcatgaaccctccacctttatttaacgaagtgagcgccactgtcatccaggccgaaaaggtcgaccgattacgcaatgaagttcaaatcaagcacgaggaagactacagagaagcccttgtgaccataaagaatgatctgaaactgatcgaaggtgtcgatatcaaggaaaatctgcaggatcagatcagacactggttcatcgagtgtcggaatctcacaggcaccttccctgattaccccgatgttgaggaagggggatctgccatcatcttttctgacaaaacaattcagcaggtgatcgaagatattattgcaaaccaggaagaagaggaaaaaaacaaaaaaaaaaagaagaagaaggagaaacagccgaagaaagccaagaagcaaaagaagggcacaaaggaaaagaacaaagaggaggacgaaaaatggaaaatgtccccgagcctgttcctaccagcgatgaaggagggctgcaacgcttataaggagatatggatgaagaaggacgagtcgtggaatttctcacaggattatgatcctgagctgattaaggaggagaagaggaaggaactccagtccgagattcgtatccaggttgacgaactcatgcgtcaagagctaaagaacctgaaactagcagtcgatcgcgaacgcgaaagaccagtgaaggccggaaagaaaaaagacaagaaaaaaggcaagaaaggcaaaaagaaagaaaaaaaagccaagaaagacaaagatttgactgccgatagaactattgaatctctgtacaaggagcttgtggaagagggactactaatacaggcactgaaggtgaatctgagtgattacattggggagtactcctacctgggcactactctacgccaggtgagcatagagccaatgccaagcctcctcgatgtccgccagcttatcacgctgtatgggatatggcctctcggatccgcggccgtgcacgagaaagcacccttagttaaaagcctactcctcgccgggcctagcggggtcggcaagaaaatgctggtacacgcaatatgcacagagacaggcgctaacctttttaacctgtcttcttccaacatagccggtaagtatcccgggaagaatggactccagatgatgctgcatgccgtcttcaaggttgcgcgccagcttcaaccttctgtggtttggatcgaagataccgaaaagacattttacaagaaggtccccaacgctgaaaagatgtttactccatcagctggtgaagtggccgccctccagaaaaatctcaagcgttccacaagtcggtag

SEQ ID NO: 48162 - DNA, 2346 bp, Artificial Sequence
  Description of Artificial Sequence: Synthetic coding sequence
atgagcaacgccatgtacaacaagatgtggcaccagacccaggaggcactgggcgccttgctggataaggagccacaaaagatgatagagccacagaggaatcaggttttcatatttcagaccctcgccactttttatgtcaagtatgtccagatcttcaggaatctggaaaacgtgtacgaccaatttgttcacccccagaagcgaatcctgattaggaaggtactggatggcgtgatggggaggatcctcgagcttaaaaatgagatggtggagctggagcttaccgagttccattattttgacgacatcctccaagacttgaaattggctccacagcagcttgatatcccaatcccgaagtatttcttaaaagaaaagctggaagtgatcaaagggagagagaaaatcttggcccagattctcgcagattccggtatagatacatcagatatgaaatacccggtgaagtctatccccttcgatgaggccgttaaactgatccagattgctgaacgtgctcggcaaggccgtctcagggccctgttcatgaagcagatctatcttcaggaatatcgcgccaagcagagcaaaatgctaggcaagaaggtcacggatacatgggctgccgccctgcgcatccaaaaggtttggcgtaggtttcatcagcgtaaggagaccgagaaacttcgagaagaagaaatgatcttcctgggcatgaaccctcctcccctctttaacgaagtgagcgcaaccgtcatccaagccgaaaaggtcgaccgcctaagaaatgaagtccagattaagcatgaagaggactaccgcgaggcgctggtgacgattaagaacgatcttaagctgatagagggtgtcgatattaaggaaaacctgcaggatcagatcaggcactggtttatagagtgtcgaaatctgaccgggacctttcctgattatccagacgtggaagagggtggctcagccattatcttcagcgacaaaaccatccagcaagaggaagatgaaaaatggaagatgtctccgtctttattcctgccggccatgaaagaggggtgtaatgcttataaggaaatctggatgaagaaggacgagagttggaatttcagccaagattacgaccccgaactcataaaggaagaaaagaggaaggaactgcagagtgaaatcagaatccaggttgatgagctgatgcgccaggagttgaaaaatctaaaactggccgtcgaccgcgagagggaacgccccgtcaaagctggcaagaagaaggacaagaagggcaagaaggggaaaaagaaagagaaaaaagctaagaaagacaaggacttgaccgcggacagaacaattgagagcctgtacaaagagctggttgaagaaggcttgcttatccaggctctgaaggtcaatctgagcgactatatcggcgaatacagttacctcgggaccactctgcgtcaggtgagtatcgagccaatgccgtctctcctcgacgtccgccagctcattaccctatatggcatctggcctctgggttccgccgctgtgcacgagaaagccccattggtgaagagtttgctgctcgccggcccaagcggcgtaggtaagaagatgctggtgcacgccatatgcaccgagaccggggccaacctttttaatctgtctagctcaaatattgccggcaaataccctggaaagaacggcttgcagatgatgttgcacgccgtgtttaaggtggctagacagttacaaccaagtgtcgtgtggatcgaggacacagaaaaaaccttctataaaaaggtgccaaatgccgagaaaatgaatgagcccaagagactcaaaaaacatctgccacagattctgaaactattaaaaccagacgatcgcattctgattgtgggaacaacccggcgcccctttgatgccgagctgcagtcattctgtaaagtataccagaagatcatactggttccccggcctgactatgcttcccgttacgtcctatggaaacagatcattgaaaggaacggtggggtgctgacttccgcccttaacgtctcgtgcctcgcaaaagtgacagacggcttcactcagggacacattgtcgaggtggtgaagggtgtcctgacagatcagagaatccggaggcaaatccacaagcccctgaccgccgttgagttcatcactgccattacctcaatgaatcccgtgtataaggaagaagaggaatcctttaaaaattggtatgctaaaactcccctgggaaagaagcgggccctggccatcactggtgggtccactgaaaaggcaaaagacaaaggcaagaggaaatag

SEQ ID NO: 48163 - DNA, 2493 bp, Artificial Sequence
  Description of Artificial Sequence: Synthetic coding sequence
atgacccccagcctgagcgccgaggagaaccggatgtacaacaagatgtggcatcagactcaggaagctcttggtgcactgctggataaagagccccaaaagatgatagagccccaacggaaccaggtgttcatcttccaaaccttagctacgttctacgtaaaatacgtgcaaatttttaggaacctggaaaatgtctacgatcaattcgttcatcctcagaagcggattttgatccggaaggtcttggacggtgtcatggggcgaattcttgaactcaagaacgaaatggttgaactggagttgactgagttccattactttgacgatatcctccaagatcttaagctggctcctcagcagcttgatatcccaatcccaaagtacttcctcaaggaaaagctggaggtgatcaagggccgcgaaaaaatactggcccaaatcctggccgacagcgggatcgatacctccgacatgaagtatcctgtgaaatcaataccatttgatgaggcggtgaaattgattcaaatcgctgagagagctcgtcagggtcggctgagagcactgtttatgaaacagatctatcttcaagaatacagggcaaagcagtccaagatgctggggaagaaggtaacagacacatgggctgcagcactgagaattcagaaggtgtggcggcgcttccatcagcgaaaagagaccgagaagttaagagaggaggagatgatctttctaggaatgaaccccccacccctgttcaacgaagtgtcagccaccgtgatacaggctgaaaaagtggatcggctgaggaatgaggtgcagatcaagcatgaggaggactatagggaagctctggttaccatcaagaatgaccttaagctgattgaaggtgtggacatcaaggaaaacctgcaagatcagataaggcattggtttatcgagtgccgaaaccttacgggcacgtttcctgactaccctgacgtggaggaaggcggcagcgccattatattctccgataagacgattcaacaggtcatcgaggacataatagctaaccaggaagaggaagagaagaataagaagaagaaaaaaaaaaaggaaaagcagccaaagaaagctaaaaagcagaaaaagggaacaaaggaaaaaaataaggaggaggacgaaaagtggaaaatgagcccatctctgttcctcccagcaatgaaagaagggtgcaacgcctataaggagatttggatgaagaaggatgagtcttggaatttctcccaggactacgaccccgaactgatcaaggaagagaagcggaaagagttgcagagcgaaattagaattcaggttgatgagttgatgcgccaggaactgaaaaacttgaaactcgcagtagatagggaaagagaacgaccagtcaaggccggcaagaaaaaggataagaagaagggcaagaaagggaaaaagaaggaaaagaaagctaaaaaggataaagacttaacagctgacaggaccattgagtccctctacaaagagttagtggaggaaggtctactcatccaggcccttaaggtaaatttaagtgactatatcggcgaatacagctacctgggtactaccctgaggcaggtcagtatcgagccaatgccaagtttactcgacgttagacagctcatcacgctctatggcatctggcccctgggatctgcagcagtgcacgagaaggctccactcgtgaagagcctgctcctcgcgggtcctagcggcgtggggaaaaaaatgcttgtccacgctatctgcacagaaacaggggcgaatttgtttaatctctctagctcaaatatcgctgggaagtaccccggcaaaaatggattgcagatgatgctgcatgccgtttttaaggtggccagacagttacagccaagcgtggtttggattgaagacaccgaaaaaactttttataagaaagtgcccaacgccgagaaaatgaacgagcctaagcggttgaaaaaacatctgccccaaattttaaagctgttgaaacctgatgaccgaatcctcatcgtggggacaacacgccgaccttttgatgccgagttgcagagcttctgtaaagtttaccagaaaattatacttgtgccgaggcccgactacgcctctaggtatgtgctctggaagcagatcatcgaaaggaacggcggggtgttgacttctgccctgaacgtttcgtgtctggcgaaggttactgacggatttacgcaaggacacatagtggaagtggtgaagggagtcctcaccgatcagcgaatccgaaggcagattcacaaacctctcaccgccgtggagttcattaccgccatcacctctatgaacccagtttacaaggaggaagaagagtccttcaaaaactggtatgccaaaactcccctgggcaagaagagggctcttgcgatcacaggcgggagcactgagaaagccaaagacaaaggcaaacgtaaatag

SEQ ID NO: 48164 - DNA, 1449 bp, Artificial Sequence
  Description of Artificial Sequence: Synthetic coding sequence
atggacagcttcggccagccccggcccgaggacaaccagagcgtggtgaggcgaatgcagaaaaaatactggaagacaaagcaggtgttcataaaagccactgggaaaaaggaggacgagcatcttgtcgcaagtgacgcggaactagatgccaaactagaggtgttccatagtgtccaggaaacctgtactgagttactcaagatcattgagaagtatcagctgcgcctcaacgtgatctctgaggaggagaacgagctaggcctgtttcttaagttccaagcagaacgtgacgccacgcaagccgggaagatgatggatgccactgggaaggccctgtgctcatcagcaaagcagaggctagccctgtgtacaccactgtccaggctgaagcaggaggtggcgacattctcacagagagcggtcagtgatactctcatgactatcaatcggatggaacaagccaggaccgaataccggggcgctttgctgtggatgaaggatgtgtcccaggagctcgatccagacacgctgaaacagatggaaaagttccggaaggtgcaaatgcaggtccgcaatagcaaagcaagctttgacaaactcaaaatggacgtctgccagaaggtggacctcttaggagctagccgttgtaacatgctgagtcacagcctaactacctaccaaaggacactcttgggattttggaaaaagaccgcaagaatgatgagccagattcacgaagcctgcatcggattccacccttacgattttgttgccctgaagcagcttcaggatactcccagcaaaatctccgaggataacaaggacgagcagattggcgggttcctcacagaacagcttaacaaactggtgctgtcagacgaagaggcgtccttcgaaagtgagcaggcaaacaaagatcacaatgaaaaacacagccagatgcgtgagtttggagcccctcagtttagtaattctgagaatgttgccaaagatctgcctgtagattcgctggaaggcgaggactttgaaaaagaattttcctttctgaacaatctgctctcttctggttcctcttccacaagcgagtttacccaggaatgccagacggcttttgggagcccttccgccagccttacatctcaggaaccaagcatggggtcagaaccactggcgcactcttctcgcttcttaccctctcagctcttcgacctggggttccacgtggccggcgctttcaataactgggtgtcacaagaagaaagcgagctctgtctgtcccataccgacaaccaaccggttccatcacagagccctaaaaaactgacaaggagtccaaacaatggcaaccaagatatgtccgcttggttcaatctgttcgccgacctcgaccccctgagcaatcccgacgctattggacatagcgatgatgagttgttgaatgcgtag

SEQ ID NO: 48165 - DNA, 1449 bp, Artificial Sequence
  Description of Artificial Sequence: Synthetic coding sequence
atggacagcttcggccagccccggcccgaggacaaccagagcgtggtgagaaggatgcagaagaaatattggaagactaaacaggtctttattaaagctacggggaaaaaggaagacgaacacttagtcgctagcgacgctgaactggacgcgaagctggaggtgtttcattcagtgcaggaaacatgcaccgaactgctgaaaataatagagaaataccaattaagactcaatgttatatctgaagaggagaacgaactgggcttgttcctgaaatttcaagctgaacgcgatgcgacacaggccggaaaaatgatggacgcaacaggcaaagcgctgtgctcgtccgcaaagcagcgtctggcattgtgtacccctctatctcgcctgaaacaagaggtagctacattctcccaacgggcagtatctgataccctgatgactataaacagaatggaacaggccagaacggagtacagaggagcactgttatggatgaaagacgtaagtcaggagctggatccggacacactgaagcaaatggaaaagtttcggaaggttcagatgcaggtgcgtaattctaaggcctcgttcgacaaactgaaaatggacgtctgtcagaaggttgatctcctaggcgccagccggtgtaatatgctgtcccattctctcaccacttatcagaggactctcttgggattctggaagaagaccgccagaatgatgagtcaaatccacgaggcctgtataggctttcacccatacgatttcgtggcacttaaacagctccaggacacaccttccaaaatatcggaggataataaggatgaacagatcggaggattcctcacggagcaactaaataagctggtactttcagacgaagaggcctctttcgagtccgagcaagccaacaaagaccacaacgagaagcacagccagatgagggagttcggggcccctcagtttagtaactcagaaaatgtggccaaggacctgcctgtggactcactcgaaggagaggattttgagaaggaattcagtttccttaacaatctactctcaagtgggagctccagcactagcgaatttacccaggagtgtcagacagcgttcggttctccctctgcctcactgactagccaggaaccttcaatggggagcgagcctctggctcactcctctaggtttcttccaagccaattgttcgacctaggattccatgtcgccggagccttcaacaattgggtatctcaggaggagtccgagctgtgtctcagccacaccgacaatcagcctgtgcccagccagtcaccaaaaaagctcacccgcagcccaaataatggcaaccaagatatgtctgcttggttcaacctgttcgccgatctcgatcccctctctaacccagacgccattggtcattccgatgatgaacttcttaacgcctag

SEQ ID NO: 48166 - DNA, 237 bp, Artificial Sequence
  Description of Artificial Sequence: Synthetic coding sequence
atggacagcttcggccagccccggcccgaggacaaccagagcgtggtcaggaggatgcagaagaaatattggaagaccaaacaggttttcattaaagccacaggcaagaaggaagacgagcatctggtcgcatccgacgcagagctggacgcaaagctcgaggttttccacagtgtccaggagacttgtacggaactacttaagattatcgagaaataccagttacgtcttaattag

SEQ ID NO: 48167 - DNA, 360 bp, Artificial Sequence
  Description of Artificial Sequence: Synthetic coding sequence
atggacagcttcggccagccccggcccgaggacaaccagagcgtggtcaggcggatgcaaaaaaagtattggaagacaaagcaagtgttcatcaaggccactgggaagaaggaggacgagcatttggttgcctcagatgcagagttggatgcaaaattggaggttttccattccgtccaggagacctgtaccgagctccttaagattattgagaaataccaactgaggctgaatgttattagtgaagaggagaatgagctcggtcttttccttaaatttcaggccgaacgcgacgcaactcaggccgggaagatgatggatgccaccgggaaagccctgtgctcctcagcaaaacagtag

SEQ ID NO: 48168 - DNA, 297 bp, Artificial Sequence
  Description of Artificial Sequence: Synthetic coding sequence
atggacagcttcggccagccccggcccgaggacaaccagagcgtggtgcgccgcatgcagaaaaaatactggaaaactaaacaggtgtttataaaagctactgggaaaaaggaggacgaacatctggtggcatctgacgccgaactagacgcaaagctggaggtgttccactccgtgcaggagacatgcacagaactactgaaaattatcgagaaatatcagctcaggctaaacgtaataagtgaagaagaaaacgagttgggcctatttctgaagttccaagcagaacgcgattag

SEQ ID NO: 48169 - DNA, 375 bp, Artificial Sequence
  Description of Artificial Sequence: Synthetic coding sequence
atggacagcttcggccagccccggcccgaggacaaccagagcgtggttcgccgtatgcagaagaaatactggaagacaaaacaggtattcataaaggctactggaaagaaagaagacgagcatttggttgcctccgacgctgagctggatgctaaactggaggtgttccactctgtgcaggaaacatgtacagaactgctcaaaattattgagaagtaccagttaaggttaaatgtgatcagtgaggaggaaaatgaacttgggctgtttctgaaattccaggcagaacgcgatgccacacaggctggaaagatgatggatgcgactggaaaggctttgtgtagttctgcaaaacagcggctggcactgtgctag

SEQ ID NO: 48170 - DNA, 129 bp, Artificial Sequence
  Description of Artificial Sequence: Synthetic coding sequence
atggacagcttcggccagccccggcccgaggacaaccagagcgtggtgagaaggatgcagaagaaatactggaaaaccaagcaggtttttatcaaagcgacaggtaaaaaggaagacgaacatttatag

SEQ ID NO: 48171 - DNA, 300 bp, Artificial Sequence
  Description of Artificial Sequence: Synthetic coding sequence
atggacagcttcggccagccccggcccgaggacaaccagagcgtggtcaggcggatgcagaagaaatattggaagacaaagcaggtgtttatcaaagcgacgggcaaaaaagaggacgaacacctcgtggcaagcgacgcagagctggatgctaagctcgaggtcttccacagcgtgcaggaaacttgtacagagttgctgaagatcatagagaagtaccagttacggctgaacgttatctccgaagaagaaaacgagctgggcttatttttgaagttccaggctgaacgagacgcttag

SEQ ID NO: 48172 - DNA, 405 bp, Artificial Sequence
  Description of Artificial Sequence: Synthetic coding sequence
atggacagcttcggccagccccggcccgaggacaaccagagcgtggtcaggcggatgcaaaaaaaatattggaagacaaagcaggttttcatcaaggctaccggaaagaaggaggacgagcatcttgtggcaagcgacgctgaattggatgccaagctggaggttttccattcagtgcaggagacctgcaccgagctcctcaagataatcgagaagtatcagttaaggctgaatgttatttccgaagaggaaaacgaactgggactgttcctcaagttccaggctgaacgtgacgctacgcaggccggcaagatgatggatgccacagggaaggctctttgcagcagcgcaaaacaacggctggcactgtgtactcctctgtcccgactgaagcaagaagtttag

SEQ ID NO: 48173 - DNA, 360 bp, Artificial Sequence
  Description of Artificial Sequence: Synthetic coding sequence
atggacagcttcggccagccccggcccgaggacaaccagagcgtggtaagacggatgcagaagaaatactggaagaccaaacaggttttcataaaagctaccggaaaaaaggaggacgagcatctggttgccagtgatgcagagctggacgccaagcttgaagtgtttcactctgttcaggaaacctgcacagagttactcaagatcatcgaaaaataccaactgcggctgaacgtgatctccgaggaggagaatgaattggggctctttctaaaattccaggccgagagggatgctacgcaagcagggaagatgatggacgcaacaggcaaggcactgtgcagctcagccaaacagtag

SEQ ID NO: 48174 - DNA, 456 bp, Artificial Sequence
  Description of Artificial Sequence: Synthetic coding sequence
atggacagcttcggccagccccggcccgaggacaaccagagcgtggttcgccggatgcagaagaagtactggaaaactaaacaggtgtttataaaagctactggcaagaaagaggacgaacacctggtggcgagtgacgcagagctggacgccaaactcgaagtgttccacagcgtgcaggagacttgtacagaactcctcaagataatcgagaaatatcagctgcggcttaatgtgatctccgaggaggagaatgaactggggctcttcctgaagtttcaggcagagcgcgatgccacacaagctggcaaaatgatggatgccacagggaaggctctgtgctcatccgccaagcaacgcctcgccctgtgtacacccctctctagattgaagcaagaggttgccaccttttctcagagagctgtgtctgacaccctaatgaccatcaacagatag

SEQ ID NO: 48175 - DNA, 294 bp, Artificial Sequence
  Description of Artificial Sequence: Synthetic coding sequence
atggacagcttcggccagccccggcccgaggacaaccagagcgtggtgcgcagaatgcagaagaaatactggaagaccaagcaggttttcattaaagccaccggtaagaaggaggacgagcacctggtggcctcagacgcagaactggatgcaaaactggaagtcttccattctgttcaggagacctgcactgaactgttgaagatcattgagaagtatcagctgagactgaacgtgatcagtgaagaagaaaacgaactgggtctgttcctgaaattccaagctgaaaggtag

SEQ ID NO: 48176 - DNA, 303 bp, Artificial Sequence
  Description of Artificial Sequence: Synthetic coding sequence
atggacagcttcggccagccccggcccgaggacaaccagagcgtggtgaggcgcatgcagaaaaaatactggaaaactaaacaggtattcatcaaagccacaggcaagaaagaggacgaacacctggtcgcctccgacgctgagttggacgctaagctcgaggtatttcattcagtacaggagacctgtactgaactgctgaagatcatcgagaaatatcaactgcggctcaacgttatcagcgaagaggagaacgaactcggcttatttctgaaattccaggcagagagagacgctacttag

SEQ ID NO: 48177 - DNA, 408 bp, Artificial Sequence
  Description of Artificial Sequence: Synthetic coding sequence
atggtgcagtacctgaagagcgtggacatccccgagaaccgggtgatcctgatcacacctactcctctgtgtgagaccgcctgggaagagcagtgtattatccagggttgcaagctgaacaggctgaatagtgtggtaggcgagtacgccaatgcatgtctacaagttgcgcaggattgcgggaccgacgtgctggatctatggacacttatgcaggattcacaggactttagcagctatttgtctgacggcttacacctctctccaaagggaaatgaatttttgttcagccatctttggcccctcattgagaaaaaagtatcctcactgcctcttctgctgccatattggcgagacgttgcggaggccaagcctgagctgagcctgctgggagatggcgaccattag

SEQ ID NO: 48178 - DNA, 747 bp, Artificial Sequence
  Description of Artificial Sequence: Synthetic coding sequence
atggccctgtgcgaggccgccggctgcggcagcgccctgctgtggccccgcttgctccttttcggtgattcaattactcagttctccttccaacagggaggctggggggcaagtttggccgacagattggtgcgcaagtgtgacgtccttaataggggattcagtgggtataacacacggtgggcaaaaattattcttccccggttgataagaaaaggcaacagtctggatatcccggtcgctgtgacaatattcttcggcgccaacgactccgcactcaaggacgaaaacccaaaacagcatatccccttagaggaatatgctgctaacctcaaaagtatggttcagtacctgaagtccgttgatattccggaaaaccgggtaatcctcattacccctacacccctgtgtgaaaccgcctgggaagagcagtgcataattcaaggctgcaagctgaatcggttgaactctgtggtgggcgaatacgcaaatgcctgtctgcaggtggctcaggactgtgggaccgatgttctagatctgtggaccctgatgcaggattcccaagacttttcatcatatctgagtgacggccttcatctgagtcctaagggtaacgagttccttttcagtcatctgtggcctctgatagagaaaaaggtgtcttctctgccactgctcctaccttactggcgggacgtggctgaggccaaaccggaactaagcctgttaggagatggcgatcattag

SEQ ID NO: 48179 - DNA, 408 bp, Artificial Sequence
  Description of Artificial Sequence: Synthetic coding sequence
atggtgcagtacctgaagagcgtggacatccccgagaaccgggtgattctgatcacacctaccccactgtgcgaaaccgcttgggaagagcagtgtatcatccaagggtgtaaactcaatcgattgaactctgtcgttggcgaatatgctaatgcgtgccttcaggtggcccaggactgcggcaccgacgttctcgacctgtggacactaatgcaggactcccaagacttttcatcatatctttcagacgggctgcacttgagtccaaaaggcaatgaatttctcttctcacatctctggcccctaattgagaaaaaggtgtccagtctgcctcttctgctaccttattggcgagacgtcgctgaagccaagcccgagttaagcctgctgggcgacggcgaccattag

SEQ ID NO: 48180 - DNA, 1356 bp, Artificial Sequence
  Description of Artificial Sequence: Synthetic coding sequence
atggaggccggcccccccggcagcgcccggcccgccgagcccggcccttgcctttctggccagaggggtgccgatcacaccgcctccgcctccctgcagtctgtcgccggaacggaacccggtcggcacccccaggccgtggccgcagtgttgcctgctggaggatgcggagaaaggatgggagtgcctacccccaaacaattttgtccaatcttagagcggcccctaatttcttatacactgcaggccttggagcgagtgtgctggatcaaggatatagtagtggcggtcacaggggaaaatatggaggtgatgaaaagtatcatccagaagtatcagcataaaaggatctcattggtcgaggctggggtgacacggcatcggagtatatttaatggccttaaagccttagctgaagatcagataaactccaaactctctaaacctgaggtcgtgattatccacgatgctgtgcggccattcgtggaggagggggtgctcttgaaggtcgtgacagcggctaaggagcatggagccgcgggtgccatacggcccctcgtgtcaaccgtggtttcccctagcgcggatggatgtcttgattactcactcgaaagagcccgccaccgggctagtgaaatgccccaggccttcctcttcgacgtgatttatgaagcataccaacagtgttcagactacgacctggagttcggcaccgaatgcctgcagctcgccctaaaatattgctgcactaaggccaaactggtcgaaggttcccctgacctgtggaaggtgacatataagcgtgatctgtacgctgccgagtccatcatcaaggaaagaatctctcaggagatttgtgtagtgatggacaccgaagaggataataaacacgtcggccacttgctcgaggaggtgctgaagagcgagttaaatcacgtgaaggtgacgagcgaagccttaggtcatgcaggcaggcacctccagcagatcattctggatcagtgctataactttgtttgcgtgaatgtcactacaagcgatttccaggagacgcaaaaactcctctccatgctggaggagtcttcactgtgtatcctgtaccctgttgtagtggtttcggtccattttctagattttaagctggtgccaccatcgcagaaaatggaaaacttgatgcaaataagggagttcgccaaggaggtaaaagagcgcaatatcctgctgtatggcctgctgatcagctaccctcaggacgatcagaaactccaagagagcctccggcagggagctatcataatcgcgtcactcatcaaagagcgcaattcaggcctgattgggcaactcctgattgcctag

SEQ ID NO: 48181 - DNA, 996 bp, Artificial Sequence
  Description of Artificial Sequence: Synthetic coding sequence
atggcccggaacgccgagaaggccatgaccgccctggcccggttcagacaggcacaactggaggagggcaaggtgaaggaaaggagaccatttctggccagtgaatgtacagagttgcccaaagccgagaagtggcgccggcaaattatcggcgaaatttctaagaaggtggctcaaattcaaaacgccgggctgggagagtttaggatccgagatctgaatgatgaaatcaacaagctcctgagagaaaagggccactgggaagttcggattaaggaactgggggggccagactatgggaaagtcggtcccaaaatgttggaccacgagggcaaggaagtgcctggcaatagaggttataaatacttcggagctgcgaaggacctccctggggtgcgcgagctcttcgagaaggagcccctccccccccctcgcaagactcgcgccgagctgatgaaggccattgattttgagtactatggatatctcgacgaggatgacggcgtgatcgttccattggaacaagagtatgaaaagaaattaagagctgagctcgtggaaaaatggaaagcggagcgtgaagcgcggcttgctaggggggaaaaagaagaggaggaggaggaggaagaagaaattaatatctatgctgtgaccgaagaggagagtgatgaagaaggatcccaggagaaggggggagatgattcacagcagaaatttattgcgcacgtccctgtcccttcacaacaggagattgaagaggccctggtgaggaggaagaaaatggaactcctccagaagtacgcctctgagactctccaagcccagtctgaggaagctcggcgtctgctgggttgcagatccggcaccagacccgcccgaagcggcagcgcacctagccctagagcaacaaccgcggtccccatggggccatccctacccacgacctctccccggggggccccaagctgccgatgcctcaccgggttacgaatgtag

SEQ ID NO: 48182 - DNA, 1671 bp, Artificial Sequence
  Description of Artificial Sequence: Synthetic coding sequence
atggccagcaagcccgccgccggcaagagccggggcgagaagcggaagcgggtggttttaaccttgaaagaaaaaattgatatttgcaccagactggagaagggagaatccaggaaagccttgatgcaagagtataacgtcggtatgtccacattgtacgacattcgtgcgcacaaagcccagttactgagattttttgcttccagcgattcaaacaaagccctggagcaacggcgcacattacacacacccaagctcgagcatctggatagagtgctgtacgaatggtttctgggtaaacgatctgagggagtacccgtttcaggtcctatgttaatcgagaaggcaaaggacttctacgagcagatgcagttaaccgaaccttgcgtgttttctgggggatggctttggcgattcaaggcgcggcatggaatcaaaaagctagatgctagctcagagaagcaatctgcagaccatcaggccgctgaacaattctgcgcattctttaggagcctcgccgccgagcacggcctttctgcagaacaggtttacaatgccgatgagaccgggctgttctggaggtgtttaccaaaccctacccccgaggggggagccgtgccaggtcctaagcaggggaaggacagactgacagtgcttatgtgcgcgaacgcaactgggagtcacagattgaagcccttggccatcggcaaatgcagtggccccagggccttcaagggtattcagcacttgccggtggcatacaaagcacagggcaatgcttgggtagataaagagatattttctgattggtttcatcatatctttgtcccgagcgtcagggagcacttccgcaccatcggcctgcctgaggatagcaaagccgtgctgttgctggactcctcccgggcccatccacaggaggccgagctggtgtccagcaatgtgtttaccattttcctgcccgcctctgttgcgagccttgtgcagcccatggagcaagggataaggcgggacttcatgaggaatttcatcaatcctcctgtgcctttgcaggggcctcacgcaaggtataatatgaacgatgctattttttctgtagcctgcgcctggaatgcagtaccctctcacgttttccgtagggcatggaggaagctctggccctcagtcgcgttcgcagagggctctagtagtgaagaagagcttgaagccgaatgttttcccgtgaagccacataataagtcgttcgcgcatattctggagcttgtcaaagaagggtcaagctgtcccggccagctgaggcagcgccaggcagcgtcttggggtgtggctggacgagaggcagaaggtgggcgaccgccagccgctactagtcccgcagaggtggtctggtcatccgagaaaactccaaaggcggatcaagatggacgaggcgacccaggagaaggagaagaagtggcctgggagcaagccgccgtggcattcgatgccgtgttaagattcgccgaacgccagccctgctttagcgcgcaggaagtcggccagctgcgcgcactgagggccgtttttaggagccaacaacaggaaactgttggactagaggatgtggtggtgacaagccccgaggaactcgcgattcccaaatgctgtcttgaggccagcaccgagacatag

SEQ ID NO: 48183 - DNA, 1707 bp, Artificial Sequence
  Description of Artificial Sequence: Synthetic coding sequence
atggccagcaagcccgccgccggcaagagccggggcgagaagcggaagcgtgtggttctgacccttaaagagaaaattgatatttgtacccgtctggaaaagggagagtcacggaaagcgctcatgcaggaatataatgtcggcatgtccaccctgtacgacatccgagcacacaaggctcagttactcaggttttttgccagctcagattccaacaaggccctggaacaacggaggacactccatacccctaagctggaacacctggatcgagttctctatgaatggttcttaggcaagcggtctgaaggagtgcctgtgtctgggccaatgctgatagagaaggctaaagatttttatgaacagatgcagctcacagagccatgcgtgtttagcgggggctggctctggcgttttaaagcgcggcacggaatcaaaaagctggacgcctcttccgaaaaacaatccgctgatcaccaggcggcagaacagttttgcgcgtttttcaggtcactagccgctgaacacggactctcagctgagcaggtttacaacgctgacgagactggcctgttttggcggtgcctgcctaatccaaccccggagggaggcgccgtgccggggccaaagcaaggtaaagaccggctgaccgttcttatgtgtgctaacgctaccggtagccatcgtctcaaacctttagccataggaaaatgctccggacctagagcattcaaagggatccagcacctccctgtcgcctacaaagctcaaggaaacgcctgggtggacaaggaaatattcagtgattggtttcaccacattttcgtaccctccgtgcgggagcactttcgcaccattggcctcccagaagattcgaaagccgtcctcctgttggactctagccgagcccatcctcaggaggccgagctggtgagctcaaacgtctttacaatatttctacctgcatccgtggcatccttagttcagccaatggagcaggggatccgcagagatttcatgagaaattttattaatccaccagtgcctctccaaggtccacatgcccgatataacatgaatgatgccattttctccgttgcctgtgcttggaatgcggtaccttcccacgtgttcagaagagcctggcgtaaactgtggccctcggtagcatttgccgagggatcttcctcagaggaagaactggaagcagaatgctttccagtgaagccccataacaagtcatttgcccatatactggaacttgtgaaggagggaagctcatgtcctgggcagctgcgacagcgccaggcagccagctggggcgtcgcgggccgtgaagcggaggggggtcggcccccagctgccacctcccccgccgaagttgtttggagctccgagaaaacccccaaggctgaccaggacggcagaggagatccaggtgagggggaagaggtagcttgggagcaagccgccgtggcttttgacgccgtgctgcgctttgcagagagacagccctgtttctctgcccaagaggtcggccagcttagagcgctgcgagcagtgttccggtcccagcagcaggtgaggcggcgccgaggtgcactcggagccgtggtgaaagtcgaggcactacaggagggtccaggcggctgtggtgcgaccgctcagtcacctttgccatgctctagcactgcaggagacaactag

SEQ ID NO: 48184 - DNA, 960 bp, Artificial Sequence
  Description of Artificial Sequence: Synthetic coding sequence
atgaagggcgagatccagcagagcctgggcgcctgggtgctgctgacttgcctgggcctatactgtggcaaaacactgttgtttaagaacggatcaacagaaatttatggcgagtgtggggtttgtcctcgcggccagagaactaatgcccagaagtattgtcagccatgtacagagagtcctgaactctatgactggctgtacctcgggtttatggccatgctccctcttgtgttacattggttttttatagagtggtattccggcaaaaaatcgtctagcgctttgttccagcatataacagcgctattcgagtgctctatggccgccattatcacactcctggtttccgacccggttggtgtgttgtatatccgatcttgcagagtgctgatgctctctgactggtatacaatgctttacaacccaagcccggactacgtgaccaccgtgcattgcacacatgaggccgtgtacccactttacacgatcgtctttatttactatgcattttgtcttgtacttatgatgctgctgcggccactgttggtcaaaaaaatagcgtgtggcttaggcaaatccgaccgctttaagagcatctacgcagctctgtacttttttcccatactgactgtgcttcaggctgtggggggcggacttctgtactatgcgtttccctacatcattcttgtgctcagcctcgtgacattagccgtttatatgtcagcaagcgaaatcgaaaattgctatgaccttcttgtgcgcaaaaagcgactcattgtgctcttttcacattggctacttcacgcctatgggatcatctctatctcgcgcgtggacaaactggaacaggatttgccactgctggccctggttcccacacccgccctgttttatttgtttacggcaaagttcaccgagccatctcggattctgagcgagggggctaacggtcattag

SEQ ID NO: 48185 - DNA, 936 bp, Artificial Sequence
  Description of Artificial Sequence: Synthetic coding sequence
atggccgtggacatccagcccgcctgcctgggcctgtactgcggcaaaactctgctgtttaagaatgggtcaactgagatctacggcgagtgtggcgtgtgtcccagggggcagcggactaatgcgcagaagtattgtcagccctgcactgaaagcccagagctttacgattggctctatttaggtttcatggcaatgctgcccctcgttctgcattggtttttcatcgagtggtatagtggcaaaaaatctagttcggctctgttccaacacattacagctctcttcgaatgcagcatggctgctattataaccctgcttgttagcgaccctgtgggcgtgttgtacattcggagttgccgagtgctcatgctttccgattggtataccatgttgtataacccttcccccgattatgttacaaccgtgcactgtacccatgaagccgtgtaccccctgtatacgatcgtgtttatttactacgccttttgtctcgtccttatgatgctgctccgccccctcttggtaaaaaaaatagcttgtggacttggcaagagcgaccgctttaagagcatctatgcggccctgtacttctttccaattcttaccgttctgcaggccgtggggggcggtctcctgtactatgctttcccttatatcatcctggtcttgagtctggtaactctggccgtgtacatgtcggcatccgagatcgagaactgctacgacctgttggtgcgaaaaaagcggttgattgtgcttttctcccattggctgctccacgcctacggcataattagtatctcacgagttgacaagctggaacaggatctgcccttgctagccctggtgcctacgcccgccctgttctatctcttcaccgcaaaatttacagagccctcccgcatcctgtcagagggcgccaacggccactag

SEQ ID NO: 48186 - DNA, 918 bp, Artificial Sequence
  Description of Artificial Sequence: Synthetic coding sequence
atggcctgcctgggcctgtactgcggcaagaccctgctgttcaagaacggatcaacggagatctacggcgaatgcggcgtatgcccaagaggacagcgaactaatgctcagaagtactgtcaaccatgtacggaaagcccagagctctatgactggctgtatctgggcttcatggccatgcttccactggtcctgcattggtttttcatagagtggtacagcggtaagaagtccagttccgcgcttttccagcatattaccgctttatttgaatgttctatggccgctatcatcactctgctggtgtccgaccccgtgggcgttctctatattcgcagttgccgtgtgttgatgttgagtgactggtataccatgctctacaacccatcacctgattacgtgacgactgtgcactgcacccatgaggccgtctaccctttgtataccatcgtgttcatctattacgcgttctgtttggtgctaatgatgttattgcgccccttgctggtcaaaaaaattgcctgcggtttgggtaagagcgaccgctttaagagtatctacgcagctctttattttttccctatcctgaccgttctgcaggcagttggcggcggacttctctactacgctttcccttacattatccttgttctatcgctggtgaccctagccgtgtacatgtctgcctccgagatagagaattgctacgatttgctggtgaggaagaagcgcttgattgttctgttctcgcactggctgctgcacgcttatgggattatttctattagtcgtgtggataagctggagcaagacttgccgctgttagcgcttgttcctactcctgccctgttctacctgtttacagctaagttcaccgagccctcgaggattctatctgaaggtgctaacggtcattag

SEQ ID NO: 48187 - DNA, 1518 bp, Artificial Sequence
  Description of Artificial Sequence: Synthetic coding sequence
atgagccggagctacaacgacgagctgcagttcctggagaagatcaataaaaattgttggaggatcaagaagggatttgtgcccaatatgcaggtggagggcgttttctacgtgaacgacgctctggagaaattaatgttcgaagagctgaggaatgcctgcaggggcggcggcgtgggaggatttctcccagcgatgaagcagataggcaacgtagccgctcttcccggaatcgtgcatcggtcaatcggccttcccgacgttcactcaggctacggatttgccataggcaacatggctgccttcgacatgaatgatcctgaagccgtggtgtctcccggaggtgtgggatttgacattaattgcggggtgagactgctcagaacgaatttggatgagtctgacgtgcagcccgtgaaagagcagcttgcgcaggcgatgttcgaccacatccccgttggtgtgggcagtaagggagttatccctatgaatgctaaggatctcgaggaggccttagagatgggggtggactggagcctccgcgaaggatacgcgtgggccgaggacaaagaacattgcgaggaatacgggcgaatgctgcaggccgatcctaacaaggtctctgctagagcgaagaagcgcggactcccgcagttgggcacgctgggcgctggcaatcattacgcagagattcaggtggtcgacgaaatcttcaatgaatatgcagctaagaagatggggattgatcacaagggacaggtctgcgtcatgattcattccggttccagagggttagggcaccaggtggcgacagacgcactcgtcgcgatggagaaggcaatgaaacgagataaaattatcgtaaacgataggcagttagcttgcgcgcgcattgcttccccggagggacaggactacctgaagggaatggcagccgctggcaattatgcatgggtgaatcgctcttcaatgacttttttgaccaggcaggcctttgcaaaggtttttaataccaccccagacgacttggatctgcacgtgatctacgacgtgagccataatattgctaaagtagaacagcatgttgtggacggtaaagaaaggactctgctggtccatagaaaagggtccacacgagcatttcctccccaccatcccttgattgcggtggactaccaactgaccgggcagcccgtcctgatcggaggtactatgggcacatgttcctatgtgctgaccggcaccgagcaaggtatgacagaaacctttggaacaacttgtcatggagccggtcgcgctttgagtagagctaaatcccgaagaaacctcgacttccaggacgttcttgataagttggccgacatggggatcgctattagagtggccagtcctaagcttgtgatggaggaggcccccgagtcatacaaaaacgtgaccgatgttgtcaatacatgccacgacgcaggaattagcaagaaggctattaaactgcggccaatcgccgtgattaaggggtag

SEQ ID NO: 48188 - DNA, 315 bp, Artificial Sequence
  Description of Artificial Sequence: Synthetic coding sequence
atgagctgcgtgccctggaagggcgacaaggccaagagcgagagcttagagctgccccaggccgcccctcctcagatttaccatgagaaacaacgaagagaattgtgtgccctgcatgctctcaataacgtgtttcaggattccaacgcatttaccagagacaccctgcaagaaatctttcagcggctgagtccaaacacaatggtgacaccccacaaaaagtccatgttgggtaatggtaattacgatgtgaatgttatcatggccgcactccagactaagggctacgaagccgtgtggtgggacaagcggtag

SEQ ID NO: 48189 - DNA, 189 bp, Artificial Sequence
  Description of Artificial Sequence: Synthetic coding sequence
atgagctgcgtgccctggaagggcgacaaggccaagagcgagagcctggagctcccacaggctgcccccccgcagatttatcacgaaaaacaaagacgggagttatgtgctctgcatgctcttaataacgtctttcaagactccaacgcattcactagagatactctgcaagaaatcttccaacgctag

SEQ ID NO: 48190 - DNA, 186 bp, Artificial Sequence
  Description of Artificial Sequence: Synthetic coding sequence
atgagctgcgtgccctggaagggcgacaaggccaagagcgagagcctagagctgcctcaggcggctccaccccagatttaccacgagaaacaaaggcgagaactttgcgcacttcacgcactaaataatgtgttccaggattctaatgcatttacacgcgataccctccaggaaatttttcagtag

SEQ ID NO: 48191 - DNA, 627 bp, Artificial Sequence
  Description of Artificial Sequence: Synthetic coding sequence
ggcgacgccgagacccccggcagcgtggagcggcggggccggcggggtgccgaagatgggatgtcccaggctcccggggcacagcccagcccccccacagtataccacgagcgtcagcgcctcgaactgtgtgcggtgcacgcgctgaataacgtgttgcaacagcagctcttttcccaggaagcagctgacgagatatgcaagaggctggctcctgattcacggcttaatccccataggtccctactcggaacgggaaattacgatgtgaacgtcatcatggctgctctccagggtctgggcctcgctgccgtttggtgggatcggcgacgacctcttagccagctagccttaccccaggtgctcggccttatccttaacttgccttcccctgtgtctttagggctgttatctctgcccttgcgtagaagacactgggtggccctaaggcaggttgacggagtctactataatctagactctaaactgcgcgcccctgaggcactcggggacgaggatggcgttagagcattcttggcagcagctctggctcaggggctatgtgaggttcttctcgtagtgaccaaggaggtcgaggagaagggctcttggctaaggactgattag

SEQ ID NO: 48192 - DNA, 567 bp, Artificial Sequence
  Description of Artificial Sequence: Synthetic coding sequence
atgagccaggcccccggcgcccagcccagcccccccaccgtgtaccatgaacgtcagcgcctcgagctctgtgctgtgcacgccctcaacaatgtgctccagcaacagctgttctctcaagaagcggctgacgagatctgtaaacgccttgcacccgactccaggctgaacccgcatcgctctctgctgggaactggcaactacgatgtcaatgtgatcatggctgctcttcagggcctgggactcgcagccgtatggtgggaccgacggagacctctcagccagctcgcgctcccgcaagtgctcggactcatcctgaacctgccctctcctgttagcctggggctgctgtccctgcctctgcgcaggaggcattgggtggctttacgccaggttgatggggtgtattacaacctggactccaagctgagagctcccgaagccttaggtgatgaggatggcgtgagagcattcctagcggcagctctggcacagggactttgtgaggttctcctggtcgtgacaaaagaagtagaggaaaaaggatcttggcttagaacagactag

SEQ ID NO: 48193 - DNA, 441 bp, Artificial Sequence
  Description of Artificial Sequence: Synthetic coding sequence
atgagccaggcccccggcgcccagcccagcccccccaccgtgtaccacgagaggcagcgactggagctgtgtgctgtacacgctctgaataacgtcttacagcaacagttattttcgcaggaagctgcagacgagatatgcaagcgaccactgagccagctcgctcttccccaggttctgggtctcatcctaaacctgccatctccagtctccctaggattattgtccctgcccctgcggcgccggcattgggtggccctcaggcaggtagatggtgtgtattacaacctcgacagcaagctccgcgctccggaggcccttggcgatgaagacggcgttagagcctttctcgccgccgctcttgcgcaaggcctgtgtgaagtgctccttgtagtgaccaaagaggtagaggaaaagggctcttggctcaggaccgattag

SEQ ID NO: 48194 - DNA, 567 bp, Artificial Sequence
  Description of Artificial Sequence: Synthetic coding sequence
atgagccaggcccccggcgcccagcccagcccccccaccgtgtaccatgagcgccagcggttggagttatgtgccgtgcatgccctgaataacgttctccagcagcaattgtttagtcaggaggcagctgatgaaatctgtaagaggttggccccggattctaggcttaacccccacaggtccttgttgggtacagggaactacgacgttaacgttattatggccgccctacaaggactcggccttgcagctgtgtggtgggatcggcgccgccccctgtcccaactggcccttccccaggtgctgggactgatcctgaatctcccatcccccgtctccctggggcttttgtcacttcctctgcgcagacggcactgggtggcccttcgtcaggtggacggcgtttattacaacctggattctaaactgagagccccagaagctcttggcgatgaggatggtgtacgggctttcttggcagccgctctcgcccagggactgtgcgaggttctgttggtggttaccaaggaagtcgaagagaaagggtcctggctgcggacagactag

SEQ ID NO: 48195 - DNA, 1392 bp, Artificial Sequence
  Description of Artificial Sequence: Synthetic coding sequence
atgcgggccggccccgagccccaggccctggccggccagaagcggggggccctgaggctgctggtacccagattagtgctaaccgttagcgccccagctgaggtgcgacggcgggtcctgagacccgtgctctcttggatggatagggaaaccagagcccttgccgacagccattttaggggcctgggcgtcgatgtgcccggggttgggcaagcccctggccgggttgcatttgtatctgagccgggcgctttcagttacgctgattttgtacgcggcttcctgctgcctaacctcccctgcgtgttctcttctgccttcacccaaggatggggatctcgcaggcgctgggtgactcctgcgggcaggccagactttgaccacctactgagaacttatggcgacgtggtggtgcccgtcgccaattgtggtgtgcaggaatataactcaaaccccaaggagcacatgaccctaagggactatataacatattggaaggaatacatccaagccgggtacagttcaccgcggggatgcctgtacctgaaagattggcatttatgccgcgatttccctgtggaggatgtgtttaccctgcccgtttatttttcaagcgactggctcaatgaattttgggatgcccttgatgtcgacgattatcgctttgtatacgcaggccccgctggcagttggtccccttttcatgccgacatcttccgatcattttcctggtccgtaaatgtctgtggccgaaagaagtggctgttgtttccccctggccaggaagaggctctgagggataggcatggtaatctgccatacgatgttacatctccagccctatgtgatacgcatcttcatcccaggaaccagctggccggaccgcctctggagatcacacaagaagcaggagagatggtgttcgtccccagtgggtggcaccatcaggttcataacctggatgatactatatccattaatcataattgggtcaacgggttcaacctggctaacatgtggcgatttctgcagcaagagttatgtgcagtgcaggaagaagtgagcgaatggagagatagtatgccagactggcatcaccactgtcaggtaattatgcggtcttgtagcggtatcaatttcgaagagttttaccattttttgaaggtcattgcggagaaacgactgcttgttctcagggaagccgccgccgaggacggtgcaggattagggttcgaacaggctgcattcgatgtggggaggatcactgaagtgcttgccagcctcgtggcccaccctgattttcaaagggtggacacctcagcattctcccctcagccaaaagagctcctgcaacagcttagagaggctgtggatgctgccgcggctccctag

SEQ ID NO: 48196 - DNA, 1323 bp, Artificial Sequence
  Description of Artificial Sequence: Synthetic coding sequence
tgagccctggccggccagaagcggggcgccctgcggctgctggtgcctcggcttgtgctaaccgtttctgctcctgctgaagttcggaggcgcgtgcttcgccctgtcctcagttggatggacagagagacccgggctctagctgacagtcactttcgcggactgggtgttgatgttccaggtgtggggcaggcaccagggcgcgtcgctttcgtgtctgaaccaggggcattctcttacgccgattttgtacggggctttttgcttcctaacctcccatgcgtgtttagcagcgccttcacgcaggggtggggatcccgccgcaggtgggtcacacctgctgggagacctgatttcgatcacctgctccgcacatacggagacgtggttgtgcctgttgccaactgcggggtacaggaatataactccaatcccaaggaacacatgactctgcgggactatataacatactggaaggagtatatccaagccggctacagcagtccacgcggctgtctctacctgaaagactggcatttgtgtagagatttccccgtagaagacgtgttcacccttcctgtgtatttctcatcagactggctcaacgaattttgggatgctctggatgttgacgattatcggtttgtttacgcagggcccgccggctcttggtcacccttccatgccgacatttttagatcattctcatggagcgtgaacgtctgcgggcgaaaaaaatggctcctgttcccgccagggcaggaggaggctttacgtgatcggcatggcaatctgccgtacgacgttacatccccagctctgtgcgacacacatcttcatcccagaaaccagctggccggaccgccattggagattacccaagaagctggtgagatggtatttgttcccagcggctggcaccaccaagtgcacaacctggatgataccattagtattaaccacaattgggtgaatggcttcaacttggccaatatgtggagatttcttcagcaggagctatgtgccgtgcaggaagaggtgatcatgaggtcgtgctctggcattaatttcgaagaattttatcactttttaaaagttattgctgagaaaagacttttggttctccgagaggctgctgccgaagatggagccggcctgggattcgagcaggctgccttcgacgtgggcaggattaccgaggtgttagcctcacttgtcgctcatccagatttccagcgcgttgacacatccgctttctcacctcaaccaaaagaattactgcagcagctgagggaggccgtagatgccgcagccgccccgtag

SEQ ID NO: 48197 - DNA, 951 bp, Artificial Sequence
  Description of Artificial Sequence: Synthetic coding sequence
atggccgaggccgccctggaggccgtgcggagcgagctgcgggagtttcccgcagcagccagggagctgtgtgtacccttggcagtcccctatctagacaaaccaccaacgccgctgcacttctacagggactgggtctgtccaaatcggccatgcatcatccgcaatgcactccagcattggcctgccttacagaagtggtcactgccttattttagagcaacagtaggaagtacagaggtgtctgtggctgttacaccagacggctatgcagatgccgttagaggcgaccgatttatgatgcccgctgagcgacgcctccccctttccttcgttttagatgtgctcgaaggaagggcccagcatccgggcgtcttgtacgtgcagaaacaatgttcaaatctcccatctgaactgccccagttgctaccagacctggaatcccacgttccgtgggccagtgaggcccttggcaagatgcctgacgctgtaaacttttggctgggggaggcggctgccgtcacgtctttgcataaagatcactatgaaaacctgtattgtgtggtgagtggtgagaaacacttcttgtttcacccaccgtctgatcggcctttcatcccatacgagctttatactccagcgacatatcaattgaccgaagaaggaactttcaaagtggtcgacgaggaagccatggaaaaagtgccatggatcccgcttgacccgctggctcccgacctggccagatacccctcttatagtcaagcccaagcactgcgctgcaccgtccgggcaggggagatgctctacctcccagccttgtggtttcatcacgttcagcagtcacaggggtgtatcgctgtgaacttctggtatgacatggaatacgatctcaagtactcttacttccagcttttggacagtctcacaaaggcctccggcctagactag

SEQ ID NO: 48198 - DNA, 1005 bp, Artificial Sequence
  Description of Artificial Sequence: Synthetic coding sequence
atggtgaccggcggcgcccacagccggagccggggcggcctgcccagtgcctctcggcgaggattgttcagaggcggacccaaggaagtgacatccggcgttcgcccaggaagccgtcccctcccccggaggaggagttgccgacctatggctggcggatgggcccaagggagccgccgggccgcccgtttgccagagggcggaagactgatggcacccgcttccagacttctagctctctgggctcttgccgccgttgccttgcccggctcgggcgcggagggggacgggggttggcgccccggcggcccaggcgccgttgccgaggaggagagatgtaccgttgagcgaagggcggatctaacctacgccgaatttgtgcagcagtatgcgtttgtgcgccctgtgattctgcaaggcttgaccgataattctaggttcagggccctctgtagccgcgaccgcctcctcgcaagctttggggacagggttgtccgtctgagtacggccaatacttactcctatcacaaggtggatctgccctttcaggagtacgtggagcaactgctgcacccccaggacccaaccagcctcgggaacgatacactgtacttcttcggggacaataacttcacggagtgggcatccctattccgccactacagcccccctcctttcggcctcttagggaccgcccctgcttacagttttggcattgccggagccggatctggcgtgccattccattggcatggcccaggctatagtgaggttatctacgggagaaagagatggttcttgtacccacccgaaaaaactcccgaatttcatcctaataaaaccactctagcatggctgagagatacctatccagctctgccaccgagcgccagaccgctggagtgtaccatccgagcaggagaggtgctttatttcccggacaggtggtggcacgccactctaaatctggatactagcgtgtttatttctacttttctgggttag

SEQ ID NO: 48199 - DNA, 858 bp, Artificial Sequence
  Description of Artificial Sequence: Synthetic coding sequence
atggccggcggctgggcccagggcagccggcgggccgcccggctgcctgagggtggccgtctgatggcacctgcgtccaggctgctagccctgtgggcactggctgccgtggcccttccgggctccggcgccgaaggtgatggaggatggcgaccgggcggtcccggcgctgtggctgaagaagagcgatgcacggtagagcgacgggccgacctgacatatgccgaattcgttcaacagtatgcattcgttcgtcctgttatcctccaaggactaacggacaatagtcgcttccgggccctctgcagcagggatcggctcctggcctcattcggggaccgcgtcgtccgactgtcgacggccaatacctactcttaccataaggtagaccttccattccaggaatatgtggagcagctgctacatcctcaggatcccacctctctgggaaacgataccctatacttcttcggagacaacaatttcactgagtgggcctcacttttcaggcactattctccacccccgtttgggctgctcggcacggctccggcctatagcttcggtatcgcaggtgcaggatccggcgtcccatttcactggcacgggcctggttacagtgaggtgatctacgggcgtaagcgttggtttctgtacccacccgaaaagacacctgaattccatccaaacaaaacgaccctggcttggttaagggatacttaccccgctctcccaccttccgctcgtcctctggaatgtacaatccgggccggtgaggttctgtattttccagataggtggtggcatgcaaccctgaacctggatacttccgtgttcatctccaccttcctcggttag

SEQ ID NO: 48200 - DNA, 915 bp, Artificial Sequence
  Description of Artificial Sequence: Synthetic coding sequence
atggtgaccggcggcgcccacagccggagccggggcggcctgccctctgcaagtaggcgcggcctcttccgaggtggccccaaggaggtgacatctggcgttaggccaggtagcagaccattgccccgccgacggtcttgccggcctatggctggcggctgggctcagggctctagaagggccgcacgtctaccggagggtgggcgtcttatggcccctgcctcccggctcctcgcattatgggcattggctgcagttgccctcccaggctctggagcagagggcgatggcgggtggtatgcctttgtccgtccggttattctccagggcctaactgacaattcaagatttagagcactgtgctctcgggacaggctcctcgctagtttcggagatcgggtggtcagactgagcaccgccaacacgtactcctaccataaggttgacttgccctttcaggaatacgtcgagcagctgctacatccccaagatccaacctccctgggaaatgataccctgtactttttcggggacaataactttaccgagtgggcgagcctcttcagacactactcccctcctccgtttggcctcttgggtaccgcccctgcctactcatttggcattgccggggcaggtagcggcgtacccttccactggcatggtcccggctactcagaggtgatctacggccgaaagaggtggttcctatatccaccagagaagacccccgaattccacccaaacaagaccaccctggcctggctgcgcgacacatatcctgccttgccacctagtgctcgcccccttgagtgcaccattagggccggagaagtcctctatttcccagatcgttggtggcatgcgaccctaaacttggatacttctgttttcattagcactttcctcggttag

SEQ ID NO: 48201 - DNA, 2238 bp, Artificial Sequence
  Description of Artificial Sequence: Synthetic coding sequence
atggaggtgatgaacctgatggagcagcccatcaaggtgaccgagtggcaacagacttacacgtatgactccggcatccacagcggagcaaacacatgcgtgccatctgtgagctccaaaggcatcatggaggaagacgaggcgtgcggacgacaatatacccttaagaaaaccaccacctatacgcagggggtgcctccatctcagggtgatttagagtatcagatgtccaccaccgcacgggcaaagcgtgtccgcgaggcaatgtgtcctggcgtgagcggtgaagactcgagcctgcttcttgccacccaggtggaaggtcaggcaaccaatctgcagcgcctggccgaacccagccagctactcaagtcagctatcgttcatctcatcaattatcaggacgacgcagaactcgcaacaagagccctccctgaactaaccaaacttctgaacgatgaggaccccgtagttgtaacaaaagccgccatgattgtgaatcaactgtctaagaaagaggcgagcagaagagcgttgatggggtctcctcagttagtcgctgcggttgtccgcactatgcagaatacctctgacttggacacagcccgctgtaccacttcgattcttcataatctcagtcatcatcgagaaggcctcctcgcgattttcaaaagcggcgggatacctgcccttgttcgtatgctctcaagccctgtggagagcgtcttgttctacgctatcacaacccttcacaatctgttactctatcaggagggtgcaaagatggcggttcgccttgccgatggtctgcaaaaaatggtgccattactgaacaaaaacaatcccaaattcctggctattaccaccgattgcctgcagcttcttgcctatggtaatcaggagtcgaagctgattattttagctaacggcgggccccaggcactggtgcagataatgcgaaactactcttacgagaagctcctctggaccacttcccgcgtactcaaggtgttaagtgtatgtccctctaataagcctgcaattgtggaagctggcggtatgcaagccctaggtaagcatttgacaagtaattcgcctcggttggtccagaattgtctgtggactctgcgtaatttaagtgacgtggcaaccaagcaggaaggactggaatccgtattaaagattttagtgaatcagctctcggtggacgatgtaaacgtccttacttgcgctactggaaccctgagcaatttgacgtgtaataattcaaaaaataagaccctggtaacccagaattccggggtcgaggctctaattcacgccatcctgcgtgcaggcgataaagatgacatcacggagcctgcagtgtgcgccctgagacacctaaccagcaggcatccagaagccgagatggcacagaacagtgttcgtctgaattatggcatccccgcaatcgtgaaactactgaaccaacccaatcagtggcctctggtgaaggctacgatcggccttattaggaaccttgctctgtgtcctgccaaccacgcaccattgcaggaggccgccgtaattccaaggttggtccagctgttggtcaaagctcaccaggacgctcagaggcacgtcgcagctggcacccagcagccttatactgatggggttcgaatggaggaaatcgtggagggttgtaccggtgccctacatatcctcgcccgcgatcctatgaatagaatggaaattttccggctgaacaccatccccttgtttgtgcagctgctatactcatctgttgaaaatatccagagggttgcagctggggttttgtgtgaattggcccaagataaagaagctgcagatgccattgatgcggagggggccagcgcacctctgatggagctccttcacagccgcaatgaaggtacggccacatacgctgctgctgtgctgtttagaattagcgaggacaaaaatcctgactatcgcaaaagagtttccgtcgaacttacaaattccctatttaagcatgaccctgccgcatgggaggcagcacagtcaatgattcctataaacgagccctacggggacgacatggatgctacctaccggcctatgtattctagtgacgttcccctggatcccttggaaatgcacatggacatggatggggactaccccatcgacacttactcagatggtctgcggccaccgtacccaaccgctgatcatatgctggcttag

SEQ ID NO: 48202 - DNA, 2238 bp, Artificial Sequence
  Description of Artificial Sequence: Synthetic coding sequence
atggaggtgatgaacctgatggagcagcccatcaaggtgaccgagtggcaacagacctatacatatgactccggcattcatagcggggcaaacacctgtgtcccatctgtctcctccaagggcattatggaagaggatgaggcctgtgggcgacagtatactctgaagaagaccacaacctacactcaaggcgtaccccctagccagggagacctggagtatcaaatgtctaccactgcccgagccaaaagagtcagggaagctatgtgtcccggcgtaagtggagaggattcttcgctgctgctggcgacccaggtcgaaggtcaagctacaaatttgcaacggctggctgaacccagccagttgctgaaatccgccatcgtccatttaatcaactaccaggatgacgccgaactggcaactagagcacttcccgagctgacaaagctgctgaacgacgaggatcccgtagtcgttactaaagcagccatgattgttaatcagcttagtaagaaggaggccagtagaagggccttgatgggaagcccccagctggtggccgcagttgtcaggactatgcaaaacacatcagacttagacacggccagatgcaccactagcatcctacataacctgagccaccatagagagggattgctggctattttcaaatcaggaggcataccggccctggtgaggatgctgagttcacccgtggaaagcgtcctcttttacgcaataaccactttgcacaatctgcttctatatcaggaaggggccaagatggccgtacggctcgctgatggcctgcaaaaaatggtgccccttctgaacaagaacaatcccaagtttttggctataaccacggattgtttgcagctgctggcttacggaaatcaggaatcaaagctgatcatcctcgcaaacggcgggccccaggcactcgtccagatcatgagaaattattcatatgaaaagttactgtggactaccagccgggtgcttaaagtgctgtctgtgtgtccaagcaataagcctgctattgtggaagccggcgggatgcaagccttaggcaaacacctaacatccaacagtccgcgcctcgtgcagaattgcttatggactctgcggaacctttccgacgtcgccaccaagcaggaaggactggagagcgttcttaaaattctcgtgaatcagctgagtgtggacgatgtcaatgttctgacttgtgccaccggaactttatctaatctaacatgcaataatagcaaaaataagactctggttacacagaattcaggcgtagaggccctgatccacgcaatccttagagctggtgataaggacgatattacagaacccgctgtctgtgctctgcggcacctgacttctcgtcatcctgaggcagagatggcacagaatagcgtccgcctgaactatggcatccctgccatcgtcaaactgctcaatcagcctaaccaatggccacttgtaaaggctacaattggtttgattcgaaatctagccctctgcccagccaaccacgcccccctgcaggaagccgccgtgatcccgcggctggtgcaacttcttgtgaaggcccatcaggatgcacagcgacatgtggccgcggggacacagcagccctataccgatggtgtgaggatggaagaaatcgtggagggatgcacaggggccctccatatcctggcaagagaccccatgaatcgcatggaaatttttcgcctgaacaccattccactgttcgtgcagctgttatactcgtccgtggagaatatacagcgagtcgccgctggcgtgctttgtgagctggcacaggataaagaagccgcagatgccattgatgcagagggagcctccgcaccgcttatggaattgctgcattccagaaatgagggcaccgctacctacgcggcagcagtgctgttccggatttcagaggataaaaatcccgactatcgcaaaagggtcagcgtggagcttactaacagtctgttcaaacacgaccccgcagcttgggaggctgctcagagtatgatccccataaatgaaccgtatggagacgatatggacgcaacttatcggccaatgtactcttccgacgtaccattggaccctttggagatgcatatggatatggacggcgattatcctattgacacatactccgacggtctgcgccccccctacccaaccgcggaccatatgttagcctag

SEQ ID NO: 48203 - DNA, 1890 bp, Artificial Sequence
  Description of Artificial Sequence: Synthetic coding sequence
atgcacgtgcccggcggcaagttcgacttcgacgacggcggctgctacgtgggtggatgggaggccggccgcgcgcatgggtacggagtgtgcacaggccccggagctcagggggaatatagtggctgctgggctcacgggtttgaatccttgggagtttttaccggccctggtggacattcatatcagggccattggcaacaggggaaaagggagggtctgggagttgaacgcaagagtcgttggacttataggggggaatggctcggcggcctgaaggggagaagcggcgtttgggaatcagtctcgggtctccgttatgctggcctgtggaaggacgggtttcaggacggctatgggaccgagacctactcagacggcggtacataccagggccagtggcaggctggcaaaagacatggatatggcgttaggcagtctgttccttaccaccaggccgctctcctgcgttctcccagacggacttccctggatagcggtcactccgatccccctactccccctccgccactccccctaccaggcgatgaggggggcagtccagctagcggatcaaggggaggattcgtgctggcaggtcctggcgatgcagatggagcatccagccgcaaaagaacccccgccgccggcggcttcttccgccgcagccttctcctgtccgggctgcgggcaggcgggcgtcgctcctccctgggcagcaagcggggctcactgagatcggaggtgagttccgaagtgggttcgactggaccgccaggctcggaagcctctggacctcccgctgccgccccccccgccttaatagagggctccgctacggaggtgtatgcaggggaatggagggccgatcggagaagcggctttggagtgagccagcggagtaacgggctgcgatacgagggggaatggttaggcaaccgaaggcacgggtatgggagaaccaccaggcccgacgggtccagggaggaggggaagtacaaaaggaatcgtctcgttcacggaggccgagtcagaagcttgctccccttagccctgcgcaggggcaaggtgaaggagaaagttgatcgggctgtggagggcgcccgcagggccgtgtctgctgctaggcagcggcaagagatcgcagcagcgagggccgctgacgccttgctcaaggctgtcgccgcctcctctgtcgctgagaaagccgtagaggcagctcgaatggcgaaactcattgctcaggacttacaaccgatgctcgaagcacctggcaggagaccgagacaggactctgagggatctgacaccgagccgttagatgaagactctcccggcgtttatgaaaacggcttgacaccttctgaaggaagcccagaactcccatccagccctgctagctccaggcagccttggcgcccaccagcatgtaggagcccgttaccccccggcggagaccaggggccgttttcatcccctaaggcttggccagaggagtggggtggagccggggctcaggccgaggaactcgccggttacgaagccgaggatgaagctggtatgcagggccctggtccaagagacgggtccccgctgctagggggctgttccgacagctccggctcactccgagaggaggagggcgaagatgaagagcccctcccgcccctccgcgcccccgccggtaccgagcctgaacctatcgccatgctggtcctgaggggctccagttcaaggggtcctgacgctgggtgcctgacagaggaacttggcgagccagccgctactgagagacccgcccagccgggagccgcaaatcccttggtagtgggggctgttgctcttctggacctctctctggcctttcttttcagtcagttgctcacctag

SEQ ID NO: 48204 - DNA, 1590 bp, Artificial Sequence
  Description of Artificial Sequence: Synthetic coding sequence
atgagcaccaacgagaacgccaacacccccgccgcccggctgcaccgctttaaaaacaagggaaaggactccacagaaatgcgccggcgtcggatagaggtgaatgtggagttaaggaaggctaaaaaagacgaccagatgctgaagagacggaatgtcagctcatttcctgatgatgcaacatcaccattgcaggagaatagaaacaatcaaggaacagtgaattggtcagtggatgatattgttaaaggcattaattcctctaacgtcgagaaccagttgcaggcgacacaggcagctcgcaagctcctgtccagagagaaacagccgccaatagacaatattatacgggctggcctgatcccgaagtttgtatcttttctcggccggacggactgcagccccatacaattcgagtctgcgtgggcactcacaaatatcgcttcagggaccagcgaacaaactaaggcggtagttgatggcggagccataccagccttcattagcctgttggcgtcaccacatgcccacatttccgaacaggccgtgtgggcccttgggaacattgctggtgatggctctgtgttccgggacctggttatcaaatatggcgcagtggatcccctactcgccctccttgccgtgccagatatgtcctcactggcatgcggctatttacgaaacctcacatggacactgtcgaatctatgtcggaacaaaaaccccgcacctcctatagacgcagttgaacagatcttgcccaccctagttcgactgttgcatcacgacgacccagaggtgctcgcagatacctgctgggcaatttcttacctgacggatggacctaatgagcgtatcggcatggtggtcaagacaggagtcgtaccgcaactggtaaagcttcttggggcaagcgagctcccgatcgttactcccgctctccgggcaattggtaacatagttacgggtactgacgagcagacacaggtggttatcgatgccggtgcactggcagtctttccttccctgttgacgaatcctaaaacaaatatccagaaagaagccacctggacaatgtccaacatcacggcagggcgccaagaccagattcagcaggtggtgaaccacgggctggtcccctttctcgtctctgtgctgagcaaagcggattttaagacccagaaggaggccgtttgggctgttactaattacacttcaggcggcacggtggaacagatagtctacctagtccactgcggaatcatcgaaccactgatgaacctgctgaccgcaaaagacacaaagatcatcctcgtgattttggacgcgattagcaatatcttccaggccgccgagaagctgggagagacagagaaattaagcatcatgattgaagaatgtggcggattggacaagatcgaggccctgcaaaaccacgagaacgaatccgtttataaagcttccctgagccttatcgaaaagtatttctcagtagaagaagaggaagatcagaacgtggtgcccgaaactacaagcgaaggatatacttttcaggttcaggatggcgctcccggtactttcaacttttag

SEQ ID NO: 48205 - DNA, 459 bp, Artificial Sequence
  Description of Artificial Sequence: Synthetic coding sequence
atgcgggagaagctgatccggctgcagagcctgtacatcgaccagttcaaacgactgcagcatttactcaaagagaaaaagagacggtacctccacaaccgcaaggtagagcatgaggcactcgggtcctctctcctgaccggtcctgagggcctgctagcaaaagaacgcgagaatctcaaaaggctgaagtgcctgagacgctaccggcagaggtacggtgtagaggcattgttgcacaggcagctgaaggagagacggatgttagccacggacggcgcagcccagcaggctcacaccacgcgttcatctcagaggtgtcttgcgttcgttgatgatgtgcggtgttctaaccagagcctccctatgactcgacattgcctgacccagaaggacgctacagcaattggggacctactgaccttgtactgcggcctaatggaaaccgctctggactag

SEQ ID NO: 48206 - DNA, 1479 bp, Artificial Sequence
  Description of Artificial Sequence: Synthetic coding sequence
atgaaccggatccggatccacgtgctgcccaccaaccggggccggatcacgccggttcctcgcagtcaagagccgctgagttgtgcattcacccacagaccctgctcgcacccgcgccttgagggacaggagttttgtatcaagcatatactggaagataagaatgctccgttcaagcagtgtagctacattagtacgaaaaacgggaagcgatgccccaacgcagcgccaaagcccgagaagaaagatggcgtctcattttgcgcagaacacgttcggcgcaacgccctggccttgcatgctcagatgaaaaagaccaatccgggtcccgtgggagagaccctgctttgccagctgtcctcctatgccaagacagaactgggatcccaaacccccgaaagttccaggagtgaggcctccagaattctcgatgaggattcgtggtcagatggggagcaggaaccaataacagtcgaccagacatggagaggcgaccccgattccgaggctgatagcatagactccgaccaggaggatccactgaagcacgcgggcgtgtacactgccgaggaagtcgccctcataatgcgagagaaactaatcagactccagtccttatatatagatcagtttaaaagattgcaacacctgctgaaagagaagaagcggcggtatctgcacaatcgtaaagttgagcacgaggccttgggcagctcactcctgaccggcccagagggcctgctggcaaaggaacgcgaaaatctgaagcggctcaaatgtcttcgtagatatagacagagatacggggtagaagccttgcttcacaggcaactcaaagaacgccgtatgctggccacagacggcgcggctcaacaggcccacacaaccagaagtagccagcggtgcttagcatttgtagacgacgttagatgttctaaccagtccctgcccatgacccggcattgcctgacgcacatttgccaggacacgaatcaggtgctgttcaagtgttgccaggggtccgaggaggtcccctgcaacaagcccgtgcctgtcagtctgtctgaagacccttgttgccccctacactttcaattgccgccccagatgtacaagccagagcaggtcctgagcgtgccggacgacctcgaagcgggtcctatggacctttacttaagcgctgctgaactgcagccaacggaatccctccctcttgagttttccgatgatctggatgttgtcggagatggcatgcagtgtcccccgtcacctcttctgtttgatccaagcctaactctagaggaccacctagtcaaagagatcgccgaggacccagtggacattttgggccagatgcaaatggcaggtgacggttgccggagccagggctctcgtaatagtgaaaaagccagcgcgcccctgagccagagtggactggctacagctaatgggaagcccgaaccaacctcaatcagttag

SEQ ID NO: 48207 - DNA, 210 bp, Artificial Sequence
  Description of Artificial Sequence: Synthetic coding sequence
atgaaccggatccggatccacgtgctgcccaccaaccggggccggattacccctgtgcctcggtcccaagaacccttgtcctgtgcctttacgcacaggccttgctcgcatccacgtcttgagggccaggagttctgtatcaaacatatccttgaagacaagaatgccccgttcaagcaatgttcttatatttccacgaaaaacggctag

SEQ ID NO: 48208 - DNA, 2376 bp, Artificial Sequence
  Description of Artificial Sequence: Synthetic coding sequence
atgcccctgtacgacaaccagaaggcccggagcgtgatgaacgagtgtgaaaggcacgtgatctttgccaggactgatgctgatgccccgcctccgcccgaggactgggaagaacatgtcaacaggaccggatggacaatggcgcagaataagctctttaacaagatcttaaaggctctgcagtcagatagactggctcgactcgcaaacgaaggggcttgcaatgagccggtgttgcgccgtgtggccgtggataagtgtgcccgaagagttcgacaggccttagcctcggtctcttgggacacaaagctgatacagtggctgcacactacactggtggaaaccctcagtctgccaatgctagcagcttacttggacgctctgcagacactaaaagggaagattcccactctcattgatcgaatgctggtgtctagtaacacaaagacaggggctgccggggccgaggccctgtcactgttgctaaagcggccgtgggaccctgctgtgggcgtgctgtcacacaataagccctctaagctccccggaagtccgctgattctgatcgcatcgagcgggcctagcagtagcgtcttccctacttctagacgacacaggttctggcagagccaactctcctgtctcggcaaggtgatcccagtggctacccatctgcttaacaacggttctggcgttggggttctgcagtgtctggaacacatgattggcgccgtgaggagcaaggtgctcgagattcactcgcacttcccccacaagccaatcattttgattggctggaacactggtgccttagtggcctgtcatgtaagtgttatggaatacgtcactgcggtcgtctgcttgggtttccctctcctcaccgtggacgggcccaggggggacgtggatgacccactgctggatatgaagactccagtgctgtttgtgatcgggcagaacagcctccagtgccatcccgaagctatggaggacttccgcgaaaagatccgcgccgagaattcattagtcgtggtcggtggggccgacgacaatttgcgcatctccaaggcaaaaaaaaagtcggaagggcttacacaaagtatggtggatcgctgcatccaggatgagattgtggattttctcacgggcgtcttaactagagccgaaggccacatgggttccgaaccacgcgatcaagacgccgagaaaaagaaaaagccacgggatgtagccagaagggatttggctttcgaagtgcctgaaagaggaagccgtccggcttctcctgctgccaaactccctgccagtccttccgggagcgaggacctgagcagtgtcagttctagtccaacaagtagcccaaagactaaggtgacaacagtgaccagcgcacaaaaatcttctcagatcggctccagccagttgctgaaacggcatgtgcagcgaactgaagcagtgctgactcacaaacaagcgcaggttcccatctcttctgaacctccagaagaaggtgagaaggaggatctcagagttcagctaaaaagacaccatccctcttctccactacctggatccaaaacctcaaaaagaccaaagattaaagtgtccctcatttcccaaggagacacagccggaggtccttgtgccccaagtcaaggcagtgcccccgaggctgctggaggaaaaccgatcactatgactctggggcaagcatccgcaggtgccaaggaactcaccgggctcctgaccaccgcaaaatctagttcatctgaggggggcgtgtcggcctctcccgttccatcagtagtgtcttcaagcaccgcacccagcgccctgcatactctacagtcaagactagtcgctacatcccctggatcgtctctcccaggggcgacgtccgcctcaagcctgctgcagggcctttctttctcattgcaagacatttcgtccaaaacatcaggactgccagcaaacccctcccccggaccagccccccaggctactagtgtgaaactgccaactcccatgcaaagtcttggagctatcaccaccgggacctcgactattgtgagaaccattcccgtggccaccacgctgtcttctttgggcgctactccgggtggtaagcctacagctattcaccaacttttaaccaatgggggactcgcgaagcttgcgtcatcccttccaggcttggcccagatctccaatcaggcttcagggcttaaggtgcctacaacgattacccttactctgagaggacagcctagcaggatcaccaccttgtcaccaatgggctccggagccgctccatcggaggagtcgagcagccaggttctgccttcttcttctcaaagactgccacctgcaccatag

SEQ ID NO: 48209 - DNA, 2637 bp, Artificial Sequence
  Description of Artificial Sequence: Synthetic coding sequence
atggcccaccggggcggcgagcgggacttccagaccagcgcccggaggatgggcacaagcctcttattccagctctccgtgcacgaacgcgaattggatttggtgttcctagaccacagctacgccaagccttggtctgcacaccctgatgctagcagcgcccggcctacccgtatgctgttcgtcacacccaggcgccagcacgagtccacaatcgagagcgatgttccaatagatgtcgagaccgtgacttctacacctatgccactctatgacaatcagaaagcccgctctgtcatgaatgagtgcgagcgccatgtgatcttcgctcggaccgacgccgacgcacctccacctcctgaagactgggaggagcatgtgaatcgtactgggtggacgatggcacagaacaaacttttcaacaaaattctgaaggcactccagagcgaccggctggcccgtttggccaatgagggagcctgcaacgaacccgtactgagaagagtcgctgtagataagtgtgccagacgtgtgaggcaagctcttgccagcgttagctgggacacaaaactcatccagtggttgcatacaacactggttgagacattgtcactgcctatgctagctgcctatctcgacgctcttcagaccttaaagggaaaaataccaaccctgattgaccggatgttggtgtcaagtaacacaaagacaggggccgcgggagccgaggccttgtcactgctactgaagcgcccttgggaccctgccgtcggggtgctgagtcataacaagccttctaagctgcccgggtctcctctcatcctgattgcttcgagtgggccctctagctctgtgttcccgacatccaggcgacacagattttggcaaagccagttgtcttgtctgggaaaggtgataccagtcgcaacgcacctcttgaacaatggtagcggtgtgggtgtcctacagtgccttgagcacatgattggagccgtgcggtccaaggtgttagagatccattcccactttcctcataagcccattatcctcataggatggaatactggggccctggtggcttgccacgtgagcgttatggagtatgtgacagccgtagtatgtctcggatttccgctgctgacagtggatgggccccgcggcgatgtggacgacccattactcgacatgaaaacacctgttctctttgtgattggccagaattcactgcaatgccaccctgaagcaatggaggatttcagagagaaaatcagagccgaaaatagccttgtggtggtcggcggtgcggatgataatctgaggatttccaaggcaaaaaaaaagagcgaagggctcacacagagtatggtggacagatgcatccaagacgaaattgtggattttttgacgggggtactcacacgagccgaggggcatatggggtccgaacctcgggatcaggacgccgaaaagaaaaaaaagccaagagatgtagcccgtcgagacctcgcattcgaggtgcccgagagggggagcaggccagcaagcccggccgccaaattgcccgcatccccatctggatccgaagatctctcatcagtgtcaagctcccccacatcctccccgaaaacgaaagttaccactgtaacctctgcccagaagtcctctcagatcgggtctagccagctcctgaagagacatgtgcagcggactgaggcggtgctcactcacaaacaggcccaggttccaatcagtagcgaaccccccgaggaaggcgagaaagaggacctacgcgttcagttgaagcgccaccacccttcaagtcctctaccaggttctaagacctctaaaagaccaaagattaaagtctcccttatctcccagggtgatactgctggtgggccctgtgctccctcacagggatcagcacctgaggctgcgggaggcaaacccattaccatgacgctcggtcaggcaagtgccggcgccaaagagctaactggattgcttaccactgccaagtctagctcttccgaaggaggagtctcagcctctcctgttccctcggtggtctcaagcagcacagctccctctgcattgcacaccttacagagtaggcttgtcgccacaagcccgggcagcagcttgcccggggccacctctgcgagcagcctgctgcagggactctctttttctctgcaggacattagctcaaaaacatcaggcttgcccgcgaatccttcgcctgggccagcccctcaggccacaagcgtcaaattacctactcccatgcaatcactgggcgctataactaccggcaccagcactatcgtgaggactatccctgtagcgactaccctctcttcgctgggggctactcctggtgggaaacccacagctatccatcagctcctgacaaatggaggcctggctaaattagccagtagtctgcccggattagctcagatctccaatcaggctagcggtctgaaggtcccaaccaccatcaccctcactcttcgaggccagcccagtagaatcaccactctcagcccaatggggtcaggcgctgctccgagtgaggagagcagctctcaagttctgcccagctcctcccaacggcttcctcctgccccctag

SEQ ID NO: 48210 - DNA, 426 bp, Artificial Sequence
  Description of Artificial Sequence: Synthetic coding sequence
atgcccctgtacgacaaccagaaggcccggagcgtgatgaacgagtgtgagcggcacgttatctttgcacgaactgatgccgatgctccaccaccacctgaagactgggaagagcatgtgaaccgaacgggctggacaatggctcaaaataaactgttcaacaagatattgaaggcccttcagtctgaccgactggcgagactggcgaacgaaggcgcctgtaatgaaccagtgctgcgtagagtggctgtggacaaatgtgcccgtagggttcggcaggcactggcctccgtcagttgggacaccaagctcattcagtggctgcacacaaccctcgtagaaacgttatcgctgcccatgctcgccgcctacctggatgcactgcagaccctgaaaggtaaagtgatcctgaccttttgcggatag

SEQ ID NO: 48211 - DNA, 1593 bp, Artificial Sequence
  Description of Artificial Sequence: Synthetic coding sequence
atgcccctgtacgacaaccagaaggcccggagcgtgatgaacgagtgtgaacgccacgtcatcttcgcacggaccgacgcagacgcgcccccaccccccgaggattgggaagaacatgtgaatcgcaccggatggacgatggcccagaacaagctgttcaataaaatactaaaagccctgcaaagcgataggttagcccgactggcaaacgagggtgcctgtaatgagcctgtgctgaggagggtggccgtggataagtgcgcaaggcgggtccggcaagccctggcttccgtgtcctgggacacaaaacttattcagtggctgcacacaactctggtggaaacactgagcttgcccatgctggccgcttatctcgacgcccttcagacccttaagggaaaaatccctacccttatcgatcggatgctggtgtcgtctaataccaagactggggccgccggggctgaggccctatctctgttacttaagagaccatgggacccggctgttggggtattgagccacaataagcccagtaagctgcctggaagtcctctgattttaatagcatcatctggccctagttccagtgtcttccccaccagtcggcggcacagattctggcagtcacagctctcctgcctcggcaaggtgattccagtcgctacccatctgctcaacaacggatctggcgtgggcgttctacagtgtcttgagcacatgatcggcgcagtccggtcaaaggtcctggagatccattcacatttcccacacaaacctataattctcattgggtggaacacgggagctctggtggcttgtcacgtttctgtcatggagtacgttaccgctgtggtttgcctgggattcccactgctcaccgtagacggtccgcggggtgacgtggatgacccactgctggatatgaagactcctgtcctgtttgtcataggacaaaacagcctccagtgccaccctgaagccatggaggacttccgggaaaagattcgagccgaaaacagtctcgtggttgttggaggcgccgatgataacctgcggatctcaaaagctaagaagaagtccgaggggctcacacagtctatggtcgacaggtgcattcaggatgagatcgttgacttcctcaccggggtcctgacacgggctgaagggcacatgggatctgagccacgcgatcaggatgctgaaaaaaagaaaaaaccccgcgacgtagcacgcagggacctcgcatttgaggtacccgaaaggggtagcaggccagctagtccagcggcgaagctgccagcttctcccagcggtagcgaagatctcagctcagtcagctcttctccgactagcagccctaagactaaagtgacgactgtgacctctgcacaaaaaagtagtcagatcggtagcagtcaacttttgaaacggcacgtgcagagaactgaagctgtgttgacccataagcaggcccaggtcccaatctcttctgagcctcccgaagagggagagaaggaagacctccgggtgcagttgaagcggcaccatccatctacacccctgcccgtgtatagctggttccaccactag

SEQ ID NO: 48212 - DNA, 2295 bp, Artificial Sequence
  Description of Artificial Sequence: Synthetic coding sequence
atgaccctgccccactgccaccggctgatgctgacccaccacctgttctggaccggctggacaatggctcagaataaactgtttaacaagattcttaaggctctgcagtccgatcgtttggcacgacttgccaatgaaggggcttgtaatgagccagtcctccgtcgagttgctgtcgataaatgtgcacgtcgggtacgacaggcgctagcaagtgtttcttgggatactaaactgattcagtggctccatacaactttggtagagacgctgtccctcccaatgctggcagcctacctggacgctctccaaacattgaaggggaagatccccactttgatagatcggatgttggtatctagcaatacaaagacaggtgcagcgggcgccgaagcactgtctcttcttctaaagcgcccctgggaccccgccgtgggagtgctgagccataacaagccttcaaagctcccaggatctccgctgatccttatagctagcagcggtccttctagtagtgttttccccacgtcgaggcggcatcgattttggcaatcgcagttgtcttgtttgggaaaagtcattcctgtggcgacccatttactgaacaatggctccggtgtgggagtcctgcagtgcctggagcatatgatcggcgccgtcagatcgaaagtgctggaaatccactcacactttccacacaaacccatcatcctcattgggtggaacactggggcattggttgcctgccatgtgtcagtcatggagtacgtgactgctgtcgtttgcctcgggttcccacttttgacagtggacggtccaaggggggacgtggatgaccctctgctcgatatgaaaaccccggttcttttcgttatagggcagaattccctgcagtgtcaccccgaagccatggaggacttccgagagaaaattcgggcagaaaattctctggtggtggtggggggcgctgacgacaacctgcggatcagtaaggcgaaaaaaaagagcgagggtcttacacagtctatggtggataggtgcattcaggacgaaatcgtggactttttgacaggcgtgctcacccgggctgagggccacatgggtagtgaacctagggatcaggatgccgaaaaaaagaaaaagccccgtgacgttgcccgtagagatttggccttcgaggtgcccgaaagaggctctcggcctgcctcccccgccgcaaagctacctgcaagtccctcaggcagcgaggacctatcctcagtgagcagcagccctactagttcccccaagactaaggtgaccaccgtgacttctgctcagaagagctcacagatcggcagctcacaactgcttaagcggcatgtccagaggacagaagctgttctgacgcataaacaggcgcaggtgcctatcagttcagaacctcctgaggaaggagaaaaggaggatctgagagttcagctgaagcggcatcacccatcatctccactacctggatctaagaccagcaaaagaccaaaaataaaagtttcactcattagccagggagacaccgcaggcgggccctgtgcgcctagccaggggtccgctcctgagggcggaaagcctatcacaatgacgcttggccaggcttcggctggggccaaggaacttacaggtctacttacgaccgctaagagcagctccagcgagggtggcgtgtcagcaagccccgtgccgagcgtggtgtcgtcatccaccgctccctcggcgctgcacacactgcagagcagactggtcgcaaccagtccgggctcgtctctccctggggccaccagcgcatcctcccttttacagggtctttccttttcgctgcaagacatctcctccaaaacgtccggcctgcccgcaaatccttcccccggccccgccccccaagctaccagcgtgaaactcccaacccctatgcaaagcttaggcgccattaccacaggaacaagtactatcgtgcgtactatacccgtcgccaccacacttagttccctcggggccacacccggtggcaagcccaccgccatacaccaattactgaccaacggaggcctcgctaaactggcaagcagcctgccaggcctcgcacagatcagtaatcaggcttcggggctgaaagtacccacgacaatcaccctgaccctgaggggccaaccatccaggatcactactctctcccctatgggctcaggcgctgcacccagcgaggaatcgagctcgcaggtcctgccatcttcctcacagagactgccaccagcgccttag

SEQ ID NO: 48213 - DNA, 1059 bp, Artificial Sequence
  Description of Artificial Sequence: Synthetic coding sequence
atgcccctgtacgacaaccagaaggcccggagcgtgatgaacgagtgtgaacgtcatgtgatctttgcccgaaccgatgctgacgctccccctcccccggaggactgggaggaacatgtgaacaggacgggctggacaatggcacagaataaactatttaacaaaatccttaaagcactccagtcagacagactggcccggctggcaaacgagggagcttgtaatgaaccagttctgcgcagggtggcggtggacaaatgtgcacgacgggttcgtcaggcactggcgtcagtgtcctgggataccaaattgattcagtggctgcatacaaccctggttgagactctctcacttcccatgctcgccgcctatttggatgctcttcaaactcttaagggcaaaatacccaccctgatagatcggatgctggtctcaagcaacaccaaaaccggagcagctggcgctgaggcgctgtctctcctgctgaagcggccctgggatcccgccgtcggagtgttgagtcacaataagccttctaagttgcctggctcaccactgatcttaatcgcctcctcagggcccagcagctcagtttttccaaccagtcgtcgacaccggttctggcagtctcaactgtcatgtctgggcaaagtcatcccggtagccacacatcttcttaacaatggctctggagttggggttctacagtgcttggaacatatgataggcgcagtgcgctcaaaagtgctggagatacatagtcattttccccataagccaataattctcatcgggtggaataccggggcgctggtggcctgtcatgtgagtgtcatggagtacgtaacggctgtggtatgtttgggcttcccgctgctcacggtagatggcccacggggcgacgtcgatgatcctctcttggacatgaagacccccgtactctttgtgatcggtcagaacagtctgcagtgccatcctgaagccatggaggatttccgtgagaaaatacgcgcagagaactctctcgtggtcgtggggggcgccgatgataacctgtag

SEQ ID NO: 48214 - DNA, 1329 bp, Artificial Sequence
  Description of Artificial Sequence: Synthetic coding sequence
atgagcgccgcccagggctgggaccggaaccggcggcggggcggcggtgccgctggggccggcggcgggggaagtggagcgggtggtggaagtggaggctctggagggcgaggtaccgggcagcttaatcggtttgtacagctgtcaggccggcctcacctgcccggcaagaaaaaaataaggtgggacccagtccgcaggcgattcattcagtcgtgccccataatcaggattccaaaccgatttttacgcggtcataggccccctccagccagaagtggacatcgttgtgtagcagacaatacgaacctgtacgtcttcggcggctataaccctgactatgacgagagcggggggcccgataacgaggattacccactctttcgcgaattgtggcgttaccactttgctacaggggtttggcaccaaatggggaccgatggctatatgccaagggagttggcctccatgagtcttgtcctacacgggaataaccttctagtatttggcggcactggcattccctttggcgaatcgaacggaaatgacgtgcatgtgtgcaacgtcaagtataagcggtgggcgctgctgagttgtagaggcaagaagcccagtcggatctatggacaggcaatggccattattaatggaagtctgtatgtgttcggaggcactacagggtacatctacagcacagacctccacaagctagacttgaatactagagaatggacacagttgaaaccaaacaacttgtcttgtgaccttcccgaagagcgctacagacatgagatagcacacgacggccagcgtatctacatcctcggaggaggtacttcctggacagcctacagcctgaacaaaatccatgcctacaacctggagaccaatgcttgggaggagatagctactaaacctcacgagaaaatagggtttcccgcagcacgacgttgccactcttgtgttcaaataaagaacgacgtgttcatctgcggcggttataatggagaggtgatccttggtgacatttggaagctaaatctacaaacctttcagtgggttaagctgcctgccacaatgcccgaaccagtgtacttccattgtgcagcagtcacccctgctggctgtatgtacattcatggcggagtggtgaatatccacgaaaacaagcgtaccggctctcttttcaagatttggttagttgtcccaagccttttggagctggcctgggaaaaacttttggcggcttttccgaacctcgcaaatctgagcagaacacagctgcttcatctaggcctgacacagggactgattgagaggcttaaatag

SEQ ID NO: 48215 - DNA, 1563 bp, Artificial Sequence
  Description of Artificial Sequence: Synthetic coding sequence
atgggcaagaagggcaagaaggagaagaagggccggggcgccgagaagactgccgccaaaatggaaaagaaagtgagcaagcgcagtcgtaaggaagaagaagacttggaagctcttattgcacactttcagaccctggatgctaaacgaacacagaccgtggagctgccttgccccccgccctcgcctaggctgaatgcgagtctttccgtccatcccgaaaaagacgagctgatcctcttcggaggagaatactttaacggccagaaaacgtttctctacaacgaactgtacgtgtataacactcggaaggatacctggacaaaagtggatatcccatccccccctcctcggaggtgtgcccatcaagccgtagtggtcccccaggggggcggccagctctgggtgttcggcggtgagtttgcaagtcctaatggagagcaattctatcattacaaggatttatgggtactccacctggcgaccaagacttgggagcaagtaaagagcaccggcgggccttcagggcggagcggccacaggatggtcgcctggaaacgccagctcatcctctttgggggctttcacgagtctactcgggactatatttactacaacgatgtctacgctttcaatctcgatacatttacgtggtccaagctgagcccaagcggtaccggcccaacccctcggtctggctgtcaaatgtctgttaccccccaaggcggtattgttgtgtacggcggatacagcaaacagagagtgaaaaaggatgtggataagggaacccgccacagtgacatgttcctgctcaagccagaggacggccgcgaagacaagtgggtatggacgagaatgaacccctccggtgtgaaacccacgcccaggtcaggattttctgtcgcaatggctcctaaccaccagacgctgtttttcggcggcgtctgcgacgaagaagaggaagaatcgttgagtggcgaattttttaatgatctctatttctacgatgccacaagaaataggtggtttgaaggccagctgaaggggcccaagtccgagaaaaagaagcggcgacgaggcaggaaggaagagcctgagggtggctctagacctgcttgcggtggcgcaggaacccagggccccgttcaactggtcaaggaagtagtggccgaggatggcacagttgtcacgatcaagcaagtgctaactgccccggggagtgccgggcagccccgcagtgaagatgaggactcgctggaagaggctggtagcccggcccctggaccttgtcccaggagcaacgctatgctggctgtaaaacacggggtcctttatgtctacggaggcatgtttgaggcaggagatcgccaagtgaccttaagcgatttgcattgccttgatcttcatcggatggaagcttggaaggcccttgtcgaaatggatcccgaaactcaggagtggctagaggagactgattcagaggaagactctgaggaggtggaaggagctgagggtggggtggacgacgaagatagcggcgaggagagtggcgccgaagattag

SEQ ID NO: 48216 - DNA, 777 bp, Artificial Sequence
  Description of Artificial Sequence: Synthetic coding sequence
atggtggcctggaagcggcagctgatcctgttcggcggcttccacgaatccaccagggattatatttactacaacgatgtgtacgcctttaacttggatacctttacctggagtaagttgtctccatcaggcacgggcccaacacccaggagcggttgtcagatgtctgttacccctcagggggggatcgtagtgtatggcgggtacagtaaacagcgggttaagaaggacgtagacaagggcacacgccatagcgacatgtttttattgaaaccggaggacggccgggaggacaaatgggtttggactagaatgaatcctagcggggtgaagcccactcctcgctccggattctcagtcgcaatggcccccaaccatcagaccttgttctttggcggggtgtgcgacgaggaagaggaggaatctttatctggcgaattcttcaatgacctgtatttctatgacgcaaccagaaataggtggtttgaggggcagttaaagaaactgagatcaggctggcgccgtaggacaaggaagagaactgtgcgcaggcttcgtgctcccagggtagggtctactacgaagactgctgaacgaagggccgtccggagaacagagagtccatgtcaggggaggctcgcctctgccgtccccacctccgcccaagaccccgcagtcttgagcgaggctcttggagcatccgtgaggcctgacgcacaggaacgggccgaggggggatggccaaggccagggtgcgaactttccccgatggtttag

SEQ ID NO: 48217 - DNA, 1470 bp, Artificial Sequence
  Description of Artificial Sequence: Synthetic coding sequence
atgggcaagaagggcaagaaggagaagaagggccggggcgccgagaagactgctgctaaaatggagaagaaagtgtctaagaggtctagaaaagaggaggaggacctggaagctctgatcgctcactttcaaacactggatgcaaagaggacacagacggtcgagctcccctgtccccctcctagccccagactgaatgcaagcctgtccgttcaccccgaaaaagatgagctcatcttgtttgggggggaatacttcaatggccagaagaccttcctgtataatgaattgtacgtttataatacccgtaaggacacgtggacgaaggtggatatccctagtccccctccacggcgctgtgcccatcaggccgtcgtggttcctcaggggggtgggcagctgtgggttttcggtggcgagttcgcgagtccaaatggagagcagttttaccactacaaggatctatgggttctgcacctggccacaaagacgtgggaacaagtgaaggactatatttattacaacgatgtttacgcctttaatttagacacatttacctggagcaaactgtctccttctggcacaggcccaactccgagatcaggctgccaaatgtctgtaacgccccaaggtggcatagtggtatacgggggatacagtaaacaaagagtgaagaaagacgtagataagggcacacggcacagtgacatgtttctattgaagcctgaagatggccgggaagataaatgggtgtggacaaggatgaaccccagcggggtcaagccgacaccccgatcaggcttttcggtggccatggctcctaaccaccagacactcttttttgggggggtatgcgatgaggaggaagaagagtcattgtctggggaattttttaatgacctgtacttctacgacgcgactcggaacaggtggttcgagggacaactcaaggggcccaaatcagaaaaaaagaagcggagacgtggccggaaagaggagcctgaaggaggcagccgccctgcgtgcggcggggccggtacccagggccctgttcagctggtgaaggaggtagtagctgaggatggcaccgtggtgactatcaaacaggtactgacagcacctggttccgccggccagcctaggtctgaggatgaggactccctcgaggaagcggggagcccagccccaggaccctgcccgcggtctaatgctatgttggccgttaaacacggcgttctttatgtgtacggcgggatgttcgaggcaggcgaccgccaggttaccctcagcgatcttcattgcctggacctgcaccgcatggaagcctggaaagcgctggtcgagatggaccccgagacacaggaatggctcgaagagaccgactccgaggaagatagcgaagaggtggaaggcgccgagggcggcgtggatgacgaggattctggggaagagtctggcgctgaggactag

SEQ ID NO: 48218 - DNA, 1392 bp, Artificial Sequence
  Description of Artificial Sequence: Synthetic coding sequence
atgggcaagaagggcaagaaggagaagaagggccggggcgccgagaagaccgcggcgaagatggaaaaaaaggtgtctaagaggtcgcgcaaggaagaaacttttctgtataacgagctgtatgtttacaacacccggaaagatacatggaccaaagtagatattccctcgccacccccacggaggtgcgctcaccaggcagtggttgtccctcaggggggcggacagctgtgggtgttcggtggtgagttcgcaagcccaaacggggagcagttctaccattacaaggatctttgggtcctccaccttgccactaagacctgggaacaggtcaagtccacaggcggcccttctggaagaagcggtcacagaatggttgcatggaaaaggcagctgatccttttcggcggcttccacgagagcaccagagactacatatactataatgatgtgtatgcttttaatcttgatactttcacttggagcaaactgtccccctctggcaccgggcctactcctaggagcggatgtcagatgagtgtgaccccacagggtgggatagttgtttacggcgggtatagtaagcagcgcgtcaagaaagacgtcgataagggaacaaggcatagtgatatgttcctcctaaagcccgaggacggaagagaggataaatgggtatggacaaggatgaatccatcaggggtaaaaccaacacctcgctcagggttcagcgtagccatggcgccgaaccatcagacactgttcttcggcggggtttgcgacgaggaagaggaggagtcgcttagcggggagttcttcaacgacttgtacttctacgatgctactaggaatcgatggtttgagggacagctgaaaggccccaagtcagagaagaaaaagcgcagaagagggcgcaaggaggaaccggagggaggttccaggcctgcatgcggcggcgccggaacacagggaccggtgcaactggtcaaagaggtggtggccgaagatggaacagtggtgaccattaagcaagtgctaactgccccaggatcagccgggcagccccgaagtgaagatgaggatagtctcgaggaggccggctcacccgccccaggtccctgtcctcgctctaatgctatgctggctgtgaaacatggtgtcctgtatgtgtatggcgggatgtttgaggccggagaccggcaagttacactttcggacctacactgcctggacctgcaccggatggaagcatggaaagccctcgtggaaatggacccagagacacaggaatggcttgaggaaaccgacagcgaggaggattcagaagaagtcgagggggctgaaggaggcgtggacgatgaggacagtggagaggaatcaggggctgaggattag

SEQ ID NO: 48219 - DNA, 1518 bp, Artificial Sequence
  Description of Artificial Sequence: Synthetic coding sequence
atgagcgccgaggagatggtgcagatccggctggaggaccggtgctatccggtgtcaaaaaggaaactgattgagcagtcagactacttcagagcactgtataggtccgggatgcgtgaagccctgtctcaggaagctggcggtcccgaagttcagcagctgagagggttgtcagctcctggattaagactggtcctagattttatcaacgctgggggagcacgagagggatggctcctcggccctcgaggagagaaaggaggtggagttgatgaagatgaagagatggatgaggtgtcgctgctgtccgaattagtcgaggccgcgtcatttctgcaggtgacatcgctgttgcagttgctgctgtcacaggtgcgcctgaataattgtttggaaatgtacagactggctcaggtgtatgggcttccagatctccaggaggcttgcctgcggtttatggtcgtgcatttccatgaggtcctctgcaaacctcagtttcatcttcttgggtcaccccctcaggccccaggcgatgtcagccttaagcagcgcctgcgagaggcaagaatgaccggaacccctgtgctggttgccctcggagacttcctaggcggcccattggcccctcacccatatcagggggagcccccttcaatgctccggtacgaagagatgactgagagatggttccccttggcaaacaacctgcccccggacttggttaacgttcgaggctatggaagtgcaatcttggacaactacctctttatcgtgggtggctatcgcattacctctcaagagataagcgctgcccacagctacaatccttcaaccaacgagtggctgcaggtggcatctatgaaccaaaaaaggtcaaatttcaaactcgtggcagtcaactctaagctgtacgccattggtggccaggccgtgtctaatgtcgagtgctataaccccgagcaagatgcctggaacttcgtggcgcctctaccaaaccctcttgcagagtttagtgcctgcgaatgtaagggcaagatctacgtcatcggtggctatacaacacgcgacaggaacatgaatattctgcagtactgcccttcaagtgatatgtggaccctctttgagacatgtgatgtgcacattcggaagcagcagatggtctcggtcgaggaaactatatacatcgtcgggggctgcctccacgaactggggcctaataggagaagctcacaaagcgaagatatgcttacagtccaaagttataatacagttaccagacagtggctgtaccttaaggaaaacaccagcaaatcaggactgaacttgacatgcgctctgcacaacgacgggatttacatcatgtccagagacgttacactctccacatccctggagcatcgagtgttcctcaaatacaatattttctcagattcctgggaggccttcagacggttcccagcattcgggcataatttgctggttagcagcctctacctccccaacaaggccgagacgtag

SEQ ID NO: 48220 - DNA, 1785 bp, Artificial Sequence
  Description of Artificial Sequence: Synthetic coding sequence
atggtgctgcggagccaccccttcccccggcaggaccggccccagggaagcgttcctagagcggtaccaggctcgcccgtcggccctagcacgagtactcactctgaggaccggcacggcccatcatcaagcgtgggtaccgtgatcgggaccggaactgggggtttagttgaagctggtggccagcctcagccgcgaagctccgagacaaatggttcaccttcaccagacccccctccaggtctcagaggggaaggtacccgcgaaaaaagtcttgacccattgcctcaggccgccatgcctcgtggacccgctcagccccctgctcagaggccccccgggcccgccgctagttcttccgccaggcggagtcaacctgtacctcagcttcggaagcggagccggtgtgaaatcgccccatccagtgagcaagaggtaaggccggcagcatctggggacccacagggcgaggctccgggggaggggggcagcccagccggaaggagcggagcactgaccgaaaagcaagaagaggctcggaagctgatggtgttcctccagagacccgggggctggggagtcgtcgagggcccgcggaaaccttctagtcgtgcactggaacctgccaccgccgcagcattacgcaggcgacttgacctgggtagttgcctcgacgtgctggccttcgcacagcagcacggggagcccggcttggcccaggagacttatgccctcatgtccgataacctcctgagggtcctgggcgacccttgtttgtatcgccgactgtcggccgcagatcgggagcgcattctgagtttgcggactggccgtggaagggccgttctgggagtgctcgtgctgccatcgttataccagggaggcagatccgggttaccgcgcggccccaggggagaagagccacctgccgctgctccggtgagcctgcctttaccagcacacctgcacgtgtttaacccccgagaaaatacttggcggcctctgacacaggttcctgaggaggcgcccctccgggggtgtggattgtgcaccatgcacaattacctgttcctcgctggtggtataagaggaagcggcgcgaaggccgtatgttcaaatgaagtcttctgttataacccgctgacaaatatatggtctcaggtgagacccatgcaacaggccagggcacagttgaaattggttgctctggacgggcttctgtatgccatcggaggcgagtgtctgtactctatggaatgttacgatcctcggacagatgcatggaccccccgggcccctctgccagcgggcacattcccagtggcccatgaagccgtggcctgccgtggcgacatctacgtgactggcggtcatctcttctatcggctgcttcgctactccccagtgaaggatgcttgggatgaatgtccgtatagtgccagccaccgccggtcaagcgacatcgtcgccctcggcgggtttctgtatcgatttgatctgctccgcggtgtcggcgcagccgtgatgcggtacaacacagtaaccggctcctggtctcgggctgcctccctcccactgcccgcccccgcacccctacactgcaccacacttggtaacacaatttattgcctcaatcctcaagtgaccgccacattcacagtaagcgggggcacagcccagtttcaagcaaaagagctgcagcccttccccctgggaagcactggagttttgagcccttttattctaaccttgccaccagaggaccgactgcagacaagtctgtag

SEQ ID NO: 48221 - DNA, 1053 bp, Artificial Sequence
  Description of Artificial Sequence: Synthetic coding sequence
atggaggtgcccaacgtgaaggacttccagtggaagcggctggcccccctgcccagtaggcgggtatactgttccctcctcgaaactggtgggcaggtgtacgcgataggaggatgtgatgataatggggtgccaatggactgcttcgaggtatactccccagaagctgatcagtggactgctctccctcgcctgccaaccgctcgcgccggcgtggctgtgacagccctgggaaaacgcatcatggtcattggaggcgtgggtactaatcaactgccactgaaggttgtggaaatgtataacatcgacgagggaaagtggaagaagagaagcatgttaagggaggctgctatggggatatcagtgactgctaaggactaccgtgtatacgccgccggaggcatgggattagacctacgcccccataaccaccttcaacactacgacatgttgaaggacatgtgggtctctcttgccccaatgcctaccccaagatatgctgctacctccttccttagagggtcaaaaatctacgtgctaggcgggcgccagtcaaagtacgccgtgaacgcatttgaggtgttcgacattgaaaccaggtcttggacgaaatttccaaatataccatataagagggctttcagcagctttgtgacattggataaccatctgtactcactaggcgggctccgccagggcaggctgtacagacagccaaaatttctccggactatggatgtgttcgatatggagcaggggggctggcttaagatggagcggagctttttcctgaagaagcggagggctgattttgtagccggatcactttctggtcgggtgatagtggcgggcgggttgggaaaccagcctaccgttttggagacagctgaagccttccatcccgggaaaaataaatgggagattctgccggcaatgcctacaccaagatgtgcctgttcctctatcgttgtgaaaaactgtttgcttgcagtcggcggcgtgaatcagggtttgtctgacgctgtcgaagcactttgcgtaagcgacagctag

SEQ ID NO: 48222 - DNA, 1053 bp, Artificial Sequence
  Description of Artificial Sequence: Synthetic coding sequence
atggaggtgcccaacgtgaaggacttccagtggaagcggctggcccctttaccttctagacgcgtttactgctccctgctcgaaaccggcggacaagtctacgctattggagggtgtgatgataacggcgtccccatggattgcttcgaggtgtactcacccgaggcagaccagtggacagcactcccacggctgcccaccgcccgggctggtgtggctgtgaccgcactcggtaaacggatcatggtcattggaggggtggggactaaccaacttccgctgaaagtcgtggagatgtacaatatagacgagggtaaatggaaaaagcggagcatgctgagagaagctgccatgggcatctcagttaccgccaaggactatcgtgtgtatgctgccggggggatgggtttggacctgcggcctcacaatcacttacagcattatgatatgctaaaggacatgtgggtcagcctcgctcctatgccaactccacgttacgccgcaacttccttcttgcgaggcagcaagatatatgtgctcggtggcagacagtccaaatacgctgtgaacgcgtttgaggtatttgatatcgaaactcggtcatggacgaagttccccaatattccttataagcgtgcctttagttcttttgttaccctggacaatcatctgtactccctgggtgggctgcgccagggacggctgtaccgtcaacctaagtttcttagaacaatggatgtgtttgatatggagcagggaggctggctgaagatggagagatcattctttctaaaaaaaaggagggccgacttcgtggctggctcacttagtggacgtgtcatcgtggccgggggtctgggaaaccagccaacagtgctggaaacagccgaggcatttcatccggggaaaaataaatgggagattctccctgcaatgccaacccccagatgtgcctgcagctccattgtggttaaaaattgcctacttgcggttggtggggtgaatcagggtctgagtgatgccgtagaagccctgtgtgtcagtgactcatag

SEQ ID NO: 48223 - DNA, 714 bp, Artificial Sequence
  Description of Artificial Sequence: Synthetic coding sequence
atgatcgccggctgccggagcttcagcctgcagagcgactaccgggtatatgccgcggggggaatgggcttggatctgcggccccacaaccacctgcagcattatgacatgttaaaggacatgtgggtgtctctggcgcccatgccgaccccaaggtacgctgccacaagctttctgagagggagtaaaatctatgtcctgggtggccgccagagcaaatacgcagtgaatgccttcgaggtgttcgatattgagacgcggtcatggacaaaattccccaacattccgtacaagagagccttctcgagtttcgtgaccctggacaaccacctctattccttgggaggccttaggcaggggcgactttaccggcaacctaaatttttgaggaccatggacgtgttcgacatggaacaaggaggctggctcaagatggaaagaagcttcttcctcaagaagaggcgagctgatttcgtcgctgggagccttagtggtagagtgattgtggctggcggtctggggaaccagcctacggtgcttgaaacagcggaagcgttccatcccggaaaaaacaagtgggagatcctgcccgccatgcccacacctcggtgtgcttgttcttctatcgtcgtgaaaaactgtctactcgcagtaggtggcgtaaaccagggactgtcagatgcggtggaggcgctgtgtgtgtcagattcttag

SEQ ID NO: 48224 - DNA, 1053 bp, Artificial Sequence
  Description of Artificial Sequence: Synthetic coding sequence
atggaggtgcccaacgtgaaggacttccagtggaagcggctggccccactgccgagccgccgcgtgtattgtagcctacttgaaactggcggtcaagtgtacgcaattggagggtgtgatgacaacggagtcccaatggactgttttgaggtctattctcctgaagctgatcaatggacagcgctgccgcgcttgccaactgcccgggccggagttgctgttactgccctcggaaagcggatcatggttataggcggggtcggcaccaatcaactgcccttgaaagtggtggagatgtataacatcgatgagggcaaatggaaaaagagatctatgctgcgtgaagccgcgatggggatcagcgtgacggcaaaagactaccgggtctacgctgccgggggaatgggactagatctgaggccacataaccacctgcagcattatgatatgctcaaagatatgtgggtatccctcgcgccaatgccgacacccagatacgccgcaacaagcttcctgaggggctctaagatctacgtgctcggcggccgtcagtctaagtatgcggttaacgcttttgaagtgttcgacattgagacacgctcctggacaaaattccccaacatcccatataagcgagcttttagttcattcgtgaccctcgacaaccacctgtattcattaggcgggctccggcagggacgtctgtatcggcaaccgaagtttctgcgcaccatggacgtgttcgatatggagcagggcggatggctgaaaatggagcgctccttcttcttgaagaaaagaagggccgattttgtggccgggtccctctcgggaagggtaatagtcgctgggggcttgggtaaccagcctaccgtgctagaaactgccgaagccttccacccaggcaaaaataagtgggagattctgccggctatgcccactccccgatgtgcctgcagttccattgtggttaagaattgtctgctggccgtaggaggggtgaatcaggggcttagcgacgctgtcgaagccctctgcgtgagcgacagttag

SEQ ID NO: 48225 - DNA, 1050 bp, Artificial Sequence
  Description of Artificial Sequence: Synthetic coding sequence
atggccgtggccgtgccccccggccgggccgccggcagcggctgggcctggcgcccagtagcacgtgatgccctgctcgcacgggcctttcattcttgtaccgagctgcggggccggttttaccttgtcggcggtctcctggcgggtggagccagagagccttccagcgatacagtggtcttcgatccagctagaggacaggccgtccgattgggagccagaggttctcccccccggtcccaccacgacgcagcccctgtggatgggcgatggctctgtgttgtaggcggttgggacggctcccgccgtctcgcgactgtgaccgctctggatacggagcgcggggtttgggaagcttggactgggacccctggcgattgcccaccagcgggcctgagttcccacacttgtacaagaatttctgatagggagttacaggtggcggggagagaaggtggcattcacacacaaagaagatacggttccatttacaccctgaggctggacccgtccgcacggacatactgctataagcaggagggatgtcatacagcctctagatctggccattgcgcggccctacttcagacgcccggacctcacccaggccaccagcttctgctttttggggggtgcaacttggctgaacctgaagttgccggtcactggtcgcacgggaaaatcaaagaggagcccccagtggccccacacctaatggagcagcttgcgagactggtatcctctggacaggggagccagaagggacctcacggcttaaggcaccacagctgtagtgtagtgggaccatttgcggtgctctttgggggagaaacattgacccgtgctagagacaccatctgtaatgatctgtatatctacgatacaagaacgagtccccccctgtggtttcacttcccatgcgcagataggggcatgaagaggatgggtcaccgaacttgcctgtggaacgatcaactttacttagtgggagggtttggggaggacggccgcacggcttccccacaggtgtgtatcctagactttatctag

SEQ ID NO: 48226 - DNA, 867 bp, Artificial Sequence
  Description of Artificial Sequence: Synthetic coding sequence
atggccgtggccgtgccccccggccgggccgccggcagcggctgggcctggagacccgtggctagggacgctttactggccagggctttccactcatgcacggaactgagaggcaggttctatctggtgggtggactgctggccggtggagctagggagccctcttcagacacagtagtcttcgatcctgcccgaggacaggcggtccggctgggcgcacgggggagtccacctagaagccaccacgatgcggcccctgtggacggcaggtggctttgcgtcgtcggtggctgggatggatctcgccggctggctaccgttaccgctcttgatacagaacgaggagtctgggaggcttggaccggcactcccggggactgccctccagcagggctttcttcgcacacctgcactagaatcagtgaccgcgaactgcaggttgccggcagggaaggaggcattcacacacagcgccggtatgggagtatttataccttgcgccttgatccttcggcccgcacatactgctataaacaggagggctgccacacggcaagtcggagcggccattgcgcagcacttctacaaacacctgggccccatccagggcatcagcttctgctgttcggcgggtgcaacttggccgaacccgaggtggcaggccattggtctcacggtaagataaaaagtttcctctccccacagggcggcacaacctgttgctcgtctttcgatggcaccgcctgtaaggcttgcgaacaatgggcaggcgtaccggagggtgccccctggactactgcaagcctcatgttttgtggacgagccctgtgttgcgcagtgtggtggcgaaactcggaccagagttag

SEQ ID NO: 48227 - DNA, 1872 bp, Artificial Sequence
  Description of Artificial Sequence: Synthetic coding sequence
atggagcacgccgtggccccctgcgtgctgtaccccggcaccgagccaggcgcagccggcgagagtgagagcgagggcgcagcctccccagcacaaaccccttgttctctcggggcctcgctgtgtttctcttcaggggaggagtcacccccccagtcactcgcttccgcggccgagggggctgcaacgtcacctccaagctccggcggcccacgtgtggtagagcgtcagtgggaagctggttcagccggagccgctagccccgaagaacttgctagcccggaggaacgggcctgccctgaggaaccggccgctccttcacccgagccgcgcgtttggcttgaggaccccgctagtcccgaggaaccaggcgagccggccccagtgccaccagggtttggggcagtctatggagagcctgacctggtgcttgaggtcagcggccgtcggcttagagcacacaaggccgttttagccgctagaagcgactactttagggcacgtgcttcccgcgatgttctgagagtgcagggggtctcactgaccgccctgcgactcctgctggctgacgcctattccgggaggatggccggcgtccgcccagataatgtggcagaagtcgtcgctggcgctcggcggctccagttacccggggcagcccaaagagcaacagacgccgtcggccctcagctgagtttggcaaattgctatgaggtgttgtcagcagctaagcggcagcgtttaaacgaactcagggacgcagcatactgttttatgtcagaccattatctcgaagtgctgcgggagccggccgtatttggaaggctgagcggcgcagagcgtgatctgctccttcgacggaggctgagagcagggcgagctcatcttctggcagcagctctgggccccgccggcgaacgggcgggctctcgtccccagtccccgagcggtgacgctgacgcccggggtgacgctgctgtatactgtttccacgccgccgcgggggagtggagagaactcacacggctccccgagggcgctcctgccagaggttgcggcttgtgcgtcctgtataactatctcttcgtggccggaggggtggcccctgccggacccgacggacgagcccgcccttctgaccaggtcttctgttacaatcccgccacagattcatggtctgcggtgcggcccctgcgacaggccagaagtcagctcaggctgttagccctggacggccacttgtacgccgtggggggtgaatgcctgctctccgtagagcgttacgaccctcgggctgatagatgggctcccgtcgctcctcttcctaggggcgcattcgctgttgcgcacgaagcgactacttgccacggagagatctatgtgagcgggggctctctattctatcggctcctgaagtacgatcctaggcgggatgagtggcaggaatgtccttgttctagcagccgggaacgcagcgccgatatggttgctctcgacgggtttatctatcgttttgacctctccgggagccggggtgaagcccaagcggctggcccctctggggtcagtgtctccaggtaccactgtctcgctaaacagtggtccccttgcgtcgccccacttcgtctgcccggaggcccaacaggcctgcagccattccgatgcgccgccctggatggggccatctactgcgtgagtcgagctgggacctggagatttcagcctgccagagaaggggaagccggtggagacgccggacagggaggtggttttgaggctctgggcgcccctctcgacgttagaggagtactaataccgtttgcactctccttgcctgaaaaacctccacgcggcgaacagggggcaccttag

SEQ ID NO: 48228 - DNA, 1872 bp, Artificial Sequence
  Description of Artificial Sequence: Synthetic coding sequence
atggagtgcaagatcgagggcaaggagaagtaccagcacagcctgaatctcttgaacaagattcagaatatgaaggagttggccgaaatgatcgatgtcgtgctgacagcagagggggagaaattcccatgtcatcggttggtactggctgccttcagtccctactttaaggcaatgtttacgtgcggcctgcttgaatgtaatcagagggaggtcatattgtacgacattactgcagaatccgtgtctgttttgctaaactatatgtataacgctgccctggagataaataacgccaacgtccagacggtggccatggccgcctacttcatgcagatggaggaagtgttttccgtgtgtcagaaatacatgatggatcacatggacgcatccaattgtctcggtatctattattttgccaagcagattggggcggaagatctgtccgaccggagtaaaaaatacctgtaccagcatttcgctgaagtctcacttcacgaggagatcctcgaaatagaggtgcaccagtttcttacactcattaagtcagatgacttaaacatttcacgagaagaaagtatcttagatcttgtcttgaggtgggttaatcacaacaaggaactacgcaccgtccatttagtcgagctgctcaaacaagtgagattggagctggtaaaccccagcttcttgaggcaggccctgcgacggaacacaatgctgctgtgtgacgctgactgtgtggatattattcaaaacgcatttaaagcaatcaagacccctcagcagcactcgttgaaccttcgctatggcatggaaacaacatcactcctcctttgtattggcaacaattcttctggaatccgctcccgacaccgcagttacggggatgcctcgttctgctacgaccctgtcagccggaaaacatattttatatcctcccccaagtacggcgagggtttgggcacagtgtgtactggagttgtgatggaaaataacacaatcatagtggccggtgaggcttctgcctcaaagctgtctcggcagaaaaataaaaacgttgagatataccgatatcatgacaggggcaaccagttttgggaaaaactctgtactgcggagttccgggagctgtatgcgttgggaagcatccacaatgacctgtacgtgataggagggcagatgaaaattaaaaaccaatatcttataacaaactgcgtggataagtacagcgttgaaagagataattggaagagagtgagtccattgcccttgcagctggcatgccatgctgtggtgacggtgaacaacaagctttatgttattggaggctggaccccccagatggaccttcctgacgaagagccggatcgactctctaacaaactgctacaatacgacccttcgcaggatcagtggagcgtacgggcccccatgaagtacagcaagtaccgtttttctactgctgtggtgaactccgagatctatgtgctggggggtataggatgcgtcggacaagataagggccaggtcagaaaatgcctggacgtagtagagatctataaccccgacggtgacttctggcgcgaaggaccgcccatgccgtcccctctcttgagtctccgaacaaattcaacaaacgccggggccgtagatggcaagctctatgtttgtggaggatttcatggtgctgacagacacgaagtgatatccaaagagatcctggagctggacccctgggagaaccagtggaacgtcgtggctatcaatgtcctcatgcatgatagttatgacgtttgcctcgtggcccggatgaatccaagagacctgattcctcctccaagtgacctggtcgaagaggggaatgagcactag

SEQ ID NO: 48229 - DNA, 1872 bp, Artificial Sequence
  Description of Artificial Sequence: Synthetic coding sequence
atggagtgcaagatcgagggcaaggagaagtaccagcacagcctgaacctgttgaacaagattcagaatatgaaagaactcgccgagatgatcgacgtggtgttaacggccgagggggagaaattcccctgccatcggcttgtgcttgccgcatttagtccctatttcaaggcgatgttcacttgcggcctgttggaatgtaaccagcgcgaggttatcctgtatgatattacagcagaatccgtgagcgtgttgctaaattacatgtataacgcagccctcgagataaacaatgccaatgtccaaacagtggccatggctgcctatttcatgcagatggaagaggtgttctccgtttgtcagaaatacatgatggaccatatggacgcttccaactgcttaggcatctattacttcgctaagcagatcggagcggaggatctgtccgatcgtagcaagaaatatctgtatcagcacttcgctgaggtctccttgcacgaagaaattctggagatagaggtccatcagtttttgactcttataaaatcagacgacctgaacatctcgcgggaggagagtatccttgatcttgtgctgaggtgggtcaaccataataaggaacttcgtaccgtccacctcgttgaactcctgaagcaagtgcgtttggaattggtcaacccctcttttctacgccaggccctcagacgcaatactatgttgctatgcgacgcagattgtgtggacatcatccagaatgcctttaaggctatcaaaactccacagcagcattctttgaatcttcgttacgggatggaaacaacctcgcttcttctgtgcatcggcaacaatagctcaggcatcaggtccaggcacaggtcctatggagatgccagtttctgttatgacccagtctcccggaagacgtatttcatcagcagcccgaagtacggagagggacttggaaccgtgtgtaccggcgtggtaatggagaataatacgataatcgtggctggggaggcgtcagcctctaagctctcccgacagaaaaacaaaaacgtggaaatttacaggtaccatgatcggggaaaccagttctgggaaaagctgtgcaccgctgagttccgcgagctgtacgctctgggatcgatccataatgatctgtacgtgatcgggggccagatgaagattaaaaatcaataccttatcaccaactgcgttgataagtattcagtggagagggataactggaaaagagtcagtccccttccacttcagctcgcttgtcacgctgtggtgactgtgaataacaaactctacgtgatcgggggatggaccccacaaatggatctgccagacgaagaacccgacagactctcaaataaactattgcagtacgacccttctcaggatcaatggtccgtacgggctcctatgaagtactctaagtacaggttcagcaccgctgtagtgaatagcgaaatctacgtcctgggcggaatcgggtgtgtgggccaagacaagggccaagtgcgcaagtgtctggatgtggtggaaatctacaaccctgacggggatttctggcgagaaggacctccgatgccatccccccttctgtcactgcgtactaattccaccaacgcaggcgccgtagatggaaagctgtacgtatgtggcggcttccatggcgcagaccgacatgaggttatttccaaggagattttggaacttgacccttgggagaaccagtggaatgtggtagccatcaacgtgctgatgcatgactcgtatgacgtgtgcctggtcgccaggatgaaccctcgggatctcattcctcctccttcagatctagtagaggaggggaacgagcactag

SEQ ID NO: 48230 - DNA, 1872 bp, Artificial Sequence
  Description of Artificial Sequence: Synthetic coding sequence
atgagcacccaggacgagcggcagatcaacaccgagtacgccgtgtcgctgctagaacaactgaaactgttttatgagcagcagctctttacagacatcgtcctgattgttgagggaacggagttcccctgtcacaagatggtactggccacatgttcctcctacttcagagccatgtttatgagcggactatctgagagcaaacaaacccatgtgcacttgaggaacgtggatgcagctacactgcagatcataatcacatacgcctacacaggaaatctggcgatgaacgacagcacagtggaacagttatacgaaacagcttgcttcctgcaggtagaggacgtgctgcaacgctgcagggaatacctgatcaaaaaaatcaacgctgagaactgtgtacggcttctgtctttcgccgacctgttctcatgtgaggaactcaagcaaagcgctaagcggatggttgagcataagtttaccgctgtttaccaccaggacgcctttatgcaactgtcccacgacctgctgatcgatatcctgtcctcagacaaccttaatgttgagaaagaggagaccgtccgagaagcggctatgctgtggctagagtacaatactgaatcccggtcccagtatctgtcgagcgtgctgagtcagatcaggattgatgctctgtctgaggtgacccagcgcgcctggtttcaggggctccctcccaatgacaagagcgtcgtcgtgcagggcctatacaagagcatgcctaaattctttaagcctcgactggggatgactaaagaagaaatgatgatatttatcgaagcctcttcggaaaacccttgcagtctgtacagttccgtgtgttacagcccacaggcagagaaggtctacaagttgtgctccccacccgccgatttacacaaggtaggcacagtggtgactccggataacgatatatatatcgcaggggggcaggtacctttgaaaaacaccaagacaaaccatagtaaaacgtccaagctgcagacagcatttaggactgtcaattgcttctattggtttgacgcccagcaaaacacttggttccctaagaccccgatgctctttgtgagaattaaaccttcactcgtctgctgtgagggatatatctacgctattggcggagactcagtgggcggggagctcaatcgaaggactgtggagcggtacgacactgaaaaagatgagtggactatggtctccccactaccctgcgcgtggcaatggtctgcagccgtggtcgtccatgattgcatttacgtgatgacactgaatctgatgtattgttacttccctcgcagcgattcgtgggtcgaaatggccatgagacagacttcgaggagctttgcctccgctgcagcattcggcgataagatattttatattggcggactgcatattgccacaaactccggcattaggctccccagcggcacggtggatgggtcatccgtcacagtggaaatatacgacgtcaacaagaacgaatggaaaatggccgccaacatccccgcaaagcggtattctgacccctgcgtgcgggccgtagtcatcagcaattctttatgcgttttcatgcgggaaacacatctgaatgagagggcgaagtacgtcacctatcagtatgatctggagctcgatcggtggtccttgcgtcaacacatctcagaacgagtcctgtgggacctggggcgggacttccggtgtacagtcggaaaactctacccatcctgtttggaggagagtccatggaagcctcctacatacctcttctcaaccgacggaacagaggagtttgagttagacggggaaatggtggcactgccaccagtgtag

SEQ ID NO: 48231 - DNA, 45 bp, Artificial Sequence
  Description of Artificial Sequence: Synthetic coding sequence
atgagcacccaggacgagcggcagatcaacaccgagtacgcctag

SEQ ID NO: 48232 - DNA, 15 bp, Artificial Sequence
  Description of Artificial Sequence: Synthetic coding sequence
atgagcacccagtag

SEQ ID NO: 48233 - DNA, 147 bp, Artificial Sequence
  Description of Artificial Sequence: Synthetic coding sequence
atgagcacccaggacgagcggcagatcaacaccgagtacgccgtgtctctgctcgaacagttaaaattattttatgaacaacagctgtttaccgacatagtgctgattgtcgagggcaccgagtttccgtgccacaagatggtctag

SEQ ID NO: 48234 - DNA, 90 bp, Artificial Sequence
  Description of Artificial Sequence: Synthetic coding sequence
atgagcacccaggacgagcggcagatcaacaccgagtacgccgtgagtttgctggagcagcttaagctgttttatgagcagcaactgtag

SEQ ID NO: 48235 - DNA, 1050 bp, Artificial Sequence
  Description of Artificial Sequence: Synthetic coding sequence
gtgcgggaggccgccatgctgtggctggagtacaacaccgagagccgctctcagtatctaagctccgtgctgagccaaattcgcattgacgcgctgagcgaagtcacccagagggcctggtttcagggtcttcccccaaatgataagagcgtggtcgtccaaggactgtataaaagtatgcccaaattcttcaagcctaggctgggaatgacaaaagaggagatgatgatctttatcgaggccagctccgaaaatccatgtagtttgtacagcagcgtatgttattctcctcaggcggaaaaggtctacaagctgtgttccccaccagcagatttgcataaagtcgggaccgtcgtgacccctgacaatgatatttacatcgccggcgggcaagtgccgctgaagaataccaaaaccaaccactctaagacttctaaattacagacactgcagaactgcgaattactgttgctggatgcacagcaaaacacttccaaagaccccaacgctttttgccctcataaggccattttctgttgcgagggttacatttacgcaatcggcggagattccgtgggcggggagctaaacaggagaacagtcgaacggtatgacacggagaaggatgaatggactatggtcagtcctctcccttgtgcctggcagtggtcagccgctgtggtggtccacgactgcatatatgtaatgactttgaatcttatgtattgttatttccctcgcagcgacagttgggtggagatggcaatgagacagaccagccgcagtttcgcctccgccgcagcctttggcgataaaatcttctacatcggagggttacacatagccacaaacagcggcatacgactgccttccgggactgtggacggatcctccgtcacggttgaaatctatgatgtgaacaaaaacgaatggaaaatggccgcaaacatccctgccaaacggtactcggacccatgtgtgcgggcggttgtgatctccaatagtctgtgcgtcttcatgcgagagacacatcttaatgagagggcctag

SEQ ID NO: 48236 - DNA, 1839 bp, Artificial Sequence
  Description of Artificial Sequence: Synthetic coding sequence
atggagctggccatggacaacagctacgccttcaaccagcggagcacttgcaatggtattccatcagaaaagaaaaataatttcttagtgtctgaggatcatggccaaaagatcctcagcgttctgcagaacttccgggagcagaatgtgttttacgatttcaaaataatcatgaaggatgagatcatcccctgccatcgatgcgtgctcgctgcttgttcagacttctttagggccatgtttgaggtgaacatgaaggagagagatgacgggtcggtgacaataaccaatcttagtagcaaagcggtcaaagctttcctggattacgcatacacgggtaaaactaaaatcactgatgacaacgtggagatgttcttccagctgtctagtttccttcaggtttcattcctctccaaggcttgcagcgatttccttattaagtcaatcaatctggttaactgcctgcagctactgagcataagcgatagctatggatccacaagcctcttcgaccacgcactgcacttcgtgcaacaccatttctcactcctcttcaagtcaagcgactttcttgaaatgaatttcggggtgttacaaaagtgtctcgagagcgatgaactcaatgtgcctgaagaggagatggttctgaaagtggtgttgagttggaccaaacacaacctggaatcaaggcaaaaatatctgccccatttgattgagaaagttagactacaccaactatctgaagagactctacaggactgtctatttaacgaagaaagtctgcttaagtcaacaaactgcttcgatatcatcatggatgctatcaaatgcgttcagggctccggtggcctgttccccgacgctcggccctctaccactgagaagtacatattcatccataaaacagaggagaacggggaaaaccagtacacgttctgctataatattaagagtgacagctggaaaatcctaccacaatcccatctcatcgatcttcctggttcttctctttcctcgtacggggagaaaatctttttgaccggcggttgtaaggggaaatgctgtagaaccgtcagactgcacatagcagagtcgtaccatgatgccaccgaccagacctggtgctactgccccgttaaaaacgacttctttctagtgtctacaatgaaaaccccccgaactatgcatacctctgtgatggcactcgacagactttttgtgattgggggaaaaacacgaggctcccgcgatataaagagcctcctggacgtcgagtcctataacccgcttagtaaggaatggatcagcgtgagcccactgcctagaggtatttattaccctgaagctagtacttgtcagaacgtgatatacgttctcggctctgaggtagaaatcacggatgcttttaatccaagtttggattgctttttcaagtacaatgcgactactgaccagtggtccgagcttgtggccgagttcgggcagtttttccatgccaccttaatcaaagccgtcccggtgaattgcacgctatatatctgcgatctgtctacttataaggtgtacagtttctgtcctgatacctgtgtatggaagggagaaggttccttcgagtgtgcagggttcaatgccggggcgattggaatcgaagacaaaatctatatactcggcggagattacgcgccagacgagatcactgacgaggtccaggtttaccatagtaatagaagtgaatgggaagaggtcagtcccatgcccagggccctcaccgaattttactgtcaggtgattcaatttaataagtacagggatccatggttctcaaatctgtgtgcatag

SEQ ID NO: 48237 - DNA, 1839 bp, Artificial Sequence
  Description of Artificial Sequence: Synthetic coding sequence
atggagctggccatggacaacagctacgccttcaaccagcggagcacgtgtaacggcattccaagcgagaaaaagaataacttcctggtgtctgaagaccatggacagaaaattctaagtgtattacagaacttccgggagcaaaacgtgttctacgacttcaaaatcatcatgaaagacgaaattatcccttgtcaccgttgcgtcctcgctgcttgttccgactttttccgagccatgttcgaggttaatatgaaagaaagagacgacggttccgtgaccattaccaatctgtcatccaaggctgtcaaggcattcctcgattacgcctacaccggcaagacgaagattacagacgataatgtggaaatgttcttccagctgtcttctttcctccaggtttcatttctgtcaaaggcctgtagcgattttctgattaagtcaatcaaccttgtaaattgcctccaactgctcagcatttcggatagttatggcagcacttcactgttcgatcacgcattgcacttcgtgcagcaccacttttctcttcttttcaagtcatctgactttcttgaaatgaactttggcgtattacagaagtgccttgagagcgacgagctcaatgtaccagaggaggagatggtgcttaaagtcgtactcagttggaccaagcataatctggagtctaggcaaaagtacctcccccatctgatcgaaaaggtgcgccttcatcagctgtcggaggagacgctgcaggattgcctgttcaatgaggaatccttacttaaatctactaactgttttgacataatcatggacgccatcaaatgtgtgcagggtagtgggggactctttccagacgccagaccatctacgacagagaaatatatttttatccacaagacagaagaaaatggcgagaatcagtacacattttgttacaacatcaagtcggactcctggaaaattctcccccagagtcacctcatcgatctgcctggtagctctctgtcttcttatggcgagaagatcttcctgactggagggtgcaagggaaagtgctgtcgaaccgtccggctccacattgcggagtcttatcacgatgctactgatcaaacgtggtgttactgcccagtcaagaatgacttcttcctggtcagcaccatgaagaccccaaggacaatgcatacgtctgtcatggccctggaccgcttgtttgtgataggaggcaaaacacgcggatctagggacataaagtccctgctcgatgtggaatcttacaaccccctgtccaaggagtggatttcagtgtcaccccttccacgagggatctactatcctgaagcaagtacgtgtcagaacgtcatatatgtgttaggctccgaggtcgaaatcactgatgcttttaacccttcgcttgactgtttttttaagtataacgcaaccacagaccagtggagcgagttagtggcagagtttgggcagttcttccacgctacccttattaaagccgtgcctgtcaactgcaccctgtacatttgtgacttatccacatataaggtgtatagcttctgtcccgacacttgcgtttggaaaggagaggggtcattcgaatgcgccggttttaatgcaggcgccatcggcattgaggacaagatttacattctggggggcgactatgcccctgacgagataaccgacgaggtgcaagtgtatcacagcaaccggtccgaatgggaggaggtgtcccccatgccccgtgccctgaccgaattctattgccaggtcatacagtttaataagtaccgggacccttggttctcaaacctctgcgcttag

SEQ ID NO: 48238 - DNA, 957 bp, Artificial Sequence
  Description of Artificial Sequence: Synthetic coding sequence
atgaagggcggcaacgccgacagctggcagcgggagaagctggccagtatggagtcgcccgaagagcccggcgccagcatggacgaaaattactttgttaactacaccttcaaggatcggtctcactcagggcgggtggctcaggggattatgaagctttgcctcgaggaagagctcttcgccgacgtcaccatctctgtggagggccgggagttccagctccaccggctggtgttgagcgcacagtcatgcttcttccgctctatgttcacctccaatctaaaggaagcacataacagggtcatagtcctgcaagatgtcagtgagtccgtctttcagcttctcgtggactatatctatcatggcaccgtgaaactgcgggccgaggaactccaagagatctacgaagtgagcgacatgtaccagcttacctctctattcaacgccctgggcttttggccggcacagtgtaagtgggaaacagcattcagagccgatcgtcacagtgattcatcgatacgcctcccttcgtgcgctaaaacccaccttgcacagctgcaaaacactgaagagttcctgcacctgccacacagattgctgactgatataatatctgatggggttccatgtagccagaaccccaccgaggcaatcgaagcatggattaattttaacaaagaggaaagggaagccttcgctgaatccctgaggacgagtttaaaagagatcggtgaaaacgtgcacatctaccttattggcaaagagtcctcacgcacacactcactggcggtcagtctgcattgtgccgaagatgacagcatcagtgtctctggtcagaactctctctgtcaccagattaccgccgcatgtaaacacgggggagatttatatgttgtgggcggctccataccacggcgaatgtggaagtgcaataatgctacagtagactgggaatag

SEQ ID NO: 48239 - DNA, 1557 bp, Artificial Sequence
  Description of Artificial Sequence: Synthetic coding sequence
atggagagccccgaggagcccggcgccagcatggacgagaactacttcgttaattatacattcaaggataggtcgcacagtggaagagtagcccagggcatcatgaagttatgccttgaagaggaactcttcgctgacgtgactatcagcgttgaaggtagagaattccagcttcatagactagtactgagcgcacagtcttgcttctttagatcaatgtttacgtcaaacctgaaggaggcccacaaccgggtgatcgtgttacaggacgtctctgaaagcgtgtttcagctgttggttgactacatttaccacgggacagtcaaacttagagcagaagagctgcaggaaatatacgaggtttctgatatgtaccagttgacgtcgttgtttgaagagtgcagtaggttcttggcccgtaccgtccaagttggcaactgcttgcaggtgatgtggctggcggatagacactccgatccagagctctatacggcagctaaacactgtgcaaagacccatctcgcccagttgcagaacacagaagagttcctgcatttgccacacaggctcctcacagacatcatcagcgacggagtgccctgcagccagaatccaacggaggctatagaggcttggatcaatttcaacaaggaagaaagggaggctttcgcagaatcgctgcgcacctcactgaaagagattggtgaaaatgtacacatttacctcatcggcaaggagtcctcccgcacacactctcttgcagtttcccttcactgtgctgaagacgatagcattagtgtgtccggacaaaactctctgtgtcatcagataacagcagcctgtaaacacggcggagacctctatgtcgtaggcggcagtattccccgacgcatgtggaagtgcaacaacgctacggtggactgggaatggtgcgcccccctgccgcgcgacaggcttcagcacactttggtgtcggtaccgggcaaagacgctatttactctcttggaggtaagacccttcaggataccctgtcaaatgccgtgatttattaccgagtcggcgacaatgtgtggacagaaactacgcagcttgaggttgcagtttcgggcgctgcaggggctaacttgaacgggattatctatttgctgggcggtgaggagaacgacctcgacttctttacgaagccatccaggctaatccagtgctttgataccgagaccgacaaatgtcacgtcaaaccttacgtactgccattcgctgggagaatgcatgccgcggtgcataaagacctggtgttcatagtcgctgagggagactccctcgtgtgttataacccactgctcgatagcttcactcgactgtgccttcctgaggcatggagcagtgctcctagcctgtggaagatcgcttcttgcaatgggtcaatttacgtatttagagacaggtataagaaaggcgatgctaatacttacaagttggacccggcgacgtccgctgtgactgtcactcgcggaataaaggtcttactgaccaatctccaatttgttctggcttag

SEQ ID NO: 48240 - DNA, 1605 bp, Artificial Sequence
  Description of Artificial Sequence: Synthetic coding sequence
atgaagggcggcaacgccgacagctggcagcgggagaagctggcctcgatggagagccctgaagagcctggagcctctatggacgagaactacttcgtaaactataccttcaaagatagatcccacagcgggcgcgtcgcacaaggcattatgaaactgtgcctcgaggaggagttgttcgctgacgtgactataagcgtggagggcagagagttccagctgcatcgcctggtgctgtcagcgcagtcgtgcttcttccgttccatgtttacttctaatctcaaggaggcccacaacagggtgattgtcctgcaggacgtgagcgagtctgtgtttcaattgttggtggactatatttatcacggtacggtgaagctacgcgcagaagagttgcaggagatttatgaggtttctgatatgtaccagctgacatctctctttgaagagtgttctcgtttcctcgcacgtacagtgcaagttggcaactgcctgcaggtgatgtggctggctgacagacactcagaccccgagctttacacagccgccaaacactgtgccaagacccatttggcgcagttacagaacactgaggaattcctgcatttgcctcacagattactgaccgacatcatatccgatggcgtaccatgctctcagaaccctaccgaggccatagaggcttggattaactttaacaaggaggaaagagaagcctttgccgagtccctgaggacctcacttaaagagattggagaaaacgtgcatatttaccttattgggaaggaatccagccgcacccattccctggctgtgtcattgcactgcgcggaagatgacagtataagtgtctcaggccagaattctctgtgtcaccagattaccgccgcctgcaagcacggcggagacctgtacgtcgtgggtgggtctattcctcggcggatgtggaaatgcaataatgcaaccgtcgattgggagtggtgcgcacccctgccccgggataggctgcagcacactctagtgtctgtcccaggtaaggacgccatatactcactgggaggcaagacccttcaggatactctgtcgaacgcggtaatttattacagggtgggtgataatgtctggacagagacaacacagctagaagtagcagtcagtggagccgctggagctaatctgaacggaatcatttatcttctgggaggggaagagaacgacctggatttttttaccaaaccctctagacttattcagtgcttcgacacagagactgataaatgccatgtgaagccttacgtcctgccctttgcagggcgcatgcacgccgctgtccacaaagaccttgtgtttatcgttgctgagggcgattcactggtgtgctataacccgttattggattccttcactaggctgtgcttacccgaggcatggtcatctgcgcctagtttgtggaagatcgcttcctgtaacgggagcatatatgtgttcagagatcgatataaaaaaggggacgcaaacacatacaagctcgaccccgcaactagcgccgtcaccgtgaccaggggtatcaaggtgcttctgacgaacttgcagtttgtacttgcttag

SEQ ID NO: 48241 - DNA, 1866 bp, Artificial Sequence
  Description of Artificial Sequence: Synthetic coding sequence
atggccctgggcctggagcaggccgaggagcagcggctgtaccagcagacgctgcttcaggacggccttaaagacatgctggaccatggtaagtttctggactgcgtggtgagggctggcgaaagggagtttccgtgccaccgactagtgttggccgcatgtagcccgtatttccgcgcaagattcctggctgaaccagagcgggccggggagctccacctggaggaggtttcaccagatgtcgttgcccaggttttacactatttgtacacatctgagattgcactggatgaggcctcagtccaagatttattcgctgctgcgcacaggttccaaattccttctatctttactatctgcgtgagctttctgcagaagcgactgtgcttgtcaaactgcctagctgtttttcggctcggcctgctactggattgtgctcgcctggctgttgctgctagagatttcatttgcgcccatttcacattagttgcaagagacgccgactttctgggattgtccgccgacgagctcatcgctattatctccagtgacgggttgaacgtcgaaaaggaggaggctgtgtttgaagccgtcatgcgctgggctggttccggagatgctgaagcacaagcagagcgccagagggccctcccaactgtattcgagagcgttaggtgccggttgctgccaagagcgtttcttgaaagtagagtggagcgccatcctctggttagagcgcagcctgagctgttgcgcaaagtccagatggtaaaggatgcccatgaagggaggatcaccactctacgcaaaaagaaaaaaggcaaagacggtgctggtgctaaagaggcagataaagggaccagcaaggctaaggctgaagaagacgaggaggctgaaagaatacttcctggcattctcaacgacacattaagatttggcatgtttctacaggaccttatcttcatgatcagcgaggagggggccgttgcctatgatcctgctgctaacgagtgctattgtgcctctctgagtaatcaggttcctaaaaaccatgtcagcttggtaaccaaggagaaccaggtcttcgtggccggcggactgttttataacgaagacaataaggaagacccaatgagcgcatacttcctccagttcgaccacctcgattcagagtggctgggtatgcctccactgccatccccaagatgcttatttggtctaggcgaagcccttaattcgatttacgtggtcggtgggagggaaattaaagatggagaaagatgcctggactcggtgatgtgttatgatagattgtccttcaagtggggcgagtccgatccattgccatatgtggtttacgggcacacagtgctgtcccacatggatctggtatatgttattggagggaaaggaagcgatagaaagtgcttgaacaagatgtgcgtgtatgacccaaaaaagtttgagtggaaggagttggcccctatgcagacagctagaagcctgtttggggcaaccgtacacgatggcaggattattgtagctgcaggagtgactgacacagggctgacatccagtgcggaggtatacagtataaccgacaacaaatgggcaccgttcgaggcttttccgcaggaaaggtcttctctttcactagtctctctcgtgggaaccctgtacgctatcggcggttttgccacccttgagaccgaatctggagaactggttccaacggaactcaatgacatatggcgttacaacgaggaggagaaaaagtgggaaggcgtcctgcgcgaaatagcttacgccgcgggtgcaacatttctcccagtgagactgaacgtcctttgcctcaccaagatgtag

SEQ ID NO: 48242 - DNA, 1101 bp, Artificial Sequence
  Description of Artificial Sequence: Synthetic coding sequence
atggtgaaggacgcccacgagggccggatcaccaccctgcggaagaagaagaagggcaaagatggcgctggcgctaaggaggctgataagggtacgagcaaggccaaagcagaggaagacgaagaggcggagaggattctccctgggattcttaacgacacacttaggtttgggatgtttctccaggatctgattttcatgatttcagaagaaggagcagtggcctatgatcccgctgcgaatgagtgctactgtgcttcgctcagtaaccaggttccaaaaaatcacgtctctttggtgaccaaggaaaatcaggtttttgtggcaggcggactgttttataacgaagataataaggaggacccgatgagcgcttatttcctgcaattcgatcatctggatagcgagtggctagggatgccaccgctaccaagtccacggtgcctcttcgggttgggcgaagccttaaatagcatttatgtggtcggggggcgcgaaatcaaggatggcgaacgctgtctggactctgtgatgtgttacgatcgcctgagtttcaaatggggcgagagcgacccccttccgtatgtagtgtacggacacaccgtgctttctcacatggatcttgtgtatgttatcggcggcaagggaagtgatagaaagtgcctgaacaaaatgtgcgtctatgaccccaagaaatttgagtggaaagaacttgccccaatgcagacagccagatctctctttggtgccaccgtccatgatggtaggataatcgtggctgccggcgttacagatacagggctaacgtcttccgcagaggtgtattcaatcaccgacaacaagtgggcccctttcgaggccttcccacaggaaagatctagccttagtcttgtctcgctagttggtacgctgtacgcaattggcggatttgcaacactggaaacagagtctggtgagctggtcccaaccgaactgaatgacatctggcgctacaacgaagaagagaaaaagtgggagggcgtgcttcgggaaatcgcttacgcagcaggggccacattcttacccgtgaggctgaatgttttatgtcttactaaaatgtag

SEQ ID NO: 48243 - DNA, 2025 bp, Artificial Sequence
  Description of Artificial Sequence: Synthetic coding sequence
atgcagagccgggaggacgccccccggagccggcggctggccagcccgaggggcggtaagaggccaaagaagatacataaaccaacagttagcgcattctttacaggaccagaggagctaaaagataccgcccatagtgctgctttgctagcccaactgaagtccttctatgacgctcgcttgctgtgtgatgtcaccatcgaagtggtgactccaggttctggtcctggtaccggcagactatttccatgtaatcgcaacgtgttggctgccgcttgcccatatttcaagtctatgtttacaggtggaatgtacgagtcccagcaagcaagcgttacaatgcacgatgtcgacgctgagtcttttgaagtacttgtggattactgttacaccggcagggtgtctttgagcgaagcaaatgtggagaggctctatgccgcttccgatatgcttcagctggaatatgtgagggaggcctgcgcttcctttctagcccgcaggctggatctgaccaactgcaccgccatcctgaagttcgctgacgcttttgggcaccgaaaactcaggagccaggctcagtcctacatagcccaaaatttcaagcagctgagccacatgggttccataagggaggaaaccctggccgatttgacactcgcccagcttctggccgtcttgagactcgacagcctggacgtggagagcgaacagactgtgtgccacgtcgccgtgcagtggttggaagctgcccccaaggagcgcggtccctctgctgctgaagtgtttaaatgtgtccggtggatgcacttcacggaagaagatcaggattatctggaaggactgttgacgaaaccgattgtaaagaagtactgcctggacgtcattgagggagccctccagatgcggtacggcgatctgctgtacaagagcctcgtccctgtgccgaactcctcttcgtccagttcttccagcaattccctcgtgtccgcagctgagaatcccccccagcggctggggatgtgcgcaaaggagatggtgatcttttttgggcatccccgagacccttttctgtgttgtgatccgtacagcggggatctctataaggtcccttctccgctgacatgtttggcccatacacggaccgtcactacgcttgccgtgtgtatttccccagatcacgatatatacctcgctgcccagccccggactgacttgtgggtctacaagcccgcacagaactcatggcagcagttagctgatcgactcctttgcagagaaggaatggatgtggcttacttgaacgggtatatttacattctaggtgggagggaccctataactggtgtgaagctcaaagaggtggagtgttataatgtgaagcggaaccagtgggcccttgtcgcccctcttccacattcatttctgtctttcgacttaatggtgatcagagactatttgtatgccctgaacagtaagcgaatgttctgttacgacccgtcccataatatgtggttaaagtgtgtgagccttaagcgaaatgattttcaggaggcttgtgtgtttaatgaagaaatctactgtatctgcgatattcctgtgatgaaagtttataatccagtgcgggcggaatggcgccaaatgaataatattcctctggtttcagagactaataactataggatcatcaagcatgggcaaaaactcctgttgattacaagtaggacaccccagtggaaaaagaatagagtaaccgtgtacgaatacgacattagaggtgatcaatggataaacatcggtactacattagggttgcttcagtttgattctaacttcttctgcctctcagcccgcgtctaccctagctgtctggagcccggtcaatctttcctaacagaggaagaggaaataccaagtgaatcttcaaccgaatgggacctaggcggcttcagtgaacctgacagcgagagtggctcctcaagttccctgagcgatgatgatttctgggtcagggtcgctcctcagtag

SEQ ID NO: 48244 - DNA, 1827 bp, Artificial Sequence
  Description of Artificial Sequence: Synthetic coding sequence
atgcagagccgggaggacgccccccggagccggcggctggccagcccccgcggggggaagcggccaaagaaaatacacaaacctacggtaagcgcgttcttcactggccctgaggagctgaaggacactgcctccgtgacaatgcacgacgtggatgctgaaagcttcgaggtccttgtggattattgttatacaggccgggtaagcttatccgaggcaaatgtggagaggttgtatgctgcgtcggacatgttgcagctcgagtacgtacgcgaggcgtgtgcaagcttcctcgcgaggcgcctggacctcacgaactgtacagctatactgaaatttgctgatgcatttggccatcggaaactcaggtcccaagcgcagtcgtatattgcccagaatttcaagcagttatcccacatgggaagcattagggaagaaacactagctgatctgaccctggctcaacttcttgccgtgctccgtctggattctctcgatgtggaatcagaacagacagtgtgccacgtggcagtccagtggctagaagcagccccaaaggaacgaggaccttcagcagctgaagtcttcaaatgcgtccggtggatgcacttcacggaggaagaccaagactacctggagggcctcctgaccaaaccgattgttaaaaaatattgccttgatgtgatcgagggagccctgcagatgcgctatggagatctcctctacaaaagtctggtgcccgtcccgaattccagcagttccagcagttcctcaaattcattggtgagcgccgccgaaaatcccccgcagagactcggtatgtgcgcaaaagaaatggtgattttcttcggccaccctcgtgacccatttctctgctgcgatccgtacagtggagacttatacaaagtgccatcacctctaacctgcctggcccacacgaggacagtgaccacattagctgtgtgtatcagtccggaccatgacatttaccttgctgctcagccacgcaccgacctgtgggtgtacaaacctgcgcagaacagctggcagcaactggcagaccgcttgctgtgcagagaaggtatggacgtcgcctatctgaacggctacatatacattctgggtggccgagaccctattacgggcgtgaagcttaaggaagtcgaatgttataatgtgaagcggaaccagtgggcgcttgtggctcccttacctcatagctttttatctttcgatcttatggtgatcagggactacctttacgcgctcaattcaaaacggatgttctgttatgatccaagccataacatgtggctgaagtgtgtctcgctgaagcgtaatgactttcaggaggcctgtgtgtttaatgaggaaatttattgcatctgtgacattccggtgatgaaagtgtacaaccctgttagagcggaatggaggcagatgaacaatatccccctggtatctgagacgaacaattacaggattatcaagcacgggcagaaattactgctgataacatcaagaacaccacagtggaagaaaaacagggttactgtatacgagtatgacataaggggcgaccagtggatcaacatcggcactacactcggccttctccaatttgactctaattttttttgcctgagcgcccgcgtgtacccatcatgtttggagcctgggcagtcgttcctgacggaagaggaggaaatcccttctgaaagtagcaccgaatgggaccttgggggtttttctgagcctgactccgaatcgggtagtagcagctcgctgtcggacgacgacttctgggtccgggtagcgcctcagtag

SEQ ID NO: 48245 - DNA, 2055 bp, Artificial Sequence
  Description of Artificial Sequence: Synthetic coding sequence
atgcagagccgggaggacgtgccccggagccggcggctggccagccctaggggagggaggaggcctaagcggatttccaaaccatctgtgagcgccttttttaccgggcccgaggaactgaaggacaccgcacacagcgctgccctactcgcacaactgaaaagcttttacgacgcaaggttattgtgcgatgtcacgatagaggtggtgacccccggaagcggccccggcaccggaaggctgttcagttgcaatcggaacgtcctagcggccgcatgtccctactttaaatccatgtttactggcgggatgtatgaatcccagcaggcgtccgtgaccatgcacgacgtggacgctgagtcctttgaagtgctggtagactattgttataccgggcgagtctccctctcagaggccaacgtgcaacgactgtatgcagctagtgacatgctgcagctcgagtacgtccgcgaagcatgtgcctctttcttagctaggcgactggatctgaccaactgcactgccattctgaagttcgctgacgctttcgatcaccataagctcagatcccaggcgcagtcttacatcgcccataattttaaacagctctcacgaatgggctcgatccgggaggagaccctcgccgatttgacactagctcaattgctagctgtgctgagattggactctctcgatattgaaagcgaaaggacggtgtgccatgtggccgttcagtggctggaggctgctgcaaaagagcggggcccaagcgcagctgaagtgtttaaatgtgtgcgttggatgcacttcaccgaagaggatcaggactacctggaaggtcttctgacaaaaccaattgtgaagaagtattgtttggacgttattgagggcgcgttacagatgagatacggagacctgctgtataagagcttggtccccgtgcctaacagcagttccagttccagctcttctaatagcctagtgtccgccgctgaaaaccctccccagcggctggggatgtgtgcaaaggaaatggtgatctttttcggccacccaagagatcctttcctttgttacgatccctatagtggagacatatacaccatgcccagcccacttacatcattcgcccatacaaagacagtgacctccagtgcagtctgcgtgtccccggatcatgatatctatctggccgcccagccacggaaagacctgtgggtctacaagcctgcacagaacagctggcaacagctcgcagataggttactgtgtagagaaggcatggacgtggcttacctcaatggttacatctacattctaggcggccgggatcctatcacaggtgtaaagctgaaggaggtggaatgttacagcgtccagaggaaccagtgggcactggtcgcccctgtgcctcactccttttacagcttcgaacttattgtggttcagaactatctgtatgcagtcaattcaaagcggatgctgtgttatgacccgtcccacaatatgtggctgaattgcgctagcctgaaacgctcggattttcaggaggcgtgcgtcttcaacgacgaaatttactgcatctgtgatatcccagtgatgaaggtatacaatcctgccaggggcgaatggagaagaattagcaatataccgctggactctgaaacacacaactaccaaattgtgaaccacgaccagaagttgcttctgattacttcaacgacccctcaatggaaaaaaaatcgggtgacggtgtatgaatacgacactcgcgaggaccagtggataaatataggtactatgttggggcttctacaatttgactccggctttatctgtctgtgcgccagggtatacccttcctgcctcgaaccaggacaaagtttcatcacagaggaagacgacgcgagatcagagagcagcaccgagtgggacctggacggattctctgagctggattctgagtccggcagctccagctccttttctgatgatgaggtctgggtgcaagtcgccccccagagaaacgctcaggatcagcaaggttcactgtag

SEQ ID NO: 48246 - DNA, 1761 bp, Artificial Sequence
  Description of Artificial Sequence: Synthetic coding sequence
atgttcaccggcggcatgtacgagagccagcaggccagcgtgaccatgcatgacgtggacgcagagtcctttgaggtgttagtggactattgctacacggggcgcgtgagtctgagcgaggcaaacgtccagcggctttacgcggcaagcgacatgttacagttagagtatgtccgagaggcatgcgccagctttctggcacgtcgtttagatctcacaaattgcaccgccattctgaagttcgccgatgcgtttgatcaccataaactgcgctctcaggctcagagctatatagcccataacttcaaacaactctcccggatggggagtatccgcgaggaaacgctcgcagatttaactctagcccaattgctcgctgtgctccgtctggattccctggatatagaaagcgagcgtacagtctgccacgtggcagtacaatggcttgaagccgcagcaaaggaacgaggtccgtccgccgctgaagtgtttaagtgtgtgcggtggatgcatttcacagaggaggaccaggactatctggagggattgctgaccaaacctattgtgaagaagtactgtctggacgtcatcgaaggagctctgcaaatgcgttatggtgatctgctgtataaatctctggtgccagtgcctaactcttcctcttccagcagctcatccaatagcttggtgtctgcggccgaaaatcctccacagaggctgggaatgtgtgctaaggaaatggtgatattcttcggccacccccgcgatcctttcctgtgttacgatccatactctggagatatctacactatgcccagcccgctgacaagctttgcccacacgaagacagtgacaagctctgccgtttgtgtatctcccgaccatgatatatatcttgccgcacaaccgcgtaaagacttatgggtttataaacccgcacagaacagttggcaacagctggcagacagactgctgtgcagagagggcatggatgtcgcctacctaaacggctatatctacatcctcggtggacgcgatcctatcacgggggtaaagctgaaggaagtcgagtgttattctgttcaacgcaatcagtgggcactggtggctcctgtcccgcatagcttctatagtttcgaactaatcgtggttcagaactatctgtatgctgttaactctaagaggatgctctgctatgatccgtctcacaatatgtggctgaattgcgcttcactcaagagatccgactttcaggaggcctgcgtattcaatgacgagatctactgtatctgcgatattcccgtcatgaaagtgtacaacccagcccgcggggaatggcggcggatctctaatataccactggactccgaaactcacaactatcaaattgtgaaccatgaccagaaattgctgctgatcacaagtactacacctcaatggaagaaaaatcgagtgactgtgtacgagtatgatacacgcgaggatcagtggatcaatattggcacaatgttaggattgctacagtttgattcgggttttatctgcttgtgtgccagagtgtatccttcctgtcttgaacctggtcaatccttcattacagaagaggatgatgcacggagcgagtccagcactgaatgggacctcgacggcttcagtgagctggactccgaatccggctccagctcttcattctctgatgacgaggtgtgggtgcaagtggcacctcaaaggaatgcccaggatcagcaaggcagtctgtag

SEQ ID NO: 48247 - DNA, 1728 bp, Artificial Sequence
  Description of Artificial Sequence: Synthetic coding sequence
atggaccccttccacgcctgcagcatcctgaagcagctgaagaccatgtacgacgaaggacagctcactgacatcgttgtcgaggtggatcacggtaagactttctcctgccaccgcaacgttctggcagcaatctctccttacttccggtctatgtttactagcggtctcacagaaagtacccagaaagaagttcgcatcgtcggtgtggaggctgagtccatggatctggtgctcaattatgcttacacatccagagtgattctgacagaggctaatgttcaggccctctttacagcagcttctatctttcagatcccatcgatccaagatcagtgcgccaagtatatgattagccatctcgatccccagaactcaatcggcgtgttcatctttgctgaccactacggacatcaggagttgggtgatcgcagcaaagagtacatcagaaagaaattcctctgtgtaactaaagaacaggaatttctgcagttgacaaaagatcagctaatctcgatactggattctgacgatctgaatgtggaccgcgaagaacacgtgtacgaaagtattatccggtggtttgagcatgaacaaaatgaacgagaggtccatctgcccgaaatcttcgcgaaatgcattagattcccacttatggaagacaccttcatcgaaaagatcccaccccagttcgcccaggccattgccaaatcctgcgtcgaaaagggtcccagtaacactaatggttgcacccagagactggggatgacagcctccgaaatgatcatatgctttgatgcagctcataagcatagcggcaaaaagcagactgtgccctgcctggatatcgtcaccggccgagttttcaaactttgtaagccaccaaacgatttgagagaggtgggcatcctggtctctcccgataatgatatctatattgccggcggatacagacccagctcaagcgaagtatccattgatcacaaagcggagaacgacttttggatgtatgatcacagcacgaatcgatggctgtcaaagccctccctccttagggctcgaattggatgtaagctggtttattgctgtggaaaaatgtacgccatcggtggtcgggtatacgagggcgatggcagaaatagtctgaagtcggtggaatgttacgattctagggaaaactgctggactaccgtgtgcgcaatgcccgttgcgatggaattccacaacgccgtggaatacaaagagaagatttatgttctgcagggggaattcttcttgttctacgagccgcaaaaagattactgggggttcttgacccccatgacagtacctcgtatccagggcctcgccgcagtgtacaaagactcaatttattacattgccggtacctgtgggaaccaccagcggatgtttaccgtggaggcatacgatattgaactgaacaaatggactcgtaaaaaagacttcccatgtgaccagagtatcaacccatatctgaaactggtcttattccagaacaagctgcatttatttgtacgggcgacccaggtcacggttgaggagcacgtattcagaactagtagaaagaactctttgtaccaatatgacgatattgccgaccagtggatgaaggtgtatgagacccccgatcggctctgggatttgggcaggcattttgagtgcgcagtcgcaaaactctatccccaatgcctgcagaaggtgctctag

SEQ ID NO: 48248 - DNA, 1806 bp, Artificial Sequence
  Description of Artificial Sequence: Synthetic coding sequence
atggccgccagcgccgacctgagcaagagcagccccacccccaacgggattccttccagtgaccctgcctcagacgcgatggatccgttccatgcttgcagcattcttaagcagctaaagacaatgtatgacgagggacagctgactgacatcgtggtggaagtcgaccatgggaagaccttctcttgccatcgtaatgtgttggccgcaatctctccctacttccggtccatgttcacttctggcctgacagagtcaacccagaaagaggtgcgcattgtaggagtggaagctgagtctatggacctggtcctaaactatgcatatacatcaagagtgatcctgacagaggcaaacgttcaggccctgttcaccgctgcctcaatattccagattccgtctatccaggaccagtgcgctaagtatatgatttcccacctcgaccctcagaatagtatcggcgtctttatatttgctgatcactatgggcaccaggagcttggtgacaggtccaaagagtatattcgaaagaaatttctgtgtgtaacgaaagagcaagaatttctgcagctgactaaggatcaattgatctctattttagactctgacgatctgaatgtggatagggaggaacacgtttatgagagcattatacgatggttcgaacacgagcagaatgagcgcgaagtgcatctacccgaaatattcgctaaatgcataagatttccattgatggaggatacattcattgagaaaattcctccacaattcgcccaggcaatcgcaaaaagttgtgtggagaaaggaccttcaaatactaatgggtgcactcagaggcttggtatgactgcgagtgaaatgattatctgtttcgatgccgcccacaaacactccggcaagaagcagaccgtgccctgcctagatatagtgaccggcagggtgttcaaactatgcaagcctcccaatgatctgcgggaggttggaattctggtgagtcccgataacgacatctacattgctggcggctataggccctccagctccgaagttagcattgatcataaagctgaaaacgatttttggatgtatgaccacagtaccaatagatggctgagcaaaccatcactactgcgcgcacgcataggatgtaagttagtgtattgctgcgggaagatgtacgccatcgggggccgcgtatatgagggtgatggacgcaatagtttaaagtcagtcgagtgttacgattcccgcgaaaactgttggaccaccgtgtgcgcaatgcctgtggcaatggaatttcataatgctgtggagtacaaagagaagatctatgtcctccaaggagaatttttcctcttctatgaacctcagaaagactactggggatttttgaccccaatgacagttcctcgcatccagggattagcagccgtttataaggatagcatctactacatagccggcacctgcggtaaccatcagcgcatgttcaccgtggaagcctacgatattgagctgaataagtggaccagaaaaaaggactttccatgcgaccagtcgatcaatccttatttgaagctggtcctgtttcagaacaaacttcatctgttcgtccgcgcaacgcaggttaccgttgaagagcatgtgttccgaacttcccgcaaaaactctctttaccagtatgacgacatcgccgaccagtggatgaaagtctatgagacacccgataggctctgggacctgggacgccatttcgagtgcgcagtagcgaagctgtaccctcagtgtttgcagaaagtgctgtag

SEQ ID NO: 48249 - DNA, 948 bp, Artificial Sequence
  Description of Artificial Sequence: Synthetic coding sequence
atggacgtgaacaagttcgaggccagcgtgggcttcctggacgtgaagaaatttttgtctacctggaagttacagaatcctcgaacacatttcgtactgtcacctcattgttttatgggcggaataatggctccaaaagacatcatgacaaatactcacgccaaatctatcctgaacagtatgaactccctcaggaagtctaacactctctgcgatgtgacactgcgtgtggagcagaaggactttcccgcccataggattgtgcttgccgcttgtagtgattacttctgtgctatgttcactagtgagctgtctgagaaaggtaaaccctacgtggatattcagggcttgacggcctctacaatggagattctgttggattttgtttacactgagaccgtacacgtcaccgttgaaaacgtgcaagaactgctgcccgcagcctgtctactgcagcttaaaggcgtcaagcaagcctgttgtgagtttttagagagccagcttgatccatctaattgtctgggtatccgcgactttgccgagacccataattgtgttgacctgatgcaggccgccgaagtttttagccagaagcactttcccgaagtggtgcagcacgaggaattcattctcctttcacagggggaggtggaaaaactgataaagtgcgacgaaattcaagtggatagcgaggaaccggtttttgaagctgtaatcaattgggtgaagcacgcgaagaaggagcgagaggagtcactgcctaacctgctgcaatacgtgaggatgcctttgctgacgcctcgatacattaccgatgtcatcgatgccgaacccttcatcagatgttctttacagtgtcgggacttggttgacgaagccaaaaagttccacctccgcccagaattacgctcccagatgcagggcccacggacccgcgctagactttag

SEQ ID NO: 48250 - DNA, 615 bp, Artificial Sequence
  Description of Artificial Sequence: Synthetic coding sequence
atgcagggcccccggacccgggcccggctgggcgccaacgaggtgctgcttgtggtaggaggattcgggtctcagcagtctcccatcgatgttgtggagaaatatgaccccaaaacccaggaatggtcattccttccctcgatcactcgcaagcgccgctacgtcgcctccgttagcctgcacgaccgaatatacgtgattggaggatacgacggtaggtctcggctgtcaagcgtggagtgcttggactatacagcggacgaggatggggtctggtattctgtggctcccatgaatgttagaagaggactggctggtgcaactacactcggagatatgatctacgtctccggcggcttcgacggatccaggcgacacacttccatggaacggtacgaccccaacattgaccagtggtcaatgctcggagatatgcagacggctcgggaaggcgctggactggttgtggccagcggggtgatctactgcttgggaggatacgacgggctgaatatactgaacagtgttgaaaagtatgaccctcacaccggacactggaccaacgtcactcctatggccaccaagcgcagcgatatgatggttatcccctgttag

SEQ ID NO: 48251 - DNA, 1707 bp, Artificial Sequence
  Description of Artificial Sequence: Synthetic coding sequence
atgggcggcatcatggcccccaaggacatcatgaccaacacccacgcaaaaagtattctcaactcaatgaattcattaaggaaaagcaacaccttgtgcgatgttacactacgggtggaacagaaggatttcccggctcatagaatcgttctggctgcatgttccgattacttttgtgctatgtttacatccgagttgtctgagaaagggaagccatacgttgacatccagggactcactgcttcaacaatggagatcctgttggacttcgtgtacaccgaaaccgtccacgttacggtggagaatgtccaagaactgctgcctgccgcgtgtttactgcagcttaagggcgttaagcaagcgtgttgcgaattcctcgagtctcaactggatccgtcaaattgtctgggcattcgtgattttgccgaaacgcataactgtgtcgatcttatgcaggctgcagaagtcttcagccagaaacacttcccagaagtcgtacagcacgaagagttcattctgctgtcacagggggaagtggagaagctcataaagtgtgatgagatccaggtggactcagaggaaccggttttcgaagcagttatcaactgggtcaaacatgccaagaaggagcgtgaggaaagcttgccaaacttacttcagtacgtgcgcatgcccctgctaactcccaggtatatcacagatgtcattgacgcagagccattcattagatgctcactgcaatgtcgtgacctggttgatgaagccaaaaagtttcaccttcgtccagagttgcgctcacagatgcagggtccgagaacacgcgcccggctgggagccaacgaggtgctgcttgttgtcggaggcttcgggtcccagcaatcaccaatcgatgtggtggaaaaatacgaccctaaaacacaagagtggagcttccttccatccatcactaggaagagacgctatgttgccagcgtaagtctccacgaccgtatttacgtgattggcggatatgacggccgaagccggctgagctctgtggagtgtttggactatacggccgatgaagacggtgtttggtattctgttgcccctatgaatgtcaggagaggccttgcaggagccacaacattgggggacatgatctatgtgagcggaggcttcgatgggagtaggcggcacacctccatggagcgatacgaccccaacatcgatcaatggtccatgcttggagacatgcaaacagcccgggaaggcgccggtctggttgttgctagcggcgtaatttattgcttaggggggtacgatgggctcaatatcctgaattctgtggagaaatacgaccctcacaccggccattggaccaacgtgaccccaatggccaccaagcgatctggcgctggagtggcccttctaaacgaccatatatacgtggtaggggggttcgacggaactgcccacctgagttcagtggaagcatataatattagaactgacagttggaccaccgtgacctcaatgaccacaccaagatgctatgtgggcgccaccgttctgagaggcaggctatatgcaatcgccggttacgacgggaacagcctcttgtcctctatagagtgttatgatccgattattgattcctgggaagtcgtcacatctatgggaacccagaggtgcgatgctggagtgtgcgtgctccgagagaaatag

SEQ ID NO: 48252 - DNA, 1821 bp, Artificial Sequence
  Description of Artificial Sequence: Synthetic coding sequence
atggacgtgaacaagttcgaggccagcgtgggcttcctggacgtgaaaaagttcctctccacatggaagttacagaatccacggacacacttcgtcctttctccccactgtttcatggggggaatcatggcacccaaggatattatgacaaacacacatgcaaaatcaatacttaatagcatgaacagtctgcggaagagtaataccctctgcgacgttacccttagagtagaacagaaggactttccggcccatagaattgttttggctgcctgctctgattacttttgcgcgatgtttacatccgaactgtccgagaagggtaaaccatacgtggacatccagggacttacggcctctaccatggaaatcttactcgactttgtctacacagagacagtgcatgtgaccgtagaaaacgtgcaggaattacttcctgcggcatgtctactgcaacttaagggagtcaagcaggcctgctgcgagtttctagaaagccagctcgacccctctaactgcctgggtatacgggattttgcggagactcataattgtgttgatctgatgcaggccgctgaggttttcagtcagaaacatttcccggaggtggtccagcacgaggagttcattctcttatcccagggagaggtcgaaaaactcatcaaatgtgatgagattcaggtggacagcgaagaacccgtgtttgaagccgtgattaactgggtgaaacatgctaagaaagagagagaagaaagcttaccaaatctgttacagtatgtgcggatgccgctgctcactccccgctatattacggacgtgattgacgccgagccttttatacgttgttccctgcagtgtagggatctggtggacgaagctaagaagttccatctgaggccggaactgcgttctcagatgcaaggcccgcggactcgagccagattaggagctaacgaggttctgctcgtggtcggcggtttcgggtcccagcagtcccccatcgacgtggttgagaagtatgatcccaagacccaggagtggtcctttcttccttccatcaccagaaaaaggcggtacgtagcctccgtgtctctacatgataggatttatgtcatcggcggttatgacggccgctccaggctgagttccgtcgagtgcctggactataccgctgacgaggacggcgtttggtacagtgtggcccctatgaatgtgagacggggcctggctggtgccaccactttgggtgatatgatctacgtttcaggaggattcgatggtagccggcggcacactagcatggaaagatacgatcccaatatcgatcagtggagcatgctgggagacatgcagactgcaagagagggcgcgggtctggtggtcgcatccggggttatctattgcctgggcgggtacgacggtttgaatatcctgaactcagtggagaagtacgacccccatactgggcactggacaaatgtgactcctatggctacgaaaagatcaggggccggagtggcacttctgaacgaccacatctatgtcgtgggagggttcgacggaacagcccaccttagctctgtcgaagcatacaacatccggaccgactcttggacaaccgtaacttcgatgacgactccacggtgctacgtgggagccacggttttgcgcggaagattatatgctattgctgggtatgatggcaacagcttgctgtcctccattgagtgttatgacccaattattgacagctgggaggtggtgacctccatgggcacgcagcgctgcgacgctggcgtctgtgtcctgagagaaaagtag

SEQ ID NO: 48253 - DNA, 1815 bp, Artificial Sequence
  Description of Artificial Sequence: Synthetic coding sequence
atggccggcgacgtggagggcttctgcagcagcatccacgacacctccgtttctgcaggcttcagggctctctacgaggaagggctccttttagatgtcaccctcgtgatagaagatcaccagttccaggcccacaaagctctcctggccacacagagcgattacttccgcattatgtttacagcggatatgagagaaagagatcaggacaaaatccacctcaagggcctgaccgctacaggtttttcccatgtgttgcagttcatgtactatggcacgatagaactttctatgaacacagtacacgaaatccttcaggctgccatgtacgtgcaactgatcgaggtcgtaaagttttgctgctcatttcttttggccaagatctgcttggagaactgtgctgaaatcatgagactgcttgatgattttggagtcaatattgaaggagttcgtgagaagctggacacctttttactggataactttgtgccacttatgagccggccggacttcttgtcttatttaagttttgagaagctcatgtcgtatctggacaacgaccacctgagtaggttcccagaaattgaactctatgaggccgttcaaagctggctgcggcacgaccgccggcgctggagacacactgataccatcatacagaatattcgattttgcttgatgactccgacttccgtgttcgaaaaagttaagacgagcgaattttacaggtactccagacagctacgttacgaagtcgatcaagccctgaactatttccagaacgtccaccagcagcctctccttgatatgaagagctccagaatacgtagcgccaaaccgcagactactgtgtttcgggggatgattggccactccatggtgaattccaagatattgcttcttaagaaacccagggtatggtgggaattggaagggcctcaggtcccgttgaggcctgattgcttggcaattgtaaacaattttgtatttctcctggggggcgaagaattggggcccgacggagagttccacgccagcagcaaggtgtttcggtacgacccgcgacagaactcatggcttcagatggccgacatgtctgtgcctaggagcgaatttgctgtgggcgtcattggcaaatttatttacgctgtagcagggcgcacaagggacgaaaccttttacagtaccgaacgctatgatatcaccaacgacaagtgggagttcgtggacccatacccggtaaataaatacggacatgaaggcaccgtgctcaacaataagctttttataaccggcggcataaccagtagctctaccagtaaacaggtgtgtgtttttgacccatctaaagagggcactatcgaacagaggacacggcgaacgcaggtagtgaccaactgttgggaaaacaaaagcaagatgaactacgccagatgtttccacaagatgatatcctacaacgggaagttatatgtttttgggggcgtttgcgtgatcctgagagcaagttttgagagccagggttgtcccagcacagaggtctataacccagagaccgaccagtggactatcttggctagtatgcccattggcaggtccggacacggtgtaactgtcctggacaagcagatcatggtcctcgggggcctgtgctacaatggccactacagcgactccatactgacatttgatccagacgagaacaagtggaaagaggatgaataccctaggatgccctgtaaactggacggactgcaagtgtgcaacctccacttccccgattatgtgttagatgaagtgcgcagatgtaactag

SEQ ID NO: 48254 - DNA, 1437 bp, Artificial Sequence
  Description of Artificial Sequence: Synthetic coding sequence
atggacaccagcgacctgttcgccagctgccggaagggcgacgtgggacgggtgcgctacctcctcgaacagcgggacgtcgaggtgaacgtccgagataagtgggattccacgcctctctactatgcctgcctttgcgggcacgaagagcttgtcctctacctcctagcgaacggcgcgcgctgcgaagcgaatacattcgatggtgaacgatgcctctatggggcactgagcgatccgatccggcgagctctgcgggactataagcaggttacagcctcatgccggagacgggactactacgacgactttctacaaagacttctggaacagggcatccacagtgatgtcgtgttcgtcgtgcacgggaagcctttcagagtgcatcgctgcgttctgggggcacggtcggcttacttcgctaacatgctggacaccaaatggaagggaaaaagcgtggtggttctccgccaccccctcattaacccggttgcatttggagcactgctgcagtacctatacactggccggctggacattggagtggagcacgtaagcgattgtgaacgccttgccaaacagtgccagctctgggatctgctctctgacttggaagcgaagtgcgagaaggtctccgagttcgttgcgtccaagccaggcacgtgtgtaaaagttctgaccatagagccgcctcccgctgacccccgcctgagagaggacatggctctgttggctgactgcgcactgcctccggaactgcggggggacctgtgggaactccctttcccctgccccgatggctttaactcctgtcccgatatatgctttcgggtggctggctgcagctttctatgccacaaggcattcttttgtggaaggtctgattactttagagccttgctggatgaccatttccgcgagagcgaggagccagccacctcagggggaccccctgctgtgacattacatgggattagtcctgatgtcttcacacacgttttgtattacatgtattccgatcacacagagctgagccccgaagctgcatacgatgtcctgtccgtagcagacatgtacttgttaccgggcctcaaacgtctctgtggccgctctctcgctcagatgctggacgaagacacagtggtgggtgtgtggcgtgtggcaaagctgtttcgtctcgcgcgtctggaggatcagtgtacagagtatatggccaaagtcatagaaaaactcgtagagagggaggatttcgtagaggccgttaaggaagaagccgcagccgtggccgcaagacaagagactgattcaatccctctggtcgatgatattagatttcatgtggcatcaacagtgcagacgtactccgccatcgaggaagctcagcaacgactgcgcgcgctagaagacctactggtatcgatcgggctggattgctag

SEQ ID NO: 48255 - DNA, 1389 bp, Artificial Sequence
  Description of Artificial Sequence: Synthetic coding sequence
atgggcgccagcttcctgcagctgcagagcatcaaggacgcctgctgtactttcctgcgcgagcgcctacatcccaaaaactgtctgggggttcgacagttcgccgagacaatgatgtgtgcagtcctgtacgatgcagcaaactcattcatccaccagcacttcgtggaggttagcatgagtgaggaatttctggctctgccactggaggatgtgttagagctggtcagcagagacgagctaaacgtgaaatccgaagagcaagtgttcgaggccgccctggcctgggtcaggtatgatcgcgaacagaggggcccctaccttcctgagctgctgagcaacattagacttcctctgtgcagaccgcagtttttgtctgaccgagtccaacaggacgacctcgtgagatgctgccataaatgccgggacctggtagacgaagcaaaggattatcatctgatgcccgagagaaggccgcacttacccgctttcaggacaagaccccgctgttgcaccagtatagccgggctgatttatgccgtgggaggactgaacagcgctggagactcgctgaacgtggtcgaggtgtttgatccaatcgccaactgctgggaaagatgccgtcctatgaccacagcacgaagcagggtgggcgtcgccgttgtcaatggcttgctgtacgctattggtggttacgatggccagctgcgtttgagcacagtcgaggcctacaaccccgagacagacacttggacgcgggttggatccatgaactcaaaacgatcagcgatggggactgtcgtgttggacggacagatatatgtgtgcgggggttatgacggaaactccagtctgtcttcagtcgaaacttactctccagagactgacaagtggactgtcgtgacaagcatgtcctcgaacaggtcggcagcaggcgttactgtgttcgaaggccgcatttacgtctccggggggcatgatggcctgcaaatcttctcatcagtcgaacactacaaccaccatacggccacatggcaccccgccgcaggaatgctgaacaagcgttgtagacacggagcagcctctctggggagtaaaatgtttgtctgcggcggctatgatgggagtggctttctgagcatcgccgaaatgtacagcagtgttgcggaccaatggtgcttgatcgttccaatgcacacgagacgaagccgcgttagtttagtggcatcctgcggacgcctgtatgcagtgggcggttacgatggccaaagtaatctgtctagcgtggaaatgtatgatcccgagacggactgttggacctttatggcgcccatggcctgtcacgaggggggtgtcggggtggggtgcattccactcctcactatctag

SEQ ID NO: 48256 - DNA, 1905 bp, Artificial Sequence
  Description of Artificial Sequence: Synthetic coding sequence
atggccgaggagcaggagttcacccagctgtgcaagctgcccgcccaaccaagtcaccctcactgcgtcaataacacttaccggtctgcccagcacagccaagctctgttaagagggttattggccctgcgggacagtgggatcctgtttgacgtggtcctggtggtggagggaagacatatcgaggctcaccgtatcctactggccgcatcctgcgattacttcagaggtatgttcgccggaggcctgaaagagatggagcaagaagaagtgctaatccacggagtgtcatacaacgcgatgtgtcagattctccatttcatttacacaagcgagcttgaactgtctctgagcaacgtccaagagactctggtcgctgcctgccagctgcagattcctgagataatacacttctgttgcgattttcttatgtcctgggtggacgaagagaatatcttagacgtctacaggctggctgagctgttcgacctgtccagattgaccgaacagctggatacttatatccttaagaattttgtggctttcagccgcactgacaagtataggcaactgccgttggagaaggtgtacagtttgctgtcctctaataggctagaggtatcctgcgaaactgaagtgtacgagggagccctgctataccattattccttggagcaagtacaagccgatcagatttcccttcacgagccaccaaagctcctggagacagtgagattccctttgatggaggccgaggtgttgcagcgactgcacgacaaactagacccctcacccttaagggacacagttgctagtgccctgatgtatcaccgtaatgagagtctccagccctcactgcaaagccctcagactgaacttaggtcagacttccaatgtgtggtaggattcgggggcatccatagtactcccagtactgtcttatcagaccaggcaaaatacctaaacccccttctcggcgaatggaaacattttacagcttcgctggctccccgcatgtctaaccagggtatcgctgtcctaaacaatttcgtctatctgattggcggcgataacaacgtgcaaggcttcagggcagagagccgttgctggcgctatgaccccaggcataacagatggtttcagatccaatcactccagcaagaacatgccgatctgtctgtgtgcgtcgtcggacgttatatctacgcagtcgcgggacgagattaccataacgatttaaatgcagttgaacgctacgaccctgccaccaatagctgggcatatgtggcccctctgaagagagaggtctacgctcacgcgggggccactttagagggcaagatgtacatcacatgtggaaggagaggcgaggattatttgaaggagactcattgttatgaccccggcagtaacacgtggcataccttagcggatggacctgtgcgcagggcctggcatgggatggcaacgctgttgaataagttatatgtgatcgggggctcaaataatgatgccgggtaccggagggatgtgcaccaggtggcttgctatagttgtacttcgggccaatggtcttccgtatgtcccctgcccgccggtcacggggagcctgggattgccgtattggacaaccgcatctatgtcctgggaggaagatcacacaaccgaggtagcagaaccggatacgtacatatttatgatgtggaaaaggactgctgggaagagggtccgcaactggataactctatctcaggcctggcggcttgcgtgctcacactgccacggtctttgctgctggaacccccccgcggtaccccagacaggagccaagctgatcccgattttgccagtgaagttatgagcgtgtcggattgggaagagtttgacaattcatccgaagattag

SEQ ID NO: 48257 - DNA, 1476 bp, Artificial Sequence
  Description of Artificial Sequence: Synthetic coding sequence
atgagctgggtggacgaggagaacatcctggacgtgtaccggctggcggagctgttcgatctaagtagactcacagagcagctggatacatacattctcaagaatttcgtcgccttcagtcgaactgataaatacagacaactcccccttgaaaaagtgtactcgctgcttagcagcaacagattggaggtgagttgtgagaccgaagtgtacgagggcgcactgctctaccactatagcctcgaacaagtgcaagcagaccaaattagtctgcatgaaccgcccaaattactcgaaactgtccgcttcccattgatggaagccgaagtccttcagcggctgcatgataagctcgatccgagcccccttagagacactgtggcgagcgcgctcatgtatcatagaaatgaatccttacagcccagtctacagtcccctcaaaccgagcttaggagtgactttcaatgcgtagtcggcttcggagggatacactctaccccatccacagtcctgtctgatcaggcaaagtacctgaacccattgctaggcgaatggaagcactttactgcttcgctcgctcctagaatgtccaaccagggtattgccgttttgaataacttcgtgtatcttattggcggtgataataacgttcagggattccgcgcagagagccggtgctggcgatatgatccacgccacaaccgttggttccagatacaaagcttgcaacaggagcatgccgatctgtccgtgtgcgttgtgggacgctacatatatgccgtcgccgggcgtgattatcataatgatctgaacgcggtcgaacggtatgacccggccactaacagttgggcatatgtcgccccccttaagcgcgaagtgtacgctcacgcgggcgcgaccctcgaggggaaaatgtatataacctgcggaagaagaggagaggactacctaaaagagacacattgctacgaccctgggagtaacacctggcacacacttgccgacggacccgtgaggcgggcgtggcacggcatggctaccctgctgaataaattatacgttatcgggggttctaacaacgacgctggctatcgaagagatgtacaccaggtggcctgctactcttgcacatccggacagtggtcttcggtctgtcctcttccagccggccacggggagcccggtattgctgtgctagataacagaatctacgtgctcggaggaagatcccacaaccgcgggagccgtactggatatgtgcatatatatgacgttgagaaagattgttgggaagaggggccacagttggacaatagcatcagtggactggccgcctgtgtgctgaccttgcctcgctctcttctgcttgaaccccccaggggcacccccgatagatcgcaggccgacccagacttcgcttcagaagtgatgagcgtgtcagattgggaagagtttgacaactctagcgaagattag

SEQ ID NO: 48258 - DNA, 708 bp, Artificial Sequence
  Description of Artificial Sequence: Synthetic coding sequence
atggccgaggagcaggagttcacccagctgtgcaagctgcccgcccagccctcccaccctcactgcgtcaataacacttaccgatccgctcaacactcgcaggccctcctgagaggtctattagccctccgcgactctgggattctcttcgatgtggtccttgtcgttgagggaaggcatatcgaggcacatcgcatcctcctggcagcatcatgcgattatttcagagggatgtttgcaggtggactgaaagagatggaacaagaggaggttctgatccacggtgtctcttataacgccatgtgccagattcttcatttcatttatacctctgagctcgagctatccctgtccaatgtgcaagaaaccctggttgcagcatgtcagttgcagattcctgagatcatacacttctgttgtgatttccttatgtcctgggtggacgaggagaacattttggatgtgtacagactggcagaacttttcgacctgagcagattgacggaacagctcgatacctacatcctgaaaaactttgtggccttctccaggactgacaagtatcgccagctcccactagagaaagtgtatagcctcctgtcgtccaatcggctagaggtgagttgtgagactgaagtctatgagggcgcattgctataccattactcgctggagcaggttcaggctgaccagattagcttgcactag

SEQ ID NO: 48259 - DNA, 1677 bp, Artificial Sequence
  Description of Artificial Sequence: Synthetic coding sequence
atggccctgaagggccaggaggactacatctacctgttcaaggactcaactcatcccgtcgatttcctagacgccttccggactttttatttggatggattgttcacagacattacgctgcaatgtccaagtggcattatctttcactgtcacagagctgtgctggctgcgtgctccaactactttaaggctatgttcacagctgacatgaaagagaagtttaaaaacaagatcaagcttagcgggatccatcacgatattctggagggcctggtgaattacgcctacacttcccagatagaaataactaaacggaatgtgcaatcattactggaggccgctgacctgctgcagtttctgtcagtgaaaaaggcctgcgagagattcctcgtgaggcatctggatatcgacaattgcatcggcatgcattcttttgctgagtttcacgtttgcccagagttagagaaggaatctcggaggatactctgttccaagtttaaagaggtgtggcagcaggaagaattcctcgagatctcacttgaaaaattcttgttcatactttcccgaaagaacctttccgtgtggaaggaggaagccatcatagagcctgttatcaaatggaccgctcatgacgtagagaatagaatcgagtgcctgtataacctcctctcatacattaacatcgacatagacccagtgtatttaaagaccgctctgggtctccagaggtcctgcctgctcaccgagaataaaattcggtctctcatttataacgcactgaaccccatgcataaggaaatctcccaaaggagtacagccaccatgtatatcatcggcggatactactggcatccactctctgaggtgcatatctgggatcccttaactaacgtttggatccagggtgctgaaattcccgattacacaagggagagttacggtgtgacatgtctgggacccaacatatacgtgacgggtggctaccgcaccgataacatagaagccttagacacagtatggatttacaattcggagtccgacgagtggacagaggggctgcccatgttaaacgcgcggtattatcactgcgcggtgacactgggagggtgcgtttatgccctcggtgggtaccgcaagggagctcccgccgaagaggcagaattttacgacccccttaaggagaagtggataccaatcgcaaacatgattaagggtgtcggaaatgcgaccgcatgcgtcctacacgatgttatctacgtgattggaggccactgcggataccgggggagctgtacctatgacaaggtccaaagttacaatagtgacataaatgagtggagcctgatcactagcagcccacaccccgagtatggactgtgcagtgtacccttcgagaacaagctttatctggttggaggacagacaaccataaccgaatgctatgacccagaacagaatgagtggagagagatcgcacccatgatggaacggcgaatggagtgcggcgccgtcattatgaatgggtgcatctatgtcaccgggggttacagctacagcaaagggacatatctgcaaagcatcgagaaatacgatccagacctgaacaaatgggagatcgtaggcaacctacccagcgccatgcgtagccacgggtgcgtatgcgtgtacaacgtgtag

SEQ ID NO: 48260 - DNA, 1677 bp, Artificial Sequence
  Description of Artificial Sequence: Synthetic coding sequence
atggccctgaagggccaggaggactacatctacctgttcaaggactccacacatccagtggacttcctcgatgcctttcgtactttttatcttgatggccttttcaccgacatcacgctgcagtgtccttctggaattatcttccattgccatagagcagtactcgccgcgtgttctaattattttaaggccatgtttactgccgacatgaaggagaaatttaagaataagataaagctatcaggtatccatcacgacatccttgagggtctcgtaaactacgcctatacaagccagattgaaatcaccaaaaggaatgttcagtctctgctagaggcggctgatttgcttcagtttttgtctgtaaagaaggcatgtgaacgctttcttgttcgtcacttggacattgataattgcatcgggatgcattcctttgccgagtttcacgtttgtcctgagctggagaaggagtccagacgtattttatgttctaaattcaaggaagtgtggcagcaagaagaattcctggaaatatcactcgagaaatttttgtttatccttagccgcaagaatctgtctgtctggaaagaggaggccatcattgaacccgtcatcaaatggacagcccatgatgttgaaaatcgtatcgaatgcctgtataacctgttgtcttatattaatattgacattgatccagtgtatctaaaaacagctctgggtctgcagaggtcatgcctgcttacagaaaataagattaggagccttatctataacgccctcaaccccatgcacaaggagatcagccagaggtccacggctacgatgtacatcatcgggggctattactggcatccacttagtgaggtgcacatctgggaccccttgacaaacgtgtggatccaaggagctgagatccctgactatacaagagaaagctatggagtcacctgtctcggtccgaatatctacgtgactggcggatacagaacagacaacatcgaagctcttgacacggtgtggatttacaactcagaaagtgacgagtggaccgaagggctgcctatgctcaacgcccggtactatcattgcgccgtcacacttggcggttgcgtttacgccctcggcggctataggaaaggcgcaccagccgaagaggcggaattctatgatccgcttaaggaaaaatggattcccatcgccaatatgatcaaaggcgtgggcaatgcgaccgcatgcgtgctacacgatgttatctacgtgatcggcggacactgcggctaccggggttcttgtacttacgacaaggtgcagagctacaattccgacattaatgaatggagcttaattactagctccccacaccctgagtacggactctgttctgtccccttcgagaacaagctgtacctggtgggtggccagacgaccatcacagagtgttacgaccctgagcagaacgaatggcgcgagatcgcacctatgatggaacggcggatggagtgtggagccgtgattatgaacggctgtatctacgtgactgggggctacagctactcgaaggggacctacttacagtccatcgaaaaatacgaccccgatctaaacaagtgggaaatcgtggggaacctacccagcgccatgcggagccacggctgcgtgtgtgtctacaacgtttag

SEQ ID NO: 48261 - DNA, 1848 bp, Artificial Sequence
  Description of Artificial Sequence: Synthetic coding sequence
atggccgagagcggcggcagcagcggcggcgccggcggcggcggcgctttcggggccggccctgggcctgagcgccccaactctactgcagataaaaatggagccctgaagtgcaccttctccgctccgtcacattccactagcctcctgcagggattagcaacactgcgcgcacagggacagcttctagacgtcgtgttaactatcaatcgcgaagcatttcccgcccacaaggtcgtactggccgcctgttcagattatttcagggccatgttcactggggggatgcgcgaagcctcccaagacgtgatagagctgaagggggtgagtgcccgtggattacggcacattatcgacttcgcctactctgcagaagtgaccttggacctcgactgtgtccaggacgtgctcggggcagctgtgttcctccagatgctacccgtggtcgaactgtgtgaagaattcctaaaggccgccatgtctgttgagacttgtctgaatattggtcaaatggcaacgacctttagtctggctagcctccgtgaatcagtggacgccttcacgttcagacattttctacagatcgctgaggaagaagacttcttgcggttgcccttggaaagattggtgttttttctccagtccaaccgactgcaatcgtgcgccgaaatcgatctctttagagctgcagtccggtggcttcagcatgatccagctcggcgtcccagggcctctcacgtgctttgccacatccgctttccgctcatgcagtcatcggagctggtagatagtgtccagactcttgatatcatggtggaagacgtgctgtgcagacagtatctcctggaggccttcaactaccaagtgctcccatttagacagcatgaaatgcaatctccacgcacagctgttaggagcgacgttccatccttagtgaccttcggagggaccccttataccgatagcgatcggagcgtctcatcaaaggtgtatcagctgcccgagccaggagctcgacactttagggagcttaccgagatggaagtggggtgctcccatacgtgtgtcgcggtgctggacaacttcgtgtacgtcgcaggcggccagcacctccagtataggtcaggcgaaggcgccgtggatgcctgctaccgctatgacccacacctgaatcgttggttgcgactgcaggccatgcaggaatccaggattcagttccagttgaacgttctatgcggaatggtctatgcaaccggaggaaggaaccgagctggcagcttagcttccgtcgaacggtattgtccacgacggaatgaatgggggtacgcttgtagcctgaagcgtcggacgtgggggcatgcaggcgcagcctctggaggacgactctacatttctggaggctatgggatatcggtggaggacaaaaaggcactgcactgctacgaccctgtggcagatcagtgggagttcaaggcgcccatgagcgagccacgtgtgctgcatgccatggtcggcgcaggagggcgcatttatgccctgggtggacgtatggaccatgtcgatcgctgttttgatgtgctggccgttgagtactacgtaccagaaacagaccagtggacaagcgtgtctccaatgagggccgggcagtccgaggctgggtgttgtcttcttgagaggaagatttacattgtcggtggatacaactggagactgaacaatgtgaccggcatcgttcaggtctataatacggatacagatgagtgggagcgagatttgcacttcccggaatcatttgctgggattgcctgcgcacccgttcttctgccccgcgccggaacccggaggtag

SEQ ID NO: 48262 - DNA, 438 bp, Artificial Sequence
  Description of Artificial Sequence: Synthetic coding sequence
atggccgagagcggcggcagcagcggcggcgccggcggcggcggcgcattcggtgcaggtcctgggcccgagcgccccaacagcaccgccgataagaatggcgctttgaagtgtactttctctgcgccatcccactccacgagcctcctccaaggactggccacgctacgagcacaaggtcagctgttagatgttgttctcaccatcaaccgggaagccttccccgcacataaggtggttttggcggcgtgtagcgattacttccgagctatgttcaccggaggcatgcgggaggcgagccaggatgtgatagagctaaaaggcgtttccgccagagggctcaggcatataatcgatttcgcgtatagcgccgaggttacactggacctggattgcgttcaggaagttgccccgaagactcccggcactctggcatag

SEQ ID NO: 48263 - DNA, 1716 bp, Artificial Sequence
  Description of Artificial Sequence: Synthetic coding sequence
atggaccacaccagccccacctacatgctggccaacctgacccacttgcatagtgagcagctcctgcagggcctgaacttgctgcgccaacatcacgagctgtgtgacataattctgcgtgtgggagatgtcaaaatacacgctcataaagtagtactggccagtgtcagcccttatttcaaggctatgtttactggtaacctgagtgagaaggagaatagcgaggttgagttccagtgcattgatgaaaccgcccttcaggcaatcgttgagtatgcctacactgggactgtgtttattagtcaggatacagttgaaagcctgctgccagcagccaatctcctccagattaagctagttttaaaggagtgctgcgcctttctggagtcccagctggaccccggcaattgcatcggaatctcccggttcgccgaaacatatgggtgtcgcgacctgtatctcgctgcaaccaagtacatatgtcagaatttcgaggccgtttgccaaaccgaagagtttttcgagctgacccacgccgacctggacgagatcgtatcaaatgattgtctgaacgtcgctaccgaggagactgtattttatgcgctggaatcatggattaaatacgatgtgcaggaacggcagaagtatctcgcacagctcctaaatagtgtccgcttacccctgctgagtgtcaaatttctgacccgactgtatgaagcaaatcacctcataagggatgatagaacgtgtaaacacttgcttaatgaggcgcttaagtatcacttcatgcctgaacatcggctgagccaccagactgttctaatgacacgcccaagatgcgctcccaaagttttgtgcgctgttgggggaaagtccggactcttcgcttgcctcgactccgtcgaaatgtacttcccccagaatgactcttggattgggctcgctcctctgaacatacctagatatgaattcggcatttgcgtgctcgaccagaaggtgtacgtgatcgggggcattgccacaaatgtgcgccccggcgtcaccatccggaagcatgagaactctgtggagtgttggaaccccgacacaaatacatggacctctctggaacgcatgaacgaatccagatctacactcggggtcgttgtgttggctggcgagctctacgctttgggaggctatgatgggcaaagctacttgcagagcgtcgaaaagtatatacccaaaataaggaaatggcaaccagttgccccaatgacaaccacacggtcttgctttgctgccgccgtgctggacggtatgatctatgctatcggcggctatggccccgcccatatgaactccgtggagaggtatgacccatccaaggatagctgggagatggtagcatccatggcagacaaacgaattcattttggagtcggcgtgatgctcgggttcatctttgtggtggggggccataatggagtgagccacctgagtagtatcgagaggtacgacccacatcagaaccagtggacagtttgtagacccatgaaggagccaagaactggagtcggcgctgccgtgatcgacaattatctatacgtggtagggggccattcagggtcgagttatctgaatacagtgcagaagtatgaccctatcagcgacacttggctagatagcgccgggatgatctactgccgctgtaactttgggctgacagcgttgtag

SEQ ID NO: 48264 - DNA, 255 bp, Artificial Sequence
  Description of Artificial Sequence: Synthetic coding sequence
atggaccacaccagccccacctacatgctggccaacctgacccacttgcatagcgaacagttgctgcagggactgaacctactaagacagcaccacgaactgtgcgacatcattctccgggtgggcgacgtgaaaattcacgcgcataaggtggtgctagccagtgtgtccccctattttaaggcaatgttcacaggcaatttaagcgagaaagagaattctgaggtggagtttcagtgcatcgacgagacatag

SEQ ID NO: 48265 - DNA, 489 bp, Artificial Sequence
  Description of Artificial Sequence: Synthetic coding sequence
atggaccacaccagccccacctacatgctggccaacctgacccacctacactcagagcaactgttgcagggcctgaatctgctgcgccagcaccatgaactctgtgatattatactaagagtcggggacgtgaaaatccacgctcacaaggtggttttagctagtgtaagcccatactttaaagccatgttcaccggaaacctatcagagaaggagaattccgaggtggagtttcagtgcattgatgagaccgccctgcaggcgatcgtggagtacgcctataccggtacagtcttcatatcccaagatacggtggagagtctcctgcctgcagcaaacctcctgcagattaaactcgtgctcaaggagtgctgcgcctttttggaatcacagctcgaccccggcaactgcatcggcataagcaggtttgcggaaacctatggatgtagggacctgtatttagcggccacaaaatatatctgtcagtag

SEQ ID NO: 48266 - DNA, 138 bp, Artificial Sequence
  Description of Artificial Sequence: Synthetic coding sequence
atggaccacaccagccccacctacatgctggccaacctgacccacttgcatagtgaacagttgttgcagggcctcaacctgctcagacagcatcatgaactatgcgacatcatcctgcgtgtgggcgatgtcaagtag

SEQ ID NO: 48267 - DNA, 2628 bp, Artificial Sequence
  Description of Artificial Sequence: Synthetic coding sequence
atgagccggcaccacagccggttcgagcgggactaccgggtgggctgggatagacgggagtggtcagtgaacggaactcacggaacaacttccatttgctccgtgacatctggagcaggcggtggcacagccagttcactgagcgtgcggccgggcctccttcccctgcctgtggtgccgtcgcgcctacctacgcccgccacagccccagccccctgtaccactggatcctcagaagcaatcacctcgctcgtcgcttcttccgcctccgctgtgactacaaaggccccggggatttcaaagggggattcacagtcccaggggctggccacaagcatccgctggggccagactcccatcaaccaatctactccttgggacaccgatgaacccccctctaaacagatgcgggagtctgacaatccgggaacaggaccctgggtcacaacagtagcggccggcaaccagcccacgcttatcgcccactcctatggcgtggcacagccgccaaccttctctcccgccgttaatgtgcaagcacccgtaatcggcgtgaccccaagtctcccgcctcacgtgggtcctcaactacctttgatgccagggcactactccctaccgcagccaccatcccagccactatcatcggtcgtagtgaacatgccagctcaggctctgtatgcttcacctcagcctctcgcagtgtcgaccctgccaggggtaggacaggtcgcccgccccggcccaaccgccgtcgggaatggtcatatggcaggacccttactgccgccccccccgcctgctcagccaagcgccactctgcctagtggagccccagcaaccaatggaccccctactacagatagcgcgcacgggctacagatgctgaggacaatcggtgtgggaaaatacgaatttaccgacccagggcaccccagggagatgttgaaagagcttaatcagcagcggcgagccaaagcatttactgatcttaaaattgttgtcgaaggccgcgaatttgaagtgcatcaaaatgttctcgctagttgcagcctgtacttcaaggaccttattcagagaagcgtgcaggactctggccagggcgggcgcgaaaagctcgaactcgtcctgagcaaccttcaggccgacgttcttgaacttctgctcgagttcgtctacaccggctccctggtaatagattctgcaaatgccaagaccctgctggaggcagcttcaaagttccagttccataccttctgcaaagtatgtgtgagctttcttgaaaagcagctgaccgcatccaattgtctgggtgtgttggcaatggctgaggccatgcagtgtagtgagctctaccacatggcaaaggcatttgcactacaaatattccctgaggtggcagcccaggaggaaatcttgagcatcagcaaagacgactttatcgcgtatgtttctaatgacagtctcaacaccaaggccgaagagctcgtttatgaaacagtgatcaaatggattaagaaggatcccgccacacggacacagtatgcagctgagctcctcgccgtcgttagactgcccttcattcaccccagctatctccttaatgtggtggacaacgaggagctgattaaaagtagcgaggcatgtcgagaccttgtgaacgaagccaagcggtatcacatgctgccacacgcgaggcaggaaatgcagactccacgaactagacccaggctgtctgctggtgtcgctgaggtgatagtactggtcggtggaagacaaatggtggggatgactcagcgctccttggtggctgtcacatgttggaacccacaaaacaacaagtggtacccgctggcttcccttccattctacgatcgtgagtttttctccgtagtatccgctggcgacaacatctatcttagcgggggaatggagtctggggtgaccttggccgacgtgtggtgttacatgagcctgctggacaattggaacctcgtgtctcgcatgaccgtcccgcgctgccgccataattccctcgtttatgatggtaagatctatacgctggggggactgggagtggccggcaatgtcgatcatgtcgaacggtatgacacgattactaatcaatgggaagccgtagctcccctcccgaaggccgtgcactcggcggctgctaccgtctgtggaggcaaaatatacgttttcgggggggttaacgaagcaggccgtgctgccggggtgttgcaaagttacgtgccacagaccaatacatggtccttcatcgagtctcccatgatagacaataagtacgctccagcagtgaccctcaacgggttcgtctttatcttagggggagcctacgcacgtgcaacaacaatttacgaccctgagaaaggaaatatcaaggcagggcctaatatgaaccattctcgacagttctgcagtgctgtggttcttgatggaaagatctatgctaccgggggtatagtaagttccgaagggcccgccctgggcaacatggaggcctacgagcccacaaccaacacatggactctgctgcctcacatgccttgccctgtattccgacatggttgcgtcgttattaagaaatatatccagtccgggtag

SEQ ID NO: 48268 - DNA, 1683 bp, Artificial Sequence
  Description of Artificial Sequence: Synthetic coding sequence
atgctggacggcctgcagcggctgcggagccagcccaagctggccgatgtaacacttctggtgggcgggagggagctgccttgtcatcgtggactcctggctctgtccagcccctatttccatgctatgttcgcgggcgactttgccgagtccttctctgctagagttgagctcagagatgtcgaacccgccgtggtggggcagctagtggatttcgtctacacgggaaggctaacgatcacccaaggcaacgttgaagcactgactagaaccgctgcccggctccacttccccagtgttcagaaagtatgcggccgataccttcagcagcagctggacgccgccaactgtctgggaatttgtgaattcggagaacaacaagggctgctgggcgttgccgctaaagcttgggcctttttacgcgagaattttgaagccgtcgccagagaggatgagtttctgcaattgcctagggaacgcctggttacctgtctggcaggagatctgttgcaggttcagccggagcagtcccgcctggaggcacttatgcggtgggttcgacacgatcctcaggcgcgcgctgcgcaccttccggaattgctctccctcgtccacttggatgcagtgccacgaccctgtgtccaacaactgcttgcaagcgagcccctcattcaagagagtgaggcatgccgggctgccctttcacaaggtcatgacggagctcctctggcactgcaacagaagctcgaggaagtcttagtggtggttggaggccaggccctcgaagaggaagaagcaggcgaagagcccacacccggactgggaaattttgctttttataattctaaggccaaacgttggatggctctcccggatttcccagattaccacaaatggggttttagccttgcggccctcaacaataacatctacgttactggtggatccaggggaaccaagactgacacgtggtccacgactcaagcatggtgctttccactgaaggaggcatcttggaaaccagtcgcacctatgctcaaacctcggaccaatcacgcctcagctgcgctgaatggagagatctatgttatcggtggcacaactctggatgtggttgaagtggagtcctatgacccctacactgactcatggacccccgtgtcccccgcactaaaatacgtgagtaacttttccgctgcgggatgcaggggaagactgtacttggtggggtccagcgcgtgcaaatacaatgcactggctttacagtgctataaccctgtgacggacgcttggtccgtcatcgcatccccatttctgcccaaatacctgagcagtccacgctgcgctgcccttcatggcgagctgtacttgattggggacaatacaaagaaggtgtatgtctatgatcctggcgcgaatctgtggcagaaagtgcagtcacagcatagtctccatgagaatggcgcactggttccactgggggatgccctgtatgtgactggaggcaggtggcagggaatggagggtgactatcatgtggaaatggaggcctatgacaccgttcgagatacgtggacacgtcatggcgcgctgccaagactttggctgtatcacggagcaagcacagttttcctcgatgtttcaaagtggacacagccaagcggtccaacccaggaacattag

SEQ ID NO: 48269 - DNA, 1737 bp, Artificial Sequence
  Description of Artificial Sequence: Synthetic coding sequence
atggtgcggaacgtggacgacctggacttccacctgcccagccacgctcaagatatgctggacggactgcagcgtctgcgaagccaacccaagttggctgacgtcaccctgttggtgggaggacgggagctaccctgtcaccgtggccttctggcactgtcttccccttattttcatgccatgttcgccggagattttgcagaatccttctcagcaagagtggagctaagagatgtggaaccagcagtggtaggccagttggttgatttcgtgtacacggggcgcctgacaatcacacaagggaatgttgaggcactcacgcggactgccgcccggctgcacttccctagtgtgcagaaagtgtgtggaagatatttacagcagcagttagatgcggccaattgcctcggcatctgtgagtttggcgaacagcaaggactgttaggcgtggccgctaaggcctgggctttcctgcgagagaacttcgaggctgttgcgagagaagatgaattcctacagctgccccgtgaacgacttgtgacatgccttgctggagatctgctgcaagtccagccggaacagtcacgactggaggccctcatgaggtgggttcgccatgaccctcaggctagagctgcccacctaccagaactgctgagcctggtccacctcgacgccgtcccccgtccttgcgttcaacaacttctcgcgtccgaaccactcattcaagagtcagaagcctgtcgggctgcactgtcgcaaggacatgacggagccccactggcacttcagcaaaagctggaagaagtgctagttgtagtagggggacaggctctggaagaagaagaagccggcgaggagccaacacccgggcttgggaattttgctttttataattctaaagcaaaacggtggatggccttacctgattttcccgactaccataaatggggcttctctctagctgcacttaacaacaacatatatgtaaccggagggtcacgcgggaccaagaccgatacatggtcaacgactcaagcctggtgttttcccctcaaggaagcctcctggaagccggtcgcccctatgctgaagccacggacaaaccacgcatccgccgccctcaacggggaaatctatgtgattggtggcaccaccttggacgtggtcgaagttgaatcatacgatccttatactgacagttggactcctgtttcccctgcattaaagtacgtgtctaatttctccgctgccgggtgtcggggtcggttgtacctggttggtagttctgcatgcaaatacaatgctttggccctgcagtgttacaacccagtgacagacgcgtggtctgttatagcaagtccctttctgccaaagtacctctcttctccccgctgcgcggctcttcacggtgaactttacctgattggagacaataccaaaaaggtgtatgtgtacgatccgggggcaaatctttggcagaaagtccagtcacagcactcgctgcacgagaatggggccctcgtccccctgggcgatgcattgtacgtgaccggagggagatggcagggcatggaaggcgactatcacgtggagatggaagcctacgatactgtccgggacacctggactaggcacggcgcgttaccacgcctgtggctgtaccatggcgcctccacagtgtttctggatgtgtccaagtggactcagcctagtggacccacccaggaacattag

SEQ ID NO: 48270 - DNA, 420 bp, Artificial Sequence
  Description of Artificial Sequence: Synthetic coding sequence
atgcccagcgagcggtgcctgagcatccaggagatgctgaccggccagcgtctttgccacagtgaatcacataatgacagtgtacttgccgcattgaaccagcagagatctgatgggatcctctgtgacataactctcatcgctgaggagcagaagttccacgcccacaaggccgtgctcgcagcttgttccgactattttcgggctatgtttagcttgtgtatggtggagtcgggagcagatgaagtgaacctccatggcgttacttccctgggtctcaaacaggcattagaatttgcttacaccggacagatcctgcttgagcctggggtgatccaagatgtcttagcagctggaagccatctccagctgcttgaattactgaacttatgcagtcattatttgatacaggtcgagtag

SEQ ID NO: 48271 - DNA, 621 bp, Artificial Sequence
  Description of Artificial Sequence: Synthetic coding sequence
atggtggagagcggcgccgacgaggtgaacctgcacggcgtgacctctctcggcttaaaacaggctttagaattcgcctacactggacagatcctgctcgagcccggggttatccaggacgtgttggccgcaggatcgcatctccaattgttagaactcctaaacttgtgcagccattacctcatccaagagcttaatagtttcaactatctagatctgtacaggctagccgatttgttcaatctgacgctgctcgagaaagcagtgatcgactttctcgtcaaacacctgagcgaattgctgaaatccaggcctgaggaagtcctaacattgccatattgcttactgcaagaagtgctgaagtcggacagactcacgagtctcagcgaagagcagatatggcaaaagtgtggaatttgcgcagcattttgtgccctgaggggcgactggtgccccgggctgcctcagtgggatgacaaaacagcaagctgtgaggtagtgggaacccaattgcctctgcccgtccatgggcgtgcacccgcaattcacccgctgtggccaaacggctgtggctatagcccgtactcctgtcccgtcccacccccatgcccctcgaagtag

SEQ ID NO: 48272 - DNA, 1863 bp, Artificial Sequence
  Description of Artificial Sequence: Synthetic coding sequence
atgcccagcgagcggtgcctgagcatccaggagatgctgaccggccagcgattatgccactctgaatcgcacaacgactccgtcctggccgcacttaatcaacagcgcagcgacggaatcttgtgtgacatcactcttatcgcagaggagcagaaatttcatgcccataaagccgtgctagcagcctgctccgattatttccgggccatgtttagcctgtgcatggttgagtccggcgctgatgaagtcaatctccacggcgtgacctcgctaggattgaagcaggctcttgagtttgcctatactggccagattctactggagcccggagtcattcaggatgtcctcgccgcaggatctcatttgcaattgctcgaactgttgaatctttgttctcactatttgatccaagagctcaacagcttcaattatctggacctgtatagacttgctgatctcttcaaccttaccctcctcgagaaggcagtgatagatttcttggtcaaacatctttccgagctgttgaaatccaggcccgaagaagtgttaacattgccttattgcctccttcaagaagtcctgaagagcgaccggctcacctctctctcagaggagcaaatctggcaactggcagtccgatggcttgagcacaactgtcattatcagtatatggacgaactgctgcagtacatccgcttcggcttaatggatgtggataccctccacaccgtagcactgtcccatcctctcgtccaagcaagcgagacagcaacagcgttagtgaatgaggctctggaataccatcaatcgatctatgctcaaccagtctggcagacaagacgcaccaaacccaggtttcagagtgacactttgtacattattggcggtaagaaaagagaagtgtgtaaggtgaaagagctgaggtactttaaccctgtggaccaggagaatgctctcatcgccgccatcgccaactggtcggaactggcccccatgccagttggtaggtctcatcactgtgtggccgtgatgggcgacttcctctttgtggccgggggcgaggtggagcacgcatccgggcgcacgtgcgcggtgagaaccgcatgtcggtatgaccctcggtctaactcctgggccgagattgcacccatgaagaactgtcgggaacacttcgtgctcggggccatggaggaatacctgtatgcagtgggcggcagaaacgaactgcgtcaagtgctcccaaccgtggaacgctactgtcctaagaagaataagtggacatttgttcagtctttcgacaggtccctatcctgccacgctggatatgtggctgacggtctcctctggatatctggaggggtcacgaacacggcacagtatcagaaccggcttatggtctatgagccaaaccagaacaaatggattagccggtctccgatgctgcaaagacgggtataccacagtatggccgccgtgcagagaaagctgtatgtcctcggagggaacgacttggactataacaacgacagaatcctggtgaggcatatcgacagttataacatcgacactgatcagtggacccgttgcaattttaatctgctcactgggcagaatgaatctggggtggcagtccacaacgggcgcatttaccttgttggcggatacagcatctggactaacgagccgctggcctgcatccaggtgctggacgtgtctcgggaagggaaagaggaagtcttctatggcccaaccctcccgtttgccagtaatggtatcgcagcttgcttcctgcccgctccgtattttacctgtcctaatctgcagaccttgcaagtcccccatcatcgaatcggaacgatctag

SEQ ID NO: 48273 - DNA, 531 bp, Artificial Sequence
  Description of Artificial Sequence: Synthetic coding sequence
atcctgctggagcccggcgtgatccaggacgtgctggccgccggctcgcacctacagctgctcgagctattaaatctgtgcagtcattacttaatccaggagttgaattcttttaactaccttgacctgtaccgcctggcggatttgttcaatttgacactgcttgaaaaagctgtaattgatttcctcgttaagcacttgtccgaattgcttaagtccaggccggaagaagtacttacactgccatattgcctgctgcaagaagtgctgaagtccgatcgcctcacttccctgagtgaagagcaaatctggcaaaagtgtggaatatgtgcagcgttctgcgctttgaggggtgattggtgtccaggcctcccccagtgggacgacaagacagcttcctgtgaagtggtgggaacgcagctgccactgcctgtacacggtcgggcccccgccatacacccactgtggcccaatggatgtggatattccccctacagctgccccgtgcccccgccctgtccctctaagtag

SEQ ID NO: 48274 - DNA, 1755 bp, Artificial Sequence
  Description of Artificial Sequence: Synthetic coding sequence
atgcccagcgagcggtgcctgagcatccaggagatgctgaccggccagaggctgtgccactccgaatcacacaacgattctgtcctggccgctctgaaccaacagcgatcagatgggattctttgcgacatcaccttgattgccgaggagcagaagtttcatgctcacaaggccgttcttgcagcgtgttccgactattttcggatcctgctggagccaggtgtcatccaggacgtcttggctgcagggagccacctgcagctgttagagttactgaacctctgctctcactaccttattcaggaacttaactcctttaactacttggatctatacagactagccgacctgttcaacctaaccctgttggagaaagccgtaattgactttctggtaaagcacctcagtgaactgttgaagtcacgccctgaagaagtcctcacattgccgtattgtttgctgcaggaggtactgaagagcgacagactcacctccttgtccgaggaacagatatggcagctggccgtgcgctggcttgaacataattgtcactatcagtatatggacgaacttctgcagtacatcaggttcgggctgatggatgtggacaccctgcacaccgtggccttgtcccaccccttggtacaggcatcagagacagccaccgcccttgtcaatgaagccttggaatatcaccagagtatttacgcacagcccgtctggcagactaggcgcaccaagcctaggttccagtcggacacactgtatatcatcgggggaaagaaaagagaagtgtgtaaagtaaaggaactgagatacttcaaccctgtcgaccaggagaacgcactgattgccgcgattgcaaactggtccgaacttgcccctatgcccgtcggacgcagtcaccactgcgtggctgtgatgggtgacttcctcttcgtggcgggaggagaggttgagcacgcctcaggcagaacatgtgcagtacggacagcatgtcgatatgacccgcggagcaattcatgggccgagatcgcccctatgaagaactgccgagagcacttcgtgctcggcgccatggaggagtacctctacgctgtgggtggtaggaacgaactgaggcaggttctgccaacggtggagcgatattgccctaagaagaataaatggacattcgtgcaatccttcgatcggtctctgagctgccacgcaggttacgttgcggatgggctgttgtggatctctggaggtgtgaccaataccgcacagtaccagaacaggctcatggtttacgaacctaatcaaaacaaatggatcagtcggtcccccatgctgcagcgtagagtgtaccacagtatggccgctgtgcaaaggaagctgtacgtgctaggggggaacgaccttgactataacaacgaccgaattctcgtccggcacatagattcatacaacatcgacactgaccagtggacacgctgcaattttaatctgctgactggtcagaacgaatcaggcgtggccgttcacaacggacgcatttatttggttggtggctattcgatatggacaaacgagcccctggcttgtattcaagtgctggacgtcagtcgagagggcaaagaggaagtgttctacggtcctacacttccgttcgctagcaacgggatagccgcgtgcttcttacccgcgccttatttcacatgcccgaatctgcagaccctgcaggtgccccatcacagaatcgggacaatatag

SEQ ID NO: 48275 - DNA, 1656 bp, Artificial Sequence
  Description of Artificial Sequence: Synthetic coding sequence
atgcccagcgagcggtgcctgagcatccaggagatgctgaccggccaacgcctttgccacagtgaaagccacaatgactctgtccttgctgctctgaaccagcagaggagtgacggcatactgtgtgatatcaccttgattgcggaggagcagaagttccatgctcacaaggccgtcctcgcagcctgctccgattattttcgggaacttaacagcttcaattacttagatctttatagactcgcagacctgttcaatctgaccctgctggagaaggcagtgatcgatttcctagttaagcacctctccgagctgttgaagagtcgccccgaggaagttctcacgctaccatattgtttgctccaggaggtactgaaaagcgacagattgactagcctgagcgaagagcagatctggcagctcgccgtgaggtggctagaacacaactgccattaccagtatatggatgagctgctccagtatattagattcggactgatggatgtcgacaccctccataccgttgctctttcccatccgctcgtgcaagccagcgagactgctaccgccctagtcaacgaggcgttggaataccaccagtctatttacgctcagcctgtgtggcagactaggcgaactaagcccagattccagtcggacacactctacattattggcgggaaaaagcgcgaagtttgcaaagtaaaggagcttcggtacttcaaccccgtggatcaggagaacgctcttatagcggcaattgcaaactggagtgaattagcccctatgcctgtcggcaggtcacatcactgtgttgcggtcatgggagatttcttattcgtcgcaggaggggaggtggaacacgcctccggccgaacgtgcgctgtacgcaccgcatgcagatacgaccctcggtcaaattcttgggcagaaattgccccgatgaagaactgtcgggaacacttcgtgctgggcgcgatggaggaatatctgtacgcggtcggaggcagaaatgagctccggcaggtgctgccaactgtggagaggtactgtcctaaaaagaataaatggaccttcgtccagagtttcgaccggtcactttcatgtcatgccggctatgtcgccgatggcctcctgtggataagtgggggcgtgactaataccgcccagtatcagaacagactgatggtgtatgagccgaatcaaaataaatggatcagcaggtcacccatgcttcaaaggagagtttaccacagtatggccgctgtacaaaggaagctttacgttctaggcgggaatgacctggactacaataatgaccggatccttgtccggcacatcgattcttacaacatcgacacggatcagtggacccgctgcaatttcaacttactgacggggcagaatgagtcaggagtcgctgtacataatggcagaatctacctcgtagggggctattccatatggaccaatgaacccttggcctgtatccaggtcctggatgtgtctcgtgaggggaaagaggaggttttctacggccccaccctcccttttgcaagcaatggcattgccgcctgtttccttccagccccctacttcacgtgccctaatctgcagactctccaggttcctcaccatagaatcggcacaatttag

SEQ ID NO: 48276 - DNA, 531 bp, Artificial Sequence
  Description of Artificial Sequence: Synthetic coding sequence
atgctgcccctgagccaccccggcggcgtgaccaacaccgcccagtatcagaatagactcatggtgtatgaacctaatcagaacaagtggatttctaggtccccgatgctccagaggcgagtgtatcattctatggccgccgttcagcgcaaactctatgtgctgggaggaaatgatcttgactataacaacgatcggatcctggtccgccatatcgattcttacaacatagacacggaccaatggacccgatgtaattttaacctccttacggggcagaacgagagcggagttgccgtgcacaatggtagaatctacctcgtgggcggctacagtatctggaccaatgaaccgctggcttgtatccaggtgctggatgtgtcgagggagggcaaagaagaggtgttctacgggcccaccctgcccttcgcctcgaatggaatcgcagcatgcttcctacccgcgccgtactttacttgcccaaacctccagaccttgcaggtgccccaccaccggatcggcaccatttag

SEQ ID NO: 48277 - DNA, 1602 bp, Artificial Sequence
  Description of Artificial Sequence: Synthetic coding sequence
atgctgctgagcggcatgcgggagagccagggcaccgaggtgagcctgcgtactatctcaactcaagacctaagactgcttgtgagtttcgcttactctggtgtggtacgagctaggtggccgggactcctgcgcgcggctcaagcagcactgcagtaccaaagtagtagctgcctagatctatgccagaaaggcttggctcggggtctgtccccagctcgctgtctggccctgtttccgatggccgaagcaccaggactcgaaagattatggtctaaagccaggcattatctgctgactcacttacctgctgttgccttatgtcctgctttcccctccttgccagcggcatgtttggctgaattactggatagcgatgagctgcacgtgcaagaagaatttgaggcattcgtggcggcccgatgttggctggccgccaacccagagacacaggaaagcgaggccaaagctttgttgagatgcgtgagattcggaagaatgtccaccagggagctgcgcagggtgcgggctgctggcctgctgcctccgctgactcccgatcttctccaccagttgatggtggaggctgacgtgcctggccaggagcgacggagggagcccgaccgcgctctggtggtgataggaggagacggactgcgccctgacatggccctgcgccagcctagtagggcggtctggtgggcgagagcttttcgttgtggcgttggcctggtgaggactgtagaatggggccaattacccgcattgcctgctcctggccgctttaggcacggagccgccagtcttgccggttcagagctctatgtgtgcggggggcaggacttttatagccacagcaacacccttgcatccactctgagatgggagccatcgcaggaggactgggaggagatggcccctctttcccaggcccggtcgctgttcagtctcgttgccctggatgggaaactttacgccttaggcggccggcataacgatgtggcccttgattcagtcgagacctacaatcccgaattaaacgtttggcggcctgctcctgctctgccagccccctgttttgcccatgccgccgcaatcttggaaggacagctgtacgtcagtgggggctgcgggggaacaggtcagtatctggcctcccttatgcattatgaccccaagttggagaagcctgggacttttttatccccgatgggcgtcccaagagccggtcatgtcatggcagctctgggaggacgattgtatgttgccggcgggcttggtgagaccgaagacctactctcatttgaagcatacgaattgcggacagactcctggacccatcttgccccccttcctagcccccatgtaggcgcagccagcgccgttctgcagggggagttactggtccttgggggatacagccaccgcacatatgctttgtctcacttgatccacgcttattgccctggactgggtcggtggctgtgtctgggaaccctgccccggcctcgtgccgaaatgccagcatgcattctcaccctgcccgcggtgcagcacatcgccttggtgcccactccgcatcagacaaagcctgccggatag

SEQ ID NO: 48278 - DNA, 1935 bp, Artificial Sequence
  Description of Artificial Sequence: Synthetic coding sequence
atgagctacttcctgagctactgcaaggcccacggcggcgccctgctcacgggttatcaggcactccgagcagaaggctttttgtgcgacgtaaccctggaaaccgaggggtctgagtttcccgcccatagatctctcctggcttgtagctctgactacttccgagcgttgttcaaatcccacacacaggaaagcagagcgagagttattcatttgcacgtcccctccgccgctgggctgcaaagattgttggatttcatttatacagcctggctgtctctgtctatggacacggttgaagacactcttgaagccgccagctatctccaagtcacggaggctctcggactatgcggaagatatctggaaagacaactcgcgccagagaattgctgtttcgccgccaacgtcgccgctagatttggtctggcccacacactggatgccgccgagcgatgcattgtgtcacatcttcaggaactactggcgcggggcgcggggccagctgggttgctggaactgaatcccacaagtctacgggcagttttaggcgctcctgacgttgcccgggtgcctgaggctagactcctcgggttggctttggcgtggctccggcaggagcccactactgagcgtctggcacactgtaccgaactgctggaaagagtccgattcggcctcgttccggccgatgtgctgcgccgcgtttacagtggttcaggtctggtgcttcccgcacgggtgaaaggcctgatcatccaggccttaaattaccacactacccctagccggcagcccttgatgcagggcgagcagacctctattagatcaccacaaactagaattttactcgtagggggccggagggctcgggaagtcgttattgaagaagtcgcggctccacagagagccgcccgcggccaggtggccgctcctgagccagaagaggaggaagaagagctggaagaagaggaggaagaggaggaatgggaattgacccagaatgtggtggcctttgatgtgtacaaccacaggtggcgctcactcacccagcttccaacacccctcttaggccacagtgtatgcaccgcagggaattttctctttgtactagggggggaatcacccagcggctcagcttcctctccactcgccgatgactcccgcgtggtaacagctcaagtgcaccggtatgacccccgctttcatgcttggacagaagtacccgccatgcgcgaagccagagcacatttctggtgcggcgctgtgggagagcgcctgctggctgtaggaggcttgggcgcaggcggggaggtgcttgcgtccgtagaaatgtatgacttaaggcgcgaccgatggacagcggcaggcgcactcccacgggccctgcatggccacgctggcgccgtgggcgatcgaggggtagtgtacattagcgggggtaaggccggtagaggagagggtggcgccagttccctgagagatctctatgtgttaggccccgaggaacaggtttggtccaagaaagcacccatggggactgcgcgattcggtcaccacatggcggtgctgcgaggtgcagtgttcgcattcctggggcgatatgaacctttctctgagatagagaggtacgatcccggggctgaccaatggacacgattgcgccctctaccgtatgacaggttctgctacggtctggctgtggttgaggaaacagctctcctacttggaggcctgaagtggcgggacagcaggcaggttccaactcggaatgtggtgggatacgacttggacctcgacaggtgggaagacattgggtgcgccctgccttgggcttggagtggtctgcggtgtgcggttttgcagttagctgagggcggcgatgatgagcgagagggcgaggtgggagaagcccttgacctggtgctaggctag

SEQ ID NO: 48279 - DNA, 1092 bp, Artificial Sequence
  Description of Artificial Sequence: Synthetic coding sequence
atgcggtgggtgcggcacgacgcccccgcccggcggggccagctgcggagattacttgagcacgtgcgacttccgttgctggctcctgcctattttcttgagaaagtggaggccgacgagcttctgcaggcctgcggtgagtgcaggccattgctgctcgaggctcgagcctgctttatcctgggaagagaagccggcgccctccgcacccgaccccggcggtttatggatctagccgaggttatagtcgtgatagggggatgtgaccgtaagggactgttgaagcttcccttcgccgacgcctaccaccccgagtctcaacggtggactcctctacctagcctgccagggtacacaaggtccgagttcgcggcatgcgctttgaggaatgacgtgtacgtctcaggcggacatataaacagtcatgatgtgtggatgttctcatcacatctgcacacatggattaaggtcgcatcactccacaagggcaggtggcggcacaaaatggctgtagtccagggccaactgtttgctgtgggaggctttgacggactcaggcgactccactccgtggagcgctacgatccattttccaatacttgggctgccgccgcgccgttgcctgaggctgtgtcttctgctgccgtggccagttgcgcaggtaaactctttgttattggaggagcccgtcagggaggagtgaataccgacaaagttcagtgctttgatcccaaggaagacaggtggtccctgaggtctccagccccattctcacaaaggtgtctggaggcagtaagtctcgaggataccatctatgtcatgggaggactcatgtctaagatattcacttatgacccaggcaccgatgtctggggcgaggccgccgtcctccctagtccagttgagtcctgcggagtgaccgtgtgcgatgggaaggtgcacatcctgggcggcagagatgatcggggcgaaagtacagataaggtattcactttcgacccatcctctggccaggtcgaggtgcagccctctctgcagcgatgtacttcgtctcatggatgtgttacaatcatccagagcttaggtcggtag

SEQ ID NO: 48280 - DNA, 1752 bp, Artificial Sequence
  Description of Artificial Sequence: Synthetic coding sequence
atgcggcagggccacgcccccgaggagagcgagcccggctgcgaggctccatgtgccggaccttgtcacgcccaaagagttctgcaggcgcttaatgcgtaccgcaggtctggcacacttaccgatgtcgtgctccgagccggcggtagagactttccttgtcacagagccgctcttagtgcagggagcgcttattttcggtcactgtttgctgcaggacgacctgagcggggcccagccgttgtgcccgttgtgcccgtggcccctgaagcgccaggcacttccccggctggagccgcagccgcccttgccgttgtgttagattatgtttatggcgccggagtccggctccgcgcagaagacgaggccgctgccgttcttgccctggcggagaggctgggggtggcaggtttgcgcgaagcctgcgtaagatttctggaaggacgcttgcgcgctgccaattccttggcgctgcgccgtgtcgcagcggcattttctctggccccactggcagaaagatgcgggcgagtcctgagacaggcgttcgctgaggtggcccggcacgctgactttctcgagttggcccctgacgaagttgtggccctgttggctgatcccgcactgggcgtggcgcgggaggaggctgtgtttgaggctgcaatgcgctgggtacggcacgatgctcctgcaaggcgcggacagctcagacgacttttagagcatgtacgcctgcctttgttagcgcctgcttacttcctggagaaggtggaggcagacgagttgctccaagcctgcggggaatgccggccgttgcttctggaagcccgggcatgtttcatccttggacgggaagccggagcattgagaactaggccacgtcggtttatggatctggcagaagtgattgtagtgataggcgggtgcgatcgtaagggtttattgaagttgccatttgctgatgcttaccatcccgaatcccagcgctggacgcctttgccctctttgcccggctatactagatccgaatttgccgcatgcgccctccggaatgatgtttacgtttcaggcggtcatatcaacagtcacgacgtatggatgtttagcagccacctgcacacctggatcaaagtggcctcattgcacaaaggcagatggcggcataagatggccgttgttcaggggcaactgtttgctgtcggaggatttgacggcttacggcggctacatagcgtggagcgttatgatcctttctccaatacctgggcagctgcagctcccctcccagaagcagtgtcaagcgctgcggtggctagttgcgccggtaagctgtttgtgatcggaggtgccaggcaaggaggagtgaacactgacaaggtccagtgtttcgaccccaaggaggaccgatggagcctaaggtcacctgcacccttctctcagcggtgtctcgaagctgtgagcctggaggacactatctacgtcatgggcggtttgatgtctaaaatcttcacctacgacccaggcacagatgtctggggtgaggccgccgtactgcccagtccagtcgagagctgtggagttaccgtctgtgatgggaaagtgcacatcctaggaggtagagatgataggggtgaatctacagacaaggtatttaccttcgatccctccagcggtcaggtggaagtgcaaccttctctgcagcggtgcaccagttcacatggttgcgtgaccattattcaaagcctaggacgatag

SEQ ID NO: 48281 - DNA, 1662 bp, Artificial Sequence
  Description of Artificial Sequence: Synthetic coding sequence
atgatggagggcagccggcagacccgggtgagccggccctacaagatctcagaatcgtcaaaagtttacaggtgggcagaccatagttccacagtgctgcaacgcctaaatgagcagcgtctgagaggtttgttctgcgacgttgtgcttgtggccgacgagcaacgggtccctgcccaccgcaaccttctcgccgtatgcagtgattattttaactccatgtttactatcgggatgagagaggcattccagaaggaggtcgagctgattggggcttcttacataggactgaaggcggtcgtcgatttcttgtatggaggagagttagttctggacgggggaaatatcgactacgtgttagagacggcccatctgctgcagatctggaccgtggtggatttctgttgtgaatatctggagcaggaagtgagcgaggacaactatctgtatctgcaggagctggcaagtatttactcacttaagagactggatgcatttatcgatggtttcatactgaatcatttcggcactctcagctttactcctgactttttacagaatgtcagcatgcagaagctctgcgtgtatctatcttctagcgaggtccagcgtgagtgtgaacacgacctgctccaggccgcccttcagtggctaacccaacagccggagagggaggcgcacgccagacaagtgctcgagaatatccattttccgttaatcccaaagaacgatctgctgcatcgcgttaagcctgcggtttgcagtctgcttccgaaggaggccaattgtgagggcttcatagaagaagcggtcagataccacaataatctggctgcgcagcctgtgatgcagaccaagagaaccgccctccggaccaaccaagagagactgttgtttgtggggggggaagtcagtgaaagatgcctcgagctctccgacgacacctgctatttggatgctaagtctgagcagtgggtgaaggagaccccactgcccgcccggcggtcacaccattgcgttgccgtgcttgggggattcatttttattgcaggtggttcattttcccgcgacaacggcggagatgctgcatcaaatctgctttaccggtttacgtacggacacgcgggcaccatctacaaggactttgtatacatttcagggggacatgattaccagatcggcccctatcgtaaaaatctgctgtgttacgaccacaggacagacgtgtgggaagagcggcggcccatgacaaccgccagagggtggcacagtatgtgttcgttgggggacagcatttattctatcggtggcagcgacgataacatagaaagtatggagagatttgacgtgctgggggtggaggcttacagtccccagtgtaatcaatggaccagggtggcacccctgttgcacgctaacagcgaatcgggagtggctgtgtgggaagggcgtatctacatcctcggaggatattcctgggagaataccgctttctcaaaaaccgtgcaggtgtacgatcgcgaggctgacaagtggagccgcggggtcgatcttccaaaggccatcgcgggcggcagtgcctgcgtgtgcgccctggaaccacgccccgaggataagaaaaaaaagggcaagggcaagcggcatcaggatcgaggtcagtag

SEQ ID NO: 48282 - DNA, 1851 bp, Artificial Sequence
  Description of Artificial Sequence: Synthetic coding sequence
atgatggagggcagccggcagacccgggtgagccggccctacaagatctcagaaagctctaaggtatatagatgggccgatcactctagcactgttttgcagcgcctgaatgaacagagactacggggccttttctgcgatgtggtcttggtggcagacgagcaaagagtgcccgcacaccggaatctgttagcagtgtgcagcgattattttaatagtatgtttactataggcatgcgggaagctttccagaaggaggtggagctgattggcgcaagttacatagggctaaaggcggtcgtggatttcctctatggcggcgagctcgttctggatggggggaacatcgattacgtgctggagacagcgcatctgcttcaaatctggacggtggtggatttttgttgcgagtatctcgagcaggaagtaagcgaggacaactacctgtacctacaggagctagcctccatctattccctaaaaaggctggatgcgtttatcgacggatttattctcaatcactttggcacattatcttttactcctgattttctgcaaaacgtgagcatgcagaagctgtgcgtctatctatctagcagcgaggttcagcgagagtgcgagcatgaccttctgcaagccgccctgcagtggttaacgcagcagccagagagggaagcgcatgctcggcaagtgcttgagaatatccacttccctctgatccccaaaaatgacctcctgcacagggtgaaacccgccgtttgcagcctgctgcctaaggaggcaaactgcgaaggattcatagaagaggctgttagataccataacaatctggccgcgcagccggtgatgcagactaaacggactgcacttcggaccaaccaggagcgtctgttatttgttggcggtgaggtgagtgagcgctgcctggagttaagtgacgatacgtgttacctagacgccaagtccgagcagtgggttaaggagacacctctgcctgcacgccgcagccatcattgtgtcgctgtgttgggcggcttcatttttatcgcaggagggtcattcagccgagataatggaggggacgcagctagcaaccttctgtacaggtacgatccaagatgcaaacaatggatcaaagtggcttcgatgaatcagagacgggtggatttctacttagcttctatagaggacatgctggtggcaataggcggacgcaacgagaacggagccttgtcctctgtggagacttattctccgaagaccgattcctggtcctacgtggccggcctgcctcgctttacctacggacatgccgggactatttacaaggatttcgtgtatattagcggcggtcatgactatcagatcggaccgtatcggaagaatttgctgtgttacgaccatagaaccgacgtgtgggaagagagacgccccatgacgaccgcgagagggtggcactccatgtgtagcctcggagatagcatctattcaatcgggggttctgacgataacatagaatctatggagaggtttgatgtactcggcgtcgaggcatacagtccacaatgtaatcaatggaccagagtagcaccgctactgcacgctaattcagaatcaggagtcgccgtgtgggagggacggatctacattttggggggatattcctgggagaataccgctttctccaaaactgttcaggtttatgatcgtgaggccgataaatggagcaggggagtggacttgccaaaggccattgccggtggcagtgcctgcgtgtgtgcgcttgaaccaagacccgaggacaagaagaagaaaggcaaaggaaagcggcaccaggatagaggacagtag

SEQ ID NO: 48283 - DNA, 1851 bp, Artificial Sequence
  Description of Artificial Sequence: Synthetic coding sequence
atgatggagggcagccggcagacccgggtgagccggccctacaagatctcagaatcttctaaggtgtacagatgggcagaccatagcagcacggtcttacaaagactcaatgaacagcggttacggggactgttttgcgacgtggtgctggtggcagatgagcagagggtcccagcccaccgcaatctcctggcggtatgtagtgactacttcaattctatgtttaccattgggatgagggaggcgtttcaaaaagaggtggagttgatcggagccagttacatcggcctaaaggctgtagtggatttcctgtacggtggggagctcgttctagacggcggcaacatagactacgttctcgagacagcccacctgttgcagatctggaccgttgtagacttctgctgtgagtacttggagcaggaggtgtcggaggacaactacctctacttacaggaattagcctctatttacagcctgaagaggctagatgcctttattgatgggttcattctgaaccatttcggaaccctgtcattcactcctgactttttgcagaacgtctcaatgcagaaattatgtgtgtacttaagctccagcgaggtgcagagggaatgcgagcacgatctgctccaggccgccctgcagtggcttacccaacagccagaacgcgaggcacacgcgcgccaagtgctggagaatatccacttcccactgataccaaagaacgatctcctgcatcgcgtgaagccagctgtctgctccttactgcccaaagaagctaactgtgagggcttcatcgaagaggccgtgcggtatcacaacaatctagctgcccagcccgtgatgcaaaccaagcgaaccgcattaagaacaaatcaagagcggctgcttttcgtaggaggcgaagtgtcagagcgttgtctcgaactcagcgacgatacatgttatctggatgctaaatcggagcagtgggtcaaagagactccactccctgccaggcgctcacatcactgcgtggccgttctgggcggcttcatctttatcgcaggcggcagttttagcagggataacggaggtgatgctgccagcaacttactgtacagatatgacccaagatgtaaacaatggattaaagttgccagcatgaaccagaggcgcgtggatttctatctcgcatcaatcgaggatatgttagtcgctatcgggggaaggaacgagaatggcgccctttcctccgtcgaaacctacagcccgaagacggactcttggagctatgtggccggtttgcctcggttcacttacggccacgccggtaccatctacaaggacttcgtgtacatttccggaggccacgattatcaaataggcccgtataggaagaatttgctctgctatgatcatcggaccgatgtatgggaggagaggcggccaatgaccaccgcccgtggatggcattctatgtgttccctaggtgactctatctactctattggaggtagcgacgacaacattgagtccatggagaggttcgatgtattgggcgtagaggcttacagtccgcaatgcaaccagtggacaagagtcgccccccttctgcatgccaactctgaatctggagtggccgtgtgggaggggcggatctatatcttgggaggctactcatgggagaacacggcttttagcaagacagtccaggtgtacgacagggaggccgacaaatggtctcgtggggtggacctgcccaaagcgatcgccggtgggagcgcctgcgtctgcgccctcgagcctcggccagaggacaagaaaaaaaaaggtaagggaaaaagacaccaggaccggggtcagtag

SEQ ID NO: 48284 - DNA, 1746 bp, Artificial Sequence
  Description of Artificial Sequence: Synthetic coding sequence
atggacgaggagagcctggacggcctgctgttcaaggaccacgacttcagcagtgacctgctgagacagctcaactcactgcgccagtcaagaattctcactgacgtgtcaatctgtgccggcgcacgggagataccatgccaccgaaacgtgctggccagcagtagtccttactttagggccatgttctgtagctctttccgggaaaaaagcgaggcaaaggtccaactgaaaggcatcgaccctcccactctcgatcagattgttagctacgtatacactggggaggcccatattgccactgataacgtcctcccagttatggaagcagctagtatgctgcagttcccaaaattgtttgaggcatgctcttcatacctccagagtcagctggcacccagtaattgcctcggcatgatccggttaagtgagattctgtcatgcgagacactaaagaagaaagccagggaagtcgctctgaccagctttcccgaagtggcggcttctgccgacctaaaagagctgtgcgcgctagagttaagagattacctgggggacgacgggttgtgtggggaagaggagaaggtattcgaggctctgatggtttggatcaagcacgacctccaagcgcgaaagcgctacatgcaggaactcttcaaacaggtgaggctgcaatatatccaccccgcctttttccaccattttatagccaacgacgctctcctccagagctctccagcctgtcagatcatcttagagacagctaagcgccagatgttctccttatgtggaaccactgttcccgactgcaagctactacttcacgtgccgcccagaaactcttaccaggacttcctgattctcttggggggtcggaaggattctcaacaaacaacgagggacgtgttgctatattccaagcagacaggccagtggcagtccttggcaaaattacccacaagactctacaaggcatcagctatcactttacataggagcatatacgtcttggggggaatggcagtctcctcggggcgctcacttgtctctcacaatgtttatattttctctcttaaactgaatcaatggcgcctgggagagcctatgctcgttgcacgctattcccatcggtcgaccgctcataaaaactttattttctctattggaggcatcggggaaggccaggagttgatgggcagcatggaaaggtatgattccatctgcaatgtctgggagtctatggccagcatgcccgtaggtgtcctacatccagctgtggcggtaaaagaccagcgcctgtatctattcggcggagaggacatcatgcagaatcctgtcaggctgattcaggtatatcacatcagccggaattcctggttcaagatggaaaccaggatgatcaagaacgtgtgtgctcctgcagtcgtacttggggaacggattgtaattgttggaggctacaccagaaggattctggcctacgaccctcagtcaaataaattcgtgaaatgcgcagatatgaaggatagaagaatgcaccacggagctaccgtcatgggtaataaactgtacgtgacaggagggcgacgacttactaccgattgtaacattgaggactccgcctcttttgattgttacgatccggaaacggatacttggacctcacagggacagctgccacacaaactgtttgaccatgcgtgtctaacactgcagtgtatcccccgaactagtggactcccttag

SEQ ID NO: 48285 - DNA, 1854 bp, Artificial Sequence
  Description of Artificial Sequence: Synthetic coding sequence
atgaaggtgagcctgggcaacggcgagatgggcgtgagcgcccacctacagccttgcaaagctgggaccacaaggtttttcacttccaatacacactcatccgtggtactccagggatttgaccagttgcgaattgagggattgttgtgtgacgtgaccctagtgcctggggatggtgatgagatcttccccgtacacagggcaatgatggcttcagcctctgattacttcaaagccatgtttaccggaggcatgaaagagcaggacctgatgtgtattaaactccacggcgtgaataaagttgggttgaagaagataatcgattttatctacacagctaaacttagtctgaatatggataatttgcaggacaccttggaagccgcgagtttcctgcagattctccctgtgctggatttttgcaaggttttcttgatctctggggtctctctcgataattgcgttgaagttggtcgaatagccaacacctataacttgatcgaagtggacaagtatgtgaacaatttcatactgaaaaacttcccagccctcttgtcaaccggcgaattcttaaagcttccattcgaacgcctggcattcgtgctcagttctaatagcttaaaacactgtactgaactggagctgtttaaggctgcttgccgatggttgcgcctggaagatccccgtatggactatgccgcaaaactgatgaagaacattaggtttcctctgatgaccccccaggacctgatcaattacgttcagacagtcgacttcatgagaaccgacaacacctgcgtcaatcttttgcttgaagcttcgaactatcagatgatgccatacatgcagccagttatgcagtccgatagaaccgctatcaggtcggattccactcacctggtgactctggggggagtgctacgccagcaactggtcgtttccaaggagctgcgcatgtacgatgaaagggcccaggaatggagaagtctggctccaatggacgcacctaggtaccagcacggcatcgcagtaatcggcaactttctttacgtggtgggcgggcagagtaactacgataccaaaggcaagaccgctgtagacaccgttttccgattcgatccgcgttataacaagtggatgcaggtggcctctttaaatgagaagagaactttcttccacctgtcagccctgaaggggcacctgtacgcggtggggggaaggtcagccgctggagaattggctactgttgagtgttataaccctagaatgaacgagtggtcatacgtggcaaaaatgtcagaacctcactatgggcatgccgggacagtctacgggggtctgatgtatatcagtggcgggattacacacgatacatttcagaacgaactgatgtgcttcgaccccgacacagataaatggatgcagaaggcgccaatgacaacggtaagaggactgcactgtatgtgcacagttggtgacaaactgtacgtgatcggaggcaaccactttagaggtacatctgattacgatgacgtcctcagctgcgagtactactccccaacactggatcagtggacacctattgctgccatgcttcggggccaaagcgacgtcggcgtggctgtgtttgagaataaaatttacgttgtcggcggatattcttggaataatagatgtatggttgaaattgttcagaaatacgacccggagaaagacgaatggcataaagtgtttgatctccccgagtcactgggcggaattcgcgcctgtaccctcactgtattccctccagaggaaaaccctgggagccctagtcgcgagagccctctcagtgccccatcggaccattcttag

SEQ ID NO: 48286 - DNA, 1650 bp, Artificial Sequence
  Description of Artificial Sequence: Synthetic coding sequence
atgatggccagcgccagcgactacttcaaggccatgttcaccggcggcatgaaagagcaagacctcatgtgcataaagcttcacggggttaacaaagttgggctcaagaaaattattgactttatttacaccgcaaagttaagcctcaacatggacaaccttcaggacactctcgaagccgcaagcttcctgcaaatactgcctgtcctggacttttgcaaggtgttcctgatttcgggagtgtctttggataactgtgtggaagtgggccggatcgccaatacatacaatctaatcgaggtcgacaaatatgtcaacaattttatactgaagaacttcccggcactcttgagcactggcgaattcctgaagctcccctttgagcgcctggcattcgtgttgtccagcaatagccttaaacactgcaccgaactcgagctctttaaagccgcctgtcggtggctgcgcttagaggacccaagaatggactacgccgcaaaacttatgaaaaatatacggtttcccctgatgacgccacaagatttaatcaactatgtgcagactgtggactttatgaggacggacaatacctgcgtgaacctcctactcgaagcatccaactaccagatgatgccgtacatgcagccagtaatgcaaagcgacaggacagctatcaggtccgactcaacccatctcgtgacactgggcggtgtattgcggcagcagcttgtggtctctaaggagctgcggatgtacgacgaaagggctcaggaatggcggtcattggcccccatggatgcgcccagatatcagcacggaattgccgtgatcggaaattttctgtacgtcgtcggtgggcaaagcaattatgacaccaaaggtaagaccgccgtggatactgtgttcaggtttgatccaaggtacaacaagtggatgcaggtagctagtctgaatgaaaaaaggaccttctttcacctcagcgccctgaaaggacacttgtacgcggtgggcggacggagtgcagcaggcgaattagccaccgtggagtgctataatcctagaatgaacgagtggtcgtatgttgccaagatgtccgagccccactacggacacgccgggactgtctacggcggcctgatgtacatttcagggggtataactcacgacacgtttcagaatgagctgatgtgctttgaccctgacacagataaatggatgcagaaggctcccatgaccaccgtgaggggtcttcactgcatgtgcactgtcggggataaactgtacgtgatcgggggcaatcattttagaggcacctccgattacgacgacgtgttgtcatgtgaatattacagccctaccctggaccagtggacccccatcgctgccatgttacgcggccaaagcgatgttggggttgcggtgttcgaaaataagatttatgtcgtgggaggctacagctggaataaccggtgcatggtggagattgtgcaaaagtacgatcccgagaaggatgagtggcataaagttttcgacctccctgagagcctggggggaatcagggcctgtaccctgaccgtgttccctccagaggagaaccccgggagcccaagccgagaaagcccattaagcgctccctccgaccattcgtag

SEQ ID NO: 48287 - DNA, 534 bp, Artificial Sequence
  Description of Artificial Sequence: Synthetic coding sequence
atgaccaccagcatccggcagttcaccagcagcagcagcatcaagggcagctccgggctcggcggggggtcctcacgcacgagctgccagctttccggaggactgggggcagggagctgtcggcccgggtctgctggaggcttgggatcagccttaggaggcagcagctattcatcttgctacagctttgggagcggcggagggtatggatcttcttcattcgagggagttgatggcctactcgtgggcggtgaaaaggccaccatgcagaatctgaacgataggctcgcctcctacctcgacaaagtacgagcgctggaggaagccgatacagaattggaagtcaaaatccgagattggtaccagaggcaggcccctggccctgcgagagattactctcaatattatcggatcatagaagagctgcagaacaaaccaccatggacaatgccaacgagctgttacatattaaccatgcctatctggctattgttaaccagcgctccaaagtcgtggcaaaacgagggccgatag

SEQ ID NO: 48288 - DNA, 1326 bp, Artificial Sequence
  Description of Artificial Sequence: Synthetic coding sequence
atgaccaccagcatccggcagttcaccagcagcagcagcatcaagggatcttctggactgggcggtggaagcagtcgaacgtcctgccagttatccggcggactgggtgcaggtagttgtcggcccggcagcgctggaggtcttggatccgcgctaggcggttcttcctacagttcctgttatagtttcggctcgggaggcgggtatggctcatcttctttcgaaggcgtggatggactgctcgtcggtggtgagaaggctactatgcagaatctgaacgaccgcctcgccagttaccttgacaaagtgcgagcgttggaagaagccgatacggaactggaggtgaaaatcagggactggtatcagcggcaggcgccaggacccgcaagggattatagtcagtattataggatcatcgaggaactccagaataagatccttacagctacagtggacaacgccaacattctgctgcatatagacaacgcgcacctggccgctgcagatttccggacaaagtttgagacagagcaggcactttgcctttcagtggaagccgacattaatggcccttgtcgtgtactggatgagctgactctagcccgggccgacctggagatgcatatcgagaacctgaaggaggagctagcctacctaaaaaagaatcatgaagagatgaatgcccctcgggggcaggtcggcggggagatcaacgtcgagatgggcgctgctccgggagtggacctaagcaggattctgaacgaaatgcgggaacaatacgagaagatggccgaaaagaacagaaaggacgccgaagattggttcttcagcaaaactgaggagttgaatcgcgaagtggccacaaactcggagctggtacagtcaggcaaatccgagatttcggaattgcggtgcactatgcaggcattagagattgagctgcaatcccagctctcaatgaaagcatccctggagggaaatttggcagaaacagagaaccgctactgcatgcagcttagccagatccaggggttaatcggatccgtagaggagcgattggcccagttgctgtgtgagatggaacaacagaatcaagaatacaagattctactggatatgaagatgaggcttgagctcgaaattacaacctatcatcggttgctggaaggagaagacgcccacgagggtctattggccccgactcacttcaaattaccggcatctccagccgccgtgactacatgccaggtgcccacgattgttgaggaggtgcaggacggtaaggtgatttcttcaagggaacaagtgagacaaacaacccgttag

SEQ ID NO: 48289 - DNA, 366 bp, Artificial Sequence
  Description of Artificial Sequence: Synthetic coding sequence
atggccagctgcagcaccagcggcacctgcggcagcagctgctgccaaccctcctgttgtgagacctcatgttgccagcccagttgctgccagacctccagctgtggaactggttgcggtatcggaggaggaattggctatggacaggaagggtccggggggagtgtcagtacccggatcagatggtgccatccagactgtcacgtggaaggaacctgtttgcctccatgctatctcgtgtcgtgcacccctccgagctgttgtcagctgcaccatgcagaagccagctgttgtaggcccagctactgtgggcagtcatgttgcagaccagcctgctgttgccattgctgtgagcctacctgttag

SEQ ID NO: 48290 - DNA, 372 bp, Artificial Sequence
  Description of Artificial Sequence: Synthetic coding sequence
atgaccggcagctgctgcggcagcaccttcagcagcctgagctacgggggggggtgctgccaaccctgctgctgtagggacccctgctgctgtaggcccgtgacgtgccagaccactgtgtgcagaccagtaacgtgtgtccctaggtgcacccgaccaatttgcgagccttgtagaagaccagtgtgctgtgatccctgcagccttcaggagggctgctgcaggccaatcacatgctgcccctccagctgcacagctgttgtctgtcgaccttgttgctgggcaacgacatgttgccagccagtgtccgtccagagcccttgcgggcagcctacaccttgttccacaacctgccggacttcaagctgctag

SEQ ID NO: 48291 - DNA, 390 bp, Artificial Sequence
  Description of Artificial Sequence: Synthetic coding sequence
atgaccggcagctgctgcggcagcaccttcagcagcctgagctacggcggcggctgctgccagccttgttgttgccgcgatccgtgctgctgtaggcccgtcacctgtcagaccaccgtgtgccggccagttacctgtgtgcctcgctgcacccggcccatctgtgaaccgtgtcggcggcccgtttgctgcgacccttgcagcttgcaagaagggtgttgccgacccatcacgtgctgtccttctagctgtactgctgtcgtgtgtcgcccttgctgttgggcaactacctgctgtcaaccagtcagcgtccagagcccttgtggacagccaagcccctgcggacagcccaccccttgcagcaccacttgtcgaacatccagctgctag

SEQ ID NO: 48292 - DNA, 468 bp, Artificial Sequence
  Description of Artificial Sequence: Synthetic coding sequence
atggtgagcagctgctgcggcagcgtgtgcagcgaccagggctgctcacaggatttgtgccaagaaacttgctgccggccttcttgctgccaaactacatgctgcaggacaacctgctacagaccaagttgctgtgtctccagctgttgcaggccacagtgttgccagtctgtgtgttgccagcctacttgttgcagacctacttgctgcgaaactacttgttgccaccctcgctgttgcatctctagttgttgtcgtccctcctgttgcatgtcctcctgttgtaagccacagtgctgtcaatccgtgtgttgccagcctacctgttgtcggcctagctgttgcaggccatgctgctgtctgcggcctgtgtgcggtagagtctcctgccataccacctgctaccggcctacatgtgtaatcagcacatgccctcgtcccctctgctgcgccagttcctgctgttag

SEQ ID NO: 48293 - DNA, 660 bp, Artificial Sequence
  Description of Artificial Sequence: Synthetic coding sequence
atgggctgctgcggctgcagcggcggctgcggcagcggctgcggcgggtgtggctccggttgtggcgggtgcgggtctggttgcggtggttgtggctccgggtgtggcgggtgtggctctggatgtggcggatgcggctcaagttgttgtgtgccgatctgctgctgtaagccagtgtgctgttgcgttcctgcgtgcagctgctcttcgtgtggcagctgtggcggaagtaaaggaggatacgggagctgtgggggatcaaagggcggctgtgtttcatgcggggggtccaaggggggctgtggcagttgcgggggatctaaggggggctgtggctcgtgcggtggttctaaaggcggctgcgggtcttgtggcggaagtaagggcggttgtggaagctgcggctgtagccagtgtagctgttgcaagccttgttgtttctcttcaggttgcggtagctcctgctgtcaatcctcatgttgtaaaccttcatgttgtcagtcatcttgttgcaagccttattgttgtcagtccagttgctgtaagccttgctgttcctcaagcgggtgcgggtcttcttgctgccagtcatcatgctgcaacccttgttgctctcagtcaagctgctgcgtgccagtctgctgccagtgtaaaatttag

SEQ ID NO: 48294 - DNA, 687 bp, Artificial Sequence
  Description of Artificial Sequence: Synthetic coding sequence
atgggctgctgcggctgcagcggcggctgcggcagcggctgcggcggctgcgggagcggatgtggaggctgcggtagcggatgtggggggtgtgggtccggatgtggcgggtgcggcagcgggtgcggcggatgtggaagttcctgctgcgtgcctatctgctgctgtaaacctgtctgttgctgtgtcccagcgtgtagctgtagctcctgtggatcttgcggtgggtcgaagggtggatatggcagctgcggcgggagtaagggcgggtgtgtctcttgtgggggttctaagggtgggtgtggttcttgtggggggtccaaggggggatgcggcagttgcggaggatcaaagggcggctgtggttcatgcggcggctccaaaggaggatgcggctcctgtggatgttcacagtgctcctgttgtaagccatgctgtttttcctctgggtgcgggtccagttgttgtcagtcaagttgctgcaaaccatgctgctcatcatctggatgtgggagttcctgttgtcagtctagttgctgcaagccttactgttgccagtcatcatgctgtaaaccctgttgttccagcagtggatgcggaagctcatgctgccagtcatcctgctgtaatccttgctgtagccaaagtagctgctgcgtcccggtgtgctgtcaatgtaaaatttag

SEQ ID NO: 48295 - DNA, 351 bp, Artificial Sequence
  Description of Artificial Sequence: Synthetic coding sequence
tgctgccaccccacctgctgccagaacacctgctgccggaccacctgctgccagcccacctgtgtggcttcatgctgtcagccgagctgctgtagcactccttgctgtcagcccacctgttgtggttccagctgttgtggcacaacatgttgccagcctacatgctgccagcctacctgttgccgcaatacctcctgccagcctacatgttgtggctcaagttgttgccagccaccctgttgtcgcccaacctgctgccaaactacctgttatcgaacgacttgttgcagaccatcctgttgctgctccccctgttgtgtgtcttcctgctgccagccatcttgttgttag

SEQ ID NO: 48296 - DNA, 306 bp, Artificial Sequence
  Description of Artificial Sequence: Synthetic coding sequence
cggcccttctgctgccacaccccctgctgccagcccagctgctgcgtcccatcctgctgtcaaccctgctgccacccaacctgctgtcagaatacctgttgtagaacaacctgctgtcagcccacctgcgtggcatcgtgctgtcaaccatcctgctgctctactccctgttgccagcccacatgctgcgggcaaacctgtaatgagagctcttattgccttccttgttgccggcctacctgctgccagaccacttgctataggaccacctgctgtaggccatcttgctgctgttctccttgctag

SEQ ID NO: 48297 - DNA, 753 bp, Artificial Sequence
  Description of Artificial Sequence: Synthetic coding sequence
atgacccactgctgcagcccctgctgccagcccacctgctgccggacaacctgttgtagaactacctgctggaagcccacgactgtcactacctgctcttctaccccctgctgtcaaccttcgtgctgcgtgcccagttgttgccagccttgctgccatcctacctgctgccagaacacatgctgtcgaactacttgctgtcagcccacatgcgtggcctcttgctgtcagccttcttgctgtagtactccgtgctgccagcccacctgttgcgggtcaagctgttgcgggcaaacatcctgcggttctagttgttgtcagcctatttgcgggtcctcttgctgccaaccgtgctgtcaccccacatgctaccaaacaatctgttttcgcaccacttgttgtcagcccacatgctgccagcccacatgttgtagaaatacctcttgccagcctacatgttgcgggtcctcatgctgtcagccttgctgtcacccaacctgttgtcagaccatctgtaggtccacatgttgtcagccaagttgtgtcacaaggtgctgcagcactccctgttgccagcccacatgcggtgggtcgagctgctgcagccagacctgcaacgagagttcttattgcctaccctgttgtagaccaacctgctgccagaccacctgttaccgaaccacttgttgtcggccctcatgctgttgctctccatgctgcgttagctcatgctgtcagccgtcctgctgctag

SEQ ID NO: 48298 - DNA, 483 bp, Artificial Sequence
  Description of Artificial Sequence: Synthetic coding sequence
atgacccactgctgcagccccggctgccagcccacctgctgccggaccacctgctgtcgaacaacttgttggcagcccacaatagtgacaacatgttccagcaccccttgctgccagcccagctgctgcgtgtctagctgttgtcagccttactgccatccgacttgttgtcaaaatacctgttgccgaactacctgctgccagcctacctgcgtaactagctgctgtcaacccagctgctgctccacaccttgttatcagccgatctgctgtgggagctcttgttgtggacagacctcatgtggatctagttgcggacagagtagttcttgtgcaccggtgtattgcagaagaacttgttatcaccctactaccgtgtgcttgcccgggtgcctaaatcagtcctgtgggagctcctgttgccagccttgctactgtcctgcctgctgtgtctctagctgctgccagcacagctgttgctag

SEQ ID NO: 48299 - DNA, 510 bp, Artificial Sequence
  Description of Artificial Sequence: Synthetic coding sequence
atgacccactgctgcagcccctgctgccagcccacctgctgccggacaacctgttggaaaccaacaacagttactacatgctccagcacgccttgctgtcagccctcctgttgtgtgtctagctgctgtcagccctgttgtcatcctacatgctgtcagaacacctgctgtagaacaacctgctgtcaaccgacctgcgtgacctcttgttgccagccatcatgttgttcaaccccctgttgccagcctatttgttgtggatctagttgttgcggccagacctcgtgcggctcctcttgctgtcagccgtcgtcttgcgcaccaatctactgtaggcggacatgctaccacccaacctctgtctatctgcccgggtgtctgaaccagtcctgtggtagttcttgttgtcagccctgctgccgcccagcctgttgcgagaccacctgctgtcggaccacatgtttccagccgacgtgtgtgacaagttgttgccagcctgcctgctgctag

SEQ ID NO: 48300 - DNA, 510 bp, Artificial Sequence
  Description of Artificial Sequence: Synthetic coding sequence
atgacccactgctgcagcccctgctgccagcccacctgctgccggactacttgctggaagccaacgacagtgacgacgtgtagctccaccccatgctgtcagcctagctgttgtgtctcttcgtgctgccagccttgctgtcgccctgcatgctgccagaacacatgttgtaggacaacctgctgccagcctacttgcctgacctcttgttgtcagccctcgtgttgttctacaacatgctgccaacccatatgttgtggctcaagttgttgcggacagacctcttgcggctcatcttgcggtcagagctccagctgtgcacccgtctattgcagacgaacttgttactaccccacaacagtctgtctgcctggctgcctcaatcagtcttgcggtagcagttgttgtcagccatgttgtaggcccgcctgttgcgagacaacatgttgccgcaccacttgttttcagcccacttgcgtcagctcatgctgccagccctcatgctgctag

SEQ ID NO: 48301 - DNA, 528 bp, Artificial Sequence
  Description of Artificial Sequence: Synthetic coding sequence
atgacccactgctgcagcccctgctgccagcccacctgctgccggacaacctgttgccggacaacctgctggaaaccgacaacagtcacaacgtgttccagcacaccgtgctgtcagcccagttgttgcgtgtctagctgttgtcagcccccttgttgtaggccggcttgctgccagaatacgtgctgtcgcaccacctgctgccagccaacctgcctgacctcatgctgtcagcctagttgttgttcaaccacatgctgccagcccatctgttgtggcagctcttgttgcggacagacctcttgcggctccagctgcggccagtcctcctcctgcgcccctgtatattgtcggcgcacatgctattacccaaccaccgtttgcctcccaggctgcctgaaccagtcatgcggcagctcttgctgtcagccttgttgtcggccagcctgctgcgagacaacatgttgtaggacaacatgttttcagcccacttgtgtgtcatcgtgttgtcagccttcatgttgctag

SEQ ID NO: 48302 - DNA, 2037 bp, Artificial Sequence
  Description of Artificial Sequence: Synthetic coding sequence
atgcccacctggggcgcccggcccgccagccccgaccggttcgccgtctcagctgaggcagaaaataaggtccgcgaacagcagcctcacgtcgagcgcatcttttctgtgggcgtctccgttttacctaaggattgtccagacaatccccacatctggttgcaactcgaggggccaaaagaaaatgcgtccagggccaaggaatacttaaagggactttgtagccctgagctgcaggacgaaattcactacccacccaaactgcattgcatcttcttgggtgcccagggatttttcttagattgtctggcctggagcacgagcgctcacctagttcctagagctcctggtagcctcatgatctccggtctcactgaggctttcgtaatggcacagtccagagttgaagagctggctgagcggctctcctgggacttcacccccggaccctcatcaggcgcatcccagtgtaccggagttctgcgtgatttcagcgccctgttgcagagccccggagatgcccaccgcgaggcactcctgcagcttccccttgctgtccaagaagagctgctgagcttggtccaagaagcatcgtcaggtcaaggtcctggagcgctggcctcctgggaaggccggagttctgccctgctcggagcgcaatgccagggagtgagggcacctccctccgacggacgagagtctttggatacgggatcaatgggcccaggcgactgcaggggcgctagaggcgatacatacgcagtagagaaagaggggggaaaacagggaggccctcgcgagatggattggggatggaaggagctgccaggagaggaggcttgggaaagggaagttgccttacgcccacaaagcgtcgggggcggagctagggaatcagcaccgttgaagggaaaagcactgggcaaggaggagatcgcactcggcggaggaggcttctgcgttcatcgggaaccccccggagctcacggttcatgccacagggccgcacaaagcaggggagcatctttgttgcaacgcttgcacaacggaaacgcctcccccccccgagttcccagcccacctcccgctcctgagcctccctggcactgcggggatcgaggagattgcggtgaccgtggggatgtgggcgatcgaggtgacaagcaacagggtatggccaggggtagaggaccccagtggaaacgcggggcccgcggggggaatctcgtgactggaacacagagatttaaggaggctctacaagatccctttaccctctgtttggcaaatgtgcctgggcaacccgacctccgacacatagtgattgatggcagcaacgtggcaatggttcacggtctccagcactatttttctagccggggaatcgccattgccgttcagtacttttgggacaggggtcaccgagatattaccgtgttcgtgcctcaatggcggttctcaaaagacgctaaggtgagggagtcacacttcctgcagaaactgtactcgctcagtctgttgtcgctgaccccaagtcgggtgatggatggcaaacggatctccagctatgacgaccgctttatggtgaaacttgccgaggaaactgacgggataattgtctccaatgatcagttccgcgacctggccgaagagtcagagaagtggatggcaattattcgcgagaggttattgccatttacatttgtcgggaacctgtttatggtgccagatgaccctctgggacggaacggccccaccttggatgagttcctaaagaaacctgccagaacccagggctcctccaaggcccagcacccctcacggggctttgcagagcacggaaagcagcagcaagggcgggaggaagaaaagggtagcggcggcatcagaaaaacccgggagaccgaaagactccgtcgccagctcctggaggttttttgggggcaggatcacaaagtcgacttcattctgcagcgcgaaccctactgccgcgatataaaccagctgagcgaagcccttttgtcactgaacttctag

SEQ ID NO: 48303 - DNA, 2037 bp, Artificial Sequence
  Description of Artificial Sequence: Synthetic coding sequence
atgcccacctggggcgcccggcccgccagccccgaccggttcgccgtgtctgccgaggccgagaacaaggtgagagagcaacaacctcacgttgaacggattttcagcgtcggggtttcagtactccccaaggattgtcccgataatcctcacatttggttacagctcgaaggcccgaaggaaaatgcatcccgagcaaaagaataccttaaagggctgtgctcaccggaacttcaagatgagattcattacccaccaaagctgcactgcatttttcttggtgcccaggggttctttcttgactgtctcgcttggtccacctcagcccatctcgtaccgagagcccccgggagcctcatgatttcaggcttaactgaagcgttcgttatggcgcagtccagagtggaggagttggccgagagactgagttgggattttacaccagggccgtcatccggtgcttctcaatgtaccggtgtgctgagggatttctccgcgctgctgcagtccccaggggacgcccaccgagaggctctgctgcagctgccgctcgcagttcaagaggagctgctctcactggttcaggaagcatccagcggacagggacctggtgcactggctagctgggaggggcggtcatccgcgctgctgggggctcagtgccagggggttagggccccacctagcgatggaagggagagcctcgacaccgggtcaatggggcccggagactgcagaggggcaagaggggacacatacgcagtggagaaggaaggaggcaaacagggcggaccaagggagatggactggggctggaaagaattaccaggggaagaggcatgggagcgggaagttgctctgcggcctcagagcgtcgggggtggcgcaagagagagcgccccactcaagggtaaggccctgggtaaggaggaaatcgctttgggcggagggggattttgcgttcacagggagccacccggcgctcacggcagctgccaccgcgccgcacaaagccggggggcctcccttctgcagcgtctccacaatgggaatgcatcgccaccgcgcgttccaagcccgccgcctgcccccgagcctccgtggcactgtggcgacaggggggattgtggagaccgaggcgatgtcggtgatagaggcgataagcaacagggcatggctagagggagaggcccccagtggaagcgcggagcgagaggggggaatctggtgacgggaacacagagattcaaggaggcgcttcaggatccgtttacgctctgtctggctaatgttcccggtcaacccgacctgcgtcacatcgttatagatggctccaacgtagctatggtgcatgggttgcagcactacttcagctcaagagggatcgccattgcggtgcagtacttctgggatcgcggccacagagacatcactgtgtttgttccccagtggcgtttctctaaagacgcaaaggtgcgtgaatcccatttcctgcaaaaactttacagccttagtctgcttagtctcacaccctcacgcgtaatggatggaaagagaatttccagctatgatgataggtttatggtgaagctagctgaggagaccgacggaatcatagtgagtaacgaccagtttagagatttggctgaagagagcgagaaatggatggcaatcatccgtgagcggttgttgccattcacttttgtagggaacctcttcatggttcccgacgacccactgggcaggaacggccccactttggacgagtttttaaagaagccagctcgcacccagggatccagcaaagcgcagcacccatcaaggggttttgccgaacacggcaaacagcaacaggggagggaagaggagaagggtagcgggggcattagaaagaccagagagacggagaggctgcgtaggcaactgctagaagtattctggggtcaggaccacaaagtcgacttcatcctccagagggagccttattgccgagatatcaaccagctttctgaggcactcctaagtctcaatttctag

SEQ ID NO: 48304 - DNA, 408 bp, Artificial Sequence
  Description of Artificial Sequence: Synthetic coding sequence
atgcccacctggggcgcccggcccgccagccccgaccggttcgccgtgtcggccgaggccgaaaataaagtgagagaacagcagccgcatgtagaaagaattttcagtgtgggtgtgtcagttctcccaaaggactgcccagataatcctcacatttggctgcagcttgagggccccaaggaaaacgcaagccgggccaaagaatatttaaaaggcttgtgttcacctgagctgcaggatgagattcactaccctcccaagctgcactgcatattcctgggcgcacaaggattcttcctagattgcttggcctggtctacatccgcacacctggtgcccagggcacctggctcactcatgatatcaggccttactgaggcattcgtgatggcacaatcccgggtttag

SEQ ID NO: 48305 - DNA, 2037 bp, Artificial Sequence
  Description of Artificial Sequence: Synthetic coding sequence
atgcccacctggggcgcccggcccgccagccccgaccggttcgccgtcagtgcggaggcggaaaacaaagtgagagagcaacagccccatgtcgagaggatcttctcagttggggtctcggtcctgccaaaagattgtcctgataatccccatatctggctgcagctggaaggccctaaggagaacgcttctcgcgccaaggagtacttgaagggactgtgtagcccagagctgcaagatgagatccattacccacctaaactgcactgtattttcctcggagcccaagggttcttcttagattgcttggcatggagcacgtcggctcatctagtgccaagggctcctggaagcctgatgatatctggtcttaccgaagccttcgtcatggctcagagcagggttgaagaactcgcggaacgcctttcatgggactttacccctggccccagttccggcgcatcacaatgcaccggggttctgcgcgacttcagtgctttgctacagtcgcctggagacgcgcatagggaagcattgttacagttgcctctcgctgtgcaggaagaactcttatcgctcgtgcaggaggcctcttctggccaggggccaggcgccctcgcctcttgggaggggagatcatctgccctccttggtgcacagtgccaaggggtaagggccccaccatctgatggaagagagtccctggatacggggagcatgggaccgggcgactgtcggggcgctcgtggggacacttacgctgttgaaaaagaaggtggtaagcagggtggcccacgtgagatggattggggctggaaagagctaccgggtgaagaggcttgggaacgagaagtggccctaagacctcagagcgtcggtggtggtgcacgtgagtcggctcccctgaaggggaaggctctaggaaaggaggagattgccctcggcggcgggggattttgtgtgcaccgcgaacccccaggtgcacacggcagttgccatcgcgctgcacagtcacgtggcgccagtctgctccaaaggctgcacaacggcaatgccagtcccccaagggtgcctagccctcctcccgccccggagcccccctggcattgtggcgatcggggagactgcggggaccggggggacgtgggagatagaggtgataagcagcaggggatggcccgggggcggggtccacaatggaaaagaggggcccgaggcggcaatttggtgacggggacacagagattcaaagaggcccttcaagaccctttcaccctctgtctcgccaatgttccaggacagcccgatctgaggcacatcgtcattgacggctccaatgtggctatggtgcatggtctgcagcactatttcagcagtagaggcattgctatagctgtgcagtacttttgggaccggggtcaccgtgacatcacagttttcgttcctcagtggcggttcagtaaagacgccaaggttcgagagagccacttcctgcagaaactatacagcctatcgttgctttctctaaccccatcccgcgtcatggacggaaagaggatttcaagctatgacgatagatttatggtgaaactagcagaggaaacggatggtatcatcgtgagtaacgatcagttccgggatctggccgaggaaagcgagaagtggatggccatcatacgggaacgactgttaccctttacttttgttggcaatctctttatggtgcctgatgacccgctcggccgcaatggacccaccctcgacgaattcctgaagaagcctgctcgcacgcagggaagttctaaagcgcagcacccttcccgagggttcgccgagcatggtaagcaacagcagggccgcgaagaggagaaaggcagcggaggcattcggaagacccgtgaaacagaacggctgaggcgccagctgctcgaggtattctggggtcaggatcataaggtcgacttcatccttcagagagaaccctactgcagggatatcaatcaactgtccgaggctctgctgagtctaaacttttag

SEQ ID NO: 48306 - DNA, 387 bp, Artificial Sequence
  Description of Artificial Sequence: Synthetic coding sequence
atggccgtgggcaccagcgccctgagcaaggagccctggtggaccctgccagagaatttccatagccctatggtcttccacatggaagaagaccaggaggagcttatcttcgggttagatgacacttatctcaggtgcatcgagcttcattctcataccctgatccaattagagagatgcttcaccgctactggtcaaactcgcgtgacagtggtcgggcccccaatggccaaacagtggctgttactcatgtttcattgtgttggctcccaagactcaaaatgtcacgctagagggttgaagatgcttgaaagagttcgtagtcagcccctcacaaacgacgatcttgtcacctctgtttccctgcctccatacactggcgattag

SEQ ID NO: 48307 - DNA, 1251 bp, Artificial Sequence
  Description of Artificial Sequence: Synthetic coding sequence
atgagccccagccacgtggtggtgaacgtgagcaccgcccggagcgggcccctaaccacctcctcagccccggtctcacgcgccgagtcgctgcgcccaggatctagatcatgtaccatgtcaatgtctcccaccgtgattattctggcgtgcttgggcttcttcctcgaccagtctgtgtgggcccatgtgggaggacaagataaacctttctgctccgcgtggcctagcgctgtagttccccagggcgggcacgtgacattgaggtgccattgccgcagaggctttaatatttttacactgtacaaaaaagacggcgtacctgtgcccgagctctataatcgaatcttctggaattcattcctgatttcccccgtaacacccgcgcacgccggcacctaccggtgcagaggctttcatcctcactctcccacagagtggtcagcaccctcaaatccgctggtcattatggtgaccggactatacgaaaagccatcattaaccgcccgtccaggcccgaccgtgagagcgggtgagaacgtgaccctgagctgtagttcccaatctagctttgatatttaccatcttagtcgagagggtgaggcccatgagctgaggttacccgccgttccgtcaataaatgggacctttcaggctgatttccctctaggaccagccacacacggcgagacctataggtgtttcggtagctttcatggttccccctacgaatggtcagacccctccgacccacttcctgtgtccgtgacaggcaacccgagcagcagttggccatcccctacagagccatccttcaagaccggcattgccagacatcttcatgcagtgataagatattcagtcgcaataattctcttcacaattctgccattttttctgctgcaccggtggtgttccaaaaagaagaacgctgcagtgatgaatcaggaacctgccgggcatagaaccgtgaacagggaggactccgatgaacaggacccccaagaagtgacctatgctcagctggaccattgcatcttcacccagcgcaaaatcacgggcccgtcccaacggagcaagagacccagcacagataccagcgtctgcatcgagttacccaatgcagaaccacgggcgttaagtcctgcgcacgagcaccacagtcaagcactgatggggagttccagggagaccacagcactgtcacagacccagttggccagcagtaacgtccctgccgcgggcatttag

SEQ ID NO: 48308 - DNA, 915 bp, Artificial Sequence
  Description of Artificial Sequence: Synthetic coding sequence
atgagcctgatggtggtgagcatggcctgcgtgggcttcttcctgctgcagggcgcgtggccccacgagggcgtacatcggaagccaagcttactggcccatcccgggcccctggtgaagtccgaggaaaccgttattctccagtgctggtctgacgttagatttgaacattttctgttgcaccgagagggaaagtataaagacacgcttcacctaataggagagcaccatgatggcgtgtccaaggctaactttagtatcggaccgatgatgcaggatcttgccgggacataccgttgttacggtagtgttacccatagtccctatcaattatcagcccccagtgaccccctagacatcgtgatcaccgggctgtacgaaaagccatctctgtctgctcagcccggccctaccgtgttagcgggcgagtcagtcacacttagctgctctagcaggtccagttatgacatgtatcacttatcaagagaaggagaggcccacgagcggcgtttcagcgcagggccaaaggtgaatggtactttccaggcagattttcccctgggcccagcgactcatggtggaacatataggtgttttgggtcgttccgggactctccgtatgaatggagcaactcatccgaccccttactcgtttccgtcaccgggaatccttcaaattcctggccctctcccacggagccctcttctaagacaggaaatccccggcacttacatgttctcattggaacatcagtggtgaaaatccccttcactatcctgcttttctttctgctgcaccgctggtgctccaacaagaaaaacgctgcggtgatggaccaggagcctgcagggaatcgcacagtgaactcagaggatagtgatgagcaggatcaccaggaagtaagttatgcatag

SEQ ID NO: 48309 - DNA, 915 bp, Artificial Sequence
  Description of Artificial Sequence: Synthetic coding sequence
atgagcctgatggtggtgagcatggcctgcgtgggcttcttcctgctgcagggggcatggccccatgagggcgtgcatcgcaaaccttccctgttagcccacccgggaccgctcgtgaaaagcgaggagaccgttattctgcagtgctggagtgatgtccggttcgagcattttctcctgcatagggaagggaaatacaaggacaccctgcatctaatcggtgagcaccacgacggcgtaagtaaggccaacttttctatcggaccaatgatgcaggacctggcggggacatataggtgctacgggagcgtgactcattctccttatcagctgtccgccccttccgatcccctggatatcgtcatcacaggcctgtacgagaagccttctttatccgcccaacctgggcctacagtgctcgcaggagaatctgttaccctcagctgctctagtaggtctagttacgacatgtaccacctgagccgggaaggggaggctcatgagcgcagattcagcgctggacctaaggtcaatggcaccttccaggccgactttcccctgggaccagccacacatggggggacctaccgatgtttcgggtcattccgggattccccctacgagtggagtaattcaagcgatcctttgttagtgtccgtgaccggtaacccctctaattcctggccaagtccaacagagccatctagcaagactggaaacccccgccacctacacgttctaatcggaacaagtgtggttaagattccctttactatcctgctcttttttctgctccacagatggtgcagcaacaaaaaaaatgcagcagtcatggaccaagagcctgccggcaaccggacagtgaactcggaggactccgacgagcaggaccaccaagaggtgtcctacgcttag

SEQ ID NO: 48310 - DNA, 867 bp, Artificial Sequence
  Description of Artificial Sequence: Synthetic coding sequence
atggcctgcgtggccttcttcctgctgcagggcgcctggccccacgaagggtttaggaggaaaccttctttactcgcccaccctggcccattggtgaaaagtgaagagacagtgatcctgcagtgttggtccgatgtgatgttcgaacattttttgctgcacagagaaggaacgtttaatcacaccctgcgcctgatcggcgaacatattgatggtgtcagtaaggggaacttcagtattggccgaatgactcaggacctcgccgggacctaccggtgctatggatccgtgacccatagcccgtatcagttgagcgctccttcagatccgctagacatcgtaattacggggctgtacgaaaaacctagtctatcagcccagccaggtcccactgtgctagctggagagtccgtgacacttagctgctcatcacgctcttcctacgatatgtatcacttatctagagagggggaagcccacgagagaaggctgccagcaggtcccaaagtaaaccgtacattccaggcagacttcccactggatcccgcgacacacgggggcacctaccggtgcttcggcagcttcagggacagcccatacgagtggtctaagtcgagcgaccctttattggtgtctgtgaccggcaacagctctaatagctggccttctcccactgagcccagctcagagacggggaatccccgccacctccacgttctcattgggactagcgtcgtaaagctcccgtttacaatattacttttctttctgctgcatcgctggtgcagtaataagaagaatgcctcggtgatggaccagggcccagctggcaatcgcaccgttaacagggaagattcggacgagtag

SEQ ID NO: 48311 - DNA, 666 bp, Artificial Sequence
  Description of Artificial Sequence: Synthetic coding sequence
atgagcctgaccgtggtgagcatggcctgcgtgggcttcttcctgctgcaaggggcctggccattgatgggaaaccatcggaagccctctctcttggctcaccctggcccgcttctgaagagtggcgaaaccgtcatcctgcagtgctggtcagacgtgatgtttgaacatttcttcctccatagggaaggcatatccgaggacccatcgaggctggtgggtcagattcacgatggggtctctaaggccaatttcagcattggtccacttatgcctgtcctggccggtacctatcgctgctacggtagtgtgccgcactctccctaccagttgagtgctcccagcgatcccctggacatcgtcattaccggactgtatgaaaagccctccctgtctgcacagccagggccaaccgtacaggcaggggagaatgtcactctttcctgctctagctggtcttcatacgacatataccatttatccagagagggcgaggcacacgaacggcgtctgagggcggtacctaaggtgaatcgcaccttccaagctgattttccactaggacctgctacccacggcggaacctacaggtgtttcggttccttccgagcactcccttgtgtttggagtaatagctcagacccccttttagtctcagtcacatag

SEQ ID NO: 48312 - DNA, 1002 bp, Artificial Sequence
  Description of Artificial Sequence: Synthetic coding sequence
atgagcctgaccgtggtgagcatggcctgcgtgggcttcttcctgctccaaggagcatggccactaatgggaggacaggacaagccttttttatccgccagaccttccaccgttgttccacgcggaggacacgtggccctgcaatgccactaccgacgggggtttaacaattttatgttatacaaggaggatagatctcacgtgcccatcttccacggcaggattttccaggaaagctttatcatggggcccgtgactccggcccacgccgggacatatagatgccgggggagtagacctcattccctgacgggctggagcactccttcaaatcctctcgtgatcatggttacagggaatcaccgaaagcccagtctcttggctcacccgggccctctgctgaaatctggagagacagtgattctgcaatgctggtcagatgtgatgtttgaacatttctttttgcatagagagggcatctcggaggatccaagccgtctggtgggccaaatacacgatggtgtctctaaagctaattttagtatcggacctctgatgccagtactggcggggacatatagatgttatggatctgttcctcacagcccctaccagctgagtgctccctctgaccctctggacattgtgatcactggcctctatgaaaaaccaagtctgagcgctcaaccggggcccacagtgcaagcaggcgagaatgtcaccctgtcctgtagttcttggagttcttatgatatatatcacctgagccgtgagggagaagcgcacgaaaggaggttgcgagctgttccaaaagtcaatcgcacttttcaggcagactttccgttgggccccgccacccacggggggacttatcgctgtttcggcagttttcgggcgcttccttgtgtgtggtctaatagtagcgacccgctgctcgtgtctgtgacaggaaatcctagctcttcctggcccagccccacagaaccctcgtccaagtcatag

SEQ ID NO: 48313 - DNA, 5250 bp, Artificial Sequence
  Description of Artificial Sequence: Synthetic coding sequence
atgcaggccatggaccccgccgccgccgacctgtacgaggaggacggaaaagatctggacttctacgatttcgagccacttccgaccctgccggaagacgaggaaaacgtctccctggccgatatcctgagcctgcgtgatcgtgggctttcagaacaagaagcctgggctgtgtgtttagaatgctccctctcaatgagaagtgtggcacatgctgccatatttcaatcactttgcatcacccccgacacactcgccttcaacacaagtggtaatgtttgcttcatggagcagctgagcgacgatcctgaaggggcctttgtgccgcccgaattcgacgtgaccggcaacacttttgaggcacacatctattccttgggggctacgctcaaagcagcactagaatatgtagcagagcccacactagagccaagattaagtcaggacctggaggctctgttgtcaaggatgcaggccgaggatccgggtgacagacctgacctggaatctattatagccttgtgtgaggagaaactgcagctgacgtcttcttgtcgtgtctgtcgaagcctgtccgccgtcggccgcagggtgctttccattgagtccttcggcgcattacaggatgttagcgagtcatcctggcgggagcggcccgctcctggtaatgccgggcccagacggccacctggcgatccctccacagatcctgaggtcttgccaacgccagaaggtcctgagtccgagacctcccgagggccacgcgcaagccccacaaaggccctcctatcaacccctgttcgaaacggggagtcccactctagagagggcctggccgggctggttctcgacgccgagaggaccttgggcgagctggatagggatgccctgcggcggagcagattgaggaaagtccagacattcccacgtttgctgagtgacagtcctgaagcaaccctttgtctcccactgactcgggggaagtcacagctgcccatcagcgagttgttttctccagacccacggaaggcctttctagatcggaaaaacgggctgtcctcctttcaagcgcagcctaaatgtaggctttggcctgaacaggagcctgaacatcagcttggaagggtaccctgcgccggccgaagcacagacaggggtcccggtgtgcccggctcgcctggccagccagagacatcccacccttcccagggcccggccgaggcccccgcggacccccgtgatgcctccggcgaagctcagacacccagagacgacgaacgtattccagagggcgctaggcaactagagagcgccgcggctgaacagtgggtatcactccaggaccttttgagccagctcggcagaccctttcgggaatacgaactgtgggcactgtgtctggcctgcttaagggccctacagactagacctgagcatccagcctacctctgcttggattccgttctggtggctgaggacggcgccgtgcttttccaacctcctccggctaatggatcttatgattcgttctttctcgcacctgaacttgcagaggaaagattggtgactgaaaaggcgtcagtctattgtgtggccgcagtgctgtggacagctgcaaagttctctgtgccgagaaaccacaagctggccctgccacgcaggttgaaaaccctcctgctagacatggccagacgctccgctccggagcgtccttcagctgctgaagccattaaggtctgtggatcatatctgctccaacgtggcatggattccagaaagattctggctcaccttcgggcttctatttgtcaggtctatcaggaggaggagaccataagcctccagaatgctttctctgtggtggagctcaagccgtctgtggctccagcacccgagccctctcccggatttcttcccgtgaatagtgacactggcctggtggcagtcccaggacccgtccccggccagcatccgtgtggggaggaagcgacacaactgccagccgccttcacatccgaggctactcattttaagccaattgtactggctcagaatgcatcagtcgcacgtgatcaacctgctctcgctcaggaggagtcagaagagcgaggtggccagcgggaaggagaaggagaggagaagctgtcccttgaagcgcacgccggtagcccttctttgaaaactccagatggccctgtccccggacccgggcctcaaggtgctgcgcccgagccattgggcgcctccgtgcagcgggacagtgcccagggccggccctgccccccgccccaagccccagcaaatcagcctgagggggccagtagcgccgctcccgggtccccagtgccagccccgcctacaaaagcttcggccctccccgtagagcagggccctgcagaaccaatcccccctggggtcgcttcaggcggtctgcgcccggacgctctaggtcctacaaccgctcatcacggtccacgtcatcctcccaaaccccctcggagcaaggccaccgagcgccctgggcaggagccagagggcccgggagccactccagccggcgagagggacgatcagtccccagatagcgtccccgagcgtcctagaccagcagaccgccgcctctgcttgccttgtgttgatgccagtccattgcccggaaggacggcttgcccgtctctgcaggaggccaccaggctgattcaggaagaatttgcttttgatggctatttagataacgggcttgaggctttgattatgggtgaatatatttttgccctcaaggatttaacatttgctaccttctgcggcgcgatctctgagaagttttgcgacctgtattgggatgaaaaattactgcagaatctttttaaagtcgttaatggacaggctagtccttctcctagtactgctgaggaagcaggtagccagcttgagggtagccagtcgccgcggagcccaagcagcaagaggccctcactgcaccggcttggcaaggaaaaaccagccatggctcgcacttcaagtcgggccccctgttcacctacttcagtcagtgacgtcgactccgacgctctgagtagggggaattttgaggttggcttcaggccccaacgcagcgtcaaggcggagcgagcccagcagcctgaggcaggggaggatagaagacctgctgggggcgccagtgacgtggaggctgttacacgcttagcaagatctaagggtgtgggcccagcactctcccctggacccgccgggtttcagagttgtagcccaggctggtgtagcgcattttatgaggctgactgttttggtgccgatgtccataattatgtgaaggacctcggccgacagcaggccgacggtgctttgcctgatgcgcagtcccctgagcttgaacagcaattgatgatggaaaagagaaactatcgcaaaactctgaagttctatcagaagctgctccagaaggaaaagagaaataaaggcagcgacgtgaagacgatgctgtcaaaattgaaaggccagctggaagaaatgaaaagccgggttcagtttttgtcactcgtgaagaagtatcttcaggtgatgtacgccgaaaggtggggcctcgaaccatgtacattacctgtgatcgttaatatcgcggcagcgccatgcgacacacttgacttttcgccattggacgaaagttcgtcccttattttctacaatgtgaataaacatcccggcggaaggcagaaagcccggattctgcaggccggcacccccctagggctaatggcctacctatattcttcagatgctttcctcgaggggtacgttcaacaattcttgtacacatttagatatttttgcacaccccacgattttctgcacttcctgctggatcgtatcaactctacgctgacgcgggcacatcaggaccccacatcaacgtttacaaaaatatataggcgatcgctctgtgtcctgcaggcttgggttgaagactgctacgcggtggactttcccaggaattcaggactattggggaagctcgaagactttatatctagcaaaatcttgcctctggatggctccgccaagcaccttttagggttactggaagtgggtatggataggcgcgcagaagggaacccacggggtacggacctggaaaacccaagggaggctgaagaagacgcccgccctttcaacgccctgtgtaagcgcctctctgaggatggcatttcccggaagagcttcccatggagattgcccagggggaatgggcttgtgctgcctcctcacaaggaacgaccctatacaatcgctgctgcgctgcccaagccatgcttcctcgaagatttctacggtccctgtgccaaaacttctgagaaaggcccgtattttctgacagagtatagcacccatcagttgtttagccagctgaccctccttcagcaagagctgtttcagaaatgtcacccagttcatttcctgaacagcagagctctcggggtgatggataaatccactgcgattccaaaagcttccagcagcgagtcactatcagccaaaacatgttctctgttccttcccaattacgttcaggacaagtatttactacaactgctcaggaacgccgacgatgtgtctacctgggttgcggccgaaattgtcacgtcgcatactagcaagctgcaggtgaacctcctttcaaagttcctgctgatcgctaaatcttgttacgagcagaggaactttgccacagccatgcagatactttccggcctagagcacctggctgtgcggcagtctcctgcttggagaatccttccggctaaaatagctgaagtcatggaagaactaaaggcagtggaggtcttcctgaagagcgacagcctgtgtctgatggaggggcggcgttttcgtgctcagcccaccttgccttctgctcacctgctagccatgcacatccagcaactggagaccgggggcttcacgatgacaaacggagcgcaccgctggagcaaactgagaaatatcgcaaaagtcgtctcacaggttcacgcattccaggaaaatccctatacctttagtcctgaccccaagctgcagtcctacctcaaacagcgaatcgctcgattcagcggcgctgacatatccaccctggccgctgatagtagagcaaatttccaccaggtaagctctgagaaacatagccgcaagatccaagacaaactgcggcggatgaaggcaacatttcagtag

SEQ ID NO: 48314 - DNA, 5256 bp, Artificial Sequence
  Description of Artificial Sequence: Synthetic coding sequence
atgcaggccatggaccccgccgccgccgacctgtacgaggaggacggtaaggacctggatttctatgacttcgaaccactcccaaccctaccggaggatgaggaaaatgtgtctctcgcagatattttgtcattacgggacagagggctgtcagagcaggaagcatgggcagtctgtctggagtgcagtctgtccatgagatcagtagcacacgcggcgatttttcaatctctttgtattacacctgacacattggcatttaacacctccggtaatgtgtgcttcatggagcagctgtccgatgaccccgagggcgcctttgtcccacctgagtttgacgtcactggaaacacattcgaggcacatatatacagcctgggagcaaccctgaaagccgcccttgaatatgtggcggaacccacacttgagccaagactgagtcaagatttagaggctctgctttcacggatgcaggcggaggatcctggagacaggccggatcttgagtcaatcatagccctctgcgaagaaaagcttcaattgactagcagctgtcgcgtgtgcagatccctttctgccgtgggacggcgagtcctgtccatagaaagttttggcgccctgcaggatgtgtcggagtcatcatggagagagcggcccgcccccgggaacgccggacctcgtcgtccgcccggggacccaagtaccgacccagaggtgttacccacgccggagggacctgagagcgagacgtcccgtggacccagagctagcccaaccaaggccttgctgtccacccccgtgaggaacggcgagtcccattcccgtgaggggctcgcagggctggtgctcgacgctgaaaggaccctaggagaactggatagagacgccctgcgaaggagccggctgaggaaggtacagacgtttcctcgcttactgtcagattctcctgaggcaacgttgtgtttgcccctgacacggggcaagagtcagttacccatcagcgaattgtttagtccagaccctaggaaggctttcctggatagaaaaaacgggctcagctcatttcaggcccagcctaaatgccgcttgtggcctgagcaggaacctgagcatcagctcggtcgggtgccatgtgcaggccgatctactgaccgtggacctggtgtccccggctctccgggacagcctgaaacgagtcaccccagtcaggggcctgccgaagccccagcggacccccgcgacgccagcggtgaggcccagactcctagagatgacgaaaggatccccgaaggagcacgacaactggaaagtgcggcagccgaacagtgggtgagtttacaggaccttctgtcccaacttggaaggccttttcgcgaatacgaactttgggcactctgtctggcttgcctccgcgcactccagacgaggccggagcaccctgcgtacctttgcctagattccgtactggtcgcagaggacggcgccgttttgtttcagccaccgccagctaacggttcatacgacagtttttttctcgccccagagttggccgaggagagactggtaaccgaaaaggcaagtgtgtattgtgtggcagctgttctatggaccgcagccaagttcagtgtacccagaaaccataagctggccctgccaagaaggttgaagaccctgctgctagacatggctagaaggtctgccccggagcggccctctgcggcagaggccataaaagtgtgtggcagctatcttctgcaaaggggtatggatagcaggaaaattctggcccacctacgggcgagtatttgccaggtttaccaggaagaagaaacaatcagcttgcagaatgctttctccgtggtggaactgaaaccgagtgtggcacctgcacctgagccatcaccgggcttcctgcctgtgaatagtgacactggcctcgtcgcagtgccaggtccagtgcccggccaacatccgtgcggggaagaagccacacagctgcccgccgcctttaccagcgaggcgacccacttcaagcccattgtgcttgcccaaaatgcatcagtcgctagggaccagcctgccctggctcaggaggagtcagaggaaagaggtggtcaacgggagggcgagggcgaggaaaaactgtcactcgaggcccatgcagggtctccctccctgaaaacccctgacggccccgtgcccggccccggaccccaaggtgccgcccccgagcccctaggggcgtccgtacagagagattctgctcagggcaggccatgccctcctccccaagcccctgctaatcagccagagggggcctctagcgctgcaccaggctcacctgtgcccgcacccccgactaaggctagcgccctgcccgtcgagcaaggacctgctgagcctattcccccaggagtggcgagcggggggctgaggcccgacgcattgggacccaccactgcacatcatggtccccgacacccacctaaacctcctcggagcaaggccacagagcgtcctggccaagagcctgaggggccaggagccaccccagccggcgagcgtgatgaccagtctcctgactctgtccctgagcgaccaaggcccgcagacagaagactgtgtttaccttgtgtcgacgctagcccacttcccggaagaacggcttgtccttcactccaagaggccactagactgatccaagaagaatttgcctttgacggttacctcgataatgggctggaggctttgatcatggagcccggcgaatatatcttcgccctcaaggatctgacatttgcgactttctgcggggccatcagtgagaagttttgcgacctttactgggacgagaagcttcttcaaaatttgttcaaggtggtaaacggacaggcctctccttccccttccacagcagaagaggcaggctcccagctagagggctcgcagtcaccacgatccccttcctcaaagcgaccatcattgcatcggctcgggaaagagaagccagcaatggcgcggacctctagccgtgcaccttgctcgcccacatctgtgtccgacgtggactccgatgcactgtctcgaggcaattttgaagttgggtttcgccctcagagatcggtcaaagccgagcgggcgcaacaacccgaagctggcgaggaccgtcgacctgctggaggagcgagcgacgtcgaagcagtgacaagactggcgcgctccaaaggcgtgggcccggcactgtcaccaggtcccgccggattccagtcttgttccccaggctggtgcagcgcattttacgaggctgattgctttggcgcggatgttcacaattacgtgaaagacctggggcgacagcaggccgatggagctctccccgatgcgcagtcaccagaactggagcagcagctcatgatggaaaagaggaattacagaaagaccctgaagttctatcagaagctgcttcagaaggagaaacgtaacaagggatccgatgtcaaaaccatgctgtctaagcttaagggccagcttgaggagatgaaaagcagagtgcagttcctttccttggtgaaaaagtatctacaggtgatgtatgctgagcggtggggcttagaaccttgtacccttcccgttatcgtgaacattgctgcagccccttgcgacaccctggacttctcgccactggacgaaagctccagccttatcttctacaacgtcaataagcatcccggtgggaggcagaaagctaggatcctccaagcaggcaccccgctgggactcatggcttacctttactcctcagacgccttcctggaaggttatgttcaacaattcctctacacatttagatatttctgcacgcctcatgacttcctgcactttctgctagaccgcattaactctacactgactcgggcccatcaggaccccacctcgaccttcaccaagatctaccgcaggtctctgtgtgtgctgcaagcttgggtcgaggattgttacgctgtcgatttcccgaggaactccgggctgctgggcaagctcgaggatttcatctcatccaaaatcctgcccctcgatggctcggcaaaacaccttctgggattgcttgaagtgggaatggaccgacgggccgagggcaatccacgaggcacggatctggagaatccgagagaggccgaagaggacgcgagaccattcaatgccttatgtaaacgcttgtctgaagatggtatctctcgcaaatcttttccttggaggttgccaagggggaatggactcgttctgccgcctcacaaggagaggccctacactatagctgcagcgctgcctaagccttgcttcctagaagatttctacggcccgtgtgccaagacatcagagaaggggccgtatttcctgactgagtacagtacacaccagctgttcagccagttaaccctgttacagcaggaattgtttcagaaatgccatcccgtgcacttcttgaactctagagccctaggtgtgatggataaatccactgccatcccaaaggccagcagtagtgagtctttgtcagcaaagacctgttcactatttctgcccaactacgtccaggacaaatacctgctgcagctcttacgtaacgcggacgacgtcagcacctgggtggccgccgagatcgtgacatcccatacttctaagctgcaagtgaatctgttgtctaaattcctccttatcgccaagagttgttacgagcagcgaaacttcgccactgcaatgcagatcctgagtggccttgagcatctcgctgtgcggcagagcccggcttggaggattctcccagccaagattgctgaggtcatggaagagctgaaagctgttgaagtgtttctgaagtctgacagcctttgcctgatggagggcaggcgctttagggctcagcctactttgccatcagctcacctgctggcgatgcacatacagcagctggagactggtgggtttactatgacgaatggcgcacatcggtggtccaaacttaggaatatcgcaaaggtggtctctcaggtacacgcttttcaagagaatccatatactttctcacctgaccccaaattgcagtcctaccttaagcagcgcatcgcccgtttcagcggtgcagacatttccacactggccgccgatagcagagccaactttcatcaggtgtcctcagaaaaacacagtaggaaaattcaggataaactgaggcgcatgaaggccacctttcaatag

SEQ ID NO: 48315 - DNA, 561 bp, Artificial Sequence
  Description of Artificial Sequence: Synthetic coding sequence
tgagacctgagcaagagccgggagaacctgagcgccgtgatgctgtataaccccgggctcttccccatcaaagggcctatttgcctccgcctcgaattcgaaaggcagcaacgcgaagaacttgagaagttggaatccaagaggaagctgattgaggaaatggaggagaagcagaagagtgacaaggccgaactggagcgcatgcagcaggaggtggaaacccagcgaaaagagaccgaaattgtgcagctgcaaatcaggaaacaggaggagtccctgaagagacggtcgtttcatattgagaacaagctgaaggacctgctggccgagaaagaaaagttcgaagaggagaggctgagggaacagcaggaaatagagctgcagaagaagagacaggaggaggaaactttccttcgggtgcaggaagagctgcaacgcctgaaagagctgaataacaatgagaaggccgaaaagttccagatttttcaggaattagaccaacttcagaaagagaaggatgagcagtatgctaagttggagctggagaagaagaggctgtag

SEQ ID NO: 48316 - DNA, 2874 bp, Artificial Sequence
  Description of Artificial Sequence: Synthetic coding sequence
atggccgaccccgccgagtgcagcatcaaggtgatgtgccggttccgacctctcaacgaggcagaaatcttgcggggagacaaattcattcctaagtttaagggggacgagaccgttgtgatcgggcagggtaaaccctacgtgtttgaccgtgtattgccgccaaataccacccaagaacaggtgtataacgcgtgcgcaaaacagatagtaaaggatgtgctagaaggatataacggcaccatctttgcgtacgggcagacgagctccggcaagactcacaccatggagggcaagctacacgacccccagctaatgggcatcatcccccgcatagcgcatgatatcttcgaccatatttattctatggatgagaacctggaattccacattaaagtgtcgtacttcgagatctatctcgacaaaatcagagatttactggatgtaagtaaaactaatctcgccgtgcatgaagataagaatagagtaccttacgtcaagggctgtactgaaagatttgtgtcttcaccggaggaggtgatggatgtgattgatgaaggcaaggccaaccgacatgtggcagtgaccaatatgaacgaacactcctcgagatctcacagtatttttctgattaatatcaaacaggagaacgtggagaccgagaagaagctgagcgggaaactctacctggtggatctggctggctctgaaaaggtttctaaaacaggtgcagagggagctgtgctggacgaggcaaagaatatcaataagagcctgtccgcactggggaacgtcataagcgctctcgccgaaggcaccaagactcacgtgccatacagggactccaagatgacaaggatcctccaggatagtttgggagggaactgtcgcaccaccatagtgatctgctgttctccaagcgtgttcaacgaggccgagactaagagcacattgatgttcggtcaacgcgccaaaactatcaagaataccgtctctgtgaatctcgagctgaccgcagaagagtggaaaaagaagtacgagaaagaaaaggaaaagaacaaaacactgaaaaatgtcatacagcatctagagatggagcttaacagatggagaaacggcgaggccgttcctgaagatgagcaaatttctgccaaggaccaaaaaaacctggaaccttgtgacaacactcctattatcgacaacatcgcccccgtcgtggccggcatcagtacagaagaaaaagagaagtacgacgaagagatctcgtccctctaccgccaactggatgacaaagatgacgagattaaccagcagtcccagcttgctgagaaactcaaacagcagatgctggaccaggatgaactgctggcctctacgcggcgggactatgagaagattcaggaagaattgaccagactgcagatcgaaaacgaagctgctaaagatgaggtgaaagaggttctccaggctttggaggaactcgctgttaactatgaccagaagtctcaagaagtagaagacaaaactcgagcaaatgaacaacttactgacgagttagcccagaaaacaaccaccctcacaacaacgcagcgagagctgtcacaacttcaggagctgtcgaaccatcagaagaaacgtgccaccgaaattctaaatctccttttgaaggatctgggcgagatcggaggcatcattggcacaaacgacgtgaagactctggccgatgtgaacggcgttattgaggaagagtttaccatggcgcggctgtacattagcaagatgaaatctgaagttaaaagtttggtcaacaggtcaaagcagttggagagcgcccagatggattccaaccgcaagatgaatgcctccgaaagggagctcgccgcctgtcagctccttatctcccagcacgaagctaagataaagagtcttactgactatatgcagaacatggagcagaaaagaaggcaactggaggagtcccaagactccctgtcggaagaactagccaagctacgtgcccaagagaagatgcacgaggtgagcttccaagataaggagaaggaacacctgaccaggctgcaggacgccgaggaaatgaagaaggccctggaacaacaaatggaatctcacagggaggcccatcagaaacagctgtcacgcctaagggacgagatcgaggagaagcaaaaaataatcgacgaaatcagagacctcaaccaaaagttacagctggagcaggaaaagctttccagcgactacaataaactcaaaatcgaggatcaggaacgggagatgaaattggagaagctgcttctgctcaacgacaagcgcgagcaggcgcgcgaggatctgaaaggtttagaagagactgtttcaagggagttgcaaactctgcacaacctcaggaagctgttcgtgcaggacctcaccacccgggtaaaaaagtcagtcgaactggataacgatgacgggggaggatcagcagcgcaaaaacagaagatttcgttcttggagaacaacctggaacaactgactaaggtgcacaaacagcttgtcagagataacgccgatctaaggtgcgaactacccaaattggaaaaacggctacgggccaccgctgagagggtgaaagctctggaaagcgctctgaaagaggcaaaggagaatgccatgagggaccgcaagcggtaccagcaggaggtggatcgaattaaagaggctgtgagggcaaaaaacatggcaaggagggcccatagcgcccagatagcgaaaccaatccggcccggtcattatccagctagtagccctacggcggtgcatgctattagaggtggcggaggaagctcctcaaacagtacccattatcagaagtag

SEQ ID NO: 48317 - DNA, 2064 bp, Artificial Sequence
  Description of Artificial Sequence: Synthetic coding sequence
atggtggagaacgagcggctgcggcaggagatgcggcggtgcgaggcagagctgcaggaactcaggacaaagccagctggcccatgccccgggtgcgagcatagtcaggagtctgcccagcttagggataaactgagccagctccagcttgaaatggctgagtctaaagggatgctgtctgagctgaacctggaagtccagcagaaaaccgacagactggcagaagttgagctgcggctgaaggattgcttggccgaaaaagctcaggaagaggagaggctttctcggagactcagagactcacacgagacaattgcatcccttagagcccagtcgccccctgtgaagtacgttatcaagaccgtcgaggtcgaatcaagtaagactaagcaggctttgtctgagagtcaggctcgaaaccagcacctccaagagcaggtggcaatgcagaggcaggttctgaaggaaatggagcagcagttgcagagttcacatcaattgacagcccggctgcgagcccagatcgctatgtacgagtccgagcttgagagggctcacggccagatgcttgaagaaatgcagagtctggaagaagacaagaatagggcaatcgaagaggcgtttgcaagggcacaggtggaaatgaaggcagtccatgagaacttagccggggtaagaaccaacctgcttaccctgcagcccgccctgagaactctcacaaacgactataacggactaaagcgccaagtgcgggggttcccattgttgctacaggaggccctgagatcagttaaagccgagattgggcaagcgatcgaggaggtcaacagtaataatcaggagctgctcagaaaatataggcgcgaactccaactgaggaagaagtgccataatgaattagtgaggttgaaagggaacatccgtgttattgctcgagtccgaccagtgacaaaggaggacggcgagggacccgaggcaacgaacgccgttacatttgatgccgatgatgactctataatacacctgctgcacaagggtaagcccgtgtcattcgaactggacaaggtcttttctccccaggctagtcagcaggacgtattccaggaggttcaagccctggttacctcctgcatcgatggattcaatgtctgcattttcgcctatgggcaaaccggcgccggcaagacctataccatggaggggacggccgaaaacccaggtattaaccagcgggctctccagctcctgtttagcgaggtgcaggagaaggcgtcagattgggaatacaccatcacggtaagcgccgctgagatatataatgaagtgctgagagatttgctcggaaaggagccacaagaaaagcttgagattcgcctgtgtccggatggatcggggcagctctacgtccctggactgaccgagttccaagtgcagtcagtggatgacataaacaaggtgtttgaatttggccacaccaatcggactacagaattcactaatctcaatgagcacagctcgcgaagccacgcactgttgatcgtaaccgttaggggggtggactgttctaccggtctgaggactacaggaaagctcaatctggtggatttggctgggtcagagcgagttggcaaatccggcgctgaggggtctaggttgagggaggcccaacatatcaataagagtctgtccgcgctgggtgacgtgattgcagcccttcggagccggcagggccatgtgccattcagaaattccaaactaacttatctgcttcaagatagcctgagtggagacagcaagactttgatggtggtccaggtgtcacctgtagaaaaaaataccagcgagactctctattctcttaaattcgcagagcgggtgaggagtgttgagctgggcccaggactccgtcgtgccgagttgggaagctggtcgtcgcaagagcacctcgagtgggagccagcatgtcagaccccgcagccctctgcaagggcccactccgccccgagctcagggactagttcgagacctggatctatcagacggaagcttcagccctctgcatag

SEQ ID NO: 48318 - DNA, 2556 bp, Artificial Sequence
  Description of Artificial Sequence: Synthetic coding sequence
atggcccaggtgctgcacgtgcccgcccccttccccggcacccccgggccggcatccccccctgcattcccggcgaaagatccagaccccccttacagcgtagaaaccccgtatggctacaggcttgacctagatttcctgaagtacgtggacgacatcgagaagggccataccctgcgccgcgtggctgtgcaacgtagacctagactgtcaagcttgccccgagggcctggatcctggtggacgtccaccgaatccctatgtagcaatgcctccggtgatagccgacatagcgcctatagctactgtggtaggggattttaccctcagtatggggctctggagaccagaggcggctttaaccctcgcgtcgagcgtaccctgctcgatgccaggcgtagactggaagatcaagccgctactccgactggtttgggcagtctcacaccatccgctgccgggtctacggcttctttggtcggcgtgggcctgcccccacctactccccgctccagtggtctgtccacccctgtaccaccatcggccggacatttggctcacgtgcgggagcagatggccggcgcacttcgcaagctaaggcagctagaggaacaggtgaagcttatcccagtcctccaggttaagctctcagtgctgcaggaggagaaaaggcagcttacagtgcagctcaagtctcagaaatttctggggcatcctactgcagggcgtggtaggagtgaactgtgcttggatctgccagacccacctgaggatccagtggcactggagacacggagtgtgggcacctgggttagagagcgggatctgggcatgcccgatggggaggctgctttagcagcaaaggttgcagttctcgagacacaactaaaaaaggccttgcaggaactgcaggctgcccaagcccgtcaggcagatcctcagccccaggcctggcccccacctgactctccagtcagagtagacaccgtgagggttgtcgaaggccctagggaggtagaggtcgtggccagcactgccgcaggggcacctgcgcaaagagcacagtccctggagccctacggcaccggccttcgtgcgctggccatgccgggccgccctgagtcgccccctgtattccggagccaggaggtggttgagacaatgtgccccgtacccgccgcggcgacctccaacgtgcacatggtaaaaaagatcagcatcacagagagatcctgtgacggagcagcgggactcccagaagtgcccgcagagtcctctagtagcccccccggttcagaagtggccagcttgactcagcccgaaaaaagcactgggcgagtgcctacccaggagcctacccaccgcgagccgactaggcaggctgccagccaggaatcagaggaggctggcgggacagggggcccgcccgccggagtacggtctatcatgaaaaggaaggaagaggtggcagaccccacagcccaccgcaggagtctgcagttcgtgggtgtgaacggaggctacgaaagtagcagtgaggacagtagcacagccgaaaacatttccgacaacgacagtaccgaaaatgaagctcctgagccgcgagagcgcgtgcccagcgtggcagaggccccccagttgagaccagccggaactgctgcagccaaaacctctagacaggagtgtcagctgagtcgcgagagccagcacataccaaccgccgaaggcgcctccgggtctaacactgaggaggaaatccgaatggaactctctcctgatcttatttctgcctgcttggcactagagaagtatctggataatccaaacgccctcaccgagagagagctgaaggtggcgtataccaccgtgctgcaggagtggctccgcctcgcctgccgcagcgatgcacacccagagctagtgcgaaggcatctggttacatttagagctatgtcagctcgcctgttggattacgttgtgaacatcgccgattccaatggaaataccgccttgcactacagtgtcagtcatgcgaactttcccgtcgtgcagcaactcctcgattccggcgtgtgcaaggtggacaaacagaaccgggccgggtactcccccattatgcttaccgctctggccacactcaagacccaggatgatatcgagaccgtcttacagctgttccgcctggggaatatcaacgctaaggccagccaggccggtcagacagccctcatgttggccgtgtcacacggtagagtagacgtggtgaaagccctactggcctgcgaagctgacgtcaatgtgcaggacgacgacggctccaccgcccttatgtgcgcatgtgagcacgggcacaaggaaatcgccgggttactcctggccgtaccttcctgtgatatcagcctaacggatcgggacgggtctacagcccttatggtcgctctggacgctggtcagagcgagattgccagtatgttatacagccgtatgaatatcaagtgttcctttgcccccatgtctgatgatgagtctcccacttcatcctccgccgaggaatag

SEQ ID NO: 48319 - DNA, 2580 bp, Artificial Sequence
  Description of Artificial Sequence: Synthetic coding sequence
atggcccaggtgctgcacgtgcccgcccccttccccggcacccccggcccagcctcaccaccagccttccctgcaaaagatcccgatcccccctactctgttgaaacgccttacggatatcgcctggacctcgattttctgaagtatgtcgacgacattgagaagggtcataccctgcgccgtgtggcggtgcagagaagaccacgattaagttcactccccagaggcccaggcagctggtggacctccaccgagtcactgtgttctaacgccagcggcgattccaggcattcagcctacagttactgtggaagggggttctaccctcagtatggcgcactggagacaagagggggattcaatcccagagttgagaggacgctgcttgatgcccgccgccggctcgaggatcaggcagccacacccaccggcctaggttcactcacgccgagcgctgcaggctccacagcgtctcttgtgggggtgggcctgcctcctccgacgccccggtcatcagggctcagcactcccgttccgccgagcgccggccacctcgctcacgtgcgagagcagatggcaggggcgcttaggaaattacggcagttggaggaacaggtgaaattgattcccgtgttgcaagtcaaattatcagttctgcaggaggagaaacggcagctgacagtgcaactgaagtcccagaaatttttgggacacccaacagcaggccgaggacgctccgagctgtgtctggatctgcccgatccacccgaagaccccgtcgcccttgaaacccgatcagtgggcacctgggtcagggaacgcgacctaggcatgcctgatggcgaggctgcactcgccgctaaggtggcagtactggagactcagctcaagaaagccctgcaggagttgcaggctgcccaggcaaggcaggctgaccctcagccacaggcctggccgccgccggacagccccgtcagagtggataccgttagagtggtagaaggacctcgggaagtcgaagtggtggccagcaccgccgccggggctcctgcccagagggcacaatctctggagccctatggaacagggctgcgtgcactagccatgccaggcagacccgagagtcccccagtgtttcgctcacaggaagttgttgaaacaatgtgtccggttcctgccgccgccacctccaacgtgcatatggtaaagaagatcagtattacagagcgcagctgtgacggcgccgcaggcctgcccgaagtgcctgcggaatcctcttccagcccacccggcagtgaagtggcctctttgacccagccggagaagagtactggcagagtgcctacgcaggagccaacccacagagagcccacgcgccaggctgcctcccaggagagtgaagaggcaggagggaccgcgcctccactgtcaagccctcccggaggcccaccagccggcgtgcgatctatcatgaaacgaaaggaggaagtggctgaccctacggctcataggagatccctgcagtttgtgggagtgaatggcggctatgagtctagttccgaggattccagcacagcagaaaatataagtgacaacgacagtactgagaatgaggcaccagagccaagggaacgggtgcctagcgttgccgaggcaccacagcttcggccagctgggacggccgccgccaagacttcacggcaggagtgtcagttgtcacgcgaatcccaacacatccctactgccgaaggcgcatccgggtcaaataccgaggaggagattcggatggagctgtctcctgatcttattagcgcctgtctagccctggagaaatatctcgataacccaaacgcactgacggaacgggaactcaaagtggcctacaccactgttctacaggagtggttgagactagcttgtaggtccgatgcccatcccgagctcgtacggcgtcacctggtaacattccgcgccatgagtgcacgacttttggactacgtggtcaacatagctgacagtaacggaaacaccgcactgcactacagtgtgtcacacgcaaacttccctgtggtccagcaacttctggactcaggcgtatgtaaggttgacaaacaaaatagggcaggttatagcccgattatgctcaccgccttggccaccctgaagacccaggacgacattgaaaccgtgctccagctgttccgcctgggaaatattaacgccaaggcttctcaggcagggcagacggccctgatgttggctgtatctcatggcagggtggatgtggttaaagcactgttagcatgtgaagctgatgtgaacgtgcaagatgatgatggcagtactgccctgatgtgtgcatgcgaacacgggcacaaggagatcgctgggcttctattggccgtgccgagctgtgatattagtctcacagaccgagacggaagcacagctttgatggtcgccctggacgccgggcaatccgagatcgcttccatgctgtactcccggatgaacattaaatgttctttcgcccccatgtccgacgacgaaagcccgacttccagctctgccgaggagtag

SEQ ID NO: 48320 - DNA, 2556 bp, Artificial Sequence
  Description of Artificial Sequence: Synthetic coding sequence
atggcccaggtgctgcacgtgcccgcccccttccccggcacccccggcccggcaagccctcccgcttttccagccaaggaccccgaccctccctacagtgtggagacgccatatggatatcgtctggacctagacttcctgaagtatgtagacgacatagaaaagggccacaccctgcgacgggttgcagttcaacgacggccccggctgtcgagtctgccacgaggaccagggagctggtggacatctacagaatccctgtgttctaacgcctcaggcgatagtcgtcattcagcttatagctattgtggcagaggattttaccctcagtacggcgccctggaaactagaggtgggtttaaccccagggtggagcgtaccctgcttgacgctaggcgtcgcctcgaggaccaagcagctactcctaccggattggggagtctaacaccttctgccgctggaagcaccgcatccctcgtcggagtgggcctccctccgccgacaccgcgttcgtccgggttgagcacacctgtaccccctagcgcaggccacctggcccacgtaagagagcagatggcgggggccctgagaaagctcagacagctggaagaacaggtcaaattgatcccagtgctgcaagtgaaactcagtgtgctccaggaagaaaaacgacagcttacggtgcagctaaaatctcagaaattcctggggcacccaactgccggaaggggccgctctgagttgtgcctggatctccctgacccgcctgaagatcctgttgcacttgaaacaaggagtgtggggacatgggttcgggagcgagaccttggcatgccagatggcgaagcagccctcgctgccaaagtcgctgttctcgaaacccaacttaagaaggcattacaggaattacaggccgcccaagctaggcaggccgatcctcagcctcaggcttggcctcccccggacagcccagtgcgtgtggacaccgtccgcgtggtggaaggtccccgtgaggtagaagtggtggcctctaccgctgccggggcacctgcccagcgcgcccaatctctggagccctatggcacaggcttgagagcgctggctatgcccggccggccagaatcaccacctgtattcaggagtcaggaagtagtagagaccatgtgccctgttccagccgccgccacatccaatgtccacatggtgaaaaagatttccattacagagagatcatgtgatggtgcagccgggttgcctgaggtgcccgctgagtcttcttccagtccacccggctccgaagtggccagcctgacccagccagaaaaatccactggccgagttccaacccaggagcctactcaccgagaacccacacggcaagccgcctcccaggagtctgaggaagcgggaggaacaggagggccccctgctggtgtgaggagcattatgaagcgcaaggaggaggttgccgacccaacagcacacagacgaagcctacagttcgtaggagtgaatggggggtacgagagctcatcagaagacagtagcacagccgagaacatttccgacaatgatagtacagagaatgaagctccagagccgcgagagagggtacccagtgtagccgaggcccctcagctccgcccggccggcactgcggcagctaaaacgtctcgacaggagtgtcagttatctcgggagtcgcagcatatccccactgctgaaggggcgtctggaagcaacactgaagaggaaatccgcatggaactgtctcctgatttaatctctgcttgcctcgcgctggagaaatacctggacaaccccaacgccttgactgaacgggagcttaaggtagcttacacgactgtacttcaggagtggctaagactcgcctgcagaagtgacgcacacccagaactcgtgcgacggcacttagtaacctttcgtgccatgtccgccaggcttctcgattacgtggtcaatattgctgattcaaacggtaatacagccttgcactattctgtgtctcacgccaacttccctgtggtgcagcagctgttggactcaggcgtttgcaaagtcgacaaacagaatcgtgcgggatattccccgattatgctcaccgcactggccacgcttaagacccaagacgacatagagacagtgctgcagttatttcgactcggcaatatcaacgccaaagcctcccaagccggacagaccgcactcatgctcgcggtgtcccatgggcgtgtggacgtggtcaaggctttgctggcttgcgaagcggacgtcaacgtccaagacgacgatggatcaactgcccttatgtgcgcctgcgaacacggccataaagaaatagctggcttgcttttagccgtcccctcatgtgatatcagtttgactgatagggatgggagcaccgcactcatggttgcactcgacgctgggcagagcgagatcgctagcatgctttactcccggatgaacatcaagtgcagctttgcccctatgagcgacgacgaatctccgacatcgtcaagcgccgaggaatag

SEQ ID NO: 48321 - DNA, 2466 bp, Artificial Sequence
  Description of Artificial Sequence: Synthetic coding sequence
atggccaagttcgccctgaaccagaacctgcccgacctgggcggccccaggttatgcccagtcccggccgctggaggggcccgcagcccttcatcgccatattcagtagagacaccatatgggtttcacttagatctcgactttctgaaatacatcgaggagctggaaagagggccagccgcccgtagagcccctggccctccaacaagtcggagaccacgggctcctcgtccaggattagccggcgcccgatccccaggggcttggacatcttcagaatcactggcgagcgatgacggcggtgccccaggcatcctgtcccagggtgctccctcgggattgttaatgcagccattgagcccacgggcacctgtgcgaaatcccagagtggaacacactcttcgcgaaacctcacgaaggctcgaactggctcagacccatgaacgagccccttcaccaggacgaggagtgccccgcagccctagagggtccggacgctccagtccggcgcccaatctagctccagcctcccccgggcccgcccagctgcagttagttcgagaacagatggccgccgctctgcgacgcctaagagagctggaagaccaggctcgcacgctacctgagctccaggagcaggtgcgggctctgcgcgccgaaaaagcccgcctgcttgcaggtcgcgcacagcccgagccagatggtgaagccgaaacccggccagacaaacttgcccagctgagacgccttacagagcggctagccaccagtgagcgcggtggtcgagcgagggcaagcccaagggcagattcaccagacggcctggctgcaggacggtctgaaggagcactgcaggtccttgacggcgaagtgggatccctggatggaaccccccagacaagggaggtagccgccgaggccgtgcccgagaccagggaagccggagctcaagccgtaccagaaacgcgggaagccggcgtcgaggccgctccagaaacagtggaggccgacgcctgggtgactgaggcactactgggcttgcctgccgcagccgaacgcgagctcgaattactgcgcgcatcactggagcatcaaaggggcgtgtctgaactgttgaggggacgactgagggagcttgaagaggcaagagaggccgccgaagaagctgccgcaggggctcgcgcacagctcagggaagctactacccaaacgccatggtcttgcgctgagaaggccgctcagactgagagcccagccgaagctccctctctgacccaagagtctagtcccggatctatggacggcgaccgagctgtggccccggctggtattttaaagtctatcatgaagaaacgagatggaacaccaggcgctcagcccagcagtgggccaaaatctttacagtttgtgggtgtcctgaacggcgagtatgaatcatcctcctcggaggatgcaagtgactctgatggagatagcgaaaatggaggcgcagagcccccaggcagttcaagtgggagcggagacgactcaggaggaggtagtgattctggcaccccagggcctccaagtggcggggacatccgggacccggaaccagaagcagaagccgagccccagcaggtggctcagggccgatgtgaactcagccctagactccgcgaggcctgcgtggcactgcagcgccaattgtccaggcccagaggcgtggctagtgacggaggcgctgtgaggctggtggctcaggaatggttccgggtgagctctcagcggaggtcccaggcggagccagtggcacgcatgcttgaaggggtgcggcgacttggacctgagctgctagcgcatgtcgttaatttggcagacggcaatggcaacacagccctgcactatagcgtaagccacggtaatctggcaattgctagtcttctgttggacactggggcctgtgaagtgaacagacagaacagagctgggtattctgccctaatgcttgccgcccttacgagcgttaggcaagaggaggaggacatggctgtggtgcagaggcttttctgtatgggggatgtaaacgccaaagcatcccagacagggcagaccgcccttatgctcgcgattagtcacggaagacaggacatggtggctacattgttagcctgcggagcagacgtcaacgcccaggacgctgacggagctaccgcgctaatgtgcgcttctgagtatggtagactggacaccgtgagactactgttaacgcagcctggatgcgaccccgctattttggataacgaaggaacaagcgcacttgctattgccttagaagccgagcaggacgaggtggccgccctcctgcacgcccatttatctagtggccaacccgacacccagtcagagagtccccctggatcccagactgccacccctggcgagggagagtgcggagataacggcgagaatcctcaggtgcagtag

SEQ ID NO: 48322 - DNA, 633 bp, Artificial Sequence
  Description of Artificial Sequence: Synthetic coding sequence
atggccaccgcccggaccgtggcccccagcccccgggtggcccccagagcacccggcatgactgcggctggcgaccccacaagggctccgctggcacttccagccgctggtacgagtggtaccctgagtcctcggaggagacagtccttgtcgcgctggcatcgcggtggggagagaagaagcttagttgtgtggcggggaggcgggtgcccaccccctggtcggcgatgccctagaagcatactgtctctgagctggccaccattgcaggtgcgtgctgagcctgcttccgagggcggtgtaaggtctgcggctgcagctgccgagcctgctccaagatcctctgacggcggcgccgtgaggctggtggcccaagagtggtttcgggtttcctctcaaaggagaagtcaggcagagcctgttgcacggatgctcgaaggagttcggcgcctcgggcccgaacttctcgctcacgtggtaaatctggcggacgggaatggtaacaccgcacttcactactccgtcagccacgggaatttggctatcgcctcgctactgttggacacaggtcagagccagggtagagtgggtcaccaagagatgggcggtggaagaggccagggcctgacatag

SEQ ID NO: 48323 - DNA, 402 bp, Artificial Sequence
  Description of Artificial Sequence: Synthetic coding sequence
atgatcacccccctggccagcgccgagaccaacgaggacatggccgtagtctggaagctcctgagagaaggcaacgtcaacatccaagccacacaagggggtcaaactgcgttgatgctgggtgtgagtcatgaccgtgaagatatggtgcaggccctgctgtcatgccaggcagatgtgaatctgcaggatcatgatgggtcaagtgcactgatggtggcttgccaccatggcaatgtggatctcgtgaggctgcttctggcacaccctgcttgtgacagttcactgaccgacaaggccgggcgaacagcactgtctatcgctctcaagtcacctacccacatggaaatcgctggattgctccgcgcacatgcagaacagggtcgctcacttggactctag

SEQ ID NO: 48324 - DNA, 1104 bp, Artificial Sequence
  Description of Artificial Sequence: Synthetic coding sequence
atggagaagaccgacgagatcagccccagcaccagcctgaagagcattatgaagaagaaggactatgggttccgcgcaggaggcaacgggactaaaaaaaacctgcagtttgtcggcgtgaacggcggttatgagacaacaagtagcgaagagaccagtggcgaggattcgactccagaagatcttagtgactcagaggccgagaaaaagtgtgatggcccagatcataagcacgttaaagatgcacacctcacatgtgaagcaggccagggaatcccagagggtacgtgtcatgcggcccaggaaagtggcccgggagaggaggtaccacatagcaaggcagaacgctataaaccctcagaggaattcctcaacgcctgtcgtgcgctttcccagcatctccccgaaaccgggaccacaaccgaccagctgctcagacagagcctaaatactataagccaagaatggtttcgcgtgtctagtcgcaaatcctctagccccgctgtagtcgctagttatttgcacgaggtgcagcctcactcccctcatttcttaaaactccttgtgaacctggctgatcacaatggtaacacagcgctccactactccgtgtcccactctaatttctcaattgtgaagctacttctggagacaggggtgtgcaacgtggaccaccagaataaggctggatatacagcagttatgatcacgcctctggccagcgccgagacaaacgaagacatggccgtggtttggaagctgctgagagaggggaacgtcaacattcaggcgacccaagggggccagacggccctgatgttaggtgtgtcccacgatcgggaggacatggtccaggctctgctgtcctgtcaggctgacgtgaatctgcaggaccacgacggttccagtgcattgatggtagcatgccaccatggcaatgtcgacctggtgcgcctgctgctggctcatcctgcatgtgattcctccctcaccgataaggcaggacgaacagcgctctctatcgcacttaagagtccaactcatatggaaatcgcaggactgctgagagctcacgctgaacagggccgttccctaggcctgtag

SEQ ID NO: 48325 - DNA, 1056 bp, Artificial Sequence
  Description of Artificial Sequence: Synthetic coding sequence
atgaagaagaaggactacggcttccgggccggcggcaacggcaccaagaaaaacctccagttcgtgggggtgaacggaggctacgagactactagttcagaggagacctcaggagaggatagtacacccgaggatctatctgactcagaagcggaaaaaaagtgcgacggacctgatcacaaacatgttaaggacgctcatttaacctgtgaagcggggcagggaattcctgagggcacctgtcacgccgcccaggagtcaggaccaggggaggaagtaccacatagcaaagcagaaaggtataaaccttccgaggagttcctgaacgcctgccgggccctcagtcaacaccttccagaaaccggcacgaccaccgatcagctattgagacaaagcttaaatacgataagtcaggagtggttccgggtcagtagtcggaaatcatcatctccagcagttgtggcatcatacctccatgaagtgcagccacactcacctcacttcctcaaattgctggtcaatctggcggaccacaacggcaataccgcacttcactattccgtttcgcacagtaacttcagcatcgtcaagcttctgttggagaccggtgtgtgcaatgtggatcaccagaataaagccggttataccgcagttatgattaccccactggctagtgcagaaaccaacgaggacatggctgtggtgtggaagctcttaagggaaggtaatgtaaacatacaggcgacgcagggcgggcagacagccctgatgctgggcgtatcacacgaccgggaagatatggttcaggcactcttaagttgtcaggcagatgtaaatttgcaggaccatgacggtagcagcgccctgatggtggcttgccatcatggtaatgttgatctcgttcgcctcctcctggctcatcctgcctgtgatagctctctgacagataaggccggcagaacggcactctctatagccttaaaatcgcccactcacatggagatagccggactgctgcgggcccatgcggagcagggaaggagtttgggtctctag

SEQ ID NO: 48326 - DNA, 2988 bp, Artificial Sequence
  Description of Artificial Sequence: Synthetic coding sequence
atggagaagaccgacgccaaggaccagagcagccagggcgacgaggagaaggaccctccaaaaagccatccgtatagcgtggaaaccccttacgggtttcacctggacctggattttctcaagtacgtcgatgacattgagaagggcaatacaataaagcgcattccaatacacagacgcgctaaacaggccaaattttcaacccttccaaggaatttcagtctgcctgattccggcgcgagaccccctgctgctccacccttgcagaattggtcccccgtagtgccaagagaagcatcactgggaactcaggaacaaaaccaatcccctcctcttggtaacgccccccaggcttcgacctcaaggagtgaggtgtcctaccacaggaaggcactgttggctgaggctacacgtcagctagaggctgcagagccggaggatgctgagctcactttcgggtcaggccgcccccaactgttgcgggcctcttcaatgccagccaccttactccacagccgggccagcgaagagccgggcctgtcactgggacctcctgccccaccagccttaccacccttgcaaggtgaggggtctgtgtgcgacgggacctttgagccggctgaaggtctggcaggatttcactcctcctccccccgtgcaagtactcgaattcccgagctggttcaagaaggcgcggaacccccggaaggagtggtgaaagtgccgaatcacctccctctgcccggccccccttttagcttccaaaatgtgctggtcgtcttagaagacaaggaagacgagcataacgccagagaggctgaagtgctctttacacccgggtcacccaccccctctcccccacctttgccatcacccatccccgagaatgaactgctcctggaagaaattgagctgaacatatctgaaatcccgccccctcccccagtggaggtggacatgagaagcatcggaatacgggtgaccgaagagagtctgggcttggcccgcgtggatcctggctcaataagcagcctgaagcagcaggtttcagcactcgaaggggagctgtcaggccgaacagaggagttggcacaagtccgtactgctttacagcagcaggaggaagaaatcaaggctcgggagcaaagaattagagaactcgaatttacagttgcacagctggagggacagtttcatcaggagaatgctaaagacacacaggggcaaacggatgtgatggttaacacggaccctgtgcacggtctgttgacaagggaatcttgcgataagggcatcgaggtcaacctgttagggtctatggagtccgaatcatggggtcatcgtggtgaggaaaacggactgctttggggcccagatggccataaacagggcaatcaatcccccgcagagagagtgctgttgccacagctttcacttccacaaggccccgaacaggtgctaactagttcagtgcattcctttctgtcaaccgagctgcgaattgaggaagcaggcacagaacaagaaggcggtccccaaggcggcactcgcggggcaggaggcttcctttgggggagcgaccgcaagacaccgcctgcaggccgagaagagacatcatcaaacctccctggcaaagagcaccctgggagaccacccagtagccccactgacgccacaatcgggcagtacgtaaaaaaaattcaggagctgcttcaagagcagtggaactgcttagaacatggctacccagagctggccagtgcaatcaagcagcccgcttctaagttgagctcgatccagagccagctgctgagtagcctcaaccttctgctgtctgcgtacagcgcgcaggcccacccacccaaggaaccacccgcctccagctcctctcctcccgtggaaatatcaccctcgacatcgcttaagtcaattatgaagaagaaagattatgggtttcgcgctgggggcaatgggaccaagaaaaaccttcagttcgtaggcgtcaacggagggtacgaaactacctcctctgaagaaaccagcggcgaagattccaccccagaagacctttctgacagtgaagcagagaagaagtgtgatggtccggaccacaaacacgtgaaagacgctcatctgacatgtgaggccgggcagggcattcctgaggggacatgtcatgctgctcaggaatccggcccgggtgaggaggtaccccatagcaaggcagaaaggtacaaaccctctgaagaattcctgaacgcctgtagagctttatcccagcacttacctgaaaccggcaccaccaccgatcagctcctgagacagagcttaaacaccatctcacaagagtggttcagagtgagctcgcgcaaaagttcgtctcctgctgtggtcgctagctacctccatgaggtgcagcctcactcccctcactttctgaagctgttagtgaacctcgccgaccataacgggaacactgccctgcattactccgtatcacacagcaacttcagcatcgttaagctgttactggagaccggtgtgtgtaatgtcgatcatcaaaataaggcaggctacaccgccgtgatgataacccctctagccagtgcagagactaacgaggacatggcggtcgtgtggaaactgttgcgagagggtaatgtgaacatccaagctactcaggggggtcaaacggcccttatgctcggggtgtctcacgacagggaagatatggtgcaggcccttctctcttgccaagctgatgtaaatctgcaggaccacgatggatcaagtgcgcttatggtggcatgtcaccatggcaatgtcgacctcgtgcgcctcttactcgcccatcctgcatgcgactcgtccctgaccgataaagctggcaggaccgccctgagcatagcactgaaaagccccactcacatggagatagccggactgttacgtgcccacgccgagcaggggagaagtctcgggctatag

SEQ ID NO: 48327 - DNA, 387 bp, Artificial Sequence
  Description of Artificial Sequence: Synthetic coding sequence
atgatgaccgccgtgagcctgaccacccggccccaggagagcgtggctttcgaagatgtggccgtctatttcaccacaaaggaatgggctattatggtgccagccgagagagcactttatcgggatgttatgttggaaaactatgaggccgttgccttcgtagtcccgcctacctcgaagcccgcgcttgtatcccacctcgagcagggcaaggaatcttgctttacccagccccagggggtactaagtcgaaacgactggcgcgccgggtggatcggctatctcgaattgcggaggtacacctacctagccaaggcagtgttacggcgtattgtgagcaaaatattcagaaatcgccaatgctgggaggaccgacgaaaggcctag

SEQ ID NO: 48328 - DNA, 387 bp, Artificial Sequence
  Description of Artificial Sequence: Synthetic coding sequence
atgatgaccgccgtgagcctgaccacccggccccaggagagcgtggccttcgaagatgttgccgtatacttcactactaaagagtgggcaattatggtcccagcagagagagccctgtaccgcgatgtcatgctcgagaactatgaggcagtcgcgtttgtggttcctcctacttccaaacccgccctcgtatcacatctggaacaggggaaagagtcatgcttcacccagcctcaaggtgtgttgagcaggaatgattggagagccggatggattggatatctcgagctgcgcagatacacatacctggcaaaagcagtccttagacgcatagtaagcaaaatctttcgaaaccgccaatgctgggaagatagaagaaaggcctag

SEQ ID NO: 48329 - DNA, 387 bp, Artificial Sequence
  Description of Artificial Sequence: Synthetic coding sequence
atgatgaccgccgtgagcctgaccacccggccccaggagagcgtggctttcgaagacgtcgcagtgtactttacgacaaaggaatgggcaattatggtgcctgctgaacgcgccctctacagggatgtgatgcttgaaaattatgaagctgttgcttttgtggtcccacccacctcaaagccagcactcgtaagccatctcgaacagggtaaagaatcctgtttcactcaaccacaaggcgtgctgtccaggaacgactggagggcgggatggataggatatcttgagctgcgcaggtatacgtatctcgcgaaagccgtgctgaggcgtatcgtttcgaaaattttcaggaatagacagtgttgggaagatcgtagaaaggcatag

SEQ ID NO: 48330 - DNA, 3090 bp, Artificial Sequence
  Description of Artificial Sequence: Synthetic coding sequence
atgcgggagaactacgagaccctggtgagcgtgggcaccgccgagctgctgcccctgtcagcattcttgtctccttctgagcccggacgagcagtcggcggcggctcacatgccgatgaaggccaagaaccagctggatgtggagatccgcagggaggccagccacggcattccttgcacttgacagcactcgtgcagctggtgaaggagatcccagagtttctcttcggagaagtgaagggtgctatggactcccccgagtctgagagtcggggtgcttcccttgacggcgaacgcgcatcccctgaggcagctgctgctcgcgaaccatgtccactgcgcgggctgttgagttgtctcccagatggccccactagccagccccacctagccactacaccaactgattcctcctgctccagcggaccaacgggtgatggcgttcagggatcacccctgccgatcaagactgctgacaagccttggccgactaggaaggagggaccgggtgcacttgggggagaaccctcaccccccacacatagcccctcccggcgcaaatcccatcggggccaagaacggggcactagcgaagccgggatttcccctgggaacagtccactacaaggcttaatcaactgtcttaaagagattttagtgcctggtccaagacatcccgagacttctccatcgttcctacccccactgcccagtctggggacatctcgtcttactcgcgccgacttgggcccaggctcaccaccttgggcggtgaaaactgaggccgtctcaggagactgccccttacaaggattactgcactgcctcaaagagttacctgaggcccaggatcgtcatccatcccctagtggggtcggcaatcggagactgcaggaaaaccccggagcgtggaagcggggaagcggcggacctggttacctcctgacccctccaccccaccctgatttgggagccggtggtctgctgtcagtgaaaatggagaattcctgggttcagtccccccctggccccgcaagttgccaacccggccgtcagccgctctccccctctgcgacaggggacacccgcggcgtgccacaaccctcctggggccctgaagctcaggccgcgtccgcgtctagctcacccctggaggctctggaggcctgcctcaaaggcatcccccccaatggatcatcccccagccagctgcccccaacgtcatgcagccaaaatccgcaacctggtgacagcagatctcagaagcctgagctccaaccccaccgcagtcacagcgaggaagccacacgcgagcccgtgctgccgctggggcttcagtcttgcgtcagggatggcccttcccgaccgctggctccccgcggtacaccgacatcgttctcctcttcttccagcactgactgggatctggatttcggttctcccgttggaaatcaggggcagcacccgggaaagggttccccgcctggatcttctcccttacaagggctggaaaattgtctgaaagagattcccgtgccggtgttaagacccgcctggccttgcagctctgcagcagaccgaggcccgcgacgggcggagcctcggaactggactgcggacaaggagggtctcagagccgaggcttgcgagagtcgcctgggccagggacgcggggaggcccctacaaggagtctccacttagtatcaccacaggtgttcacctcttcatgtgtgcccgcatgccaccagcggggtttcaaggaccctggagcaactcggcccggggtgtggaggtggctgccggaaggctcggctccgaaaccttcccctttgcattgcctggaatccgctctgcgcgggatcctcccggttcgccctctccggttcgcctgcgtgggaggaccttccccgtcacccagccccggttctagtagctctttcagcggctcagaaggcgaggatccacgcccagagccagacctctggaaacccctcccacaagaacgggatcgactcccaagctgcaaaccacccgtgccactttccccctgccccggaggcacaccggcaggcagttccggaggtagccctggagaggatccacgcaggacagaaccgagatattgcagcggcctcggtgccggcactgctcaagacccctgtcctgtgtcccagcttgaaaagcggccacgcgtgagtgaggcctcaagaggtctggagctaggccacggaaggccgcgcgtagccgccaagacacacgaacggttgcttcctcaggggccacctgagttgccatctgaatcgcctcctccagaactccccccacccgaggccgctccgccagtcttacccgccagctctttacaacccccctgccattgcggtaaaccactgcagcaggagttgcattccttgggcgccgctttagcggagaagctggaccgactggccacagcattggctggactcgcccaggaagtcgcgaccatgcgaactcaagttaatagattgggccgtcgccctcaagggcctggccccatgggtcaggccagttggatgtggacgttgccccgtggcccacgatgggcgcacggtccgggccatagacatctgccttactggagacaaaaagggcctacgcggcctaaacccaaaattttgagaggtcagggtgagtcatgtcgagcaggcgacctgcagggacttagccgtggtacagcacgccgcgcacggcccctgccacccgacgcaccgccagccgagccgccaggactgcactgttcaagcagccagcaactgctgtctagtacgcctagctgtcatgcagcccctcctgcacaccccctgcttgctcacacaggtggtcaccaatcacctctcccacctctggtccctgccgccctccccttgcagggtgcttcaccacccgctgcctccgcggatgctgacgtccctacctccggggtggcacccgacgggatcccagaacggcccaaagagcccagcagcttactcggcggagttcagcgtgcactgcaggaggagttatgggggggcgagcacagagaccctcggtggggcgcccactag

SEQ ID NO: 48331 - DNA, 2910 bp, Artificial Sequence
  Description of Artificial Sequence: Synthetic coding sequence
atgcgggagaactacgagaccctggtgagcgtgggcaccgccgagctactccccctgtccgcttttctctctcccagcgaaccagggcgcgctgtggggggcgggtcccatgccgacgagggccaggagcctgcgggttgcggcgatccacagggggggcagccccggcatagccttcatctgaccgccctggtgcagctcgttaaagagattcctgagtttctgtttggcgaagtgaaaggtgcgatggacagccctgagagtgaaagtagaggggcatctctcgacggcgaacgcgcctcgccggaggccgccgctgcacgggagccctgccccctaagaggtctcctatcttgcctgccagatggcccaacaagccagccacatctggctactactccgacggattcctcatgctcttctggtccaacaggggacggggtgcagggcagccccctcccgataaagactgccgataagccttggccgactcggaaggagggtcccggggcactcgggggcgagccgtcacctccaacgcattcaccctcaaggaggaagagtcataggggccaggagcggggcacctccgaagctggtatctcaccaggcaacagcccgttgcaggggctgattaattgcttaaaagaaatcttagtgcccgggcccaggcacccggagactagtccttcgttcctgccgcccttgccaagccttggcacgagtcgcctgaccagagcagacctggggcccggcagtcctccctgggcagtgaaaactgaagcagtgagtggggactgccccctgcaaggccttctccactgtctcaaggagctccctgaagctcaagaccgacaccccagcccatcgggagtcggaaacaggaggcttcaggagaacccgggcgcctggaagagagggagcggcggtcctggatacctgcttactcccccacctcaccccgacttgggcgctggtggcctcttgtcagtgaagatggaaaactcctgggttcagagccctcctggcccagccagctgtcagcccgggcgacagcccctttcccccagtgccaccggggacaccagaggcgtcccccagcccagctgggggcccgaggcgcaggcggccagcgcgtctagctccccgctggaggccctcgaagcctgcctcaaaggtatccctccgaacgggagctctccgtcccagctgccacccaccagttgctcccagaacccccagccaggagatagtagaagccagaagcctgaactgcaaccacacaggtctcattcggaagaagcaactcgggaacctgtgctgcctctgggcctccagtcatgtgtgagagacgggccctctcgacccctggctcctaggggcacacccacttctttttctagctcttcttctaccgactgggacctggattttggctctccagtggggaaccagggccagcatccaggcaagggaagtcctcccggttcatctccactgcagggcctcgagaattgcctgaaagagatccccgtgccagtgctgagacccgcctggccatgttcgtcagctgccgaccgcggcccccgccgggcagagcccaggaactggacagccgacaaggagggatccgctccaaaaccatccccccttcattgcctggagtcagctctccgcggcatactgcctgttaggcccctgcggtttgcatgtgtcggtgggccttcaccaagtccgagcccgggttccagctcttctttctctgggtccgaaggagaagatccaagacctgagcccgatctttggaagcccctgccacaagagagggaccggctgccctcgtgcaagccacctgtcccccttagcccttgccctggtggtacacccgccggttcctctggcggctcacctggcgaggaccccaggagaaccgaaccccgatattgtagcggacttggggcgggaaccgcccaagatccttgccccgtctcacagctggagaagagaccaagggtttccgaggccagcagggggctggagctggggcatggcaggccgagagtggcagccaagacccatgagcgcctcttaccccagggccctcctgaactcccttccgaatcccccccacctgagttgcctcctccagaggcagctccccctgtccttcccgcaagtagcctgcagcccccctgccattgcgggaagcctctgcagcaggagctgcattccctgggagctgcactggccgaaaaactcgataggcttgcgaccgcccttgcaggcctggcccaagaggtggcaaccatgcgtacccaggtgaaccgcctgggccgccggccacaagggcctgggcctatgggccaggcctcatggatgtggacactccctcggggtcccaggtgggcccacggcccaggacacaggcacttaccttattggaggcaaaaggggcccacccgtcccaagccaaaaattctgcgcgggcagggagagagctgcagggcgggtgacctccaagggctctcgaggggaacggcaaggagagcccgcccgctccctccagatgctccccccgctgaacccccaggcctacattgttcttcctcccagcagctgctgtcatctactccctcttgtcacgctgctccacccgcccatccactgcttgcccacactgggggccaccagtctccactgcccccactggtgcccgcagcactcccgttacaaggcgcctcccctccagctgcctctgccgacgcagacgtgccgacctcaggcgtagcgccagatggcattcccgagaggccaaaagagccaagctctcttttgggaggggttcagcgcgccctgcaggaggaactttggggaggagaacaccgcgatccacggtggggggctcattag

SEQ ID NO: 48332 - DNA, 312 bp, Artificial Sequence
  Description of Artificial Sequence: Synthetic coding sequence
atgcgggagaactacgagaccctggtgagcgtgggcaccgccgagttgctgccactcagtgcctttctgtccccctctgaacctggaagagccgtcggtggcggctcccatgcagacgagggccaggagcccgccgggtgtggagaccctcaaggggggcagccccgtcatagtttgcatcttaccgcgttggtccagctagtaaaggagattcctgaattcttattcggtgaagtgaagggagccatggactccccagagagtgagagtcggggagccagcctggacggagaaagggcctccccggaatag

SEQ ID NO: 48333 - DNA, 1479 bp, Artificial Sequence
  Description of Artificial Sequence: Synthetic coding sequence
atgcccagcttcctggtgcccagcctggtgagcagccccgtgctgcttaaactgcttttttcaccagggccaaaaactatttggtccctttggcaacagcccatgttgttccaagaggcgactgctttcgaaaatatgacaaaggattggaattacctggaagggtctcaaaaggactgctacagagatactatgctagattcctacgaaaatacagttccacaggggagttttctgcagctatctatgatgcctcagcgggctggtaatgatcccccaggggtctcaaacgcctctgagatggagatggagatctcgaacatgcgggaaaagtttcttatgagcgtcacgaaattagtcgagagtaagagctacaactctaaagtcttttcaaaagagaagtatttccagaccattaaggaggtgaaagaggccaaggagaaagggaaaaaaagttctagggactatcgacgtgcagcaaaatacgacgtgatttcagttcagggaaccgagaaattgattgaagctacacatggtgaacgagacaggattcggtattacgtgcacaaagaggagctgttcgacatccttcatgacactcatttaagcatcgggcacggagggagaacacgcatgctaaaggagctacagggaaaatacgggaacgtgacaaaggaggttatagttctgtatctgacgctctgcaaacagtgtcaccaaaaaaatcccgtgcccaaaaggggtcttgcccccaagcccatgacttttaaagacatagacagtacatgccaggtcgagatcctagacatgcagagtagcgcagatggtgagttcaagttcatcttatactaccaggatcattcaaccaagttcattatcctcaggcccttacggactaagcaagcccacgaagtcgtatctgtgttgctggacatattcactattcttgggaccccgagtgtgctggatagtgactccggagttgaattcaccaatcaggtggttcatgagctcaacgagctctggcccgacttgaagatcgtatctggcaagtaccaccctggccagtctcagggttccctggagggcgccagccgggacgtcaaaaacatgatctcgacctggatgcaaagcaatcatagttgccattgggccaaagggttgcgttttatgcagatggtccgcaatcaggctttcgatgtttcattgcagcagtcaccattcgaagccatgtttgggtacaaggccaagttcggactgtacagtagcaacctgcctcgcgagaccgttgcgacactgcagactgaggaggaacttgagatcgccgaagagcagctcgagaatagcctttggatcaggcaggaggaacgtgccgaaattggcgctgacagatccgacatggacgacgacatggaccctacccccgaagccagcgaaccctccacttcacagggaacttctggcctcttatgttggtag

SEQ ID NO: 48334 - DNA, 1233 bp, Artificial Sequence
  Description of Artificial Sequence: Synthetic coding sequence
atgatgccccagcgggccggcaacgacccccccggcgtgagcaacgccagcgagatggaaatggagatatcaaacatgcgcgagaagtttctaatgagcgttaccaagttagttgagagcaaaagctataactccaaagtgttcagcaaggaaaagtacttccagacaataaaagaagttaaggaggcgaaagaaaaaggcaaaaaaagtagtagggactacagaagggccgccaagtacgacgtgatttccgttcaggggacagagaaacttattgaggcgacccacggggaacgcgatagaatcaggtattatgttcacaaggaagaactgttcgacatcctgcacgatactcatctctccattggccacggcggccgcacgagaatgttaaaggagctccagggaaagtacggaaacgtgaccaaggaggttatcgtgttgtatctcacattatgtaaacagtgccaccagaagaacccagtgcctaaacgcgggttagctcccaagcccatgacctttaaggacatagatagtacctgtcaggtggaaatacttgacatgcagtccagcgcggatggggaatttaagtttatactgtattatcaggaccactcaacaaagtttatcatcttgcggcctctcaggacaaagcaagcacacgaggtggtgtccgtcctcctggatatttttaccatcctcggaactccttctgtgctggacagtgactctggggtcgaattcacaaatcaggtcgtgcatgagctcaatgaactgtggccagacctgaaaatcgtgagcggcaaataccacccaggccagagccagggctccctggagggcgccagccgcgacgtaaagaacatgatctccacatggatgcagtccaaccactcatgtcattgggcaaagggactcaggttcatgcagatggtacgcaatcaggcgtttgacgtttcccttcaacagagcccctttgaggccatgttcgggtataaggccaagttcgggctttatagctcaaacctgccccgcgaaacggtggctacactccagacagaggaagagctggagatcgccgaggagcaacttgaaaacagcttgtggatccgacaggaagagcgagcggagatcggggctgacagatctgacatggatgacgatatggaccccacacctgaagcttccgaaccaagcactagccaaggcacttctggtctcttgtgttggtag

SEQ ID NO: 48335 - DNA, 2130 bp, Artificial Sequence
  Description of Artificial Sequence: Synthetic coding sequence
atgggccaccggaccgccatgcccgagccccggggcagcagccagctgcgtgttaacgctgccttcgccgcacggtacaaccgctatcgggaaagagaagagctgcagcgacttaaagacagatatggtgatagagactccagcagtgactctagctctgagagcgatagttccgacgagcgagtggaattcgacccgcagcaggaaagggacttttacaagactctaagcctgctgaagaaaaaggaccctcgaatttaccagaaggacgctaccttttacaatcggacggcttcatcgtctgatagcgaggaggaccccgaggcattggaaaagcagaagaaagtgaggccaatgtatctcaaggactatgagagaaaggtgatattagaaaaggccgggaagtatgtggatgaagagaactctgatggcgaaacttcgaaccaccggctgcaagagacgtcgtcacagagttatgtggaggaacagaaacaacttaaagagagttttagggcctttgtggaagatagcgaggatgaagatggggcaggggaaggggggtctagcctgttacagaaacgggctaaaacaaggcaggagaaggcccaggaagaggccgactatatagaatggctgaagggacaaaaagagatcaggaatcctgactctctgaaagaattaactcatctgaaagagtattggaatgaccccgaacttgacgagggcgaacgttttcttagagattacatactgaacaaaaggtacgaagaggaagaagaggaggaggaggatgaagaagaaatggaagaggaagagggggtgcatggaccccctgtccagctggccgtggacgactctagcgacgagggagagcttttcttgaagaagcaggaggattttgaacagaaatataacttccgattcgaggagccagactccgccagcgtaaaaacctatcctcgctccatcgcatcaagcgttcgccgtaaggacgagcggcgtaaagaaaaacgtgaggaaacacgggagcgcaagaagagggagaaagcgaagaagcaggaagagctcaaacaactcaaaaatctcaaaaggaaagagatcttggccaagctcgaaaaactgcgaaaggtgacaggcaacgaaatgctgggcctggaagagggagatcttgaggacgatttcgaccccgcgcagcacgatcagttgatgcaaaagtgcttcggtgacgaatattatggcgctgtagaggaagagaaacctcagttcgaagaggaggaggggcttgaagacgattggaactgggatacttgggacggacctgaacaggagggagactggtcacaacaggaactgcactgcgaggaccctaattttaacatggatgcagactacgacccctcccagccaagaaaaaagaagcgagaagctccactgacaggaaaaaagaagagaaagtctcccttcgccgctgctgtgggccaggaaaagcccgtattcgaaccaggagacaaaaccttcgaggagtacctggacgagtactacagactggactacgaggacattattgatgatctgccttgtagatttaaataccggacagtggtgccctgcgacttcggtttatccaccgaggagatcctcgccgcagacgacaaggagctgaataggtggtgctctctgaagaagacctgcatgtaccgctctgagcaggaggaactcagagacaaaagagcctactcacaaaaagctcagaactcctggaaaaaacgccaggtgtttaaatccctctgcagggaggaggctgaaactccagccgaggctaccgggaagccccagagggatgaagcaggcccacaacgtcagcttcctgccctcgacggttcactcatgggacctgaatcacccccggcacaggaggaggaggcaccagttagcccacacaagaagccagctccacagaagagacgccgagctaagaaggcgcgcctactggggccaaccgtgatgcttggcggttgcgaattcagcaggcagcgccttcaggctttcggcctgaacccaaaaagacttcactttcgtcagcttggcagacagagacgcaagcagcaggggcctaagaatagctcttag

SEQ ID NO: 48336 - DNA, 1749 bp, Artificial Sequence
  Description of Artificial Sequence: Synthetic coding sequence
atgggccaccggaccgccatgcccgagccccggggcagcagccagttgagagtgaacgcggctttcgccgctaggtataaccgttatcgggaacgggaggaacttcagcggttgaaggatagatacggggaccgggactcctcttcagactcgtccagcgagtccgacagctccgatgagagggttgaatttgacccacaacaggagcgcgatttttacaagacactgagtctgctcaagaaaaaggaccctagaatttaccagaaagacgccactttctataacagaaccgccagtagctcagacagcgaggaagatcctgaggcattggagaagcagaagaaagtgagacccatgtacctcaaagattacgagcggaaggtgatcctcgaaaaggcggggaaatacgtcgacgaagagaacagcgacggtgaaacatccaaccacaggttacaagagacctcaagtcagtcttacgtagaagagcagaagcagctgaaagaatcgtttagagcgttcgtggaagattccgaagacgaggatggcgctggcgaaggcggaagctcattactccagaagagggctaagacacggcaggaaaaggctcaagaagaggctgattatattgagtggcttaaggggcaaaaggagattcgcaaccccgacagtttgaaagaactgactcacctgaaagaatactggaatgatcctgagcttgacgagggtgagagatttctgagggactatatactgaataagagatacgaggaggaggaggaagaggaggaagatgaggaagagatggaggaggaggaaggagtgcacggacccccggtgcaactggccgtcgatgatagctccgatgagggggagctcttcctaaaaaagcaggaggacttcgagcagaaatacaactttaggtttgaggaacctgacagtgcgtccgttaaaacgtatcctcggtctatcgcaagctccgtccgcagaaaggacgaacgccggaaagaaaagcgagaggagactcgggagcgcaagaaacgtgaaaaagcaaagaagcaggaggagctcaagcaattgaagaacttgaagagaaaagagatcctagccaaactagagaagctgagaaaagtcaccggaaacgagatgttgggtttggaggaaggggacctggaggacgacttcgatcctgcacagcatgatcagctgatgcagaaatgttttggcgacgagtattatggtgcagtggaggaggagaagccccagtttgaggaagaggaggggttagaagatgactggaactgggacacatgggacgggcccgagcaggagggagactggagccagcaggagctgcattgtgaggaccccaactttaacatggatgcagactatgaccctagtcaaccaaggaagaagaaacgagaggctcccctcactgggaagaagaaacggaagtcgccattcgccgctgccgtggggcaggagaagccagtattcgagccaggggaggctcaagtaggccggccttgggtggggcggggccatcgtggagcctggcacagtcctgcagcctggttatgtttggagcaaggaactagaagaagcaggtctacgtggatgtcgattaccggatggaccacccgtacctcttcgactacatgcccggtggccagcagtaccgctcagtggtgtccagttacactggcgagtgcgctgcgacgctccagtctgctgaccatacgttcctag

SEQ ID NO: 48337 - DNA, 1065 bp, Artificial Sequence
  Description of Artificial Sequence: Synthetic coding sequence
atgcccctggtggtgttctgcggcctgccctacagcggcaagagccggcgtgccgaagaactccgggttgccttggccgctgaagggagagccgtttacgtagtggatgatgccgccgttctgggggcagaggacccagctgtgtacggcgattcggcccgcgaaaaagctttacgcggggccctgagagcctctgtggagcggaggttgtccagacacgacgtcgtaatcctagattcactgaattacataaagggatttagatacgaactctattgtttggcaagagccgctcgcactcctctgtgcctggtctattgtgtcagaccaggagggccaatcgccggaccccaggtcgctggggcaaacgaaaacccaggacggaacgtctctgtgtcgtggaggccccgggcagaggaggatggtcgagctcaagcagcagggagctccgtcctgcgggaactgcacacagcagacagcgttgtaaatggctctgcccaggctgacgtacctaaagagctggaaagggaagagagtggtgcggccgagtctcccgctctggtgacgcccgacagcgagaagagcgccaagcatgggtccggcgctttctactcccctgaactgctggaggctctgacactgcgcttcgaggccccagacagccgcaaccgctgggacagacccctgttcacactcgtgggtcttgaagaacctttacccctcgccggaatccgttctgccttgtttgagaacagggcacccccacctcaccagtctacacagtcacaaccccttgcctccggatcctttctgcaccagttagaccaggttacctcccaggttctcgccggtctgatggaggcccagaaaagtgctgtgcctggggatctgctgactctgccaggaaccaccgagcatttacgatttactcgtccattgacaatggctgaactgagcagattacggcgccagtttatcagctacacaaaaatgcaccctaataacgaaaacctgccccagctggctaacatgttcctccaatatctcagccagtccctgcactag

SEQ ID NO: 48338 - DNA, 162 bp, Artificial Sequence
  Description of Artificial Sequence: Synthetic coding sequence
atggaggccgccggcggcttccaggtgcacttccaccccagcaacggggacggccggttcatcgaaacatctagtgccgccgatctcgaagtgatatcttactcttccaaagtgagcgtgaccgagcggtgttttatcaaagtttgtactgtcctgttttag

SEQ ID NO: 48339 - DNA, 162 bp, Artificial Sequence
  Description of Artificial Sequence: Synthetic coding sequence
atggaggccgccggcggcttccaggtgcacttccaccccagcaacggggacggccgttttattgagacatcaagcgcagcagaccttgaggttatcagttactctagcaaagtctccgtgaccgagcgctgcttcataaaagtgtgcacggtgctattttag

SEQ ID NO: 48340 - DNA, 1041 bp, Artificial Sequence
  Description of Artificial Sequence: Synthetic coding sequence
atggacatgctggaccccggcctggaccccgccgccagcgccaccgccgcagccgccgctagccatgacaaggggcctgaagcagaggaaggtgtggaactgcaggaaggcggcgatggaccgggtgctgaagagcagactgcagtggcaataacaagcgtgcagcaagcggcgttcggggaccataatatccaatatcagttccgcactgaaaccaacggaggtcaggtgacctaccgtgtggtgcaggtgaccgacgggcagttggacggccagggtgataccgccggcgctgtgtccgtggtctccactgccgcgttcgccggaggccagcaggcagtcacccaggtgggagtcgatggcgccgcccagcggccaggtcccgcggcggcaagtgtgccccctgggcccgcagccccctttccattggcagtcatccagaatcctttcagcaacggaggaagccctgccgcagaggcagtgagtggagaagcaagattcgcctacttccccgcttcatcggtgggcgatactaccgcagttagcgtgcaaacaacggatcagagtctgcaggctggcgggcaattctacgtgatgatgacaccccaggatgttttacagacaggcacgcaaagaacaatcgctcccaggactcacccctattcacccaagattgacgggacacggactccccgggacgagcgccggcgcgcccaacacaacgaagtggagcggaggcgaagggataagattaataactggatcgtacagctgtctaagatcatccctgactgtaacgccgacaacagcaaaactggcgcctccaagggcggcatcctttcaaaggcttgcgactacattcgtgagcttcgtcagactaatcaacgcatgcaggagacatttaaagaagccgaaaggttacagatggataatgagttactgaggcagcagattgaagagcttaagaatgagaatgcacttctccgcgcgcagctacagcagcataaccttgaaatggtgggagaaggaacgaggcagtag

SEQ ID NO: 48341 - DNA, 531 bp, Artificial Sequence
  Description of Artificial Sequence: Synthetic coding sequence
atggacctgcccgacagcgccagccgggtgttctgcggccggatcctttccatggttaataccgatgacgttaacgctatcattctcgctcagaaaaacatgctggacagatttgaaaagaccaatgaaatgttactcaatttcaataatctgtctagcgcccggctgcagcagatgtccgaaagatttttgcaccacacacggactctcgtggaaatgaagcgggaccttgactccatatttcgtaggatacggactctcaaaggtaagctcgccaggcagcatcctgaggcgttctcccatatcccagaggccagcttcctagaagaggaggacgaagaccccatcccgccatccacaactacaactattgcaacctccgagcaatcaacagggagctgcgacacatctccagatacagtttctccttctctctctccagggttcgaagatcttagccatgtgcagcccggaagtccagccatcaatggacggagccagacagacgacgaggagatgaccggagagtag

SEQ ID NO: 48342 - DNA, 531 bp, Artificial Sequence
  Description of Artificial Sequence: Synthetic coding sequence
atggacctgcccgacagcgccagccgggtgttctgcggccggatcctctcaatggtgaataccgacgatgtcaacgctatcatcctggcccagaaaaacatgctggatcgattcgagaagacgaacgagatgctgctgaactttaacaatctgtcctcagcccggcttcagcagatgtccgagagattccttcatcatacccgcacgctggtggagatgaaacgggatctggattccatattcagaaggatccgaactctgaaaggcaaactggcacgccagcatccagaagcattctcacatatacccgaggcttccttcctcgaagaagaagatgaagatccaatacccccctccaccacaacaacaatagccactagcgagcagagcactgggtcttgcgatacctctccagacaccgtctctccttctctgtctcctggattcgaagatctgagtcatgtacagcctggtagccccgccatcaatggaaggagccagaccgacgatgaagaaatgacgggagaatag

SEQ ID NO: 48343 - DNA, 432 bp, Artificial Sequence
  Description of Artificial Sequence: Synthetic coding sequence
atgcgggacgccgacgccgacgccggcggcggcgccgacggcggcgacggccgcgggggccatagctgcaggggcggcgtggacaccgccgctgccccagctgggggtgctcctcccgctcatgcacctggccccggacgggacgccgctagcgcggcacgaggctcgaggatgcgccctcatatattcacgctgtccgtgccctttccaactccactggaggctgaaatagctcatggttcccttgcacccgatgccgagccccaccagcgcgttgtgggaaaagacctcactgtgagtggcaggatcctggttgtacggtggaaagccgaggattgccgattgctaagaataagtgtaatcaattttcttgaccagttgtccctcgtggtacggaccatgcagcgcttcggccctccggtctcccgatag

SEQ ID NO: 48344 - DNA, 3747 bp, Artificial Sequence
  Description of Artificial Sequence: Synthetic coding sequence
atggtggtggccctgcggtacgtgtggcccctgctgctgtgcagcccctgcttactgatccaaataccagaggagctgatggagccccctgttattactgaacagtccccgcggcgcctcgtggtctttcctactgacgatatttctctcaagtgcgaagcctccggcaagcctgaagtgcagttcaggtggactagagatggagttcactttaagccaaaggaggaattgggcgtcacggtgtaccagtctccacatagcggcagtttcacaataaccggaaataattccaacttcgcccagaggtttcagggcatctatcgatgcttcgcatccaacaaactcggcaccgctatgtcacacgagattcgtctgatggctgaaggcgcgcctaaatggcccaaagagactgtgaaacctgtcgaagttgaagaaggcgaaagtgtggtgctcccctgcaacccacccccatcagccgaaccgcttagaatctattggatgaatagcaagattttgcacattaagcaggatgaaagagtgactatgggacaaaatggaaatctctacttcgccaacgtcctgaccagtgacaaccactcggactacatctgccacgcccactttccaggaacccgcactatcattcagaaggagccaattgatctgcgcgttaaagcgacgaatagcatgatagatcgtaaacctaggctgctatttccgactaattcttcttcacatctcgttgcactgcagggtcagcctctggtgctcgagtgtatcgcagaggggttcccgacacctacgattaagtggctccggccctctggcccgatgccagctgatagagtaacatatcagaatcacaataagaccctccagttgctcaaggtgggcgaagaagacgatggcgagtaccggtgtctggcggagaatagcctcggttcagccagacacgcctattacgtgacagttgaggctgcgccatactggctccacaagccacagtctcatctttacggacccggcgaaacagcgcggctcgactgccaggtccagggtagaccgcaacccgaggtcacttggcgcatcaatgggatacccgttgaagagcttgcgaaagatcaaaagtatagaatccagaggggcgctctgatactgtcaaacgtccagcctagcgacacaatggtcacgcagtgcgaagcgagaaaccgccacggccttttactggctaacgcctacatatatgtggtgcaactgcccgccaagatactgacagcagacaatcagacgtatatggcagtacagggcagtactgcttacctcctgtgtaaagcgttcggcgcgccagtgcctagcgtgcagtggcttgacgaggatggaacgaccgtcttgcaagatgaacgcttcttcccgtacgcaaacggcacactcgggattagggacctccaggcgaatgacactggccggtacttttgcctggcagcaaacgatcagaataacgtgactatcatggcaaatctgaaggttaaagacgctacacagataacacaaggtcctaggtccacgattgaaaaaaaaggctcaagggttacatttacctgccaggcatctttcgacccgagcctccagccgtctatcacctggagaggcgatgggcgtgacctgcaagaactgggagatagcgacaaatactttatagaagacggcagactcgtgatacacagtttagattactcagatcaaggaaactattcctgcgtagccagcaccgagctcgatgttgtggagtccagagctcagctcctggtcgtgggatcacctggacctgtgccaaggcttgtccttagcgaccttcacctgttgactcagagccaggtgcgggtaagctggagccctgcggaggaccataatgctcccatcgagaagtacgacatcgagtttgaggataaggagatggctcccgaaaagtggtattccctgggcaaggtgccaggcaatcaaacctcgacaacgctaaagctctctccgtacgtgcactatacttttagagtgaccgcgatcaacaaatacgggcccggggaaccttctcctgtttctgaaacagtggtaacccccgaggctgccccggagaaaaaccctgtggatgtgaagggcgaagggaatgaaacaacaaacatggtcatcacatggaaaccactaagatggatggactggaatgcaccgcaggtgcaatatcgggtgcagtggcggccccagggcaccagagggccttggcaagagcagattgttagtgatccgtttctagtcgtatctaacacctcaacatttgttccctacgaaatcaaggttcaggcagttaatagccagggaaaagggcccgaaccccaagttaccatcggatactcaggcgaggactatcctcaagctatcccggagctggagggaattgaaatcctgaactcaagcgctgtccttgtgaaatggagacctgttgacctggctcaggtgaagggccaccttagaggatacaatgtgacttactggagagagggttcacagagaaagcatagtaagagacacattcacaaagaccatgtcgtagtcccagcaaataccacctcagtgatattaagtgggctgcggccgtatagctcctaccacctggaggttcaggcctttaacggcagaggaagtggcccagctagcgaattcacattttccacaccggagggagttcctgggcatccagaggcactccacttggagtgccagtctaacaccagccttctcctgcgctggcagccaccactctcacacaacggggttctgaccggttatgtgctctcatatcatcccctcgatgaaggcggaaaggggcagctgtcttttaatctgcgcgaccctgagctccgaactcacaatctgacggatctgtccccccacctcaggtatcggttccagcttcaggccacgacgaaggagggacccggtgaggcaatcgtgcgagaaggagggaccatggcacttagcggtatttcagattttggcaacatatcagctactgccggcgagaattattctgtggtgtcatgggtcccaaaggagggtcagtgtaattttcggttccatattctgtttaaagctttgggcgaagaaaaagggggggcttccttgtcgccgcagtatgtgagctataatcagagctcctacactcagtgggacctccagcctgacactgactacgaaatacacctgtttaaggaacgcatgttccgtcatcagatggcggtgaaaacgaatggtactggccgggtacgcctcccgcctgccgggtttgccaccgagggatggttcattggctttgtgtccgctataatccttctgctcctggtcttactgatcctgtgttttattaagcgttcaaagggaggcaagtatagcgtaaaggacaaggaagatacacaggtggatagtgaggcccggccgatgaaagacgagacattcggggagtattcagacaatgaagagaaagcttttggctcctcgcagccttcgctgaacggggacattaagccactggggagtgacgactcgctagctgactatggaggcagtgtggatgtccagttcaacgaggacggctctttcataggacagtactcaggcaagaaggagaaagaggctgcaggcggtaacgactccagcggggcaacctcacccataaaccctgccgttgcactggaatag

SEQ ID NO: 48345 - DNA, 3774 bp, Artificial Sequence
  Description of Artificial Sequence: Synthetic coding sequence
atggtggtggccctgcggtacgtgtggcccctgctgctgtgcagcccatgcttactgatccagatcccagaagaatatgaaggacaccatgttatggagccgcctgtgattaccgaacagagtcctagacgacttgtcgtttttcctacggacgatatcagcctgaaatgtgaagccagtggcaagccagaggtgcagttcaggtggaccagagatggcgttcacttcaaacctaaagaggaacttggcgtaaccgtatatcagagccctcattctggaagctttacgatcaccggcaataattcgaattttgctcagcgattccagggcatctacaggtgcttcgcttccaacaagcttggcacagcgatgtcccacgagatcaggcttatggccgaaggggcccctaaatggcccaaagaaactgtgaagcccgtcgaggtggaagagggggaatctgtagttctgccttgtaaccctccaccgagcgccgaacctttgagaatttattggatgaacagcaagatcctgcacattaagcaagacgagcgagtcactatgggccaaaacggaaatctgtattttgccaatgttctgacttctgataatcactccgactatatctgccatgcccatttccccgggacgagaaccataattcagaaggagcccatagatctgagggtcaaggctacgaattcaatgatcgatagaaaaccaaggcttctcttccccactaacagcagtagtcacctcgtggctcttcagggccaacccctcgtgctggagtgcatcgctgaggggttccccacacccacaataaaatggttaaggccctcggggccaatgcccgcggaccgcgtgacataccagaatcacaacaaaacattacaactgctgaaagttggggaagaggacgatggcgaatatcgatgtctggccgaaaattcactcggcagcgcgagacatgcttattacgtgactgttgaggctgcaccctactggctccacaaaccccagtcccacctctacggccctggcgaaactgccagattggattgccaggtgcaagggagaccccagcctgaagttacctggagaatcaacgggatacccgtagaggagctggccaaggaccagaaataccgcattcagagaggagcactgatattgtctaacgttcaacccagcgacactatggttactcagtgcgaggcacgaaataggcacggactgctcttggctaacgcttacatctatgttgtgcagcttccggccaagattctaacggccgacaatcagacttacatggccgtacaaggtagcacggcctatttgctctgtaaagccttcggagcacctgtgcccagtgtgcaatggctcgacgaggacggcacaaccgtgctccaggacgagcgatttttcccttacgcaaacggaactctgggcattcgggacttacaagcaaacgacaccggacggtacttctgtctcgccgctaatgaccagaacaatgtaaccatcatggcaaacttgaaggttaaagatgcaactcagatcactcagggacctcggagcacaattgagaagaaaggctctcgggtcacattcacctgccaggcctccttcgacccttccctgcagccttctatcacctggcgtggcgacggccgagacctccaggagttgggagattccgataagtattttattgaggacggccgcctggtcatccacagcctggactactccgatcagggaaactattcctgtgtcgcatccaccgagcttgacgtggtggagtctagggcccagctcctggtggtcggcagcccgggccccgtaccaagactggtccttagtgatctccatcttctgactcagtcccaggtgagggtgagctggagcccggccgaggaccataacgcaccgattgagaaatatgatatcgagtttgaagacaaggaaatggctcccgagaagtggtactctctcgggaaggtgcctggcaatcaaactagcactaccctgaagctgtcaccttacgtgcactacacattccgggtcacagctatcaacaagtatgggcctggcgaaccttcaccggtcagtgagaccgtggtcactccagaggcagcccctgagaaaaaccctgttgacgtcaaaggcgaaggcaatgagacaacgaacatggttattacatggaagcccctaaggtggatggattggaacgctccccaggtgcaatatcgagttcaatggcgtccccagggaacaaggggaccatggcaggagcagattgtgtcagaccctttcctggtggtgtccaatacctcaaccttcgtgccgtatgaaattaaggtacaggccgtcaatagccagggcaaggggcccgaaccacaggttacaatcggatactcaggagaggactaccctcaggccatccctgaactcgagggtattgagattcttaacagctcggctgtcctggtcaagtggcggcctgtggaccttgctcaggtaaagggccacctgcgcggctataacgtcacttattggagagaagggagccagcgcaagcacagcaagcggcacatccataaagaccatgtcgtggtcccggcgaacaccacaagcgtcatcttgtccggcttacgcccttatagtagttaccatctggaggtgcaggcctttaacggtagagggagtggcccggcctcggaatttactttttctactcctgaaggggtccccggccatcctgaggcactgcacctggaatgccagagcaatacatctctactcttgaggtggcaacccccacttagccataatggtgtcctcactgggtatgttctgtcttaccatcccctggatgagggaggcaaagggcagctgtcctttaacctgagagatccagagcttaggacccacaacctcacagaccttagtccgcaccttcgttatcgcttccagctgcaggccactacaaaggagggacctggtgaggctatagtcagagaagggggcacaatggccctttctgggattagcgactttggtaacatctccgcaactgctggagaaaactactccgtggtgagttgggtgccaaaggagggccagtgtaattttaggtttcacatcctgtttaaagctctgggtgaagagaaaggaggcgcgagcctcagccctcagtatgtaagctacaatcagagttcatatactcagtgggatttgcaacccgataccgattacgaaatccacctattcaaggaaagaatgtttaggcaccagatggcagtgaaaacaaacgggacggggcgcgtgagattaccacctgctggattcgcaacagagggctggtttattggattcgtatctgcgattattctgttgctgttggtccttctgatcctttgtttcatcaagagaagcaaaggggggaagtatagcgtgaaggataaagaggatacacaggttgatagcgaggcccggcctatgaaggacgagacattcggagagtacagatctcttgagtctgataacgaggagaaagcattcggctcctctcagcccagtctgaacggagatatcaaacccctcggcagtgacgactccctcgctgattatggagggtccgtggacgttcagttcaacgaagatggtagcttcattggacagtactccgggaagaaggaaaaggaggctgctggcggaaatgactctagcggcgctactagccccatcaatcccgcagtagcattagagtag

SEQ ID NO: 48346 - DNA, 1338 bp, Artificial Sequence
  Description of Artificial Sequence: Synthetic coding sequence
atgctgctgttcgtggagcaggtggccagcaagggcaccggcctgaatcctaacgccaaagtatggcaggagatcgccccgggcaacacggacgcgacccctgtcactcacggcaccgaatcttcctggcacgaaattgctgcaacgtctggggcccaccctgaggggaatgctgaactaagtgaggacatctgtaaagagtatgaggttatgtatagctcctcctgcgaaactaccaggaacacaactggtattgaggagtctacggacggcatgatcctcgggcctgaagatctaagctaccagatctatgatgtttcaggcgaatctaatagtgcagtgagtacggaggatctgaaggagtgcctaaagaaacagttggagttctgcttcagtcgtgaaaatctgtctaaggatctgtatttgatcagccagatggacagtgaccagtttatcccaatatggacggtggctaatatggaggaaataaaaaaactcaccaccgatcccgatctgatactagaagtgctcaggagctcacccatggtccaggtggacgaaaagggagagaaggtcagaccctcccataaacggtgcattgtcatcctgcgggagatcccggagaccacaccaatcgaggaggttaaaggcctattcaagtccgagaactgcccaaaagtgattagctgtgagttcgcccataactctaattggtacatcacattccagtcagacactgacgcccaacaggcttttaaatacctgcgcgaggaagtcaagactttccaaggcaagcctattatggccaggatcaaggcaattaataccttcttcgctaaaaacgggtaccgtctaatggactcaagtatttattctcatcccatccagacccaggcccagtacgccagcccggtgtttatgcagcctgtgtataatccgcaccagcaatatagcgtgtactctatcgtcccgcagtcttggtccccaaacccaacaccctactttgaaaccccactggcaccgtttccaaatggcagctttgtcaatggctttaattcccccggttcctataagaccaatgccgcagccatgaatatgggacgaccttttcagaaaaaccgggtgaaaccccagttccgatcatctggagggagcgaacacagcacagaaggctctgtgagtctgggcgacgggcaacttaatcgatattccagtcgcaatttccctgctgagcgacacaatccaaccgtgacagggcaccaagagcagacctatctgcagaaagaaacttccaccctccaggtggaacagaatggagactatggccgaggcaggtag

SEQ ID NO: 48347 - DNA, 2568 bp, Artificial Sequence
  Description of Artificial Sequence: Synthetic coding sequence
atggagaactggcccacccccagcgagctggtgaacaccggcttccagagcgtgcttagtcagggcaacaaaaagcctcagaatcgaaaagaaaaggaggagaaagtcgagaaacgctcaaatagcgacagcaaagagaatagggaaaccaaactcaatgggcctggagaaaatgttagtgaggatgaggcccagtcaagtaaccagcggaagagagggtggaaacgggatcgagagaagcgggacgatcaggatgacgttagtagtgtccgttcggaaggtggtaacatccgtggctccttcagaggaagaggccgaggaaggggccgggggagagggcggggacgcggtaaccctcgactgaacttcgattatagttacggataccaagaacacggggagaggactgaccagcctttccaaactgaactgaatacaagcatgatgtattactatgatgatggcaccggagtgcaggtataccctgtcgaagaggctctgctgaaggaatatatcaaacgtcaaatagagtattacttttctgtggagaacctggaacgcgacttcttcctcaggggcaagatggacgagcaagggttcctgccaatttccctgatcgctggattccagcgggtacaggccttaaccacaaatctgaatcttatcctagaggctctcaaggacagcaccgaggtcgagattgtggatgagaagatgaggaagaagattgaaccagaaaagtggccaatcccaggacccccccctcggtcagtcccaccaaccgatttttctcagctgatcgactgccctgaatttgttcccggacaagcattctgttcacacaccgaatccgctcctaacagtccccggatcgggtcaccgctgtccccaaaaaaaaactctgaaacctccatcttgcaggcaatgtcccggggtctttcaaccagtctaccggatctggactccgagccatggatcgaggtcaagaaacgacaccagcccgctccggtgaagctcagggaatctgtcagtgtccctgagggctccttaaatcagttatgcagcagtgaggaacccgaacaggaagagctggatttcctgttcgacgaagagatagagcagatcgggcgcaagaataccttcacagattggtccgacaacgactccgattacgagatcgacgaccaggacttgaataagattttgatcgtaacacaaactcccccgtatgtcaaaaaacaccccggaggcgatcggacggggacccacatgtcacgagccaaaatcacctcggagctcgcgaaggtcattaacgatgggctatactactatgagcaggacttgtggatggaggaggacgagaataagcataccgcaataaaacaggaagtggaaaactttaagaagttgaacctgataagtaaggaacagtttgagaaccttactccagaactcccctttgagccaaaccaagaggttcccgttgcccccagccagtcacgacaagaccttaccgatgagctggctcagaagctctttgatgttagtgaaattacatcagcagccatggtccatagcctccccacagccgtgccggagagccctcggatccacccaacccggacgccaaagactcccagaacgccacgactacaggaccccaataagacaccgcgattctacccggttgtcaaagaacccaaagccattgatgtgaagtcgccccgtaaacggaaaacacgccacagtaccaacccccctctcgaatgtcatgtgggttgggtaatggattccagagatcgcgggcctggcacctcctcagtgagcacatcaaatgcatctccttccgaaggtgccccgctggccgggagctatgggtgcaccccccacagcttccctaagttccagcatccttcacacgagctgctgaaggaaaatgggtttactcagcaggtgtaccacaagtacagaagacgctgcctctctgaacggaaacgactgggcataggccagagtcaggagatgaacaccctctttcgcttttggagcttctttttgcgagaccacttcaacaagaaaatgtacgaggaattcagacaattggcttgggaagatgccaaagagaattatcggtatggcttggaatgtttatttaggttttatagttatgggctggaaaaaaaatttcggagggagattttccaggactttcaggaagagacaaagaaggattacgagtcgggacagttgtatgggctcgaaaagttttgggcgtacttgaagtattcacagagcaaaacacagtccatcgatcccaagctgcaggagtacctttgtagctttaagcggttggaggactttagagtggatccccccatttctgacgaatttggacggaaaagacacagcagcacttccggggaagaaagtaaccggcacaggttgcctccgaatagcagcacgaagccgcccaatgctgcaaagcctaccagcacgtccgaattacaggttcctatcaactcccctaggcgcaatatttctccagagtcatccgacaacagccactag

SEQ ID NO: 48348 - DNA, 2745 bp, Artificial Sequence
  Description of Artificial Sequence: Synthetic coding sequence
atggagaactggcccacccccagcgagctggtgaacaccggcttccagagtgttttgagccagggcaataagaaacctcagaaccgtaaagaaaaagaggaaaaagtcgaaaaacgaagtaatagtgacagcaaagaaaaccgcgagactaagcttaacggtcccggcgaaaatgtgtccgaagacgaggcacagagctcgaatcaacgcaagcgcgccaataagcataagtgggtgccactgcacctagacgtggtgcgcagtgagtcacaggaacggccagggtctcggaactcctcccggtgccagccagaggctaacaaaccaacccataataatagacgaaacgacactcgttcctggaagagagaccgcgaaaagagagatgaccaggatgacgtgagttctgtgagaagcgagggtgggaatatccgtggtagcttccggggacggggccgtggccgcggtcgagggcgaggccgggggcgcggcaatcccaggctgaacttcgactatagctacggctaccaggagcacggagaaagaactgatcagcccttccagaccgagctcaatacctctatgatgtactactacgacgacggcaccggggtgcaggtgtacccggtggaagaagccctgttgaaggaatacattaaacgccaaatcgagtattatttttcggtggagaatctggaacgggacttcttcctgagaggaaagatggatgagcagggcttccttcccatctctctgattgctggctttcagcgggtgcaggcacttaccaccaacctcaacctgatccttgaggccctgaaagactccactgaggtggagatcgttgacgagaaaatgcgcaagaaaattgagcctgagaagtggcctattcctgggccgccccctcgttcggtgcctccaacggatttctctcagctgattgattgcccggaattcgtcccaggccaagccttctgctctcatacggaatcggcacccaactcacccaggatcggaagccctctgagtcccaaaaagaacagcgaaacctccatcctgcaggcgatgtctcgcggcctctccaccagtctgcccgacctggatagcgaaccctggattgaggtgaagaaaagacatcagcctgctccagtgaaattgagggaatctgtgtccgtgcccgagggctcccttaaccaactatgctcctcggaagagcctgagcaggaggagctggattttctatttgatgaggagatcgaacaaataggaagaaagaacacttttaccgactggagtgacaatgattcggattatgagattgatgaccaggacttgaataaaattttgatcgtcacacagacgcccccctatgtcaagaaacatccgggaggtgaccggaccgggacccacatgtcccgggccaagatcacgtcggaacttgccaaagtgattaatgacggcctgtactactatgagcaagatctgtggatggaggaggacgaaaataaacatacagcgatcaaacaggaagtcgaaaactttaaaaagttaaacctcatttcgaaagaacagttcgaaaacctgactccagaattgcctttcgaacctaaccaggaggtgcccgtggcccccagtcaaagtagacagggcggtgtccagggcgtgctacatatcccaaaaaaagatcttaccgacgagctggctcagaaactgtttgacgtctcagagattacatctgcggcaatggtgcattccctgccgactgctgtccccgagagtcctcggatccaccccaccaggacacctaaaacgccgaggacaccacggctccaggacccaaacaaaacgcctcgtttctatcccgtcgttaaggaaccgaaggctatagacgtcaaatctccgaggaagaggaaaacccgccattctactaaccccccattagaatgtcacgttggctgggtgatggactcaagggatcgcgggcccggcactagctcagtatcaacatcaaatgcctcccccagtgagggcgcacccctggctggaagctacggatgtacccctcactcctttccaaaatttcagcacccatcccatgaactgctgaaagaaaatgggtttacacaacaagtgtaccacaagtataggcgccgttgcctgtctgaacggaaaaggctggggattggccagtcccaagagatgaatactctcttcaggttctggtcctttttcctccgagatcactttaacaaaaagatgtatgaagagtttcgtcagttagcttgggaagacgccaaggagaactatcgatatgggctggaatgcctgttcaggttttacagctacggactggagaagaaattcaggcgcgagatttttcaggactttcaggaggaaacaaaaaaagattatgaaagcggccagttgtacggtctggagaagttctgggcgtatctaaagtatagccagagcaaaactcagagcatcgatcctaagttacaggagtacctctgttcctttaagcgcctggaagatttccgtgtggaccctcccatctctgatgaattcggaaggaagcgccactcttcaacttctggagaggaatctaacaggcataggttacccccgaatagctccaccaagccgcccaatgccgctaaaccaacatcaacctcggaactgcaggtgccaatcaatagcccaagacggaacatctctcccgagagttcagataacagtcattag

SEQ ID NO: 48349 - DNA, 846 bp, Artificial Sequence
  Description of Artificial Sequence: Synthetic coding sequence
atggtgcacagcctgcccaccgccgtgcccgagagcccccggatccaccccacgcgcacccctaagaccccaagaactccaagactgcaggaccccaacaagacccctagattttatcctgtggttaaggagcccaaagccatcgacgtgaagtcccccaggaagcgaaaaacacgccacagtaccaacccacccctcgaatgccacgttggatgggtcatggattcgagagaccgcgggccgggcacctcttctgtcagtacctccaacgccagtccaagtgagggcgctcccctggcaggatcctacggctgcaccccacactcttttccaaagtttcaacacccctctcatgagctgctcaaggaaaacgggttcacacagcaggtgtaccacaaatatagaaggcgttgcctaagcgaaaggaaaaggctgggcatcggacagagccaggagatgaacactctgttcaggttctggtctttttttctgcgggaccatttcaacaagaagatgtacgaggagtttaggcagctggcctgggaagacgcaaaggagaattacagatacggtctcgagtgcctgtttcgattctacagttacggcctggaaaaaaagtttcggagagagatattccaggatttccaagaggaaaccaaaaaggactatgaatctggacagctctacgggttggagaaattttgggcatatctgaaatacagtcagtcgaagacgcagagtatagatccaaaattacaggagtatttgtgcagttttaagagattggaggacttccgcgtagataaccaccatgatagacttctgctgctcattattaatatctag

SEQ ID NO: 48350 - DNA, 1008 bp, Artificial Sequence
  Description of Artificial Sequence: Synthetic coding sequence
atggagaactggcccacccccagcgagctggtgaacaccggcttccagtcagtgctaagtcaagggaataaaaagccccagaataggaaggaaaaggaggaaaaagtcgagaagaggagcaattccgactctaaagaaaaccgagagactaagctcaatggcccaggagaaaatgtgtcagaggatgaggctcaatcaagtaatcagaggaagagggcaaataagcacaagtgggtgcctctgcacctggatgtcgtacggagtgagagccaggagagacccggaagccggaattcatccaggtgtcagcctgaagcgaataagccgacacacaacaacaggcggaatgacactcgctcctggaagcgggaccgggagaagcgggatgatcaagacgatgtcagcagtgtgagatccgaggggggaaatattcgcggttcattccgcggcagagggcgcgggcgtggacgcggtcgcgggcgcggaagaggcaaccctagactcaactttgactatagttacggttaccaggagcacggggaacgtacagatcagccctttcagactgagctaaatacctcaatgatgtattactatgacgacggcacaggcgtacaggtgtaccccgtcgaggaggccttgctgaaggaatacattaagagacagatcgagtattacttcagtgttgaaaacctcgagcgggatttttttctaagaggaaagatggacgagcagggcttcttgccaatttccttaatcgcaggcttccagagggtgcaggcactgacaaccaatctcaacctcatcttagaggcactgaaggattcgactgaggtcgagattgtagacgaaaagatgaggaaaaagatagagccagaaaagtggcccatacctggaccacccccccgaagtgtccctcctactgacttttctcagttaattgactgcccagaatttgtgcctggacaagctttttgtagccatacggtgcgcgtgatgattttttag

SEQ ID NO: 48351 - DNA, 1569 bp, Artificial Sequence
  Description of Artificial Sequence: Synthetic coding sequence
atggagaactggcccacccccagcgagctggtgaacaccggcttccaatcagtgctttcccaaggcaacaaaaagcctcagaacaggaaggagaaggaagagaaggtggaaaagcgctccaatagcgacagcaaagaaaatcgggaaaccaagttaaacggtcccggcgagaatgtttctgaggacgaagcccagagctcaaaccagcggaagagggccaataaacacaagtgggtgcctctccatcttgacgtcgtcaggtcagagtctcaagaacgtcccggcagcagaaactcaagcaggtgccagccagaggccaacaaaccaactcacaacaatagacggaacgatacacggtcctggaagcgtgatagggagaagagagacgatcaggatgatgtgagttctgtgaggagtgaggggggaaacatccgcggtagctttagagggcgcggtcgcggccggggtcgaggccgggggaggggccggggaaatcccaggctgaactttgactactcttacgggtaccaagaacacggtgagcgtacggaccagccattccagaccgaacttaacacttccatgatgtactactatgatgatggcacaggggtgcaggtgtatccagtggaagaagctctgctgaaggagtacatcaaacggcaaatagaatactatttcagcgtggagaaccttgaaagggatttcttcctgagagggaagatggatgaacagggcttcctcccgatttcactgatcgctggctttcaaagagttcaggccttaacaacaaatcttaatctgattctggaggctctgaaagattccacagaagtagaaatcgttgacgagaagatgcgcaaaaaaatagaaccagaaaaatggcccattcccgggcctccaccgagatctgtgcctcctacggatttttcacagcttatcgactgcccagaatttgtgcctggtcaggctttttgcagtcatactgagtcggctcccaattctcctcggatcggaagtcctctctcccccaagaaaaattcagagacctctattttacaagccatgtctcgggggctgagtacaagcctcccagacctcgactcagagccgtggatcgaagtgaagaaacgacaccagccagcccccgttaagctgcgagagtcagtgtctgtcccggaaggcagtcttaaccagctctgtagctcagaggagcctgaacaagaggaactggacttcctattcgatgaagagatcgaacagatcggaaggaaaaatacctttaccgactggagcgataatgactccgactatgagatcgacgatcaagatctgaataagatcctaatcgttacacaaacacccccctatgtgaagaaacatcccggcggtgatcgcacaggaacacacatgagcagggccaagatcacttcagagctcgccaaagtaataaacgatggtttgtactactatgagcaggatctctggatggaggaagatgaaaacaaacacaccgccatcaaagtcattgtgagtggtcagcatctttccactgacgccctgttttag

SEQ ID NO: 48352 - DNA, 1077 bp, Artificial Sequence
  Description of Artificial Sequence: Synthetic coding sequence
atggagaactggcccacccccagcgagctggtgaacaccggcttccaaagcgtcctgagtcagggaaataagaaacctcagaataggaaggaaaaggaagaaaaagtcgagaagcggtctaacagtgattccaaggagaatagagagactaaattgaatgggccaggtgaaaatgtgagtgaggatgaggcccagagtagcaatcagcggaaaagggccaataagcataagtgggtgccgctgcacctggatgtggtccgctctgagtcacaggagcgcccaggaagccgcaacagctcccgctgccagcccgaggctaataaaccaactcacaataacagacggaacgatacacgctcttggaagcgcgaccgtgaaaaaagggatgaccaggacgatgtgagcagcgttcgatccgaaggaggcaacatcaggggcagtttcaggggccgcggccggggccgcgggaggggaagagggagaggccggggcaatcctcgcctgaactttgattactcttatggttatcaggaacacggagagcgcactgaccaacccttccagactgaactgaacaccagcatgatgtactactatgacgatggcacgggcgtgcaggtctaccccgtagaagaggccctcctgaaggaatacattaagcgccaaattgagtattatttctctgtcgagaacctggagcgggacttcttcctccggggaaaaatggacgagcagggtttcctcccgatttcattgattgcgggatttcagcgggtgcaggcactaaccacaaacctgaatctaattctcgaggctttaaaggactccacggaagtggagatagtcgatgaaaaaatgcggaagaaaattgaacctgaaaagtggcccattcctggacccccgcctcgatccgttccgccaactgacttttcccagttgattgactgccctgaattcgtgcctggtcaggctttctgttcccacactggaaacattttcagttcacgtgcaaacgacgttactgttgggtatctcgtccaattcacataccttttcatttatttccagttcatttag

SEQ ID NO: 48353 - DNA, 2364 bp, Artificial Sequence
  Description of Artificial Sequence: Synthetic coding sequence
atggagaactggcccacccccagcgagctggtgaacaccggcttccaatccgtcttgtctcaggggaataaaaaaccacagaatcgcaaagaaaaagaggagaaggttgagaaacgcagcaactccgacagtaaagaaaatcgcgagaccaaactgaacggcccaggagagaatgtatccgaggatgaggctcagtcgagtaaccagaggaaaagggcgaataagcataagtgggtccccctgcatctcgacgtggtgagaagcgaaagccaggagagacctggatctaggaatagttcacggtgtcaaccagaggccaacaagcctacacacaataaccgccgcaacgatacccggtcatggaaacgcgacagagagaaaagggacgatcaggatgacgtctcctcagtacggtccgaaggcgggaacattagaggcagcttccggggccgaggccgcggcagagggcgggggagaggtcggggacgggggaatccccgccttaactttgactattcctacggctatcaggaacatggggaaaggactgatcagccattccagacagagctgaacaccagcatgatgtattattacgacgatggtacgggggttcaagtttacccagtagaagaggcactcctcaaagaatatatcaagaggcaaatcgaatactatttcagtgtggaaaaccttgagcgggattttttcctgcgtggcaaaatggatgaacagggcttcctgcccatttctctgattgccggtttccaacgggtccaggcactcaccaccaacctgaacctcattctagaggcactgaaggatagtactgaggtcgaaatcgtcgatgaaaagatgcggaagaaaattgaacctgagaagtggcccattccaggccccccccccagatccgtgccccccacagacttcagccagcttattgactgcccggagtttgtaccaggtcaggccttttgttcccatacagaatcagcccctaacagcccgaggattggatccccccttagccctaagaagaattcggagacatccatcctacaggcaatgagccgcggtctgtccacctccctgcccgaccttgattctgaaccctggatcgaagtgaagaagagacatcaacctgctcccgtgaagctccgcgaaagcgtcagtgtgccggagggcagcctgaaccaactctgcagctctgaagagcctgagcaggaggaactcgattttctgtttgacgaggaaattgagcaaatcggccgcaagaatacgttcacagactggagcgataacgacagcgactacgagattgacgaccaagatctgaacaaaatattaatcgtcacccaaacgcctccatacgtaaaaaaacatccggggggcgacaggaccggcacacatatgagccgcgctaagataacctcagaactggcgaaggttatcaacgacggcctgtattattatgaacaggatctgtggatggaagaagatgagaacaaacacaccgcaattaagcaagaagtggagaattttaaaaaactgaacttgatctcaaaggagcagtttgagaacctgacgcctgagctgccatttgaaccaaatcaggaggtgccggtggcaccgagtcaaagccggcaggggggggtgcaaggggtcctgcacatacccaagaaggatctgactgacgagcttgctcagaagctgttcgacgtgtctgaaattactagcgctgccatggtccacagtctccctaccgccgtgcccgaaagccccagaattcatcccacccgtacaccaaaaactccaagaacacctcgtctgcaagaccccaataagactccacggttttaccctgtagtgaaagaacctaaggccattgacgtgaagtctccacgcaagcgtaagacaaggcactccactaatccgcccttggagtgtcatgttgggtgggtgatggattcacgggacagaggaccaggcacaagctcagtctcaacaagcaatgcgtcacccagtgaaggtgcaccacttgccggtagctacggctgcacaccccattcttttcctaagttccagcacccgagtcacgaactgctgaaggagaacgggttcactcagcaagtttatcacaaatatcggagacgctgcctatctgagcgtaagagactcggcatcggacagtcccaggagatgaatacactattccgcttctggagcttcttcctgcgagatcactttaacaagaagatgtatgaagagtttcggcagctcgcatgggaagacgccaaagaaaattatagatctgccgtgtggactcggaaggtgctcggcctgttcgagatattcagcatttag

SEQ ID NO: 48354 - DNA, 1476 bp, Artificial Sequence
  Description of Artificial Sequence: Synthetic coding sequence
tgagaggagaaggtggagaagcggagcaacagcgacagcaaggagaatcgagaaactaagctcaacggcccaggtgagaatgtctcagaagatgaggcccaatcttctaatcagagaaaaagggcgaacaagcataagtgggttcctttgcacctggatgtggtgcggtcggaatcccaagaacgtcctggctctcgaaattctagcaggtgccaacctgaggctaacaagcctacgcacaataatcgccgcaatgatactagaagctggaagagagaccgggagaagcgcgacgaccaagatgacgtgtcctcagttcggtccgagggcgggaatattcgcggaagttttcgcggacgcggcagaggaagggggcggggacgcggtagagggcgcggcaaccctcgcttgaatttcgattattcttatggctaccaggaacacggagagcgaaccgatcagccgtttcagacagaactaaatacgtcgatgatgtattattatgatgatggcacaggagtccaagtgtaccccgtggaggaagccctactcaaagagtatattaagcgccagatcgaatattatttttctgtcgagaacttagagcgcgacttcttcctgaggggcaagatggatgaacagggcttccttcccatcagcctgatagcaggattccaaagagttcaggccttaacaaccaatctaaatctgatcttagaagcactgaaggactctacagaggttgaaatcgtcgacgaaaaaatgcgtaaaaaaatcgagcctgagaagtggcccattcccggcccccccccacgatccgtgcccccaacagatttctcgcagctcatagattgcccagaattcgttcccgggcaagccttctgcagccataccgaaagcgccccgaactccccccgcatagggtcgcccctgagcccgaaaaaaaatagcgagacatctatcctgcaggcgatgagtcgcggactgagtaccagcttacccgatctcgactccgagccttggattgaagtgaaaaaaaggcaccaacctgccccagttaagctccgtgaatcggtgtcggttcccgaggggagcctaaaccaactgtgctcctctgaggagcccgagcaggaggaactggattttctgttcgatgaagagattgaacagatcggtagaaaaaacaccttcacagattggagcgacaacgacagtgactacgagatcgacgaccaggatcttaacaagattctgatagtcacccaaacgcccccctacgtgaagaagcatcccggtggcgaccggacaggcacacatatgagccgcgctaaaatcacgtctgagctggccaaggtgatcaacgacggcctgtactattacgagcaggacttgtggatggaggaggatgaaaacaagcacactgctataaaggtcatagtgtccgggcaacacctctcaacagacgctctgttttag

SEQ ID NO: 48355 - DNA, 1962 bp, Artificial Sequence
  Description of Artificial Sequence: Synthetic coding sequence
atgctgctgttcgtggagcaggtggccagcaagggcaccggcctgaacccgaatgctaaggtgtggcaggagattgcaccagggaacacggacgcaacccccgtcacacatggcaccgagagttcatggcatgaaatcgcggccaccagcggggcacacccagaaggtaacgcagagctatccgaggacatctgtaaagagtacgaagtaatgtattcaagctcctgcgagacaactcgtaacacgaccgggattgaggagtctacagatggcatgattctgggacccgaagatctctcctaccagatatatgatgtgagtggagagtcgaacagtgctgtgtccacggaggatttgaaagaatgcctgaaaaaacagctagaattttgcttttctagagaaaacctctcgaaagatctctacctcatttcacagatggactcagatcagttcatccccatttggacggtggcaaatatggaagaaatcaagaagctgacgacagatccagatctcattcttgaagtcttgagatctagtccaatggtgcaggtggacgaaaagggcgaaaaagtgagacctagccataagaggtgtattgttatacttcgggagatcccggagaccacccctatagaggaagtgaagggactatttaaaagtgagaattgtcctaaggtcatttcttgtgagttcgcacacaactctaactggtacattacttttcaaagtgataccgacgcccagcaggccttcaaatatctacgcgaggaagtgaagactttccaaggtaagcctattatggccaggatcaaagccattaataccttttttgcaaaaaacggatataggttgatggactcgagcatttacagtcatcctatccaaactcaggcgcagtatgcttcacctgtcttcatgcagcctgtatacaaccctcaccagcagtattctgtgtacagtatcgtgccccaaagctggagcccaaacccgactccatatttcgagactccactcgcccctttccccaacggttcctttgtcaacggctttaattctccggggtcttacaaaaccaatgccgcagctatgaatatgggaagaccttttcagaaaaacagacgcaccctgttccgggggaggagacgccgtgaggacgaccgcatcagccggccgcatccaagcaccgccgagtctaaggcgcccaccccaaagttcgacctactcgctagcaactttcctccccttcctggaagttcatcccggatgccaggtgaattagtcctggagaataggatgtcagatgtggtaaagggtgtgtacaaagagaaggataatgaagaattgaccatcagttgcccagtgcctgctgacgaacaaactgaatgcacaagtgctcagcaattgaacatgtcgacctcttcaccttgtgctgccgagctaacggctttgagtaccacccagcaagagaaggacctgatagaggatagtagtgttcagaaagacggcctcaaccaaacgacgatccctgtctctccgccttccactaccaagccctctcgggcctcaaccgcctccccttgcaacaataacatcaacgcagctacagccgttgctctccaggagcctcgcaaattgtcatacgctgaggtatgtcagaaaccacctaaggaaccttcaagtgtgctcgtgcagccgttgagggagttgaggtcaaacgtcgtgtcgccaaccaaaaatgaggacaacggggctcccgaaaatagcgtcgaaaagccccacgagaagccagaggcccgcgctagtaaagactattccggttttcgtggtaacatcatcccccgaggggctgctggtaagatcagagagcagcgaaggcagttctcccatcgggcaattccgcaaggggtgacacgtaggaacggaaaggagcagtatgttcctcctaggagccctaaatag

SEQ ID NO: 48356 - DNA, 1962 bp, Artificial Sequence
  Description of Artificial Sequence: Synthetic coding sequence
atgctgctgttcgtggagcaggtggccagcaagggcaccggcctgaaccccaacgcaaaagtatggcaggaaatagccccaggaaatactgacgccacccctgtgacacacggcaccgaaagcagctggcacgaaatcgccgccacatctggagcacatccagagggaaatgcggagcttagtgaagacatctgcaaggaatatgaggtgatgtatagcagttcttgtgaaacaacaaggaataccacaggcatcgaggagtccactgacggcatgatactggggcccgaggatttgtcttaccagatctatgatgtgtctggagagtcaaattcagccgtctctaccgaagatttgaaggagtgtttaaagaaacagctagagttctgcttttctagggagaatctctctaaggacctgtacctgatcagccagatggattctgatcagttcatcccaatctggaccgtagccaatatggaagagataaaaaagctcaccaccgaccccgatctgatcttagaggtactgaggagttcccccatggtgcaggtggacgagaagggcgagaaggtgagacctagtcataagaggtgtattgtgatcctgagggagattccagagactacccctatcgaggaggtcaagggcttgttcaagagcgaaaactgcccgaaggtcatctcatgcgagtttgcccacaactcaaattggtatattacctttcagtcagacaccgacgcacaacaggctttcaaatatcttcgtgaggaggtgaaaacctttcagggcaaacccatcatggcacctttcccaaatggctccttcgtcaatgggttcaactctcccggctcatataagactaacgccgccgccatgaacatggggcgcccttttcaaaagaatcgggtgaaacctcagtttcgctcctctgggggatcggagcactcaaccgaagggagtgtgagcttgggcgacggccaattgaataggtactcgtcacgcaattttcccgcggagcgtcacaacccgaccgtaaccggacatcaggagcagacatacttgcagaaagagacatcaacactgcaagtggaacaaaacggcgattacggacgaggccgcaggaccctttttcgcgggcgcaggagaagagaagacgatcggatctcacgaccacacccctcaaccgcagagagtaaagcccctacacctaagttcgacttactcgcatccaacttcccacccttaccagggagctccagtagaatgcctggcgaactggtactggaaaaccggatgtccgatgtggtcaagggagtgtataaagaaaaagataacgaggaactcaccatctcgtgcccagtccccgccgatgagcagaccgaatgcacttccgcgcaacagcttaacatgagcacatcatcaccatgtgccgcagaactgaccgccttgtctacaactcagcaggaaaaagacctcattgaggacagcagtgtacagaaagacgggctgaaccagaccacaattccggtctcccccccgtcaactaccaagcctagtcgagcatcaacagcttccccctgtaataacaacattaacgccgcaaccgccgttgctctgcaggaacctcgcaagttgtcttacgctgaggtctgtcagaaaccacctaaggaaccgtcatccgtcttagtccaaccccttcgcgagctcagaagcaacgttgtcagccccacaaaaaatgaggataacggggcacccgagaactcagtcgaaaagccccatgagaagcccgaggcccgtgccagcaaagattactctggtttcagaggaaatattatccctcgaggagctgccggaaagattcgcgaacagcgtaggcagtttagccaccgggccataccccagggagtgacaaggaggaatggaaaggagcagtacgtgcctccgcgtagccccaagtag

SEQ ID NO: 48357 - DNA, 1125 bp, Artificial Sequence
  Description of Artificial Sequence: Synthetic coding sequence
atgctgctgttcgtggagcaggtggccagcaagggcaccggcctgaatcctaatgcaaaagtctggcaggagatcgcccctggaaacaccgacgccacgcccgtaactcacggcacggagagctcctggcacgagattgcagcaactagcggcgcccatcccgaaggtaatgcagaactcagtgaagacatctgtaaggaatacgaggtcatgtacagctcgtcttgcgagaccaccaggaacaccaccgggatcgaggaatcaacagatggaatgatactcggccccgaagatttatcatatcagatctacgacgtgagcggagagagtaatagcgctgtctccacagaggacctgaaagagtgtttaaaaaagcagcttgagttttgtttctccagggagaacttatctaaagatttgtatctgattagccagatggactccgatcagttcattcctatctggaccgtagccaacatggaggagatcaagaaactgaccacagacccggatttaatactggaggtgctgcggtccagtccaatggtccaggttgacgagaaaggcgagaaggtccggccgtcacacaaacgctgcatcgttattctcagggagatacccgagacgacccccatcgaggaagtcaaaggactgttcaagtccgaaaattgcccaaaggttatatcctgcgagttcgcccacaatagtaattggtacataactttccagagcgacacagatgcccaacaggcgtttaagtatctgcgcgaagaggtgaaaactttccagggcaagccaatcatggctcggattaaggccatcaatactttctttgctaagaacggctaccgtctgatggactcctcaatctacagccaccccatccagactcaggcccagtatgcttctccagttttcatgcagccagtgtataaccctcatcagcaatatagcgtttactctatcgtaccccaaagctggagtccgaatcctactccatatttcgaaacccccttggcaccattcccaaacggctcctttgtgaacgggttcaacagccccggatcatataaaacgaacgccgctgctatgaacatggggaggccattccagaagatcgtctag

SEQ ID NO: 48358 - DNA, 2175 bp, Artificial Sequence
  Description of Artificial Sequence: Synthetic coding sequence
atgctgctgttcgtggagcaggtggccagcaagggcaccggcctgaatcccaatgctaaagtatggcaggaaatagctccaggcaacacagatgccaccccagtgactcacgggactgagtcgtcttggcacgaaatcgccgcaacgagtggagctcacccagagggaaatgccgagctgagtgaagatatatgcaaagagtacgaggtgatgtactccagcagctgcgagactacccgcaatacgacaggcattgaagagtctactgacggcatgattcttggccctgaggacctctcgtaccagatctatgacgtctctggcgaaagcaattccgctgtgagcacagaggatctgaaggaatgtcttaagaagcagttagagttctgcttctctcgtgaaaatttaagtaaagacctgtacttaatatctcaaatggactccgatcaattcattcctatttggacagtcgcaaatatggaagagattaaaaagctgactactgacccagatctgatcctagaggtgctgcgatcgagtccaatggtgcaggtggacgaaaagggcgaaaaagtgagaccctcacacaagcgatgcattgtaatcctcagagaaattccagaaactacacctatcgaggaggtgaagggcctctttaaatcggaaaattgccctaaagtgatctcttgtgaatttgcgcacaactccaactggtacatcacatttcagtcagacactgacgcccagcaagcctttaagtatcttagagaggaggtgaagactttccaaggaaagcctatcatggcgagaattaaggccataaacaccttttttgccaagaacggctaccgactgatggattcgtcaatctacagtcatccgatccagacccaagctcagtatgcctcccctgtgtttatgcagccagtctataatccacaccaacagtatagcgtgtactctatcgttccacagagttggtcacccaatccaactccatattttgaaacccccctggctcctttccctaatggctcatttgtgaatggttttaacagtcccggcagctacaaaactaacgccgctgcaatgaacatggggagacctttccagaagaaccgtgtgaagccgcagttccgttcaagcggcggctccgaacacagtactgaggggtctgtgagtctcggagacggacaactgaaccgttactcgtctcggaatttccccgctgagcggcacaatcccaccgttaccgggcaccaagaacaaacttatctgcaaaaagagacttcgacccttcaggtggagcagaatggggactacgggcggggtcgtcgcaccctgttccgtggccgccgacgcagagaggacgacaggatttctcgcccacatccttccaccgcggaaagtaaggcccctacaccgaagttcgatctgctggcatctaactttccgccactgcctgggtcttcgtctcgcatgcccggagaattggtgctcgaaaacagaatgagcgacgtagtcaaaggggtgtataaggagaaagataatgaagaactcacgattagctgcccggtacccgcagatgagcaaacagagtgcacctccgctcagcagttgaacatgtctacatcttccccatgcgccgccgagttgaccgctctgagcacaacacagcaggagaaagatcttattgaggactcaagtgttcaaaaagacggcctgaaccagacaactatcccagtttcaccccccagcaccaccaagccgtcgagagcttcaacagctagcccatgcaataataacatcaatgccgccaccgctgtggccctgcaggaacctcgcaagctgagctacgccgaggtgtgccaaaagccgcctaaggagccgtcatcggtgttggttcagcccctgcgggaactacggagcaatgtggtgtctccaaccaaaaacgaagataatggcgcacccgagaactctgtggagaagccacatgaaaagccagaagcccgggccagtaaagactattccgggtttcgggggaatatcatacctcgaggcgcggcggggaagattagagagcaacgcagacagtttagccatagagccataccacagggcgtgacccgcaggaatggcaaggaacagtatgtgccgcctaggtcacctaagtag

SEQ ID NO: 48359 - DNA, 2193 bp, Artificial Sequence
  Description of Artificial Sequence: Synthetic coding sequence
atgctgctgttcgtggagcaggtggccagcaagggcaccggcctgaacccaaatgcaaaagtgtggcaagagatagctcccggcaacactgatgctactccagtgacgcatggaacagagagcagttggcatgagatcgccgcaacttccggcgctcatccagaggtgtcagtctttaatacaggaaacgccgaactgtctgaggatatttgtaaggagtatgaagtaatgtactcttcgtcatgtgagaccacacgtaataccaccggtattgaggaaagcacggatggcatgattctggggccagaggatctaagctaccagatctatgatgtctcaggcgaatctaactcagcagtgagcaccgaagacctcaaggaatgcctcaagaagcaattagagttttgtttcagcagagaaaacctgtctaaggatctatacctgatatcccagatggatagcgaccagttcatcccaatctggacggtcgccaatatggaggaaataaagaagttaacgactgaccccgatctcatactggaagttctgcgcagttcccctatggtgcaagtcgacgagaaaggcgagaaggttaggccctctcataaaaggtgcatagtgatcttgagggagataccagagacaaccccaattgaagaggttaaaggcctgttcaaatctgaaaactgcccaaaggtcatcagttgtgagtttgcacataactccaattggtacatcacgttccagagtgataccgatgcccaacaagcatttaaatatctgcgcgaggaagttaaaactttccaggggaagcccattatggctaggataaaagctattaacaccttcttcgcaaagaacggctaccggctgatggactccagcatttatagtcatcctatacaaacccaggcacagtatgcttcgccagtgttcatgcaacccgtctacaatcctcaccaacagtacagcgtatatagcattgtacctcagtcctggagccccaaccctacgccttacttcgaaactcctttggcgcccttcccgaacggatcgtttgtgaacggatttaactcccccggaagctataaaacaaatgcagccgctatgaacatgggccgcccttttcaaaaaaacagagtcaagcctcagtttaggagctccggagggagtgaacacagcacagaggggtccgtgtccctgggcgatggccagcttaataggtattctagtcgcaatttccctgcagagcgtcacaacccgacagtcaccggccatcaggagcagacctatctgcaaaaagaaacctccaccttacaagtagagcagaacggcgattacgggcgggggagacgaaccctgttccggggacgacgccggagggaagacgatagaatatcccggccccatccgtctactgcagagagcaaagcccctacaccaaaatttgatctactggcctccaactttccaccgctcccagggagcagctcacgaatgcctggggagctcgtattggagaatcgcatgtcagacgttgtgaaaggtgtctacaaggaaaaggataacgaagaattgacaatttcatgtccggtccctgcagatgagcagacagagtgcacgagcgctcagcagctcaacatgagtacatcttccccctgtgccgccgagctgaccgctctgtctaccactcagcaggagaaggacctcatagaggatagctccgtgcagaaagacggactgaaccaaaccacaatccctgtgagcccaccctctactacgaagccatcccgggcgagtaccgcctccccctgcaataacaacatcaacgctgctactgccgtggctctgcaggagcccagaaagctgagctacgctgaagtatgtcaaaagcctcctaaagaaccatcaagcgtactggtgcagcctctgagggaattacgctctaatgtggtatcccccaccaagaatgaagacaacggagctcccgaaaatagtgtcgagaaaccccatgaaaagcctgaggcgagagcaagtaaagattatagtggcttccgaggtaatattatcccgagaggcgctgcaggtaaaattcgagagcagcgcagacaattctctcacagggctatcccccagggtgttacgcggagaaatggaaaggagcagtatgtcccccctagaagccctaagtag

SEQ ID NO: 48360 - DNA, 567 bp, Artificial Sequence
  Description of Artificial Sequence: Synthetic coding sequence
atgtacagcagcagctgcgagaccacccggaacaccaccggcatcgaagagagcactgacggcatgatattggggccagaggacctgagctatcagatttatgatgtttccggcgagtctaattctgcggtatcaacagaggacctgaaggagtgcttgaagaaacagttagaattttgttttagccgcgagaacttaagtaaggacctctaccttatttcacagatggactctgaccagttcataccaatctggacagtggctaacatggaggagattaagaagctgacaactgatcctgacttgattctggaagtgctgcggtcttccccaatggtgcaggtagacgagaagggggagaaggtgaggccaagccataaacgatgcatcgtcattcttcgagaaatcccagagacaacccccatcgaagaggtgaagggtttgtttaaaagtgaaaactgtcccaaggtaatctcctgcgagttcgcccacaatagtaattggtatatcacctttcagtccgacaccgatgctcaacaagcctttattctgaagaggagatcttag

SEQ ID NO: 48361 - DNA, 2172 bp, Artificial Sequence
  Description of Artificial Sequence: Synthetic coding sequence
atgctgctgttcgtggaggtggccagcaagggcaccggcctgaaccccaatgctaaggtttggcaggaaattgcgcctggcaacacagatgccaccccagttacccacggaaccgagagtagctggcacgagatagcagccacctctggggcgcatcccgaaggcaatgccgaactgagcgaagacatttgtaaggagtacgaggtaatgtattccagttcctgcgagactactagaaatactaccggtatcgaagaatcgactgatggcatgatcttgggacccgaagacctgtcctatcagatctacgatgtaagtggcgagtctaactccgctgtctccacagaggatttaaaagagtgtctcaagaaacagctcgagttttgcttcagcagagaaaatctttctaaggatctctacctgataagtcagatggattctgaccagtttatacctatttggacagtggccaacatggaggaaataaagaagctcaccaccgatcccgatttaatcctggaagtgttgcggtcgagtcccatggttcaagtagatgagaaaggagagaaggtgagaccatctcataagcggtgcattgtcatattaagggaaattccagaaaccacccctatagaagaagtgaaaggtctgtttaaaagcgagaattgccctaaggtcatctcttgcgagttcgctcacaacagcaactggtatattactttccagagcgataccgatgcgcagcaggcttttaagtatctgcgggaggaggtgaaaacatttcagggaaaaccaatcatggcccgcattaaggcgataaatacctttttcgccaaaaacggttaccgcctaatggattccagtatatactcccaccctattcagactcaagctcagtacgcctctccggtgtttatgcaaccagtgtacaacccccaccaacagtactccgtgtatagcattgtaccccagagctggagccctaatcccaccccatatttcgaaaccccacttgctccttttcccaacgggagcttcgtgaacgggttcaatagcccaggatcatacaaaacaaacgcagccgcaatgaatatgggccgcccatttcagaagaatagggtcaagccccagtttagatcgagtggcgggtctgagcactctaccgaaggtagcgtgagcctcggcgatggacagctgaatcgctactcttccagaaacttccccgctgagaggcataatcctaccgtaaccggtcatcaggagcagacctacttacagaaagagacgtcgacactgcaggtggagcagaacggcgactacggccgcggccgcagaacactgtttcgagggcgcaggcggagggaggacgataggatatcacggccccacccttcaacagcagaatcgaaggcgcctacacctaagtttgacctgctcgctagcaacttccctcctctgcccggatccagctcaaggatgcccggcgaactagtcctggagaatagaatgagtgatgttgttaaaggtgtatacaaggaaaaggataatgaagagctgaccatctcctgcccagtccccgcagacgagcagacagagtgtacctccgctcagcagctgaacatgtcgacctcttcaccttgcgctgcggaattaaccgcactatccaccacacagcaggagaaggacttgattgaagactcatccgtacagaaggacgggcttaatcaaacgactatccccgtgagccccccctcgaccactaagcctagtcgagcaagcactgcgtctccttgtaataataacattaatgccgctactgccgtggcactgcaggaacccaggaagctcagttatgctgaggtgtgtcagaaaccacctaaagagcctagcagtgtccttgtccagccactgcgcgaactgcgctctaacgttgtgtcaccaaccaaaaacgaagataacggagctccagagaactctgtggaaaaaccgcacgaaaaacccgaagctcgcgcctctaaagattactcaggattccgagggaacatcattcctcggggggcagctggtaagattcgagagcagcggaggcagttcagccacagagcaattcctcagggggtgaccaggcgtaatggtaaggaacagtacgtgcctccccggtcaccaaaatag

SEQ ID NO: 48362 - DNA, 2217 bp, Artificial Sequence
  Description of Artificial Sequence: Synthetic coding sequence
atgaccagcgaccaggacgccaaggtggtggccgagccccagacccagcgggtacaggaggggaaagattccgcccacctgatgaatgggcccatttcacagacaacatcccaaacgtctagtattccacccctgtcccaggtcccagccactaaggtgagcgaactgaatcccaacgctgaagtttggggcgcacccgtcctgcatctagaagcaagttctgccgcagacggggtgagcgccgcctgggaggaggtggccggacatcacgctgacagaggaccccagggaagtgatgccaacggcgatggtgatcaggggcacgaaaatgccgccctccctgacccacaggagtctgaccccgcagacatgaatgctctggccctgggacctagcgaatatgattctctcccagagaattccgaaacaggcgggaatgagtcccagcctgactctcaggaggatcctagggaagtgctgaaaaaaactctggagttttgcctgtcacgcgaaaacttggcaagcgacatgtacctgatcagtcaaatggactctgaccagtatgtacccattactacagttgctaatctcgaccatatcaaaaaactaagcaccgacgttgatctcatcgtcgaggtgttgcgttccctccccttggtgcaagtagacgagaaaggggagaaagtcagacccaaccagaatcgatgcatagtgatcctgagagagatttcagagagcacaccagtcgaggaggtcgaagccttgtttaagggcgataacctgccaaagtttatcaactgcgaattcgcctataatgataactggttcattaccttcgaaaccgaggctgacgcacaacaggcttacaaataccttagggaggaggtgaaaacttttcaggggaagccaatcaaagctcgcatcaaggccaaagctattgccatcaacacctttctcccaaagaatgggtttcggccactggatgtatccctgtatgcacagcagaggtatgcaacaagcttctactttcctccaatgtacagcccacagcagcagttccccctgtatagcttgataacaccacagacttggtcagctactcattcgtatctggaccccccccttgtgactccatttcctaatactgggttcataaatggatttacttcacccgcattcaaaccggctgcttcccccttgactagcctcaggcagtacccaccaaggtcccgcaacccttctaaatctcacttaaggcatgctatcccctcggccgaacggggtccgggtcttctcgagtccccctccatctttaattttaccgctgatcgtctgataaatggagtccgatcgccacagacgcgtcaggcaggacagacgcgcacccgtattcagaatcctagcgcctacgctaagcgggaggccgggccaggacgtgtggagccaggcagtctagaatcttcccccggactcggtcggggtaggaagaatagctttggttacaggaagaagcgagaagagaagtttaccagtagccaaacacagtctccgactccacccaagcccccctccccctcctttgaactggggctctcctctttcccccccctgcccggagcagccggaaatcttaagactgaagacctttttgagaacagactgtctagtcttataattggtccaagcaaggaacgcaccctgtccgctgatgccagtgttaacaccttgccggtggtcgtgagccgggagcccagcgtacctgcctcatgcgctgtgagtgccacgtacgagcggtcaccttcgccagcccaccttccagatgatccaaaggtagccgagaagcagagagagacgcatagtgtggatcgattgccgtctgctctgaccgccacagcttgtaagtccgtacaggtcaatggcgctgccacagaattacgcaagccatcatatgccgagatatgtcagagaacttccaaggagcctccttcctccccgttgcagccacagaaggagcagaaaccgaacaccgtggggtgcggaaaggaggagaaaaagttagcggaacccgccgagcgataccgcgaaccacctgccctgaagtccaccccaggtgcaccacgggaccagcggcgccccgctgggggtagaccctctcctagcgccatgggcaaaaggctgagccgggaacagtccacgcctccaaaatctccccagtag

SEQ ID NO: 48363 - DNA, 396 bp, Artificial Sequence
  Description of Artificial Sequence: Synthetic coding sequence
atgaccagcgaccaggacgccaaggtggtggccgagccccagacccagcgtgtacaggagggcaaagattccgctcacctgatgaatggccccatttctcagactacatcccaaacatcatccataccacccctgagccaggtacctgctacgaaggtgagcgagctaaacccaaatgcagaggtctggggcgcgccagtccttcatctcgaagcgtcatccgccgccgacggcgtctccgccgcgtgggaagaggtcgccgggcatcatgctgacaggggacctcaggggtctgacgccaacggcgatggcgatcagggccatgaaaatgcggccttaccagatcctcaggagtccgaccccgcggatatgaatgccctggcactagggccatag

SEQ ID NO: 48364 - DNA, 174 bp, Artificial Sequence
  Description of Artificial Sequence: Synthetic coding sequence
atgaccagcgaccaggacgccaaggtggtggccgagccccagacccagcgggtccaggaaggcaaagattccgcccatttgatgaacggcccgatttctcagactacatcccagacgagctccatcccgcctctgtcacaggttcctgccacaaaggtgtctgaactgaattag

SEQ ID NO: 48365 - DNA, 552 bp, Artificial Sequence
  Description of Artificial Sequence: Synthetic coding sequence
tgaagcttcgagctgggcctgagcagcttcccccccctgcccggcgccgcaggcaacctcaagacggaggatctctttgaaaaccggttgtcttcactcatcatagggcccagcaaggagaggactctgagcgctgatgcctccgttaataccttgccggtggttgtaagccgggagcctagcgttccggcaagctgcgccgtgtcggccacctatgaaaggagcccgagtccagcccacctgcctgacgaccctaaggtggctgagaaacagagggagacacatagcgtcgataggttaccttccgccctgacagcaaccgcctgtaaaagtgtgcaagtcaacggggctgcgaccgtgcggacgtcctgcctgccctcatgtactacggccgcacgactgtggtgtgagcagacactgagaacgcctgcccccgcacggttcctgatcacgtcgaatctggtgggattctatctgaggctgagcgtactgtgctttctctacaaaatcccccttatcttcgcgaacaactttcccttgaccactctgtag

SEQ ID NO: 48366 - DNA, 1020 bp, Artificial Sequence
  Description of Artificial Sequence: Synthetic coding sequence
tgaagcatcttcaacttcaccgccgaccggctgatcaacggcgtgcgaagcccgcagactcgccaggcgggtcaaactaggactcgcattcagaatccatcagcctacgcaaaacgcgaggccgggcctggccgggtggagccaggaagtctcgaaagctcgcctggccttggacgcggccgtaaaaatagcttcgggtatcggaaaaagagagaggagaagtttaccagctcacagacacagtctccaaccccaccaaaaccccctagtccgtctttcgaactcgggctgagctcttttccccccctccccggagctgcaggaaacctgaaaacggaggatctgttcgaaaatcgcttgtcctctctgatcatcggaccttccaaagagcgcacccttagtgcggacgcaagtgtcaatactcttcctgtagttgtgagccgtgaaccctccgtgcccgcttcatgtgccgtctctgcaacatatgaacgcagtccctcacctgctcatctgccagacgaccctaaggtggccgagaagcagagagagacgcactccgtggacagattgccgtccgccctgactgcgaccgcttgtaagtccgtccaagtgaacggtgccgccaccgtacgcacgtcctgcctgccctcttgcacaacagcagcacgactgtggtgcgaacagacgctacggacgcctgcccccgcccgctttcttatcaccagcaacctagaactgagaaagccaagctatgctgagatttgccagaggacatccaaagagccaccttccagcccgcttcagccccagaaagagcagaagccaaatacagtgggctgcggaaaagaggagaaaaagctggccgaacccgccgagaggtaccgggagcctcctgccctaaagtctacccccggagcgccacgggatcaacggagacctgcgggcggtcgccccagtccaagtgccatgggcaaaagactgagtagggagcagtctaccccgccaaaaagcccccagtag

SEQ ID NO: 48367 - DNA, 1293 bp, Artificial Sequence
  Description of Artificial Sequence: Synthetic coding sequence
atggccgaggccgtgctgatcgacctgttcggcctgaagctgaactcacagaaaaactgtcaccagaccctgctgaagaccttgaatgccgtgcaataccatcacgcagctaaagccaagttcctgtgcatcatgtgctgttccaacatatcatatgagcgagatggtgaacaggataattgtgaaatcgagacttccaacggactttccgccctgttagaggagttcgagatcgtgtcatgtcccagtatggcggccactctgtataccataaaacagaaaatagacgaaaagaatttaagctctataaaagtgattgttccccgccataggaaaactctgatgaaggcgttcatcgatcagttgtttaccgacgtgtacaactttgagtttgaggatctgcaagtgaccttccgaggaggattgtttaaacagtctatagaaatcaacgtgatcaccgcccaggaactccgaggtattcagaacgaaattgaaacctttctgcgaagtctcccagctcttcgaggcaaactaaccatcataacgagctcactcatccctgatatctttattcatgggtttaccacacgaaccgggggtatatcctatatcccgacgctgagttcctttaacctatttagcagctccaagaggcgcgatccaaaggtagttgtgcaggaaaacctccgtcgcttagcgaatgccgcaggattcaacgtcgaaaaattttaccgcatcaagactcaccactccaatgacatttggattatgggccgtaaggaaccagatagttatgatggcatcaccaccaaccagcgaggagtgaccatcgccgctttgggagccgactgtatccccatcgtctttgccgatcctgttaaaaaggcttgcggcgtagcccacgctggctggaagggcactttgctcggcgtggccatggccacggtgaacgccatgatagcagagtacggctgctcccttgaagacatagtggtagtattgggccccagcgtcgggccatgttgtttcacactgccccgcgaaagcgcagaggcattccacaacttgcatcccgcctgcgtgcaactgttcgactccccaaatccttgtatagatatcagaaaggccacacgcatactgctcgaacagggaggtatcttgccgcaaaacatacaggaccagaatcaggacctcaacctgtgcacatcttgtcaccctgacaagtttttctctcacgtccgggatgggcttaactttgggacgcaaatcgggtttatttcaattaaagagtag

SEQ ID NO: 48368 - DNA, 495 bp, Artificial Sequence
  Description of Artificial Sequence: Synthetic coding sequence
atggccgaggccgtgctgatcgacctgttcggcctgaagctgaacagtcagaaaaactgccaccagaccttgctcaaaaccttgaacgcggtccagtatcaccatgcagcaaaagccaaatttctgtgtattatgtgttgctctaatatatcttatgagcgggatggcgagcaggacaattgcgaaatcgaaactagcaacggccttagcgctctgctggaggagttcgaaatcgtatcttgtccgtccatggctgcaactctttatacaatcaaacagaaaattgatgaaaagaaccttagtagcatcaaagtgattgtacctaggcacagaaagactctgatgaaggccttcattgaccaattatttaccgacgtgtataatttcgagtttgaggatttacaggtgacctttcggggaggtcttttcaagcaaagcattgaaatcaatgtgattactgctcaggagcttaggggcattcagaatgaaatttag

SEQ ID NO: 48369 - DNA, 1293 bp, Artificial Sequence
  Description of Artificial Sequence: Synthetic coding sequence
atggccgaggccgtgctgatcgacctgttcggcctgaagctgaactcccaaaaaaattgccatcagaccttacttaagactctcaatgccgtgcagtaccatcatgctgcaaaagctaagttcctgtgcatcatgtgctgttctaacataagttatgagcgcgacggagagcaggacaactgcgagattgagacatcgaatggcctgtcagcactacttgaagaatttgagattgtctcctgtcctagcatggcagccaccctgtacaccatcaaacagaaaatcgacgaaaagaaccttagctctatcaaggttattgtacccaggcaccgcaagacgttgatgaaggcatttatcgaccagctgtttactgacgtgtataacttcgagtttgaggatctccaggttacctttagagggggcctcttcaaacagagcattgaaatcaatgtgataaccgctcaagagctgcgcggtattcaaaatgagatagaaacttttctcaggagccttccagcactacgcggtaaactgacaatcatcacttccagccttatccccgatatctttatacatggtttcaccacccgaacaggtggcatttcttatattccgacactgtcgtcattcaatctcttctcctccagcaagaggagggaccctaaagtggtggtgcaggagaaccttcgccgactggcgaacgctgcagggtttaacgtggaaaagttttaccggatcaaaacacaccactccaatgatatctggattatgggacgtaaggagccagacagctacgacggtattaccactaatcagaggggagtgaccatcgccgccctaggggcagattgcataccaatcgtgttcgccgacccggtgaaaaaggcatgtggtgtcgctcatgccggctggaagggcactttactgggggtggcaatggcgaccgtcaatgccatgatcgcagaatacggttgcagccttgaggatatagtggttgtgctgggccctagtgttggcccctgttgttttactctgccgagggaaagtgctgaggcttttcataaccttcacccggcgtgcgtccagttattcgactccccaaacccctgcatagacattcgtaaagccactagaattttattggagcaaggcggcatcctaccacagaatatccaggaccagaaccaggacctcaacctgtgtaccagttgtcatcccgacaaattcttttctcatgtccgggatggcctgaatttcggtactcaaatcggcttcatttccattaaggaatag

SEQ ID NO: 48370 - DNA, 5472 bp, Artificial Sequence
  Description of Artificial Sequence: Synthetic coding sequence
atggccctgagcagcgcctggcggagcgtgctgcccctgtggctgctctggagcgccgcctgttcgagggccgcctccggggatgataacgcctttccctttgacattgagggatcctcagctgtaggccgccaggacccacctgaaacgagcgagcctagagtagcactgggcaggttacctccagcggcagaaaaatgcaacgcgggattcttccacaccttaagtggcgagtgtgtgccctgtgattgtaacggcaacagtaatgagtgtctcgacggcagcggctactgcgtccactgtcagcggaatactacaggggaacattgcgagaaatgccttgatggctacataggcgactctatcaggggagccccgcagttctgccagccctgcccctgccccttgccacatctggccaacttcgccgagtcttgttatcgcaaaaacggtgccgtccgctgcatttgtaatgaaaactatgcaggaccaaattgcgaacggtgtgcccccggttactacggtaatcccctgctgatcggaagcacctgcaagaagtgtgactgttccgggaacagtgaccccaatctgatatttgaagattgcgacgaagttacgggccagtgtagaaactgcctgcgcaatactactggctttaaatgtgagcgatgcgctccagggtactacggtgatgcccgcattgcaaaaaattgcgcagtgtgcaattgtggaggtgggccttgcgacagcgttactggagagtgtctggaggaaggtttcgagccacccaccggaatggattgcccaactatctcctgcgacaagtgtgtgtgggacttgaccgacgacctccggctggccgcgttgagcatcgaagaaggtaaatctggagtgctctctgtctcatctggagcagctgcacaccgacacgtaaatgagattaatgcaaccatttacctgttaaaaaccaaactgtccgagcgggagaatcaatacgctcttcgaaagattcagatcaacaacgctgaaaacaccatgaagagcctgctgtccgacgtcgaggagctcgtggagaaagagaaccaggcctcccgtaaagggcagttagtgcagaaggaatccatggacaccatcaaccacgcaagccagctcgttgagcaggcccatgacatgcgggataaaatccaagaaattaataacaagatgctatactatggcgaggaacacgagcttagtccaaaagagatttccgaaaagctggtgctcgcccagaaaatgctcgaagaaatccgcagtcgtcagccgttttttacccagcgagaactcgtggatgaggaggctgatgaagcttacgagctgctgtcccaggcagagagctggcagcggctacataacgaaacacggacgctctttcctgtggtactggaacaactggacgattacaacgctaagctgtcagatctgcaggaagccctagatcaagcgctaaactatgtaagagatgctgaagacatgaaccgggctacagccgccagacagcgcgaccacgagaaacagcaggaaagggtgcgggagcagatggaggtcgttaatatgtctctgtccacttctgcagactcactgactacacccaggcttacactatccgagttggacgatattattaaaaacgcctccggaatctacgccgaaatcgacggagcaaaatccgagctgcaggtgaaacttagtaacctcagcaaccttagccacgacctcgtgcaagaagccattgatcacgcacaggatttgcagcaagaagccaatgagctttcaaggaaactccacagtagcgatatgaacggactagtgcagaaagccctggacgccagcaatgtctacgagaatatcgttaactacgtgtcagaagctaatgagaccgccgagtttgcactgaatactaccgatcgcatctatgacgctgtctctggtattgacacccaaattatatatcataaagacgagtcggaaaaccttctcaatcaagccagggaattacaggcgaaggctgaaagctcttccgacgaggccgtggcagacacctcccggcgcgtgggaggagccctcgcacgcaagtcagcattgaagacccgcctgtccgatgcagtcaaacaactgcaagcggccgaacggggtgacgcccagcagaggctcggacaatcacgactgatcacggaagaagcaaataggactacaatggaggtgcagcaggctacagcaccaatggcgaacaacctcacaaactggagccagaaccttcaacacttcgactccagcgcctacaatactgcagtgaatagtgcccgggacgcagtgcgcaatctcacagaagttgttccccaactgttagaccagctgcgtactgtggaacagaaaaggcctgcctcaaatgtgtccgcatccatacagaggatccgagagctcatcgcccagacccggtcagtcgccagcaaaattcaagtgtcgatgatgtttgacgggcagtccgcagtcgaggtccatagccgtacttcaatggatgatttgaaggcttttacatctctgagcttatacatgaagcctccggtcaaacgacccgaactgacagagacagcagatcaatttatactttacctgggaagtaaaaatgccaagaaagagtatatgggcttggcaataaagaatgacaacctggtgtacgtatataacctggggaccaaagatgtggagataccccttgacagcaaacctgtctcttcatggcctgcctatttcagcatagttaagatcgaacgtgtgggcaagcatggcaaggtattcctaaccgtaccaagcctaagctctacggcagaggaaaagtttataaagaaaggcgagttttccggggatgacagcctcttagacctagatcctgaagatacagttttctacgtcggaggggtgccatcgaatttcaagctcccaacctctctcaacctgcccggattcgttgggtgtctggaacttgcaactctgaacaatgatgttatctcactatataacttcaaacatatctataacatggatccatctacctcggtgccatgcgccagagacaaactggccttcacccagtctagggctgcctcctacttttttgacggttccggctacgccgtggtgcgggacataacgcggcgtggaaaattcggccaggttaccagatttgacattgaggtgaggacccctgccgacaatggacttatcctccttatggtcaatggctctatgttcttcaggctggaaatgaggaacggctatctgcatgtcttctatgacttcggtttttctggtggtccagtacacttggaagataccctgaagaaggcccagatcaatgatgctaagtaccacgaaatctccatcatttatcacaatgataaaaaaatgattctggtggtggaccgacgtcatgttaagtcgatggacaacgaaaagatgaagattccgttcaccgacatttacattggcggagcaccaccagagattctgcaatctcgagccctgcgggcgcacctccccttagatatcaattttcgaggatgcatgaaaggcttccagttccagaaaaaagatttcaatttgttagagcagacggagacactcggggttggctatgggtgtcctgaggattctcttatctctcgacgcgcttacttcaacgggcaatcattcatcgcctcgatccagaagattagcttttttgacggattcgaaggggggtttaatttccggacgttgcagccaaacggcctcctgttttactacgcctccgggtctgatgtattttccatttctctggacaatggcacagtgattatggatgttaaggggattaaggtccagtccgttgataagcaatacaatgacggtctctcacactttgtaatcagctcagtgtccccaactaggtatgaactcattgtggacaaatcccgagtaggctccaaaaacccgaccaagggcaagattgagcagacacaagcctcagagaaaaagttttacttcggaggaagccctattagcgctcagtacgcaaactttactggctgcatctctaacgcttactttacacgagtggatcgggatgtggaagtggaagatttccaaagatataccgaaaaggtccacacctccctttatgagtgcccaatcgagtcctcccctctatttctgctgcacaagaagggaaaaaatctgtctaaacccaaggccagtcagaacaaaaaaggaggtaaaagcaaagatgctcccagttgggatcccgtggcgctgaagctacccgagaggaatacgcctcggaattcccactgccacctatcaaacagccccagggccattgagcacgcctaccagtacggaggtaccgctaactcaaggcaggagtttgaacatcttaagggagattttggtgccaagtcgcagttctccatccgcctgagaacacgctcgtcacacggcatgattttttacgtgtccgaccaagaggagaacgattttatgacacttttcctggcccacggacggctagtatatatgttcaatgtgggccacaaaaaattgaaaatcaggagccaggagaagtacaacgatgggctctggcacgatgtgatttttatccgggagcggtcaagcggccgcttagttatagatggcctgcgcgtactggaggaatcattgccccccaccgaagcgacatggaaaatcaagggccccatctacctgggcggggtcgcacccggcaaagctgttaagaacgtgcaaatcaactccatttactcatttagcggttgcttatctaatttacagctgaatggggcttctattaccagtgcatcccaaaccttcagcgtgacaccgtgttttgagggacccatggagaccgggacctacttctccactgaaggcggctatgtcgtcttagacgagtccttcaatattggtttaaaatttgagatcgcatttgaagtgcgaccgaggtctagctcaggcaccctggtgcacggtcactcggtgaacggggagtatctcaatgtgcatatgaagaatggacaggttattgtgaaagtcaataacggcatccgggacttctctacctccgtgactccaaagcaatccttgtgcgatggtaggtggcaccgaataacagtgattcgcgatagtaacgtggtgcaattggacgtcgacagtgaggttaatcacgtggtgggcccattaaacccaaagcccatcgaccatcgggagccggtgtttgtcggcggggtaccagaaagcctcctaaccccgagattggccccctcaaaacctttcacaggatgtataagacattttgtaatcgatggccatccggtgtcctttagcaaagctgcattggtttcaggcgcagtgtcaattaactcttgtcctgctgcctag

SEQ ID NO: 48371 - DNA, 363 bp, Artificial Sequence
  Description of Artificial Sequence: Synthetic coding sequence
atggccctgagcagcgcctggcggagcgtgctgcccctgtggctgttgtggagtgcagcatgctcccgcgccgccagcggagacgacaacgccttcccctttgatattgagggcagttctgcggtagggcggcaggatcctcccgagacttcagaaccacgcgtggctctgggacggctcccgcctgctgcagaggtgcagtgcccatgccattgtcatcccgccggcgcccccgcgccccccagagctgtgcctcattccagctttagcctgagcccacccctctcaagtccccagtgtctcgagagtttcacatgggcccggtccgttaggaagctcgagattaagtctttcccactgtag

SEQ ID NO: 48372 - DNA, 1263 bp, Artificial Sequence
  Description of Artificial Sequence: Synthetic coding sequence
atggacaccaagcggtgcttcgccaaccggttcgacgactaccagggatctttgctggctggacagtgtgaggaagccgtcgctcctttggtcactgctaccatagagaggatattgcaagagcttccccctctggggggaggagcagaggcccgcggggcaacagcgggagcttcggcgtgccaggggggactgtacgggggtgtcgcaggggtagcctacatgctctaccacgtgtcccagagcccgctgttcgctaccgcacgggagcggtatctgcggagcgccaagcgcttgattgatgcctgtgctagggccgaggaatggggtgagcctgacgctgataccagggccgctttcctccttgggggcgccggtgtttatgctgtggcgaccttggtttatcacgctctgggccgcagcgactacgtccagccactgggcaaattccgtgcgttgtgtgcagtatgcgctccagtgtcattcctcgagtgcggaagtgacgaactgtttgtaggccgagcgggctacctctgtgcggccctggtgctgaagcagaagctagcacaagaggtcctcacccctgcccaaattaaaagcatctgccaagccatactggattccgggaagcagtacgcaatcaagaaacgtaaaccattccccttaatgtattcttactatggaacggagtacctgggtgccgctcacgggctgagtagcattctccagatgctgctgtcataccacgagcacctaaaaccttctgatcgggagctggtctggcagtcagtcgactttctgatggaacaagaacagaactgtaattggccacctgagctgggagagaccattgaacgcgagaacgaactggtacactggtgtcatggggcgcctggcatagcctacctctttgccaaggcctatctggtgtccaaaaaaccccagtacctcgacacctgtattaggtgcggtgagctgacctggcagaagggcttgctaaagaaaggacctggaatctgccatggggtagccgggagcgcatacgtgtttctgctgctttatcggctcactggtaactccaagtacatctacagagcacagcgttttgcccagtttctgttcacagaagaattcaaagcaggatcccgggtgttggagagcatctactccctttacgaggggttctcaggcactgtctgctttttgatcgacttgttacagcctaaccaagccgagttcccgcttttttctgttttcgtgtag

SEQ ID NO: 48373 - DNA, 1167 bp, Artificial Sequence
  Description of Artificial Sequence: Synthetic coding sequence
atggacaccaagcggtgcttcgccaaccggttcgacgactaccagggtagcctcctcgccggccaatgcgaggaggccgtggcgccgctcgtcactgctacaattgagcgaatcctgcaggaattaccacctttgggggggggcgctgaggctaggggtgcaactgccggcgcctcggcttgtcagggcggcctttatggaggggtcgctggcgttgcatacatgttataccacgtatcgcagagccctctgttcgccaccgctcgcgaacggtacctccgatcggccaaacgcctcatcgacgcatgcgccagagcagaagaatggggcgaaccggatgcggacacaagagcagcctttctgctagggggcgccggagtgtacgctgttgctactctggtctaccacgctctgggaagatccgactacgtgcagcctttagggaaatttcgggctctttgcgccgtctgtgctccagtctcatttctggaatgcggatcagacgagctgtttgttggccgcgcaggctacctgtgcgctgctttggtgttgaagcagaagttggcccaggaggtcttgacaccggctcagatcaagtctatctgtcaagctatcctggactcaggaaaacagtacgcaattaagaagcggaagccttttccactgatgtatagctactacggcactgaatacttaggcgcggcacacggcctgtcttctattttacagatgctccttagctatcacgagcacctgaaaccaagcgaccgcgaactggtatggcagtctgttgactttttgatggagcaagaacaaaattgcaattggccacccgaactgggcgagacgattgagcgcgagaacgagttggtgcactggtgccacggggcacccggcattgcataccttttcgccaaggcctacttagtgagtaagaagccccagtacttagacacatgcatccggtgcggagaactcacctggcaaaagggtttattgaagaagggccccggaatttgtcacggggtggctgggagcgcgtatgtgttcctcctactctataggctgaccggcaacagcaaatacatctaccgcgctcagagctcttttccagtgaacttgattaaaatggagcatctgttgtatacaagacaacattgtttctag

SEQ ID NO: 48374 - DNA, 243 bp, Artificial Sequence
  Description of Artificial Sequence: Synthetic coding sequence
atgagccagcagaagcagcagagctggaagccccccaacgtgcccaagtgttcacccccacaaaggagcaacccctgccttgctccgtactcaacaccatgtggggcccctcatagtgagggctgtcactctagtagccagagaccggaagtgcagaaaccgcgccgcgccaggcaaaagcttaggtgcctcagccgggggaccacataccactgtaaggaagaggaatgcgaaggcgactag

SEQ ID NO: 48375 - DNA, 4410 bp, Artificial Sequence
  Description of Artificial Sequence: Synthetic coding sequence
atgtggcccagccagctgctgatcttcatgatgctgctggcccccatcatacatgcatttagcagggcaccaatcccaatggcagtggtccgtagagagctgtcatgcgagtcataccccatcgaactgagatgccctgggacagacgttatcatgatcgagtccgccaactatgggcgcaccgacgacaagatttgtgatagcgacccagcacagatggagaatatacgatgttacctgccagacgcatataaaatcatgtcccagcgctgcaataaccgcacacagtgcgccgtggttgctgggccggatgttttccctgacccttgtccagggacatacaagtaccttgaagtgcagtatgagtgcgtgccttacaaggtcgaacagaaagtgtttctgtgcccgggtctgctgaaaggagtttaccagtccgaacatctgttcgaatcagatcaccagtcaggtgcatggtgtaaggacccgctccaagcctcagacaagatttattatatgccatggacgccataccgcacagatactctgacagagtatagcagcaaggatgattttattgccggcagacccacaaccacctataagctgccccacagagtggatgggaccggattcgtagtgtacgacggggcactcttttttaacaaagaaagaacgcgaaatattgtgaagtttgacctgcggactaggatcaaatcaggcgaggctatcatcgccaatgccaattatcacgacacgtcaccttaccgctgggggggaaaaagtgacatagacctcgcggtcgacgaaaacggtttgtgggttatctacgcaaccgagcagaataacgggaaaattgtgatctcacagctgaatccttacaccctaaggattgagggcacttgggacaccgcctatgacaagaggtcagcttccaatgctttcatgatttgtggcatcttatatgtggttaaatccgtatatgaggatgatgacaatgaggcaacagggaataagatcgattacatatataacactgaccagtcaaaagattctctggtggatgtgccgttccccaacagctatcagtacatcgccgctgtcgactataacccccgggacaacctcttgtatgtttggaacaattatcatgttgtgaaatattccctcgattttggccctctcgactcccgatccgggcaggcccatcacggacaggtgtcctatatctctccgcccatacacctggattctgaattggagcgtcctagcgtgaaagacatttccacaacaggccctctcggaatgggttccacgaccacgtccaccacactacgcaccaccacactctcccctgggcggtctacaacgccgtccgtgtccggtcgacgaaaccgctccactagcactcctagtcctgccgtcgaagttcttgacgacatgaccacacatttgcctagcgccagctctcaaatacccgcactcgaagaaagttgtgaggccgtggaggcccgagaaatcatgtggttcaaaaccagacagggacagattgcaaagcagccgtgccccgctgggactataggagtatctacctatctctgcctggcccctgacggaatttgggaccctcagggcccggacctgtcaaattgctcttctccctgggtcaatcatattactcagaaattaaagagcggcgagacagcggctaacatcgctcgggagctagctgaacagacccggaaccacctgaacgcaggggacataacatactctgtgcgcgctatggatcagttggtggggcttcttgacgttcaactcaggaatctgactcccggaggcaaggattcagcagctaggtccctcaataagctccagaaaagggaacgtagctgcagggcctatgtgcaagctatggtggagactgtgaataacctgctccagccgcaggccctcaacgcctggagagacctgacaacttccgatcagctgcgagcagctacaatgctgctccacacagtggaggaatccgcattcgtcctcgccgataacctgcttaagaccgatatagtgagagaaaacacagacaatataaaactggaggtggcacgcctatccacggagggtaacctggaggacctgaaattcccagagaacatgggccatggatcaacaatacagctgtccgccaataccctcaaacagaacggaaggaacggtgagatcagagtcgcctttgtgctgtataacaaccttggaccctatctgtccacagagaatgcaagtatgaagctggggaccgaagcactgtccacaaatcactccgtgatcgttaactctcctgtcatcaccgcggccattaacaaagagttcagtaacaaggtgtacttggccgatcctgtcgtatttactgttaaacacattaagcaatcagaggagaacttcaatcccaattgttctttctggtcatatagcaagcgtaccatgactgggtattggtccacccagggatgcaggctgctgacaacaaacaagactcacaccacttgctcttgtaatcacctgaccaacttcgctgtgctaatggctcacgtcgaagtgaaacatagtgatgctgttcacgacttgctactcgatgtgatcacctgggtgggaatcctcctctcactcgtttgcctcctcatttgcatcttcactttttgcttctttcgagggctgcaatcagatagaaatactattcataagaatctctgtatcagcttatttgtggccgagctcctttttctaatcggaatcaacagaactgatcagcccatcgcttgtgccgtttttgcagcgctgctgcattttttcttcctggcagcgttcacatggatgtttctagaaggcgttcagctgtatattatgctggtcgaggtgtttgagagtgagcactcccgcagaaagtacttttatttagttggttatggtatgcccgcgctgatcgtggcagtttctgcagccgtcgattatcggtcttatggcacggataaggtctgctggctgcggctcgacacttactttatttggtccttcatcggacccgctactttaattattatgcttaacgtaatcttcctggggattgctctgtataagatgttccaccataccgccattctgaaacccgagagcgggtgtctcgataatatcaattatgaagacaaccggcccttcattaagagttgggtcatcggggctattgctctgctgtgcctgttgggcttaacttgggcctttgggctgatgtacattaacgaatcaactgtgattatggcctacctattcaccatcttcaatagtttacagggaatgtttatatttatattccattgtgtgctgcagaagaaggttagaaaggagtatggcaaatgtctgcgcacccattgctgctcaggcaaatccaccgaatcctccattggatctgggaaaaccagcggctcccggaccccaggtaggtactctacaggaagtcaaagtcgcatcaggcgaatgtggaacgacaccgttcgaaaacaatctgaatctagttttatcaccggcgatatcaactccagcgccagtctgaacagggagggcctgctgaataacgcacgcgatacaagcgtgatggacacactgccattgaacgggaatcatggtaacagttattccatcgcctcaggcgagtatctatccaactgtgttcaaatcattgaccgcggctataatcacaatgagacggctctggagaagaagatcctgaaagaactgacgtcaaactacattcctagttatctgaacaatcacgaacgatcatctgaacagaatagaaatctcatgaacaaactggtcaacaacctggggtcaggcagagaggacgacgccatcgtcctcgatgatgcaacatctttcaaccacgaggagagtctgggactggagttgattcatgaggaatctgacgcccccttactgccaccaagagtgtattctaccgaaaaccaccagccgcatcactacacacgacgccgcattcctcaggaccattccgagtccttctttccgcttctgactaacgagcataccgaggatctgcaatccccacaccgagattcattgtatacctctatgcctaccctcgcgggcgttgctgcaacagagtccgttacaaccagcactcagactgagccaccccctgcgaagtgcggagacgccgaggacgtgtactacaaatccatgcctaacctgggaagccgaaaccatgtccaccagctccacacttattaccagctcggccgcggctcctctgatggatttattgtacctccgaataaagatggtactccccccgaagggagtagcaaaggccccgctcatctggtcacttctttgtag

SEQ ID NO: 48376 - DNA, 2013 bp, Artificial Sequence
  Description of Artificial Sequence: Synthetic coding sequence
atgagcctggccgacctgaccaagaccaacatcgacgagcacttcttcggcgttgccttggaaaacaatcggcgaagcgctgcctgcaaacgcagccctggaaccggggatttttctcggaatagcaatgcttctaacaaatccgtcgactactcaaggtcacaatgttcctgtggatcactgagcagccaatatgattattcggaagacttcctctgtgattgctccgagaaagctattaaccggaattacctgaagcagccagtagtgaaggagaaagagaagaagaaatacaatgtgagcaaaatctcccaatctaagggccagaaggaaatctctgttgagaaaaaacacacttggaatgccagcttgtttaattcccagatccacatgatagcacagcggcgggatgcgatggcgcaccgtatcctgtctgccagattgcacaaaatcaagggtctgaaaaatgaactggctgatatgcatcacaaactggaggccattttgactgaaaaccagttcctcaaacagctgcagctgagacacctcaaggctatcggtaagtatgagaactctcaaaataacctgccccagatcatggccaaacaccaaaacgaagtgaagaacctgcgccaactcttgaggaagtcccaagagaaggagaggacactgagccgtaaactccgcgaaactgatagccagctcttgaaaaccaaagacatactgcaagctctgcagaagctgagcgaggacaagaacctagcagagagagaagaacttacccacaaattgtccattatcacaacaaaaatggatgcaaacgacaagaagattcaaagcctggagaagcagctccgactgaattgtcgcgctttcagtcggcagttggccattgagaccagaaaaactctagcagctcagaccgccaccaagactctgcaggtcgaggtgaaacatctacagcagaaactcaaggagaaagacagggaattggagatcaagaacatctattcccacagaatacttaaaaacttgcacgacacggaggattatcccaaggtttcatccactaagtcagtgcaagctgatcgcaagatcttgcccttcactagcatgaggcatcagggtactcaaaagtctgatgttcccccactgaccacaaaaggaaagaaggcgaccgggaacattgatcacaaagaaaagtctactgaaatcaaccatgagatcccccattgcgtgaataagctgccaaagcaggaggattcaaaacgcaagtatgaggatctgagcggagaggagaagcatctggaggttcagattctgctcgaaaacacagggcgtcaaaaggacaaaaaagaggaccaggaaaaaaagaatatatttgtgaaagaagagcaggagctgcctcctaagatcattgaagttatacatcctgagcgggagtctaaccaggaggacgtgctggtccgcgaaaaattcaagcgttcgatgcaaagaaatggggtcgacgatacattggggaaagggacagccccgtacaccaagggccctttgcggcagaggcgacactactccttcacggaagcaacagagaacctgcaccacggcctgcccgcctctggcgggcccgccaatgccggaaacatgcgatactctcactccaccggcaaacacctcagcaacagagaggaaatggagctggagcattccgattcggggtacgaaccttccttcggcaagtccagtagaatcaaggttaaagacacgacgttcagggacaagaaaagttccttaatggaggaactcttcggttcgggttatgtgctcaagacagaccaatccagtcccggagtcgccaaaggctccgaagagcccctgcagtcgaaggagtctcatccactccccccatcacaggcttccacctcgcacgcgttcggcgactccaaggtcacggtggtcaactcaatcaagcccagcagccctaccgaaggaaaacggaaaatcattatctag

SEQ ID NO: 48377 - DNA, 2013 bp, Artificial Sequence
  Description of Artificial Sequence: Synthetic coding sequence
atgagcctggccgacctgaccaagaccaacatcgacgagcacttctttggggtggccctggagaataaccggcgtagcgctgcgtgtaaacgaagccctgggacaggtgatttcagccgaaatagcaatgctagcaataagagtgtggattactcgcgctcccagtgcagttgcggcagcttaagctctcagtacgattactcagaggatttcttgtgcgactgttcagagaaagccatcaataggaattacctaaagcagcccgtggttaaggagaaggagaaaaagaaatataatgtgtcaaagatctcccagagtaaagggcagaaggagatcagtgttgagaagaagcacacctggaacgccagtttgttcaactctcagatacatatgattgctcagaggcgagacgccatggcccatcgaattctctcagccaggttacataaaatcaagggcctgaagaatgagctggctgatatgcaccataagctggaggcaatattgaccgaaaatcagttcctgaagcagctgcaactcaggcatcttaaggcgattggaaaatatgagaattcccagaataacttgccgcagataatggctaaacaccaaaacgaggtgaaaaatttgcgccaactgctgcgaaaaagccaggaaaaagaacggaccctgtctagaaaactccgtgagaccgacagtcaattgctgaagacaaaagatattctgcaagcgcttcagaagctttccgaggacaagaatctggctgaaagagaggagcttacacacaagctgtcaattattacaaccaagatggatgcaaatgacaaaaagattcagagcctggagaaacaactgaggctgaattgtcgggcattttcacggcaactggctatagaaacccggaagaccctggccgcacagaccgctacaaagactctgcaggtggaagtgaagcaccttcaacaaaaactgaaggaaaaggacagagaactggaaataaagaacatttactcccacagaatcctgaagaatctccacgacacagaagattatccgaaagtttcatcaacaaagagcgtacaggccgacagaaaaatcttaccctttacatccatgcggcatcagggaacgcagaaatccgacgtgcccccgcttactacaaaggggaaaaaggcaactggtaacatcgatcacaaagagaagtccacagagattaatcacgaaatcccccattgtgtgaacaagctgcccaagcaggaagactccaagagaaagtatgaggacctgagcggtgaagagaagcacttggaggtgcagattctgctggaaaacacaggcagacaaaaggacaagaaggaagatcaggaaaagaagaatatcttcgtgaaggaagagcaggagctcccgcctaaaattatcgaagtgatccatcctgaaagggagagcaatcaggaggacgtacttgtgagggagaagtttaagcggtcgatgcagcgtaatggtgtggatgatacgcttgggaaagggacagcaccatacaccaagggccctttgcggcaaagaaggcactacagcttcactgaagccaccgaaaacctgcaccatggattgccagccagcggtggacccgcaaacgctggcaatatgcggtacagccatagcaccggaaaacacctctccaatagagaagagatggagttagagcattccgactccggctacgaaccatccttcggcaaatcatcccgaattaaggtgaaagacactacatttcgcgataagaaatcatccttaatggaggaactatttggctctggctatgtgctaaaaacagaccaaagttctcctggagtggctaaaggatctgaggaacctctgcagtccaaggagtcacaccccctaccaccatctcaggccagcacttcacatgcattcggagattcaaaggtgactgtggtgaactcaattaaacctagctcaccaaccgaaggaaagcgcaagatcattatttag

SEQ ID NO: 48378 - DNA, 2013 bp, Artificial Sequence
  Description of Artificial Sequence: Synthetic coding sequence
atgagcctggccgacctgaccaagaccaacatcgacgagcacttctttggcgtcgcgcttgaaaataataggcgatcagctgcatgtaagcgatctcccggtactggagacttcagcaggaattccaacgctagcaataaatcagtggattactccagaagtcagtgctcatgcggctccctgagcagtcaatatgactactctgaagacttcttgtgcgattgttcagaaaaggcaatcaatcgaaattacttaaaacaaccagtcgtgaaagaaaaagagaagaaaaagtataacgtgtccaagattagccaatccaaaggacagaaggaaatctcagtggagaagaagcacacctggaacgcttctctgttcaactcccagattcacatgatcgctcagcgtcgggatgcgatggcccacagaatcctgtccgcccgtctccataaaataaaagggttaaagaacgagctcgcggacatgcaccacaagctggaagcgatcctgaccgaaaaccagttccttaaacagctgcagctgcgacatttaaaggccattggcaagtacgaaaatagccagaacaatctgcctcagattatggctaagcatcagaatgaggtcaaaaaccttcgtcagctcctgagaaagtcgcaagagaaggagaggacactgagccggaagctgcgcgaaaccgatagtcagctcctcaaaacgaaggacatcttgcaagcactgcagaagctttcggaagacaagaatctcgccgagcgggaggaacttacacataagctgagtatcataactacaaagatggacgccaacgacaagaaaatccagtccctggaaaaacagctgaggctgaactgcagagctttctcccggcagctggcgattgagacccgcaaaacgctcgctgcacagactgccacaaaaactctgcaggttgaagtaaagcatcttcagcaaaagctgaaagaaaaggatagagaactcgaaataaaaaatatctattcccaccggatcctgaagaacttacacgataccgaagactatccaaaagtcagctcaacaaagagcgttcaggccgaccggaagattttgcctttcaccagcatgagacaccaggggacccagaagtccgatgttccgcctttgactactaaagggaagaaagccacgggcaacatcgaccataaggagaagagtacagagatcaaccacgagatccctcactgtgtgaacaagctgccaaaacaggaagattccaagagaaaatacgaagatctctctggcgaggaaaagcatctggaagtgcaaatcttactcgagaacaccggccgccagaaagacaaaaaagaagaccaggagaagaaaaatattttcgtgaaggaagaacaggaactgccccccaagatcattgaggttattcaccccgagagggaatccaaccaagaagacgtcctggtccgtgaaaaatttaagcgctcaatgcagaggaacggcgtggatgataccctcggaaagggaacagccccctacactaaaggcccactgcgccagaggcgccattattcctttacagaggccactgagaatctgcatcatggcttgcctgcctccggaggcccagccaatgccggtaacatgcggtacagccactccaccggtaagcatcttagcaatagagaggaaatggagctggaacactccgatagtggctacgagcctagcttcggcaagagctctcgaatcaaagttaaggataccacctttcgggacaagaagtcatcactcatggaagaactttttggaagtggttatgtgttgaaaacagaccagagctctccaggcgtagccaagggaagcgaagagcctttgcagtctaaggaaagtcaccctttgccacctagccaagcctccacatcccacgcctttggagatagcaaggtgaccgtcgtgaactccattaaacccagtagccctaccgagggaaagcgaaagattatcatatag

SEQ ID NO: 48379 - DNA, 282 bp, Artificial Sequence
  Description of Artificial Sequence: Synthetic coding sequence
atgagcctggccgacctgaccaagaccaacatcgacgagcacttctttggcgtagcactggagaacaatagaagaagcgcagcctgcaaaaggtcccccggaactggggacttcagccggaatagcaacgcgagcaacaagtccgttgactactcgcgctcacagtgcagttgtggcagcctgtcctcccagtacgactattcagaggactttctgtgtgactgctcagaaaaggctattaatcgtaactatttgaagcagcccgtggtgaaagaaaagtag

SEQ ID NO: 48380 - DNA, 210 bp, Artificial Sequence
  Description of Artificial Sequence: Synthetic coding sequence
atgagcctggccgacctgaccaagaccaacatcgacgagcacttctttggggtcgccttagaaaacaataggcgcagtgcggcctgcaagagatctcctggaaccggagactttagccgtaactcgaatgcaagtaataaatccgtagactactctcggtctcagtgttcttgcggttccctttctagccagtacgactacagcgagtag

SEQ ID NO: 48381 - DNA, 570 bp, Artificial Sequence
  Description of Artificial Sequence: Synthetic coding sequence
atgagcctggccgacctgaccaagaccaacatcgacgagcacttctttggcgtggccctggagaataataggagaagcgcggcctgcaagagatccccgggtacaggcgactttagtcgaaacagcaacgcatctaataagtccgtcgattatagccgctcccaatgttcctgtgggtcgctgagtagccagtatgactactctgaggactttctctgcgactgctccgagaaggcaatcaaccgtaattacttaaagcagccagtagtcaaggaaaaagaaaaaaagaaatataacgtcagcaaaatctcacagagcaaaggccagaaagaaatctcagtagagaagaagcacacttggaacgcctccctattcaattctcagatccatatgattgcgcaacggagggacgccatggcccataggattctcagtgccagactccacaagatcaaaggattaaaaaatgagttggctgatatgcaccacaagcttgaagccatattaacagaaaatcagttcttgaagcagttacagcttcgacacctcaaagctattggaaagtattag

SEQ ID NO: 48382 - DNA, 192 bp, Artificial Sequence
  Description of Artificial Sequence: Synthetic coding sequence
atgagcctggccgacctgaccaagaccaacatcgacgagcacttcttcggcgttgctctggagaacaatagacgcagcgccgcttgtaagaggagcccaggcaccggagatttttcgcgaaattccaatgcaagtaacaagtcggtcgactactccagaagtcagtgttcttgcgggtccctctcatcatag

SEQ ID NO: 48383 - DNA, 288 bp, Artificial Sequence
  Description of Artificial Sequence: Synthetic coding sequence
atgagcctggccgacctgaccaagaccaacatcgacgagcacttcttcggagtcgccctggagaacaaccggaggagcgccgcatgcaaaagaagccccggaaccggcgactttagcaggaactccaacgccagcaataaatcagtggattatagcaggagccaatgcagctgcggcagcctgtcgtcacaatacgactacagtgaggacttcctttgcgactgctctgagaaggcaattaaccgcaattacctgaaacagccagtggttaaagaaaaggaaaagtag

SEQ ID NO: 48384 - DNA, 285 bp, Artificial Sequence
  Description of Artificial Sequence: Synthetic coding sequence
atgagcctggccgacctgaccaagaccaacatcgacgagcacttctttggagttgctctcgagaataaccgacgtagtgcagcctgcaagcgatcccccggaactggggatttctcccgaaactccaacgcatctaataagagtgtcgactattcacgatcgcagtgcagctgtggatcactgtcttcccagtatgactacagcgaggacttcctgtgtgactgcagtgagaaagccataaacaggaattacctgaagcaaccagtggtgaaggaaaaggaatag

SEQ ID NO: 48385 - DNA, 327 bp, Artificial Sequence
  Description of Artificial Sequence: Synthetic coding sequence
atgagcctggccgacctgaccaagaccaacatcgacgagcacttctttggagtagctctggaaaataacagaaggagcgctgcctgcaagcggagccccggcactggggatttctcacgtaattccaatgcaagtaacaagtcagttgactattcccgtagtcagtgcagttgtggcagcttatcctcccagtatgattattccgaagacttcttatgtgactgtagcgaaaaagccatcaatcggaactatctaaagcagccagtggtgaaggaaaaggaaaaaaagaagtataacgtctcaaaaattagccagtcaaagggctag

SEQ ID NO: 48386 - DNA, 33 bp, Artificial Sequence; identical to SEQ ID NO: 22088
  Description of Artificial Sequence: Synthetic coding sequence

SEQ ID NO: 48387 - DNA, 93 bp, Artificial Sequence
  Description of Artificial Sequence: Synthetic coding sequence
atgagcctggccgacctgaccaagaccaacatcgacgagcacttctttggagtggctctcgagaacaataggaggtctgccgcgtgcaagtag

SEQ ID NO: 48388 - DNA, 429 bp, Artificial Sequence
  Description of Artificial Sequence: Synthetic coding sequence
atgagcttcctgaccgtgccctacaagctgcccgtgagcctgagcgtggggtcctgtgtcatcatcaagggaacgttgatagactcatcaatcaacgaaccacaactgcaagtggatttctacaccgaaatgaatgaggatagcgaaatcgccttccatttgcgggtacatctggggcgaagggtggtaatgaattcacgagagttcgggatctggatgttagaagagaatcttcactatgtaccatttgaggatgggaagccatttgacctgcgcatctatgtgtgtcttaacgagtatgaagtgaaagtcaatggcgaatacatctatgcctttgttcatcggatccccccaagttatgtgaagatgattcaggtgtggcgtgatgtgtccctggacagcgtgctggtgaacaacggccgaagatag

SEQ ID NO: 48389 - DNA, 1071 bp, Artificial Sequence
  Description of Artificial Sequence: Synthetic coding sequence
atggccttcagcggcagccaggccccctacctgagccccgccgtgcctttcagcggcaccattcaggggggtctccaagacggcttccagattactgtgaacggagccgttctgtcttcaagtggcacacggttcgctgttgattttcagaccggcttctctggaaatgacatcgcctttcattttaacccacgtttcgaggacggcggttatgtggtatgtaacacaagacagaaaggacgatggggacccgaggaaagaaagatgcatatgccttttcagaaaggaatgccctttgacctgtgctttctggtgcagtcatcagattttaaagttatggtgaatgggtctttgttcgttcagtacttccatagggtcccgttccacagggtcgataccatcagcgtcaacggcagcgtgcagctgtcctatatctcctttcaaaaccctaggacagtgcccgttcagccggcattcagtacagtgcccttttcccagcccgtctgtttccctcctaggccacgcggtcggcgtcagaaaccaccttctgtgaggccggccaatccagcgccgatcacccagacagtgatccatacagtacagagtgcgtctgggcagatgttcagtcaaaccccagcaatacctcccatgatgtacccacacccagcataccctatgcccttcataaccactattcctggaggtctctatccctccaaaagtattatcctttccggcaccgttttgccatccgcccagaggtttcacatcaacctatgctccgggagccatattgcctttcatatgaacccccgattcgatgagaatgcggttgtgagaaatacgcagatcaataactcatggggctccgaagaaagaagccttccgcggaaaatgcccttcgtgagaggccagagcttctcagtttggatcttatgtgaggcacattgtctcaaggtggctgtggacgggcagcacgtgtttgaatattaccaccggctgaggaacttgccaacgattaataaactggaagtgggtggggatattcaacttacccacgtgcaaacgtag

SEQ ID NO: 48390 - DNA, 1068 bp, Artificial Sequence
  Description of Artificial Sequence: Synthetic coding sequence
atggccttcagcggcagccaggccccctacctgagccccgccgtgcccttttcgggaacaattcagggcgggctccaagatggatttcagatcacggtgaacggtgcagtgttgagctcctcagggacacgctttgccgtggatttccagacaggattctctgggaacgatatcgccttccatttcaatccacgcttcgaggatgggggatacgtggtttgtaacacaaggcaaaaaggtagatggggacctgaagagcggaaaatgcatatgccattccagaaggggatgccctttgatttatgtttcctggtccagtccagcgatttcaaggtcatggtcaatggctctctattcgtccagtatttccaccgcgtgcctttccatcgggtggacactatttccgtgaacgggtctgtccaactgagttatatctccttccaaaatcctagaactgttcctgttcagcccgcgttttctactgtcccattctctcaacctgtgtgttttccccctcggcccagggggagacgccagaaaccccccagcgttcggcctgctaacccagcacccattacacaaaccgtgattcatactgtgcagagcgcttccggccaaatgttttcgacgcccgctattcctccaatgatgtatcctcacccagcctaccccatgcccttcataactactattcccgggggcctgtatccgagcaagagtataatactgagtggcacggtgctgccttcagcgcagagattccacattaatctatgctcaggcagtcacatagcatttcacatgaatccccggttcgatgagaacgcggttgtgcggaatacccagattaacaattcgtgggggtccgaggaacgatccctccctaggaaaatgccgttcgtgcgcggtcagtctttttcagtgtggattctgtgtgaggctcactgccttaaggttgctgtcgacggccaacacgtttttgagtactatcataggctaagaaacttaccaacaatcaacaagctggaggttggcggcgatattcaactgacacacgtgcagacctag

SEQ ID NO: 48391 - DNA, 1071 bp, Artificial Sequence
  Description of Artificial Sequence: Synthetic coding sequence
atggccttcagcggctgccaggccccctacctgagccccgccgtgcctttctccggcactatacaagggggacttcaggacggctttcagattacagtgaatggcgccgtcttgagttgtagtgggaccagattcgcagtggattttcaaacaggcttcagtggcaacgatatcgcttttcatttcaatcctcggtttgaggatggaggctatgtcgtctgtaataccagacagaaagggacatgggggcccgaggaaagaaagatgcacatgcccttccagaaggggatgcccttcgatctgtgttttctagtacagtcctcagactttaaggtgatggtgaacggttccctgttcgtgcagtatttccatcgggtccccttccatagggtggacacgataagcgtgaacggcagcgtgcagctgtcatacatatcttttcagaaccctcgggctgtacccgtgcagccggccttctccacggtgccattctctcaaccagtctgtttccccccacgtcctcggggacggcgccagaagccaccttcagtgcggcccgctaatccagctcctattacccagaccgtcattcataccgtccaatcagccagcggccagatgttctcccagactcccgccatacctccgatgatgtatccccatcccgcatatccaatgcccttcatcaccaccatacccgggggcctgtaccccagtaagtctattattttaagcgggactgtcctccccagcgcccagcggtttcacataaatctctgtagcggaagccacatcgcttttcatatgaaccccagattcgatgagaacgctgttgtgcggaacacacaaatcaataactcctggggaagcgaggagcgttccctgcctcggaaaatgccgttcgtgagagggcagtctttctccgtgtggatcttatgcgaagcacactgtcttaaggtggccgtggacggtcagcatgtctttgagtattaccaccgcctcaggaatctgcctacgatcaataagctggaggtgggcggggatattcaactcacccacgttcagacatag

SEQ ID NO: 48392 - DNA, 807 bp, Artificial Sequence
  Description of Artificial Sequence: Synthetic coding sequence
atgcacatgcccttccagaagggcatgcccttcgacctgtgcttcctggtgcagtcttcggactttaaggtaatggtgaacgggtccctattcgtccaatacttccaccgggtgcccttccatagagtcgacaccattagcgtaaacggttctgtccaactttcgtatatcagttttcaaaacccaagagccgtgcccgtgcagcctgcattctccacggtcccattcagccagccggtttgtttcccaccgaggccaaggggaaggcgacagaaaccacctagcgttagacccgcgaatccagctcctatcacccagaccgtgatccatactgtgcaaagcgcttctggccaaatgttctctcagactccagcaataccaccaatgatgtacccccatcctgcttacccaatgccttttatcactacaattcccggtgggctgtatccatctaagtcaataattctgtccggcaccgttttgcctagcgcacagcgcttccatatcaatttgtgcagtggaagtcatatcgcttttcacatgaatcctcgctttgacgagaacgcggtggtgcggaacacacagatcaacaattcttggggtagtgaagaacgatcgctgccgagaaaaatgcccttcgtgcggggccagagcttttcagtgtggatcctgtgcgaggcacattgtctgaaagttgccgtcgacggacagcacgtatttgaatactaccatcggctgagaaacctcccaaccattaacaagctggaggtgggtggcgacatccagctcacacacgtgcagacctag

SEQ ID NO: 48393 - DNA, 519 bp, Artificial Sequence
  Description of Artificial Sequence: Synthetic coding sequence
atggccggcagcgtggccgacagcgacgccgtggtgaagctggacgacgggcaccttaataactctttgtcaagccccgtgcaagctgatgtttatttcccccgcctgatcgtgccattctgcgggcacatcaagggtggaatgcgtcccggaaagaaggtactcgtgatgggcatagtggatctcaatcctgaatcatttgctatctcattgacttgcggcgacagcgaggatcccccagcagacgtagccatcgagctcaaagccgtatttacggaccgccagctgcttcggaacagctgtattagcggggagaggggcgaggaacagagcgcaatcccatactttcctttcatccctgatcagccctttcgtgtggagatattatgcgagcatccacgattcagagtatttgttgacgggcaccagctgttcgatttctaccaccgcattcagacgctctctgctatcgatacgattaagatcaatggagacctgcagataacgaaacttggatag

SEQ ID NO: 48394 - DNA, 1497 bp, Artificial Sequence
  Description of Artificial Sequence: Synthetic coding sequence
atgagcaccttcggctaccggcggggcctgagcaagtacgagagcattgatgaggacgaattacttgccagtctgagtgccgaggagctgaaagagctggagagggagctcgaagatattgagcccgatcgaaatctacccgttgggttgagacagaaaagtctcactgagaaaactcctaccggcaccttcagccgggaggcattaatggcctactgggaaaaggagtctcaaaaactgctcgagaaggagagacttggcgaatgtgggaaagtggccgaggataaggaagagagtgaggaggaagaggattccgatgaggaggaacgcactatagaaacagccaagggcattaacggcaccgtcaattacgattctgttaattctgataactctaagccgaaaattttcaaatctcaaatcgagaacatcaacttgactaacggtagtaacggccggaataccgaaagtcctgccgcaatacacccttgtggcaaccctaccgtcatagaagatgcactggacaagattaagagtaatgacccagataccaccgaagtgaacctcaataatattgagaacataaccactcagaccctgactcgttttgctgaagccctgaaggataacacagtggttaagacgtttagcttggctaacacccatgctgatgattctgcagccatggcaatcgccgagatgcttaaagtcaatgaacacattacaaatgtgaacgtggagtctaatttcattacggggaagggtatcctggccattatgagggctctgcaacataacaccgtgctgaccgagctgcggtttcacaaccagaggcatattatgggaagtcaggtggagatggaaattgtgaaactgctgaaggagaataccacactgctaagacttggataccatttcgaactgcccggtcccagaatgagtatgacttccattctcacacggaacatggataagcagagacagaagagactacaagaacagaaacagcaggaaggatacgatggaggccccaatctgcgcacgaaagtatggcaaagggggaccccctcaagttctccttatgtctctccaagacattccccgtggtcttctcctaagctcccgaagaaggtgcagacagtcaggagcagaccgctgtctccggttgccacccctccaccgcctcctccccccccactgcccgagaaaaaactcattacacggaatatagccgaggttataaagcagcaggagtctgcccagcgtgcactccagaatggccagaaaaaaaagaaaggaaagaaggtcaagaagcagccgaacagtatcctgaaggagatcaaaaattcgttacgtagcgtgcaggagaagaaaatggaggattcatcacggccatccacccctcagcgttcagctcacgagaacctgatggaggcaataaggggatctagtatcaagcagctcaaaagggtcgaggtccctgaagcactcaggtag

SEQ ID NO: 48395 - DNA, 1524 bp, Artificial Sequence
  Description of Artificial Sequence: Synthetic coding sequence
atgagcaccttcggctaccggcggggcctgagcaagtacgagagcatagacgaagatgagttgctagcaagcttatcagctgaggaattaaaggaactggagagagagctagaagatatcgaaccagatagaaatctgccggtcggattacggcaaaagtctctcacagagaaaacccccacaggaacatttagccgtgaggctcttatggcctactgggagaaagagagtcagaagctgctggaaaaggagcgtctgggcgaatgtggtaaggtagcagaagacaaagaagagcgcacaatagagactgctaagggcatcaacgggacagtcaactatgatagcgtaaacagtgacaatagcaagccgaaaatcttcaaatcacagattgagaatataaacctgacaaacgggtcaaatgggagaaacactgagtctccagccgctatacacccttgcggcaacccgaccgtaatcgaagacgcactcgataagatcaagtccaacgatccagacaccacagaagtcaatctgaacaatattgaaaacatcaccactcagaccctaacccgcttcgctgaggcactgaaggacaacaccgtggtgaaaacattctcccttgctaacacgcacgctgatgactcagctgctatggctatagccgaaatgctcaaggttaatgaacatataactaatgttaatgtggaaagcaattttatcacaggcaaaggaattttagctatcatgagggcacttcagcataacacggtgttaacggagctccgtttccataatcagaggcacatcatgggatctcaggtggaaatggagatcgtgaaacttttaaaagaaaacacaaccttgctcagactgggttatcacttcgagctgcccgggccccggatgagcatgacctccattctcacccgcaacatggacaagcagcgccagaagcgtttgcaggagcaaaagcagcaggagggttatgatggaggtcctaacctacgaactaaggtgtggcagagaggtacccctagctcatccccttacgtctcccctcggcacagcccctggtctagccctaagcttcccaaaaaggtacaaacggtccgcagtcgacctctctccccagtggccacaccccctcccccccccccgccccctccacctcccccaccatcctcacagcggttgcctcctcccccacccccaccccctcctcctctgcctgagaagaaactgataacacggaatatagccgaagtcattaaacagcaggaatccgcacaacgagcccttcaaaacggacaaaaaaaaaaaaaaggaaagaaagtcaagaagcaacctaattcaattctgaaagagattaagaacagtctgaggtccgtccaggagaagaaaatggaagactcttcacgtccttctacaccccaaaggtccgcccacgagaacctcatggaggccattaggggtagcagcatcaagcagttaaagcgggtcgaggtaccagaagcactgaggtag

SEQ ID NO: 48396 - DNA, 1644 bp, Artificial Sequence
  Description of Artificial Sequence: Synthetic coding sequence
atgagcaccttcggctaccggcggggcctgagcaagtacgagagcatcgatgaagatgaattgctggcatcgctgtctgccgaggagctgaaagagctggaacgggagctggaggacattgagcccgacaggaatcttcctgttggtttaagacagaaaagcctgactgaaaagacgcccactggaacatttagccgtgaggccctcatggcctattgggaaaaggagtctcagaagctgctggaaaaagagcgcctgggggaatgcggaaaggtggcggaagacaaggaggagtcagaagaagagctcatatttacagaaagtaattcagaggtcagcgaggaggtgtacacagaggaagaagaggaagagtctcaagaagaggaggaagaagaggactctgatgaggaagaaaggacaatcgagactgctaaaggtatcaatgggacagtgaattacgattctgttaacagtgataattctaagccaaagatttttaagtcacaaatcgagaatatcaatctgacaaatgggtctaacggccgtaataccgaatcgccggccgctattcacccttgcggcaaccctaccgttattgaggatgcactcgacaaaatcaaaagcaacgatccagataccacagaggtcaaccttaataatatcgagaatatcaccacgcaaacactcacacggtttgccgaggcactcaaagacaacaccgtcgtaaagactttcagcctggccaatacccatgcagacgatagtgctgccatggctattgccgagatgctgaaggtgaatgaacatataactaacgtcaatgtcgaaagcaacttcattaccggtaaaggtatactagctattatgagggccttgcaacacaacacggtgctgaccgagctgcggttccacaatcagcggcacatcatggggtcccaagtggaaatggagatcgtcaagctcctcaaagagaatacaacattgctgcgcctgggatatcactttgagctgcctggacctcgcatgtctatgacgagtatcctcaccagaaacatggacaagcagaggcagaagcgactgcaggagcagaagcaacaggaaggatacgatgggggtccgaatctgcgcacaaaggtatggcagcggggcactccgtcgtcatctccttacgtgtccccgcggcatagtccctggtcatcccctaagcttcccaaaaaagtacaaaccgtgcggtcaagacctcttagtccggtagctaccccacctcctcccccacctccaccccctcctccacctccgagttcacaacgcttgcctcctccccccccccctccacccccccctttgcctgagaagaaattgattacaaggaatattgctgaggttatcaaacagcaagagtccgcccagagagccttacagaacggccagaaaaagaagaagggtaagaaagtaaagaaacagcccaacagcattctcaaagaaattaagaatagcctgcgtagcgttcaggagaaaaagatggaggactcttcgcggccaagtacacctcagcgttcggcacacgagaatcttatggaggctatacgagggagtagcatcaagcagttaaagcgcgttgaagtaccggaggcccttagatag

SEQ ID NO: 48397 - DNA, 2208 bp, Artificial Sequence
  Description of Artificial Sequence: Synthetic coding sequence
atgctgcggctgctgcggcccctgctgctgctgctgctgctgccccccccaggaagcccagaaccccccgggcttacccagttatcacctggggctcccccccaagcaccggaccttctgtacgccgatggcttacgtgcctacgccgctggagcatgggcaccagctgtggctctgctcagggaggccctcaggagccaggcggcgctcggtcgcgtgcgactggactgtggcgcttcctgtgccgccgacccaggtgctgcgcttcccgcagtgctgctcggggctcccgaaccagactcaggcccgggacctacacaggggagctgggaacgccagttactccgagcggcactgcgtagagcggactgtctaacccagtgtgccgcacgacgtttgggaccaggaggggccgcgcgtagagttggcagtgccctccgtgacgcttttagacgtcgtgagccatacaattatctacagcgggcctactaccagcttaagaagctggatctcgcagccgcggcagcacataccttctttgtcgctaatcccatgcacctgcagatgcgcgaagacatggccaaatatcgccgcatgagcggtgtacgccctcaaagctttcgggacctggagactcctccacattgggctgcatatgataccggattagaactcctgggacgacaggaggccgggctcgccttgcccagattggaggaagccctccagggcagcctggctcagatggagtcctgtcgggctgattgtgagggccccgaagagcagcagggcgcggaggaggaagaggacggtgctgccagccagggtggcctgtatgaggcaattgcagggcactggatccaagtgttgcagtgcaggcagcggtgcgtcggtgagacagcgacaaggccaggaagatctttccccgtgcctgatttccttcctaaccagctgagacggcttcacgaagcccatgcacaggtgggcaacctgagccaggccattgaaaacgtgctgagtgtgttgctattttatcctgaggacgaggcagccaaacgggctctgaaccagtatcaggctcagctgggcgagcctaggcccggcttggggcccagagaggacatacagcgatttatccttagatcactgggggagaagcggcaactgtactatgccatggagcacctcggaacttcatttaaagatcccgatccttggactccagcagctctgattcctgaagcccttcgcgagaagctgagggaagatcaggagaaacggccttgggatcatgaacctgtgaaacctaagcccctcacgtattggaaggacgttcttttactggagggagtgacactgactcaagatagtagacagttgaacggtagtgagcgcgccgtgctggacggtttattaactcccgccgagtgcggtgtgctgctgcagctcgctaaggatgccgcgggggccggggctcggagtggctacagggggcgcaggtccccacatacaccgcatgagagatttgaaggactgacagttttgaaggcagcccaactcgccagggccggtaccgtgggatcgcagggtgccaaacttctgttggaagttagcgagagggtccgtacactaactcaagcctacttcagcccggagaggccactgcatttgtcctttacccatctcgtttgccggagcgccatcgagggcgaacaggaacagcgtatggatctgagccatcccgtacacgctgacaactgcgtgctggatcccgacaccggagaatgttggagggagccccctgcttacacgtaccgcgactattctggtctgctgtatctaaatgatgattttcaggggggggacctgttcttcacagagccaaatgccctgaccgttacagcccgtgtgagaccgcgatgtggccggctggttgcgtttagctccggcgtcgagaatccccacggagtgtgggccgtcacgagggggcgaagatgtgctctggctctttggcatacttgggcccctgagcaccgggagcaggagtggatcgaagcaaaagaactccttcaggagagtcaggaagaagaggaagaagaagaagaagaaatgccctccaaagaccccagcccagaaccgcccagtcgcaggcaccagcgagtgcaagataagactggccgggcccctcgtgttagggaagagctgtag

SEQ ID NO: 48398 - DNA, 3015 bp, Artificial Sequence
  Description of Artificial Sequence: Synthetic coding sequence
atgcacggcagctgctgcctgggcggcggccagcccctgagcgtgtttgcatcccttcatatgggcccggagggtctggccctgaaagccggaagaggatggtgccctaccttccagtcattcccggagcctacccctagttacggtgcacccggagtggaatttatggggttgcaccaggaaaacaatgctgtcacccagattcacctcctcccaggccagtgccagctagtgaccctgctggacgacaacagcctgcatttatggtccttaaaggtgaaggggggcgcttcggagctgcaggaggacgagtcctttactctccggggtcccccaggcgctgcccccagtgcaacccagatcaccgtggtcctgccacactcctcttgtgaactgttataccttggcaccgagtctggtaatgttttcgtggtgcagctgcctgctttcagggcgttagaggaccggacaatcagcagcgatgcagtgctccagagacttccagaggaggccagacaccgacgggttttcgagatggtcgaagcactgcaagaacatccacgcgatccaaaccaaatattgatagggtactcccgtggattggtggttatttgggacttacagggaagtagggtcttataccactttctgtcttcccagcagctggaaaacatatggtggcagagagatggtcggttgcttgtgtcttgccactctgatggctcatattgccagtggcccgtgtctagcgaggcccagcagcccgaacccctcagatctctcgtgccatatggcccctttccgtgtaaggctattacccgcatcctctggctcacaacaagacaggggctgcctttcacaattttccagggcggcatgccccgagctagttacggtgatagacattgtatcagcgtcatacacgatggacaacagacggccttcgattttacctcccgcgtcatcgggtttaccgtgctgaccgaggctgacccagctgccaccttcgacgacccatacgccctggtcgtcctggctgaggaagagctggtggtcatcgatctgcagaccgcgggatggcctccggttcaattaccatacctggcgtcgctgcactgttccgctatcacctgctcgcaccatgtcagcaacatccccctaaagctgtgggaacgcattatcgccgcagggtccagacagaacgcacacttttccacaatggaatggcccatagacggcggcacatcactcactccagcccctccgcagcgcgatttacttttgaccgggcatgaggatggaacagttaggttctgggacgcctccggggtctgcctgagactgctttacaaactgtcgactgtgcgggttttccttaccgacaccgacccgaacgagaatttttctgcccagggtgaagatgaatggccccctctgcgcaaagtggggagttttgacccctattcagatgaccctcgactcgggattcagaaaatctttttgtgcaagtattctggctatttggcggtagctggcactgctgggcaggtgctcgtcctggagctcaacgatgaggccgccgaacaagccgtagagcaagttgaggctgacctgctgcaggaccaggaggggtaccgctggaaggggcacgaacgcctggcggcaaggagcgggccagtccgctttgaacccgggttccagccatttgtgctggtacagtgccaaccacctgctgtagtgactagcctcgcgctgcattctgagtggcgtttggttgcatttggcacttcccacggattcgggctctttgatcaccaacaaagacgccaagtgtttgtaaaatgcacgcttcacccttcagatcagttggccctggaaggtccactgtctagagttaaaagcttaaaaaagtccctgcgtcagagcttccgacgaatgcgaaggagcagagtatcctcccggaaacggcatccggcagggccccctggcgaagcccaggaaggttcagctaaagctgagcgccctggcctgcaaaacatggagctggccccagtccaacgcaagattgaggcacgatctgccgaggatagctttaccgggtttgtcagaaccctgtactttgctgacacataccttaaagatagcagtagacattgtccctcactgtgggcagggactaacggcggcacaatctatgccttttcccttcgggtgccaccagcagagcggcgcatggatgagcccgtccgcgcggagcaggctaaagagatacaactgatgcaccgggcaccagttgtgggtatccttgtattggacgggcactctgtgcccttgcctgaacctttggaagttgcccatgacctgagtaaatcccctgatatgcaaggtagccaccagttgctagtcgtcagtgaagaacagttcaaggtttttacgttgcctaaggtcagcgcgaagctgaaactgaagttgacagctctagagggaagtagagtgcggagagtttccgtggctcacttcggatccaggcgcgctgaggattatggggaacatcaccttgccgtgttaaccaatttaggcgacattcaggtggtcagtttgcccctgctgaagcctcaggtgcgttactcatgcattcggcgcgaagatgtcagtggcattgcttcttgcgtcttcacgaagtacggccaaggattctacctaatttcacccagcgagtttgaacgattctctctcagcacaaagtggctggttgaacctaggtgcctggtggactccgctgagactaagaaccatcgcccagggaatggagccggtcctaaaaaggccccctcccgcgctcgaaatagtggaacccagtctgacggagaggaaaagcagccagggctcgtgatggaacgggctctgctcagcgacgaaagggctgcaaccggtgtccatattgagcctccctggggtgcggcatctgctatggctgagcagtctgagtggctttccgtgcaggccgccagatag

SEQ ID NO: 48399 - DNA, 2061 bp, Artificial Sequence
  Description of Artificial Sequence: Synthetic coding sequence
atgggcccccggagccgggagcggcgggccggcgccgtgcagaacaccaatgacagttcagcacttagcaagaggagtctggccgccagagggtatgtgcaggaccccttcgctgctctgctcgtaccgggggctgctcggagggcacctcttatccaccgcgggtactatgttagagctcgcgcagtgcgccactgcgtgcgtgcgtttcttgaacagatcggagccccccaggcagcattgagagcacaaatcctgagcctcggcgctggcttcgattctttgtattttaggctgaaaactgcagggagactcgctcgggccgcagtttgggaagtggattttcccgatgtagctagaagaaaagcggagcgcattggggaaacacctgagttatgcgccctgacgggccccttcgagcgtggagaacctgcctcagcactctgcttcgagtctgctgattactgcatattgggactagacctgaggcagttacagcgcgtcgaagaggctctgggtgccgctggcctcgacgcggcctcgcccaccctcctgctagccgaggccgtgctgacatacctggaaccagaatccgccgctgcactgattgcgtgggctgcccagagattccccaatgcactctttgtggtttacgaacagatgcgtcctcaggacgcatttggtcaatttatgctacagcattttcgccagcttaactccccgctgcacggcctggaaaggttccctgatgtggaggcccagcgcaggagatttcttcaggccggctggacggcttgtggcgctgtggacatgaatgagttttaccactgcttcttacctgcagaggagcgaaggagagtggagaatattgaacccttcgacgagttcgaggagtggcatctgaaatgcgcacattacttcattctcgcggctagtagaggagacactctctcccatacgctggtattcccttcctcagaggcctttccgcgagtgaatcccgcatctccctcaggggtatttccggccagcgtggtctcctctgaagggcaggtgcctaatctcaaacgctacggtcatgcttctgttttcttgagtccagacgtgatactctccgccggcggattcggggagcaggagggcagacactgtcgagtcagccagtttcaccttctgagcagagactgcgacagcgagtggaaagggtcccagattggctcatgcggaacgggcgtgcagtgggatggccggttgtatcatacaatgacgcgactgtctgaatcaagagtcctggttctcggcggacgtctgtcccccgtgtccccagcattgggcgtgctgcagctgcatttcttcaaatccgaggacaacaataccgaggacctcaaggtgacaatcacaaaggcagggaggaaagatgatagcactctttgttgttggcgacactctaccacagaagtgtcttgtcaaaaccaggagtatttgttcgtgtacggggggaggtccgtcgtggaacccgtgttatctgactggcatttcttgcacgtgggaacaatggcatgggtgaggattcccgtggagggagaggtaccggaagcgaggcatagccacagtgcctgtacgtggcaagggggagcactcatcgccggcggactgggggctagtgaagaaccacttaacagcgtgctgttcctgaggcccatctcatgtggttttctttgggagtccgtggacattcaaccgcctatcaccccccgttattctcacacagcccacgtgctcaatggaaagctcttgctagttggggggatctggatccactcttcatcttttccgggggtgaccgtgattaacctgacaacaggcctcagcagcgaataccaaattgacaccacctatgtgccttggccactgatgctgcacaaccacacatccatcctgctgcctgaagaacaacaacttctcctccttggcggtggtggcaactgttttagtttcggaacatacttcaatcctcataccgtcacactggacctttcttctctaagtgcgggacagtag

SEQ ID NO: 48400 - DNA, 798 bp, Artificial Sequence
  Description of Artificial Sequence: Synthetic coding sequence
atgacccggctgagcgagagccgggtgctggtgctgggcggccggctctcccccgtatctcctgccttgggagtgctccagttacattttttcaaatccgaagataacaacactgaagatctgaaagtaacaatcactaaagcaggccgcaaagacgattcaactctgtgctgttggcgccatagtacgacagaggtgagttgccagaaccaagagtacctgttcgtctatggaggaaggtctgtggtggaaccagtattgtcagactggcacttcctgcatgttgggaccatggcctgggttcggatccctgtcgagggcgaggtgccagaagcacggcatagtcattcagcatgtacttggcagggtggtgccctgattgcaggagggctgggggcctccgaagaacctcttaattctgttctctttctgagacccatatcttgcgggttcctttgggaatctgtcgacattcagcccccaatcacaccacgttattcccatacagcgcacgtgctgaacggaaaactccttctagtagggggtatctggatccattcttcctcctttcctggagtgaccgtgattaacctgacaacagggctgtccagtgaataccagatcgataccacttatgtaccctggccactgatgctccacaaccacactagcatcctgttacctgaggaacagcagctgttgcttctgggaggaggcggcaattgcttctcctttggcacctattttaatcctcacacagttaccctggatttaagcagtcttagcgcaggccagtag

SEQ ID NO: 48401 - DNA, 399 bp, Artificial Sequence
  Description of Artificial Sequence: Synthetic coding sequence
atggaccaccacatccccatgcacgccctgcccgaggagatccagaagatgctccctgaggagaaggtatgcaagtactgcggcgtctcatatttgattctgcatgagttcaaggccatggaggaaaaagtgaaggccatggagaaggaaatgaagttctatcaggggagtgtcgacagggagaagcgtctgcaggaaaaactacacagcctttcacaggaactagaacagtataaaatcgacaacaagagcaaaaccgagcgcatctacgacgtggggatgcagctgaaaagtcagcagaacgaatttcagaaggtaaaaaaacagctgagccacctgcaggatgagctcaaaataaagtataggcaaagctatatcttccggctgtgcttctgctag

SEQ ID NO: 48402 - DNA, 879 bp, Artificial Sequence
  Description of Artificial Sequence: Synthetic coding sequence
atgggcatcgccgagagcacccccgacgagctgcccagcgacgccgaagaacaactgcgcagtggagatcagcagttggaattatccggccgcaggcttcgtcgcctgccctccgccgtgtgtgctctatctcgtctgcagaaactctacgtttccggtacgggccttagggagctccctgaagaaatcgaagaacttcgggagcttagaattctggctctggactttaataaactcgagcgtcttcccgacggactgtgtaggctccccagactcaccaggctctacctcggcgggaataggctcttggccctgcccgctgacttcgcccagctccagtcgctgcggtgcctgtggattgaaggtaattttcttcggcggttcccccgccctctactgaggttggtcgctctgcaatctcttcaaatgggagacaatcggttgagagccttgcccgccgagctgcccagaatgaccggactccggggactgtggctgtatggcaatcgtttcgaggaatttccgcccgctctcctgagaatgggcagattacatatactcgacttagaccgcaatagactgggtggatttcccgacctccaccccctcagggcgcttcgcgtgttctcctacgatcacaaccctgttactgggccccctcgagtggccgacacggtgtttctggtcggggagggcgctgtggaacggatggccgaacgtgacgagcccacgccccgtccgccgcctcggagaccagcccgagcgtttgaggatgaggaagaggaagatctgctgatcggcggggcgggatctagagccttgggtgcccccggcggctcattccgagcattagaggcagcccccggacttgggacctag

SEQ ID NO: 48403 - DNA, 1482 bp, Artificial Sequence
  Description of Artificial Sequence: Synthetic coding sequence
atgcacaccctggtgttcctgagcacccggcaggtgctgcagtgccagcctgctgcgtgccaggccttgcccctgttgcctcgggagctgttccctctcctattcaaggtggcatttatggacaagaaaactgtagtcctgcgcgagctggttcacacttggccttttccgcttctgtccttccaacagttgctgcaggaatgtgctcattgttctcgcgctctgctgcaggaaaggccctcaaccgagagcatgcaggcagtcattctgggcttgacggcccgcctccatacgagcgagcctggcgcatctactcagccactctgtcggaagcacgcactgagggtcctggatatgacaggcctcctcgacgatggtgtggagcaggatcccggcacgatgtcaatgtgggattgcactgccgctgtggcccgaacatgcattgcacagcaacaggggggggctgctgagccagggccagcacccatccccgtagaagtgagagtcgacttaagggtgaaccgtgccagctacgcatttttgagggaggctctcagaagttccgtgggatcgcccctgaggctgtgctgccgcgacctgagagccgaagacctgccaatgagaaatacagtggcactgctacagctgctcgatgctggatgcctacggcgagtggacctcaggtttaacaacctgggacttaggggcctgagtgtcattatcccccacgtcgctcggttccagcatctggcttccttgcgcttgcattacgtgcacggagactctaggcagcccagtgtcgatggggaggataatttcaggtacttccttgcacaaatgggccggtttacctgcctccgagagttgtcgatggggtctagcttactgtctgggagactcgatcagctcctgtccacgctccagtcacccctggagtcgctggaactggcattctgcgccttgctgccagaggatctgcgcttcttggctaggtccccccatgcagctcatctgaagaaactggacctgtccgggaacgaccttagtggatcccagctcgccccattccagggcctgctgcaggctagtgccgccactcttcttcatctggaactcacagaatgtcagctggcggatactcagctcctggcaacattaccgatcctaacgcagtgcgcatcactcagatatctgggactgtatgggaatcccttaagtatggcgggattgaaggaactgcttcgcgacagcgtcgcccaggcagaattgaggacggtggtacacccgtttcctgttgattgttacgaagggctgccttggccaccgccagccagtgtcctcttggaagcaagcataaacgaagaaaaatttgcgcgcgttgaagcagaactgcaccagctgctgctggcctccggtagggcccacgttttgtggaccacggatatatacggacgactggcagcggactacttttccttgtag

SEQ ID NO: 48404 - DNA, 1545 bp, Artificial Sequence
  Description of Artificial Sequence: Synthetic coding sequence
atggacaccatgcggagcctgcggttcatcagcgccgaggccctggtttctcatccgcaagtggcaaggcagtcactggactcggtggctcacaacttatatccactgctcttcaaagccagttaccttttggaacaggccgaagtaacccgagctgtgctggggagatggccactcgaggaattccgactgggcgccctgctgggacctggcgccgatcatccgcaagatcttcgtgataggacctgccgtgcctgcctggaagctctggttcgcggactcgccgaccacgtgctgcaggacagatctagaaggcgtctgcgggtcgccgatctgacaggtattagagacgtacaggtccagcgttgcccatgcggccgggcccttggacgatggggccgcacccagctccttgctcgaacatgctgtgaacttcaagcagagcctctcgctgctgggaggcctgtggaagtcttggcagatctatttgtgacagagggaaacttcgaggctgtcgtacaagccctgcgtccggcagggccagccccccttagagtgcactgtccctcattccgcgctgattctctctcaccttctcagcttttgcacgtgctgaggctggctggcccaggggctttgaggaaactcgaagtggttcacaatgtgcgccttcatgctggccacgttcagcagctcctagcacaggttggctttcctagacttgccagcctgacgttgccaacgaaagcctttgacgcaccaccaacctacgcttcaacacccgatggggaggacccccttctcgcttcgattgccagggagctgagcaaaatggctcagttgacagagctcagtgttgctttttctactctgacaggcaaaattcccactctcctgggccccttgcagacccctttgcgtgtgcttgacctggccaactgcgcccttaaccacacggatatggccttcttggccgactgcgctcacgccgcccatttggaggtgttagacctctcagggcacaacttggttagtctctacccatccacttttttcagactgctgagccaggcgtccaggactctgcgcatcctgaccctcgaggagtgcggcatagtggactcccacgtaggaatgctcatcctcggtctgagcccctgtcaccgcttgcggcagttgaaatttcttggaaatcccttgtccgcccgagccctgaggcgactattcactgccttatgcgagctccccgaattacggtgtatagagttccctgtgcccaaagattgttacccagaaggcgcggcttatccacaggacgagctcgctatgtcaaaatttaatcagcagaagtatgatgaaattgcagaggagctgcgcgccgtcctactccgggcggatcgcgaggatattcaggtatcaacaccattattcggatcattcgaccccgatatccaggagacgagtaacgagctgggagcattccttttgcaagcattcaagacagccctcgagaacttctcgcgcgccctaaagcagattgaatag

SEQ ID NO: 48405 - DNA, 1278 bp, Artificial Sequence
  Description of Artificial Sequence: Synthetic coding sequence
atggccatcaagaagcagaagcggtgccggaagatccggcccgtgagcgcctttatttcagggagtccccaggatatggaaagccagctcgggaaccttggaattccccccggttggttttctgggttaggcggctcacagcccactgcctcaggcagttgggaaggcctgagcgaactaccaacgcacggatacaaactgaggcatcagactcaggggcgtcccagacctcccaggactacccccccagggccaggtcgaccctccatgccggcccccgggactcggcaggagaatggcatggccacacgattggacgagggactcgaagacttcttcagcaggcgggttcttgaggaaagttcttcataccctcgaaccttgcgcaccgtcagaccagggctctcagaggccccacttccacctctgcagaagaagagaaggcgcgggctattccactttcgccggcctaggtctttcaagggtgatagaggtcctggatcccccacaaccggactactcctaccgcctccccctccacctcccccaactcaagagtctcctccatctcccgaccctcctagcctgggcaacaattcctcaccctgttggagcccagaagaggagtcctctctgttacccggattcggggggggtcggggcccctccttcaggaggaagatggggcctggccccgaccaggaaggctcaacacaagcctggcagaaaaggcggtctagcgacgatgctggtcctggatcttggaagcccccgccccccccgcagagcaccaagccttctttctctgcaatgcggcgagctgaggcgacttggcacatcgccgaggagagtgctcccaaccattcctgccagagtccctccccagctagccaggacggtgaggaggagaaggagggaactctttttcccgaaagaacactgccagctagaaatgccaaactgcaagacccggccctggccccttggccccccaagcctgtcgctgtcccacggggtcgtcagccccctcaggagcccggggtgagggaagaagcagaggcaggagacgctgcccccggagtgaacaagcctcgcttgcggttgagtagtcaacaggatcaggaggagcctgaggttcagggccctcctgaccccggaagacgaacagcaccgttaaagcccaagcgtacccggcgcgcacagtcctgtgacaaattggaacctgacaggagacggccgccagatcctaccggcacatccgaacctgggactgactag

SEQ ID NO: 48406 - DNA, 4119 bp, Artificial Sequence
  Description of Artificial Sequence: Synthetic coding sequence
atggccaagcccagcgtggagctgacccgggagctgcaggacagcatccgaaggtgtctttcccagggcgccgtgctgcagcaacatcacgtgaaactggaaaccaagcccaagaagtttgaggaccgtgtgctcgcacttacctcttggcgcctgcatctgtttctcctgaaagtccctgccaaggtggagagctcgttcaatgtgctagagatccgcgcatttaatacactcagccagaatcagatcttggtcgaaaccgagcgcggcatggtgtctatgaggttgccctctgcagagtccgttgatcaagtaacccggcacgtgtcaagtgctctgagtaaggtatgtccgggccccggctgtcttatcaggagaggtaatgccgacaccccagaagggccccgtgatacgagcccaaattctgagacgagcaccagtacaacgcatagtgtatgtggggggttctcagagacctacgccgccctgtgcgactacaacggactgcactgcagagaagaggtccagtgggatgtcgacacaatttaccatgcagaggataaccgggagttcaacctgctggatttctcccatctggagtcgcgcgaccttgcactgatggtagctgccttggcatacaaccaatggttcaccaaactctactgtaaagatctgcgactgggtagcgaggtcctggagcaggtgctccatactcttagtaaatcaggcagccttgaggaattagtactcgataatgccggactcaagacggatttcgtccaaaagctggccggggtgttcggcgagaacggttcatgcgtacttcacgccctcactctgtcccacaaccccattgaggataaggggttcttaagcttgagccagcaactcctctgtttcccatctggcctgacgaagctctgcctggccaagaccgccatctccccacgagggttgcaggcccttggccagacattcggcgccaaccctgctttcgcaagctcgctgcggtacctcgacctgtctaagaaccctggccttttggcaaccgatgaagccaatgccctttattccttcctggcgcagccgaacgcacttgttcatttggacctgtccgggaccgattgcgtcatagatctgctcctgggcgcgctgctgcacgggtgctgttcacacttaacttatctgaatctggctcgaaatagctgctcccacagaaaaggcagagaggcgcccccggcattcaaacaattctttagcagcgcttatacgctgtcgcacgtcaacctgtctgctactaagttgcccctagaagcattgcgggccctgctgcagggactaagtttgaacagccatttgtccgaccttcacttggacctgagctcctgcgagctgcgatctgccggggctcaggctctgcaggagcagttgggcgccgtaacctgtgttggctcccttgacctcagcgataatgggttcgactcagacctcctaaccctggtgccagccctcgggaagaacaaaagtctgaagcacctgttcctgggtaaaaatttcaacgtcaaggccaaaacactggaggaaattctccataagttagttcaacttattcaagaggaagattgctccttgcagtccttaagcgtggcggattcaaggctgaagttgcgcacaagtattctgatcaacgcacttggatcgaatacttgcctcgccaaggtggatttgagtggcaacgggatggaggacatcggtgctaaaatgctgtctaaggcccttcaaattaacagttcccttaggacaattctgtgggaccggaataatacctccgctctcggcttcctggacatagcccgggccttggagtcaaaccacacacttaggtttatgtcgtttccagtgtcagacatcagccaagcttatagatcagcaccggagcgaactgaagatgtctggcagaagatccaatggtgcctggtccgaaataaccactcccagacctgcccccaagagcaggcttttcggctccagcaggggctggtgacaagctcagcagagcagatgctgcaaaggctatgcggacgcgtacaggaggaggtgagggccctgcggctgtgtccattagagccagtccaggacgagcttctctatgcacgagacctgatcaaagacgcaaagaactcacgggcattgtttcctagtctgtacgaacttggtcatgtgctggccaacgacgggccggtaaggcagaggctggagagcgttgcctccgaggtgagtaaagccgtggataaagagttgcaagtaattctcgaaagcatggtgtccttaacacaggagttatgtcctgtcgctatgagagtggctgaggggcataataagatgctgagcaatgttgctgagcgcgtcacagtcccccggaatttcatcagaggggctctcctggagcaggcaggacaggacatccaaaataagttagatgaagtgaagctatccgtcgtgacctacctcaccagctcgatagtcgacgagattttacaggaactgtaccacagccacaagtctcttgctcgccacctcactcagctgaggaccctgtccgatccccccggatgccccgggcaggggcaggatttatcttccaggggcagaggtaggaaccatgaccatgaggagacaacagacgatgagttgggaactaatatcgacaccatggcgatcaagaaacagaaaaggtgtcggaagatacggcccgtgtcagcttttattagtgggtccccacaggacatggaaagccagctaggaaacctgggaatccccccaggctggttttcagggctcggtgggagccagcctacggcgtcgggctcttgggaaggccttagcgagctgcccacacatggctataagttaaggcaccaaactcagggaagacccaggccgcctcgcaccactccgcctggcccgggaagaccttcaatgccagcccccggcactcgacaggagaacggcatggcaaccaggctggatgaggggttggaggactttttttcccggcgtgtgctcgaggagtctagcagttatcctcggaccctgcgaaccgttcgccctggcctgtcggaagcgccactgccaccattacagaagaaacgaagacgtgggctctttcattttaggagacctcggagtttcaagggcgatcgcgggcctggtagcccaacaaccgggctgctcctaccaccacccccacctccaccacccacgcaggagagtccgcccagtcccgacccgccatctcttggtaataatagctcgccctgttggtcacctgaggaggagagctccttactgcctggattcggcggcggccgtggacccagtttccgacggaagatgggtactgagggcagcgaaccaggtgagggagggcctgcaccaggcacagcccagcaaccacgcgtccacggtgtggccctgccgggtcttgagcgtgcaaagggctggtcttttgacggtaaacgagaaggtcccggcccggaccaggaaggtagcacgcaggcttggcagaagaggcgtagcagtgacgacgcagggcctggctcttggaagccaccgccccccccgcagtctactaagccctccttctcagcgatgagaagagccgaagccacctggcacattgcagaagaaagtgcccccaatcattcctgccagtcaccgtccccggcctctcaggatggcgaggaggagaaggagggcacccttttcccagagagaacccttcctgccagaaacgctaaactgcaggacccagccttggccccctggcctccgaagcccgtcgctgtgccaaggggacggcagcctcctcaggagccaggagtacgggaagaagctgaggcgggggacgccgctcccggcgttaacaaacctagactcaggctcagttctcagcaagatcaggaggagcctgaggtgcagggcccaccggatcccggtagacggactgcccccctgaaacctaaaagaacgcgcagggcacagagctgtgataaattggagccggatagacgtaggccacctgatccaaccgggacctctgaacctgggactgactag

SEQ ID NO: 48407 - DNA, 555 bp, Artificial Sequence
  Description of Artificial Sequence: Synthetic coding sequence
atgctgaagaagatgggcgaggccgtggcccgggtggcccggaaggtaaacgagactgtggaaagtggcagcgacactctagacttagccgagtgtaagctggtgtccttccctatcggcatttacaaggtgttgcgcaacgtgtccggccaaatccatttaatcacccttgcaaacaacgaattgaaatctctaacaagtaagttcatgactacttttagtcagctcagagagcttcatctggaaggaaactttctgcatcgcttaccatccgaggtgtcagccctccagcacttgaaggccattgacctatcacgaaaccaattccaggatttccctgaacagctgacggccctgccagctctggagactatcaatcttgaggaaaacgagatcgtagacgtccctgtggagaagcttgctgcaatgcccgcactccggtcaatcaatcttcggtttaatcctcttaatgcggaggtccgcgtgatcgctccacctctgattaaattcgatatgctgatgtcccctgaaggggcccgggcgcctctgccctag

SEQ ID NO: 48408 - DNA, 387 bp, Artificial Sequence
  Description of Artificial Sequence: Synthetic coding sequence
atgctgaagaagatgggcgaggccgtggcccgggtggcccggaaggtaaacgaaacagtagagagcggaagtgacaccttggatctggccgaatgtaagctcgtcagttttcccataggtatctataaggtgttaaggaatgtgagcggccaaattcatctaattacccttgccaacaatgaattgaagtccctaacttcaaaattcatgacaactttcagccaacttcgggatgtgcctgttgaaaaactcgccgccatgcctgccctgagaagtatcaatttgagatttaatccactgaacgcagaggtgagggtgattgcgccacctcttattaagtttgatatgctaatgtcacctgaaggagcgcgggcccctctcccatag

SEQ ID NO: 48409 - DNA, 405 bp, Artificial Sequence
  Description of Artificial Sequence: Synthetic coding sequence
atgctgaagaagatgggcgaggccgtggcccgggtggcccggaaggtgaatgaaacggtagagagtggcagtgacaccctcgagttgcatttggaaggtaactttctgcacagattaccgtccgaggtgtccgctctgcagcacctgaaggcgatagatcttagtagaaaccaattccaggatttccccgagcagcttacagccttaccagcccttgaaaccatcaatctcgaggaaaacgaaatcgtggacgttcccgtggaaaaattggcggcgatgcccgcactgcggagcatcaacctgcgattcaaccccctgaatgccgaagtacgagtcattgcgcctccactaattaaatttgacatgctgatgtctcccgagggagcccgggctccactgccatag

SEQ ID NO: 48410 - DNA, 555 bp, Artificial Sequence
  Description of Artificial Sequence: Synthetic coding sequence
atgctgaagaagatgggcgaggccgtggcccgggtggcccggaaggtgaatgagaccgtggaatccgggtctgacactctagatcttgctgagtgcaaattggtgtcttttcctataggcatctataaggtgctcaggaatgtttctggtcagatccacctcatcactctggccaataacgagctgaaatctcttacgagtaaattcatgactaccttcagccagctgcgggagttgcatctggagggaaacttcctccaccgactcccgtccgaggtctcagccctgcagcatctgaaggccattgatttgagccgaaaccaattccaagacttcccggagcaactgaccgccctccctgcactggagaccatcaacctagaagagaatgagatagtggatgttccagtggaaaaactggcagcaatgcccgctcttaggagtatcaacttacgtttcaatcccctaaatgccgaggtccgggtgatagctcctccgctgataaagtttgacatgctgatgtcccctgaaggcgccagagctccactcccctag

SEQ ID NO: 48411 - DNA, 387 bp, Artificial Sequence
  Description of Artificial Sequence: Synthetic coding sequence
atgctgaagaagatgggcgaggccgtggcccgggtggcccggaaggtcaatgagacggttgaatccgggtccgacactctggatttggctgagtgtaagctcgtcagcttccccataggcatttacaaagtccttagaaacgtttccgggcagatccacctgattaccctcgccaataacgagctgaagtcactgacgtctaaatttatgacaaccttttcgcaactgagggatgtcccggtagaaaagcttgccgcaatgcccgcacttcgctcaattaacttgaggtttaaccccttgaacgccgaggtgagagttattgccccccccctgatcaagttcgatatgctcatgagtcccgagggtgctcgagctcccttaccctag

SEQ ID NO: 48412 - DNA, 405 bp, Artificial Sequence
  Description of Artificial Sequence: Synthetic coding sequence
atgctgaagaagatgggcgaggccgtggcccgggtggcccggaaggtgaatgaaacggtagagtccggatcggataccttggaactccacttggaagggaacttcttgcataggctcccctcagaggtctctgcgttgcagcatctcaaagcgattgatttgagccgcaaccagtttcaggatttccctgaacagttaaccgcccttccggccctggaaacaattaatcttgaggagaatgaaattgtcgacgtgccggtggagaagttagctgccatgcccgcacttaggtcaatcaaccttagattcaaccccctgaatgccgaagttcgggtcatcgcaccccctctgatcaagtttgacatgctcatgtcacctgaaggagctcgcgctcccctaccgtag

SEQ ID NO: 48413 - DNA, 528 bp, Artificial Sequence
  Description of Artificial Sequence: Synthetic coding sequence
atgctgaagaagatgggcgaggccgtggcccgggtggcccggaaggtcaatgagaccgtggaatctggatctgatacgctcgatcttgctgagtgcaaattggtttccttccctatcggaatatacaaagtcttaagaaatgtgagcggccagatccatttaataacactggctaacaatgagctgaaatcactcaccagtaaattcatgacaacattttcacagcttcgtgagcttcatctcgaaggaaacttcctacacaggctgccatcagaggtctctgcacttcagcaccttaaggccattgacctgtcaaggaaccagttccaggatttccctgagcagctcaccgccttacccgcactggagaccattaatctggaggagaatgagatcgtggacgttcctgtagagaagctcgctgccatgcccgccctaagaagtattaacctccgcttcaatccattgaacgccgaagtgagggtgatcgccccccccctgatcaagtttgatatgctgatgagctag

SEQ ID NO: 48414 - DNA, 1032 bp, Artificial Sequence
  Description of Artificial Sequence: Synthetic coding sequence
atgagcgacgaggacgacctggaggacagcgagcccgaccaggacgatagtgagaaagaggaggacgagaaggaaaccgaagaaggggaagattataggaaagaaggcgaggagtttcccgaagaatggctgcccacccccttgaccgaggacatgatgaaggaagggctatcattactgtgcaaaacaggcaatggcctggcccacgcgtatgtgaaacttgaagttaaagaacgagatctgaccgatatttacctactgcgtagttacattcatctcagatacgtggatatctctgaaaaccatcttactgacctgtctcccttaaattacctgacccatctgttgtggttgaaggctgacggcaataggctaaggtctgctcagatgaacgagctgccatatctgcaaatcgcttctttcgcctataaccagattaccgataccgaaggtatttcccatcctagactcgagacactgaacctgaaggggaactccattcatatggtgaccggacttgaccccgagaaattgatatctttgcatacagtggaactgagaggaaatcagttggagtcaactctgggcatcaacttgccaaaactgaagaacctctatctcgcccaaaacatgctgaagaaggtcgaaggcctcgaggacctctcaaatctaacaactttgcacctccgggacaatcaaatcgatacactgagcggcttctcacgagagatgaagtctctccagtatctcaacctccgaggaaatatggtggctaacctgggcgaactggctaagctccgggatctacccaagttaagggccttggtccttctggataacccctgtacagacgagactagctataggcaggaggccctagtgcaaatgccatatctcgaacgcctagacaaagaattctatgaagaggaggagcgggccgaagcggatgtgattaggcagaggctgaaagaggagaaagagcaggaacccgagccacagcgggatctcgagcctgagcagtctttgatttag

SEQ ID NO: 48415 - DNA, 939 bp, Artificial Sequence
  Description of Artificial Sequence: Synthetic coding sequence
atgagcgacgaggacgacctggaggacagcgagcccgaccaggacgactccgaaaaggaagaagacgagaaagaaacggaggaaggggaggactatagaaaggagggggaagaattcccggaggaatggcttcctactccactgacagaagatatgatgaaggaaggcctgagcctgctgtgcaaaactgggaatggactagcacatgcctatgtgaagctcgaggtgaaagaaagagacctgaccgacatatatttgctccgaagttacatccatttaagatatgtagacatatccgaaaaccatcttacagacctgagcccactgaattatctgacccacctcttatggctgaaagcagacgggaataggctacgaagcgctcagatgaacgaactgccttacttacagatcgcaagcttcgcttacaatcagattactgacacagagggaatctcgcaccctagactggagacattgaatttgaaagggaacagtattcatatggttactgggcttgaccctgagaaactgataagtctgcacaccgtcgagttgaggggcaatcagctggagtccaccctcgggattaacctcccaaaactgaaaaacctgtatctcgcccagaacatgctgaaaaaggtggagggtctcgaagacctgtctaacctgacgactcttcacctccgagacaaccagattgataccctctcagggttttctcgagaaatgaaatccctccagtacctcaacctgaggaggagcaaaacgttggcttttagacccgaccagacccctcgagggtctcatcacatgtacgacagagagcaaagaatgccagttttcgccccaaagctggagatacatcacaacttgagaccccgtatatgcagcgtccctgtcctgtgggcagtgtggggcgccgaatggggagcgtag

SEQ ID NO: 48416 - DNA, 285 bp, Artificial Sequence
  Description of Artificial Sequence: Synthetic coding sequence
atgagcgacgaggacgacctggaggacagcgagcccgaccaggacgatagtgagaaggaagaagacgagaaagagaccgaggagggagaggattatagaaaagagggagaagagtttccagaggagtggcttcctaccccactgacagaggacatgatgaaggaggggttatctctcctatgcaagacaggcaatggcctggcacacgcttatgtaaaactcgaagtgaaggagagagacctcacagacatttatctactgcgctcttacatccatttacgctag

SEQ ID NO: 48417 - DNA, 1032 bp, Artificial Sequence
  Description of Artificial Sequence: Synthetic coding sequence
atgagcgacgaggacgacctggaggacagcgagcccgaccaggacgactctgaaaaggaggaagacgagaaggagaccgaagagggagaggattatcgcaaagagggcgaagaatttcccgaggaatggctgcctacgcccctaactgaggatatgatgaaggagggcttgagtctcctgtgtaagaccgggaacggccttgcccacgcttatgtgaagctcgaggtgaaggaacgggacctcacggatatctatctgctgcgctcttacatccacctgcgatacgtagacatcagcgaaaaccatttaacagacctgagccccctgaattacctgacgcacctgctctggctcaaagccgatggaaacaggttgaggagcgctcagatgaacgagctgccatatctacagatagcatcattcgcatacaaccaaattacagacaccgagggcatatctcatccccggctggagaccctgaatctcaagggtaactcaatccacatggtgactggcttggaccccgagaaacttataagcctgcatacggttgagttgcgaggcaatcagcttgagtcgacgctggggatcaacttgcctaaacttaagaatctttacttagcgcagaatatgctgaaaaaagtggagggactggaagatctgtcaaatctcacaactctgcacctaagggacaaccaaatcgatacgttgagcggcttctcacgcgagatgaagtcgctgcagtatcttaatcttcggggtaatatggtcgctaatctcggggaattagcgaagcttagggatttgccgaagctcagggccctagtgctgctggataatccctgtacagatgaaaccagctacaggcaggaagccctggtgcagatgccataccttgagcgcttggataaggaattttacgaagaggaagaaagggcagaggcagacgtgatccgccaacgcctgaaggaagaaaaggagcaggagccagagccgcagcgggatttagagcccgaacagagcctgatctag

SEQ ID NO: 48418 - DNA, 1032 bp, Artificial Sequence
  Description of Artificial Sequence: Synthetic coding sequence
atgagcgacgaggacgacctggaggacagcgagcccgaccaggacgatagtgaaaaagaggaggacgagaaagaaaccgaggaaggcgaagattaccgaaaggagggtgaagagttccctgaagagtggctcccaaccccgctgaccgaggatatgatgaaggaagggttgtccctactttgtaagaccggaaacggcctggcccatgcctacgtcaagcttgaggtgaaggagcgagaccttactgacatttaccttctgaggtcctatattcacttgcgatacgtggatatctctgaaaaccacttgaccgacctgtcaccattgaactatcttacgcatctgctatggttgaaggctgatggaaatcgactacggagcgcccagatgaacgagctgccttacctacagatagcatcattcgcatacaaccagatcactgacactgaagggatttcgcaccctagacttgaaacattgaatctaaagggcaatagcatccacatggtgaccggactggatccggagaaactgatttcactgcacacggtggagctgcggggcaaccagctcgaatccaccctggggattaatctccctaaactgaagaacctgtatctcgcccagaacatgcttaagaaggtcgagggtctcgaggacttgagtaacctaacgaccctgcaccttagagataaccagatcgacactctgtctggcttttcacgggaaatgaagtccctgcagtacttgaatctgagagggaacatggtggccaatctcggcgaactcgccaaactacgtgatttgccaaaactacgcgccctggtgctcttagataatccctgcacagacgagacaagctatcggcaggaggcactggttcagatgccttatcttgaaagactcgataaggaattttatgaggaagaggagagagctgaggcggatgtgataaggcagagactcaaggaggagaaagaacaggaacccgagcctcaacgtgacctggaacccgaacagagcctcatctag

SEQ ID NO: 48419 - DNA, 1032 bp, Artificial Sequence
  Description of Artificial Sequence: Synthetic coding sequence
atgagcgacgaggacgacctggaggacagcgagcccgaccaggacgattcagagaaggaggaagacgagaaggaaacagaggagggcgaggattacaggaaggaaggcgaggaattccctgaagagtggctgcctaccccccttacagaggacatgatgaaggaaggtctgtcactgttgtgcaagaccggtaacggccttgcccatgcatacgtcaagctggaagtaaaggaacgcgacctgacagacatctatctgctgcgttcatacatccacctccgctacgtagacatttcagaaaaccacctgacagacctgagtcccttaaactacttgacacatctgctgtggcttaaagctgacggtaacagactgagatccgcacagatgaatgaactcccttacttgcaaatcgcatcatttgcatacaaccaaattactgataccgaggggatctcccatccaaggcttgagaccctgaacctgaagggcaactctatccacatggtcaccgggctcgatccggaaaagctcatttcattgcacactgtggagctgaggggcaaccagctcgagtcaacattgggcatcaacctgccaaaactgaagaatctgtatctagcccagaacatgctcaagaaggtggaaggcctggaagatttgagcaatcttactaccctccatctgcgcgataaccaaatcgatactctctcggggtttagtcgggaaatgaagtcgctccaatacctaaacctccggggtaacatggtcgctaacttgggggaactagccaagctgagagatctgcccaaattgagagcactggtcctgttggacaatccttgcacagatgagaccagctacagacaggaagcgctagtgcagatgccatatttggagcggctggataaagaattctatgaggaagaagagcgagcagaggcggacgtgatccgtcaaagactcaaagaagaaaaggaacaggagccagagccccaacgagaccttgaaccagagcagtctcttatatag

SEQ ID NO: 48420 - DNA, 1152 bp, Artificial Sequence
  Description of Artificial Sequence: Synthetic coding sequence
atggagggcagcagcagctacgaggtgcccagcgtggccgccgccgacctcgaagagggggcaggccagacccgatctctcccggcaaccccctcaaaggatgtccataaaggtgtgggcggaatcattttctcgagctcgccgatactggatctgtccgagtcaggcctctgtcgactagaagaggtctttcggatcccgagcctgcagcagttgcacctgcagcgcaatgccctatgtgtaattccccaggacttcttccagctactgccaaatctcacatggctcgatctccgttataaccgaattaaagccctcccatccggcattggggcccaccaacacctcaagaccctcctactagaacgtaatcccatcaaaatgctccctgtggagctaggctccgtgacaacactgaaagcactcaacttgcgccactgtcctctcgaattcccaccccagctggtggttcaaaagggcctggttgcaattcaaagattcctgaggatgtgggctgtcgagcacagcctacccagaaatccgacttcccaggaagcacctccagtacgggaaatgactctgagggacctgccttcgcccgggttggaactttctggcgaccacgcttccaaccagggcgctgttaacgcacaggatcccgaaggtgccgtgatgaaggagaaagcatcgttccttccacctgtagaaaaaccagacctttcggagcttcgcaagagcgctgatagcagtgagaactggcctagtgaggaagaaataaggaggttttggaagctaagacaggaaattgtggaacacgtaaaagcagacgtgctgggcgaccagctgctgacgagagagctcccacccaatttgaaggccgcacttaacatcgagaaggagttgccaaaaccccgacacgtgttccgaacaagagtgccacggaagcaggctctccagcgcctacacgagcgtaagacaagaatcatgggagtcgttggccgcgcgcctacccacatgggagaaggtaggcagccaccaccaggagcctcataccctacaagctgtcacagaaccaaatggcgcagcgaacagaaggattggaaaagggccgaacgccggaggagcgaaagctcccgcaggagtagactgtag

SEQ ID NO: 48421 - DNA, 510 bp, Artificial Sequence
  Description of Artificial Sequence: Synthetic coding sequence
atggagggcagcagcagctacgaggtgcccagcgtggccgccgccgatctcgaggagggagctggtcagacgcggagcctacctgctacgccttctaaagacgttcataagggggttggcggcatcatttttagttcctcaccaatcctggatctgagcgaatcaggcctgtgccggctggaggaagtgtttagaataccaagccttcaacagcttcacttacaacggaatgcactgtgtgtgatccctcaggactttttccagcttctgcctaatcttacgtggctggatctacgttacaaccgaatcaaggcgctgccctctggcattggagctcaccaggagaggaatcacgccgagtctactgagcctaagactttgccgtcgggcataccctcttccgctagatgcgccgagggcataggtggttatcctgcactgccagctgacgttggcagcaggaccttgagtccccagaagtccaacttctcccgaggatccaccgggtag

SEQ ID NO: 48422 - DNA, 1407 bp, Artificial Sequence
  Description of Artificial Sequence: Synthetic coding sequence
atggacatcaacacctacaacaaccagctgcacctgcagcggaacgccctgtgtgtgatcccacaggactttttccagctgcttcccaatctcacctggcttgaccttcgctacaaccgaatcaaagcactcccaagtggcatcggcgcacatcaacatctcaagacactcctgctcgagaggaacccaatcaaaatgctgcctgtagagctcgggtctgtgaccacactgaaggcgctgaacttgcggcactgcccgctggagtttcccccccagctggtggtgcagaagggactggtggccatccaaagattcctgaggatgtgggctgtagagcattccctgccccgcaacccaacctcccaggaagccccgccggtgcgggagatgacattgagggatttgccttcacctggcttagaattgagcggggatcacgcctcgaaccagggagccgtaaacgcccaggaccccgagggggccgtgatgaaagagaaagcatcctttctgcctccagtggagaagcccgacctttccgaattgcgtaagtctgccgacagcagtgaaaattggcccagtgaggaagaaatccgcagattctggaaattgaggcaggaaatcgtggagcatgttaaagctgacgtgcttggggaccaactgcttacccgagaactcccccctaatttaaaggccgcactaaatatcgagaaagaactgccaaagccccgacatgttttcaggcgcaaaacagcaagcagcagatctatcctgcccgatctgctctcaccataccagatggcaatcagagccaaaaggctggaagaaagtcgagctgccgctctgagagaactgcaagagaaacaagctctcatggaacagcagagacgagagaaaagagctctccaggagtggagggaaagggcccaacggatgcgaaagaggaaagaagagctgtctaaactgttgccacctcgtcgctccatggtggcctcgaaaatcccgtcagctaccgacctcatagataacagaaaggtgcccctgaatcctcctggcaaaatgaagcctagcaaagaaaagtccccccaagcatcgaaggaaatgtctgccctccaggagcggaacctagaagaaaaaatcaaacaacacgtgctgcagatgcgcgagcaaagacgctttcatggacaagcccccctcgaagaaatgaggaaagctgccgaggatctcgagatcgccactgagctgcaggacgaggtactgaaactgaaattgggcctcacactcaataaggaccgccggagagctgccctaacaggtaacttaagccttggcctccccgccgctcagccccagaataccttcttcaacaccaagtatggtgagtctggaaacgttagaagatatcagtag

SEQ ID NO: 48423 - DNA, 1407 bp, Artificial Sequence
  Description of Artificial Sequence: Synthetic coding sequence
atggacatcaacacctacaacaaccagctgcacctgcagcggaacgcgctttgtgtgatcccccaagatttcttccagctcctccccaacctgacatggctggatcttagatataatcgaatcaaggccctgccgtccggcataggagcacaccagcatctcaagactctcctgctggagagaaacccgattaagatgctgccggtggagctcggcagtgttacaacgctaaaggccctcaacctacgccactgccctctggagtttcccccccagctcgttgtgcaaaaaggcttggtagcaatccagaggttcctacgcatgtgggccgtcgagcacagcctgccgagaaaccctacatcccaggaggctccacctgtgagggaaatgacgctcagggacctgccatcacctggcctggagcttagtggtgaccatgcctcaaatcaaggagccgtgaacgctcaggatcccgagggggccgtaatgaaggaaaaagccagcttcctgccacccgtcgagaagcccgacttgtctgaactgaggaaatctgccgacagctctgaaaattggcctagcgaagaagagatcaggcgtttctggaagttgcggcaggagattgtggagcacgtaaaagcagatgtgctgggcgatcagcttctgacacgggaactgccccctaatctcaaagctgccctgaacatagaaaaagaacttcctaaacctagacatgtttttcgacggaaaacagcgtcgagtcgctctattttgcctgacctgctgagtccttaccaaatggccatccgagccaaaagactggaggagagccgtgctgcagcgctgagggagctgcaggagaagcaggctctgatggagcagcagcggcgagagaagcgggctctgcaagaatggcgagagagggcgcaaaggatgaggaaacgcaaagaagagctgtctaaacttttgccccctagaagaagtatggtggcttctaagatcccaagcgccacggacctgatcgacaaccgcaaggttccactcaacccgccaggaaagatgaagcccagtaaagaaaagtcaccacaggccagcaaggagatgagtgctctccaggagcgcaatctggaagagaaaattaagcagcacgttctacagatgcgggagcagagacgctttcacggccaagccccactcgaggagatgcgaaaagccgccgaggaccttgagattgccacagagcttcaggatgaggtactgaagttgaagctgggtttgaccctcaacaaagatcgcaggcgtgccgctcttaccgggaacctttctctggggctgcccgctgcacagccccagaataccttcttcaacacgaagtacggcgagtccggcaatgttcggcgctaccaatag

SEQ ID NO: 48424 - DNA, 1593 bp, Artificial Sequence
  Description of Artificial Sequence: Synthetic coding sequence
atggagggcagcagcagctacgaggtgcccagcgtggccgccgccgatctggaggaaggagcaggacaaacacgctcgctcccagcgactccgtctaaagacgtccacaaaggagtgggcggcataatcttctccagcagccctattctcgatctttcagagtctgggctatgtagactggaggaggtttttaggatcccatctttacagcagctgcacctccagaggaacgccctttgcgtgatacctcaggatttctttcagctgctgcctaacctgacatggcttgatctacgatataatcggattaaggccctgccgtctgggatcggggcccatcagcacttaaagaccctcctgctggagcgcaatccaattaaaatgctgcccgtcgaattgggaagcgtgaccaccctgaaggccctgaaccttcgccactgccccttggagtttccgccccagttggtggtccagaagggattggtagctattcaaagatttctccgaatgtgggcagtggagcactcactccctcggaatcctacgtcccaggaggctccaccagtcagggagatgacgctgcgtgatttgcctagccccggcttggaactgagcggggaccacgcatccaaccagggggctgtaaacgcccaagaccccgagggggccgtgatgaaggagaaagcctcctttctccctcctgtggagaaacctgacctcagcgaactgcgcaagagcgcagattcttcagagaattggcccagcgaggaggaaatacgaagattctggaagctgaggcaggagatagtagagcacgttaaggctgacgtgctcggtgaccagctgttgacaagggagctccccccaaacttgaaggcggctctgaacatcgagaaggaactccctaaaccaaggcatgtcttccgaaggaaaacggccagctctcggagtattctccccgacctgttgtccccctatcaaatggctattcgtgctaagcgcctggaagaatctcgcgctgccgcactcagggaactccaagaaaaacaggctctgatggagcagcaaagacgcgagaagcgcgcgcttcaggagtggcgagagagagcccaacggatgcgcaagagaaaggaagagctgtccaagctcctccctccacgtcggtctatggtagcttcaaaaattcccagcgccactgacctcatcgacaaccgcaaggtgcccttaaacccgccaggaaaaatgaagccttcgaaggagaaatctcctcaggcatcgaaagaaatgtccgccttgcaggagagaaacctagaggagaagatcaagcagcacgttttgcagatgagggaacagcgtcggttccacggacaggctccactggaggaaatgagaaaagctgcagaagatcttgaaatcgctaccgaactacaggatgaagtgctcaaactcaagctgggcctgaccctgaataaagacagaaggagagctgccctgacagggaacctgagtctcggacttcctgccgcacagcctcagaataccttctttaacacaaaatacggagagagtggcaacgtccggaggtaccagtag

SEQ ID NO: 48425 - DNA, 1593 bp, Artificial Sequence
  Description of Artificial Sequence: Synthetic coding sequence
atggagggcagcagcagctacgaggtgcccagcgtggccgccgccgacctggaggagggggccggtcagaccagaagtcttccagctacccccagcaaggatgtgcacaaaggcgtgggcggcatcattttctccagctcacccattctggacctatcggagtcaggactgtgtagactggaagaagtgtttcgcataccatccctgcaacagctgcaccttcagagaaacgctctgtgcgtgattccacaggacttcttccagttgctaccaaacctcacttggttggacttaagatacaaccgtattaaagccctcccttctggcatcggagcccatcagcatctgaagactctcctgctcgaaagaaaccctatcaaaatgctgcctgtggaacttgggtcagtaacaacacttaaggccctgaatttacgccactgcccgctcgaatttcctcctcagctcgttgtgcagaaggggcttgtcgctatccagagattcctccgcatgtgggcagttgagcactcactaccccggaatcccacatcccaggaggctccgcctgttcgggagatgaccctgagagatttgcctagcccaggccttgagctcagtggggaccacgccagtaaccaaggcgctgtgaacgcccaggatccggagggagcagtcatgaaggagaaagcgagtttcctgccgcctgttgagaaacctgatctgagtgagctccgaaaaagcgccgattccagcgaaaattggcccagcgaagaggaaatcaggcggttttggaaattaagacaggagattgtcgagcacgtaaaggccgatgtcctgggggaccagctgctgactcgcgaattgcccccaaatctgaaggcagcattgaacattgagaaggaactgcccaagccccggcacgtgtttcgcaggaagactgctagcagccgctccatcctcccagacctcctctccccataccagatggcgataagagccaagagactggaagaatctcgcgcagctgcacttcgagaactgcaggagaaacaggcgctcatggaacagcagcgccgcgaaaagagggcactgcaggagtggagagagagggctcagaggatgaggaagcgcaaggaagaactttctaaactcctcccgcctcgccggtccatggtggccagcaaaataccctccgccaccgacttgatcgataatcggaaggtgcctttgaacccaccaggaaagatgaagccttctaaagaaaaatcaccccaggcttccaaagagatgtccgcgttgcaggaaaggaatttagaagaaaaaatcaaacagcatgtgctccaaatgcgcgagcagcgacgcttccacgggcaggctcccctcgaggagatgaggaaggctgctgaggaccttgagatcgctacagaactgcaggatgaggtgttgaaattaaagctgggtctgacccttaacaaggaccgtaggagagccgcactgaccgggaaccttagcctcggtcttccggctgcccagccgcagaacacctttttcaacacgaagtacggggaatccggcaacgtgaggagataccaatag

SEQ ID NO: 48426 - DNA, 1152 bp, Artificial Sequence
  Description of Artificial Sequence: Synthetic coding sequence
atggagggcagcagcagctacgaggtgcccagcgtggccgccgccgatctagaagaaggggctggccaaactagatccttacccgctactccctcaaaggatgtccacaaaggtgtgggcgggattatcttctcttcctcgcccattctggacttgtccgagtccggcctgtgccggctggaggaggtcttccgaatcccatccctgcagcagctgcacctgcagagaaacgcgctttgcgtgattccccaggatttcttccagctgttacccaatctcacttggctagacttacgttataatcgcatcaaggcgcttccctccggcataggcgcacatcaacacttgaagacgctgctcctggaaagaaatccaattaaaatgctcccggtggagctcgggagtgtgacaaccctcaaggccctgaacctgcgtcattgtcctttagagttccccccccagctggtggtccagaaaggcctcgtagccattcagcggttcttgaggatgtgggccgtcgagcactcattgcccagaaaccccacaagccaggaggccccccccgttcgagagatgacccttagagacctccccagtcccggactcgaactttccggagaccacgcaagtaatcaaggagctgtgaatgcacaggatcccgagggcgccgtgatgaaagagaaagctagctttctgccacccgtggaaaagccggacctctccgaactgagaaaatccgccgactcatctgaaaactggccttctgaagaggagatcagacgattctggaaattgcggcaagagattgtcgagcatgttaaagctgatgtgcttggcgaccagctgctgacacgcgaacttccacctaacctgaaggcggcactcaacatcgaaaaggagctgcctaagcccagacatgtatttaggcgtaaaactgcttcgtctagatctattttgcctgatctgctaagtccttatcagatggctatcagggccaaacgtttagaggagtcacgggccgctgcactgagggagctgcaggagaagcaggcactgatggagcaacaaagaagacccttcctgctgatattccctagagtcttccaagcattaactcgaagctccggtcgttttatcctggtccttttgtag

SEQ ID NO: 48427 - DNA, 1152 bp, Artificial Sequence
  Description of Artificial Sequence: Synthetic coding sequence
atggagggcagcagcagctacgaggtgcccagcgtggccgccgccgacttagaagagggagccgggcagacccggagcctgcccgcgaccccatccaaggacgtacataaaggtgtagggggcattattttcagctcgagcccaattttagatctgtccgaatcagggctctgcagacttgaggaagtatttcgcatcccctccctccaacagcttcacttgcagagaaacgccctttgtgtaattcctcaggattttttccagcttttgcccaacctcacgtggctcgacctccgctacaaccggatcaaggcgctgcctagtgggattggagcacaccagcatttaaaaaccctgctgctggagcggaaccccattaaaatgttacccgtcgagctagggagtgtcaccacactgaaggccctcaacctccggcattgtcctcttgagttcccgcctcagctggtcgtgcagaaaggactggttgccatccagcgattcctgcggatgtgggcagtggaacattcacttccacggaatcccacctctcaagaagcccctccagtaagggaaatgaccttgcgtgacctgccctcccctggcttagaacttagtggcgaccacgctagtaatcagggcgccgtcaatgctcaagacccggagggggccgtgatgaaggaaaaagcctcatttcttccccctgtggaaaagcccgatcttagcgaactccgcaaaagtgctgatagctccgaaaactggccctctgaggaggagatccgtcgtttttggaagctccggcaggagattgttgagcatgtgaaggccgatgtgctcggagatcaattacttacaagggagctaccccccaatttaaaagccgctctgaatatcgaaaaagaactgcccaagcctcggcatgtttttcgaaccagagtgcctaggaagcaagctctccagcgcctgcacgaaaggaagacacgtataatgggcgtggtgggcagagctccgacccacatgggggagggtcgccaaccgcctccaggcgctagttaccctaccagctgtcatagaaccaagtggcggagcgagcagaaagactggaagcgtgcagagagacgacgcagcgagtcttcgaggaggtcccggttatag

SEQ ID NO: 48428 - DNA, 1107 bp, Artificial Sequence
  Description of Artificial Sequence: Synthetic coding sequence
atgctgcccgtggagctgggcagcgtgaccaccctgaaggccctgaacctccgacactgccctttggaatttccgccccagctggtcgtgcaaaagggattagttgccattcagcggttcttacgaatgtgggccgtagagcactccttgccccgcaatccaacatctcaagaagctcctccagtgcgagaaatgactttgagggacctgccaagcccaggcctagagctgtccggtgatcatgcctcgaaccagggagctgtcaacgcccaggaccctgaaggagcggtgatgaaggagaaggccagcttccttcccccagtggaaaagcccgacctgagcgagttgagaaaatctgctgattctagtgaaaattggcccagcgaggaggaaattcgccggttttggaagctgcgtcaggaaattgtggagcacgtgaaagctgacgtgttaggggatcagcttctgaccagggagctgcctcccaacttaaaagcagctctcaatatagaaaaggagctccccaaacctcggcacgtgttccggcgcaagactgcctcctcacggagtatcctgccggatctgctatctccttatcagatggccattagggccaaacggctcgaggagagtcgagctgccgccctccgtgagcttcaagaaaagcaggcactgatggagcagcagagacgagaaaagagagcactgcaagagtggagagagcgcgcccagcgcatgcggaagaggaaagaggaactgagcaaactattacctccacgccgctccatggtggcttccaagattccatccgccacagaccttatagacaatagaaaggttccattaaatccacctggaaagatgaagcccagtaaggaaaaaagcccacaggcatccaaagagatgtccgctcttcaagagcgcaacttggaggaaaaaatcaagcagcatgtacttcagatgagagaacagcgtcgtttccacgggcaggcccccctggaggagatgcggaaagccgccgaggatctggagatctctcgcagatgggagcgaggaggaatgagagccggttgcggcgcgacgtcatggagaccacatcccacttag

SEQ ID NO: 48429 - DNA, 777 bp, Artificial Sequence
  Description of Artificial Sequence: Synthetic coding sequence
tgattccggaccagcgtgagcacccccagcggcaacaccgacatggatattaacacctacaacaatcagctgcacctgcagcggaatgccctttgtgtgattccccaagatttctttcagctgctcccaaatctgacgtggctagatttacgatacaacagaattaaggctctgccatccgggataggggctcatcagcatctgaagacgttgctgttggagagaaaccccattaaaatgctgcccgtagagttagggtcagtgaccaccctaaaagctctgaacctgaggcactgccccttagagtttcctccacagctcgttgtgcagaaaggactggtggccattcagcgctttctgaggatgtgggccgtcgaacactccttaccacgaaatccaacctctcaggaggctccacctgtgagggaaatgaccctgagagatttaccctctccaggactggaactttccggtgatcatgcaagcaatcagggcgcagtgaatgcccaagaccctgaaggcgccgttatgaaagaaaaggcctcattcttaccacctgtggagaagccagatctctcagaactcaggaaatctgccgacagctcagagaactggccatccgaagaggagatacggagattttggaagcttcgtcaggaaatcgtcgagcacgtgaaagctgatgtgctgggtgaccagcttctgacgcgcgagctgccacccaatctcaaggccgcacttaacatagagaaagagctacccaagccacgccattag

SEQ ID NO: 48430 - DNA, 1104 bp, Artificial Sequence
  Description of Artificial Sequence: Synthetic coding sequence
atggccagcgagctgtgcaagaccatcagcgtggcccggctggagaaacataagaatttatttctgaactatcgaaatttgcatcatttccctctggagcttcttaaggatgagggcctccagtatttagagaggttatacatgaagcgcaatagtctgaccagtctacctgaaaatctggctcaaaaattgcctaacctggtcgagctatatctccattccaataacattgtcgtcgtgcccgaggcgatcggttccttagttaaattacagtgcctggatttgtcagacaacgctctagagatagtttgccccgagatcggtagactgcgcgcactccgtcatttaagattagcaaacaaccagttacagttcctaccacctgaagtcggggaccttaaagagcttcagacgctggacataagtactaaccgattgctgaccttgccagagagacttcacatgtgcctgagtctgcagtatctgaccgtcgaccgcaatcgcctgtggtacgtacccaggcacctctgtcagctgccatcacttaacgaactatcaatggcaggaaatcgcctggcgttcctgcccctagaccttggcaggtcccgcgagctacagtatgtatacgtggataacaacatacatttgaaaggtctgccctcatatctctacaacaaggtgattgggtgttcagggtgcggcgcgcctattcaggtatccgaggtcaaattgctgagcttctccagtggtcagaggacagtgttcttgccggctgaagtgaaagcgattggtaccgagcatgatcacgtgctaccgctgcaggagctcgccatgcgcgggttataccacacctaccactctttactaaaagatcttaatttccttagcccaatcagtttaccgaggagcttattggaactactgcattgcccgttaggacactgccatagatgttcggaacctatgtttactatagtatatccaaagttatttccactccgcgaaacccctatggccggcctccaccagtggaagacaactgtttccttcgtagcttattgttgctccacacagtgtctccagacattcgatttgctgtcttag

SEQ ID NO: 48431 - DNA, 897 bp, Artificial Sequence
  Description of Artificial Sequence: Synthetic coding sequence
atggccagcgagctgtgcaagaccatcagcgtggcccggctggagaagcacaagaatctgtttctgaactacagaaaccttcatcacttccccctcgaactcctgaaagatgagggacttcagtacttggagcgactctacatgaagagaaattctctcacatccctgcccgagaacttggctcagaaattgcctaatctggtggaactttacctccactctaacaatatcgtcgtcgtgccggaggccatcggatctcttgtgaaattgcagtgtctagatctctctgataatgcactagaaatcgtgtgtcccgaaatcggtcgtctaagggcactgcggcaccttaggctggcaaataatcaactgcagtttttgccccctgacctggggcggagccgcgagttacagtatgtatatgtagacaataacatccatctgaaaggactgcccagctatctgtataacaaagtgatcggatgctctggttgcggggccccaatccaagtgagcgaggtgaaactactgagcttttccagcggccaaaggactgtgtttctccccgctgaggtgaaagccatcggcaccgagcacgatcatgtcctgccgctccaggaactcgctatgaggggactataccatacctatcactctctactgaaagacctgaactttttatcccctatctctctaccgcggagccttctggagctcttacactgccccttgggccattgccaccgctgctctgagccaatgttcacaattgtctatcctaaattattcccactgagagaaacacctatggcgggactgcaccagtggaagactacagtctccttcgtcgcttattgttgtagtacacagtgcttgcagaccttcgatttactcagttag

SEQ ID NO: 48432 - DNA, 456 bp, Artificial Sequence
  Description of Artificial Sequence: Synthetic coding sequence
atggccagcgagctgtgcaagaccatcagcgtggcccggctggagaaacacaagaatctgttcttgaattatcgcaacctccatcactttccactggagctgctaaaagacgaggggctccaatatcttgagaggctgtacatgaagcgaaatagcctgaccagtttgcccgagaacctagcccaaaaactgccgaatcttgtggagttatacctccattcaaacaacattgtcgtcgtacccgaggcaatcggttcgcttgtcaagctgcagtgtctagacctgtccgataacgcactcgaaatcgtgtgcccggagatagggcggttgagggccttacgccatttgcgtctcgccaacaaccagcttcaatttctccctcccgtgccccattgtggacctaagagctccatggtatgtgcagctccctcgctgcctgccgctcagccacagtag

SEQ ID NO: 48433 - DNA, 939 bp, Artificial Sequence
  Description of Artificial Sequence: Synthetic coding sequence
atggccagcgagctgtgcaagaccatcagcgtggcccggctggagaaacacaagaatctgtttctgaattaccgcaatttgcaccactttcctctcgagctgctgaaagatgagggcctgcaatatttagaaaggctgtatatgaagcggaattctctcacgtctttgcccgaaaatttagcacagaaactgcccaacctggtcgagttatacctacactccaataatattgtcgtggtccctgaggctattgggtctctcgtgaaactccagtgtttggacctcagcgacaacgccctggagatcgtgtgccccgagatcggtcgcctcagagccctgcggcacctgcggcttgcaaacaaccagctccagttccttccccccgaagtcggggaccttaaagaactccagaccctggacatcagcacaaacagactgttgacactcccagaacggctgcacatgtgtttgtctctgcagtacctgacggtcgaccgaaaccgcctctggtatgtacccagacacctctgtcagttgcccagtcttaatgagctgtctatggccggtaaccgactagctttcctaccactcgatttaggtcggtcccgggagctgcagtatgtgtatgtcgacaataacatccacctgaagggcctgccctcgtatctctacaacaaggtgattgggtgttcgggatgcggagcacctattcaggtgtccgaagtaaaactcctgtcttttagttcaggccaacgaactgtgttcctccccgcagaagttaaggccatcgggactgaacacgaccacgtgctgcctctgcaggaactggccatgagaggcctgtaccacacgtaccattccctacttaagggtcgtcagctgctcgtcctgtggcttacagccgcccccccgagcgtgtgtcgtttgctcacatgctag

SEQ ID NO: 48434 - DNA, 513 bp, Artificial Sequence
  Description of Artificial Sequence: Synthetic coding sequence
atggccagcgagctgtgcaagaccatcagcgtggcccggctggagaaacacaagaatctttttctaaattaccgtaacctgcaccacttcccactagaactgctgaaggacgaggggctgcagtatttggagagactatatatgaaaaggaactcattaacatcgctgcccgagaacctggcacagaagctccccaatctggtggagctgtatctccactccaacaatatagtggtggtccccgaggccatcggatcactcgttaagctccagtgcttggacctctctgataacgctctcgagatagtgtgtcctgagataggccgcctgcgtgccctgcgtcatttgaggctcgccaacaaccagctacagtttctgcctcctgaggtgggggacttgaaggaactgcagacactggacatatccacgaatcgcctcttgacgttacccgagcgcctccacatgtgcctgtccctgcaatatttgacagtggaccgaaatcggctttggtag

SEQ ID NO: 48435 - DNA, 672 bp, Artificial Sequence
  Description of Artificial Sequence: Synthetic coding sequence
atgtacagcagcggctggcccgccggcgccgccgagccccggcacggcaggggacgtgagctggcccaggctctcggctgcatgcacggcgctccttcccagttagcctctttgtcactcgcccactgctcctcccttaagtcacgaccagaactagagcaccaggctagtggcactaaggacgcctgccctgagccccaggggccgagcctgctcactctgagagccctacaggagttggatttgaccgcctgctccaagctcaccgacgctagcttggccaaagtcctgcagtttctgcagcttcggcaactctctttgagtctgttgccagagctcacagacaatgggctcgttgccgtggccaggggttgcccttccctagaacacctcgcattaagtcattgcagtagactcagtgacaaggggtgggcacaagccgcgagtagttggcctcgcctgcagcacctgaacctctcaagctgctcccagcttatcgaacaaacactggacgccatcggccaggcgtgccggcagttacgcgtcctggacgtggcaacatgtccgggcattaacatggccgccgtacggcggtttcaggcacagttgccacaagtgtcctgtgtgcagtcccgcttcgtaggcggggccgacctgaccctcaccctttag

SEQ ID NO: 48436 - DNA, 672 bp, Artificial Sequence
  Description of Artificial Sequence: Synthetic coding sequence
atgtacagcagcggctggcccgccggcgccgccgagccccggcacggccggggaagggagctggctcaggcactgggttgtatgcatggagcccctagccagctcgccagcctcagtttggcccactgctcctcactgaaatcacggccagagttagagcaccaggcgagtggcaccaaggacgcatgccccgaacctcaaggaccctccctcttgaccttgcgggccctccaggagctggatttgaccgcatgtagtaagctcacggatgcttcgctcgcgaaggttctgcagtttctacagctccgccagctctcattatcattgctgcccgagctgactgataatggattggtcgccgtcgctcgggggtgtccatcccttgaacatcttgcactgtcacattgtagcaggctttctgacaaagggtgggctcaagccgctagctcatggccccgcctccaacatctcaatctctcttcatgcagtcagctcattgagcagaccctggacgccatcggtcaggcctgtcgccaactcagggtcctcgatgttgcaacgtgccccggtattaacatggctgctgtgcgtcgcttccaggctcagttgccacaagtgtcctgcgtccagtcaaggtttgtcgggggggccgacttgaccctgaccttatag

SEQ ID NO: 48437 - DNA, 672 bp, Artificial Sequence
  Description of Artificial Sequence: Synthetic coding sequence
atgtacagcagcggctggcccgccggcgccgccgagccccggcacggcaggggtagagagttagcccaggctctgggctgtatgcatggtgccccatcgcagctagcctcactgagtctggcccactgctcttctctgaaatcacggcctgagctggaacaccaagcgagcgggaccaaagacgcatgtcccgagcctcagggaccctccctgttgacactgagagccttacaggagctggacctcaccgcctgcagtaaactaactgacgcatcgctggcaaaggtcctccaatttctgcagctgcgtcaactttcgctgagcctgctgccggagcttacagacaacggtttggtcgctgtggctagaggatgcccatccctagagcacctcgccctctcccattgcagcaggctcagcgacaaaggctgggcccaggccgcaagctcatggccccgcctccagcatttaaacttgagctcatgtagtcaactgatcgagcagaccttggacgcaattggacaggcatgcaggcagcttagagttttggacgtcgcgacctgtccaggcatcaacatggcagccgtgaggaggttccaggcacaactccctcaagtaagctgtgtacagtcccgctttgttggaggcgctgacctgaccctcactttgtag

SEQ ID NO: 48438 - DNA, 672 bp, Artificial Sequence
  Description of Artificial Sequence: Synthetic coding sequence
atgtacagcagcggctggcccgccggcgccgccgagccccggcacgggagaggccgggagctcgctcaggcactggggtgtatgcacggagcacccagccagctcgccagcctgtctctcgcgcactgttcctccctcaaatctcgacccgaactggagcaccaggcgagcggaaccaaagacgcttgtcctgaacctcagggcccttcactgctgaccctgcgcgccctgcaggagctggatctcacagcctgcagtaaattaactgatgcatccctcgcgaaggtcctgcagttcctgcaactgcgccagctgtccctgtctttattgcccgaattgacagataacggcctcgtagccgtcgctagagggtgcccaagtcttgagcatctagccctgtcgcactgttcccggctgagtgacaaaggctgggcccaagcagcttccagttggccacggctccagcatctgaacctcagctcttgttcacagcttattgaacagactctggatgccattgggcaggcctgcaggcagctgagagtccttgacgtcgctacctgtcccggaataaacatggccgcagtcaggcgtttccaagcacagctgccacaagtgagctgcgtgcagagccggttcgtggggggggcggatttgactcttactctgtag

SEQ ID NO: 48439 - DNA, 498 bp, Artificial Sequence
  Description of Artificial Sequence: Synthetic coding sequence
atgtacagcagcggctggcccgccggcgccgccgagccccggcacggacgcggtagagagctggcacaggcccttgggtgtatgcatggcgctccaagccaactcgcaagtctgtccctggctcattgctcttccctcaaatctcgtcctgagttggagcatcaggcatctggcacaaaggatgcgtgccctgaaccgcagggcccatccttgctgaccctccgggctcttcaggaactagatctcactgcttgcagcaaactaaccgacgcgtctttggcgaaagtgctgcagtttctgcagctgcgtcaattatctctgtccctcctgccagagttgacggataacgggttggtggcagtggcacggggctgcccctcacttgaacaccttgcactgtcccactgttcgcgtctgtctgacaagggatgggctcaggctgcctcaagctggcctcggctgcagcaccttaacctctcctcctgtagccagctgtag

SEQ ID NO: 48440 - DNA, 906 bp, Artificial Sequence
  Description of Artificial Sequence: Synthetic coding sequence
atgggcgcccggcagagccgggccagcagcaaggacaagggccccaagcggatgttgttcacaggaagacggcagaaattcagcccatgggacgatgcacttctttccggcagagacccaagatctctcctgaaaagagggatgcatcacgtctcatttagtcttgtcactcggggaatgacagatattcccgacttcctgtgggggctctcagaggttcagaagctcaacctgagccacaatcaactgagggtcctaccccccgaagtcggtaagctgacccggatcgtcgttctcaatctgtgcggcaaccggcttaaatccttaccgagagaagtcagtctgcttcagtgtctcaaggtgctgttcgtgaacatgaattgcctaaccgaggttcccgccgagctgagtttatgcagaaaattggaggttctttccctctcacacaactgtctgtctcaactgcccgcatgctttgcggatctgtctagattacgcaagttaaacctgtcaaataacttttttgcccacatccccatgtgtgtgttctcactcaaagagctcatctttttgcacgtgggcagcaatagactggaaaatatcgctgaatcaattcagcacctggcgtctctccaaatttttatcgccgaggggaacaacatacacagttttccccgcagcctctgtttagtgaccagtctggagttgctgaatctgaacaacaatgacattcagacccttccgagcgaactgcacctgctctgccgcctagtgcgcatcgcttggaatccaatggacaagggccttcacatttcccataacccattaagcaagccactgcctgagctcgttgaaggcggcctggaaatgctttttgggtatctcaaagataaaaagcatacatag

SEQ ID NO: 48441 - DNA, 1491 bp, Artificial Sequence
  Description of Artificial Sequence: Synthetic coding sequence
atgagccagacccggaagaagaccagcagcgagggcgagaccaagccgcaaacttcaacagtcaacaagttcctgcgaggcagcaacgctgagtcgcggaaagaggataacgatctaaagacaagcgattcccaaccatccgactggattcaaaaaaccgccacgagtgagaccgccaaacccctcagtagtgagatggaatggcgcagcagtatggagaagaatgagcattttctccagaaacttggcaagaaggccgtgaacaagtgtctggacctgaataactgcggtctgaccacggccgacatgaaggagatgggggaagcttttgaaatgatccctgagctggaggaactgaacctgagttggaatagtaaggtcggaggtaatctccctctgatcctgcagaaattccaaaaaggcagcaaaattcagatgattgaactcgtggactgcagtcttaccagtgaggatggcacctttttgggacaacttctcccgatgctccaatcccttgaggtgctggatttgtccatcaaccgcgacattgtcggtagcctgaattctattgctcagggtctcaagtctacctctaatttgaaggtcctgaaacttcactcgtgtggcctcagccaaaaatcagtgaagatactcgatgcagcattccgatacctgggggagctccgaaagttggacctgtcatgtaataaagacctgggcggagggtttgaggattcccccgcccagttggttatgttgaagcatttgcaggtactggatctccaccagtgttcactcacagcagacgacgttatgagcctaacacaggtgataccattactgagtaacttacaggagctggacttgtcggcgaacaaaaaaatgggctcttcttcagagaatctcttatcgcggttacggtttttgccagctctgaaatccctggtgattaataattgtgctctagaatctgagaccttcaccgcactggcggaggcctctgtgcatctatcggctctggaagtgttcaatctttcttggaataagtgtgttggcggaaacttaaagctgcttttagagaccctgaagctgagtatgtctctgcaggtgctgcgcctctcgtcttgttccttggtgactgaggatgtcgctctacttgcatccgtgatccagacaggccatctcgccaaactgcagaaactggatttgagttacaacgattccatctgtgacgctgggtggacaatgttctgccagaacgtccgattcctaaaagaacttattgagttagacatttctctgagacccagcaactttagagattgtggtcagtggtttcggcaccttctgtatgcagtgaccaaattaccccagattacagagatcggaatgaagcggtggatactgccggcatcacaggaggaggaactcgagtgctttgaccaggataagaaaagaagcatccacttcgatcatgggggatttcagtag

SEQ ID NO: 48442 - DNA, 1659 bp, Artificial Sequence
  Description of Artificial Sequence: Synthetic coding sequence
atgagccagacccggaagaagaccagcagcgagggcgagaccaagcctcagaccagtaccgtcaacaaatttctgcggggctccaacgccgaatcaagaaaggaggacaacgacctgaaaacatcggactcacagcccagcgattggatccagaaaaccgcaacatcagaaaccgccaaaccccttagcagtgagatggagtggcggagttcgatggagaagaatgaacattttttacagaagctaggcaaaaaagccgtgaataaatgcttggaccttaacaactgcggcttaacaaccgctgatatgaaggagatggttgcattattgccatttttacccgatctggaagagctagacattagttggaatggcttcgtaggtggtaccttactcagtatcactcagcagatgcatctcgtgtccaagctgaaaatactacgtctcgggagctgtaggctgacaacagatgacgttcaagccctgggcgaagcctttgagatgattcctgaactggaggaactgaacctcagctggaactccaaagtgggcggtaatctccctttgatacttcagaaatttcagaaggggtcgaagatacagatgattgaattagtggattgtagcctgacttcagaagatgggacttttcttggccagttgctccctatgctccagtctttggaggttctggatctctccatcaacagggacattgtgggaagtctgaactcaatcgcccagggactaaagtccacaagtaacttaaaggtgctcaaattgcactcctgtgggctgtcccaaaaatcggtgaagatcctcgatgctgctttcaggtatctcggtgaactacgaaaactggacttgagttgcaacaaggatcttgggggcgggttcgaggatagccctgcgcagctggtgatgctgaaacatctgcaggtgttagatctgcaccaatgtagcttaaccgcagatgacgtgatgtcccttacccaggttataccactgctgagcaatctccaagagctcgacttgagcgcaaacaaaaagatgggttcatcatctgagaatctactaagcaggctgcgcttcctgccagcgttgaagtcactcgtaattaacaattgcgccctggagtccgagacatttaccgctctggccgaggccagcgtgcacctctcagctcttgaagttttcaatctatcatggaataaatgtgtgggaggcaacttaaagcttttgctcgagactctcaaattgagcatgtccctccaagtacttaggcttagttcttgctcactggtgaccgaagatgtggccctgctggcgagcgtgatccagacaggacacctggctaagctgcagaaacttgatttgtcttataacgactctatttgtgatgccggttggacgatgttttgccagaatgtacggttcttaaaagagctgattgagctagatatcagcttaaggccaagtaatttcagggactgtgggcagtggttccgccatctcttatatgccgtgaccaaactcccccagatcacagagattgggatgaaaagatggatcctgcccgcctcccaggaggaagaactggaatgtttcgatcaggacaaaaagcgctcaattcatttcgaccatggcgggtttcagtag

SEQ ID NO: 48443 - DNA, 1260 bp, Artificial Sequence
  Description of Artificial Sequence: Synthetic coding sequence
atgggcagcagccgggaggccgcccgggcccccgcccggagccccgcatgggcatccacacaggcaagtacacctggagcggctctcgccgtgcagagagagagtcctgaatctggactacagaagcactactctaacctatgcatggagaaatctcagaagatcaaccccttcatactgcatatactgcaggaagtggacgaggaaatcaaaaaaggactggccgccggaatcactctgaatattgccgggaataaccgattggtgccagttgaacgtgtgacaggggaagatttttggattctgagcaaaatcctcaaaaactgcctatatataaacggtttggacgtggggtataacctcttgtgcgatgtaggagcatactatgccgctaagctgctgcaaaagcagctcaacctgatttatctgaatctgatgttcaatgacattggaccggagggcggcgaactgatagcgaaagtgctgcacaagaatagaacattgaagtacctgagaatgactgggaacaagattgaaaacaaaggaggcatgttctttgccgccatgctgcaaatcaattccagtttggagaaactcgatctgggcgactgcgacttagaagagtccacagttcacgtaggaagaatgttgaaagagaaccactgcctcgtggcgctccatatgtgcaaacacgacatcaaaaattcggggattcagcagttatgtgacgcactgtacctgaatagcagcctgcgctatctcgatgtgtcctgcaataaaataacccatgatggaatggtctatctagcagacgtgctaaaaagtaatacaaccttggaagtgattgaccttagcttcaaccgtatcgagaatgccggtgctaactacttgtccgagacactgacgtcgcacaacaggtcactcaaagccctcagcgtggttagcaacaatattgagggggagggcctcgtggcacttagccagagcatgaagacgaatctgaccttctcccacatttacatctggggaaacaaatttgacgaggctacatgtatcgcttactctgacctaatccagatgggctgtctgaaaccagacaataccgacgttgaacctttcgtggtggacgggagggtctacctcgccgaagtgagtaatggtttgaaaaaacactattactggactagcacatatggagagtcatatgaccacagcagcaatgccggcttcgctctagtacccgtaggccaacagccatag

SEQ ID NO: 48444 - DNA, 1395 bp, Artificial Sequence
  Description of Artificial Sequence: Synthetic coding sequence
atggccgcccagcccccccggcccgtgggcgagcggagcatgggctctagcagagaagccgcgcgtgctccagctcgcagcccagcttgggcaagcacccaggctagcaccccaggagccgccctggctgtgcagcgagagagtcccgagagcggtctgcagaagcactattccaatctgtgcatggagaaaagccaaaaaattaacccttttatactccatatcctgcaggaggtggatgaagaaattaagaagggactggccgcaggtataacactaaacatcgccggcaacaatagactcgtacccgtcgagcgggtgaccggggaggacttctggatactgtccaaaatccttaagaattgcctctatattaatggcctcgatgtcggatataatttgctgtgcgatgtcggcgcatactacgctgccaaattgttgcagaaacagcttaacctcatctacctgaatcttatgtttaacgatattggccccgaaggaggcgagctgatcgccaaggtgcttcacaagaatcgcaccctgaagtatctcaggatgaccggcaacaaaattgagaacaaggggggcatgttttttgcggcaatgttacagattaattcatccttagagaaactagatctcggagactgcgacctggggatgcaatcagttattgcatttgcaaccgttctcacacagaatcaggccatcaaagccatcaatctaaacagacctatcttatacagcgaacaagaagaatctactgtccatgtcgggagaatgctcaaggaaaaccactgcttggtggcactacacatgtgtaagcatgatattaaaaatagcggaatacagcagctgtgtgatgctctatatctcaatagttctctgagatatttagatgtgagttgtaataagattacacatgacgggatggtttaccttgctgacgtgctcaaatcaaacacaacgctggaggttatcgacttgagcttcaacagaattgagaacgctggcgcaaattacctttccgagactcttaccagtcataatcgctccctcaaagccctgtctgttgtgtccaacaacattgagggagagggcctcgtggcgctgtctcagagcatgaaaacaaacctgacttttagccacatctatatttgggggaacaagtttgacgaggcaacttgcatagcctatagtgatctgatccaaatgggctgtttaaaacccgacaatacagatgtggagccttttgtcgtcgacggccgggtctacctagcggaagttagcaatgggctcaagaaacactattattggactagcacttacggagagagttacgaccacagctccaacgccggctttgcactcgtccctgtgggccagcagccgtag

SEQ ID NO: 48445 - DNA, 1299 bp, Artificial Sequence
  Description of Artificial Sequence: Synthetic coding sequence
atggccgcccagcccccccggcccgtgggcgagcggagcatgggctcttcacgtgaagcagctcgggcgccagcccgtagtcccgcatgggctagcactcaggccagcactccaggtgccgcactcgcggttcagcgagagagtcctgagtctggcctgcagaaacactattctaacctgtgtatggagaaatctcagaaaataaacccattcattcttcatatcctgcaggaagttgatgaagagattaaaaaggggctggctgccgggatcaccctcaacattgccggtaacaatcggctggtacctgtggagcgcgtgactggagaagatttctggattctctccaaaattttaaaaaactgtctatacattaatggacttgacgtggggtacaatctcttatgcgatgtgggcgcctactatgccgcgaaactgctacagaagcagctcaacttgatctatcttaatctgatgttcaatgacataggccctgagggcggcgagcttatcgcaaaggtattgcataagaacaggaccctgaaatatcttagaatgactggaaacaaaatcgaaaacaagggcggaatgttctttgctgcaatgttacagattaatagtagcctggagaaactcgaccttggagattgtgacctcgaagagtccactgtgcacgtgggccgcatgcttaaggagaaccactgcctggtggctttgcatatgtgcaaacacgacatcaaaaactctgggattcagcagctatgtgacgcactttatctaaacagcagcctaagataccttgatgtttcatgtaacaagataacgcatgacggcatggtgtacctggccgatgtgctgaaatcaaacactaccttggaagtgatcgacctgtcttttaatcgcatagagaatgctggcgccaattacctatcagaaaccttaacatctcataaccgcagcctgaaagcactcagcgtagtgtcaaataacatagaaggcgaaggcctcgtggctctttctcagagcatgaaaaccaatctgacttttagccacatctacatttggggaaataaattcgatgaagccacatgtatcgcctacagcgacttaatccagatgggatgcctgaagccagataatacagatgtcgagcctttcgtagtggatggccgggtgtatctggccgaagtttcaaacggactaaaaaagcattattactggacctctacttacggggagtcttatgaccacagcagtaacgccggcttcgcactagtaccggttggccaacagccctag

SEQ ID NO: 48446 - DNA, 981 bp, Artificial Sequence
  Description of Artificial Sequence: Synthetic coding sequence
atgacccgggagggctaccaggtgagcttcctggacaacaagagctccggatcatcaccagaaaaagagctcatccctaagccggataccttccacttgactcacgacgccagcttgtcaaagtgtctcgacgtgggcgattcatcccagatccacccttaccagctgccttctgatgtcggactcgagaattacgatagctgttattctcagacgctatcactgcatggaagtctcggaaagcgtccccagcggtcaaagaattatcaggagtatagtatcaagccaagcaacgatataaagacgactgcctcccattcctgcggtgatctcctgactagtctttctaacccagacagctccacaggcaggctgctcaagctctcgtccgacctgtacgccacgacccacttcaactctgaccccgccgtcctggtgaacgtcgagcagcaactctcaacgtccctggacgacctgacacctgcccacggctctgtgccaaataatgccgtcttgggcaacagaactacacctctccgcacactgctactttcgcccggcaccagcgaacatagaaaaattttcacgaaacggtccctgtcccccagcaagagagggttcaagtggaaagataatatccttgcgaacctcaacttgaaacatggcttccaagatgccactggatccgagccactgtcatccgacctgggctcactgcacgggttagccggtaatcacagccctcccattagcgcccggacgccccacgtcgctactgtccttcgacaattactggagctcgtggacaagcattggaacggttccggcagtctcttgctcaacaaaaaattcctgggaaaatttgaggctaagacaggacagtctgccggcggaaagccacacttcgttcggaaaaatagtaccgtgggtggcagatgttgtcatctcaactgcgagtgggccacagtaacctacctctag

SEQ ID NO: 48447 - DNA, 2265 bp, Artificial Sequence
  Description of Artificial Sequence: Synthetic coding sequence
atggccgagcagtgggagctggacgaggagggcatccggcggctgggcgccttgacccttgagcagcccgaattggtggagagcctgagcttacaggggagttatgccgggaaaattcactcgatcggagacgctttcaggaacttcaagaatcttcggtcgttagatttaagccgaaatctgattacatctctcaaggggatacagtacctctgtagtttgcaggatctgaatctgtactacaacaatattccatccctggttgaagtctcacgcttacaacccctgccgttcttgaaagaactcgacctgcgcttgaatcctgttgttcgcaaagataccgactaccggttgtttgctgtgtacacattacagaccctggaaaaactagatgatcgcaccgtgcgcgagggggagagaaaggctgccaagctgcacttctcccagctgggaaacagtgagaactttctactcgaagtggagaaatcttcacgcgagaagactatgaaaaactgcgtcactggcgaatcttctgcctctaaggtatctgctaacgtggactcccgtatcgagatggattcaaataagggcctgttcattcccttccccaacagagaaattaaagacagcctgtcgactagcgctacacagggcaatggcactcgtgaccagaagcttgacacttttcctttagggacccagactcaagaagttgctaggcgagagatgccctcagataatcaccaggaagatgagttccgccattattcacccagacagtccaccgtgaggagtcccgagaagatgacacgagagggttatcaggtgagctttctggacaacaaaagttcaggctccagtccagagaaggagcttattccaaagccagatacgttccatctcacccatgatgcgtctctctctaagtgtttggatgtgggagattcctcgcagattcatccgtaccagctgcctagcgatgtggggctggagaattacgacagttgttattcccagacattgagtttgcatggttccctgggcaaacgccctcagcggtctaagaattaccaggaatacagcatcaagcctagtaatgacatcaagactacggctagtcatagttgcggagatctgctgacatcccttagtaatccagacagctcaacaggccggctgcttaagctctcatcagatctatacgccactacacactttaactctgatcccgctgtgctagtgaatgttgagcagcagcttagcaccagcctagatgacctcacacctgctcacggctccgtgcctaataatgcggtactgggaaacaggaccactccactgaggactctgttgttatcgcccgggacttcagaacacagaaaaatttttactaaacgctccctttctccgagcaaaaggggcttcaaatggaaagacaatatactggcaaatttgaatcttaaacacggcttccaggatgcgacaggaagcgagcctctgtctagcgaccttggatcgctccacggtcttgctggcaaccacagccctcctatctcagctaggactcctcacgtggctactgtacttagacaattacttgaattggtggacaagcactggaacggatcgggatctttactgctgaataagaaattcctcggtccggcacgagatttactgctgtctttggtggttcccgcacccagtcagccaagatgctgttctcaccccgaggacactatgaaagcattctgtaggcgtgagctggaacttaaagaagcggcacagctggttccaaatgacatggagagcctgaaacagaaactcgtgcgcgtacttgaagagaatctgattttgtccgagaaaatccagcaactggaagagggagctgcaatcagcatcgtgtccgggcagcagagccacacatatgatgacttgctccataagaatcagcagctcacaatgcaggttgcatgtctcaaccaggaactggctcagctgaaaaaactggagaagaccgtggccatcctgcatgagagtcaacggagcctggtggttactaacgaatatctcttgcagcagctgaacaaggaacccaaagggtactcaggaaaggcactgcttccccctgaaaaaggccatcatctgggcaggtcatcaccatttggaaaaagcacgctttcctcaagttccccagtggcccatgaaactggccagtaccttatccagagtgttcttgatgccgctcccgaacccggcttgtag

SEQ ID NO: 48448 - DNA, 1590 bp, Artificial Sequence
  Description of Artificial Sequence: Synthetic coding sequence
atgctgcggccccggttcctgccccccgacgaccggaccgtgcgggagggcgagcgcaaggccgccaagcttcacttctcacagctgggaaactcagaaaattttttgctagaggtggaaaagtctagtagggagaaaactatgaaaaactgcgtcactggcgaatcctcagccagcaaagtatctgccaatgtggacagtcggatcgaaatggactccaacaagggacttttcatacccttcccaaacagagaaatcaaggattcactcagtacaagcgcaacccaaggaaatggtacacgcgatcagaagctggacaccttcccattgggaactcagactcaggaggtcgcgcggcgggagatgcctagcgataaccatcaggaagatgagtttaggcactattctccaaggcagagtacagtgcgtagcccggagaagatgacaagagagggataccaagtatccttcctggataataagtcaagtgggtcctctcctgaaaaggaattaatccccaaaccggataccttccatttgacccatgatgctagccttagcaaatgccttgacgtcggggattcgtctcaaatccacccctaccagctcccgtcagacgtgggattggaaaactatgattcctgctattctcagacgctgtcactgcacgggagtctcggcaagcgcccacaaagatcaaaaaattatcaggagtactcgatcaagccctccaacgatataaagacaacggcctcccacagctgtggggacctcctgaccagtttatccaaccctgattcgagcaccgggcgactgttgaaactatcttctgacctgtatgctaccacccatttcaactcagatcctgctgttctcgtcaacgtcgagcagcagctgtcaaccagcttagacgatcttactcccgctcacggctcagttcccaacaatgctgtgctcgggaaccgcaccacccccctacggaccctgctgctcagccccggaacgtcggaacacaggaaaattttcaccaagcggagcttgtcccctagtaaacgaggctttaagtggaaggataacatactggctaatttaaacctcaagcacgggttccaagacgccacaggctcagaggaatcacttaagcagaagctggtcagagtgctggaggagaatctcatactgtccgaaaaaatccaacagcttgaggagggggccgcgatcagcatagtgtccggccagcagtcccatacgtacgacgatttattgcacaagaatcagcagctcaccatgcaagtggcctgtctcaaccaggagttggctcagctgaaaaaattggaaaaaactgttgccatcctccacgaatcacagagaagtctcgtggtaacgaatgaatacttactgcagcagctgaataaggaaccaaagggttactccggaaaagctttactgcctcccgaaaaaggccatcacttaggcagaagcagcccgttcggcaagagtactctgtcgagtagtagcccagtcgctcacgaaacaggccagtacttaatacagtcggttctagatgctgctccagagcccgggttatag

SEQ ID NO: 48449 - DNA, 681 bp, Artificial Sequence
  Description of Artificial Sequence: Synthetic coding sequence
atggagggccagtacccctgccagcccgagagcaaggcctggttcccgcgctgctacaggcagcgggtgacctgggtagtctgcaccgtctggttagaaactaccgttcctcccagtctacccgaaccccctatgtggccactgtccagcgactcgtcatggtctttgtggattagtaccggaatggcaccagctcctagtagcagcacccgatcattcagtgagagcctaaagcaaaaactggtacgggtcctcgaagagaatctgattttgtccgaaaagatccagcagctggaggaaggagccgcaattagtatcgtgtccggacagcagtctcacacatatgatgacctgcttcacaaaaaccaacagctgactatgcaagtcgcatgcctgaatcaggagttggctcagctgaaaaagctggagaagaccgtcgcaatcctgcacgaaagccagcggtcacttgtggtgaccaatgaataccttcttcagcagctgaacaaagaacccaagggatatagtggcaaagctctccttccgcctgaaaaaggccaccatctaggcaggagcagtccattcgggaagtcaaccctcagcagctccagcccggttgcacatgagactggccagtacttgattcagtccgtacttgacgctgccccggagcccggcttgtag

SEQ ID NO: 48450 - DNA, 1902 bp, Artificial Sequence
  Description of Artificial Sequence: Synthetic coding sequence
atgctgcggccccggttcctgccccccgacgaccggaccgtgcgggaaggcgagcggaaagccgcaaaattgcactttagtcagctcggcaatagcgaaaacttcctgctggaagtggaaaagtccagccgggaaaagacaatgaaaaattgtgttaccggagaatccagcgccagcaaagtgagcgctaatgtggatagtcggattgagatggattctaataaagggttgtttatcccctttcccaaccgtgagatcaaggacagccttagcacatccgctacacaggggaatggaacccgtgaccagaagctggatacctttcccctgggaacgcagacccaggaagttgctcgaagggaaatgccctctgataatcatcaggaggacgagttccgccattattcaccccgccaatccacagttaggagtcctgaaaagatgacaagggaaggctatcaggtgtcctttctggataataagtcgagtggctcaagtcctgagaaagaacttatccccaagcccgatacctttcatctcacacacgatgcttcattgtccaagtgtctggacgtgggtgattcaagccaaatacatccctaccaactgccctccgacgtgggtctagaaaactatgactcatgctattcacagaccctcagcctgcacgggtctctgggaaagagaccacagcggagcaagaactatcaggagtactccattaaaccatctaatgacattaaaactacagcctcacacagctgcggtgacctcctcacatccttaagcaatcctgactcgagtaccggcagactgttgaagctcagtagtgacctgtatgcaacaacccacttcaactccgaccctgcagttctcgtgaatgtggagcagcagttatccacatctctggatgacctgacccccgcacacggatccgtacccaacaatgctgtgttgggcaacagaactaccccacttcgcaccctcctcctctcccccggtacatccgagcatcgaaagattttcacgaagcgctctctgtcgcctagcaaaagagggttcaagtggaaggataacatccttgccaatctaaaccttaagcatggttttcaggacgccaccggtagtgagcccctctctagcgatctcggttcgttacatggcctggccggtaatcacagtcccccaatctcagcccggacacctcacgtcgccaccgtgctgcggcaactcctagagctggtggacaaacattggaatggctcaggatcgctgctcctcaacaaaaagtttctcggaccagcccgcgatcttctgctctctctggtggtcccagcaccatctcagcccaggtgctgctctcatcccgaagacacaatgaaagccttctgtcgaagagagttggagctcaaggaagcagcacagctagtgcctaatgacatggaatctctcaaacagaagctggtccgagttcttgaggaaaatctgatactctccgagaagatacagcagttggaggaaggcgccgccatcagtattgtgtcgggccagcagagccacacatacgatgatctgctgcacaagaaccagcagctcacgatgcaggtcgcctgcctcaatcaggaattagcccagcttaaaaaactggagaagaccgtggcaatacttcatgaaagccaacggtccttggttgtcactaacgagtatctgctgcagcagctcaacaaagaacctaaaggctactccggcaaggcacttttacctcctgagaagggccaccatctgggccgctcaagcccgtttggcaagagcacattaagcagcagttcgccagtcgctcacgaaaccggccagtatctcatccagtcagttttggacgcagcccccgagcctgggttgtag

SEQ ID NO: 48451 - DNA, 5103 bp, Artificial Sequence
  Description of Artificial Sequence: Synthetic coding sequence
atgagcagcgcccagtgccccgccctggtgtgcgtgatgagccggctgcgcttctggggaccgtggcccctgctcatgtggcagttactgtggctgctagtaaaggaagcacagccccttgagtgggtaaaggaccccctccagctgaccagcaacccactaggtccccctgattcttggtcatcccatagcagccacttcccccgcgaaagtcctcatgctccaacgctgcctgctgatccgtgggactttgaccatctcggcccttctgcaagctccgagatgcctgctccccctcaggagtcaaccgagaacttggtgcccttcttggatacatgggacagtgccggtgaacagccacttgagcctgagcagttcttggctagccagcaggatcttaaggacaaactgagccctcaggagagactgcctgtgtctccaaaaaaattgaagaaagaccctgcccagcggtggagtttggctgaaataatcgggataacgcgacagcttagcaccccgcagtcccagaagcaaacgctgcagaatgagtacagctcaacagacacaccgtacccagggagtttgccacctgaactgagagtgaaaagcgacgaaccccctggcccctccgagcaggtgggcccctctcagttccacctggagccagaaacccagaaccctgagacgctcgaggatatccagtcatcttctctccagcaagaggccccagcgcagctgccccagctcttggaagaggagcctagctctatgcagcaggaggctccagctctgccaccagaatcctccatggagtccctgaccctcccaaatcacgaggttagcgtacagccgcccggcgaagaccaagcttattatcacctccctaatataactgttaaaccagcggatgtggaagtaaccattactagtgaaccaactaatgaaactgagtcctcacaagctcagcaggaaaccccaatacagttcccagaggaggtagaaccaagcgctacacagcaggaggccccaattgaacctccagtccctcccatggaacacgagttgtctatctctgagcagcagcagccagtgcagccctctgaatcccctagggaagttgagtccagcccaactcaacaggagacccctgggcaacccccggagcatcacgaggtaaccgtgagcccacccggacaccaccagacccatcatcttgcaagcccttctgtctcggtaaagccacccgacgtccaactcaccatcgccgccgagcccagcgctgaagtcggaacatccctggtgcaccaggaagcaactacacggctttctggatctggtaatgacgtggagccaccagctattcagcacgggggacctcctctgttaccagagtcctccgaggaggccggccccttggccgtacagcaggaaacctcctttcagagcccggaaccaatcaataacgagaacccctcccccacccagcaagaagctgcagctgagcaccctcagaccgcagaagaaggggagagctcactgacacatcaagaggcacccgcccaaaccccagaatttccaaatgtcgtagttgcacagccgcccgaacattcacacctgacacaagccacagtacagccactggatctgggattcactataacccctgaatcaaagactgaggtggagctgagcccaactatgaaggagacaccgacgcagcccccaaaaaaggtggtaccacagctcagggtttatcagggtgttactaaccctactcccggccaggatcaggctcaacaccctgtttccccgagcgtgaccgtacaacttctggatctcggcctgacgattaccccagagcccaccaccgaagtcggtcattccactccacccaagcgaactattgtgtcgcctaagcacccagaagtgaccctcccacatccagatcaggtccagacgcagcattcccacctgacccgagccaccgttcagcccctggacctgggctttacaataacccccaagtcgatgactgaggttgaaccatcgacagcactgatgacgacagccccacctcccgggcatccagaagtgacactgcccccgtcagacaaggggcaagcccagcacagccacctgacgcaggctacggtgcagcctctggatctggagctaacgataaccacaaagcccaccacagaggttaaaccgagccctaccaccgaggagactagcacccagcctcctgatttagggctagctattattccagaacccactacagagacgcggcacagtacagcactggagaaaaccaccgctcctaggcctgaccgggtgcagaccctgcatcgtagtctcactgaggtgaccggcccgccaacggaattggagcccgctcaggacagtctggtccagtccgagtcatacacacagaacaaagcattaacagcaccagaagagcataaagcatcgaccagtacgaacatttgcgaactttgcacttgtggtgacgaaatgctgagttgcatagacctcaacccagaacagcgcctgagacaggtgccggtgcctgaaccaaatacccataacggaaccttcactattttgaactttcagggaaattacatcagctacatcgatgggaacgtctggaaggcgtactcttggaccgagaaacttattctgcgagaaaacaatctgaccgaactgcacaaggattcctttgaggggcttttgtcccttcaatacctggatttatcctgcaataaaattcagtcaatagaaagacacacctttgaacctctccctttcttaaaattcattaatctcagctgcaatgttatcaccgagttatcctttggtacatttcaggcctggcatggcatgcagtttctgcacaagcttattctcaatcataatcctctaaccaccgtggaagatccgtatttattcaaactccctgccctcaagtacctcgacatgggaacaacgctggtgccattgaccaccttaaagaatattctgatgatgaccgtggagctggagaaattgattctccccagtcacatggcatgctgtctgtgtcaattcaagaatagcatagaagcagtgtgtaagaccgtcaaactgcactgcaacagcgcctgccttaccaataccacacattgccctgaagaagcaagcgtcggtaatcccgaaggtgcatttatgaaagtccttcaggctcgcaagaactacacctccacagagctaattgttgagccagaagaaccgtctgactcgtccgggatcaacctgtcggggtttggatctgagcagctggacaccaatgacgagtcagactttatatccactctctcatacatcctgccctactttagcgctgtcaatctggacgtgaaatctctgcttctcccattcataaagctgccgacaactggcaatagtttggccaagattcagaccgtggggcagaatcgacagagggtgaaaagggtgctgatggggcccagatccatccagaaacggcacttcaaggaggtggggcgacaaagtatcaggcgtgaacagggggcccaggcttccgttgaaaatgcggcagaggagaaacggctcggatccccagccccccgggaagtcgagcagccccacactcagcagggcccagagaagcttgcaggcaacgctgtgtacacaaaaccttcgttcacccaggagcacaaggcagcagtgtctgtcctcaagccattttcaaagggcgctccgtctacatctagtccagctaaggcactgccccaagtgcgagatcggtggaaggatcttacccacgccatttctatactggaaagcgccaaggcccgagtcacaaacacgaaaacttccaaacctatcgtccatgcaaggaagaagtatcgattccataaaacacgctctcatgttactcaccggaccccaaaagtcaaaaagtcgcccaaagttcggaaaaaatcttacctgagccgtctaatgcttgccaaccggctcccctttagcgcagctaaatccctcattaattcccccagtcaaggcgccttttccagcctcggagacctctctccgcaggagaatcctttccttgaagtgagcgccccgagcgaacacttcatcgagaacaataacacaaaacataccactgcacgaaacgcctttgaagaaaacgacttcatggaaaacaccaatatgcccgaaggaacgatttcagagaacaccaactacaatcatccccatgaagcagacagtgccgggaccgcgtttaatctggggcccaccgtgaagcaaaccgagacgaagtgggagtacaataacgttggcaccgacctctcccctgaaccaaagtcctttaactatcctctacttagcagccctggcgatcaattcgaaattcaacttacacagcaacttcagtctctgattcccaataacaacgtccggagacttatagctcacgtgattcgcaccttaaagatggattgttccggggcccacgtccaggtgacttgtgccaagctgataagtcgaacgggccatttaatgaaattgctgtcgggacaacaggaagtgaaggcttctaagattgagtgggacacagatcaatggaagatcgagaattacatcaacgagtcaactgaagcacagagcgagcagaaagagaagtctctggaactgaaaaaggaagtcccgggctatggctacacagacaaattaattctggcactgatagtgactggtattttgaccattctcatcattttattttgcctgattgtgatctgttgtcatagacgaagcctacaggaagatgaagagggcttcagccggggtatttttcgattcctgccatggcgcgggtgttcctcgcggagggaatcacaggatgggctgagttcgttcggacagcccctgtggtttaaagacatgtacaagcccctgtctgcaactagaattaacaaccacgcatggaaactccataaaaaaagctctaatgaagacaagattctgaacagggatcccggcgattccgaagcacctaccgaggaggaggagtcagaggcactgccttag

SEQ ID NO: 48452 - DNA, 5103 bp, Artificial Sequence
  Description of Artificial Sequence: Synthetic coding sequence
atgagcagcgcccagtgccccgccctggtgtgcgtgatgagccggctgcgcttttgggggccgtggcccctgctgatgtggcagctgctatggcttctcgtcaaagaagcccaaccccttgagtgggtcaaagatcctttgcaattaacctccaatcccctaggcccccctgattcgtggtcctcccactcgagtcatttcccaagagagagtccacacgcgcctactctacccgccgacccctgggattttgaccacttagggccttcagcttcatccgagatgcccgccccgccacaagaaagtaccgaaaatcttgtacctttcttggatacttgggatagtgccggggaacagccgctggaaccagaacaatttctcgctagccagcaagacctgaaggataaactcagcccccaagagcgtctgcccgtgtcacctaagaaactgaaaaaagatccggcgcagcgctggtcactggccgagatcatcggtattacccggcagctgtcaactcctcagagccagaagcaaacactgcagaatgaatatagctcaaccgacactccctatcccggatcacttcctccggagcttagggtcaagtccgacgaacctccaggcccctctgagcaagtggggccgtcccaatttcaccttgaacccgaaactcaaaaccccgagacgttggaggatatccagagttccagccttcagcaggaagcccccgctcaactgccacagcttttggaagaagagccgtcttctatgcagcaagaggctcccgctctgccccccgagagctccatggagagcctgaccctgccaaaccacgaagtttcggtgcagcctccaggggaagaccaggcttattaccacttaccaaacatcaccgtcaaacctgccgatgtggaagttacaataacttccgaaccgactaatgaaaccgaaagcagccaggctcagcaggaaactcccatccagttccccgaggaggtggagccttctgccacccaacaagaggcaccaatcgagcctccagtcccacccatggagcacgagctgtctatcagcgaacagcagcagccggtccagccttctgaatctcccagggaagtggaaagtagcccaactcagcaggagacaccaggacagcctccagagcaccacgaagtcaccgtttccccgcctggacatcaccagactcaccacctagcttcaccttcggtatctgttaagccgcctgacgttcagctgaccatcgcggctgagccctctgccgaagtgggcacaagcctggtgcatcaggaagcgaccactcgactcagcggctccggaaatgacgtggaacctcctgcaatccaacacggcggacctccactcctgccggagtccagcgaagaagcgggccccctggcggtgcagcaagaaactagctttcagagtccggagccaattaataatgaaaacccaagtcccacgcagcaggaggcggcagccgagcacccgcagacagctgaagagggggagtcatctctaacccatcaagaagcaccagcccagacaccagaatttcctaatgtggtagttgctcagccacccgagcattctcacctgactcaagcgactgttcagcccctagatttgggatttaccattactcccgaatctaaaacggaggtggagctaagcccaaccatgaaggaaacacctacacagcctcctaagaaagtggtcccccagctccgagtgtaccagggggtgacaaaccccacccccgggcaggatcaggcacaacacccagtatctccctctgtgactgtgcagcttctcgatttggggttgaccatcacccctgaaccgacgaccgaagtggggcacagtactcctcctaagcgtaccattgtgtcgcctaaacaccccgaagttactttgccacacccagaccaggtccagacccaacacagccacttgacacgcgctacagtgcaaccgctagatctggggttcacaatcaccccgaagagcatgactgaggtcgagccgagtactgcccttatgactaccgccccacctcctgggcacccggaagtgactttaccaccatctgacaaggggcaggctcagcattctcacctgactcaagctaccgtgcagcccttggaccttgaacttaccataacaactaagccaacaacagaagtaaagccctcgcccaccacagaagagacctcaacacagccccctgatctcgggttagctataattccggaacccaccactgagacaagacattcaaccgctctggagaagaccactgctcccagacccgatcgagtgcagacgctgcatcgctcactcactgaagtgactggccctcctacagaactcgagcctgcgcaggattccttagtgcagagtgaatcctatacccaaaataaggctctgacagctcccgaagagcataaggctagtacatccaccaatatctgcgagctgtgcacctgtggggacgagatgctgtcatgcattgacttaaatccagaacaacggttgcggcaggttcctgtccccgagcccaatacgcacaatggtaccttcaccatcctgaactttcagggaaactacatctcttacattgacggaaatgtgtggaaagcatacagctggacagagaaactcatcctcagggaaaacaatttgacagaattgcacaaagattcttttgaggggcttctttctttgcagtatctggacctatcctgtaataaaatacagtctatagaaagacacacatttgagcctcttcctttccttaaattcatcaacctgagctgtaatgtgattactgagctgtcgtttggcaccttccaagcctggcatggtatgcaattcctccacaaattaattttgaaccacaacccccttactacagtggaggatccatatctatttaagttgcctgcccttaagtatctggacatgggcactaccctcgtgccactcacaacacttaagaatatcttaatgatgacagttgaactagaaaaactgatcttaccatcccacatggcctgttgtctctgtcaattcaagaacagcattgaagccgtctgcaaaaccgttaaactccactgtaacagcgcctgtctcacgaatacgacccactgccctgaagaagcctctgtgggaaaccctgaaggcgctttcatgaaagtgctacaggccagaaaaaactatacttccacggagttaattgttgagcctgaagagcccagcgacagctccgggattaacctttccggttttggtagcgagcagttagacaccaatgacgagtcagacttcattagcacgctgagctatattctgccttacttttctgcagttaaccttgacgttaagagtctcctactccctttcatcaagttgcccacgacaggtaacagtctggctaagattcagacagtgggccagaaccggcagagggttaagcgggtgctaatggggcctcgatccattcagaagcgtcactttaaggaggtggggcgacagagtattcggcgagaacaaggtgctcaggcctccgtggagaatgctgctgaggaaaaacgcctgggtagccccgcaccaagggaggtagagcagcctcacactcagcaagggccagagaagctcgctgggaacgccgtctataccaaaccttccttcacccaagagcataaggccgccgtcagcgtcttgaaacctttttcaaaaggggcccccagcaccagtagtccggccaaagctttgccacaggtcagagacaggtggaaggatctcacccacgctatttccatcttggaatctgcgaaggcgcgagtaactaacacgaagaccagtaagcctatcgtccacgcgaggaaaaagtaccgattccataaaaccaggagtcatgtgacccacagaactccaaaagtcaaaaaaagccctaaggtgcggaagaagtcctatttgtcccggttgatgctggcaaaccggctgcccttttcagccgccaaaagcctgatcaactctcccagtcagggggcgttttccagcttgggggatctgagcccccaggaaaaccctttcctggaggtgagcgcccccagtgagcattttatagaaaacaataacaccaagcacaccactgccaggaacgcgttcgaagagaatgattttatggagaataccaacatgccagagggaaccatttcggagaatactaattataatcacccccatgaagctgatagtgccggcactgcatttaacctgggcccaactgtgaagcaaacagagaccaaatgggaatacaataacgtaggcaccgatctatctcccgagcccaagtccttcaattaccccctcctgagcagccctggcgaccaatttgaaatccaattgacacagcaactccagtccctcattcccaacaacaatgtccgtagattaatcgctcatgtgattaggacattaaaaatggactgtagcggcgcacatgtccaagtgacatgtgccaagctgatcagtagaaccggacatctaatgaagctcctgagcggccagcaagaagttaaagcttctaaaattgagtgggataccgaccagtggaaaatagaaaactatatcaacgaaagtaccgaagcacagagcgagcagaaagagaaatcgctagaactgaagaaagaggttcctggctacggctacacagacaagctaattctcgcactgatcgtgacagggattctgaccattctgataatcctgttctgtctgatcgtgatctgttgccaccgcaggtctctccaggaagatgaggagggtttctctagagggatcttccgatttttgccttggagaggctgctctagtagacgcgaatcccaggatggcctctcctcattcgggcaacccttgtggtttaaagatatgtataagccccttagtgcaacccgaataaacaaccatgcatggaagctgcacaaaaagagcagcaacgaggacaaaattctgaaccgcgatccgggcgactctgaggcacctacagaggaagaagagtcggaagccctcccatag

SEQ ID NO: 48453 - DNA, 1008 bp, Artificial Sequence
  Description of Artificial Sequence: Synthetic coding sequence
atgaccgagaacgtggtgtgcaccggcgccgtgaacgccgtgaaggaggtgtgggaaaagaggatcaagaagctgaacgaagacctaaaacgggagaaagagttccagcataaattggttagaatttgggaagagcgtgtatcattgactaagcttagggaaaaggtaactcgcgaggacggccgcgtgatcctgaaaattgagaaggaggaatggaagactctgcctagctctcttctgaagttgaaccagcttcaagaatggcaattgcatcggacagggctgctgaagattccagagtttattggaagattccagaatctcatagtgcttgatctctcgagaaataccattagtgagattccgccagggatcggtcttctaactaggttacaggaactgattctgtcctataataaaatcaagacagtccccaaggagctttctaactgtgcgtcactcgaaaaacttgagttggcagttaatcgggacatttgtgatttacctcaggagctctcgaatttgctcaagctgacacatctcgacttatcaatgaatgactttacaacaatccctctggctgtattgaacatgccagcactggagtggctggacatgggatccaataagctagaacagctaccagatacaattgagcgaatgcagaacctgcatacactgtggctgcagaggaatgagatcacttgtctccctcagacaattagcaatatgaagaaccttggcactcttgtactgtctaataataaactgcaagatatcccggtgtgcatggaagaaatggctaatctccgattcgtaaatttcagagacaatcccctgaaacttaaggtgagtttgccaccctcagagggcactgatgaagaagaggaaagagagctctttggactgcagtttatgcacacttacatccaagaatcacgaagacgggcggaccaccaggtgaatgggtcaaccaccctgccaattagcataaacaccgacgggtag

SEQ ID NO: 48454 - DNA, 1020 bp, Artificial Sequence
  Description of Artificial Sequence: Synthetic coding sequence
atgaccgagaacgtggtgtgcaccggcgccgtgaacgccgtgaaggaggtttgggagaagaggattaaaaaactgaacgaagacctgaagcgagagaaagaattccaacacaaactggtgcggatttgggaggagcgcgtcagcctgacaaagcttagggaaaaagtgacgcgggaggacgggcgtgtgatccttaaaatagagaaggaagaatggaagacactgccttcatcacttcttaagctaaaccagttgcaagagtggcagctgcatcggaccgggttattaaagatccccgaattcatcggccgattccagaaccttatcgtacttgacttatcccggaacaccatctcagagatccctcctggaattggtctcctaactcggctccaggagctgatcctgtcctacaataagattaaaacggtcccaaaagaactctcaaactgcgcaagtctggaaaaattagaactggccgttaatcgggacatctgcgatctaccccaggagttaagcaatttactgaaactgacccacctggatctgagcatgaatgattttacaacgattcccctggctgtgctgaatatgcctgcgctcgagtggctggatatgggaagcaacaaactagagcagttgcctgacaccatcgagcgaatgcagaatctgcatacgctgtggctccaacgtaatgagattacgtgcctgccacagactatatctaatatgaagaacctgggaacgctggtgctcagtaacaataagctccaagacatccctgtatgcatggaagagatggcaaacctcaggttcgttaactttcgggataatcctttaaaactcaaggtctccctgcccccaagtgagggcacagacgaagaggaggaaagggaactcttcggtctccaattcatgcacacctacatccaggagagcaggagaagagctgcactgcaattctgcgtctgccatggtcagattctgaccatttatacctgcatggcgctggaaatttag

SEQ ID NO: 48455 - DNA, 1008 bp, Artificial Sequence
  Description of Artificial Sequence: Synthetic coding sequence
atgaccgagaacgtggtgtgcaccggcgccgtgaacgccgtgaaggaggtgtgggaaaagagaattaagaagctgaatgaggatctcaaaagggaaaaggagttccagcataagctcgttcgaatttgggaggaaagagtcagtctaaccaagctcagggagaaggtcacccgcgaggacgggagagttatcctgaaaatagagaaagaggaatggaagaccctcccctctagtcttctgaaactgaatcaattgcaagagtggcagctccaccgtacaggcctgctaaagataccggagttcattggcaggtttcaaaacctgattgtgttggacctgagcagaaatacgatcagcgagattccaccggggataggcctactgaccagactgcaggaattaatcctgagttacaacaagataaaaactgtgccaaaagagctctctaattgcgcatctcttgaaaaattggaattagcagttaatcgggacatatgcgacttgcctcaggagctaagcaatctgctcaaactgacacatctggatctatccatgaacgacttcaccacaatccctttagccgtgctaaatatgcccgccttggaatggctggacatgggaagtaataaactggagcaactcccagataccattgaaaggatgcagaatttgcacacgctgtggctccagcgcaacgagattacctgtctgccccagactatatcaaacatgaaaaacctcggtaccctggttctgtctaacaacaagctgcaggatatacctgtgtgcatggaagagatggcaaacctcagatttgtgaattttcgggataacccgcttaagctgaaggtgagcctgcccccaagcgaagggacagatgaggaagaagaacgcgaactgttcggtttgcagttcatgcacacctatatacaggagtctaggcggagagctgatcatcaggtcaacggatctactacccttcccatctccattaacactgatggctag

SEQ ID NO: 48456 - DNA, 1020 bp, Artificial Sequence
  Description of Artificial Sequence: Synthetic coding sequence
atgaccgagaacgtggtgtgcaccggcgccgtgaacgccgtgaaggaggtgtgggagaaaagaattaaaaaactaaatgaggaccttaagagagagaaagaattccagcataaactggttcgcatatgggaggaaagagttagtcttaccaagctgcgggaaaaagtaacgagagaagatggaagagtcatcctgaagatcgaaaaagaagagtggaagacccttcccagctcactgctcaaattaaatcagttgcaggaatggcagctgcatcggactggcctgctgaaaattccagagttcatcgggagatttcagaatttaatcgtgttggacttatctaggaacaccatctcagagatccctccaggaatcgggttactgacaagactccaggaattgattctctcctataacaaaataaaaaccgtgccaaaagaactgagcaactgtgcctccttagagaagttagagctggccgtgaacagagacatctgcgacttgccgcaggagctgtccaaccttctgaagttaactcatctagatctgagtatgaacgatttcaccactattccattggccgtgctgaacatgccggcacttgaatggctggatatggggagtaataaacttgagcaactgcctgatacaattgaaaggatgcaaaacctgcatactctgtggttacaacgcaacgagatcacgtgtctcccacagaccatttccaatatgaagaacctcggcaccctcgtgttgagcaataataagcttcaagacatccctgtttgcatggaagaaatggcaaacctgcgatttgtcaacttccgggataatcctctcaagttgaaagtgagcttgcctcctagtgaggggactgacgaggaggaagaaagggagctttttggactccagttcatgcatacttatatccaggagtcacgccggcgtgccgcactgcagttctgcgtctgtcacgggcaaatcctaacaatctacacttgtatggctctggaaatctag

SEQ ID NO: 48457 - DNA, 1809 bp, Artificial Sequence
  Description of Artificial Sequence: Synthetic coding sequence
atgagccggctgaagcggatcgccggccaggacctgcgggccggcttcaaagccgggggtagagattgcggcaccagtgtaccccaggggttgctcaaagcagccagaaagtcgggccagctgaacttatcaggtcgcaatctttccgaggtcccccagtgcgtatggcggattaacgtggacatacccgaagaagccaatcagaatttgagtttcggggccacagagcgctggtgggaacagacagatctgactaagctgataatctccaataacaaacttcagtcactgaccgatgatctgcgattgcttcccgctttgacagttcttgatattcacgataatcagctcacaagcctcccttcagccatcagagagctcgagaacctgcagaagctcaatgtctcccacaataagctgaagatcctgcccgaggagattacaaatctccgaaacctcaagtgcctttatctccagcataatgaactcacgtgtatttcagagggatttgaacagctgagcaacctggaggacctcgatcttagtaataatcacctaactactgtgcctgcttcatttagcagcctttcctccttagtgcgtctaaaccttagtagcaacgaattaaaatccttgcctgcggagatcaaccgaatgaaaagactcaagcatctggattgcaacagcaacctgctggagaccatacctccagaattggccgggatggaatctctcgagttgttgtatttgagacggaacaaactcaggtttctgcccgagttccctagctgtagcctgctcaaagaactgcacgtcggcgaaaaccaaattgagatgcttgaggcggagcacctgaagcatctcaattcaatactggttctggatctccgggacaataagttaaaaagtgtcccagacgaaatcattttgctccgatctctggagagactggatctttctaataatgacattagcagcttaccgtactccttagggaacctgcacctaaagtttctggcccttgagggaaatcccttgagaaccatccgcagggaaataatatccaaagggacacaggaagtgctgaaatacttgaggagtaaaatcaaggacgacggaccctctcagtccgagtcggccacggaaacagctatgacactgcccagcgagtctcgagttaatatccatgccataatcaccctgaaaatcctagactactcagataagcaagccactttgataccggatgaagtatttgacgccgttaaatccaacattgtcacctccattaatttttctaagaatcagctgtgcgagatccccaaacggatggtggagctgaaagaaatggttagcgacgtggacctctcattcaataaactgtctttcattagtctggagctatgcgtgctgcagaagctcacgttccttgacttgcgaaacaatttccttaactccctacccgaggagatggagtccctggttagactgcaaactatcaatctctccttcaatcgttttaagatgttgccagaagtgctttacaggatctttacactagaaactatccttattagcaataaccaggtgggctccgttgacccacagaaaatgaagatgatggagaacctgactactcttgacttgcagaataatgatttgctgcagatccccccggagctcggaaactgcgtgaatcttagaacgctgcttttagacgggaaccccttccgagtgcctcgagcggccatattgatgaagggcacagctgccatcttagaatacctgcgggaccgcattccaacgtag

SEQ ID NO: 48458 - DNA, 651 bp, Artificial Sequence
  Description of Artificial Sequence: Synthetic coding sequence
atgctgcagggcgccaccgagctggtggccgagcccaaccggcgggtcctagagaccctggcatcgtctttgcacacactcaagtttagacaccttctctttagtgatgtcgctgcccaacagtcgctccgtcagctgctccaccagctgatacaccacggggcggtgagtcaagtctctctgtattcttggccggtgcctgagagcgcactgtttattctcattttgactatgtctgccgggttttggcagccgggaccaggaggccctccttgccggctgtgtggtgaggcatcccgcggccgcgcaccatctagagatgaaggttccttgctactcggcagtagacggcctcggcgagatgctgctgagaggtgtgccgccgcactaatggcttcaagacggaaatcggaggcaaagcagatgcccagggcagcacctgcaacacgggtgaccagacggagcacacaggaaagcctcaccgccgggggaaccgaccttaaaagagagctacatcctcagccgccccctatgcggctactggcacccagcggacatttgttactccagcaacctccgcctctgcccctgctgcttcatcctcatacaaatggacaccaacttgctcagccgcacagcctcagcccttag

SEQ ID NO: 48459 - DNA, 2439 bp, Artificial Sequence
  Description of Artificial Sequence: Synthetic coding sequence
atggccgcccccgaggcctggcgggcccggagctgctggttctgcgaagtcgccgctgccaccacgatggaggcgacttctcgggaggccgcacctgccaaatcgagcgcgagtggacctaatgccccgccagcactgtttgaactttgtggcagagcggtctcagcacacatgggggttctcgagtccggcgtgtgggctctgcccggcccaattctgcagagcatactgccactgttgaacatttactacctggagcgcatcgaggagactgctctgaaaaagggcttatccactcaggctatatggcgaagactctgggacgagttgatgaagacccgcccttcctcactagaaagcgtgacatgctggagggccaagtttatggaagcatttttcagtcacgtattacgcgggacaatcgacgtatcttcagacaggaggctttgtgaccagagatttagccctttgttgcattcctctcgccatgtccgccaattgaccatctgtaacatgctgcagggtgctacagaactggtggcagagccaaatcggagggtgctggaaactttagcatccagcctgcataccctcaagtttcggcacctcttgttcagcgatgtggcagcgcagcagtctttacgacagctgctgcaccaattaatccaccatggtgccgtctctcaggtatctctgtactcctggccagtgcccgagtcagccctgttcatcttaatccttactatgagcgccggcttttggcagccagggcctgggggcccgccttgcagactttgtggcgaggctagcagagggcgggccccgagccgggacgagggctcactattactcggatctagacggccccggagggacgctgctgagcgatgcgcggctgcattgatggctagtcgcaggaagtctgaagcaaagcaaatgcctcgggccgcccccgccactagagtaacccgacgatccacccaggagtcactgactgcaggtggaactgaccttaagagagagttgcacccacctgccacttctcacgaggcgcccggcacaaagagaagcccaagtgcccctgccgctacaagctccgccagttcaagtacctcatcctacaagcgtgcaccagcctcctccgcaccccagcccaaaccactcaagagattcaagcgcgcggctggcaaaaaaggtgccagaacacgacaggggcctggagccgagtccgaagatctgtacgacttcgtattcatagtcgcaggcgagaaggaagatggggaagagatggaaattggtgaggtagcatgtggggctctcgacggaagcgacccttcttgcttggggctgcccgccctggaggcttcacaacggttccggtcaatcagcacgttggagctgttcactgtaccactgtcgactgaggccgctctgaccttatgtcatcttctgagtagctgggtctccctggagtctttaactttgagttacaacggactcggctcgaacattttccgactgctagactctctgagggccctgagcggacaggctggctgccggctgagagccctgcacttatccgacttattttcacccctccctatcctagagctgactagggccattgtgcgcgccctgcctctactgcgggtgcttagtatcagagtggaccatcccagtcaaagagacaatcctggcgtccccggcaatgccgggcccccctctcacataatcggtgatgaggaaattccagagaactgcctcgaacaactggaaatgggattccccagaggcgcgcagcccgcacccttactgtgtagcgtgctcaaagcctcaggctcactccagcaattgagtcttgattcagctacgtttgcgtctccacaggatttcggccttgtgctccagactttgaaggaatataatctggcactgaagcggctgtcttttcatgatatgaatctggccgactgtcagtccgaggttctatttctcctgcagaatcttacacttcaagaaattaccttttccttttgtcggttgttcgagaaacgtccggcccagtttctgccggaaatggtggccgcaatgaagggaaattcgacgttgaaaggactcaggctgcctggcaaccgcctggggaatgctggactactggctcttgcagatgtgttctcagaggactcttcctcctccctctgccaactcgatattagctccaattgcatcaaacctgatggcttgctcgagttcgcaaagcggctggaacgttggggccgaggcgcatttggccatctgaggctgtttcaaaactggctggaccaggacgcagttaccgcccgggaggccatccgcagattgagggccacatgccacgtggtgtccgactcctgggacagctcacaggcctttgccgattacgtatcaacgatgtag

SEQ ID NO: 48460 - DNA, 2088 bp, Artificial Sequence
  Description of Artificial Sequence: Synthetic coding sequence
atggaggccaccagccgggaggccgcccccgccaagagcagcgccagcggccctaatgcacctcctgcactttttgagttgtgcggtagagccgtctcagcacatatgggggtgcttgaaagcggagtgtgggcacttccgggcccaatcctgcagtcgatcctccctctgttaaacatatactatctggaacgaatcgaggaaaccgcccttaaaaagggactttccacacaggccatctggaggcgactttgggacgaactgatgaagacccgcccttcaagcctggaaagcgtgacttgctggagagcaaaattcatggaggccttcttcagccatgtgttgaggggtaccatcgacgtatcttcagataggagactatgtgaccagcggttctcgccgttactccattcctcaagacacgtcagacagctgactatttgtaacatgctccaaggggccactgagctcgttgctgagccaaaccgcagggtcctggaaacactggcaagcagcttgcacaccctgaagtttaggcacctactcttctctgatgtggcagcccaacagagcttgaggcagctgctgcaccaactgatccaccacggggccgtcagccaggtttcactgtatagctggccagtgcccgaatctgccctcttcatcctgatactaactatgtctgccggattttggcagccaggccctggagggcccccctgtcgtctatgcggggaagcctctcgtggacgtgctccatcacgagacgaaggcagtttactactgggatcaaggcggcctaggcgagatgccgcagaaaggtgtgccgccgccctgatggcaagccgccggaaaagcgaggcaaagcaaatgccgcgcgcagcacccgccactcgggtgacaagacgctccacgcaggagagtctaacggccggcggcactgacctcaagcgcgagctacatccacctgccacctctcacgaagcacctggtaccaagaggagcccctccgcacctgccgctacaagctccgcatctagttcgacaagcagttacaaacgcgctcccgcctcttccgcccctcagccgaagccactcaagcggttcaaacgcgccgcgggcaagaagggagccaggacgcggcaggggcccggagccgaaagcgaggatttatacgatttcgtgtttattgtggccggcgaaaaggaagacggagaggaaatggaaatcggcgaagtcgcctgcggagcgttagatggttcagaccccagctgtctcggactgcctgcattggaagcctcccagagattccggtctatttcgacactcgaattgtttaccgtcccattaagcacagaggcggctctgaccctctgccacctgctgagttcctgggttagtctagagagtctgacactgtcttataacggactgggtagcaacatttttcgcttgcttgactctctgagagctctatctggacaagccggctgtcgactccgggcactacacctgagcgaccttttctcgcctttaccaattcttgaactgacgcgagctattgtgagagcattgcctttactgagggtcctttctataagagtcgatcacccatcacagcgtcacagctggggaatgttagcatgctggccctggcagatgttcagccaacggattcatcctcccctgagcgtcagctggacttcagtgccaacagccagttctcagatgggcttttggtcctctccaagtggctggagcgcaggtgcagtagagcccctggtgacttgtgcatcaagtaaaaccggctggactaggatgcaatcccagccaggaaagccaagcgggggatccggcctccccgccatgtggctggctacacatggcacacatccgcgtccaagccagataatgctggcgccttgtgatggagctagaacatctcagagccatgcccgttaccaccagctggccggggccgaggcctgggcagcccaaaaccccaatcaccaattttatctgtcgctgtccgtgacttttttcctattctttccttcatccctcgccctgagatcctggcgtccgtag

SEQ ID NO: 48461 - DNA, 1287 bp, Artificial Sequence
  Description of Artificial Sequence: Synthetic coding sequence
atgagctactacctgagcagcgagaaccacctggaccccggccccatatatatgagagagaacgggcaactgcatatggtgaacttagcccttgacggggtgcggagctcattgcaaaaacctcgaccctttcgtctgtttcccaagggcttttccgttgagttgtgtatgaatcgcgaggatgacactgcccgaaaagagaagactgatcattttatcttcacgtatacccgtgaagggaatctgcgctactctgcgaagtcactgtttagcctagttctgggtttcatcagcgataacgtagatcacatcgacagtcttatcggattccctgaacagatcgccgaaaagctgttcagcgctgccgaggcccggcagaagtttactgagcctggggctggcctgagggctctgcagaagtttacagaggcctatgggagcctcgttctttgctccctctgcctgagaaaccgataccttgtcataagcgagaagctagaggaaatcaaatcattcagggagctcacctgtctggacctaagttgctgcaaacttggtgacgagcatgagctcctggagcatttaaccaatgaagcattgagctccgtgacacagctgcaccttaaagacaactgcctgtcagatgctggggtccgcaaaatgactgctcctgtgcgggtcatgaagcgtggactcgaaaatctcaccctactggacctttcgtgtaacccagagattaccgacgccggtatcggatacctcttcagttttcgtaagcttaattgtctcgacatatctgggaccggcctgaaggacataaagactgttaaacacaagttgcagacacacattgggctcgtgcattccaaagtgcccctcaaggagtttgatcatagcaactgcaagacagaaggatgggcggaccagatagttctgcagtgggagcgggtcacagccgaagctgtcaaacccagagaaacctccgagccacgagcagccgcccagcgcttctatggcaaacggtctcgcgccgaggcacccctcaagtgtccactggccgacactcacatgaattcatctgagaaacttcagttttataaagaaaaggctccagattgtcacgggccagtgcttaaacatgaagcaattagtagtcaggagagcaagaagagtaaaaagaggcctttcgaggaatctgagacagaacaaaacaattcatcgcagcctagtaaacagaaatacgtgtgcctggcggttgaagactgggacctcttgaattcatactag

SEQ ID NO: 48462 - DNA, 579 bp, Artificial Sequence
  Description of Artificial Sequence: Synthetic coding sequence
atgagctactacctgagcagcgagaaccacctggaccccggccccatctacatgcgagaaaatggccagttacatatggttaacctggctttggacggggttcggtcatctctgcagaagcctcggccttttcgactttttcccaaagggttctcagtcgagctgtgcatgaatcgcgaagacgacactgctagaaaagagaaaacagatcatttcatctttacttacacacgcgagggtaacttgcgctattccgcaaagtctctgttttctttggtgcttggcttcatatctgacaacgtagaccatatagactctttaatcggcttcccagagcaaattgcagaaaagttgttctcagcagcagaggctaggcagaaatttacagaacctggcgctggcctgagggccctgcaaaaattcacagaggcctacgggagtctggttctgtgctctctttgcctgcggaaccgttacctcgtgattagcgaaaaactagaggagattaaatcatttagggaattgacctgcctcgatctgagttgctgtaagctcggcgatgaacacgaactcctgtag

SEQ ID NO: 48463 - DNA, 1287 bp, Artificial Sequence
  Description of Artificial Sequence: Synthetic coding sequence
atgagctactacctgagcagcgagaaccacctggaccccggccccatttacatgagagaaaacggacagctccatatggttaatctggccttggatggagtccgaagctcattacagaagccgagaccctttcgcctctttcctaaaggttttagtgtggagctgtgcatgaaccgcgaagacgacaccgctaggaaggagaaaaccgaccatttcatcttcacttacacaagagagggaaatctccggtactccgctaaatccttgttcagtttggtgctgggctttattagcgacaatgtcgaccacatcgacagcctgatcggctttccagagcagattgctgaaaagttgttctctgccgcagaggcaaggcagaaattcacagagcctggagctggacttcgggccttacaaaagttcaccgaggcttacggaagtcttgtcctgtgctccctgtgtctcagaaacaggtaccttgttatttcggaaaagctggaggaaattaagtcttttcgcgaattaacgtgcctagatctgagttgctgtaagctgggagacgagcatgaactgctggaacaccttaccaacgaggccctatcttccgtcacacagctccatctaaaggataactgccttagcgatgccggtgtgaggaaaatgactgcccccgtgcgcgtcatgaaacgagggctggagaacttgacactcctggatctctcctgcaacccagagattactgacgctggtattggctatctattctcgttccgcaagttgaactgtctcgacatatccggcaccgggcttaaggacataaaaacagtgaaacataagctgcagacccatatcggcctggtccacagtaaggtccccctaaaggagtttgatcattcaaactgcaagaccgagggctgggcagatcagatcgtgctgcagtgggaaagagtgactgccgaagcagttaaaccccgcgagacatcagagccaagggccgccgcacagagattctatggaaagaggtccagggccgaggctcctttaaaatgtcccctggccgatactcacatgaactcgtccgagaaactgcagttttacaaggagaaagcacctgactgtcatggtcctgttcttaaacacgaggcaatcagtagccaggaatccaagaagtctaaaaagcgcccattcgaggagtctgaaactgagcagaataactcttctcagccatcaaaacagaaatatgtgtgtctggccgtcgaggattgggacttgctgaatagttattag

SEQ ID NO: 48464 - DNA, 720 bp, Artificial Sequence
  Description of Artificial Sequence: Synthetic coding sequence
atgagctactacctgagcagcgagaaccacctggaccccggccccatctacatgcgggaaaacgggcagctgcatatggtaaatttggctctcgacggagtgaggtccagcctgcagaagccaagaccattcaggcttttcccaaagggctttagcgttgagttgtgtatgaatcgagaggacgatactgccagaaaagagaagacagaccacttcatttttacttataccagagaaggcaacctgcggtatagtgccaaatcactcttttccttggtgctgggtttcatctctgataatgttgatcacatagacagtttgatcggctttcccgaacagattgccgagaagctgttctctgcagcagaggcgagacaaaaattcacagaaccgggggccggtctcagagccctacagaaattcacagaggcctatggatcacttgtattgtgttctctgtgcttgcgaaacaggtatctggttatttctgagaagcttgaagaaatcaagagttttagagagcttacctgcctagaccttagctgctgtaaattaggtgacgaacatgaactgttagagcacctgactaatgaggccctgagttcagttacccagttgcacctcaaagacaactgtctgtcagacgccggtgtccgcaagatgaccgcgcctgtgcgagtcatgaaaagaggattggaaaaccttactttgctagactag

SEQ ID NO: 48465 - DNA, 1584 bp, Artificial Sequence
  Description of Artificial Sequence: Synthetic coding sequence
atggagtgcctgtgcgcccacccccccgccggcctgcagcacctggggctcggtcataataaactgttaggcccattggagtccttgtacgtgactgccaaccactggggaagggttagactcggcctgggggacgctgtcttgactgccgcggcctgtgtatttctcctgttttctgaacccagatccatctgttttctggtctgtggctcccgacttctggccccatgctcaccgggattcctcacgccgcgtcgcagctgttccccaagccgacccaatttggtatcacttgatctcggttttaatgacctcactgacttgcagtcaatggtcacaagccttaggacactaaggcacctccgccttctggtgctccaggggaacccgttggcgttagtgccgtactaccgcggcttgaccatcgactcactcgctcagctttgcgtgttggatgatatcacagtgtccccaaacgaaaagcacctatttcgcggactcagcttgaacggtgacttactggcccaggaagcacagtttgtcgtcaccatcgggaacatccgcggggtgctggacacctccgtgctggatcctgaaccacggcctgaaggcccgtttattacgtacaactactacgtcacctatgattttgtcaaggatgaagagggtgaaatgaatgagagcgcaggtgttttggcagaaatcgtgaagccgtctccatctctggaactgctggtcgaagagtcccccgaagaggtcgtagaggacgtcattgaggatatcgttgaagaggtgaccgaggaggtggaaggttcactggagagtgaggtggaagaatcgggagagtctgagctctctgtcatcagcggcccgtctaccattctacaaatgcctcgggctagcgctgaagagctggccaagctgcgcctgcgaatcgatccccggctgtgcccaagccccggaacagtacttttcagtactgcccacaagccctgggccgaagtgattccatgcagttacgaaatgcagcacagcctgcgagaccttgtgccactaaaggcattcttgctcgcaggaacaaccgtaacaatagtagaggagaagatcttgagctggccagtggtactgcctgcagtggacagtccactcagcgccaagaaaggtaagggcgaaaaggataagaaaggcaaggagaaggatcgaacaggcaagggggaaaaagaacccgcgaaagaatggaaggtgctgaagaaaaaaaaggaacctccaaaggagctgagacaggatccaccgatcctgcaggtgctgggccggggactggtgatactggagcctcttctggccggcgagccgcttgtcagtacagtgtgtaacttcggggtagtgaggactcttacctctgatagactcacgctcgcgcgggactcgaagaaaataaagaaggtggctaagaaagaaaaaccgaaggccgtcattccaatttacgagggggattaccaccctgaacctctcacagtagaggtccaaatccagttgaatcaatgtcgcagtgccgaggaggctctgcggatgtttgccgtttag

SEQ ID NO: 48466 - DNA, 1971 bp, Artificial Sequence
  Description of Artificial Sequence: Synthetic coding sequence
atggaggccagctacgagagcgagagcgagagcgagagcgaggccggtcccgggacccagcgtcccgggactggaactgtctctgctgctgtcagagagcatctacgcaagctatgtctcagagagtttccctgtggcgccggcagctggaataaatcgagattcctgccacaaacctggaggacgtggcgcgaattggttccacgggaggaggacgttgtgagccccggcgaggaaacagttgaagcgctgctcgggctcgtgaggtctcgacacagtccttgggcactgttaaacaacagtaacgctgaagactcttttcttcgggagctggccattaggaaccctctgaccatcaccgacacgttcttctacagttacttcagaagcctcagagtaatcgacaaaaaggtgacgttggtggacaaggacctgctaaagtttctgaagttggaggagctggttctgtctgccaatagaatcaaggaggtggatgctactaatctgcctcccacactgaaggttttggagctatacggcaacgaaatcagctctatggaatgcttatgtgcccatccccccgctggcctacaacaccttgggctcgggcataacaaactgctgggcccccttgagagcctgtatgttacagcgaatcactggccaaatcttgtgagtctggatttgggttttaacgacctcaccgacctgcagtcaatggtgacctcactgcgcacactacgacacctgaggctcctcgtgttgcagggcaatcctctggctctggtgccctactaccgggggctgactatcgattcattagcccaattgtgtgtgctagatgatatcacagtctctcccaatgaaaaacacctgtttcgcggtctgtctctgaacggcgatctgctagcacaagaggcccagtttgtggtgactatcggaaacattcggggggtgcttgacacgtccgttctggaccccgaaccaagacccgagggacctttcataacgtataactattacgtcacctatgacttcgtgaaggacgaggagggggagatgaacgaaagtgcaggagttctggcagagatcgttaaaccctcacccagtctggagctgctagttgaggaatcaccagaagaggtggtggaggacgtgattgaggacattgtagaagaggttacggaagaggtggagggctccttagagtcagaggtcgaggaaagcggcgagtctgaactgtcagtaatctccggcccaagcacgattctgcagatgccccgggcaagcgccgaggaactggctaagctgcgtctgcgcattgatccgcgtctgtgcccttcccctgggactgtcctcttcagcacggctcataaaccatgggctgaggttatcccctgcagctatgagatgcagcattctttgcgtgacctggtacccctgaaggccttccttctagcaggaaccaccgttaccatcgtcgaggaaaagatcctatcttggccagtggtactgccagctgtagactcccctctgagcgcgaaaaaaggcaagggcgagaaggacaaaaaagggaaagaaaaagataggaccggaaagggagagaaggagcccgcaaaggagtggaaggtcctgaaaaagaaaaaagaaccccccaaggaattacgacaggatccccccattctgcaagtcctgggcagggggttagtgatcctggagccactcctggccggcgaacctttagtcagcactgtctgcaactttggcgtggtgcggacactaacctccgatcgtctaacactagcaagggactccaagaagataaagaaggttgctaagaaagaaaagcccaaggcagtcatccctatctatgagggggactatcaccctgagcccctgaccgtggaggtgcagattcagctgaatcagtgtcgctcagccgaggaggccctccggatgtttgccgtatag

SEQ ID NO: 48467 - DNA, 1416 bp, Artificial Sequence
  Description of Artificial Sequence: Synthetic coding sequence
atggagtgcctgtgcgcccacccccccgccggcctgcagcacctgggactaggtcataacaagctcctcggtcccctcgaaagcctgtacgtcaccgccaatcattggcccaatcttgtctctctcgacctcgggttcaatgacctgacggacctacagtctatggttaccagcctgagaaccttacgtcatcttcgactgctggtgctgcagggaaatccgctggccctggtcccttactatcgggggctaaccattgacagtctcgcccagctttgtgttttggacgacatcacagtatcccctaatgagaaacaccttttccggggtcttagcctgaacggagatctgctggctcaggaagcacagtttgtggtgaccattggaaatatccgaggcgtcttggatacaagcgtgctcgatcccgagccccggccggagggaccatttattacttacaactattacgtcacatatgatttcgtgaaagatgaagaaggggaaatgaatgagtctgctggagtgctagcagagatcgtgaagccatctcccagcctcgaattgctagtagaggagtctcccgaggaggtcgtggaagacgttatcgaggatattgttgaagaagtaacggaagaggtcgaaggctccttagaatccgaggtcgaggagtccggcgagtctgagctgtctgtaataagtggcccaagcaccattttgcagatgcccagggcatcagccgaggagctcgccaaattacggctgcggattgacccccgcttatgcccaagtcctggaacagtgctgttctccaccgcccacaaaccttgggcagaagttataccatgttcatacgaaatgcagcactcgctgagagatctggttcctcttaaagccttcctgctcgccggtactaccgtgactattgtggaggaaaagatactgagttggcccgtggtactgccagctgtggatagtcccctttccgccaagaagggtaagggtgagaaagacaaaaaaggcaaggaaaaggatcgaactgggaaaggagagaaggagcctgctaaggagtggaaagtgctgaagaagaagaaggagccgccaaaggaactgcgccaagacccaccaatcctccaggttctgggcagaggactcgtgatcctggagcccctgctggccggggagccactggtatctaccgtctgcaacttcggtgtcgtgagaaccttgactagtgacagactgacgttagctcgggactcgaaaaagataaagaaagtcgcaaagaaagagaagccaaaagcagtcatccccatctatgagggggactaccatcctgagccattgaccgtcgaggtgcagatccaactgaaccagtgtcgctctgcagaagaggctttacggatgtttgcagtgtag

SEQ ID NO: 48468 - DNA, 966 bp, Artificial Sequence
  Description of Artificial Sequence: Synthetic coding sequence
atgagcggcggcaagagcgcccagggccccgaggagggcggcgtgtgtattaccgaggcgctgattactaagaggaatctaacatttcctgaagatggcgagttatccgagaaaatgtttcacacactggatgaactgcaaaccgtgcggctggatcgtgagggcattactaccatccggaacctggagggcttgcagaatctccactcactatacctccaaggcaacaagatacagcagatagagaatcttgcttgcattccaagcctgcggtttctgtcgctggcagggaaccagattcgccaagtcgaaaacctgctcgatctgccctgcctccaattcttagacttaagcgagaatttaatcgaaacgctgaaactcgatgaatttccacaaagtctgcttattttgaacctgtctgggaattcctgcactaatcaggatggatatcgagagctggttactgaggcactcccgcttttgctggatctggatggccagcctgtcgtagagagatggatctctgatgaagaagatgaggctagcagcgatgaggagttccctgaactttcaggcccattttgctccgagcggggcttcctgaaagagttagagcaggagctctctcgccatagagagcatcgccagcagactgccctgaccgagcacctccttcgtatggaaatgcagcctacactcacagacctgccccttctacccggcgtgcccatggctggcgactcctcccctagcgccactcctgctcaaggcgaggaaactgtgcccgaggccgtgtctagtcctcaggcaagttcacctacaaagaaaccttgctcactgatccctcgaggacaccagagctcattctgggggcgcaaaggcgcccgcgcggcaacagcacctaaggcatcagttgcggaggccccctccactacaaagacgactgctaagaggtctaaaaagtag

SEQ ID NO: 48469 - DNA, 1752 bp, Artificial Sequence
  Description of Artificial Sequence: Synthetic coding sequence
atggccgccgccgccgtgagcgagagctggcccgagctggagctggcagagagggaacgcagacgtgagctgcttctgactggccccggtctggaagagcgcgtccgagccgccggagggcaactgccgcccagattgttcacactcccacttctgcattatctcgaagtgtccggctgcggctccttacgcgctcctggacctggccttgcacaagggctcccccagctgcacagcctggtgctgcggaggaatgctctggggcccgggttgagtcccgagcttggccccctgcccgctcttagggtgctggatttgagtggcaatgccttggaagccctgcctccagggcaaggcttgggccctgccgaacctccgggactgccacagttacagtcactcaacctttcaggaaaccgtctcagagagttgcctgccgatctagctaggtgcgccccgaggttgcagtctctcaacctcacaggtaactgcctagactctttccccgccgaactgttcaggccgggggccttacccttactcagcgagctggctgccgcggacaactgcttaagagaactttcacccgacatcgctcacctagcctctctaaaaactctggacctttcgaacaaccagctgtcggagatccccgccgaactcgctgactgtcctaaattaaaggagattaatttcagaggcaacaagttacgggataagcgccttgagaagatggtatcagggtgtcaaactcgaagcattttggagtacttacgtgttgggggaaggggtggcgggaaggggaaggggagagccgaaggcagcgagaaggaagagagccggcggaaaagacgggagcgcaaacagcgcagggaaggcggcgatggggaggagcaggatgtaggtgatgctgggcggctgttgctacgggtgctgcacgtttcggagaaccccgtgccccttaccgtccgggtcagtcctgaggtgcgggatgtccggccctacatcgtgggcgcggtggtgcgtggaatggacctgcagccaggaaatgctctgaaacgtttcttgacatctcaaacaaagttgcacgaagatctctgcgaaaaaaggacagctgctaccctggccacccacgaattgcgcgctgttaaaggtcctttgctgtattgtgctcgcccacctcaggatttgaagatagtgccactcggcagaaaggaggcgaaggccaaggagctggtcaggcagctgcaactcgaggccgaagaacagagaaaacagaaaaaacgccagtctgtgagtggtctgcatcggtacctacacctcctggacgggaatgaaaattatccatgcctggtggacgccgacggagacgtcatctctttcccaccgatcaccaactctgaaaagacgaaagtgaagaagaccacctcagatctgttcctggaggtcaccagtgcgacgagtttacagatctgtaaagacgtcatggacgcgctgattctaaaaatggccgagatgaaaaagtacactttagagaataaggaggaaggcagtctatcagatacagaggcagacgcagtctctggtcaactaccagatccgacaactaacccttcagccggcaaggatggccctagtctgttggttgtggagcaggttagggtggttgacttggaaggtagcctgaaggtggtctacccctctaaagcggatctggcaaccgctcctcctcatgttacggtcgtgagatag

SEQ ID NO: 48470 - DNA, 1515 bp, Artificial Sequence
  Description of Artificial Sequence: Synthetic coding sequence
atgctgcggctggtggccgcctgccccgagagctgcgtggtgtgcacaaaagacgtgactttatgtcatcaactgacctacatcgtagccgccccaatgactacacgtgtcctgatcatcacagacggatacttgtcttctattgaatccacaaacctgtcactactgtttaacttggcactgctctccctgtctagaaatggcattgaggatgtgcaagaagatgctctgcacgggctgaccatgctcagaacgctgctcctggagcacaaccaaatcagctcgtcttccctcacagatcatactttctccaagctacacagcctccaggttcttgtgctttctaacaatgccctgaggacgctgcgggggtcctggtttaggaatacttccggattaactagactgcaacttgatgggaatcagattaccaacctgacagattctagtttcggtggcacaaacttgcattctctgcgctatttggatctgagcaataactttatatcctacataggaaaagatgcctttcgccctctgccccaactgcaggaggtcgatctgagccgcaatcggttggcacacatgcctgatgtgtttaccccattgaaacagctgattctgcttagtctcgataagaaccagtggtcctgtacttgtgacctgcaccctctggcaagattcctgcgcaattatattaaatctagtgcacacaccctgaggaatgcaaaggacctgaactgtcaaccctcgaccgccgccgtcgccgcggctcaatcagtcctgcgtctgtccgaaaccaactgtgatagcaaggcccccaatttcacgctggtcctcaaggaccgatcgcctctcctccccggcccagacgtggctcttctgacggtcctaggattcgctggagccgtcggtctgacctgcctcgggcttgtggtatttaactggaagctgcaccagggcaaggcaaacgagcacacttcagaaaacttatgctgcagaacgtttgacgaacccctctgtgcccacgaggctaggaattatcacactaagggctactgtaactgccatctcacccaagagaacgaaattaaagttatgtccacagtgggcagtaggaaagaaatgcccctgctccaagaaaactcacatcaagccacctcagccagcgaaagcgcaacactcgacggatcattccgaaatttgaaaaagaaggatagaggcgtgggatcaacactcttttgccaggatggacgactgcttcacagcgagtgtagtgaaccgccagggaacatgagagcctttaatgaagctgggctgctgacgacatataaccctagaaaagttcaaaaactgtggaacctagagccgggggaggtccagccgcagacactgcagcatcatatcattcgtaccgaggatatatcttcagacattttccgcaggaggtatgcaaccccagcctcagccctcgctggagagtcacttgagaagcgactcactaatgagtcgtag

SEQ ID NO: 48471 - DNA, 1533 bp, Artificial Sequence
  Description of Artificial Sequence: Synthetic coding sequence
atgctgcggctggtggccgcctgccccgagagctgcgtggtgtgcaccaaagatgtgacactttgccaccagcttacttacattgttgctgccccgatgacaactcgtgtgcttatcattacagatggttatctgtcttccatcgagagcacaaacttaagcctgttattcaatctggcactactctccctttctaggaatggaatagaggacgtccaggaagatgccctacatggtttaacaatgcttcggacactgctcctggaacacaaccagatcagcagctctagtttgacagaccacacatttagcaagctgcactctcttcaagtcctggtgctttcaaataacgcgctacgcaccctgaggggtagctggtttcgcaatacctcgggtctaacccgactgcagcttgatggcaaccagataactaatctgaccgattccagcttcggtggaaccaacctgcattctctgaggtatcttgacctgtctaacaatttcatcagttacatcggaaaagacgcgttcaggcccctaccacagctgcaagaggtggatctttcaaggaatcgtttggcacatatgccagacgtctttaccccactgaagcaattaattctgctgtccctggacaagaaccaatggtcttgcacgtgcgatctgcatcccttagctcgatttcttcggaattacatcaaaagctccgctcacaccctgaggaatgccaaggatcttaattgtcaacccagcactgccgcggtagcagcagctcagtctgttctgagactgagcgagacgaattgtgattcaaaggcccctaacttcactctggtgctcaaagacagatcaccgttgctgccaggaccagatgtggccttgctgaccgttctcgggttcgccggagcagtgggcctcacttgccttggcctagtcgtgttcaactggaaacttcatcaagggaaggccaatgagcacaccagtgagaatctgtgctgtagaacgtttgacgagcccctgtgtgcccacgaggcccgaaactaccacactaaaggctactgcaactgtcacctcacccaggagaacgaaatcaaagtcatgtccacagttggcagcagaaaagaaatgccgttgctccaggaaaattcccaccaagctactagcgcctctgaaagcgctaccctggatggatcttttagaaacttgaagaagaaagaccgcggcgtgggttcaacactgttttgccaagacggcagactactccactcagagtgttcggagcccccaggcaatatgcgagcattcaacgaagcaggcttgctgacgacgtacaaccctagaaaagtgcagaagctgtggaacctggagccgggtgaggtgcagccgcagacactccagcatcacatcatacgcacagaagacatctcgagcgacatcttcagacggcgctatgccactcccgcgtcagctttggcaggggagtccttagagaagcgcctgactaatgagtcttggcagccccctatcgaatag

SEQ ID NO: 48472 - DNA, 1629 bp, Artificial Sequence
  Description of Artificial Sequence: Synthetic coding sequence
atggacctgggctgggaccggagccggggcccccggcggagcaccagctccgtgcgggtgcgtgagctgagctggcaaggactgcacaacccctgccctcaatctaaagggccgggttcccagagggaccgtcttggtgagcagctcgtggaagaatatttgtctccagcgcgcttacaggccctggcccgcgtggacgatctgagactcgtcaggacacttgaaatgtgtgtggacacacgggaggggagtctcggcaacttcggcgtgcatctccctaacctggaccagctcaagcttaatgggtcccacctgggatccttgcgggatctcggaactagcttgggacacctccaggtgttatggttggcaagatgcggcctggctgatttggatgggatcgccagtctgccggcactgaaagaactgtacgcgagttacaataacatttccgacctctctccactgtgcctccttgaacagttggaggtgctggatttggagggtaactccgtagaggatttgggtcaggtccggtatctgcagctgtgccccaggctggccatgctgaccctcgagggcaacctcgtctgtctccaaccagctccaggtccaaccaataaggtgccacggggctataactaccgggcggaggtgcgaaagctcatccctcagctacaggtgctggatgaggttcccgcagctcacactgggccccccgcacccccacgactttctcaggattggttagccgtcaaggaggccattaagaaaggaaatgggctgccccctctagattgtccccggggtgctccaattagaaggctagatccggagctgagcctccctgaaacacaatcgagagctagcagaccatggcccttcagcctactagtcaggggtgggcctctaccagaagggttactgtctgaggatcttgcccctgaggataacacctcttcactgacacacggcgcgggtcaggtgctgtgtgggaacccaacaaaaggactccgcgagcgccgacaccagtgtcaggcgcgggagccgcctgaacagcttccacagcatcggcctggggatcctgccgcttccaccagcaccccggagcctgaccctgcagattccagcgattttctcgctttagcgggcctaagagcttggcgcgagcacggagtgcgaccgctgccataccgccacccggagagccagcaggagggtgctgtggctccctggggaccccgcagggtacctgaagagcaggtacatcaagcagaacccaagactcctagctcaccgccgagcctggctagcgagccctccggcacatcttctcagcacctggtacccagcccccccaagcaccctcgcccaagggattctggcagctctagcccccggtggtccactgacttgcagtctcgaggaagaaggctccgggtcctcgggtcctggggaccaggactgggagacggtgtggcagccgtgccagtgcttcgagccctggaagttgcttccagactcagtcctcgcgctcagggctgtcccggtccaaaacccgcaccagacgcagctgcacgacctcctagagccgctgaactttcacatccatcgccagtgccaacctag

SEQ ID NO: 48473 - DNA, 720 bp, Artificial Sequence
  Description of Artificial Sequence: Synthetic coding sequence
atgggcaacagcgccctgcgggcccacgtggagaccgcccagaagacaggcgtgttccagctgaaggaccgaggcttaaccgagtttcccgctgacctgcagaaattgacctctaaccttcgcaccatcgacctgtccaacaacaagattgaaagcctaccacctcttctcattggtaagttcacactcctgaagtctctgagcttgaacaacaacaagctgaccgttttgccagacgaaatctgtaatttgaagaagctggaaacactaagcctgaacaacaatcacctgcgagagttgccgagtacctttggccagctgagcgctctgaaaacactgtctctctctggaaaccagctgggagctttgccaccccagttgtgttctctcaggcatctcgacgtgatggacctgtccaagaaccagatccggtctatcccagatagcgttggcgagttgcaggttatagagctcaatctaaatcaaaaccagatttcccagattagtgtcaagatctcatgctgcccccggctgaaaattctccgacttgaagagaactgcctggagctgtccatgctcccccagtctatactttccgattctcagatctgcctcctggcagttgaggggaatctcttcgaaataaaaaagcttcgagagcttgaagggtatgacaaatacatggagcgatttactgccactaaaaagaagttcgcatag

SEQ ID NO: 48474 - DNA, 720 bp, Artificial Sequence
  Description of Artificial Sequence: Synthetic coding sequence
atgggcaacagcgccctgcgggcccacgtggagaccgcccagaagaccggggtgtttcaactaaaggatcgaggcctgaccgaatttcctgctgacttacagaaactgacctcaaatttacggactatcgacctgtcaaacaacaaaatagaatcattgcctcccctcctcatcggaaaatttaccctcctgaagtcgctgtccctgaataataataagctgaccgtgctccctgacgaaatctgcaatctcaagaagttagagacactgagcctaaataacaatcatctgcgcgagctaccctctactttcgggcagctatctgctctgaagaccttgagcctttcggggaaccagctgggggccctgccaccacagttgtgttctctccgccatcttgacgtcatggatctgtcgaagaatcagatcaggtcgataccagattcagtcggggagctccaagtgatcgagctgaatctgaatcaaaaccagatctcccaaattagcgtgaagataagctgttgccccaggctgaagattctgaggctagaggagaattgtctcgaacttagtatgctgccacagtccattctttctgacagtcagatatgtctcctggccgtcgaaggcaatttgtttgagattaagaaacttcgcgagctagaaggctacgataagtatatggaaagatttaccgcaaccaagaagaaattcgcttag

SEQ ID NO: 48475 - DNA, 1116 bp, Artificial Sequence
  Description of Artificial Sequence: Synthetic coding sequence
atggaggaggccggcgccgccgtggtgaccgccggcgaggccgagctgaactggagccggttatctgtgagcaccgagactcttgagtctgagctggaggcccggggcgaggaaagaagaggagcccgtgaagccctgttacgactgctgctgccccacaatcgcctggtgagccttcccagggcgctgggctccgggtttccacacctccagctgcttgacgtaagtggtaacgccctgaccgccttgggaccagagttgttggctttgcgcggattgagaacactcctggcaaagaataatcgtctaggtggaccctcagctctccctaaggggctggctcaatctccactgtgcagatccctgcaggtgctgaacctgtctgggaactgttttcaggaagtcccagcctctttactggagctccgcgccctgcagaccctgagtctcggcgggaaccaactgcaatccattccagcggagatcgaaaacctgcagtcacttgagtgtttgtatctgggtggaaactttattaaggaaattcccccagagctgggcaatctcccaagtttaaattatctggtactgtgtgataacaagattcagagcattcccccacagctttctcagctgcattccttgcgaagtttaagcctgcataacaacctgctcacctatcttccaagggagattctgaacctgatccacctggaagagctctcacttaggggaaacccgctggtcgttagattcgtgagggatttgacgtacgatccgccgactctgctagaattggccgcaagaactataaagattaggaatatatcttacactccatacgatctaccaggaaacctcctgcggtacctcggttccgctagcaattgcccaaacccgaaatgtggcggagtttacttcgattgctgcgtccggcaaataaagttcgtggacttctgtggtaaatatcgacttcccttaatgcattacctgtgtagccctgaatgttcttcaccatgcagctctgcaagtcactccagcacatctcagtccgagtcagattctgaggacgaggcgtcagttgcggctaggaggatgcagaaagtgctcctgggatag

SEQ ID NO: 48476 - DNA, 780 bp, Artificial Sequence
  Description of Artificial Sequence: Synthetic coding sequence
atggacccccccgccgagaagcccggcgaggccggcggcctgcagattacgccccaactgttgaaaagccggacaggtgagttctctctggagtctatactgctgcttaaattgagggggcttggcttggccgatctgggctgccttggtgagtgcctagggcttgaatggctggatctatccggtaacgccctcacccacttgggaccccttgcatctcttcgtcagctggctgtgctgaacgttagtaataatcgcctgacaggcctcgagccgttggccacttgcgagaacctgcagagtctgaacgcagccgggaatctgctggccactcctggacagttgcagtgtttggccgggctcccatgtttggagtacctccgtctgagagaccccctggcgcgcctgtcaaaccccttgtgtgctaacccctcttattgggcggccgtgagagagctgctaccaggcctgaaagtgatcgacggcgagcgcgtgattggcaggggttccgaattctatcagctgtgccgcgatctcgattccagtctccgcccatctagctcccctgggccaagggctactgaggctcagccatgggtagagcctgggtactgggaaagctggccaagtcggagtagctccatattggaagaggcctgccggcagttccaagacacgctccaggagtgctgggatctcgatcggcaggcaagcgactcactggctcaggctgaacaagtccttagtagcgcaggtccgacctccagcttcgtgttctag

SEQ ID NO: 48477 - DNA, 780 bp, Artificial Sequence
  Description of Artificial Sequence: Synthetic coding sequence
atggacccccccgccgagaagcccggcgaggccggcggcctgcagattactcctcagctgctgaagtcaagaaccggggagttcagtctggaaagcatcttactgttaaagctccgaggcctggggctagccgacctgggttgcctgggagagtgtctgggccttgagtggctcgacctttctggcaatgcattgacccatttagggcccctggcctccctcaggcagttagctgttctgaacgtcagcaacaatagactaaccggcctagaacctctcgcaacctgcgaaaacctccaaagtttgaacgcagctggcaatctgctggcgacaccaggccagctgcagtgcctggccgggctgccctgtttggagtacctacggctgagagaccccctcgcgcgactgtcaaaccccctatgcgctaacccgagctactgggctgcagttcgggagctcctcccgggactgaaagttattgacggagaacgcgttattggcaggggcagcgaattctaccagctctgccgggacctggactccagcctgcggccctcaagctctccaggcccgcgtgctaccgaggcacagccttgggtagaaccgggatattgggagagctggccctcccgatcaagttccatcttagaagaggcctgtcggcaattccaggatactctccaggagtgctgggatcttgaccgtcaggcctctgatagcctcgcacaggcagagcaagtcctgagtagcgccggcccaacttcttcgttcgtgttctag

SEQ ID NO: 48478 - DNA, 780 bp, Artificial Sequence
  Description of Artificial Sequence: Synthetic coding sequence
atggacccccccgccgagaagcccggcgaggccggcggcctgcagatcacacctcagctcctgaagtctaggacaggcgagttcagcctggagtcgatcctcctgctaaagctgcgggggcttggcttagctgacttgggatgcttgggggagtgcctgggcctcgagtggttggacctcagtggcaacgccctcactcacttgggccctttggcatcgctgcggcaattggctgtactcaacgtgagcaataaccggctgaccggactcgaacccctcgctacttgcgagaatctccaaagtttgaacgctgccggaaacctgttagccacacctggccagctgcaatgcctggccggtctgccttgcttagagtacttacggcttcgggatcctttagccagactgagcaatcctctatgcgccaacccatcgtactgggcagccgttagagaactgctccccggattgaaggtgatcgatggagagcgtgtgatagggcgcggaagcgagttctaccagttgtgccgcgacttggattctagtctacgaccatctagttctcccgggccacgcgccacagaggcccagccatgggtggaacctggctactgggaaagttggccaagcagatcttcatcaatattggaggaggcgtgtaggcagttccaggacactctgcaggaatgctgggatctggacaggcaggcttctgattccctggcccaagcggaacaggtgctgagctccgccgggccaaccagctccttcgttttttag

SEQ ID NO: 48479 - DNA, 1746 bp, Artificial Sequence
  Description of Artificial Sequence: Synthetic coding sequence
atgcagaagccccccctgctgctgcggcggcccctgccccccaagtttacaaagttaagcctgcacgaaaaaaagacccacactgccaagaccggcaaaattgagtctctgcatgtggcattcacagaggatgaaacaacaagcatcaagatggacagaacccgcttccctgatgttcttagaaatcagtctcttacaccaataaacattcagaatatcttcctggaccactgcgtacaggagagggtaacagctatcagctccccacagaagagtacaaagcacgtacgggagcagatcccagacacggcaacaggtagcatcttctttcctcactgtaacagtgccagtaccaggatatttgggaaacagacaaataaaatggaaagtagcaggaaattcaaaactatgaaggatgtctacactgagaaaaggctcgagaacatactgatactttcgtccaaattctccaaaccgaaatccacccccgggagcgtgattgctcaaaagctcgaaaagatgcatcctaagcaccagcctctgcccgaaagtccggggtatacttatcagcacattagtcgcgacttgagtgccacagtccccagtcccccccccatgactgtgtctatgaagccagaaggacagtggccggagcacttcaagagtacagctactctgacattgcgagttacagagttcccgggctttgtgagcctgcctacacccgtcctgccccgaaagccccatcgccagtccgttattgagacactcgttacagagaacgggaatatcgagtccgttccgaagcagatcccaccacgcccaccagagggccttactaagaccgaaaagatcgagagcgagatccatgttgtccgtggtgagggtttcaaaaccgtggctgccacccgatacgaaaccattacagcaatgacaaacttggcgatcgtaaactgccaggtgtacgggagaaacgcgctcaatttaaagggctttttcatcctcaactgccctgacctcacccccctcgcctttcagcttatttacctcaatctatcctttaatgacctccattactttcctactgagatcctgtgcttgaagaatctccagatcttgaagcttcgcaataatcctatcaaggagattccatctgagatccaacagctcgagtttctgcgaatattcactatagcttttaaccttataaccgtgctccccatcgggctctttagcctgtcttacctagaggagttagatgtgtcctataatgagctcacatttatccccaatgagatccagaaactcagatccctcgaaaagcttacagtggacggcaatgagctgagctttttcccacatgggatcttgaagctcaacttaactaagatccagttcgagaacaactttacacacccttgcttttggagagataattacctcaataacccgcagcagctaacccagatcattagcctcttcatagtgcagaacaaactgcacaaattctatgacaagatccccgtagaggtgcagaagctgctaaaatggtggggtgcccagttcttgaccgagctggcccctcttagcatttactcctctagaaaagccatcaccgagggctacatcgctgtcgaactcccaaagttcgaagagtcgaagaatataacagagggtctgcttacacagaaacgttacgaggaagtgatggtgaaatgcataaacgctactacagtgacatcatag

SEQ ID NO: 48480 - DNA, 576 bp, Artificial Sequence
  Description of Artificial Sequence: Synthetic coding sequence
atgaccgagcggctgctgatcaaggccctgagcggcggcaagaacacgaagattatcacattgaacggcaagaaaatgacaaagatgccgtcggctctgggcaagctgcccgggttaaagaccctggttctgcagaacaacttgatccccaaagtttgtcctgagctgtgtaacctgactcagttccaggatctcaagctgcgcgagttctattgcgaaggcaatcccctgttcctgcagcaaccagtgatttccactcagcaggagaacgtttggagcctccaggagatcacaagccgattcgtaatgaatcagctggctgagaataacccattcttgatggatgacattgaaagataccctcaggtccggagcatgatttctcagggtaagacttgcgctatttgtgggcagtattttatcactgtgtggctagagtgtgtcaggttcgttccccctccaaaagactggaagatttccaagaacctcaagctggtgccactgcaggtactaatttgctcctacaaatgtttcacccagcgagaccctaacctctttggtatagcgcaggtctag

SEQ ID NO: 48481 - DNA, 153 bp, Artificial Sequence
  Description of Artificial Sequence: Synthetic coding sequence
atgaccgagcggctgctgatcaaggccctgagcggcggcaagaacaccaaaatcatcacactcaacgggaaaaaaatgacgaaaatgccatcagcattgggcaaactgccaggactgaaaactctggtgttgcaaaataacctcataccttag

SEQ ID NO: 48482 - DNA, 1044 bp, Artificial Sequence
  Description of Artificial Sequence: Synthetic coding sequence
atgaccgagcggctgctgatcaaggccctgagcggcggcaagaacacgaaaattatcacgttgaatggtaaaaaaatgaccaagatgcctagcgcgctggggaaattgcctggtctgaaaacactggtgctccagaacaacctgatccccaaggtctgtcctgaattgtgcaatctcacccaactaaccacattgaatctgggcaataacctgttggaggaggtgccagaagagatgaaatatttgacaagcctgaagaatctccacctttccggtaatagaatctgccgctttgctccaggcgcatgcgatggcctccaaaacctgatcctgctcaatctgaataataaccacctaacccaattgccgcaggaggtgtcccgcctcaagtcccttacctatatgagcattaactacaatcagctggcttccatccccagggaactctgtttcctggagaatcttgtcgagctgcagttgaactataatcagctaatttgcattcccgaggaaattaagtttctaaagaagcttcaaaaattgctgcttgcgcggaacaacatcggcgtgcttcccgaggagctatgtgatctgaaaaagctcaggattctcgacatagcaggaaacatcattcagatctttccgtcggggtttcaagatttaaaactccgcgagttctactgtgaagggaaccctttgtttttacaacagcctgtgatcagtacgcagcaagagaacgtgtggagcctccaggagattacgtcccgcttcgtcatgaaccaactcgctgaaaataacccttttttgatggacgatatcgagagatatccccaggtgcggagtatgatctcccagggaaaaacatgcgctatttgtggtcagtactttatcaccgtgtggttggaatgcgtgcgattcgttcctcccccgaaggactggaagattagcaagaatctcaaactcgtgcctctgcaagtgttgatttgtagctacaagtgtttcactcagcgggatccaaatctctttggtatcgcccaagtgtag

SEQ ID NO: 48483 - DNA, 1680 bp, Artificial Sequence
  Description of Artificial Sequence: Synthetic coding sequence
atgagcagcgagcagagcgcccccggcgccagcccccgggcccccaggcctggaacccaaaagtccagcggcgcggtgacgaagaagggcgagagagccgccaaggagaagcctgccactgtattacccccagttggcgaagaagaaccaaagtcccctgaagaataccaatgttctggcgtactggagaccgactttgcagagctgtgtaccagatggggttacacagattttccaaaagtagtaaaccggcctcgcccacacccaccttttgtcccaagcgcctccctaagcgaaaaggctactttggacgaccccagactgtcaggcagctgctcgctgaattctttagagagcaagtacgtgttttttcgcccgactattcaggtagagctggagcaggaggactccaagtccgtcaaggaaatttatattcggggatggaaagtcgaagaaaggatcctgggcgtcttctctaaatgcctgcccccccttacccagcttcaggctatcaacttgtggaaggtgggtctcactgataaaaccctcaccacgtttatagagttgctgcccctgtgctccagcacacttaggaaggtcagcctggagggcaatccgctgcctgagcaatcatatcataagctgatggccttagattccacaatagcccacctgtctttgcgaaacaacaacatagacgacaggggtgctcagctacttggccaggccctttctactcttcactcatgtaatcggacccttgttagccttaacttggggtttaatcacatcggggatgaaggcgctggctatattgcagatggcctccgcctgaatcgctctttgctgtggctctctctcgcgcataatagaatccaggacaagggagctctcaaattagcggaggtgctgcgcgccttcgagcttacacatacagaggtcgtggaacgtcgacgtctgctgttagaaaagggcactcaggagaggagtaggtctccatcgtcatctcgacatggtgactccaagaccgaccgtgaaaagagccagatggtgggcatctctaattcagcattggtggacaagacagacaaaactcagacgatgaaaacgcctaaaggcctcggaaagaagaaggaaaaatcctgggaacttgcaaagaaggaggaaaaactgggaagtgggcaaagtcctacccagggaactcccaagaaagaggacgcgacaaaagcaggtaaagggaaagtgacaatcccggagcagaagccttcccgagctaaaggaatcaagattggctccagagagaaaaggtctatactcctggagtcagagctagtggttgaagccacggaggtagttaaccctctcttggaacccgtggaacatcgggatggaaaagtcttcatgcctggcaacaaggttctgcttcacctgaatctgatccggaacaggattactgaagttggactagaaggatttctcgcaacggtgcagtaccaaatgcaattctccaaggcgaaatccgccagcaaagggccagtcggcctcctatggttatcccttgctaaaaattgctttgccccacagtgtcctgcctacgctataattcaggagttgatgctgcctcgcgatcccatcaaagcaaagctgcgggaggatgaagccatggcctttttcccgtag

SEQ ID NO: 48484 - DNA, 864 bp, Artificial Sequence
  Description of Artificial Sequence: Synthetic coding sequence
atgagctgggaccccaaccccgtgccccggaccctgcggtgctggagacttcggcgagcatccgagacagcattgcagtcttcacgcagggccgttgaggaccagctgaagatttgtggacatagacgcgatgccgacgtcttcgaactcttcctatctaagaaggaattgacagaagtcatcgacctgtcccgattcaagaaactgaagtatctttggttgcatcataacaaactgcatgggatcactttcttgacccgtaactattgccttaccgagctgtatctcaacaataacgcaatttttgagattgaagggctgcattatttgccatcactccacattctcttgcttcatcacaacgagctgaccaacatcgacgccacggtgaaagaattgaaaggaatgctaaatctcaagattctctctctttaccagaatcccttatgtcaatacaacctgtataggttgtatatcatttaccacctccctggagttgaactcctagacaggaatcaggtgaccgaaaaggaaagaagatcaatgattacaatattcaaccacaagaaggcccatatcgttcaaagcatcgccttcggcggaaaagttgacgcctcatgggaccctaagagccccttcaaacaaaaacccgcccagagggtgccttcagattttgcctttgccaacaatgtcgacaagactgtcctggatgacccagaggatgccgtgttcgtccggagtatgaagcgctctgtaatgactctgacctccatgaactgggacactgtgccaactcgcgaagaaagatatctagaggaagaaggcaccgaaactgcacaaatgttaacagttaccctgagatag

SEQ ID NO: 48485 - DNA, 951 bp, Artificial Sequence
  Description of Artificial Sequence: Synthetic coding sequence
atgctgcccagcagcatccagatcagcggcgagcccctgagcggcgcagaggttcgggatatctgtcgcggcctccgcgacaacgcggttcgccttctgagtcttagagggtgtcggctgtgcgacagggatttcggacggatctgcagagctctggccggtgctacatcactggcccagttaaatttgaatctgggcgtggtaagctctccatccagaataaagcagttggctgaagcccttcgcacaaatcgtagtatacagtccctttttctgcacggcagtcctctgaccgacgctggtctggcgctgttgaaccctgccctggcccttcaccctgctctggtggcccttgatctcggagactgtatgctgggggacgaggctatcaatctgatatgcggactgctgccaccagacggcgccaaaagtggcctcaaagaactgacattatcagcaaatcccggtattacgcctaaggggtggagcagactcgctatcgcggtggcccattcgagtcaggttagagtgctcaaccttgactataacccactgggagaccacgtagccggaatgctcgccgtggccgtcgccagtagcagaacgctggaggtgctggaccttgagggtaccgggcttacaaaccaaagtgcacagaccctgctggatatggttgagaactaccccaccgcacttcgcagtttggtactggcagagaattctatctcacccgaactgcagcaacaaatttgcgacctgttaagcgaaggagaggaggaagaagaagtcgctggcggcgcgggggatacccaagaatgggaaagggggagagagcccgccgcccaccagagagggtcgtccagttggatgtgtccatctgatccatcttcacaaatggtcttaatgaccagcgggttgggggattcgttactcgccgagacggagatgtag

SEQ ID NO: 48486 - DNA, 1245 bp, Artificial Sequence
  Description of Artificial Sequence: Synthetic coding sequence
atgaagctgcactgcgaggtggaggtgatcagccggcacctgcccgctcttgggctcaggaaccggggcaagggcgttcgcgccgtgttgtccctctgtcagcagacaagccgcagccagccccccgtgagggcctttctgctgatttcaaccctcaaagataagaggggcactaggtacgagttgcgcgagaacatagagcaattcttcacaaagttcgtggacgaaggcaaggccacagttcgcctgaaggagcctccagtggatatctgcctgtctaaggctatatcctcctcactgaagggctttctcagcgccatgagactcgcccatcggggctgtaacgtggacacacccgttagtacactgacacctgtgaagaccagcgagttcgagaatttcaagactaaaatggtgattacatcaaaaaaggactacccactctctaagaatttcccctactctctggagcaccttcagacaagctactgcggcctggtccgggtggacatgcgcatgttgtgcctcaagtctctcaggaagctagatcttagccacaatcacattaagaagttgccagctaccatcggggaccttatccacctacaggagcttaatctgaacgacaaccacctcgaaagtttcagtgtggccctgtgtcactccactctccagaaaagcctcagatcactcgacctgtccaagaataaaattaaggcattgcctgttcagttttgccaactgcaggaactcaagaatctcaaactggacgataatgaacttatccagttcccctgtaaaatcggtcagctgatcaacttgcggtttttaagtgctgctcgaaacaagctcccctttctgcccagcgagttccgtaacctctccctagaatacctcgacttgttcggaaacacattcgagcaacctaaagtcctccctgtcataaagcttcaggctcctctgactcttctcgaatcgagcgcacgaacaatcctccacaaccgcattccatacggctctcacataatacccttccatctgtgtcaggatttggataccgctaagatttgtgtgtgcggaaggttttgcctcaattctttcatacagggaacaactaccatgaatttgcactctgtcgcgcacactgtcgtcctggtcgataacctgggaggcaccgaagcccccatcatatcttatttttgcagcctcggatgttacgtgaatagctccgatatgttgaaatag

SEQ ID NO: 48487 - DNA, 441 bp, Artificial Sequence
  Description of Artificial Sequence: Synthetic coding sequence
atgaagctgcactgcgaggtggaggtgatcagccggcacctgcccgcacttggcttgcggaataggggcaagggcgttcgcgcagtgctgagcctatgtcagcagacctcacgcagtcagcccccagttcgggcgtttttgttgatcagtacactgaaggacaaaagaggaacacggtatgagctgcgagagaacatcgagcagtttttcacaaaatttgtggacgaagggaaggccacggtacggctgaaggagcctcccgtggacatttgccttagcaaggatagtatttggctgtcgtaccacagtatcccttctctgccaagatttggttaccgtaaaaatttatgcctttggaaaatcttatcagaactgtttcattctaggaactactatcacgagagtgcattctgctgcccgcactgcggactaagcaggtag

SEQ ID NO: 48488 - DNA, 1269 bp, Artificial Sequence
  Description of Artificial Sequence: Synthetic coding sequence
atgaagctgcactgcgaggtggaggtgatcagccggcacctgcccgccctggggctgaggaatcgcggtaagggcgtccgtgcggtgctgagcctttgccaacagacatcaagaagccagcctccagtgcgggcttttctgctgattagcaccttaaaagacaagcgagggacacggtatgagttgcgggagaatattgagcaattcttcacaaaatttgtggatgagggaaaagcaaccgttcgcctgaaggaacccccggtggacatatgtttgagtaaaatggaatcccatagcgtcacacaggtgggcgtccaatgggaggagttgggcagcttacagcctactgggcattttcaacaattcaaacgctttcctttcagctatgaaactggtcaccgggggtgcaacgtcgatacccccgtctctactctgactcctgttaaaacatctgagtttgaaaacttcaagaccaagatggttatcacatccaaaaaggattatccactttccaaaaattttccctacagcctggaacatcttcaaacctcctactgcggcctcgtccgggtagatatgaggatgttgtgtttaaaatcattaagaaagcttgacctatcccacaaccacattaaaaagttacctgccaccattggggacctcatccacctgcaggaactgaacctgaacgacaatcatcttgaatcctttagtgtggccctctgtcactctaccctacagaaatccctgcgatccctggatttgtcaaagaacaagatcaaggctttgcccgttcaattctgtcagttgcaggaactgaagaatttgaagctggacgataatgagctgatccagtttccatgcaagattggtcaacttattaacttgcgctttttgtctgcagccaggaataaacttccctttctcccctctgagttccgcaacctttctctggagtacctcgatctctttggcaatacctttgaacagccaaaggtgctgccagtaataaaactccaggctccactcaccctgcttgaatccagtgctaggacgattctgcataaccggacgatatatcccaaggagatcaatgtcaacatgtgggaaacgctccctggacgcatatcgttggggtgcatgtacgactttgccgcttccaactggtccaagggcagattcctctatacctgctggaggggcggaatgtgcatcgtcactcacttagatgattcaaaaacattcataaaaacgaacttttcgttctag

SEQ ID NO: 48489 - DNA, 507 bp, Artificial Sequence
  Description of Artificial Sequence: Synthetic coding sequence
atgcaccccagcctggccaccatgggcaagctggccagcaagctgcaattggatcttagcgtcgtgaaaatctggtttaagaaccagagagccaaatggaaaaggcagcagcgacagcaaatgcagacccgtccatctctaggtcctgccaatcagaccacttccgtaaaaaaagaagagaccccatcagccataacaaccgccaacattagaccagtttccccaggaatctcggacgctaacgatcacgatcttcgcgagcctagtgggattaagaatcccgggggagccagcgcttcagcccgggtgtctagctgggactcacagagctacgatatcgagcagatctgccttggcgcgtctaacccaccttgggcgagtacactgtttgaaatcgatgagttcgtcaaaatctatgacctccccggggaggacgacacatctagtctcaatcagtatctctttccagtatgcctggaatacgatcagttgcagtccagcgtctag

SEQ ID NO: 48490 - DNA, 549 bp, Artificial Sequence
  Description of Artificial Sequence: Synthetic coding sequence
tgagcccacggcttccagccccacgccagcgtggagcccgcctgccaagctggcacctggaacctcaaacagctgtcgcaggaagggccacggcgataccgaaggcccagaactaggtttttgagcaagcagctgactgctctgcgtgaacttctggaaaagactatgcacccctccctcgccaccatgggcaaactcgcctcaaaattgcagctcgacctctccgtggtgaaaatatggtttaaaaaccagagagccaagtggaagagacaacagaggcagcagatgcagactaggcctagtctggggcctgccaaccagaccacctccgtgaagaaagaggagaccccaagtgccatcacaaccgccaacatcagacctgtgtcaccagggatttccgatgcaaacgaccacgacttgagagagcctagcgggataaaaaatccaggcggagcctccgcttcggctagagtcagtagctgggactcccagtcatacgacatcgaacagatttgcctgggcgcgtccaaccccccttgggccagttag

SEQ ID NO: 48491 - DNA, 573 bp, Artificial Sequence
  Description of Artificial Sequence: Synthetic coding sequence
atggccagccggggcaagaccgagaccagcaagctgaagcagaacctggaggagcagctcgatagacttatgcagcaactgcaggatctcgaagagtgcagagaggaactggacactgacgaatacgaggaaactaaaaaagaaacactggaacagctatcggagttcaacgactcactgaagaagataatgagtgggaatatgaccttggtggacgagcttagcgggatgcaacttgccattcaggccgccatcagccaggcctttaaaacacccgaggttatccggttgtttgctaagaagcagccgggccagctgaggacccgtttggcagaaatggaccgcgatctgatggtgggtaaactggagcgagacctctacacacaacagaaggtcgaaattttaactgccctccgcaaattaggagaaaagctcactgctgatgatgaggcctttctgtctgcaaacgccggcgctattctttcacagttcgaaaaagtctcaacagacctgggctcaggagacaagatcctggcccttgctagtttcgaagttgagaagactaaaaagtag

SEQ ID NO: 48492 - DNA, 573 bp, Artificial Sequence
  Description of Artificial Sequence: Synthetic coding sequence
atggccagccggggcaagaccgagaccagcaagctgaagcagaaccttgaggagcagctcgaccgacttatgcagcagctgcaggacctcgaggagtgccgagaagagctagacacagacgagtacgaagaaaccaaaaaggagactcttgagcaactttcggagttcaacgacagcttaaagaagatcatgagcggtaacatgaccctagtggatgaactctcagggatgcagctggccatccaggctgccattagccaagctttcaagactcccgaggtgattcgcctgttcgcaaagaagcagcctggacagctacgtacgaggctggccgagatggaccgagatctcatggtggggaaactcgagcgggacctctacacccagcagaaagtcgaaatcttgacagcgctacgcaaactcggcgaaaagctgacagccgacgacgaagccttcctcagcgctaatgccggtgcgattctctcccaatttgaaaaagttagcaccgacttagggtctggcgacaagatcctggccctcgcgtccttcgaggtggaaaaaactaagaagtag

SEQ ID NO: 48493 - DNA, 573 bp, Artificial Sequence
  Description of Artificial Sequence: Synthetic coding sequence
atggccagccggggcaagaccgagaccagcaagctgaagcagaacctggaagaacagcttgacagactgatgcaacagcttcaggacctagaggagtgtagggaggagctggacaccgatgaatacgaagagactaagaaggagacgttggagcagctatcagaattcaacgactctctcaagaaaattatgagtgggaatatgaccctggttgatgaactctctgggatgcagctagctattcaagcagccattagtcaggcttttaagacccctgaggttatccggctgttcgctaaaaagcagccaggccaactgcgaacgcgcctggcagaaatggaccgggacctgatggttggaaagctggagcgggacctgtatactcagcagaaggtggagattctcaccgctcttaggaaactgggcgagaaactgaccgcagatgacgaggcgttcctcagtgccaatgcaggcgctatactttcccagtttgagaaggtgtccacagatcttggctccggagataaaatcctcgctctggcatcttttgaagtggaaaagacaaagaagtag

SEQ ID NO: 48494 - DNA, 636 bp, Artificial Sequence
  Description of Artificial Sequence: Synthetic coding sequence
atgaacaacttcatcttcctgaagttcatgaccctgggcaccagccggacaggcgaaatcaaaatggcgtcaaggggcaagaccgagacatctaagctgaagcagaacctggaggaacagctcgacagattgatgcagcagctgcaagacctggaagagtgtcgggaagagcttgatactgatgagtatgaggaaactaagaaagagaccttggagcagctgagtgaattcaacgactctcttaaaaaaatcatgagcggcaatatgaccctcgtcgatgaactctccgggatgcagctagccatccaggccgccatttcacaagcttttaaaacccctgaggtcatcagattgtttgctaaaaaacagccaggacagctaaggactcgtctggctgagatggatcgagacctgatggtgggtaagctagaacgggatctgtacacgcagcagaaggtagagattctgactgcactgcgaaaactcggcgagaaactcactgctgatgatgaggcttttctgagtgccaatgctggcgcgatcctctcccagttcgagaaagtgagcaccgacttgggctcgggggacaagattctggcactggcatcatttgaagtcgaaaaaaccaagaagtag

SEQ ID NO: 48495 - DNA, 720 bp, Artificial Sequence
  Description of Artificial Sequence: Synthetic coding sequence
atggtgcagccccagaccagcaaggccgagagccccgccctggccgcctcccctaatgcccagatggatgatgtaatcgacactttgacctcactgaggcttacaaactcggctcttcggagggaggcttccactctgcgcgcagagaaggccaatcttacaaacatgctggaatcagtcatggcagaattgacgttgctgaggacgagggcgcgcattccaggggccctgcaaatcactcccccaattagcagtataacctccaacggcacacgacctatgaccacaccgccgacaagcctgcccgagcctttttctggcgatcccggcaggctggctggctttttaatgcagatggaccgatttatgatttttcaggcctcgcgctttcctggagaggctgagagagtggcttttcttgtttcgcgactgactggagaggcagagaagtgggccatcccacacatgcaaccagattcacctctgcggaataactaccaaggctttctcgctgagctacggaggacatacaaaagcccactgaggcatgcccgcagagcccaaatccgcaaaactagcgcctccaacagagctgtgagagagcgccagatgttatgcaggcagctggccagtgccggtaccggcccttgtcccgtgcacccagctagcaacgggacaagcccagcccccgccctcccagctcgcgctcggaacctgtag

SEQ ID NO: 48496 - DNA, 2079 bp, Artificial Sequence
  Description of Artificial Sequence: Synthetic coding sequence
atggaccaccacatccccatgcacgccctgcccgaggagatccagaagatgctacccgaggagaaggtttgtaagtattgcggagtctcctatctgatcctccacgagttcaaagccatggaagaaaaagtgaaggcaatggaaaaagaaatgaagttttaccaggggtcagtcgacagggaaaaacgcctccaggaaaagctacattcactctctcaggaactagaacagtataaaatagataacaaaagcaagaccgagagaatctacgacgtgggaatgcagctcaagtcacaacagaacgagtttcagaaggtcaaaaaacagttgtcccatctccaggatgaacttaaaatcaagtatcgacagtcgtatatattttcccaaagactcagtgagtataagtatttttggaacaagacgctctccctgttgacattcacaaaaagggaacttacctctattaagaatgaagtgtacgacaattatcagaactggacatcccttaagggtgccgtgttcctccagatcaagagtattagtgagactgcgttgaccgaaatagacatcctcaacaagagtcttacagtgtctcagaggaataaagtgtgccttgagaaagagatgaagaacctgaagctgctgtctgatgccgccatcctgcggagccagcagattcggactagtcgacagcaggaagtgaatctgcaaactcgatgttatgaccttcaaaaagaggtactagatctgcagtgtctcgtcgaagcgttaggactaaagctgcagaaggctgtcactgagatggataactataaagagatgttgatgaataaatccaacgaggccgatgattgccagagggaactgaagaagctgaaattcgagtccattatcagcgagtctcagcataccatgctcctaaaggagaaggaggatagcctgatgacctgccagcaaatatacaaagccttgcaggaggagttgaccgtgaaggagaagcaggaagaggatattaagcgacgcatcaatctggcagaaaatgaactggagataacaaagacccttctaaatcagacccgcgaggaggtgctgacactgaagaatgaacgcgaacttatgctcatctcacatcagaagtctatcgagcagctgcaggagacactgcgccaaaagttgctcagcgatgataactggaaggagaaaattgaagccgagcttgccaaagagcgcgcccagcatctggtggaatttgaggagcaagcactgcttttcaaagaggaaacaaagctgcagctggacatcgagaaggaaaaacatcaggacgtgattcagaaatataagaaagagcaggaggagcttcagatgaagatttccgatctaatcacaggtgccacaagggacctgaggcaagaggtaacaacactcaaagaaaaactccacaagagtcacatcaggtacacggaagagtctaactcaaaagaaaaggaaatcgagaacctgaagaatcttgttgctgaattcgaaagtaggctaaagaaagagattgattcaaatgactctgtctccgagaatctacggaaggagatggagcagaaatccgacgagctaaagcgcgttatgctggcacagacacaactaattgagcaattcaaccagtcccaagaggaaaacacatttctccaggaaaccgttaggcgagaatgtgaggagagatttgagctgacagaggcgctttcccaggctagagaacagctgctcgagttgagcaagctgcgtggaagcctgcccttttcgccgtgctctctgagcaagggttccctcacttctccagctgctgccgtttcaaatcacggcgagagatccctggcacgattgaattccgagaaaggcatccagattcccaacctgaggggagttagcaagcctaccacattccccaccagcgataagccaaaaagagtcagaagtggtgtgccaattctcccccagccacacccacctcgggggggggcttcctccgcgaatgagacacgtcagcggctggcagccatcctgcgtcggaggcggtctcaacaatag

SEQ ID NO: 48497 - DNA, 1167 bp, Artificial Sequence
  Description of Artificial Sequence: Synthetic coding sequence
atgctgctgaaggagaaggaggacagcctgatgacctgccagcagatctataaggcccttcaggaggagctcactgtcaaggaaaagcaagaagaggacatcaagcggcgtattaacctcgccgaaaatgagctggagattacaaaaactctgctcaaccagacccgggaggaagtccttactctcaaaaacgaacgcgaactcatgcttattagccatcaaaaatcaatcgagcagttgcaagagacgctgcgccagaaattgctcagtgacgataactggaaagagaaaattgaggcagagctggcaaaggaaagagcacagcacctggtggagttcgaggaacaggcactgctttttaaggaagagaccaagctgcaattagatatcgagaaagaaaagcaccaggacgtgatacagaagtataaaaaggagcaggaagaattgcagatgaaaatatccgacctgataactggtgccacccgcgacctgcgacaggaggtgactaccctcaaagaaaaactgcacaaatcccacattcggtatacagaggagtcaaacagtaaggaaaaggagatagagaacctgaaaaacctagtggcggaatttgaatcaaggttaaagaaagaaatcgactcgaacgattctgtgagtgagaatctccgcaaagaaatggaacaaaagtccgacgagcttaagagagtgatgctcgcccagacgcagctcattgagcagttcaatcagagtcaggaagaaaatacgtttctgcaggagactgtgaggagagagtgtgaggagaggtttgaattaacagaagcactctctcaggcacgcgaacagctattagaattgtctaaactgaggggttctcttccattctctccctgtagtctgtcgaaaggatctctgacgtctccagcagccgcggtgtctaatcacggagagcgctccttagcgcggcttaactctgagaagggtatacagattcccaatctacggggtgtgagcaagccaacaacatttcctactagtgataagccgaaacgagtcaggagcggcgtgcccatactgccacaacctcatcccccaaggggcggcgcatccagtgccaatgagacaaggcagcggctggctgccattctgaggaggcggcgatcccaacaatag

SEQ ID NO: 48498 - DNA, 1653 bp, Artificial Sequence
  Description of Artificial Sequence: Synthetic coding sequence
atggccagcgtgttccactacttcctgctggtgctggtgttcctggatactcatgccgctcagcccttttgtttaccggggtgcacctgtagcgaggagtcttttggacgaaccctccaatgtactagcgtgagtttgggaaagatcccaggcaacctttccgaggaatttaagcaagtacgaatagaaaactctcccctgtttgagatgccccagggcagctttatcaatatgagcactctggagtatctttggctcaactttaataacataagcgttatccatctcggtgcactggagcatctccccgagctgagagagctccgcctcgaaggtaataagctgtgtagcgtgccatggacagccttcagggcgacaccactgctgagggtactagacctgaagagaaacaagatcgatgcacttccagaactggccctgcagttcctggtgtctctgacctatttagatctgtcttctaatcgacttaccgtcgtgtctaagtcagtgtttctcaattggcctgcttaccagaagtgcagacagcctgactgtggtgccgaaatcttgtcaagtttggttgtggcactgcatgacaatccttgggtctgcgattgtaggcttaggggtctagtgcagtttgtgaagtctattaccctacctgtgatcctggtgaattcatatcttatctgtcagggcccactctccaaggcgggccagttgtttcacgagacggagttgtcagcctgtatgaagccccagatttccacacctagcgctaatattacaattcgcgccggtcagaacgtgacacttagatgcttggcccaggcaagcccatcaccttctatagcgtggacttatcccttgtccatgtggcgcgagtttgatgttctcacatcaagcaccggagaggacactgcgctgagtgaactcgcaatcccagccgcccacctcgtggacagcgggaactatacatgcatggcgagcaactctatcggaaagtccaacctggtaatcagcctgcacgtccaacccgcccaggctcttcacgcccctgattctctcagcatcccttccgagggcaacgcttatattgacctgcgagttgttaagcagaccgttcacgggatcttactggagtggttagcagttgctgacacatcaaaagaggagtggttcaccctttacattgcctccgacgaggcgtttcgaaaggaggtcgtgcacattggccccggcattaacacttacgctgtcgatgacctgctgccgggcacaaaatacgaggcgtgcctgtccctggaaggccaaccccctcaccagggtcagtgtgtggcatttgtgacaggccgagatgcaggagggctcgaggcccgggaacatttgctgcacgtcaccgtcgtcctttgtgtagttctgctggccgtgcccgttggggcctacgcatgggccgctcaaggcccctgtagttgttcgaaatgggttttgagaggttgtttgcaccgcagaaaagcgccttcttgcacacccgccgcccctcagagtaaagacgggtcctttcgggagcatcctgctgtgtgtgacgacggggaggggcatattgatacagagggcgacaaggaaaaaggagggacagaagataatagctag

SEQ ID NO: 48499 - DNA, 1683 bp, Artificial Sequence
  Description of Artificial Sequence: Synthetic coding sequence
atggccagcgtgttccactacttcctgctggtgctggtgttcctggacacgcacgcagcgcaaccattctgtctacccgggtgtacctgcagcgaagaatccttcggccggaccctgcagtgtacttcagtttcactcggaaagattcccggcaatctcagtgaggaatttaaacaagtgcgtatagagaacagccctctgttcgagatgcctcagggttcatttatcaatatgagcactctggaatatctgtggctcaatttcaataatatatcagttatccatctgggcgccttggagcacctgcccgagcttagagaacttaggctcgaaggcaataaactgtgcagcgtgccgtggacagcgttccgtgctacacccctcctgagagtgcttgacctgaagaggaacaagattgacgctctccccgaactcgcgctgcagtttctcgtctctcttacctacctggatctgtcctctaataggcttacagtggtttcaaagtccgtgttcctgaactggcctgcctaccaaaagtgtaggcagcccgactgtggcgcggagatcctgagttcgttggtcgtggcccttcatgacaacccgtgggtctgcgattgtcggcttcggggccttgtgcaatttgtgaaaagtatcacactccccgttatactggtgaattcatatcttatatgtcaggggcccctgtccaaggccggccagctcttccacgaaacagagctgagcgcatgtatgaagccacaaatcagtactccatctgctaatatcacaatccgggcagggcagaacgttacccttcgatgcctggctcaggcttcaccatcccccagcatcgcgtggacttatcccttatctatgtggcgggaatttgatgggttgctcggcggtaaacatttaacccccgtgcttacatcatcgacgggcgaggataccgccctctccgaactcgccatcccggctgcccatctggtggactctggcaactacacttgtatggcgagcaatagcatcgggaaatccaacctggtaatctcgcttcacgtacagcccgcccaagcactgcatgcccccgattcactgagcatccctagcgagggcaacgcctatatcgacctgcgggtcgttaagcagacagttcacgggatactcctggagtggctggccgttgccgacacgtctaaggaggaatggtttacactctacatcgcctcagatgaggctttccggaaagaggtcgtgcatattgggcccgggattaacacctacgccgttgatgacctgttacccggtaccaagtacgaagcctgcctgtccttagaagggcagcccccacatcaggggcaatgtgtcgctttcgttacaggcagggatgcggggggtctggaggctcgggagcatctcttacacgtgaccgtcgtgctttgcgtagttctactggcagttccagtgggagcatatgcctgggccgctcaggggccttgctcctgctccaagtgggtcctgcgaggctgtttgcaccgccgaaaagctccttcttgtacacccgcggcccctcaaagcaaagatggaagtttccgagagcacccggccgtgtgtgatgatggggaaggccatatcgatactgaaggtgataaggagaagggcggaactgaggacaatagctag

SEQ ID NO: 48500 - DNA, 1176 bp, Artificial Sequence
  Description of Artificial Sequence: Synthetic coding sequence
atgcggggcagctgcgagcggagcggcgaggacgaggagcagaaggaagaggccatggttgcttgcggacgactttctggcgtccccgaagcagaacaaggccctgaggctaattgggacagcgatctcgagacggagggtacggatgggctgggggagttggtgcgggatacgctctacttgagatcatgcagggcacactcagtcgtacctatatcctgctttctgagacaagggtctgcccaggaattgaatctgaggcacaggggcctgggaccacagggggctcgtgccttagcctctagtttgtcctccaatccctatgtcaagagactggatctgcgagataatggactctgcggggccggcgccgaagcgcttgccggggcactgagcaaaagtagctccatccacgacgtggacctgtcagaaaatcagcttggggtcgcaggagcacaggccttgtgcgctgcactcacagtaaatcaggctatgcggaaaatgcagctctcaggaaacggacttgaagaacaggcagcccagcatttagccgagttactcctcgctcatacggacctgaagagcctcgacttatcatacaaccagctgaatgaccaggcgggtgaaactctgggtccggctttggcagaaaatactggactgacagagctcaatgtttcttggaaccatttacgcggtcctggtgccgtggcattcgctcgtggcctcgaggccaacattttcctgaaggtactggatatcagctataacggctttggggaccctggggcttcagctgtgggcgaggccttaaaggctaacaatgtgctggaagaactgaatatgagcaataacagaatctctgccatgggagctctgagcttggggttgggtcttcgggtcaaccagaccttgaggatattagtctctcgaaacccaatgcgatccgaaggatgttttggactgcttaaatccgtccaggataaccctgcaagcgccctcgaattattggacttttcagatatccaagtcaatgctgagttcgatggactcgcttcaagtgtccgaggcattctgcctgaactgtgtattaaaaccggcgcatgtcgagtggagtacaagaaagagctgctgcccgtgttcagaagcgctctgcccgcctcagtgcccaagtag

SEQ ID NO: 48501 - DNA, 486 bp, Artificial Sequence
  Description of Artificial Sequence: Synthetic coding sequence
atgcggggcagctgcgagcggagcggcgaggacgaggagcagaaggaggaggccatggtcgcgtgtggccggttgtccggagtgcccgaggccgaacagggaccagaagccaattgggactcagacctagaaacagagggcaccgatggactgggggaactggtcagggacactctctatcttagatcgtgccgtgcccattcagtcgtgccaatctcttgctttttgcgccaggggtcggcccaggaactgaatctgcgccaccgaggcttgggtccacagggagctcgtgcactggcctcttcgttgtccagcaatccctatgtgaagagacttgacctgcgagataacggtttgtgcggtgctggtgcggaagctctggccggagctctcagcaagtcgtcctccattcacggaagatgctgggtctggggaaggtgggctggagtgtcaagcttctcaagtggaatgtgtctgcaccgctag

SEQ ID NO: 48502 - DNA, 2298 bp, Artificial Sequence
  Description of Artificial Sequence: Synthetic coding sequence
atggccgccagccagggcggcggcggcaacagcggcggcggcggctgtggcggcggagggagttctggcggatgcggcaccgctggcgggggcgggggaggcgctggtggcggggggggcggcggagggggcacactcgtagtgcccattcccgtacctacactgttcggccagccgttcccaaatggccctccttggaacccaggaagtcttcaaccccagcatactgtgcgttccctcgaccgcgctctagaggaggcaggttcttccggcattttgagcctgagcggacggaagctccgcgattttccgggatcaggctacgacctcactgacaccacacaggcggatctgagtaggaacagatttaccgagattcctagcgacgtctggctgttcgcccctctggagactctgaacctctaccataattgtatcaaaaccatccccgaggctatcaagaatctgcagatgttgacatatctaaacattagcagaaatttgctgagcactctgcctaaatacctgttcgatctcccgcttaaggtgttagtggtttctaacaacaaactagtaagtattccggaggaaattggcaagttgaaggatctgatggagctggacatttcctgcaacgagattcaggtcttgccgcaacagatggggaagctacacagcctgcgcgaattaaacattcgcaggaacaacttgcacgtgcttccagatgagttaggcgacctccctctcgtcaagctggactttagctgtaataaggtgaccgagatacctgtctgctacaggaaacttcatcatctgcaggtgataatactagacaacaaccccttgcaggtcccacctgcacagatctgcttaaaaggcaaggtgcatatcttcaaatacctcaacatccaagcctgctgccgtatggataagaagcccgattccttggaccttccttctttatccaagaggatgcccagccagccactgaccgactctatggaggacttttaccctaataagaaccacggccccgacagcggtataggatccgacaacggggaaaaaaggctgagcacgaccgaaccaagcgatgacgacacagtgtctctgcactcacaggtcagtgagtctaacagggaacagacaagcagaaatgatagtcacataatcgggtccaaaacggatagccagaaagaccaagaggtctacgacttcgtggatcccaacactgaggacgttgctgtgcccgagcagggcaatgcccacattggctctttcgtcagcttttttaaggggaaggagaagtgctccgaaaaaagccggaagaatgaagagctgggagacgagaagcgtctcgaaaaagaacaactgctagcagaagaggaagatgacgacctgaaggaagtgacagatctgagaaagatagctgcacagttactgcagcaggagcagaagaacagaattcttaatcactcaacgagtgtaatgcgcaataaacccaagcagaccgtcgagtgtgaaaagtccgtgagcgccgacgaggtcaatagtcctttgtccccgcttacctggcaaccactcgaaaaccagaaagaccagatagacgaacagccatggcctgaaagtcatccaattatctggcagtccgaggagcggcggcggtccaaacagatccggaaggaatactttaagtacaaatccatgcgtaaaagctcttcgggcaacgagaatgatgagcaggacagcgacaacgccaatatgtctacccagtctccagtgtcttctgaagagtatgaccgaactgatggcttttcacacagtcccttcggactgaagccaaggagcgccttttcacggtcttctagacaggaatatggagctgccgatcctgggtttactatgcgtaggaagatggagcatcttcgagaggaaagggaacaaattagacagctcaggaataatttggagtcacggttgaaagttattttgcctgacgatataggcgccgccctgatggacggagtagtattgtgccatcttgctaaccatattcggcctcgttctgtcgctagtatccatgttcctagtccagccgtccccaagttatccatggccaagtgccggcgaaatgtcgaaaattttcttgatgcctgcaaaaaactgggggtgtcacaagaaagactctgcctacctcaccacattctggaagagagaggcctcgtgaaagtgggcgtcacagttcaggcactgctcgaactgcccacaacgaaggccagccagctgagcgtcgcatag

SEQ ID NO: 48503 - DNA, 735 bp, Artificial Sequence
  Description of Artificial Sequence: Synthetic coding sequence
ggcctgttcagcctgcccggcacctggcggcgggtgcgggaggaggccgtgacggtcggtgagtcacatcctattatctggcaaagcgaagaacggagacgctctaagcagattcggaaagaatacttcaagtacaagagcatgcgaaaaagcagttcagggaacgagaacgatgaacaggattccgacaacgccaacatgagtacgcaaagtcccgtgagcagcgaggagtatgatcgcaccgacggtttttcccactcgccattcggcctcaagcctcgctcagcgtttagccgcagctctcgacaagaatatggtgcggccgaccccgggtttacaatgaggcgcaaaatggaacatctcagggaggagagggagcaaattcgccagctgcggaacaatctggaatcccgcctgaaggttatcttacccgacgatatcggagctgccctgatggatggggttgttctgtgtcatctggccaaccacatcaggccacggtccgtcgccagcatccacgtccccagccctgccgtgcctaagctgagtatggctaagtgcaggagaaacgtggaaaacttccttgatgcatgtaaaaagcttggagtcagtcaggaaaggttgtgtttgccccaccatatccttgaggagcgaggactggtaaaggtaggcgtgacagttcaagccttgctggagttgccgacaaccaaagcctcccagctgtcagtggcatag

SEQ ID NO: 48504 - DNA, 2247 bp, Artificial Sequence
  Description of Artificial Sequence: Synthetic coding sequence
atggccgccagccagggcggcggcggcaacagcggcggcggcggctgtggaggcggcggaagctccggtgggtgtgggacagctggtggaggcggcggaggcgccggtgggggaggaggtgggggcgggggtacactggttgtccccattccggtccccacactctttggccagccgttccctaacggccccccatggaaccccgggagcctgcaaccccagcatacagtcaggtcactcgatagagccctggaagaagctgggagctctggcattctctccctgtctggtagaaaactcagggactttccgggaagtgggtacgacctgacagatacaacgcaggccgacttgtcacgaaatagattcactgagatccccagtgacgtgtggctcttcgccccgttggaaaccctgaacctttatcataattgcattaagactattccagaggcaattaaaaacttacagatgcttacatatttaaatattagccgaaaccttcttagtaccctcccaaaatatctgtttgatctcccccttaaggttctggtggtgtccaacaacaaacttgtatctattcccgaagagatcggtaagctcaaagatcttatggaacttgatatctcttgcaatgagatccaggtgctcccgcagcagatggggaagttgcactctctgcgggaactgaatatcaggcggaataacctgcacgtcctaccagacgaacttggcgatctcccccttgtaaaattggatttctcatgcaataaggtgaccgagatccctgtgtgctatcgcaaactccaccatctacaggtcatcattttagacaataaccccctgcaggtgcctcctgctcaaatatgtctaaagggtaaagtgcatatattcaaatacttaaacattcaggcctgctgccgtatggacaaaaagccggattccctcgaccttccatccttgtcaaaacgtatgccaagtcagccactgactgactcaatggaggacttctaccccaacaagaatcatgggcctgattctgggatcgggtctgacaatggggagaaacggctctcaacaactgagccctcagacgacgacacagtatccctgcacagtcaggtgagcgaaagtaatagagagcagacttctagaaatgattcccatatcattggttccaagaccgactcgcagaaggaccaggaggtgtatgacttcgttgacccaaacacagaagatgtggctgtacccgaacagggcaatgctcacatcgggagctttgtttcctttttcaaaggtaaagagaaatgttcggagaaatcgcgtaagaacgaggaactgggagacgaaaagagactcgagaaggaacaattactggcggaagaagaggacgacgatctaaaagaggtgacagacttacgaaagatcgccgctcaacttttgcagcaggaacaaaagaacagaatactgaaccatagtacgagcgtaatgcggaacaagcccaaacagaccgttgagtgcgaaaaaagtgtgtcagcagatgaggttaattccccactgagtcctttgacgtggcaacctctcgagaatcagaaggatcagatcgacgaacagccatggccagagtctcaccctattatttggcaatcagaggagcgacgccgtagcaaacagattaggaaggagtactttaaatacaaaagcatgcgcaaaagttctagtggcaatgaaaatgatgaagagtatgataggaccgacggtttctcccattcgccctttgggctgaagcctcgttctgctttttcccggagctcgcggcaggagtacggcgccgctgaccctgggttcactatgcgaagaaaaatggagcatctcagggaggagagagagcaaatacggcagctgcgcaacaacctggagtcaagactcaaagtgatccttcctgatgatattggagccgcactgatggatggcgtcgtcttgtgccatctggccaaccacataagaccgcgttccgtggcctctatccatgtgccatccccggctgtgcccaaattgtctatggcaaagtgcaggaggaatgttgagaacttccttgacgcatgtaagaagctcggcgtatctcaggagcggctgtgtttgccgcatcacatccttgaggagagaggtctcgtgaaggtgggggtcactgtccaggcgctactggaacttccgaccaccaaagcatctcaactctcggtggcctag

SEQ ID NO: 48505 - DNA, 2247 bp, Artificial Sequence
  Description of Artificial Sequence: Synthetic coding sequence
atggccgccagccagggcggcggcggcaacagcggcggcggcggctgcggcggaggaggctctagcggtggttgcgggaccgctggaggtgggggcggcggtgcgggaggtggtgggggcggtggcggaggcacactggtggtaccgataccagtccctaccttgttcggccagcccttcccaaatggcccaccttggaaccccggatccttgcaaccacagcatactgtacgcagtctggatcgcgctcttgaggaggctggctctagtggcatcctgtccttatctggacggaagttgcgggatttccccggctcagggtacgacctcaccgatacaacacaggctgatttgagcaggaaccggttcactgagatcccatctgacgtgtggctctttgcccctctcgagacactcaatctatatcacaattgtatcaaaacaatacccgaggccattaagaacctgcagatgttgacctacctgaatatcagtaggaatctgctctccaccctaccgaagtatctgttcgacctcccactgaaggtccttgtggtgtccaacaacaagctggtctccatccctgaggaaatcggaaagctaaaggatctgatggagctggacatctcatgtaacgagatacaggtcctaccccaacagatgggaaaactacactccctgcgtgagcttaatatccggagaaataacctgcacgtgctgcctgacgagctaggcgatttaccgctggtcaaactcgatttctcatgcaacaaagttaccgaaatccctgtttgttacaggaaactgcaccatttgcaggttatcatactggacaacaacccactgcaggtccccccggcacagatatgcctgaagggcaaggtacacattttcaaatatctaaatatacaagcctgctgtagaatggataaaaagccagacagtctggatctgccttccctgtctaagcgtatgccaagtcagcctctcacagatagcatggaagacttctaccctaataagaaccacggtccagactcaggaattggtagtgacaatggagagaagcggttatcaacaactgaaccgagtgacgacgacactgtgagcctgcactcccaggtgagtgagagcaatcgcgaacagacatcccgcaatgattctcacatcatagggagtaaaacagactctcaaaaagaccaggaggtttatgatttcgtggatccaaacaccgaggacgtggccgtacccgagcaagggaatgctcatatcggcagcttcgtgagcttttttaaaggaaaggaaaaatgcagtgagaagagccgtaagaacgaggaactgggagatgaaaagaggttggagaaagagcaactgttggccgaggaggaagatgatgacctgaaagaggttaccgatcttcggaaaatcgccgctcaattgcttcaacaggagcaaaagaacaggatacttaaccattctacatctgtaatgcggaacaaaccaaagcagactgtcgagtgcgagaagagtgtttctgccgacgaagtgaacagtccgctgtccccactgacatggcagccactcgagaatcagaaggatcagatcgatgagcagccctggcctgagtcccaccccatcatctggcagtctgaagagaggaggcggagcaagcagatcagaaaggaatacttcaaatacaaaagcatgagaaaatcaagctccgggaatgaaaatgatgaggagtacgaccggactgacggatttagtcattctcccttcggtctgaagcccaggtcagcctttagcagatcaagcaggcaggagtatggtgcggccgaccccgggtttaccatgaggcgaaaaatggagcatctaagggaggagagggagcaaatacggcagctgagaaacaatctggagagtcgcctgaaggtcatccttcctgatgacatcggcgcagcactcatggatggagttgtactgtgtcaccttgccaatcacattaggccgaggtcagtcgcaagcatacacgtacccagtccagcagtgcctaagctgtctatggcgaagtgcagacgtaatgttgaaaatttcctggatgcctgcaagaagcttggggtctcccaagagagactctgccttccccaccacattcttgaggaaagggggttagttaaggtgggagtcacggtccaggccttgctcgagctcccgactaccaaggcttctcagctgtccgttgcatag

SEQ ID NO: 48506 - DNA, 351 bp, Artificial Sequence
  Description of Artificial Sequence: Synthetic coding sequence
atgacccagctgaaggagctggacatcagcaacaacgccatccgggaaatccctagaaacataggggagctcagaaatctcgtgtccctccatgcttacaataaccagatttcgtacctaccccccagtctgctgtccctcaacgatctacagcagcttaacctgtcaggcaataatctcactgccctgccttctgccatctataacattttcagcctgaaagaaataaacttcgacgataaccccttgctgcggcctcctgtggagatctgtaagggaaaacagctatataccattgcccgataccttcagagagctgacgagcgggatggtcttcaactgcactcttag

SEQ ID NO: 48507 - DNA, 2583 bp, Artificial Sequence
  Description of Artificial Sequence: Synthetic coding sequence
atgagcgagaaggagggcatgagcgaggtgctggaggacaccatctcgcagtttagaaaagagagccggagtcagagcatgaaagagccaggctttataaaagaaacatcaaatttgatcaatgaggcgagtgattacctggagggaaaaagctcaaatcagatctatgaaactcacccaagacagaacactttggaaagcaccagttcgagcggtcgcaagtccaagcgcaatgaggaacagaagaagaatctccagttctccgagacctccacccgaacgggcacaagccagtctttgtccagtctgaccgggaggactgctgagtaccaggcccttgtaaacttcctcagccacgagacagtcggcgaggtgtctccccaggtaagcgaggagaaccagaagcagctggggctgggagcagacaactttaccgtaaacttagaggccaaaggactgcaggaattccctaaggatatcctgaagattaagtatgttaagtacttgtacctggacaagaatcagatcaaaaccttccagggtgcggatagcggtgacttattagggctcgaaattctaagcctgcaggaaaatggactttcctccctccccagcgagattcagctattgcacaacctgcggatcttaaatgtaagccataatcacattagccacatccccaaggaaatctctcaactgggcaacataagacaactctttttttacaacaattatattgagaactttcctagcgatctagaatgcttgggcaacctcgaaatcctctctctggggaagaacaaactcagacacattcctgataccctgccctcactgaaaacgctgcgagtcctcaacctggagtataatcagctgaccaccttcccaaaggccctttgttttctgcccaaactcatctcactggacctgactggcaacctgataagctccctgcccaaggagatccgggagcttaagaatcttgagacactattgatggatcacaacaagctgaccttcttggctgttgaaatttttcagttgctgaaaatcaaggagctccagctggcggataacaagctggaagtcataagccacaagattgagaacttccgggaactgcggatactcatccttgataagaatctcctaaaaaatatccccgaaaaaatctcttgctgcgcaatgctcgaatgtttatcactcagtgacaacaagctgaccgagctacctaagtacatccataaattgaataacctgcgaaaactgcacgtcaatcgtaacaatatggtcaaaataaccgattgtatcagccaccttaacaacatttgttcgctcgagttctcaggcaatattatcacggatgttcccattgagatcaagaactgtcagaaaatcataaagattgagctgagttacaacaaaatcatgtactttcccttgggattgtgtgctctggacagcctgtactacttgtccgtgaacggcaactatatctcagagattcccgtggacatatccttcagtaaacaactgttgcatctggagctctccgagaacaaattactcatatttagcgagcacttctgtagtcttatcaatttgaagtacctggacctgggaaaaaatcagatcaaaaagatacctgcatcaattagcaatatgatcagcctccacgtactgatcctgtgttgcaacaagttcgaaacgtttccccgagaactgtgtacactcgagaacttgcaggtcttagatttgagcgagaaccagctgcaaaaaatctcctcagacatctgcaacttgaaaggtattcagaagctgaacttcagttctaatcagttcatccattttccgatagaactgtgccagctgcagagcctagaacagcttaacatctcacagattaagggccgcaagctgaccagactcccaggcgaactatctaacatgacccagctgaaagaactggacatttccaacaatgccataagagagattccccgtaatattggtgagcttcgcaatctcgtgtcattacacgcctacaacaaccagatctcatacctgcccccgagccttttgtccctgaacgacctccagcaactgaacttgtctgggaataatcttaccgcactaccaagcgcaatctacaacattttttccttgaaggagatcaatttcgatgacaacccactgctgcggccgcccgtggagatctgcaaagggaagcagctgtacacaattgcacggtatctgcagagggctgatgagcgggacgagaagatcttggagaagatcttcaagatcgttgccaacaacattacggaaacaaattttgaattcctctgtcagaagctgaacctcgccaacagtgaaacggacatgccgacaaagtcaaccgtgtcattaagtgagcgggcgcatcaggctctggttatctggaagacgcaatccaataaactatcactgaccgccgctgctttgcgcgaccagctcattagagctctgaccatgatcggagcctacgagattatggacaagatcaccgccctgaacctgtttactagagccatcaaattctag

SEQ ID NO: 48508 - DNA, 180 bp, Artificial Sequence
  Description of Artificial Sequence: Synthetic coding sequence
atgagcgagaaggagggcatgagcgaggtgctggaggacaccatcagccagttccgaaaagagagccgaagtcagagtatgaaagaaccaggatttatcaaggagacgtctaatttgattaacgaggcgtccgactacctagagggaaagagctctaaccaaatctacgagacacactag

SEQ ID NO: 48509 - DNA, 354 bp, Artificial Sequence
  Description of Artificial Sequence: Synthetic coding sequence
atgacccagctgaaggagctggacatcagcaacaacgccatccgggagattcctaggaacatcggggagctcagaaacctggtttctctgcacgcatacaataatcagattagctacctgcctccctccctcctttccctgaatgacctgcagcagcttaatctctctggcaacaacctgaccgctctcccaagtgccatttacaatatctttagcctgaaggagattaattttgacgacaaccctctcctgcgaccacctgtggagatctgtaagggtaagcagctatacactatcgcacgttatttgcagagagcagacgagcgcgatgggagactaaaaatccatacatag

SEQ ID NO: 48510 - DNA, 2583 bp, Artificial Sequence
  Description of Artificial Sequence: Synthetic coding sequence
atgagcgagaaggagggcatgagcgaggtgctggaggacaccatctcccagtttaggaaagagtctcgcagccagtccatgaaggagcctggcttcatcaaagagacctccaacctgatcaacgaggcttccgattatctggagggcaagtcctctaatcagatttatgagacacaccctcgacagaacaccctggagtccactagttcatccggccgcaaaagcaagcggaacgaggaacagaagaagaacttacagttctcagaaacgtctacgcggacggggacgtctcagagtttatccagtctaaccggacgcactgcagaataccaggccctggtcaatttcctctctcacgagaccgtgggggaggtgagtccccaagtgtccgaagaaaatcagaaacagcttgggctcggggcagataacttcactgtgaatttagaagccaagggcctgcaggaatttcctaaagatatcctgaagattaagtacgtgaaatatttgtaccttgacaaaaatcagatcaagacatttcagggagctgactcaggagacctgctgggacttgagatcttgtctctgcaggagaatggcctatcaagtctgcctagcgagatccaacttctccacaatcttaggattctgaatgtctcccacaatcacatctctcacatcccaaaagagatctctcagctggggaatataaggcagctgttcttctacaacaattacatcgagaacttccccagcgacctagaatgtcttgggaacctggaaatcctctctctggggaaaaacaaattgcgccatatacctgatactttgccaagtctcaaaaccctcagggtgttgaatctggaatataatcagcttaccacattccccaaagcactgtgttttcttcccaagctcatttcacttgaccttaccggcaacttaattagctcgctgcccaaagagatccgcgagctcaaaaatctggagaccttgctcatggatcacaataaactgacattcctggctgtagagatctttcagctgctgaagattaaagagctccagttagccgataataagctcgaggtgatatcccacaaaattgaaaactttagagagctgcgaatcctcatcctggataagaacctgctgaaaaatatccctgagaagatatcttgttgtgccatgctggaatgtttgagcctgagtgacaacaaactgactgaactgccaaagtacatccacaagctgaataacctgaggaagttgcatgttaatcgtaataacatggtcaagatcaccgactgtatttcccacctcaacaatatctgctccctagaattcagtggtaacattatcacagacgtgcctatcgagatcaaaaactgtcagaaaatcattaaaatagaactcagttataacaagatcatgtatttccccctcggactgtgcgccctcgattcactctactatttaagcgtgaacggaaattacatatctgagatccccgtagatatcagttttagcaagcagctgcttcacctcgaactgtccgaaaataagctcctgattttttctgaacacttttgttccctgatcaaccttaagtaccttgacctgggcaagaatcagatcaagaagattccggctagtatatctaatatgatttcactgcacgtactgatcctttgttgtaacaagtttgagacgttccccagggagctctgcacccttgaaaatttacaagtcttggatcttagcgagaaccagttgcagaaaatctcaagcgatatttgtaatcttaagggcatccagaaacttaacttcagctcgaatcagttcatacacttcccaattgaactgtgtcagctgcagagtcttgagcagctcaatatctcacaaatcaaaggacgcaagttaactcggctaccaggggagctgagcaatatgacgcagctgaaagaactggatatatccaacaacgctatacgcgagattcccaggaacatcggagaattgagaaacctggtttcgctgcacgcttataacaaccagattagttatctgccaccttccctcctctcactgaacgacctacagcagctcaatctctctggcaacaaccttacagcattgcctagcgccatatacaatatcttctctctgaaagagatcaatttcgatgacaaccccttgcttcgacctccagtagagatttgcaagggtaagcagctgtacacaatagcccgctatctgcagcgggccgatgaaagagacgagaaaatcttggaaaaaatcttcaaaattgtggctaacaatatcaccgagaccaatttcgagttcctgtgccagaaactaaacctggcaaactcggaaacagacatgccaacgaagagcactgtctccctttctgaacgcgcccaccaagcattggttatatggaaaacgcagtctaataagcttagtttgactgccgccgccctcagggaccagttaattcgggcgctcacaatgataggggcatatgaaatcatggataaaattaccgccctcaatctgtttactagggccatcaaattttag

SEQ ID NO: 48511 - DNA, 2478 bp, Artificial Sequence
  Description of Artificial Sequence: Synthetic coding sequence
atggccaccagcgagcgggccctgctgcggacccgggccgccagcttgctacgtggactaggtaggtcaagaactggggctaggagcctgcagtttagagctgagaaagaaaggcagccttgctggtcctttcccatgggccagaagaccaaaggcagctcgaatatagcttccagctatttactccagcaacttatgcacaggtaccaggagctggactctgacggagacgaagaccagggggagggcgaggcggggagcgaagagtccagcgaaagcgagatgctgaatctcgaggaggaattcgacggcgtccttagagaagaggcagttgccaaagcccttcaccatctgggaagatccggtagtgggaccgagcaggtatatctgaacttgactctcagcggatgcaatcttattgatgtgtccatactgtgtggctacgtgcacctgcagaaactcgatttgtcggcaaataagatcgaagatctgagttgtgtaagctgcatgccgtacttgctggagctgaatgcctcccaaaacaatcttactacctttttcaactttaagccacctaaaaatcttaagaaggctgacttctcccacaaccaaataagtgagatctgcgatcttagtgcctatcacgcgctgaccaaactgattttggatggtaatgagatagaggaaatttccggcttggagatgtgcaacaatctgatccacttgtcactggccaacaataaaattaccactattaacggtctgaacaagctgccaatcaagatcctctgtctatctaacaaccagatagagatgatcaccggtctggaggacctcaaggcgttgcagaatctggatctttcacacaaccagatttcgtcacttcagggactggagaaccatgatctgctggaagtcattaacctagaagataacaagatagcagaattgcgggaaatcgagtacatcaaaaatttgccaatattgcgcgtattaaacctgcttgaaaatccaatacaagaaaaatcagaatattggtttttcgtaattttcatgctgctgagacttacagagctggatcagaaaaaaatcaaggtcgaggaaaaagtttcagccgttaacaagtacgaccccccacctgaggtggtggccgcccaagaccatctcacacacgttgttaactctgtgatgcagcctcaacgcattttcgattctaccctgcccagcctggatgccccttaccccatgctgattctcgccggccctgaagcttgcggaaagagggagctggcgcacaggctctgccggcagttttccacttattttcgatacggtgcttgccatactactcgacctccatacttcggcgagggcgatcgggtggactaccattttatttctcaagacgtcttcgacgaaatggtgaacatggggaaattcatactgaccttcagttatggcaaccacaaatatggcctgaaccgcgataccgtcgaggggatcgcaagggacggattggccagctgtatccatatggaaattgaaggggtgcgcagtcttaaatattcctacttcgaacctcgctatatcttagttgttccaatgaacaaggaaaaatatgaaggttacctgaggcggaaaggattgtttagccgcgccgagatcgagtttgcagtgtctcgggtggatctgtatataaaaatcaaccagaactttccagggtattttgacgaggtaattaatgccgatgatctggacgtggcctatcagaagctgtctcaactgatacgcgagtatcttggcctcaccgaagagccagccaagagtctggctactaccgccgatgtcaaaacctcacatcttaagcctgaggcacacccaacaaaatatatcagtagcaacatgggcgactttctgcactccacagaccgaaattatcttatcaaattctgggccaagctgtcagccaaaaagacccctgcagaaagagactctatccatcgacagcacgaagctgccaggcaagctctgatgggccgcattcggccagaccatacactgctttttcagcgcggcccagtgcccgccccactgacctctgggctgcattattacaccaccttagaggagctgtggaagtctttcgatctctgtgaagactactttaaacccccttttggcccatatcctgagaaatcaggcaaggattctttggtttcgatgaaatgcagcctgtttaggttttgcccatggtcaaaggagcttcccttccaacctccagagggttccatcagtagtcacctgggttctggagctagcgattccgagaccgaggaaacgagaaaagcactgcctattcagtccttttcccatgaaaaagagtcccaccaacaccgacagcactcagttccagtcatttctcgccctgggtccaatgtgaaacctaccctgccccccatcccacagggccgcaggtag

SEQ ID NO: 48512 - DNA, 3933 bp, Artificial Sequence
  Description of Artificial Sequence: Synthetic coding sequence
atggacgacgacgacgccaagctgaaggccgagatcgaggccgagctcgacaagctgtccattagtagcttggagaaggaggatattgagtcggatgcaaaaagcgagacccaatccgatgactctgacacagattcggtggagctgccagaaagtgttctccactgtatcaacatcattaaaaatcgatccaaagcagtggaggaactgattctgcaagatctggaggacacagacatcctgagctgcagttacggggctgtttccaacaaccacatgcacctgcgtacaggactgtctacagaatatgaggagtcttccgagcagttgatcaaaatcctgtctgaaatcgagaaagaagaattcatgaggtccaaaaccgactgtgcaacccctgattttgtcccagaaccttccccacatgaccttcccatggacgagcacgtcctgcctgacgatgcggatataaactttggttactgtgaggtggaggagaagtgtcgacagtcgttcgaggcctggcaggaaaaacagaaagagctcgaggacaaagagaagcagacgctgaaagcccagcgggatcgagaggaaaaacaattccaggaagaggaggaaaagcggcattgctggatgaagcagtttaaagttgagaagaaaaaattagaaaacattcagaaagagtatatccggaatcttcacctgcagatggaggaggaaaggaccaggtttaaagaccagcaggaaaaagaaaaaaactccctgctgaagcaacagaacaatgctgcagtgaagatccaggcgaaatacaaggcctttgtggcctatcaaaaatatgggccgataatcaaagaacaaatcgagagcaagaagcgcaaagctcaggagtggaaagaaaaggaagctaagattcgccagaaggaggaggagaatcgcaagcggctggaggaggagcagagaatcaaggaggagaggaaaaagcagaaggaggaagagagaaaaagacgcgagaaggagtatgaggagaagaaaaacatagtgaaacaggagcgtgagcaattaatcagcaaggagaagattattcttagagaagatgcctctcagcaactcatcatctcctccgctctgaagaagtcaggttacaacaacaagcatttgagcctggaagacatctcaaacgacaaaggcgacatcgccaagaatctggtggacgaaaattctaagaagcaggaagatgtcctgctgtggctggtagaagaaagtaatatgaaagagaacgtggaccgccagactatcctcaaggagtccattcaggttaagttgaaggagagcataagctcccagacaatcctcgctgattttaaaatggaagaaaagaatgagaacctggctaagaagcgatgctcagaggaacttgtcaagcaggaaagaaaatacgagaacacagataacaagaccgaacttggaaattccgacctgaaaggaaacctgaaggaacagttcccactccaggagctaaaatcagacgcccagaaggaggaaaaaataatgaaacatgtgattaatgagaacacaggacaaaaaacccagatcattcttggacacaatcaagagatctctgaggtcaaaacaaatgaggaacagaagatcatcaaagataaccaacaaaagaaaattcagaaagtcgaaaaagaagagattcaggagcagaatggactgttgtataaggacaaggacaccctggtgatttcagtcaagcagaggagcctaagtctcacatccgaaaatagcaaggatgtccgagagaacgtgatcctccaagaaaaggagatctattccaaatcaaaggagatcgaagagaaccccaaagataacgcttggaacagcggcatcgtcattttcaacacgactgatactatgatcaacatcgaaggtaagcgaaacgaccaggactatgtgctgggacgccacgctccctgcgaaggtctgtctaactacaatgctgaatccagcatggtgtcgaaagaggtaaattctttgaaaagcgaaatcagaaatataagcgaaaagtgccacgaaaatgcgcctgagcctgactcaatgacctgctgcgtgagcgagagcacgctgctgtatagtatcgaggaacggaggctggcatggatcaagtcatttaaaccatggctcgaaattttcaaacaaaatcagcagaaaaagatcgtgcgacgcaagcgacccgtaaaatgcccagcaaatatgacccctgcgcttgataagctggagatcctcagatgtggcccatgggacaccctgcagcaggtgaccactgtgacttttcaggacctgcccgggtgcgttctcagcacccttgcagaatgtaccaatctgcagttcctgtcactgagacgctgcggcctcacctctcttcacagcctgtcgaattgcaagaagcttaaatacattgatgcgcaggaaaatcacatcgaagctatcgaatgcgaaaacctcgagaacctgtgtgtggtcctgctgaataaaaatcagcttaccagcctccacggactggatggatgcaccaacatccagtgcctcgaattgtcctacaacaaaattactaggataggatattctttctttcttgaggagaagctggttgataatgcaggattttgtcatcatctggggacctccaccagctatctgtctctcgctcaggtgtggattcccacaggcctctgctggtcatggatccctattaccagtttgaccaagaactctgattgtaactttcttatttctcatctctactggaactgcggtttggagtcattaaagaacctccagcagctgattctcgaccacaatcagctgattaatacaaagggcctctgcgatacccctacgatagtatatcttgattgttcccacaatcacctcactgacgtggagggagtggaaaattgcggattactgcagattttgaaactccagggcaattacctgtccgaactgccttctcttgaaaatttagtgctcttgcgcgaattacatctggacgataatagtatcagcaccgtggaggccttcagttcttactggttgccattgctgcagaatatcactatttcacagaactctctcaccaagatcgtgccattgttccactttgtctctctggagaaacttgatgtgagccataattgcctcagcgatctcaagtcagccataaagtggtttgacgcatgttattcccttcacgagcttagtcttaccgggaaccctcttctgcaggagaccaactggagagactccctgctgaaggtgctccccgccctccggattctaaacggaaatatcctcaatagcaactcagagtccagaactgaggagcataatcaattgggctcagccgggtttctggccctgtgccagtctcagatccgcgagttcaatctcctgatcgaaaattatatcacaggaaaaggggatgtgtttacccttgatacagcagaaaacttgtgtcattatttcaagaaactgatgattttaagcactgaatataggcacgcacacgagaggggggatgtaacaatcactaagaaagacgagtctgaggctcaaaagaatcacctggctccaactaattccgattctacactgcaaaacggggtgttctattcctgtgcacgagagggagaacccgattccccagacattccagagaaatggatggactctgttagcagtcactcaccactcagtaaatccgccacatgcgagaacatggagggccgccatcaggagatcttggtgtgccagaaaagagaagatagcaaggcgtctagcattcctaccattaggatccccttcaaggaggtagtcatgactaacagcttgctccgcaatcaccaaaacatagaaccgtctgagaaatag

SEQ ID NO: 48513 - DNA, 495 bp, Artificial Sequence
  Description of Artificial Sequence: Synthetic coding sequence
atggacgacgacgacgccaagctgaaggccgagatcgaggccgagctggacaagctctccatttcgagtctggaaaaggaagatatcgagtcggatgccaaatcagagactcagagtgatgatagcgacactgatagcgtggaactgcctgagagcgtactgcactgcattaacataattaaaaacaggtccaaggctgtcgaggagctgattttgcaggacctggaagatacggatattttgtcctgttcatacggagccgtctctaataaccatatgcatctacgcacggggctgagcacagagtatgaagaatctagtgaacagttgatcaagattctaagcgagattgagaaggaggagttcatgaggtctaagaccgattgtgctacaccagattttgtgccagaaccatctccccacgatcttcctatggacgagcatgtcctcccggatgatgctgacataaattttggatattgtgaagttgagtag

SEQ ID NO: 48514 - DNA, 5169 bp, Artificial Sequence
  Description of Artificial Sequence: Synthetic coding sequence
atggacgacgacgacgccaagctgaaggccgagatcgaggccgagctggataaactgagcattagtagtctcgagaaagaggacatcgagtccgacgcaaagtcagaaactcaaagtgatgattctgacactgattctgtggagctgcccgagtccgtgttacactgcatcaatattattaagaataggtctaaggccgtggaggaactgatcctgcaagatctggaggatacggacatactctcctgttcttacggtgccgtctctaacaaccatatgcacttgaggaccggcttgagcacagagtatgaagagtccagtgaacagctgatcaagatcctgagcgagattgagaaggaggagttcatgcgctccaagaccgattgtgccactcctgatttcgtgcctgagccctccccacacgatttaccgatggatgaacacgtcctgcccgacgatgccgacattaacttcggctattgtgaggtcgaggagaagtgtagacaatccttcgaggcgtggcaggagaagcagaaggaactcgaggacaaggaaaaacaaacactgaaggcgcaacgtgacagggaggaaaaacagttccaagaagaagaggagaaaaggcactgctggatgaagcagttcaaagtggagaaaaagaagttagaaaatatacagaagcaagaacaggataagatgaacgacgaactctacaaggaggagaagatctggaaagaaaagtttaagcaacacgaggagtatatcaggaatctgcatctgcaaatggaggaggaacgcactagatttaaggatcagcaggaaaaggaaaagaatagtctactcaagcaacagaataatgcagccgtgaagatccaggcaaagtacaaagcgttcgtggcatatcaaaaatatggacccatcatcaaagaacagattgagtctaagaaaaggaaggcccaagaatggaaagaaaaggaggccaaaattagacagaaggaggaagagaacagaaagaggctggaggaggagcagagaatcaaagaggagcgcaagaagcaaaaagaagaagaacgcaagcgaagagaaaaagagtatgaagaaaagaagaatatcgtcaaacaggagcgcgagcagctgatttccaaagagaaaatcatactccgggaagacgcttcacaacagctcatcatcagttctgccctaaaaaagagcggctacaataataagcacctgagtttggaggatatctccaacgataagggcgacatcgctaaaaatctggttgatgagaactcaaagaagcaggaggatgtcctgctatggctggtcgaggagtccaacatgaaggagaacgtggataggcagaccatcttgaaggagtccatccaggtcaaacttaaggagagtatctcaagccagactatactagccgatttcaagatggaggaaaaaaacgaaaatttggctaaaaaaaggtgtagcgaggagctggtcaaacaagagaggaagtatgagaacactgacaacaaaactgagttgggcaattccgatctgaaaggcaacttaaaagagcagtttcccctgcaagagcttaagtcagacgctcagaaggaggagaaaattatgaaacatgttataaacgagaatacgggtcagaagacgcagatcatcctgggtcataatcaggaaatcagcgaagtcaaaacaaacgaagaacagaaaattatcaaagacaatcagcagaaaaaaatccagaaggtggagaaggaagaaatccaggaacagaacgggctcctctacaaggataaagatactctggtgatttccgtgaaacagcggtccctctccctgacatccgaaaacagcaaggatgtgagggagaatgtgattctccaggaaaaggaaatttactctaaaagtaaagagattgaggaaaatccaaaggataatgcctggaatagtgggatcgttatttttaacactaccgacaccatgataaacattgaggggaagaggaacgatcaggactatgtgctggggaggcatgcaccttgtgaaggattatcaaactataacgcagaaagcagcatggtgagtaaggaggtcaatagtctaaaatcggagatcaggaacatctccgagaagtgtcatgagaatgcaccggaaccagacagtatgacatgttgtgtgtcagaatctacgcttttgtactcaatcgaggaaaggcggctggcctggattaagtcttttaaaccatggctggaaatcttcaagcaaaaccagcagaagaaaattgtgcgcaggaaaagaccagttaagtgtcctgccaacatgacccccgctctagacaaacttgagatcctacgctgcggaccctgggatacgctgcagcaggtaaccactgtcactttccaggatttgccaggttgcgtgctgagtactctagccgagtgtaccaacctccagttccttagtctgcggcggtgcggcctgacttcattgcattcactttctaattgcaaaaaattaaaatatatcgatgcccaagagaatcacatagaggcaatagaatgcgaaaacctggaaaacctctgcgtcgtgttattaaacaaaaatcagctaacatccctacacgggctcgacggttgcaccaatatccaatgtttggaacttagctacaacaaaattacaaggataggatacagcttctttcttgaagaaaagctcgtcgacaacgccgggttctgccaccacctgggcacaagcacaagttacctatctctggcccaggtgtggattccgacgggcctgtgctggagctggatacctattactagcctgaccaaaaacagtgactgtaatttcctcatttcacacctttattggaattgcgggctcgagtctctgaaaaatttacagcagctcatccttgaccacaaccagctgattaataccaagggactgtgcgacacccccaccatcgtgtacttggactgttcacataatcacctgacggacgtcgagggcgtcgaaaactgtggtttgctccagatcttgaagcttcagggtaattacctgtctgaacttccctccctggagaacctagtattgcttagagagcttcatctggatgacaactccatctccacggtcgaagccttctcatcttattggctacctctgcttcagaatattactatctctcagaattcattgacaaagattgttccactctttcactttgtgtcactggagaaactggatgtgtctcataattgcctatccgatctgaaatccgctattaagtggtttgacgcatgctattctctgcatgagctgagcctgaccggaaatcccctacttcaggagaccaattggcgcgattctctgttgaaagttctcccagccttgcggatccttaacggaaatatcctcaatagcaactcagagtctcggacagaggagcacaaccaattgggttcagctggtttcctggcattatgccagtcccagatcagagaattcaacctactcatcgagaactatattaccgggaagggggacgtatttactctcgatacggccgaaaatttgtgtcactatttcaagaaattaatgatcctgtccacggaatatcggcatgcccatgagcggggcgacgtaactattacaaaaaaagacgaatccgaagcacagaaaaaccacttagcccccacgaattcagattctactcttcaaaacggcgtgttctatagctgcgctcgagagggcgaacccgactcccctgacattcccgagaagtggatggacagtgtttctagccattctcccttaagtaaatcggccacttgcgagaacatggagggccggcaccaggagatcctggtctgtcagaagcgggaggacagtaaggccagttctattccaaccatccgtatcccattcaaagaagtggtgatgacgaactccctgttgcggaaccatcagaatatcgagcccagcgaaaagattatggccgccgttgttattcagtcctactggcggggataccttatgagaaggcaaacacacttctcaacccggctgcatacggctgcgaccgagggcctgcccaatagcagcattaaaaatcagactattcttaagaagggaaagagagagaatatcgtcaatattcgcaaacaaagggaaaaagctgctatccttatccaggcagtgtggaaaggttttatactcaggaaaaaactgacgacagctctggaggctatcaagaacgaggaatctgacgaggagtacagagaaatcgatcttgaagattttatctttgacgaagcagcacttgaggaagagtggctcgcgctagactctacacgctttcccagccagacattactgttatccaatcagttgcactggcctaaaattcctggcaacttgaagtgggatgatacaagcttcaacctgccgtccaacccggcacaggcatggctgtgcaacgataaagaaaacctctcctccagtgaacacactcagttcaacagccgcagcgaaaacaaaacctccagctggacacccgagtctaagacctctaggaagagtttgttaaagtccgagaaggaaaaaaagatttccgaggaatggggattcaaagatatctctactgcccagcagatgctgaaacgtgcccagaagatgaagtccaagaaactcaaaaaaaagatcgatagcactgtgagacttgctctatttaagaataacgagaataaggttagtctgcccaagagcccaaaaatggtccagccaaggcgagacggatactttgaaggtattgaagaagacccgatccacaaggatactaccgctaacgaaaagctcgagcggaacagggaatacacctaccagtggctacacacccaggtgggggtgcacgaaacaacttcaagtagaaacatgaagtgcaaccattttctgccagagctcgatccagacgtccttaacggtggtagggtacagttagtggctcggttggtgtccagggaggatacggatctggatctgttctctatgaccaacggcagcgctctctcagtgaaccgggagaagaagaaccaagctcaccgccattctgcaggcagcagctccaagctgtggtttccgtctaagctgatatag

SEQ ID NO: 48515 - DNA, 1875 bp, Artificial Sequence
  Description of Artificial Sequence: Synthetic coding sequence
atgttccacggcaccgtgaccgaggagctgaccagccacgaggagtggagtcattacaacgagaatattagggagggccaaaaggattttgtgtttgtgaagttcaatggtttgcatctgaagagtatggagaacctccagagttgcatttccctaagggtctgcattttctcaaacaattttatcacagacatccatccccttcaatcctgtattaaactgattaaacttgatcttcacgggaaccaaatcaaaagtctgccaaacactaagttttggaacggcctgaaaaatctgaagcttctgtacttgcacgataatggatttgcaaaactgaaaaacatctgcgtactgtccgcctgccccacattgatcgccctgaccatgttcgactgcccagtcagccttaagaaaggataccgacacgttcttgttaactcgatctggcccctgaaagccctggatcaccatgtcattagcgacgaggagattatccagaactggcacctgccagagcggtttaaggcttgcaatcaccgtctgtttttcaacttttgcccggctctcaggaagggaactacttacgaggaagaaattaacaacataaaacacataacatcaaagattaacgcgattcttgcccataatagccctgtgctgatagttcagaggtggattagaggttttctcgtcagaaaaaacttatctcccgtcttcttccacaagaaaaaacaacaggaaaaaataattcgcggctatgaggccaagtggatctacattaccaagggctacgaggataaactcctcaaggatctgttctttaagcctgagacaaacattaaggggaagttggcatactggaagcacaatatctattaccctgtggacctgaaaaattcttctgagcaccggaaacatgtttctagcatcctctgcgaacttaagcccaaggatctgggcatgaagtcaaagacctctcgacatctcattcaaaaaggccaggagagtgaagatgagatcgttgacgagaagctggacacatccttcagaatctccgtgtttaaactccccatctatacctccgggagtctgaaaaacaacgctgtactaagagaaaagaaacagcatttcttccctgcatatcctcaacccatatatacaactcaccctaaacccataataaagaaagacattcgtctggagcgaagcatgaaagaatttttcgcaccacagagagctggcatgaagctgagaaccttcagtgacattgacaaatattatactgagcagaagaagcaggagtaccataaagaaaaggtgagggtcgtcgcgatggcccaggtggcaagggagagggttcgggtggcagttaatgaacatctgaaccagaaaaagtacgctacccaaaaactgatagaggagaataaggaaacaattcagaatagcctcagacaggtttggcaaaaccgtttcaattatcttgagaaagcaagagaacgcaaagcccttttcctcaaggaaaagtctcagaaagcaagcgaacggctgctggtccagaaccttaacaacgagaggactctgttgactcgaggcttgctgaaaattgatcgcctagaaaaaaatgaagcagtgcttaaagagaaatctcttatcgtgaagcaaaagctgaaggcagaaaaatacagaaaaaacttgttaaaggaaatgaagaaagtcaggagccaggaaatttataaacgtcactgtgaggaaaaatttgttatggatatgattgcttttgagaaagcctgtgaacggctgcaggatgccaagacgaaagtggctattgtcaagaccaatcttgatttcaaagtacccaacgggttgatcaaatag

SEQ ID NO: 48516 - DNA, 900 bp, Artificial Sequence
  Description of Artificial Sequence: Synthetic coding sequence
atgttccacggcaccgtgaccgaggagctgaccagccacgaggagtggagtcattataatgagaacataagggaagggcaaaaggatttcgtctttgttaagttcaacggtttacacctgaaaagcatggagaaccttcagagttgtatcagtctgcgggtatgcatttttagtaacaattttattacagatattcacccacttcaaagctgcatcaagctcattaagttggacttgcatggcaaccagattaaatcgctgccaaatacaaaattttggaatggactaaagaacctaaaactcttgtatctgcacgacaatggcttcgcaaagttgaaaaacatttgcgtgctaagcgcgtgtcccacccttatcgccctgaccatgtttgactgcccagtaagccttaagaaggggtacaggcacgtgctggtgaattcaatctggccactgaaagcccttgaccaccacgtgatcagtgacgaggagatcatccaaaattggcacctgcccgagagattcaaagcctgtaaccatcgtttattcttcaatttttgccccgccttacggaaaggcactacatacgaagaggaaattaataatatcaagcacatcactagcaagatcaatgctatactagcgcataattcacccgtgctaattgtgcagaggtggatcagaggcttcctcgtgcgaaagaacctcagtcccgtgttctttcataagaagaagcagcaggagaaaatcatcagggggtacgaggcgaagtggatctatataacaaagggatacgaagacaaactgttgaaagacctgttctttaagcctgagaccaatattaaggggaaattggcctattggaagcacgacattaagaaactttactccaatcatcattag

SEQ ID NO: 48517 - DNA, 1683 bp, Artificial Sequence
  Description of Artificial Sequence: Synthetic coding sequence
atgagcaaggacatcaagagcgtggagcacagccccaagatccaccaacgcaatgatcctcaacatgtgaacgataggacctttttcatcgatgctagtaatcagagtctgactgccattccgctcgagatattcactttcacagagctggaagaggtacacctggaaaacaaccagattgaagaaatccctcaggaaattcaaaggctcaagaatattcgggtcctgtacctggataaaaataacctccgcagcctgtgcccggcacttgggttgctatcatccctcgagagcctggatttgagttataacccaatcttttccagttcactggtggtggtttcttttttgcacgccctcagggagctgagactctaccaaacagaccttaaggaaattccagtggttatattcaagaatctccatcacctggagcttctcggtctgacaggaaatcacctgaagtgcttacccaaggaaatcgtgaaccagacgaagctgagggaaatctatctgaagcgcaaccagtttgaggtatttccccaggagctgtgcgtcctgtataccttggagataattgacttagatgaaaataaaattggagcaatccccgaagagattgggcatctaacagggctccagaagttttatatggccagcaacaatttgccggtgctgccggcctctctctgtcaatgttcccagctgagtgttctagacttgagccataatcttttgcacagcataccaaaatctttcgcagaactgagaaagatgaccgagatcggcctgtctggcaaccggttagaaaaagtgcctagactcatttgtcggtggacctccctacatcttctgtacctcgggaacactgggttgcaccggttacgcgggtcttttagatgtctggtgaatctgcgctttctggacctcagtcagaaccatctccaccactgtccgcttcagatttgcgctctgaaaaatttagaggtcctcggccttgatgataacaaaatagggcagctaccctctgaattggggtctctctctaagctaaaaatcctgggtctgaccggcaatgagtttctgtctttccctgaggaggtgctgagcttagcttctttagaaaaactctacattggccaagatcagggcttcaagttgacgtacgtaccagagcacatccgaaaactgcaatcattgaaagagttatacattgagaataatcacctcgagtatctgccagtaagtttagggtcaatgccaaacctggaagtgcttgattgtcgccataaccttctgaagcagttgcctgatgctatatgtcaggcccaggctcttaaagaattacgcctggaggacaatctgctgactcacctacccgaaaatctggactccctggttaaccttaaggttctcaccctcatggacaatcccatggaggagccacctaaggaggtctgtgccgaggggaacgaggctatctggaagtatctcaaggaaaatcgtaacagaaatattatggctacgaagattcaggcctggtggcggggaactatggttcaaagggggttcggcaagtttggcgaactcctcaaacctcagaagaagggaaagactagcccaaaggataagaagggtaaaaaggatgtcaaaggaaagccggggaagggaaagaaaaagtag

SEQ ID NO: 48518 - DNA, 537 bp, Artificial Sequence
  Description of Artificial Sequence: Synthetic coding sequence
atggagcacaaggacgacgacgacgacgacgtgagcttcgccaagtggatgtcgagcttctggggtcactcatggagagaggaggaccagaggggactgcgtgagcgccaccgtctccaggcaacaagccataggaaaacatccctgccctgccccctgcccgtgctgcccaggatccctagcagcgattgccacccgcggcggcactctcatgaggaccaggagtttcgttgtaggtcccacgtgagagactataggaaatattccgaggatggatccttcaaggagccgttagagagcaagggcaggtcccattccaagatcgaaaagtttagtgaatctttcgagagacagctgtgtttccggactaaaaggtcagcttccctcggacctgaatctcggaaggagcgtaacgagagagagtgtttacggatggagattaagtcaagaaaaaaggtggaagaggagagatcatctcggaaagaagagcacggggaggcacacatggccccactgtttgaaaaagggcccgagtag

SEQ ID NO: 48519 - DNA, 1446 bp, Artificial Sequence
  Description of Artificial Sequence: Synthetic coding sequence
atgacccccgccctgaccgccctgctgtgcctgggcctgagcctgggccccagaactcgcgtgcaagctggccctttcccaaagccaaccctgtgggcagaaccagggtctgtgatttcttggggatcccctgtgactatttggtgtcagggctctctggaagcccaagaataccagctggacaaagaaggaagtcccgaaccactcgatcggaataatccactcgagcccaaaaacaaggcccgctttagcattccttccatgacccagcaccacgcaggaaggtataggtgtcactactactcatcagcaggctggtcagaaccatccgaccctctggagctggttatgactgggttttataacaagcctaccttaagcgcgctgccatctccagtggtcgctagcggcggcaatatgaccttgcggtgtggatcccagaaaggatatcatcactttgtactcatgaaggagggcgaacatcaactccctagaactctggactctcagcaactgcattcaggtggattccaggctttattccctgtgggtccagttacgccgagccacaggtggcggttcacctgttactactactacactaatacaccccgggtttggtctcacccgagtgaccctctcgaaattctgccctctggggttagcaggaagccctctctactaacacttcagggacccgtcttagcaccaggccaaagtctaaccttgcagtgtgggagcgatgtaggctacgacagattcgtgctctataaagaaggagaaagagacttcttgcagcggcccggacagcaacctcaggcgggcctcagccaggccaacttcaccctgggccccgtcagtccatcgcatggcggccagtaccggtgttatggagctcacaacttaagctctgagtggagcgcccctagcgatccactgaacattctgatggctggacaaatttacgataccgtgagtctctcagcgcaaccgggcccgaccgttgctagcggggagaacgtgactcttttgtgccagtcacgcggatattttgacacctttcttctgacaaaggaaggtgccgcacaccccccgctgaggctgcgctccatgtatggagcacacaagtatcaggctgaattccccatgtcgcctgtgacaagtgctcacgccgggacataccggtgttatggtagttatagctccaacccccacttgctctcgtttccctccgagccactggagctcatggtgtcaggacactccggggggagttcccttcccccaaccggcccaccttccacaccagccagccatgctaaggactacacggtcgaaaacttgattagaatgggcatggctggtcttgtgcttgtttttctgggaattctcctctttgaggcgcaacactcccagcgcaatccacaggatgctgcaggccggtag

SEQ ID NO: 48520 - DNA, 1395 bp, Artificial Sequence
  Description of Artificial Sequence: Synthetic coding sequence
atgacccccgccctgaccgccctgctgtgcctgggcctgagcctgggccctagaacccgcgtccaggcagggcccttccccaagcctaccctgtgggctgagcctggatccgtgatctcgtggggaagtcctgtgactatttggtgtcaaggcagtctggaggcccaggagtaccaactggacaaagaagggagcccagagcctctggatcgaaacaaccctctggaacccaagaacaaggccaggttcagtattcctagcatgactcagcatcacgccggcagataccggtgtcattattacagctcagctggctggagtgagccttctgaccccttagagctggttatgaccgggttctacaacaagccaactctttccgcccttccctcccccgtggtggcttcaggcggcaacatgactctcagatgcgggagccaaaaagggtatcatcactttgttctgatgaaagaaggtgaacatcagctgccccgcaccttggactctcagcagttgcactctggcggatttcaggcgctgtttcccgtaggccccgttacgccgtcccacaggtggcgttttacttgctactactactacaccaatacccccagggtttggtcccaccctagcgaccctctggaaattctgccttctggggtgtctcgtaaaccctcccttctgacgctacagggtccggtgctggctcctggccagtctctcacattacagtgtggcagtgatgtcggatacgataggtttgttctgtataaagaaggagaacgagattttctccagcgtccaggtcagcaaccccaggcgggattgtcacaggctaactttaccttagggcccgtgtctccgagccacggtggacaataccgctgttacggagcccacaatctatcctctgagtggtctgcgccatccgaccctctcaatattctgatggcaggtcaaatttacgataccgtatcactctccgcccaacctggtccgacagttgctagtggtgaaaacgtcaccctgctgtgtcagtctaggggatattttgataccttcctcctcactaaggaaggagcggcccacccacccttgcgactgcgttcaatgtatggtgcccataaatatcaggctgagttcccaatgtctccggtgacatcggctcatgccggcacgtatcgctgttacggatcatattcttccaacccccacctgctttcgtttccctcggagccattggagctgatggtgtccgccagtcacgccaaagattacactgtggagaacctgattaggatgggcatggccggactagtattagtgttccttggcatcttactattcgaggcccagcatagccagaggaatcctcaagatgctgccggtaggtag

SEQ ID NO: 48521 - DNA, 1899 bp, Artificial Sequence
  Description of Artificial Sequence: Synthetic coding sequence
atgacccccgccctgaccgccctgctgtgcctgggcctgagcctgggacctagaactcgcgtgcaggcggggcccttcccaaaaccaaccctctgggcagagcccggtagtgttatttcttgggggagcccagtgacaatctggtgtcagggttccctggaggcccaggaataccagctggacaaagagggtagccctgagccgttagacagaaacaatcccctggagcctaaaaacaaagccaggttctctatcccctccatgacccaacaccacgctggaaggtatagatgtcattactacagctcagctggttggtcagaaccaagcgatcctctcgaactggttatgaccgggttttacaacaagcccaccctgtccgcgcttccatcacctgtggtggcatccgggggcaatatgacgctaaggtgtgggagccaaaaaggctaccatcattttgtgctgatgaaagagggtgagcaccagctgccccggaccctcgactcacaacagttgcactcaggaggttttcaggccctgtttcccgtgggacccgttacaccttcccacagatggcggttcacttgttattactactatactaacaccccccgagtctggtcccacccatccgacccgctcgagatcctgccaagcggggtctctaggaagccatccctccttaccctgcaaggacccgtgctggctcccgggcagagtctaaccctgcagtgtgggtctgatgtcggctataatcgcttcgttctttacaaggagggtgagcgagatttcctgcagagacccggacagcagccacaagccggtttgtctcaagcgaacttcacgcttgggcccgtctccccttctaatggggggcagtatagatgctacggagctcacaacctgagtagcgagtggagcgctcccagtgaccctctcaacatactaatggccggccagatctatgacaccgtgagcctgtctgcccaaccaggtccgactgtggcttctggtgaaaacgtaaccctgctctgccagtcttggtggcagttcgacactttcctcctgaccaaagagggtgcagctcacccacccctacgtctgagatcaatgtacggcgcgcacaaatatcaggctgaatttcccatgagtcccgtgaccagtgcccatgcaggaacttataggtgttacggctcctactcatcaaacccacacttgctgtctcatccgagcgagcctctggaactcgtggtatctgggcatagcggcggcagctcactgccgccaactggacctcccagcaccccaggcctgggcaggtacttggaggtgttgatcggggtctccgttgcctttgtgctcctgctgttcctgctgctgtttctcctgctccgacgacaaagacactcgaagcacagaaccagcgaccagagaaagaccgattttcagcggcctgccggggcagcagagacagagccaaaggatagaggactgcttcgaagatctagtcccgcggccgatgtgcaggaggagaacttatatgcagctgtgaaggacacacaatcagaggatagggtggaattggactcacagcagtcaccccatgacgaggacccccaagccgtcacatatgcacctgtaaagcattctagcccacggcgagagatggcaagtcctcccagctccctgagtggcgaattcctcgatacaaaggacaggcaggtagaagaagatagacagatggacacagaggccgcagctagcgaggcttcccaggatgttacttacgcacaactccactcgttgactcttcgtcgcaaggccacggagcccccgccctcccaggagggtgaaccgccagccgagccctcaatctacgccaccctggctatacactag

SEQ ID NO: 48522 - DNA, 582 bp, Artificial Sequence
  Description of Artificial Sequence: Synthetic coding sequence
atgacccccgccctgaccgccctgctgtgcctgggcctgagcctgggaccacggacccgcgttcaggccggccccttcccaaagccaactctctgggctgagcccggaagtgtgatttcctggggcagtcccgtaaccatctggtgccaggggagcttggaggcacaggaataccagctggataaagaaggctctcccgagcctctggatcgcaataatcccctcgaacccaaaaataaggcgcggttttccattccttccatgacccagcatcatgcgggcaggtaccggtgtcattattacagtagtgcgggatggagcgaaccaagtgaccccctggagttggtgatgacaggattttataacaagcctactctgtctgcgctacctagtcccgtggtcgcctcagggggtaacatgacgttgcggtgtggatcccagaaaggttaccatcacttcgtgctgatgaaagaaggcgaacaccagctgcccagaactctggactcccagcaactgcactcaggtggatttcaggctctctttccagtgggccccgtgactcccagtcataggcgggtctag

SEQ ID NO: 48523 - DNA, 1899 bp, Artificial Sequence
  Description of Artificial Sequence: Synthetic coding sequence
atgacccccgccctgaccgccctgctgtgcctgggcctgagcctgggccctagaacacgcgtacaggccggaccattcccaaagcctacactgtgggcagaacctggttccgtgatctcatggggatccccagtcacgatctggtgccagggaagtttggaggcacaggagtatcaacttgataaggaaggcagtcctgagccccttgaccgcaataaccccttggaaccgaaaaacaaagccaggttttccatcccgagtatgacgcaacaccacgctgggagatatcgctgccactactattcgtctgccggatggtcagagccgtctgaccctctggaactggtgatgaccggattctataacaagcccaccttgagtgctctccccagccccgtggtggccagcggcgggaacatgacattgcggtgtgggtcccaaaaaggctaccaccatttcgtcttgatgaaggagggagagcaccagctgccaagaaccctggactcccaacagctgcacagtggcggttttcaggcactgttccccgtgggccctgtaaccccaagccatcgatggcgatttacatgttattactattacacaaacactccaagagtttggagtcaccctagtgaccccctggagattctaccgagcggcgtctccagaaagccctcactcttaaccctccaggggcctgtactggcccccggacagagcctgactttacagtgcggcagtgacgtgggctacgacagatttgtgctatataaggaaggcgaacgagattttttacagcgtcctgggcaacagccacaggccggactttcccaagcgaacttcactctgggccctgtctccccctctcacgggggacaataccgatgttacggagctcataacctgagcagcgaatggagtgctccctctgatccattgaacatcctgatggcaggccagatatacgataccgtgagcctgtctgctcagccgggtcctacagtggcctctggcgaaaatgtgacccttctgtgccagagcagaggatactttgacacatttctgttgactaaagaaggagctgcccatcctcccctcagactaaggtcaatgtatggggcccacaagtatcaggcagagttccccatgagtcctgtcacctccgcccatgcagggacataccgctgctacgggtcctattcaagcaacccgcacctactgtccttcccatctgagcctttggaactgatggtttccgggcatagcggcgggtcctcactgccaccaaccgggccgccctctactccaggactgggtaggtacctcgaggtacttatcggtgtcagtgtcgccttcgtgctgctgctgtttctgttgcttttcttgctactgcgcagacagcgtcacagcaagcacagaacctcagaccagcggaagaccgattttcagcggccagctggtgcagccgagacagagcccaaagatcgcggtctgctccgaagatcctcccccgccgctgacgtgcaagaagaaaatctctacgccgctgtgaaggacactcaaagtgaggacagggtggaacttgattcccagcagagcccacacgatgaggatcctcaagcagtcacttacgctcctgttaagcatagtagccctagacgggagatggcgagtcctcccagttcactgtctggcgagttcctcgataccaaagaccgccaggtggaagaggataggcagatggacaccgaggctgcggctagcgaagccagccaggacgtgacatacgcccaactgcatagcctgacattgcggcgcaaagccacagagcccccacctagccaggagggggaaccacctgcggaaccttctatctacgccacacttgccattcactag

SEQ ID NO: 48524 - DNA, 1368 bp, Artificial Sequence
  Description of Artificial Sequence: Synthetic coding sequence
atgacccccgccctgaccgccctgctgtgcctgggcctgagcctgggccccaggacccgggtgcaggcaggtccctttccaaagcccactctctgggccgaaccagggtccgtgatttcatggggatcgccagtgaccatctggtgccagggctccctggaagcacaggagtatcagcttgataaagaagggagcccggagcctctggaccgcaacaaccctctggagcccaagaataaggcaaggttcagcattccctccatgacacaacaccacgccggccgttaccgatgtcattactattctagtgctggatggtctgaacccagcgatcctctagaattggtgatgacaggcttctacaacaaacctacgctcagtgcactgccaagtccggttgtggcttccgggggcaatatgacactgcgctgcggctctcaaaaagggtaccaccacttcgtcttaatgaaagaaggagaacatcaactgcctagaacactggactctcagcagctgcatagtggcggatttcaagctctcttccccgtggggcccgttacacccagccacaggtggcgatttacttgctactattactacacgaacacaccgcgcgtgtggtcccatccatccgatccactagaaatactgccaagtggtgtctcccgcaagccctctctgctgactctgcagggccccgtgcttgcccctgggcagtccctgactctccaatgtggttcagatgtcggttacgatcgtttcgtgctatacaaagaaggtgagagagatttcctgcagagaccaggtcagcagccgcaggccggcctcagccaggccaatttcacacttggacctgtttctccaagtcatgggggccagtataggtgttatggggcacataatttgtcttctgaatggtctgcaccctccgaccccctgaatatcctgatggcaggacagatttacgataccgtttcactctccgctcaacccggacccacggtcgcctctggagaaaacgttactctgttgtgccagtcacgcgggtactttgatacgtttctgctgaccaaggagggagccgcacatccacctttgcgcttgagatctatgtatggcgcgcataagtatcaggccgagttccccatgtccccagtcacaagcgcccacgccggtacctataggtgctacggtagctacagctctaaccctcatttacttagcttcccatccgagcctctcgaactcatggtatccggcgagggcgcagatcccgttttgtctgagttaaagggctctgcacaagctcaagctccgcgccgggcgttggggtgggatggcccacgcgaagccgttcgagaggcttag

SEQ ID NO: 48525 - DNA, 1896 bp, Artificial Sequence
  Description of Artificial Sequence: Synthetic coding sequence
atgacccccgccctgaccgccctgctgtgcctgggcctgagcctgggaccccgaaccagggtgcaggcaggccccttccccaaacccacactttgggccgagccaggctcagtcatctcttggggtagcccagtaacaatctggtgtcagggctccctggaggcacaggagtaccagttggacaaggagggctccccggagcctctcgataggaataacccactggagcccaagaataaggcaagattcagtatcccttctatgacccagcaccacgcgggacgctaccgctgtcactactactcatccgcaggttggagcgaacctagcgacccgctggaactcgtcatgactgggttctataacaaacctacactgtctgccttaccttctcctgttgttgcatcaggaggcaatatgaccctgaggtgcggctcccagaaagggtaccatcactttgtgctcatgaaagagggggaacaccagctgcccaggacgcttgattcccaacagcttcatagcggcggattccaggcactttttcctgttggccccgtcacccccagccataggtggaggtttacgtgctactactattacactaatacgccgcgcgtctggtctcacccctctgaccctctggaaatccttccaagtggcgtgagccgcaagccaagtctcttgacactccaagggcccgtgcttgctcctggccagtcacttacattgcagtgtggcagcgatgtggggtatgatagattcgtcctctataaggaaggtgaaagagacttcctgcaacgcccagggcaacagcctcaggccggattaagccaggccaactttacattgggccctgtgtcaccatcgcacggcgggcagtatcggtgttatggcgcccataaccttagttcagagtggagtgccccctctgacccacttaatatcctcatggctggacaaatctacgacactgtgtccctctctgcccagcccgggccgaccgtcgcttctggcgaaaatgttacactgctctgtcagtcgtggtggcagtttgatacgtttctgctgactaaagagggtgcagctcaccccccgcttagacttcggtctatgtatggcgcccacaagtaccaagctgaatttcctatgtcacctgtgacctcagcccatgctgggacctatcggtgctatggatcgtacagcagcaatccgcatctgctttcccacccaagtgagcccctggagttggtcgtgtccggacactcaggcggcagtagcctgccaccaaccggcccaccctccacccctggattggggcggtacctggaggtgcttatcggggtgtccgtcgcatttgttctcttgcttttcttgctcctgttcctgttactgcggcggcagcggcactctaaacataggacttcagatcagagaaaaactgacttccagaggcctgccggagctgctgaaacggaaccaaaagaccgggggctgctccgtagatcaagccccgctgctgacgtacaagaagaaaatttatacgctgccgtgaaggacacccaatctgaagaccgcgttgaattggattcccagtctccacacgatgaggaccctcaggctgtgacatacgcacctgtgaaacatagtagtccacgtcgggaaatggcgagtccaccctctagcctcagcggtgaatttctggacacaaaagaccgacaggtggaggaagatagacagatggatacagaagcagcagcatccgaggcttctcaggacgtcacttacgcgcagctgcatagcttgaccctgcgccggaaagcaacagaacctccccccagccaagagggcgagccccccgccgagccatcgatttatgctacgctggcaatccattag

SEQ ID NO: 48526 - DNA, 1083 bp, Artificial Sequence
  Description of Artificial Sequence: Synthetic coding sequence
atgatccccctgctgctggccgccctgctgtgcgtgcccgccggcgcactaacatgctatggggacagcgggcagccggtcgattggtttgttgtttataagttgcctgccctacgtggcagcggcgaagccgctcaaaggggcctccagtataaatacctcgacgagagctccggaggttggagagatggtcgggcccttattaacagccccgagggtgctgtcgggcgcagcctgcagcccctttaccgttcgaatacgtcccagttggcctttctgctgtacaacgaccaacccccccagcccagtaaagctcaggactcttccatgcgggggcatacaaagggcgtgcttcttctggatcatgatggaggattctggcttgtgcattctgtaccaaacttcccacctcctgcatccagtgcagcatatagttggccgcatagcgcgtgcacctatggccagacgttgctttgcgtgtccttcccttttgcacaattctctaagatggggaagcaattgacatacacctatccatgggtgtataactatcagctggagggaatctttgcccaggagtttccggatctcgagaacgtcgtgaagggtcaccatgtgtctcaggaaccatggaattcaagtataaccttaacctcacaggccggcgcagtgttccaaagcttcgctaagttttctaagttcggcgacgatctctattcagggtggctcgccgcggctctcgggaccaatctacaggtgcagttctggcacaagaccgtgggcatcctgccaagcaactgctctgatatttggcaagtcctcaacgtgaatcagatcgcttttccaggtcctgccgggccctcttttaatagcaccgaggaccattctaagtggtgtgttagcccgaagggtccgtggacctgcgttggggatatgaaccggaaccagggggaagagcagaggggtggcgggacactgtgtgcacaactccccgccctctggaaggccttccagcctctggtcaagaactatcagccgtgtaatggtatggcgagaaaaccatcccgagcctataagatctag

SEQ ID NO: 48527 - DNA, 2346 bp, Artificial Sequence
  Description of Artificial Sequence: Synthetic coding sequence
atggccgccaacgtgggcgaccagcggagcaccgactggagcagccagtactcgatggtggcaggtgcaggacgggagaatgggatggaaacaccaatgcatgaaaatcccgaatgggaaaaggccagacaggccctggcaagcatctctaagagcggagccgcaggcggctccgctaaaagctcctctaacgggcctgttgcctccgcgcagtatgtgtcccaggctgaggcaagtgctctccagcaacagcagtactatcagtggtatcagcagtacaactacgcatatccctattcttactactacccgatgcctccggtgccaggaatggatgagtctatgtcctatcaggcccctccacagcagttgccttccgcccagcctccacagccctctaacccaccacacggcgcccataccctgaactcaggaccccagcccggcactgctccagccacccagcacagccaggctggcccagctaccggacaggcatatgggccacacacatatacggagcctgccaaacccaaaaagggtcagcagctctggaacaggatgaagcccgccccaggtacagggggcctcaagtttaatattcagaagcgtccattcgccgttactactcagagcttcggatctaacgcggaggggcaacatagcggctttgggccccagcctaatcctgagaaagttcaaaaccattcaggatcaagcgccagaggaaatttgtccggcaaaccagacgattggccacaggacatgaaagaatacgtggagagatgttttactgcttgcgaatccgaagaggacaaggataggaccgaaaaactattaaaggaggtgctgcaggcacggttgcaggatggttcagcatatactatagattggtctagggaacccctgcccggattgactcgggaacccgtagccgaaagcccgaagaagaaacgatgggaagctgccagctcactgcacccaccacggggggctgggagcgcaactcgaggaggcggggccccttctcaaagggggaccccgggagctggtggggcaggaagagcgcgcggaaactcttttacaaagtttgggaaccgaaatgtttttatgaaggacaactctagctcctcaagtacagactcacgctcgcgctcaagtagtaggagtcctactcgacacttccgccggagtgactcgcactcagattcggattcttcgtattccggaaatgagtgccacccagttggcagaagaaatccccctcctaaggggcgggggggtcgcggcgcccatatggacagaggacgaggacgtgcccaacgcggtaagcgtcatgacttagcacccacgaagcggtctcgcaaaaagatggcagctttggagtgcgaggacccagaaagagagttgaagaaacaaaagcgcgcagcgcgatttcagcacggacactctcggaggcttcgcctcgaacctttagtcttacaaatgtcatcattagaatcctccggtgcagatcctgactggcaagaacttcagatcgttggcacttgcccagatataaccaaacattatcttcggctcacttgcgcccccgacccatctaccgttcgaccggttgccgtgctgaagaaatctctatgcatggtgaagtgccattggaaagaaaaacaagattacgcatttgcgtgtgagcagatgaaaagcatcaggcaggacctgaccgtgcagggcatcaggacagagttcaccgtcgaggtgtacgagacacatgctaggattgccctggagaaaggagaccacgaggagttcaatcagtgccaaacccaacttaagagcttgtatgctgaaaatctgcctggaaatgtgggggagttcactgcgtatcgaattctgtattatatcttcactaaaaacagcggcgatatcacaaccgagctggcttatctgacccgtgagctgaaagcggatccatgtgtggctcatgccctggcactccgaacggcatgggctttggggaattaccaccggttttttcgtctctactgccacgcaccctgcatgtcaggataccttgtggacaaatttgctgatcgagagaggaaggtcgccctcaaggctatgattaaaacctacgtggtcccctcctcactacttcccctgctcttccccagttttaggttggtctccagctgtatcaagctatctccctgtcctctcctcccattgcctccagtctttctactgatcttcttttccccatttcctccaagcctgtccgcattttttccctggtttagcactggaaagactgtccctccttcactgcccccatcttctgctatgtag

SEQ ID NO: 48528 - DNA, 2403 bp, Artificial Sequence
  Description of Artificial Sequence: Synthetic coding sequence
atggccgccaacgtgggcgaccagcggagcaccgactggagcagccaatactcaatggtcgccggcgccggccgcgaaaacggcatggaaacaccgatgcatgagaatcctgaatgggagaaggctaggcaggccctggccagcatcagtaagtccggggctgccggaggatccgcaaaaagcagctcaaatggccccgtggcaagcgcccagtatgtttctcaagccgaagcaagtgctttgcagcagcagcagtattaccagtggtatcaacagtacaactatgcctacccctactcttattattatccaatgtccatgtatcagtcatatggaagccccagccagtacggaatggcagggagttacggctcagctaccccgcagcagcccagtgccccacagcaccaaggcacactcaaccaacctcctgtgccgggcatggatgagtccatgtcgtaccaggccccacctcaacagcttccatctgcacagccaccacagccgtcaaacccccctcatggcgcacacactttgaattccgggcctcaacctggaacagccccggccacccagcacagtcaggctggtcccgcgacggggcaggcatacgggccccatacctatacagagcccgcgaagcccaagaaaggacagcaactctggaataggatgaaacccgctcctggcacaggaggcctcaagtttaatatacaaaagaggcctttcgccgtgaccacacaatcttttggtagtaacgccgagggacaacattcaggttttgggcctcagcccaacccagaaaaggtgcagaatcattccgggtcctccgctagaggtaatttgagcggcaagcctgacgattggcctcaggacatgaaggagtacgtggagcggtgcttcaccgcctgcgagagcgaggaggacaaggaccgcacggagaaactgctcaaagaggtgttgcaagccagattgcaggatgggtccgcttatactatcgactggtctcgcgaacctttacctggcctgacacgggaacccgtggccgagtcccccaaaaagaagcggtgggaagcagctagcagtcttcacccacccaggggggcaggaagcgctacacgggggggtggtgccccttcgcaacgcgggacccctggcgccgggggagccggccgcgcgcggggaaactcgttcactaagttcggaaacagaaacgtcttcatgaaggataatagctctagcagctcaacagactctcggtcacgttccagttcaaggtctcccacgcgccatttcagaaggtcagacagccactcggactccgattcgtcctactcagggaacgagtgccaccctgtcggcaggcgaaacccaccccctaaagggcggggcggacgcggggcccatatggaccggggtcgcggaagagcacaaaggggtaagcgccacgatctggcgcccacgaagaggtctcggaaaaaaatggctgccctggaatgcgaggaccctgagcgcgagctcaagaaacaaaaacgagccgccaggttccagcacgggcacagccggagacttagactagaaccgctggtgctgcagatgtcttccctggagtcgagtggtgccgacccagattggcaagagctgcagatcgtgggtacttgccctgatattaccaagcactatctgcgtctgacatgcgcgcctgatcccagcaccgtgaggccagtggccgtcctcaagaagagtctgtgcatggtgaagtgccactggaaagagaaacaagactatgcgttcgcctgtgaacagatgaagagtattcggcaagatctcacagtgcagggtatcaggactgaatttactgttgaagtatacgagactcatgcccgtattgccctcgaaaaaggagaccacgaggagttcaatcagtgtcaaactcaacttaagagcctgtacgcagagaatctaccaggaaatgtgggcgagtttaccgcctacagaattttatattacatctttaccaagaattccggtgatatcacaacagagctggcatacctgaccagagagctcaaagctgacccctgtgtggctcatgccctcgctctaaggacagcttgggcgttaggcaactatcaccgcttctttagactgtattgccacgcgccatgcatgtccgggtaccttgtcgataagtttgcggatagagagcgtaaggtggctctgaaggcaatgattaagacgttccgtcctgcgctgccagtgtcatacctacaggctgagctcgctttcgagggcgaggcagcctgccgggctttcctcgaacccctgggactggcttatacaggcccggataattcttccatcgattgtcgtctgtcactcgctcagttaagcgcattttag

SEQ ID NO: 48529 - DNA, 165 bp, Artificial Sequence
  Description of Artificial Sequence: Synthetic coding sequence
atggccgccaacgtgggcgaccagcggagcaccgactggagcagccagtattccatggtggctggggccgggagagaaaacgggatggaaaccccgatgcacgagaaccccgatcgctccggtatcgactgccgtctgtccctggctcaactatctgccttttag

SEQ ID NO: 48530 - DNA, 903 bp, Artificial Sequence
  Description of Artificial Sequence: Synthetic coding sequence
atggccgccaacgtgggcgaccagcggagcaccgactggagcagccagtactccatggttgcaggggcaggccgggaaaatgggatggagaccccaatgcacgaaaatcctgagtgggagaaagcccggcaggctctcgccagtataagtaaaagtggagctgctggagggagtgccaagtcttctagcaacggcccagttgcctctgcgcaatatgtgagccaagcggaagcctcagccctgcagcaacaacagtattaccagtggtaccaacagtacaattatgcttacccatattcatactactaccctatgtcaatgtatcagagctacggctcccccagccagtacgggatggcggggtcttatggaagcgcgacaccacagcagcctagcgccccccaacaccagggaacactcaatcagcccccagtgcccgggatggatgagagtatgtcttatcaggcccctccccagcagcttccgtctgctcagcccccccagccttctaatccccctcacggagcccatactttgaatagtggcccccaaccaggtactgctccggcaacccagcattcccaggctgggccagctaccggccaggcttacggccctcacacatacactgagccagctaaaccgaagaaaggacaacagctatggaaccggatgaaacctgcccccggaacaggcgggctcaaatttaacatccagaaaagaccctttgccgtaaccacccagtcattcgggtccaacgcagagggacagcactctggctttggccctcaacctaaccctgagaaggttcagaatcactctgggtcctccgctaggggcaatcttagcggaaagcctgatgattggccacaggacatgaaagaatacgtggaacgctgctag

SEQ ID NO: 48531 - DNA, 276 bp, Artificial Sequence
  Description of Artificial Sequence: Synthetic coding sequence
atggccgccaacgtgggcgaccagcggagcaccgactggagcagccagtattcaatggtggctggagcaggcagggagaacggcatggaaactccaatgcatgagaaccctgagtgggaaaaggccagacaggctctggcctcgatatcaaaatccggtgcagccggcggatcagctaagtcatcaagcaacggtcccgtggcgtccgctcagtatgttagccaagctgaggcttcggctttgcaacagcagcaatactaccagtggtatcagtag

SEQ ID NO: 48532 - DNA, 591 bp, Artificial Sequence
  Description of Artificial Sequence: Synthetic coding sequence
atggtgtgccggctgatctgcgtgttccacagcaccaacgccgtgtctgtcttcagcctctccttgtttagggcatgtacccccgtgcctgaccccgccccatggcccatcccttgcaggggtgcttccggcaagaaaactgggcgccccgcacgcgcccgtttacgtcgcggccatccagcttccccacctactgcccgctgtctgacatgtttcgctaccgactcatgtagccagcctttaggggcttccgtgtttggtgtcggtgagttgctgagggattgtgcccgccctcggcctccgactctgaaatgccagcaccatcagcaccagatactgcggcgacacacagccctccgtacccggaggcccgggaggcttgtctcttcttgcatcaagctgtcaccatgccccctgctaccactcccccctgtcttcctcctcatatttttttccccatttcctccctccctgtcagcattttttccatggttctcgacaggtaagacagtcccacttcctccctgcctgcacggcagcccagcccatgtgatgctaccgtccctcttcttcgtgtgtgtttttatttag

SEQ ID NO: 48533 - DNA, 1506 bp, Artificial Sequence
  Description of Artificial Sequence: Synthetic coding sequence
atgggcagccggcccccctgcggcgccaccagcagcgcccggcgggcctgccaatttccagctcccatggctgcagctcgcgagcctgaactcccgcaggaagcaccagccacggagcccgcaccacctcccgcttgccgctttttcctggaagggcgctgcagatttggcgcacgatgccggcaaccacatcccggagccccagcaccccccggccgcgaggcccagcctgaggcgggcgccaaaaagcctccactgcgaaccgccgccgatgtgattcagcgcataagatgggacccgcgcctggatcccgccgacttctctgtcggatacgtagatcggttcttaggcgtgcgggaggagccattttcggccttctgctgggaccagcctctggcagccttgggcccaggcgtgttggcagtcccccagcacagagtgcgctttttccgctttcatggtcggctggtatgggatcgcgccagccggactgatttggtgttcggcagcggttctgccgccggtaggggccctaccattctggacgcccccaataccgagggagctcatggcgccgagggtgccgaatggaccctcgccggaactggccaggaggcgcaggctgcgccaaagagagggtctacaaggcccttgtgcaccggccatcaagagcccggagtggaggagcccggcgaacttgaggccgcccaggaaagagcactgggaactgctgctgatctagggacgttggcccctagagggaggctggcaggggtcaccgaggaagcattaaaacccaccgctgctacacggactaccctgctcggcgggaaggaggcccaggccttaggggtgccgggcggatccgccgaaacaactgaggccgaatggggccctgctgcgtggcccgaggacaaaagggccagactttcagtcgccgcgccttgtcagccccggcctactcatttcgtcgcgctcatggtcaccgagcctggcctccaggctgaggtgacaaaggcccaggaatacctggtccacgtcgctcctcattgtgccaattttctcgtgccaagccaaaatctgcacctgactctagctctcctgcgccttgccggagcaggagaagaagccgcagcaatcggcgcgctgagaagagcactcctggcccctggcctgaacgctccgccaaggctgtctttccggaagctggtgttgttgggaccccacgtcctctgcgcaccgccctcccctacactggaaagcatggctcaggttctgagccagagactagaggcagagggcctgagcaccctgcagtcacccggccagctgcatccccacctcaccgtggcaaaggttcctcatggcagccaggtgcatctcccgaagcttgaattcaccctgagtcaggaagtcggttgtcagcccctgcagacactttggttgtgccgaataggtaggaccggaggcccgttccagccacttgccgagattagattggagtag

SEQ ID NO: 48534 - DNA, 3252 bp, Artificial Sequence
  Description of Artificial Sequence: Synthetic coding sequence
atggcctgccccgccctgggcctggaggccctgcagcccctgcagcccgagcctccccctgaacccgccttttccgaagcacaaaagtggattgagcaagtcaccggccgctcgttcggtgataaagattttcgcacgggattggagaatgggatacttctgtgcgaactgctcaatgccattaaacctggcctggtgaaaaaaattaaccgcctgcccacacccatcgcaggtctggataacatcatcttatttttgcggggctgtaaggaactgggcctcaaagaatcccaactgtttgatccgtccgaccttcaggacacttccaatcgggtcacggtgaagagccttgattacagtcggaagcttaagaacgtactggtgacaatatactggttggggaaagctgctaatagctgcacatcgtatagcggtacaactctgaatctgaaggaatttgaggggcttctggcacagatgcgaaaagatacggatgatattgagagccctaaaaggagtataagggacagtgggtatattgattgttgggatagcgaacggtcagactctctttccccacctagacatggccgggatgactcctttgattctttggattcttttggaagccggagcagacagaccccatctcctgacgtggtgctgagaggatcttcggacgggagagggtccgatagcgagtccgacctgccacatcgcaagcttcctgatgtgaagaaagacgacatgtctgcacggcgcacctcccacggtgagcctaagtctgctgtgccatttaatcagtacctgccaaataaaagcaatcagacagcctatgtgcctgcacctcttcgcaaaaaaaaagctgaaagggaggagtataggaagagctggtccacagcaaccagccccctgggcggggaacggccgttcagatacggtccccgcacacccgtctcagatgacgccgagagcaccagcatgtttgacatgcgctgtgaggaggaggccgcggtccagccacattcccgcgctcggcaggagcagcttcagctgatcaacaatcaactgagggaagaggacgacaagtggcaggatgaccttgcgcggtggaagtctcgcaggcgctctgtgagccaggacctcatcaaaaaggaggaggagcgtaagaaaatggagaagctcttagctggggaagatgggaccagcgagcgccggaagagtataaagacctatcgggaaatagtacaggaaaaggagcgtagagagcgggagctacacgaggcctacaaaaatgcgcggtcccaagaggaggccgaaggaattcttcaacagtacatcgaacggtttaccatcagtgaggccgtactggaacggctcgaaatgcccaagattctggaacgttcccatagtacagagcccaatctaagctcgtttctcaacgatcccaatccaatgaagtacctgaggcagcaatccttaccaccacccaaatttacagcgaccgttgaaacgaccattgcaagggccagtgttctggatacatcaatgtccgcaggttcagggtctccatcaaagacggtcacgccaaaggccgttccgatgctgactccaaagccatattcccagcctaaaaatagccaggacgtgctgaagactttcaaagtagatggaaaggtgagtgtcaacggggaaaccgtccaccgggaagaagaaaaggaaagagagtgtccaaccgtggcacccgcgcacagtcttacgaagtctcagatgttcgaaggggtggcaagagtgcacgggagcccgctagaacttaaacaggataatggcagcatcgaaattaacattaagaagcctaattctgtgccccaggagctcgcagctaccactgagaagacggagcccaattcgcaagaggataaaaatgatgggggcaagtcgagaaagggcaatatcgaactggcttctagcgagcctcagcacttcacaaccactgtcacacggtgttcacccacagtggctttcgtcgaatttccatcctctccacaactgaagaatgacgtctccgaagagaaggaccaaaagaagcccgaaaatgaaatgtcaggcaaagtggagctggtcctgtcccaaaaagtagtgaagccaaagagccctgagcctgaagctaccctgaccttccctttcttggacaaaatgcccgaggccaaccagctgcacctccccaatttgaacagccaggtcgactcccccagttctgaaaagtcacctgttatgaccccccagttcaaattctgggcctgggaccccgaggaggagagacgtaggcaggagaagtggcagcaagagcaagaacgcctgcttcaggagcgctaccagaaggagcaggataagttaaaggaagagtgggaaaaggctcagaaagaggtagaggaggaggagcggcgctactacgaagaagaacgcaagatcatcgaggacacggttgtgcccttcacagtgagcagctctagcgctgatcagctgagtacatcaagcagtatgaccgaaggctcaggcaccatgaacaaaattgacctcggcaactgccaggacgagaagcaggacaggagatggaagaagtcattccaaggagatgattctgaccttctactgaagacccgcgagtccgatagactggaggagaagggatcgctgaccgaaggggccctagcacattctgggaaccccgtgtctaaaggagttcatgaggaccatcagctcgatacggaagccggcgcaccccactgtgggactaacccacaacttgctcaggatcccagtcagaatcagcaaacgtcaaacccaacacattcatccgaagacgtcaagcccaagacgctgcctttagacaaaagcattaaccatcaaattgagagcccctctgaaagacggaagaaaagcccgagagagcacttccaggcgggaccgttttcaccctgcagccccactccccccggccaaagtcccaatagaagcatctccggaaaaaagctgtgtagttcatgtgggctgcctctcggaaaaggagccgcaatgatcatcgagacacttaatctatactttcatatccagtgctttcgctgtggaatttgcaagggccagttaggggacgcagtgtcgggcaccgacgtacgcatcagaaacggactcctgaactgcaacgattgctacatgcgcagccgatccgctggacaacccacaacactatag

SEQ ID NO: 48535 - DNA, 4401 bp, Artificial Sequence
  Description of Artificial Sequence: Synthetic coding sequence
cggaaggacaccgacgacatcgagagccccaagcggagcatccgggacagtggttacatcgactgctgggatagcgaaagaagcgactccctgagtccgccacggcatgggcgtgacgacagcttcgactccctcgatagttttggatcacgcagccgccagacaccatcacccgatgttgtgttgcgtggttctagcgacggcagaggctcagacagcgagtctgacctcccccatcgtaagttgccagacgtaaaaaaggatgatatgtccgctcggagaacgagccatggtgagcccaaatccgctgtgcccttcaaccagtacttgccaaataagtctaatcagacagcttatgtaccggccccattaagaaaaaagaaagctgaacgggaagaatatcgcaagagttggagcacggcgactagccctctcggcggcgaacggccgttctcttttcccgaaaccattgaagaagagggttctgaagtagggagcgctggagaagacaaccccgccgggcagatgaacccagggtggaaacctagtgacggaggttgcgagctccccgacggctccggaaaggagcacccttcctcagacggagccgtggtcgcaccagcccctaagagcgaggaaaaagatgcggcagaaatccagaagaggaaacgcctagaacaagccggtatcaaggtgatgcccgcagcacagcgattcgctagccagaagcagctgtctgaggagaaggaggccatccgtgatatcgtgctgcgcaaggaaaacagcttccttacccaccagcatggtaacgattccgaagccgaaggcgaagtggtgtgcagactgcccgatctcgaaaaggatgacttcgcagcaagaagagccaggatgaaccagaccaagccaatggtgcctctcaaccaactcctttatggtccctacccgaagaagggagcagagaaatctgatggcagcaagcagctcagcaagggtattagcaagaagcgctccttggagtacaagagaaatcaaggccacacggaggaggttaagttgattgtcacatgtaacatgagagctcaagagtcagagccggtagaggggggcctgcgcaaggttcccgacctgcataaagacgatctagcgcaacagcggattcagggctcactggccccgcacagagagcccccgagcttcatcacgctgagcaatatcacggaagccgatctggagacatgggagcgactcaaggttagtgagaaggctagggacggggacgtgcagcatatttgtgccagcgagcccagcccagagattaaggcggagacagcaattcgagacgatttcgccaaccgtaaggcacgggcttctaagaaggcttcctctccacgccagaaatttgtccactttggccccgtgaccgagctggatcagcagaagtggaaacgtctgtcaattgggaaagctggccctagggaagatgaggaggaggtaatttgtcacgggagcaagattcagatggattccgtgagtcctgtgtctgctgctaccagttccctgaaggggcatcaaattttcaacagacagaacgactgtcgtacgatgaattgcggtagaggagattactgccggcgcgccagttggctcgcaccagtgcctgagagccaggaggagtgggtttgcagcctcggggaatgcccacgtgggactgaggaggtcacatctaaacagttgcctcaggatggaaaggaggaaaccgagagtgcaccccgggactccgagcgcctcagcaaggccgagcggtccgaggattcctcccagcccttggtctgcccattggccagcgaatgtgaggcatccgggaccgaggagaagctcgagaagatgacagcccccgcatggagcggctccggcttaaagggccagcgtaaactggacgacagcaggaaggacgatatgatggcgcggcggaccgggatgtcactgcgccatacaggaagcaatccgaaccagttcctgccagtgccgtttgccaaacaacaagatgttgaggagtcatccaagggactgcccatgaaagatcagcgctacggcccccggacccctgtgtcagacgatgccgagtccacatctatgttcgatatgaggtgcgaggaggaagccgctgtgcagcctcacagtcgggcaagacaagaacagctgcaactgataaacaatcaactaagagaggaagacgataagtggcaggacgatctcgcgagatggaagagccgtagacgttcagtgtctcaggacttgatcaaaaaggaagaagaacggaagaaaatggagaagctgctcgctggagaggacggtaccagcgaaagacgaaagtcaatcaagacatatcgcgagattgtgcaggaaaaggagcgcagggagcgggaactgcacgaagcctacaagaacgctagatcccaggaagaggccgaggggattctccagcagtacatcgaacgcttcacgatttcggaggccgtcctcgagaggctcgagatgccaaagattctcgaaagaagtcacagcacagagccaaatctgtcttcttttctcaacgatccaaatcccatgaagtatctgagacagcaaagtctgcctcctcccaaattcaccgccaccgtcgaaactaccatcgcccgagcctccgttcttgatacgtctatgagcgcaggctccggatcaccatcaaagaccgttactccgaaagcggtgcctatgcttactcctaagccctattcacaaccaaagaatagccaagatgtgctgaaaactttcaaggtcgacggcaaggttagtgtcaatggggagacagtacaccgagaggaggagaaggagcgcgaatgtcctaccgtggctccggcacacagtttgacgaaaagccagatgtttgaaggtgtggcccgggtccacggctcaccattagagttaaaacaggacaatgggtcaatcgaaatcaacattaagaagcccaattcggtcccacaagaactggccgctactacggagaaaacagagcctaatagccaagaagacaagaacgatggtggtaaaagcaggaagggtaacatagaattggcctcatctgagcctcagcacttcaccaccactgtcacaagatgttctccaaccgtggcattcgtagagttcccatcttcgcctcaactgaaaaacgatgtttctgaggaaaaagatcagaagaagcctgagaacgaaatgagcgggaaagtggagcttgtactgtcgcaaaaggtggtgaaacccaagagcccggagcccgaggcgacccttacttttccatttctggacaagatgcccgaggcaaatcaattgcacctgccaaatttgaactctcaagtggatagcccaagcagtgaaaagtctcctgtgatgacccctttcaaattctgggcctgggatccagaggaggaaagaaggagacaggaaaaatggcaacaggagcaggaacgccttctccaggaacgctaccagaaggaacaagacaagctcaaagaggaatgggaaaaagcacagaaggaggtggaggaggaggagcggagatactatgaggaggaacggaagattatcgaagataccgtggtgcccttcacagtgtcctctagttctgctgaccagctcagcacaagctccagtatgaccgaggggtcaggaacaatgaataaaatcgacttgggcaattgccaggatgagaagcaggacagacggtggaaaaagagcttccagggtgatgactccgatctgctgctgaaaactagggaatcagataggttagaagagaaaggtagcctcactgagggcgcattggctcacagcggcaacccagtctccaagggcgtgcacgaggaccatcagctggatacggaggccggggcccctcactgcggtacgaatcctcagctggcacaagatccaagtcagaaccagcaaaccagcaatcctacgcatagctccgaagacgtaaagccaaaaacactcccgctggataaatctattaaccatcagatcgaaagcccatcggaaagaagaaaaaaaagccctagagaacatttccaggccggtcccttctcaccttgctcccccacaccaccgggccagtcccctaataggtcaatatctggcaagaagctatgctcatcatgcggcctaccccttgggaaaggcgctgccatgataatcgagactctgaacctctacttccatattcagtgcttcagatgtgggatttgtaaagggcaactcggagacgcggtgtccggaacagatgtccgcattcgcaatggcctcctgaattgcaacgattgctacatgcgttccagatcggctggtcagcctacaacattgtag

SEQ ID NO: 48536 - DNA, 2673 bp, Artificial Sequence
  Description of Artificial Sequence: Synthetic coding sequence
atggacagcgagcggcaggtgaaggacaccgacgacatcgagagcccaaaacgctccatacgagattccggctacatcgactgctgggattccgagcgcagcgattccctgtcccctccgcgccatggtcgtgacgactccttcgattctttagacagtttcggctctaggtcgagacagactccgtcgcccgatgtggtccttcgaggttcaagtgacgggaggggctcagattcagagagcgatctgcctcataggaagctaccagacgtgaaaaaagacgacatgagcgctcggcgcacctctcacggggaaccgaagtcggccgtgccctttaaccagtatctacctaacaagtccaatcagaccgcctacgtgcccgcacccctgagaaagaagaaggccgagagggaggagtatcggaaatcctggtccaccgccacctccccactcgggggagaacgtccattcagaagcactagtatgtttgatatgcgatgcgaagaagaagccgccgtgcaacctcattcccgcgctagacaggaacagctgcagcttatcaacaaccagcttcgggaagaagacgataaatggcaggacgatcttgctcgatggaagtcaaggcggcggagcgtgagtcaggatttgatcaaaaaggaagaggaaagaaagaagatggaaaagctcctcgcaggggaggacggaacttcggaacgcagaaagagtattaaaacctaccgggaaattgtccaggagaaagagcgacgcgagagggaactgcacgaagcatacaagaacgcccgaagccaggaggaagccgaaggcattctccagcagtatatcgagagattcaccatctccgaggctgtgctggagcgtttagagatgcccaagattttggaaaggtctcattcaacagaaccaaacctgtcatcgtttctgaatgatccaaatccgatgaaatacctgagacaacagagcctgccgccccctaagttcacagcgacagtggaaacaaccatcgcgagagctagtgtcctggatacgtctatgagcgctggctccggcagtccgagcaagaccgtaacccctaaggcagtgcccatgctcacacctaagccttattctcagccaaaaaatagccaggatgtcctgaagaccttcaaggtggacggcaaggtttcagtgaacggtgagacggtgcacagagaggaggagaaggagcgcgaatgcccaaccgtcgcccccgctcactccctgacgaagagccagatgtttgagggagtagccagagtgcatggcagtcccctggaacttaagcaggataatggcagcatagagattaacatcaagaaaccaaattcagtgccacaggagctggctgcaacgacagagaaaacggagcctaattctcaggaggacaagaacgacggtgggaaatcacgaaaaggtaatattgagctggcttcttctgagccgcagcactttacaaccacagtcacacgatgctcgccaactgtagccttcgtggagttcccctcaagtcctcagctcaagaatgatgtttctgaagaaaaagaccaaaagaaacccgagaatgaaatgagcggaaaggtggagctagtgctgagtcagaaggttgttaaaccaaaatcacccgagccagaggcgacacttacatttccctttctcgacaaaatgcccgaggccaaccagctccacctccccaacctgaattcgcaggtagattccccctcctctgagaaaagcccggtgatgacccccttcaagttctgggcgtgggatcccgaagaagaacgtcgtcgccaagagaagtggcagcaggaacaggagcgtcttttacaggagcggtatcaaaaggaacaggacaaactgaaggaggagtgggagaaagcccagaaagaggtggaggaagaggagcgtagatattatgaggaggaacgaaagattattgaggacacagttgtgcctttcactgtctccagcagctctgcagaccaactcagtactagttcctccatgacagagggctctggcacaatgaacaagatcgaccttgggaattgtcaagacgagaaacaagacaggagatggaagaaaagtttccagggcgatgacagtgacctgctcctgaaaacacgcgaatctgatagactcgaagagaaagggtcgttgacagaaggagccctcgcccactccgggaaccccgtcagtaaaggggtccatgaggaccatcagctggacacagaggccggggcccctcattgcggcactaaccctcaactcgcccaagatccttctcagaaccagcagacttcaaatccgacccattctagtgaggacgtcaaacccaaaacactcccccttgacaaaagtatcaatcatcagattgaaagtccatccgagcggagaaagtctatttcagggaaaaagctgtgtagcagctgcggcctgccactaggaaaaggtgcagccatgataattgagactctgaatctatacttccacattcaatgcttccggtgcggcatttgcaaaggccagctgggagatgccgtgtccgggaccgacgtgcgcatccgcaacggacttctgaactgtaacgactgctatatgcgctctcgctccgccggccagcctactacactgtag

SEQ ID NO: 48537 - DNA, 2709 bp, Artificial Sequence
  Description of Artificial Sequence: Synthetic coding sequence
atggacagcgagcggcaggtgaaggacaccgacgacatcgagagccctaaaaggagcatcagggattcaggatacattgattgctgggattcagagcgctcagactcattatccccccctagacatggacgtgacgacagttttgactccctcgattcatttggcagcagatcccgccaaactcctagcccagatgtggtactgcgcggaagtagcgacggccgcgggtccgactcagaatccgatctcccccaccggaagctgcccgacgtaaaaaaagatgacatgtccgcgcgcagaacaagtcacggcgagcccaaatccgccgtgcccttcaaccaatatctacccaataagagcaatcagacagcctacgtgcctgccccgctgcgaaagaaaaaagctgaaagggaggaatataggaagtcttggtcgacggcaacaagccccctgggcggagagagaccatttcgttacggaccgagaaccccagtgagtgacgacgcagaatccaccagcatgttcgacatgcgctgtgaagaggaggcggccgtgcagccacacagtcgcgcacggcaagaacagctgcagttgattaacaatcagttacgggaggaagatgacaaatggcaggacgatttagctcgttggaagtcccgcaggcgcagtgtctcacaggaccttatcaaaaaagaggaggagcgaaaaaagatggagaaactgttggctggggaagatggcacctcagagcggcgcaagagcattaaaacctacagggagatcgtacaggaaaaagagagacgcgagagagagctgcacgaggcttacaaaaatgctcgctcccaggaggaagcagagggtattctccagcagtatatagagcgattcaccatttcagaggctgttcttgagcggttagagatgcccaagatcctggaaagatcacactctacagaacccaacttgagttcttttttaaatgatccaaaccctatgaagtatctgcggcagcagtctcttccaccccctaagttcacagcaaccgttgagacgaccattgcacgggcatctgttctggatacaagcatgagcgccggaagtgggtctccaagtaaaacggtcacgcctaaggcggttcctatgcttactcccaagccctattcgcaacctaagaactctcaggacgtgctcaagaccttcaaagtcgacggcaaagtgagcgtgaacggcgagacggttcatcgggaagaggagaaggagagagaatgccccactgtggctcctgcgcatagcttaacaaagtcccagatgttcgagggcgttgccagggtccacggatctcccctggagttgaaacaggacaatgggtcaattgaaattaatatcaagaagccaaactcagtcccacaggaattagccgcgactaccgagaagacagaacccaattctcaggaagacaagaacgatggcggcaaaagccggaaaggcaatattgagctcgcatccagcgaaccccagcattttaccaccaccgtgactcgttgtagtcccacggtagctttcgtagagtttcctagcagtccccagttgaaaaacgacgtgtcagaagagaaagaccagaagaaaccggaaaatgagatgagtgggaaagtggaacttgtcctctctcagaaagttgtgaagccaaagagcccagaacccgaagctaccctgacattccccttcctggataaaatgccagaggccaatcagctccacctccccaatctgaactcccaggttgacagcccatcgagcgaaaagtctcctgtgatgacaccgtttaagttctgggcttgggatcctgaggaggagagacgccgtcaggagaaatggcaacaagaacaagagaggctgctgcaggagcgctatcagaaagaacaggataaactgaaggaagaatgggaaaaagcacagaaggaggtggaagaggaggaaaggagatattacgaagaggagaggaagatcatcgaggataccgttgtgcccttcactgtgtccagctccagcgccgaccaactgagcaccagttctagcatgactgagggcagtgggaccatgaacaaaatcgatctgggaaattgccaagatgaaaagcaggaccgtcggtggaagaaaagttttcagggcgacgatagtgacctgctgctgaagacacgtgagtctgacaggctggaagagaagggcagcctgacagaaggagccctagcccattcgggaaaccccgttagtaaaggagtacatgaggaccaccagcttgacactgaggccggcgcgcctcactgcgggaccaaccctcagctggctcaagatccgtctcagaatcagcagacttcgaacccaactcactcctctgaggacgtgaagccaaaaaccctgcctcttgataaatcaattaaccaccagatcgagagcccatcagagcgacgtaagtccatatctgggaagaaactttgctcgagctgtggcttgccattggggaagggagctgcgatgatcatcgagacactcaacttgtattttcatattcaatgtttccgctgtggaatttgcaaggggcagttaggggacgctgtgagtggcacggacgtcagaattaggaacgggttactcaactgtaacgactgctatatgaggtctcggtctgccgggcagcctacgaccctgtag

SEQ ID NO: 48538 - DNA, 4404 bp, Artificial Sequence
  Description of Artificial Sequence: Synthetic coding sequence
atgcggaaggacaccgacgacatcgagagccccaagcggagcatccgggattccgggtatatcgactgttgggactcagagcgaagcgacagcttgagtcccccacgccacggcagagacgactccttcgattcactggactcgtttgggtctagatcccgccagacgccctctccagatgtcgtcctgcgcggcagctccgacggccgcggttctgatagtgaaagtgatctcccccacagaaagcttcctgacgtaaagaaggatgatatgtccgcccgacgcacttcacacggagaacctaaaagtgccgtaccctttaatcagtatcttcctaataaatccaaccaaacagcctatgtgcccgccccattaagaaagaagaaggcagagcgagaagagtataggaagtcatggagtactgcaaccagtccgcttggaggtgagcggccgtttagttttccagaaactatcgaagaagaggggtcagaggtgggaagcgctggagaggacaatcctgctggtcagatgaacccgggctggaagccttcagacggaggctgcgaacttcccgacggttctggaaaagagcatccctcctcggatggtgcggttgtggcccccgctcctaagagcgaggaaaaagatgccgccgagattcagaagcgcaagaggctcgaacaggcgggcattaaggtgatgccagccgcccaacggttcgcctcacagaaacagctgagtgaggaaaaagaggccatacgggacattgtacttcggaaggaaaacagcttcctgactcatcagcacggaaacgattccgaagccgaaggggaggtcgtgtgtcggctgccagacctggagaaagatgactttgccgcacgacgggccagaatgaaccagacaaaaccaatggtcccacttaaccagcttctctacggtccttacccaaagaagggcgccgagaagtcagacggttctaagcagctctccaagggaatctccaaaaaacgcagcctagagtataagcgaaaccagggccacacggaggaggtcaagcttatcgtgacctgcaacatgcgagcacaggagagtgaacccgttgaagggggattgaggaaagtgccagatttgcacaaggacgatcttgcacagcagagaattcagggaagcttggcgccacaccgggagccgccctccttcatcacattatcaaatattacagaagccgacctggagacgtgggagagacttaaagtgtccgaaaaggccagagacggagacgtgcagcatatctgtgcctctgaaccaagtcccgagattaaggctgaaactgctattagggacgatttcgccaatcgcaaggctcgcgcatctaagaaggctagtagcccccggcagaagtttgttcactttggcccagtaactgagctcgatcagcagaagtggaagcggcttagcataggaaaggccggcccacgagaagatgaagaagaagttatctgccacggctcaaaaatacagatggactccgtctcccccgtgtctgctgctacctcgtctcttaaggggcatcagatctttaatcggcaaaatgattgtcgcacaatgaattgcggtagaggggattattgtagaagagccagttggctggctcctgtcccagagtcccaggaagagtgggtgtgttcccttggcgagtgtcctcgagggaccgaggaggtcactagcaaacagcttccccaggacggcaaggaggaaactgaaagtgccccccgcgacagtgagcggctcagcaaggccgaacgtagcgaggattcctcacagccactggtgtgcccgctggcatcggaatgcgaggcatccggcaccgaggagaaactcgagaaaatgactgcacccgcctggtccggttccgggctgaagggacagcgcaagctggacgactcacggaaagatgacatgatggcgaggagaaccggaatgtccctgagacataccgggtctaacccgaaccaatttctacccgtgccattcgctaagcagcaggacgttgaagaatcatcaaaagggcttccgatgaaggaccagcgatatggtccccgaacacctgtgtccgacgacgcagaatcaacctctatgtttgacatgcgatgtgaggaggaagccgcagtccagccccatagccgtgccaggcaggagcagctgcaactgattaataatcagttgcgcgaagaggacgacaagtggcaggatgatctggcacggtggaaatctaggcgtcggagcgtatcacaggatctcattaaaaaggaggaggagaggaagaaaatggagaagcttctggctggggaggacgggactagcgagagaagaaagagtatcaagacgtatcgagaaattgtacaggaaaaagaacggagagagcgagagttacacgaggcatataagaacgcacggtcacaagaagaagcggagggtatcttacagcagtatatagagaggttcaccatcagcgaagcagtgctcgagagattagagatgcctaaaatactggaacggtcacactcaaccgagcccaatctctcctcatttttgaatgaccctaacccgatgaaatatcttaggcagcagagcctccctccaccaaagtttaccgctacagtagagaccaccatcgcaagagccagcgttttagacaccagtatgagcgccggcagcggaagcccttcaaagacggttacacctaaggccgtgcccatgctgacacccaagccttactctcagcctaaaaacagccaggacgtgttgaaaacgttcaaagtggatggaaaggttagcgtgaatggagagacagtgcacagagaagaagagaaggaacgagagtgtcccaccgtggctccggctcattccctgacgaagtcccaaatgttcgaaggggtggccagggtgcatggcagccctttagaattgaagcaagacaacggttccatagagatcaacattaagaaaccaaactcagtgcctcaggagctggccgccacaacagaaaaaaccgagcccaacagtcaggaggacaaaaatgacgggggcaaaagccgcaaaggtaacatcgaactggcctcatcagagccccagcatttcacaacaactgtgacgcgctgcagtcctacagtggcgttcgtagagtttcccagttccccacagctgaaaaatgatgtcagtgaggagaaggaccagaaaaagcccgagaatgaaatgtcaggaaaggtagaactggttctgtcccaaaaagtggttaagcccaagagtcccgaaccagaggcaacattgacattccccttcctggacaagatgcctgaagccaatcaattgcatctccccaatctgaattctcaagtggactcccccagttccgagaagtccccggtgatgacccccttcaagttctgggcttgggatccggaggaagagcgcagaagacaagaaaagtggcagcaagagcaggagcggctgctgcaggaacgctatcagaaggagcaggataagttaaaagaagagtgggagaaagcacagaaagaagtagaggaggaagagcgacggtactacgaggaagagcgtaagattatcgaggataccgtcgtgcctttcactgtctcttcatcatccgctgatcagctgtctacctcctcaagcatgacagaagggagtggcacaatgaataagatagatctagggaactgtcaggatgagaaacaggaccggcggtggaagaaatccttccagggagacgactctgacttattgctgaagacccgggaaagcgatcggctggaggagaaaggcagcctgaccgaaggcgccctggcgcatagcggcaaccccgtctcgaagggcgttcacgaggatcaccagctcgacacagaggcaggcgccccacactgcgggacaaatccccagctagcccaagatccctcacaaaaccagcagacctcaaaccctactcattcaagcgaggatgtgaagcccaagaccctacccctcgacaagtccattaaccatcagatcgagagtccatcagaacgccgaaaaaagagccctagggagcactttcaggcaggccccttttcaccctgttcccccacccccccaggccagtctcccaaccggtctatctccgggaaaaagctgtgcagttcatgcggcttaccactcggcaagggggctgctatgattatcgaaaccctcaatctgtattttcatattcagtgcttcaggtgtgggatctgcaaggggcagttgggcgacgcagtgagcggtacggatgtccgaattaggaatggcttgcttaactgtaatgactgttatatgagatcccgttccgctggccagcctacgacactgtag

SEQ ID NO: 48539 - DNA, 2694 bp, Artificial Sequence
  Description of Artificial Sequence: Synthetic coding sequence
atgcggaaggacaccgacgacatcgagagccccaagcggagcatcagggattccggctatattgactgctgggattccgaacggagcgactcactgtcccctcctaggcatggccgcgacgatagcttcgatagtctcgatagctttggttcaagatctcgtcaaacccccagtccagatgtggtccttagaggtagttcagacggcagaggtagcgattccgagtcagacctgccccaccgcaagctgcccgacgttaagaaagatgatatgagtgcacggcgaacttctcatggcgaacccaaatcagccgtgccatttaaccaatacctgcccaacaagagcaaccaaacagcctatgtgcccgcccctctccgtaaaaagaaagccgagagagaggagtacagaaaaagttggagcactgccaccagtcccctagggggcgagcgaccgttccgttacggcccccgtacacccgtctccgatgatgcggaaagcacgagcatgtttgatatgagatgtgaagaagaggcagcggtccagccacacagcagagctcgccaagagcagcttcagctgataaacaatcagcttcgtgaggaggatgataagtggcaggacgatctggcacgctggaagagccgcaggagatccgtgtctcaagatcttattaagaaagaagaggaacgcaagaagatggaaaagctgttggctggggaggacggcacgtccgaacgcaggaaaagcattaaaacttaccgggagatcgtgcaggagaaggagcggcgggaaagagaactacatgaggcttataagaatgcccgcagccaggaagaggccgaagggatactccagcagtacatagaaaggttcactatcagcgaagccgttctggagagattagaaatgcctaagattttagagagaagccattccacagagcccaacctcagttccttcttaaacgaccccaatcctatgaagtatctgcggcagcaatcgctacctccacccaaatttactgccacagtggagacgaccatagctcgagcgtcagtattagacacttccatgtccgcaggaagtgggtccccttccaaaactgtaactcccaaagcagtcccaatgctcacacccaagccatactcccagccaaagaacagccaagatgtacttaagacatttaaagtcgacggaaaggtcagtgtgaacggtgagacagtgcatcgggaagaggagaaagagagggagtgtcctactgtggctccagcccactcactcactaagagtcagatgttcgaaggtgttgcacgggttcacggaagccccctcgagttaaaacaggataacgggtccattgagattaacatcaaaaaacccaattctgtgcctcaggagctggccgcaacaaccgaaaaaactgagcccaattcccaggaggataagaatgacggagggaagagccgtaagggcaatattgagctggcttcctctgaacctcagcattttactacaacagtcacccgctgttcacccacggtggcattcgtcgagtttcccagcagtcctcagctgaaaaatgatgtttctgaagagaaagatcaaaaaaagcccgaaaatgagatgagtgggaaggtggaactggtgctttcccagaaagtcgttaaacccaagagccccgagcccgaggccaccctcacgttcccctttcttgataagatgccagaagccaaccagcttcacctgcccaacctaaatagccaggtggatagcccctcctccgaaaagtcccccgtgatgacaccatttaaattctgggcgtgggaccctgaagaagaaaggcgccgccaggaaaaatggcagcaagagcaggaaaggcttttacaggagcggtaccagaaggaacaggacaagctgaaggaagagtgggagaaagcacagaaggaagtagaggaagaagagcggcggtattatgaagaggaaaggaagatcatcgaggacactgtagtccctttcacagtgagcagctccagcgctgaccagctcagtacttcatccagcatgaccgagggcagcggaactatgaacaaaatcgacctcggtaattgtcaagatgagaaacaggatcgtcggtggaagaaatcgtttcagggtgacgactccgacctgctgcttaaaacaagagagagtgatcgattggaggagaagggatccttgaccgagggtgctctggcccattctgggaatcctgtcagtaagggcgtgcacgaagatcatcagttggatactgaagccggcgcccctcattgcggcaccaacccccagttagctcaggatccctcccagaatcaacagacaagtaacccaactcattcgagtgaagatgtgaaaccaaaaacgctacccctggacaagagcattaatcatcagatcgagagcccgagtgagcggcggaagtctatctctgggaagaagctgtgctcttcttgtggactccctctcggcaaaggggctgcgatgattattgagacgcttaatctgtactttcacattcaatgctttcgctgtggtatttgtaagggacagctgggggatgctgtcagtggaacagacgtgaggatccgaaatggactcctgaattgtaacgattgttacatgcggtcccggtctgctggccagccaacaactctgtag

SEQ ID NO: 48540 - DNA, 3210 bp, Artificial Sequence
  Description of Artificial Sequence: Synthetic coding sequence
atggcctgccccgccctgggcctggaggccctgcagcccctgcagccagagccaccaccggagcctgcatttagtgaggctcagaaatggatcgagcaggttaccgggcgaagcttcggcgataaggattttcgaaccggtcttgaaaatggcatcttgctatgtgaattactaaatgcaataaaaccagggctcgtcaagaagataaatcggttgccaacgcctatcgccggcctggataacattatcctattcttgagaggatgcaaagaattggggttgaaggaaagtcagctctttgatcccagcgaccttcaggacacttccaatagagtaacagtgaagtctctagactatagtcgtaagctgaagaacgttcttgtgaccatatattggctaggcaaggctgctaactcctgcacaagctacagcggcactaccttaaatttgaaagagttcgaggggctactggcccagatgagaaaggatacagatgatattgagagccccaagcgttccataagggacagcggttatatcgactgctgggactctgagagaagcgatagcctatcacctccccggcacggcagagacgattcctttgattctcttgactccttcggttcacgatctagacaaacaccttccccagacgtcgttttacggggtagcagcgacggccggggcagcgattcggaatctgacttaccacacaggaagttgcctgatgtcaagaaagatgacatgagtgcccgcaggacctcgcatggtgaacctaaatccgctgtgccatttaaccagtatctccctaacaagtccaaccagaccgcctacgtgccagcccccctgcgtaaaaagaaggcagagcgagaggagtatcgcaaaagttggagtactgccacgagcccactcgggggagagcgcccgttccgatctactagcatgttcgacatgcgctgtgaagaggaggccgccgtgcaaccccattctagagctcgccaggaacagctgcaattgattaataaccagctcagagaggaagacgacaagtggcaggatgacctggcccgttggaaatcccgacgccggtcagttagtcaggacctgatcaagaaggaggaggaaagaaagaagatggagaaactcttggctggggaggacggaaccagtgagcgtcgcaaaagcatcaagacgtatcgcgagatcgtacaagaaaaagaaaggcgagaacgggaacttcacgaagcatacaagaatgcccgctcacaggaggaggcagagggcatcctacagcagtatatagaacgcttcaccattagtgaggctgttctggagcgcctcgaaatgccaaagattctggagaggtcacactccaccgaaccaaatttgagctcattcctcaacgatccaaacccaatgaaatacctacgtcagcagtcactccccccgcccaaatttacggccactgtggaaaccacaattgccagggcctccgtgctggataccagtatgtccgctggatctggtagtcctagtaagactgttacccccaaggccgtgcctatgttgacaccgaaaccttactcgcagcccaaaaactcccaggatgtgcttaagacatttaaagttgatggtaaggtctctgtgaatggcgagacagtgcatcgggaagaagaaaaagaacgtgagtgtccaactgtggcacccgcccattctctgacaaaatcccagatgtttgaaggagtggcgagggtacacggatcacctctggaattgaagcaggataacggatcaattgagattaatatcaaaaagccaaacagcgtgcctcaggaactggccgcgactaccgagaaaacagaaccaaacagtcaggaagataaaaatgacggagggaaaagcagaaagggcaatatcgagttggcttcatccgaacctcaacattttactactaccgtgacacgttgttccccaaccgtggctttcgtggaattcccctcatcacctcagctgaaaaatgatgtgtctgaggaaaaggatcagaagaagcctgagaacgagatgagcggaaaagtggagctggttctttctcaaaaagtggtgaagccaaaatcccccgagccagaagctaccctcaccttccccttcctggacaagatgcctgaggccaaccagttgcaccttcccaacctcaattcccaggagtcccccggtacagcctcggtgccactccgcgtacagaacagttggagacggtcccagttttttagccagtctgttgacagcccttccagcgagaaaagtccagtgatgacccctttcaagttctgggcatgggaccctgaagaagagcgcaggcgacaggagaagtggcaacaggaacaagagagactgctgcaagagagatatcagaaagagcaagacaagctcaaggaggagtgggagaaagcccagaaggaagtagaagaggaggagcggcgctattacgaggaagaacggaaaattattgaagacaccgtcgtgcctttcaccgtgagctcttcttctgccgaccaactgagcacatctagttcaatgactgaaggaagtggcacgatgaacaaaattgatctggggaattgccaggatgagaagcaagaccggcggtggaaaaagtcctttcagggagatgactctgacctgcttctgaaaacccgcgaaagtgatcgcctcgaggaaaaaggaagtctgaccgagggagcactggctcattcaggaaaccctgtgagcaagggggtccacgaggaccatcaactggacacggaagctggcgcgcctcattgcgggacaaacccccaactcgcacaagatccaagccaaaatcaacagacatctaatccaactcactctagcgaggacgtgaagcccaagacccttcccctggacaagtctattaaccaccaaatagagtccccatccgagcgccgcaaaagcatctctggcaagaaactgtgcagctcttgtgggttgcctttggggaagggggctgcaatgatcatagagactctgaatctttactttcacatacaatgctttagatgtggaatttgcaaggggcagctgggcgatgctgtcagcggcaccgacgtgagaattagaaacgggctcctcaattgcaacgattgctacatgcgcagccgctccgctgggcaaccgacaaccttatag

SEQ ID NO: 48541 - DNA, 3174 bp, Artificial Sequence
  Description of Artificial Sequence: Synthetic coding sequence
atggcctgccccgccctgggcctggaggccctgcagcccctgcagcccgagcccccccctgagccggccttttctgaagcacagaaatggattgaacaggtgactgggcgctcatttggcgataaggactttcgcaccgggctggagaacggcatcttgctgtgtgaactgttgaatgcgatcaagccagggctggtgaaaaagataaacagactgccaacgccaattgcaggcctagacaacattatccttttcctcagggggtgcaaagagcttgggcttaaggaatcccaactcttcgatccaagtgacctgcaagatacctctaaccgggtcacagtgaaaagcttggattactctaggaagctgaagaatgtgctggtcaccatctattggctcggcaaagcggcaaattcctgtacctcctacagtggtactactttgaatctgaaagaattcgagggcttgctggcacagatgcgaaaagacaccgatgacatcgagtctcctaagcgaagcattcgcgactccgggtatatcgactgttgggatagcgagcgtagtgatagcctttcccctcctcggcacggacgcgacgactccttcgatagcctagactccttcggttccaggtcacgccagaccccaagccctgacgtcgtcctgcgtggatctagtgatggaagagggagcgattcagaatctgatttgccgcatcgtaagctccccgacgtgaaaaaagatgacatgagtgcgcggagaacatctcacggtgagcctaaatcagcggtgcctttcaaccagtacctacctaataaaagcaatcaaacagcctacgtgcccgccccattaagaaagaagaaggccgagcgtgaagaataccgcaaaagctggtctaccgctacatccccattggggggcgaacgcccattcaggtacggcccccgaacaccagtgtctgacgacgcagaatcgacttctatgttcgacatgaggtgcgaagaggaggcagcagtacagcctcacagcagagcacggcaagaacagcttcagcttatcaacaatcagctgcgtgaggaggacgacaaatggcaagatgacctggccagatggaaatctcgtcgaagatccgtgagccaggaccttatcaaaaaagaggaggaaagaaaaaaaatggagaagcttctagcaggagaggatggtaccagcgaacggcggaaaagcattaaaacgtacagggaaatcgtgcaggaaaaggaacgaagggagcgagaactgcatgaggcatataaaaacgctcggagccaagaggaagcagaaggaatcttgcagcaatacatcgaaagatttaccatctccgaggcagtcctggagagacttgagatgcccaagattttggagcgctcccacagtacggaacccaacctcagttcttttctcaacgacccaaatcctatgaaatacctgagacagcagagtctccccccaccaaagtttaccgcgacagtcgagacaacgatcgccagagcgagtgtgctggatacaagcatgtccgccggatcggggagcccatccaagaccgtcactcctaaggccgttcccatgcttacaccaaaaccatatagccagcctaagaattctcaggatgtgctgaagacctttaaggtggacggtaaggtcagcgttaacggggaaactgtccacagagaggaggagaaagagagagaatgccctactgtagctccagcacatagcctgaccaaatcacagatgtttgagggcgttgcacgtgtccatggttctcccctggagttaaaacaagataacggttctatcgaaatcaacatcaaaaagccaaacagcgtgccacaggaactcgctgcaacaacagagaaaacagaacccaatagccaagaggataagaacgacggaggaaagtcccgcaaaggaaacatcgagttagcaagtagcgaacctcaacacttcacaactactgtaactcggtgttcccctacagtggcattcgtcgaattcccgtcctctccacagctgaaaaacgacgttagcgaggagaaagaccaaaagaagcccgagaacgaaatgagcggcaaggtggaactagtcctgtcacaaaaggtggtaaagccaaagtcacctgaacccgaggccactttgactttccccttcctcgacaagatgccagaagcgaatcagctacacctcccgaatttaaattcccaggtcgactccccatccagtgaaaaatctcctgtgatgaccccacagttcaaattctgggcgtgggaccccgaggaagagagaagaaggcaggaaaagtggcaacaggaacaggaacgactcttgcaggagaggtatcagaaagaacaagacaagttgaaagaggaatgggagaaagcacaaaaagaggttgaagaggaagagcggagatactacgaagaggagcggaaaatcattgaggataccgtagtgcctttcacagtgtctagctccagtgcagaccagcttagtaccagttcctctatgacggaagggagcggcacaatgaacaaaatcgacctgggcaattgccaagatgaaaagcaggatagacgttggaagaaatcattccagggagacgactctgacctcctcctgaaaacacgcgagtctgatcgccttgaagagaagggatccttgactgagggggccttggcccattcaggtaacccagtctcaaaaggcgtgcacgaggatcatcagctcgacaccgaagctggagccccccactgtggtactaatccacagcttgcacaagacccaagccaaaatcagcagactagtaatcctactcactcaagcgaagacgtgaaacccaagacgcttccgctcgacaaatctataaaccaccagatcgaaagtccctcagaacgaaggaagagcatctctggaaaaaaactctgcagttcatgtggcctgccgttgggaaagggtgccgctatgatcatcgagactctcaacctttatttccatatccagtgcttcagatgtggcatctgcaagggtcagcttggtgacgccgtgagcggtaccgacgtgcgtattaggaatgggctgctgaattgtaatgattgttatatgagatccagatcagccgggcagcctaccactctgtag

SEQ ID NO: 48542 - DNA, 1230 bp, Artificial Sequence
  Description of Artificial Sequence: Synthetic coding sequence
atgaacctggaccggtgcaacagcatcgccgagccccagcacttcacaacgacagtcactaggtgttcccccaccgtggcctttgtcgaatttccatcttctcctcagcttaagaacgacgtatccgaggagaaggaccagaaaaagcctgagaacgagatgtcgggcaaggtagagcttgtgctaagccagaaagtggtaaagcccaagtcacctgaacctgaggctactctcacatttcccttccttgataaaatgccagaggccaatcagcttcacctgccaaatcttaactcccaggtcgactccccgtcaagtgaaaaatcgcccgttatgaccccttttaagttttgggcatgggatcccgaggaggagcgccgtcgccaggagaaatggcaacaggagcaggaaagactacttcaggaaagatatcagaaggagcaggataagctgaaggaagagtgggagaaagcccagaaggaggtagaggaggaggagcggcgctattatgaggaggaaaggaaaattatcgaagataccgtcgtaccttttaccgtgagcagtagttctgccgaccaactctccacctcgtcttctatgaccgaaggcagcggaaccatgaacaaaatcgacctggggaactgtcaagacgagaagcaggataggaggtggaaaaaatcattccagggtgacgactcagacctgctactgaaaacccgcgagtcggatcgtcttgaagagaaaggttccctgactgagggtgctctggctcacagcggcaaccctgtgtccaagggcgtgcacgaggatcaccagctagacacagaggcgggagctccccactgcggtaccaacccccagctcgcccaggatcccagccagaaccagcaaaccagcaaccctacccacagttccgaggacgtgaagcccaaaaccctaccacttgataaaagcattaatcatcagatcgagagcccgtcagagaggcgcaagagtatcagtggaaagaagttgtgcagctcatgcggacttcctcttggtaaaggagcagccatgatcattgagaccctgaacctttattttcatatccagtgcttccggtgtgggatctgtaagggccagcttggggacgcagtcagcggcaccgacgtccgcatcaggaacgggctgttgaactgtaacgattgttacatgcggtctaggagcgccggacagccaactaccttgtag

SEQ ID NO: 48543 - DNA, 3171 bp, Artificial Sequence
  Description of Artificial Sequence: Synthetic coding sequence
atggcctgccccgccctgggcctggaggccctgcagcccctgcagccagagcccccacccgagcccgccttttccgaagcacagaagtggatcgaacaggtaacaggtcgctcatttggggacaaagactttaggaccggtctggagaacggcatcctactctgcgagttactaaatgccatcaaaccgggattagtgaaaaagatcaatcggctccctacccctattgccgggctggataatataatactcttcctgcgagggtgtaaagaactggggctgaaagagtcacagctattcgacccctctgatctgcaagatacctccaacagggttacagtcaagagcctcgattactcacggaaactcaagaacgttctggtgactatctactggcttggcaaagcagcaaactcatgtacgagctacagtggaacaaccttgaatctaaaggaattcgagggtctgctggcccagatgaggaaggacacagatgatattgagagtcccaagcgctcgatacgggacagcggttacatcgactgctgggattcagaaagatcagattccctgtcgcctcctcgccacggaagagacgattctttcgatagtttggacagtttcgggtccagatccagacagacccccagcccagatgtggtactgcggggatcctccgatggaagaggatccgatagcgagagtgaccttccacacagaaagctccccgacgttaagaaagacgacatgtccgctcgccgaaccagccacggggagcctaagtccgcagtcccctttaaccaatatctgcctaacaaaagcaatcagacagcatacgtgcctgctcccctacggaaaaaaaaggccgaacgtgaggagtacagaaaatcttggtcgaccgctacatcaccacttggcggcgaaaggcctttccgctacgggccgcggacaccagtgtctgacgatgctgagtccacaagcatgttcgacatgaggtgtgaggaggaggcagccgtccagccccattcacgagcccgacaggagcagctgcagttaatcaacaaccagcttcgcgaggaagacgacaaatggcaggacgacctggcgcgatggaagagtcgccgaagaagtgtgagtcaggatttgatcaaaaaggaggaagaacggaagaaaatggaaaaactcctggcaggggaggatgggacttccgaaagacgcaaatccatcaagacctatcgcgaaatagtacaggagaaggaacgccgggagcgggaactgcatgaggcctataaaaatgcacggtctcaagaggaagccgaaggtattctgcaacagtatatagaacggttcaccatttctgaggccgtcctggagcggcttgaaatgccaaagatcttggaaaggagtcactccaccgaacctaacctatctagctttctcaatgatcctaacccgatgaagtatttgagacagcagtcactaccaccacccaaattcacagccacagtggagacgactattgcgcgtgcctcggtcttagacaccagcatgtcggctggatctgggagcccatctaagaccgtgacaccaaaagccgtgcccatgctcacccccaaaccgtattcacagccaaaaaatagtcaagacgtcttgaaaacgtttaaggttgatggcaaagtctccgttaacggtgagacagtacacagggaggaagaaaaggaacgcgaatgtccgaccgtggcgcccgctcatagcctcaccaaatctcagatgttcgagggagtggccagagttcacggtagccccttagaacttaagcaagataacggctccattgagataaatatcaagaagcccaacagcgttccccaggaacttgctgctacaacggaaaaaacagaacctaacagtcaggaagataagaacgatggcggcaaatccagaaagggtaacatcgagctggcgagttcagagccccagcatttcaccacgacagtgacacgatgctcccccacagtggcgttcgtcgagttcccatccagtccgcaactgaaaaacgatgtatccgaagaaaaggatcagaagaaacctgagaatgagatgagtggcaaggtggaattggtcctgtctcaaaaggtggtgaaacccaaatcccctgaacctgaggcgacactgacctttcctttcctggataaaatgcccgaagccaaccagctgcacctgccaaacctaaatagccaggtagacagcccttcctctgaaaaatcacccgttatgaccccttttaagttttgggcctgggatccggaggaggagagacgcagacaggagaaatggcaacaggagcaggaaagacttctacaggaacggtatcagaaagaacaggacaaactcaaagaagaatgggagaaggcccagaaagaggtggaggaggaggagaggcgctactatgaagaggagagaaagattatagaagatacggtggtacctttcactgtctcttcatcgtccgcagatcagttgtctacctctagttctatgactgaaggcagcggcacaatgaataagatcgatctaggcaattgtcaagatgaaaagcaggacagacgctggaagaaatcttttcaaggcgacgactccgacctactcttgaagacccgtgaaagcgacaggctcgaggaaaagggatcgctgacagagggcgccctcgcccactctggaaatccggtgagtaaaggtgtacatgaagaccaccagctggataccgaggcaggcgctccgcattgtggaaccaacccacaactcgctcaggatcccagccagaaccagcaaacctccaatcccacccacagctccgaagatgttaagcccaaaacactgccattagacaagtccattaaccatcaaatcgagtctccatcagaaagaagaaaatcaatctcggggaaaaagctctgttcttcctgtggtcttcctctaggcaaaggcgcagctatgattatcgagacccttaacctctatttccacattcagtgttttagatgtggtatttgtaaaggacagttgggagatgccgtctctggcactgacgtgcgcatccggaatggattgctgaattgtaatgactgctacatgcggagccggtccgccggacagcccacgactctgtag

SEQ ID NO: 48544 - DNA, 384 bp, Artificial Sequence
  Description of Artificial Sequence: Synthetic coding sequence
atgttccaggccgccggcgccgcccaggccacccccagccacgacgcaaaggggggtggctcatccactgtccagcggtccaaatcattctccttacgggcacaggtgaaggagacatgtgcagcctgtcagaagaccgtgtatcctatggagagattggtggcggacaagctcattttccataattcctgtttctgttgcaagcactgtcacactaagctgtccctggggtcttacgcagccttacatggcgaattctactgtaagcctcatttccagcagctgttcaaatctaaaggcaactatgatgagggcttcggcagaaagcaacacaaagagctctgggcacacaaagaggtggacccaggcactaaaacggcctag

SEQ ID NO: 48545 - DNA, 1944 bp, Artificial Sequence
  Description of Artificial Sequence: Synthetic coding sequence
atgcggctgaccctgctgtgctgcacctggcgggaggagcggatgggagaagaaggctcagagttgcctgtgtgcgcctcatgtgggcagcgaatctatgacggccagtatcttcaagccctgaatgccgattggcatgcagactgtttccggtgctgtgattgctcagcaagcttgtcacatcagtactatgagaaggacggacagttattttgcaagaaggactactgggcccggtatggcgaatcttgtcatggatgctcggagcagataaccaaaggtctagtgatggttgccggggaactgaaatatcaccccgaatgttttatatgcctgacttgcggcacttttattggcgacggagacacttatacgctggtggaacatagcaagctatactgcggccattgctactatcaaactgtggttaccccagtaatcgagcaaatcctaccagacagccccgggtcccacttaccccacacagtcaccctcgtctccatacctgcctccagccacgggaagcgaggactcagcgtgtcgattgatccgcctcacggcccccccggctgcggcacagaacatagtcatacagtgcgggtccagggtgtggatccaggctgcatgtcccctgatgtgaagaacagcatccatgtgggcgatagaatccttgagattaatggcacccccattagaaatgttcctttagacgagatcgacctccttatccaggaaacctcacggctactccagttaacactggaacacgacccccacgacacattgggacacgggctgggacctgagacttccccactctcaagccctgcttacacaccgtcgggggaagccggttccagtgcacgacagaaacccgtgcttcggagttgctccattgaccggtctccaggagccggctccctcggtagtccggcttctcagcggaaagatctgggaagaagtgaatctctgcgggtggtgtgcagaccccaccgcatttttcgaccaagcgatctcatccacggggaggtgttgggaaaaggctgcttcggtcaggccatcaaagtcactcaccgggagactggggaagtcatggtaatgaaagaactcatcaggtttgacgaagaaacccagcgtacgtttttgaaagaagtgaaggtaatgcgctgcctggaacacccgaatgtgttgaaattcattggcgtcctttataaagataagcgattaaatttcatcactgagtacataaaaggtgggactttgaggggaattataaagtcgatggacagccagtatccttggtcgcaaagggtgagcttcgcaaaagacattgcgtccggcatggcctacctccattccatgaacatcatccatcgcgacctgaacagccataattgtcttgttcgggagaataagaacgtcgtggtcgctgatttcggcctcgctagactgatggttgatgaaaaaacccagcctgagggcctccggtccttgaagaaaccagacagaaagaaaaggtacactgtggtgggcaacccttactggatggcaccagaaatgataaacggacggtcgtatgacgagaaagtggacgtcttcagcttcgggattgtgctgtgcgagatcattggacgggttaacgcagaccctgattatttgccaaggactatggacttcggcttaaacgtgcggggattcctcgaccgctattgccccccaaactgcccgccaagctttttccccataacagtccggtgctgtgacctagaccccgaaaagcgaccctcattcgtgaaattggagcattggttggaaacactgaggatgcacctggcggggcaccttcctctagggcctcagctggaacagctggatcggggcttttgggagacctatcgcagaggagagagtggactgcccgcgcacccggaggtccccgactag

SEQ ID NO: 48546 - DNA, 741 bp, Artificial Sequence
  Description of Artificial Sequence: Synthetic coding sequence
atgttccccgtgaaggtgaaggtggagaagagcgagctggagatggtgaaggcccgcaaccagctcgatgcagtgttacagtgtcttctggaaaagtctcatatggatcgcgagcggctagacgaggaggccggcaaaacaccctcagacacacacaataaagactgctctattgctgccaccggcaaacgtccctcagccaggttccctcatcaacgtcgcaagaagcgaagagaaatggacgacgggctcgctgaaggaggcccacaaagatccaatacgtacgttattaagctgtttgaccgatcagttgatctggcgcaattcagtgagaacacacctctgtatcctatttgcagagcttggatgcgcaacagtcccagcgtacgggaacgagaatgctcccccagctccccccttccccccttgcctgaggacgaggaggggagcgaggttaccaattccaaatctcgcgacgtgtataaactcccaccccctaccccacccgggccccccggcgacgcctgtagatctagaattccttctccattacagcctgaaatgcaggggaccccggacgacgaacccagcgagccagagccttctccgagcacgctgatatataggaatatgcagcgatggaagcgtatccgacagcgttggaaagaagctagtcaccgtaatcaactccggtattctgaatccatgaagattttgcgggagatgtatgagcgtcaatag

SEQ ID NO: 48547 - DNA, 351 bp, Artificial Sequence
  Description of Artificial Sequence: Synthetic coding sequence
atgggctggaagatggccagccccaccgacggcaccgacctggaggcttctctgctttcatttgaaaagttggaccgggcgagcccagatctatggcccgaacagctgcctggggtagccgaattcgccgcttcattcaaatcacccattaccagcagcccacccaagtggatggcagaaattgaacgcgatgacatcgatatgctgaaagagcttgggtctctgaccacagccaatcttatggagaaggtccgcggcttgcagaacctggcttaccagctcggactcgacgagtccagggaaatgacgagaggcaagttcctaaacatcctggaaaagcctaagaagtag

SEQ ID NO: 48548 - DNA, 447 bp, Artificial Sequence
  Description of Artificial Sequence: Synthetic coding sequence
atgcggctgggctgcgagctgggcatcggcttcctgttcggcggcgtcgcttatgggaccagcttttcccgaagaaggcttgcgacctcaagagatatggggtggaaaatggcgagcccaacagatggtacagatttggaggccagtcttctgagctttgagaaattggacagggcatctccagatctgtggccagagcaactccccggggttgccgagtttgccgcctcttttaagtctcccataacctcttccccccctaagtggatggctgaaatcgagagggatgatatcgatatgttgaaagagctgggctcacttacgaccgcaaacctgatggaaaaggtccgtggccttcagaacctggcttatcagctaggattagacgaatcacgagagatgacccggggaaagttcttaaatatactcgagaagcccaagaagtag

SEQ ID NO: 48549 - DNA, 2598 bp, Artificial Sequence
  Description of Artificial Sequence: Synthetic coding sequence
atgagcgacgtgagcaccagcgtgcagagcaagttcgcccggctggccaaaaagaaggagaatatcacctacatgaagcgtgagcagctcactgagactgataaagacattgcacccgtgctggaccttaagtgtaaagatgtaagtgcgattatgaataaattcaaagtcctcatggaaattcaggatctaatgtttgaggagatgcgagagactctgaagaacgacctgaaagctgtgctgggcgggaaagccaccattccagaggtgaaaaactctgaaaatagtagtagtcgtaccgagtttcagcaaatcatcaacctcgcgctgcaaaagaccggcatggtgggaaagatagagggtgaaaattctaaaatcggcgatgataacgaaaacctgacatttaagttagaggtgaacgaactgtccgggaaacttgataataccaacgaatacaactctaacgacgggaagaaattaccccagggagagagcaggtcttacgaagttatgggatcaatggaggaaaccttatgtaacatcgatgatagggacggtaataggaacgtgcacctggaattcacagagagagaaagccggaaggacggcgaagatgaattcgtgaaagagatgagggaggaacgcaaattccaaaagttgaaaaacaaggaagaagtgttgaaagcatccagggaggaaaaggtgctaatggacgagggcgcggtgctaacgctggtggctgatttgtccagcgccacgctggacatctctaaacagtggagtaacgtgtttaatatcctgagggagaatgacttcgagccgaagttcttatgcgaggtgaagctcgctttcaagtgtgatggcgaaatcaaaacattcagtgacctccagtctttgcggaaatttgcttcccagaagagttccgtgaaggagctgctcaaagatgtgctgccacaaaaagaggaaatcaaccagggcggaaggaagtatggcatccaagaaaagcgcgacaagacactgatcgactctaaacaccgagccggcgaaatcaccagcgatggattgtccttcttattcctgaaagaagtgaaggtcgccaagcccgaagaaatgaagaacctcgaaacacaggaagaggagttctcggagctcgaagagcttgacgaggaagccagcgggatggaggatgacgaggatacatccgggcttgaggaggaggaggaagaaccatctggtctggaagaagaagaagaagaagaggccagtgggctggaggaggatgaagcatcgggactggaagaggaggaggagcagaccagtgagcaggactctaccttccaagggcatacattggtcgacgctaaacacgaggttgagatcactagcgacggcatggagaccacattcatcgattctgtggaagattccgagtccgaggaggaggaggagggcaagtctagcgaaaccggcaaagtcaaaaccacctcactgactgagaagaaagcctcccgaaggcagaaggagatcccatttagttacctggtcggtgattcgggcaagaaaaagttggtcaaacatcaagtggtccataagacacaggaggaagaggagactgctgttccaacctcacagggaacaggtaccccatgtctgaccctctgcctggcgagtccgtctaagtctctggagatgtcacatgatgagcacaagaaacactcccacacgaatttaagtatcagcaccggggtcactaaattaaaaaagactgaagaaaaaaagcacagaacactgcacacagaggaattgacctctaaggaggcagacctcacggaagaaaccgaggaaaatctgcgctcttccgtgattaacagcataagagagataaaagaagagatcggcaatttaaagtcaagtcacagtggagtgctggaaatcgaaaacagcgtggatgatctgtcttccagaatggatatccttgaggagcggatagactctttagaggaccagatcgaggagttctctaaggacaccatgcagatgactaagcagataatatcaaaggaaaggcagagggacatcgaggagcggtccaggagttgtaacatacgactgatcggtatccccgaaaaagagagttatgagaatagggctgaggatataatcaaggagatcatagatgaaaatttcgccgagctcaagaaaggaagcagtttagaaatcgtctcagcatgtcgagtgccatccaagatcgatgaaaagcggctgactcctagacacatcttggtgaaattctggaactcctcggacaaggaaaagattattcgcgcaagcagagaacgcagggagatcacatatcagggcactagaatccgattgaccgcagatttgagcttggacacactagatgccagatctaagtggtcaaatgtctttaaagtgctgctggagaaaggctttaacccgaggatcctgtatccagcaaaaatggcattcgatttccgaggcaagactaaagtgttcctcagcatcgaggagttccgtgattatgtactccatatgcctactctgcgggagctgttaggcaacaacattccctag

SEQ ID NO: 48550 - DNA, 2274 bp, Artificial Sequence
  Description of Artificial Sequence: Synthetic coding sequence
atgaaggtgttctgcgaggtgctggaggagctgtacaagaaggtgctcttgggtgccacactggagaacgattctcacgactatattttttatctcaaccccgctgtgagcgaccaggactgcagtaccgcgacttcattagagtgggccaacacctgcggaattcagggccgacaccagccgattagcgtgggcgtggcaccaatagcggttgccccagtgtgtctcaagacaaattcccagatgagcggctcccgagaagtgatgctgctccaactgaccgttataaaggtgatgacaactaggatcctgtccgtcaaaacggaatttcacgccaaggaacagtacagagatgttatcaagatacttcttgaatcagccaaggtcgacagcaaactgatctgcatgttccagaacagcgacaagctattgtcgcacatggccgcacagtgcttggcacttctgctgtacttccagctccgtgagaaaatcaccctgtccaatagctggattgccttctgtcagaagaacctcagcgagtattctgaaagcaacaaggccatctattgtctgtggacactaactgcgatcataaaggagatatttaaagatagctgctcccagaaaacagagatcttgaagcagttcctgactcattttgacactatctttgaggtcttttacaacagtctgttctcacagcattttgaaaattgccgggatacctcaaaaatcgtaaacatccttatgtgttttctcgacctacttgaactgcttatcgcctcacgcatccatttgaagctgcactttacctgccaacgtatcctgtttctgaaaccaagttgcatgctggaagttattacctggccaatccaggcatttgtgaaacgcaaagtgatcatcttcctgaagaaatgtctcctctgtaaggtgggtgaggacctgtgtcgaggatcagtaccagccttgatgccaccagatcaccacgttgccgttgacatgttggctctggctaacgccgtgctgcaagcagtcaacagcggactgctcaaaacgctgtcggtgtacgagaagcattctttctttgggggcgatgaggtccagcccgaatgcgaactgatcaccagtccagaccatgtgatactgagggccgcctcattggttattatgaaaagtctggaaatcaagttccagaactactctagcgcatcagaagtgaaggtggatctgcagagattcatgagtgagttgcttaccttcttgaagccgcatctgcagccttccctgcagttacacaacccctgtaagtggctgtcgcgggtcttcatagaacaggacgacgacatgctcgaagctgccaaagcaagcctaggcatttacctgaccctgaccaggggatgcgaagccacagagtctcttacacagggcaaggagatgtgggaccaccacacacacgagaatggctacaaccctcactgcattttcctgttttttctgaagaacattggattcgactcaacggttctccttgatttccttattagttcggagacatgcttcctggaatatttcgtccggtacctcaaacttcttcagaaggattgggacaacttcttcactatttgtaacaacttcgatgccaccgaaagcaagtacgatatttctatctgtggctgtgttccctcattggtgcaagatcagtcatctaatcagaccatccctcacaggctgacagcaccacactcccatcgggacgtgtgcgcaagacattcctgggcgtctgatgcacctagtgaacccctaaaggccgtcatgagtaagggagcccatacgatgtgcgccagtagcctgagtagtcctcgcgcatcccaaagtttagtagattatgattcttcagatgattcagacgtagaatctacagaacagtgcctggcaaacagtaagcagacctcattgcaccaacaggcgactaaagaaatccaagacgctgctggaacaagcagagataaaaaggagttctctctggaacccccaagcaggcccctggtgcttaaggaattcgatacggctttcagctttgactgcgaggtagcccccaacgacgtagtctctgaggtcggcatcttctaccgaatcgtaaagtgcttccaggagctgcaggatgcaatttgtcggctacagaagaaaaatctgtttccctataatccaacggccctgttgaaactccttaagtacattgaagtgattagcaataaaaccatgaacacgctgtag

SEQ ID NO: 48551 - DNA, 576 bp, Artificial Sequence
  Description of Artificial Sequence: Synthetic coding sequence
atgaaggtgttctgcgaggtgctggaggagctgtacaagaaggtgcttctgggggccactcttgagaatgatagtcacgactacatcttctacctgaaccccgccgtgagcgaccaggattgctcgactgctacctccttagaatgggctaatacgtgcggtatccaaggaagacaccagccaatctcagtgggagtggcacccatcgccgtggcccccgtctgtttgaagactaattcgcagatgagtggttccagggaggtcatgctgctgcagctaacggtgataaaagtgatgaccaccagaatactgtcggtgaagaccgagttccacgctaaagagcagtacagggacgtcatcaagatattgctggaatcagcaaaggtggactcaaaacttatctgtatgtttcagaactctgacaaactcctcagtcacatggcagctcagtgcctggcgctgctcctctactttcagctaagagagaaaattacactatctaactcttggattgctttttgtcagaagaatttgagcgaatattccgagagcaataaggccatctattgcctttag

SEQ ID NO: 48552 - DNA, 597 bp, Artificial Sequence
  Description of Artificial Sequence: Synthetic coding sequence
atgaaggtgttctgcgaggtgctggaggagctgtacaagaaggtgctcctaggagcaacacttgagaacgacagccacgactatattttctacctgaacccagccgtctccgaccaggattgctccaccgccacatccctggaatgggctaatacatgtgggatccagggacgccaccagccaatctcagtgggtgtggcgccgatagcagttgcacctgtgtgtttgaagactaatagccagatgagtggaagcagagaggtgatgctgttgcagctgactgtgatcaaagtaatgaccactcgtattttgagtgtgaagaccgaattccacgctaaggagcaatacagagacgtgattaagattcttcttgagagtgccaaggttgatagcaaactgatctgcatgtttcaaaattccgataaactgctgagtcacatggccgctcaatgtctcgctctcctcttatactttcagctgcgtgagaaaatcaccttatcgaatagctggatcgcattttgccagaaaaacctgtccgagtacagcgagtccaataaggcgatttattgcctctggactcttactgctattatctag

SEQ ID NO: 48553 - DNA, 390 bp, Artificial Sequence
  Description of Artificial Sequence: Synthetic coding sequence
atgaaggtgttctgcgaggtgctggaggagctgtacaagaaggtgttactgggagctactctcgagaacgactcccatgactacatcttttacttgaatcctgcggtgtcggaccaggattgttcaacagctacaagcctggagtgggcaaatacctgcgggatccagggtcgacaccagccaatttcagtcggcgtggcccccattgccgtggcaccagtctgcctgaaaacaaatagtcagatgtcagggtctagggaagtgatgttgttgcagttgacagtcatcaaggtgatgaccactagaatactgtccgttaagacagaatttcacgcaaaagagcagtaccgcgacgtaatcaagatactgctggagtccgcgaaggtatag

SEQ ID NO: 48554 - DNA, 435 bp, Artificial Sequence
  Description of Artificial Sequence: Synthetic coding sequence
atgaaggtgttctgcgaggtgctggaggagctgtacaagaaggtgctgctgggcgccaccttggagaatgatagccacgattacatcttctatctgaaccccgctgtgtccgaccaagattgttcaacagcaacttccctagaatgggccaacacctgcggcatccaagggcgtcaccagcccatatccgtcggtgttgctccgatcgctgtggctcctgtctgccttaaaactaatagtcagatgagtggcagccgagaggtgatgctgctacaactgacggtgatcaaggttatgactaccagaatcctgagtgtgaaaactgaattccacgctaaggaacagtaccgcgatgtcattaaaatcctcctcgagagcgcaaaggttgatagtaaactcatctgcatgtttcagaactcagataaattgctttag

SEQ ID NO: 48555 - DNA, 1311 bp, Artificial Sequence
  Description of Artificial Sequence: Synthetic coding sequence
atgaaggtgttctgcgaggtgctggaggagctgtacaagaaggtgttgctgggtgcaacactggagaacgatagccacgattacatcttttatttaaacccagctgtgagtgaccaggattgtagcacagccaccagccttgaatgggcaaacacctgcgggatccaaggtcggcaccagcccatcagcgttggcgtggcgccaattgccgtggcaccggtgtgtctcaagactaacagccagatgtctgggtcacgcgaagtgatgctgttacaactcacagtgattaaagtcatgacaactcggattctgtccgtcaaaacagagtttcatgcaaaggagcagtacagagacgttattaaaatcctactggagtctgcgaaggtggactctaagctgatatgcatgtttcagaattccgacaagctattaagtcatatggccgctcagtgcctggccctgctcctgtacttccagctgcgggagaagataacattgtctaacagctggatcgctttctgccagaagaacctgagtgagtactctgagtctaataaagccatctattgcctctggacactgaccgcaataattaaggaaattttcaaggatagctgctctcaaaagacggagatactgaaacagttcctgacacattttgataccattttcgaggtgttctacaattctctcttctcgcagcatttcgaaaactgtagagacactagcaagatcgtcaacatacttatgtgtttcctcgacttgttagaactgctcatcgccagtcggatccacttgaaactacacttcacatgtcagcgcattttgttccttaaaccttcttgcatgttagaagtgattacgtggcctatccaggcttttgtgaagcgaaaagtgataatttttctgaagaagtgccttctgtgcaaagttggcgaagatctatgcagagggagcgtgccagcactgatgcctcccgaccatcacgttgcagtagacatgctggcgctcgccaatgccgttctgcaagccgtgaattccggactgctcaaaaccctgtccgtgtacgagaagcatagctttttcggcggtgacgaagttcagccggagtgcgagctgatcacgtctccagaccacgtaatcctgcgggcagcctcattagttatcatgaagagtctggaaataaaattccagaactactctagcgctagcgaggtcaaaggaaactctccaaacagcttctgcatgcagtgtgtgattatttatctgtctaccgtaattcacaactatcagatatctggccttgtgtag

SEQ ID NO: 48556 - DNA, 732 bp, Artificial Sequence
  Description of Artificial Sequence: Synthetic coding sequence
atgagcagcggcaccgagctgctgtggcccggcgccgccctgctggtgctacttggcgtagccgcttccctgtgtgtgcggtgtagtaggccgggggctaaaagaagcgaaaaaatttaccaacagcgttcgctgagagaagatcagcagtctttcactgggagtcgaacgtatagtctggtcggtcaagcctggccgggccccctggcagacatggctcctactcgcaaggacaagctgctgcagttctatccatctctggaagatcctgcttctagcaggtaccagaacttctccaaaggttctagacacggctcagaagaagcatacatagacccaattgctatggagtactataattggggccgttttagcaaacccccagaagatgatgacgctaatagttatgagaatgtgttgatctgcaagcagaagaccacagaaacaggggctcaacaggagggaatcggagggctatgtcggggagacctgagcctctctctggctctcaagaccggacccactagtggcctgtgtcccagcgcaagcccagaggaggacgaagaatcagaggattatcagaattcagcaagtatccaccagtggcgagagtcgaggaaggtcatgggccagttacagcgggaggctagtcctggtccggtggggtccccagacgaagaagatggtgagccagactatgtgaatggcgaggttgcggctactgaagcttag

SEQ ID NO: 48557 - DNA, 732 bp, Artificial Sequence
  Description of Artificial Sequence: Synthetic coding sequence
atgagcagcggcaccgagctgctgtggcccggcgccgccctgctggtgctgctgggggtagccgcttccttgtgtgtgaggtgtagccgccctggagctaagcggagcgagaaaatataccaacagcgctccctccgcgaggaccagcagtcatttaccggcagcagaacgtattccctagtgggccaggcctggcctggtccattggcggatatggcccccacgaggaaggataaactcctccaattctacccctctctcgaggatcccgccagcagcagatatcagaatttttctaagggatcccggcacgggtctgaggaggcgtacattgatccaattgcaatggagtactacaactggggacgattctccaagcctcctgaagacgacgacgccaattcctatgaaaatgttcttatatgcaagcaaaaaaccaccgagacaggcgcccagcaggagggaattggtggattgtgccgcggcgatctcagtctgagcctcgccctcaaaacaggacctacatcgggtttatgcccctcagcctctcccgaagaagatgaggagagcgaggattaccagaatagtgcctcaatccatcagtggagagagtcgagaaaagttatggggcaacttcagagggaggcgtcgcctggccccgtaggcagccccgatgaagaagatggcgaaccagattatgtcaacggcgaagtggcagcaacagaagcctag

SEQ ID NO: 48558 - DNA, 732 bp, Artificial Sequence
  Description of Artificial Sequence: Synthetic coding sequence
atgagcagcggcaccgagctgctgtggcccggcgccgccctgctggtgctcctaggagtggcggcatccctgtgtgtgagatgctcccggccaggcgctaaacggtccgagaaaatttaccagcagagatctctgagagaagatcagcaatcctttacaggaagtaggacgtatagtctcgtggggcaagcctggcccggcccactggctgacatggctccgaccagaaaagataaacttctgcagttttatcctagtctcgaagatccagcctcctcgcgataccagaacttctctaagggcagcaggcacggaagcgaagaggcctatattgaccctatagccatggagtactacaactggggaagattctctaaaccacccgaggacgatgatgctaactcgtacgaaaacgttctcatttgcaaacagaaaaccactgagaccggagcccagcaggaaggaatcgggggactttgcagaggcgatctctccctgtctttagctctcaagactggcccgaccagtggtctctgtccatccgcatcacctgaagaggacgaagagtctgaggactaccaaaattcagcatccattcaccagtggcgggagagtagaaaggtgatggggcagttgcaacgcgaggcttcccccggtcccgtcgggagcccagatgaggaggatggcgaacctgattatgttaacggggaagttgcagcaaccgaagcctag

SEQ ID NO: 48559 - DNA, 495 bp, Artificial Sequence
  Description of Artificial Sequence: Synthetic coding sequence
atggtgggcgtggtgagcgacgaccaggacttcctggacagcaaggatactatgaagatggcagtggttcttgtcacacctctggggaatggcgacctcgcgttaaagttcgggtacccaactccacatggaggttgccagaagatggatacaacatttaccgaaggggcggtacctgggcagttttcaaatccggctatggccttgtcagacataagagttgcattcagtgactaccagcatttcgctctcctatatctggagatgcgaaagggtgggttacggaaccagtggctgcagttgtacgggggcagagcagccgggaggcgccctaggcaccctcgttttggcagtggtatgtctcccttgtgtctgcatcagcccttcctacatgcagaaggtggaacagcaggtagctggtgtctgtggccgagggttccagctcccccatgcccaagcctaccactgtttgctcctccggctccttctctttag

SEQ ID NO: 48560 - DNA, 696 bp, Artificial Sequence
  Description of Artificial Sequence: Synthetic coding sequence
atgcggcagcccgccgtgcggctggtgcggctgggccgggtgccctacgctgaactgctcggtcttcaggaccggtggctgaggagactacaggctgaacctggcattgaggctccatctggaaccgaagctggcgccttgttgttgtgtgagcctgcaggccccgtgtacacagctggtttaaggggaggcctgacccctgaagagaccgcgcgccttcgcgctctaggcgctgaagtccgcgttacaggacgagggggccttgccacctttcacgggcccggacaactgctctgccatcccgttttagatcttcgaagactcggtctgcgcttacggatgcatgtcgcttcccttgaggcctgtgccgtaagactctgtgagctccaaggtctgcaagacgccagggcccgcccaccaccctataccggagtgtggctggacgatcgcaagatatgtgcaatcggcgtgagatgcgggcggcacattactagccacgggctcgccctgaattgcagcaccgatctgacttggttcgaacacatcgtgccatgcggtcttgtggggaccggcgtaacatcactgagcaaggaacttcaacgccacgtgacagtagaagaggtcatgccaccctttctggttgctttcaaggagatctataaatgtactttgatctccgaggactctccaaattag

SEQ ID NO: 48561 - DNA, 849 bp, Artificial Sequence
  Description of Artificial Sequence: Synthetic coding sequence
atggaccggaccctggagagcctgcggcacatcatcgcccaggtgctcccccatcgggaccctgctctggtattcaaggacctcaatgtcgtttccatgctgcaggagttttgggaaagtaagcagcaacagaaggcagccttcccatccgagggcgtggtcgtgtatgagagtctgcctgcccctggcccacctttcgtgtcgtatgtaacccttcccggtgggtcttgctttggtaacttccaatgctgcctgtcacgagccgaggctcgccgggatgctgctaaggttgctctgatcaactctctgtttaatgagttaccaagcaggcgaatcaccaaggagttcatcatggaatccgtgcaggaagccgtggcctccacatcaggaacacttgatgacgccgatgaccctagtacctctgttggagcatatcactacatgttagagagcaacatggggaagaccatgctggaatttcaggagctgatgacgatcttccagctgcttcattggaacgggagcctcaaggcactccgtgagacaaaatgctcccgtcaggaggtgatctcatactactcacagtacagtctggacgagaagatgcggtctcacatggcactcgattggattatgaaggagcgtgatagtcccggaattgtatcccaggaacttaggatggcgcttaggcagctagaggaggctcggaaggccggccaggagttgaggttctacaaggaaaaaaaagagatactctccttggctctgacccagatttgcagtgacccagacacaagctcgccttctgacgatcaactctcccttacggccctgtgtggttaccactag

SEQ ID NO: 48562 - DNA, 1014 bp, Artificial Sequence
  Description of Artificial Sequence: Synthetic coding sequence
atggagaccatgcgggcccagcggctgcagcccggcgtgggcacctcaggaaggggcacactgcgcgctttgcggccaggagtgacgggggccgcagctgcaacagctaccccacctgctgggccccccccggccccgcctcctcctgcccctcctccaccccccctgcttctgtctggagccccgggcttacccttgccccccggagccgctggctcgcccgccgtcctgagagaggctgtggaagccgtggtacgctcctttgcgaaacacactcaagggtacggccgcgtgaatgtggtggaggccctgcaggaattttggcagatgaaacagtctcggggagcggacctgaagaacggtgcacttgttgtatatgaaatggtacctagcaacagccccccttacgtatgctacgtgactttacctggcggctcatgctttggatctttccagttttgcccgaccaaggctgaagcacggcgttccgctgcaaaaattgcgcttatgaatagcgtgttcaacgaacacccatcccgcagaataactgatgagtttatagagaaatcagtctctgaggcactggccagctttaacggcaaccgggaagaggccgataacccgaataccggcattggagccttcaggttcatgctggagtctaataaggggaagagcatgctggagtttcaggagttgatgacggtgtttcagctgctccactggaacggctccctcaaagcaatgagggagagacagtgctccagacaggaagtattggctcactattcccatcgcgcactggacgacgacattcggcaccagatggctttagattgggtgtccagagagcaatccgtacctggggccctgtctcgcgaactggcatccaccgagagagagctggatgaggctcgactcgccggtaaggaactgcggtttcataaagaaaagaaagacatcttggtgctggccgctggacagctcgggaacatgcactcgagtaactgctag

SEQ ID NO: 48563 - DNA, 855 bp, Artificial Sequence
  Description of Artificial Sequence: Synthetic coding sequence
atggagaccatgcgggcccagcggctgcagcccggcgtgggcaccagcggacgcggcacattgcgagcccttagacccggtgtgactggcgccgccgccgcaacggcaacccatacccagggatacggcagagttaacgtggtggaggccctacaggaattttggcagatgaagcagtccagaggggcagacctgaaaaacggcgcacttgtggtgtacgagatggtgccctctaattctcccccttatgtatgctatgttacactacccggagggtcatgctttggaagcttccagttttgccctacaaaggcagaagcacgcaggtccgccgccaagatcgctctgatgaattccgtgttcaatgagcacccatctaggcgaattaccgacgaattcatcgaaaaatccgtctcggaggcacttgcctcgtttaatggtaaccgagaagaggctgataatccaaataccggcattggcgccttccggttcatgctggaatcgaataagggcaaatcaatgctggagttccaggaactcatgaccgtgttccagttgttacactggaacgggagcctgaaagcaatgcgcgagcgtcaatgctctaggcaggaagttctggcccactactcgcaccgagctctcgatgatgacatcagacaccaaatggctttggactgggtatctcgcgaacagtccgtgcccggagccctgtcacgcgagctggcctccacagagcgtgagctggacgaggcccggttagccggtaaggagctacggttccataaggaaaaaaaggacatactggtactcgccgccggccagctggggaatatgcatagttcgaattgctag

SEQ ID NO: 48564 - DNA, 390 bp, Artificial Sequence
  Description of Artificial Sequence: Synthetic coding sequence
atggccaagagcctgcggagcaagtggaagcggaagatgcgggccgaaaaacgtaagaagaacgcacctaaggaggccagtcgattaaaaagcatacttaaactggacggcgatgtgctgatgaaagatgtacaggagatcgctaccgtggtggtaccaaagccaaagcattgccaagaaaagatgcagtgtgaggtgaaggatgaaaaagacgacatgaagatggagaccgacattaagcggaataaaaaaacactcctggatcagcacggtcagtacccgatatggatgaatcaacggcagcgaaagcgcctaaaggccaaacgcgagaagaggaaagggaagagtaaagcaaaggccgtaaaggtggcaaaggggctggcctggtag

SEQ ID NO: 48565 - DNA, 390 bp, Artificial Sequence
  Description of Artificial Sequence: Synthetic coding sequence
atggccaagagcctgcggagcaagtggaagcggaagatgcgggccgagaaaaggaaaaaaaacgcccccaaggaggcaagcaggcttaaaagcatcctgaaattggatggggacgtgctcatgaaagacgtgcaggagatcgccacagtggtggttcctaagccaaagcactgccaagaaaagatgcagtgcgaagtgaaagacgagaaggacgacatgaagatggaaactgatatcaagcggaataaaaagactttgttggatcagcacggccagtacccaatttggatgaaccagaggcagcgcaagaggttgaaggccaagcgggagaaaaggaaaggtaagtcaaaggccaaggcggtcaaggtggcaaaggggctggcctggtag

SEQ ID NO: 48566 - DNA, 414 bp, Artificial Sequence
  Description of Artificial Sequence: Synthetic coding sequence
atgagccagttccagggcaagggcccccggtggaccgtgctgatcatgtccaaggtggggttgcgagggggtctgtccgaccagatggcaatgaaagttctggaccccttgagacaagcactggacagtagcatgcagtcaaacaacctgtgccagcacccccaacctctcgcgctccacgtgtcagcagccgttgcgtctgcaggcgcccaggcgagttctctactggggccattgcctcatttgtcttcgtttgccttccagcctgcccattccctcctcagtctgctcggcagtcatggggctgaagtttcgaagaagatggctctgctggcgagagaacgctcgccagcccatctagtggcgtttcctgggcgcctcacggctaccccacctggcttgcccacgttttag

SEQ ID NO: 48567 - DNA, 198 bp, Artificial Sequence
  Description of Artificial Sequence: Synthetic coding sequence
atgaagaaggacagccagggcgccttcagcggcttctgccacggcggagacgctctccatgagggccgggtgaggcggcctctgtggttgaaggatatgtacaagccgctttccgcaacccgtgtgaataatcatgcgtggaaactgcacaagaagagcagcaacgaggatgaaatcctaaaccgggaccctggctag

SEQ ID NO: 48568 - DNA, 1818 bp, Artificial Sequence
  Description of Artificial Sequence: Synthetic coding sequence
atgagcagcgtgagccccatccagatccccagccggctgcccctgttactgacccatgaaggagtgctcctacccggatccacaatgaggaccagtgtggactcagcaagaaatttgcagctggtgaggtctcgattacttaaaggaacttcactacagagcactattttgggggtgattccaaatacacctgatcctgcgtcagatgcccaggatctcccaccgctgcaccgcattggcacagctgcgctggccgtccaagtggtcgggtcaaattggccgaagccacattacactctgctaattactggcctgtgcagattccaaattgtgcaagtgctcaaggaaaagccctaccctatcgctgaagtcgagcagctcgataggctggaggagtttcccaatacctgcaagatgagggaggaactcggcgaacttagcgagcagttttacaaatacgctgtgcaaatcctcgatgccgtttccctggaagaacgattcaagatgacgatcccactgctggtgagacaaattgagggcctcaagctgctccagaaaacccggaagcccaagcaagacgatgacaaacgagtgattgctatacggccgatcagacggatcacacacatctccggcacactggaagacgaagacgaggatgaggataacgatgatatagtaatgcttgagaagaaaattcgcaccagcagcatgccagagcaggcacataaagtgtgcgtcaaagaaattaagagactgaaaaagatgccccagagtatgcctgagtatgcgctcactaggaactacctggagttaatggtcgagctgccctggaacaaatccactaccgatagactagatatccgcgccgcccgcatactgttggataacgatcactacgcgatggagaagctgaagaagagagtgttagaatacctggctgtccgacagctgaaaaataatctgaaggggcctattctgtgctttgtagggccccccggcgtggggaagacctctgttgggcgatccgttgccaagaccttgggccgcgagttccatagaattgctttgggtggcgtatgcgatcaatctgatatcagaggccacagacgcacatatgttgggtccatgccaggcagaataattaacggactcaaaaccgtgggagtgaacaatcctgtgtttttactagatgaagtggacaaacttggcaagagcctccaaggggaccccgctgccgcattgttagaagtgctggacccagaacaaaatcacaatttcactgatcactatctgaatgtcgcttttgatctgtcccaagtgttattcatcgcaactgcaaataccactgcaaccataccagccgctcttctggaccggatggagatcatccaggtgcccgggtatacccaggaagaaaagatcgagattgcacacaggcatttgattcccaagcaacttgagcagcatggccttacaccccaacaaatccaaatacctcaggtaaccacgttggatatcatcactagatacacgcgagaagccggtgtgagatctttagacaggaagctgggcgcaatttgccgcgccgtcgccgtgaaggttgcagagggccaacacaaggaggctaaactcgatcggtcggacgtgactgagagggaagggtgtagagagcacatcctggaagatgagaaacctgagagcatttccgacacaacagaccttgcactgccacctgagatgccgattctgattgactttcacgcccttaaagacatcctgggcccaccaatgtacgaaatggagatcgcttcttag

SEQ ID NO: 48569 - DNA, 2427 bp, Artificial Sequence
  Description of Artificial Sequence: Synthetic coding sequence
atgagcagcgtgagccccatccagatccccagccggctgcccctgctgctgactcacgaaggtgtcttgctgcccgggagtactatgcgcacttcagttgactctgcgaggaatttgcagttggtgcggagccggctactgaaaggcacaagtctgcagagcacaatcctcggcgtgattcctaacactccggaccccgcctctgacgcccaggatttgcctccgcttcaccgcattgggacagccgcgctggctgtgcaggtagtcgggtccaactggcctaaacctcactacacattattgatcactgggctatgccgcttccagatcgtacaggtcctgaaggaaaagccctatccaattgctgaggtggagcagctcgatcggctcgaggagtttcccaacacgtgcaaaatgagggaagaactgggagaactgagcgaacaattctataaatacgcagtgcagatactagacgcggtcagcttagaagaaagatttaaaatgactattcccctgttggtgaggcaaatcgaaggactaaaactgctccagaagactagaaagccaaagcaagatgacgacaagcgcgtgatcgcaattcggcctattcgccggataacacacatatccggaacgctggaggatgaggacgaggacgaagataatgatgacatcgtgatgctcgagaagaagatccggacctcttccatgccagaacaggctcacaaggtgtgtgtgaaagagatcaaaaggcttaaaaagatgccacagtccatgcccgagtacgcactgacccgaaattacttagaactcatggtcgagctgccgtggaataaaagtaccacagataggctggacattagggccgctcgcattttactggacaacgatcactatgcgatggaaaaacttaagaaacgggtgcttgagtatttggccgtccgacagctcaaaaacaatctgaaaggcccaatcttatgtttcgtgggacccccgggcgtgggcaagacaagcgtgggccggagcgtagccaagacactgggccgagaattccacagaatcgccctagggggagtgtgtgaccagagtgatattcggggccatcgcagaacatacgtgggcagcatgcccgggcgaatcattaacggccttaaaacagtaggtgtaaataatcctgtattcctcctcgatgaagtggataagctcggtaagagcctgcagggtgatccggcagcagccttgcttgaggtcctggatcctgaacagaaccacaattttactgaccattatctgaatgtggcttttgacctttcccaagtgttgttcattgccactgccaacacgacagccacaattccagctgcactgcttgaccggatggagattatacaagttccaggctacacgcaggaggaaaaaattgagatcgctcacagacatctcattccaaaacaactcgagcagcatggacttactccccaacaaattcagatcccccaggtgacaactcttgacatcattacccggtacacccgtgaggcgggcgttcggtctctggataggaaacttggggcgatttgcagggcggtcgccgtgaaggtcgccgaggggcagcacaaagaggcaaaactggataggtctgatgtgactgagagggagggatgtcgcgaacacattttagaagacgaaaagccagagtcaatctctgacaccacagaccttgcactgccgcctgaaatgcctattttaatagattttcatgccctgaaagatatcttggggccacccatgtatgagatggaggtgtctcagagactgtctcagcccggcgtcgccatcggcttggcatggacccccctgggcggggagatcatgttcgtggaggcatcccggatggatggggaaggacaactgaccttaacggggcagctgggagatgtaatgaaggagtccgcccacctcgccatatcctggttgcgatcaaatgccaagaaataccagctgacaaatgcctttggaagcttcgacttgttagataatactgacatacatctgcactttcctgccggcgccgttactaaggatggtccatccgcaggggtaaccatcgtcacatgcttggccagtctgttctccgggcggttggtgcggagtgacgttgctatgaccggcgaaatcacactaaggggtttggtgctccctgtggggggcatcaaagacaaggttctggctgctcaccgcgccgggctgaaacaggtcattattccgcgcaggaacgagaaagatcttgaagggatcccgggcaatgtacggcaagacctcagcttcgttactgccagctgtctcgatgaggtcctgaatgcggcattcgatggcggtttcaccgtcaaaacccgccctgggctgctgaatagcaagctgtag

SEQ ID NO: 48570 - DNA, 1746 bp, Artificial Sequence
  Description of Artificial Sequence: Synthetic coding sequence
atgctggagaagaagatccggaccagcagcatgcccgagcaggcccacaaggtgtgcgtgaaagaaatcaaacgccttaagaagatgcctcagtctatgccagagtacgccttgactagaaattatttagagctgatggtcgaactgccctggaacaaaagcactaccgacaggttagacatacgcgcagcgagaattcttttggacaacgatcattatgcaatggagaagctcaagaagagagtgctggaatatcttgccgttaggcagctgaaaaataatctgaaaggaccgatcctgtgtttcgttggtccgccaggcgtcggcaaaacatctgtcggtaggagtgtggccaagaccctcggcagagaatttcatagaatcgcccttggaggcgtttgcgatcagagcgatattagaggacaccggagaacatatgttggcagtatgcccggaaggatcataaacggcctgaaaactgttggggtaaacaacccagtgtttctgctggacgaagtagacaagctgggaaaatcactccagggggaccctgcggccgccttgcttgaagtactggatcctgagcaaaatcacaacttcactgaccactatctgaatgttgcctttgatttgagtcaggttctgttcattgccacagccaatactactgctactattccggccgccctgctggacagaatggagatcattcaggtgcccgggtatacccaggaagaaaagattgagatcgcccacaggcacctaatcccaaagcagttggagcagcacggtctgactccacagcagatccagattcctcaggttaccacgctggacataattacccgatacacacgtgaagccggggtacgcagcctggacaggaagctgggggctatctgccgagctgtggcagtaaaggtggccgaggggcagcacaaggaagctaaactcgaccggagcgacgttacagaaagagaagggtgcagagagcatattcttgaggacgagaaacccgaatcaatttccgacacaactgacctggctctgccacctgagatgccgatccttattgattttcacgccttaaaagacatcctggggccccccatgtatgaaatggaagtctcccaacgactcagtcaaccaggggtggcaattggtttggcttggactccacttggaggcgagatcatgttcgttgaggccagccgaatggacggcgagggacagctgactttgaccggccagctgggggacgtgatgaaagaaagcgctcatctggccattagctggctgcgatcaaatgcaaaaaagtatcaactgactaatgcttttggctctttcgacctgctcgacaacactgatattcaccttcacttcccagctggtgcagtgacaaaggatggccccagcgccggggttaccattgttacttgcctggccagtctgtttagcggcagactggttcgaagtgatgtagccatgacaggggaaattacgctgagggggctggtgcttccggtcggtggaatcaaggataaagttctggcggcccacagagcagggctcaagcaggttataattcctcgccggaatgaaaaggatctggaggggatcccaggcaatgtacgtcaggatctctcattcgtgacagcctcctgcctggacgaggtcctgaatgccgctttcgatggcgggtttaccgttaaaacccgacctggactactcaacagcaagttgtag

SEQ ID NO: 48571 - DNA, 2322 bp, Artificial Sequence
  Description of Artificial Sequence: Synthetic coding sequence
atgagcagccccgccgtggcccggaccagccccggcggcagccgggagatggctcctgccccccaagggcgagggcgtttttgggaagttgggggcggcagtggacataggctggagagggccgccgccgagagcgaaaggtgggaactgctactacgccgcggtgaacttctagccctgggcggtcaccttaaaggcgccctggaggcgtttgccgctgctctcagacgtggggccccggccagacctgagtgccttggcgctcttgtcgattgcctggtctttaactaccggctccgacacggactgggatggagcgccgccccggtcgccggggccgacgggggcgccgggggcctcttacgctgcctgggctgccggggctttctttctgagcccgtgaccgtcccctgcggacactcgtattgccgccgttgtctccgccgggagctcagagcgcgctgtagactgtgcagagatcggctcccacccgcaactgcgagtgctactgacgcggaaggaacggccccccggcccccgccccttgccgccgcaatagctgccagtgacttccgtacatcagtcgtgctgaatcatctggccgagaaatggttccccggccagcgggagagagccagagctgctggcaggctcggtgagttgctgcaccaaggacgctatcgtgaggctctggcagcagcttgtgaagcactaagagccgagccctccgacctaattgtcaagatttaccgggcggaaagctatgccggactacaggaatttaaggctgcaattgaggaccttaacgcagtgctcttccagctgcccgattggcccgaggtttacttccgcaaggggaaggtcctgtgtgacgctggctttcttggcgatgctttgcaattgttcttacagtgtctggcgctggatgaggactttgctcccgccaaactgcaagtgcagaaaatcctctgcgacttgctcctccctgaaaatttaaaagaagggctgaaagagtcatcctggagctctctgccgtgcactaagaatcggccctttgactttcacagcgtgatggaggagagtcagtccctcaacgagccctctccaaaacagtcagaagagatacccgaagtcacatctgagccagtgaaaggaagtctgaatcgggcgcaaagcgcccaaagcataaattctaccgagatgcctgccagagaggactgcctgaagcgcgtctcgtccgaaccagtgctgagcgttcaagaaaagggggtgctgttgaaacgaaagctgagtcttctggagcaagacgtgattgtgaacgaagacggtcggaacaagctgaagaagcagggcgagactccaaatgaggtgtgtatgttttcattagcctacggcgacattcctgaggaacttattgacgtttctgattttgagtgcagtctctgtatgcggcttttcttcgagcccgtcacaactccttgcggtcacagcttctgcaaaaactgtctcgagagatgcctagaccatgctccatattgtccgctctgtaaggagtccctgaaagaatatttggcagaccggcgctactgcgtgacccagctcttggaagaactcatcgtgaagtacctgcctgacgagctgtcggaaagaaagaaaatttacgacgaggaaaccgccgagttgtcccatctcactaagaacgtccccatattcgtgtgcacgatggcctatccaacagtgccatgccctcttcacgtattcgaaccaaggtaccggctgatgattagacggagtatccagacaggcacgaaacagttcggcatgtgcgtgagtgatacccagaacagcttcgcggattatggctgtatgctgcagataagaaatgtgcactttctgcctgatggacgttctgttgtcgacaccgtgggcggtaagagattccgcgtgttaaagcgcggaatgaaggatggctactgcacagcggacatagaatatctcgaagatgtgaaggtcgagaatgaggatgagataaagaatctccgggaactccatgacctggtgtacagtcaggcgtgctcttggtttcagaacctcagagaccggttccggagccaaatcctacagcattttggatcaatgcctgaaagggaagaaaacctgcaggctgcccccaatggccctgcttggtgctggtggctactagctgtgctgccggtggacccccggtatcagctctccgtgctcagcatgaaatcactcaaagagaggctcaccaaaattcaacacattctgacctacttttcgcgggaccagtccaagtag

SEQ ID NO: 48572 - DNA, 2265 bp, Artificial Sequence
  Description of Artificial Sequence: Synthetic coding sequence
atgagccccgagcccgtgcccccccccccccccccccagtgccccggttgcgatcgtgccgagcccattgcgcagcgtttggaagagggcgacgaagcgtttcgggcgggggattatgaaatggctgcagaactcttccgaagcatgctggcaggcttagcgcaacctgaccgcggcctgtgtttgaggctcggtgacgcactagctagagcaggccgcctccccgaagccctgggtgcgtttagaggagcagcccggttgggagctcttaggcctgaagagctggaagagctggccggtggactggtgcgagctgttgggctgcgggatagaccacttagcgcagagaaccccggcggggaacctgaagcacccggtgaggggggacccgctccagaacctcgagcccctcgggacctgctagggtgtcctcgctgccgccgccttctgcataaacctgtgactctgccctgcggccttacagtgtgcaaacgttgtgtcgaaccaggccctgcccggccgcaggtgaggagggtgaatgtggtcctttcaggactccttgagaagtgctttccagctgaatgtcggctgaggagactggcagggcaggctagatcactgcagcgccagcagcaaccagaagcggcactgctccggtgtgatcaggcactggagctcgctcccgacgataattcactgttactgttgcgcgccgagctttatctcaccatgaagaactatgagcaggccttacaggatgcatccgcggcctgccagaacgaacccctccttataaaggggcatcaagtcaaagcacaggcactctccggactgggcagaagcaaagaagtgctgaaggaattcctttactgcctggctcttaacccggagtgcaattcagttaagaaggaagcacaaaaagttatgtgcgaagtgcttttttcagctaccgctaacgttcacgaaaacttgacttcgtcaatacaaagccgcctaaaagcgcagggccacagccacatgaacgctcaggccttattagaggagggcgacgccggcagtagcgagaattcgtcagaaaagagcgacatgctcggcaataccaattcctccgtgctgtactttattttgggattgcattttgaggaggacaaaaaggcccttgaatccattttgccgaccgccccttctgcaggcctcaagaggcagttccctgacgatgtagaggatgcccctgacctgaacgctccaggtaagatacccaagaaagatttgtcattgcagagatcacccaacagcgagacagaagagtctcaagggctctccttagatgtgactgatttcgagtgtgcgctttgtatgcgtttgttgttcgagcctgtcacgacgccatgcggacacaccttttgtctcaagtgtttggagcgctgcctagaccatgccccacattgccctctctgtaaagataagttgagcgaactcttggccagccgcaacttcaatatcaccgtgctggccgaagaactcatcttcagatacctgcccgacgagctttccgacagaaagcgcatctatgatgaggaaatgtctgagttatctaacctcacacgcgatgtcccaatttttgtttgcgcaatggccttcccaactgtaccctgccccctccatgtcttcgaaccacgctacagactgatgatcaggcgctgcatggagacagggaccaaacggttcggaatgtgtctgtccgccgagcatgccggactatctgaatatggatgcatgctggagataaaagatgtcagaacattccctgacggcagttctgtcgtagacgccataggcatcagtagattcagagtactttctcataggcatcgtgatggctacaacacagcggatattgagtatctcgaggacgaaaaagtcgaaggtcctgaatacgaggagctggctgcactccacgactccgtacaccagcaaagtgtcagctggttcgccagccttcaagatcgcatgaaggagcagatcctgtcccattttggtgtgatgcccgatcgggagcccgaacctcagtcgaaccctagtggccctgcgtggtcctggtggatactcgctgtcctgcccctggagaggaaggcacagttagccatcctggggatgaccagtctgaaagagcgcctcctggcgattcggaggattcttgtgatcattactcgcaaaatgaattcgaggcaggaactcgccaatgcccgggagcgcaacaattag

SEQ ID NO: 48573 - DNA, 1536 bp, Artificial Sequence
  Description of Artificial Sequence: Synthetic coding sequence
atgaagaactacgagcaggccctgcaggacgccagcgccgcctgccagaacgagcctttactgatcaaaggccaccaggtaaaagcacaggcacttagcggtctgggccgctcaaaagaagttttgaaggaattcctatactgcctggcactgaatcccgagtgcaacagcgtgaagaaggaagcacagaaggtaatgtgcgaggtactgttcagcgcgacggctaacgttcacgaaaacctgacatctagcatccagtcaagactgaaagcgcaagggcactcccacatgaatgcgcaagcactgctcgaggagggcgacgctgggtcgtcagagaattcctccgaaaagtccgatatgttgggcaataccaactcctctgttctttattttatactgggcctccattttgaagaagacaaaaaggcactggagtccatcctccctaccgccccgtccgccggattaaaaagacagtttccagacgatgtcgaggacgccccagacctgaatgctcctggtaaaattccaaagaaggacctgtctctccagcggagccctaattctgagacagaggaatctcaggggctatctctggacgtcaccgacttcgagtgcgccttgtgcatgcgactgctgttcgagccggttacaactccttgcggacacaccttttgccttaaatgtttggaaaggtgtctagaccacgctccacattgccctctatgtaaagataagctttcggaactgctggcctctcgcaacttcaacatcactgtgttggcagaagagttgatcttccggtatcttcctgacgagctctctgacagaaaacggatttatgatgaggagatgtccgagctgagtaacctgactcgcgacgtgcctatcttcgtgtgcgccatggcttttcctaccgtgccatgccctctgcacgtgttcgagccccgctatagattgatgattagacggtgcatggagacgggaaccaagcgttttgggatgtgtctgtctgcagagcacgctggcctctcagaatacgggtgtatgctggagatcaaggacgttaggacatttccggatgggagcagcgtggtcgacgccattggcatctcaaggttcagagtgttgtcacatagacaccgcgacgggtacaatactgcggatattgagtacttagaagacgagaaagtggaggggcctgagtacgaagaactcgctgctctgcatgactcagttcatcaacagtctgtgtcctggttcgcaagcctccaggatcgcatgaaggagcagatcctatcccacttcggagtcatgcccgatcgggagcctgagccccagtctaacccctccggccctgcatggtcctggtggatcttggccgtcctgccccttgagagaaaagctcagctggccatactgggcatgacttctcttaaggagcgccttctggccattcggcgtatccttgttatcatcacacggaagatgaactcccggcaagagctcgctaacgccagggagagaaacaattag

SEQ ID NO: 48574 - DNA, 2157 bp, Artificial Sequence
  Description of Artificial Sequence: Synthetic coding sequence
atggagagcgtgcggatcgagcagatgctgagcctgcccgccgaggtgtcatcagataatctagagagtgccgaaagaggcgcatcagccgcccaggtggacatgggcccgcatccaaaggtggctgcagaaggtcctgcccctctcccaacccgcgaaccagaacaagagcagtcccccggcacatctacaccagagtcgaaagtgctgctcactcaggccgatgcgctggccagtcgcgggcggattcgtgaagccttggaggtatataggcagctctctgaaaggcagcagttggtggcagaacagctggagcaactggtgcgctgtttggccgaaaaagtgcctcaaggcgaagcactggcccctgcaccacctgatgaaggctctactgcttccggtactgtggctgcagaggaaacaggcgctgccgctgctgccgcagccacggaagtgtgggacgggttcaaatgtaggaaatgccatggctttctaagtgaccctgtatccttgtcatgtggccacaccttctgtaaactgtgtctcgaacgtggccgcgctgcggaccggaggtgtgctctgtgcggggttaagctcagcgcccttatggtggcaactggccgggctagaggcgctagaagagcgggacaacaacctcccccccctctccgggtgaatgttgtgctcagcgggttactgggaaagctctttccaggtccagctcgagcaagtcagttacgtcacgagggcaatcgcctgtacagggaacggcaagtggaagccgcgctgctcaaatataatgaagccgtaaaacttgcaccgaacgaccacttactttactcaaatcggagccaaatttacttcacattggaatcccacgagaatgctctgcacgatgccgaaatcgcctgtaaactgaggccaatgggtttcaaggataatctggagctgccgcactgttcatcccaagaggaggctgccgcgagaggcgacgggagttctctcatggatccggctaaagtaaaaggggatggccaacagcaccatatgaaggaccaggaggaagaagaggagaagtgggacgcgacctcgccaaaagccgccagctccaagaccggcaagtgccaagaaaagaagagaaaacactgccagatcgagagtcaagaggaaactggcatgccaaataaggcttcgaagcaagaccctccgacagatcaaggggacaaacccgcgttgagtttgcccctggcttcgttcgacgctagcgatctcgagtgtgcactgtgtatgaggctgttttacgagccggtaactaccccttgtggccacaccttttgtctcaagtgcctggagcgctgtctggaccataatgccaagtgtccactctgtaaggacggtcttagccaatgtctcgcatcacgcaaatattccaaaaatgtcatcatggaggaattgatcgccaagttcctgcccgaagagctcaaggaacgtcgcaaactttacgaagaggaaatggaggaattgtcaaatcttaataagaatgtgcctatctttgtgtgcacaatggcgtatcctacggtgccatgtcccctgcacatctttgaaccatgttacagactgatgatacgccgttgcatcgagacaggcaccaggcagttcggcatgtgcctgggagacccagtaaagggtttcgctgagtacggttgcatcctcgagatcaggaatgttcagttcttcgccgatggccgatccgttgtggacagcatcggcaagcgccgcttccgggtgctccaccagagtcagcgcgatgggtacaacaccgccgatatcgagtacattgaagatcagaaagttcagggagaagactgcgctgagctgatgggtcttcacaactgcgtgtatcagcaggccagcctgtggttccattctctgaagctctcactgaaaaaccgtatactaaaccacttcggccctatgcccgagaaagacgctgacccacaaatgaacccaaatggcccggcatggtgctggtggatgcttgccgttctgcctctggaatccagagcacaacttcccttcctcgcaatgcggtccctaaaagaccgcctgaacggaatccgtcgagtacttgccttcataagccgaaaccagaactag

SEQ ID NO: 48575 - DNA, 2157 bp, Artificial Sequence
  Description of Artificial Sequence: Synthetic coding sequence
atggagagcgtgcggatcgagcagatgctgagcctgcccgccgaggtgtcatctgacaatttagaaagtgccgaacgaggcgcatctgccgcccaggtggatatgggcccacatcccaaggtggcagccgagggtccagctccactgccaacacgggagcctgagcaggaacagagccctggaacctcaacccctgaatcaaaggtactgttgacccaagctgacgccctggcctctaggggcaggatcagggaggccctggaagtgtataggcagctatcagaaagacagcaactcgttgccgaacagctcgagcaactcgtcagatgtctggctgaaaaggtgcctcagggcgaggcactcgcgcccgcacccccggacgaggggtccaccgctagcggcaccgtggcggctgaggaaactggcgcggcagctgcagccgccgccacagaggtgtgggacggatttaaatgtcggaagtgccacggcttcctctcagacccagttagcctctcttgtggccataccttctgcaaactgtgtctggaacgggggcgagcagctgaccgcaggtgtgcgttatgtggggtaaaactgtcagccctaatggtggctaccgggagggctaggggggctaggcgggccggacagcaacccccacccccactcagagtaaacgtagtgttgagtgggctgctgggcaagctgttccccggtccagccagagccagccagctgaggcacgagggtaacagactgtatcgtgaacgtcaggtggaagctgccctgttgaaatataatgaagcagtcaagctggcgcctaatgatcacctgttgtactctaacagatcgcagatatatttcacgcttgagtcacacgaaaacgcccttcacgacgcagaaattgcatgcaaacttaggcccatggggtttaaggacaaccttgaattgccccattgttcttcgcaagaggaagcggcagccaggggagatggaagctccctgatggatcctgctaaagtgaagggagacggccagcagcaccacatgaaggaccaggaagaagaagaagagaagtgggatgctactagccctaaggccgccagtagcaaaaccggaaagtgtcaagagaagaaacgtaagcattgtcagatcgagtcccaagaggagaccggcatgcctaataaggcgagcaagcaggaccctccgactgatcagggtgacaagccagcccttagtctccctttggcctccttcgatgccagcgacttggagtgtgcactgtgcatgcggctcttctacgagccagtgactacaccatgtgggcacaccttttgtctgaagtgtctcgaacggtgtctagatcataacgcgaagtgtccactatgcaaggatggactctcccagtgcctggccagtaggaagtactcaaagaacgtgattatggaagagttgattgcaaagtttctgccagaagaactcaaagagcggagaaagctctacgaggaggaaatggaggagctgtcgaatctgaataaaaacgtgcccatcttcgtgtgtactatggcctacccgacagttccatgtccactccacatctttgaaccctgttaccgcctcatgatccggcgctgcatcgagactggtacccggcagtttggcatgtgcctgggtgacccagtgaagggatttgctgagtatggctgtatattagagatccggaacgttcagtttttcgcagacgggaggtccgtagttgattcaatcgggaagagacgcttccgagtgttacaccagagtcagcgcgacggatataataccgctgatattgagtacatcgaggatcagaaggtgcagggggaagattgtgcagagctgatgggactgcacaattgtgtgtatcaacaagcttccctctggtttcattccctgaagttgtctctaaaaaatagaatcctaaaccactttggccctatgccggagaaggatgctgacccacaaatgaatccaaacggacctgcatggtgctggtggatgcttgctgtcctccccttagagtcacgcgcccagttacctttcctggcaatgcggagtttaaaggatcgacttaacgggatacggagagttctcgctttcatcagtcggaatcagaattag

SEQ ID NO: 48576 - DNA, 2280 bp, Artificial Sequence
  Description of Artificial Sequence: Synthetic coding sequence
atggagagcgtgcggatcgagcagatgctgagcctgcccgccgaggtgtcttccgataaccttgagagtgcagagcgcggagcgtccgccgctcaggtggacatgggcccccatcccaaagttgccgcagagggtcctgcacctctcccaaccagagagccagagcaggaacagagcccaggtacgtcaacccccgagagcaaggtacttctgacccaagccgacgccctggcgagtcggggccgaattcgcgaggctctggaggtgtaccggcaattatccgaacgccagcaactggttgccgagcagcttgagcagctggtccgctgtctagcagagaaagtgccacaaggcgaagctttagctccggcgccaccagacgagggcagtacagcctcaggtactgtggcggcagaagaaactggagccgccgccgccgccgcagccaccgaggtgtgggacgggtttaagtgtaggaaatgccacggattcctgagtgatccagtatctttgtcatgcggtcacactttttgtaagctctgtctggagaggggacgggccgcggataggcgatgtgcactctgtggcgtcaagctctccgcgctgatggtggccacaggcagggccaggggcgctcgccgggccggccaacagccccccccaccgctgcgcgtgaatgttgtattaagtggactgttagggaagctctttcctggccctgccagggccagccagctaagacacgagggtaatcgactgtatcgtgaaagacaggtggaggccgctcttttgaagtacaatgaggccgtgaaactggctccgaatgatcacctcctgtattctaaccgaagtcagatctacttcaccttggagtcgcacgagaacgctcttcacgacgccgagatcgcctgcaagctgcggccaatgggcttcaaggcgcattttcggaaggctcaggcgctcgccacgctcggtaaggtggaggaagctttacgcgagtttttgtattgtgtttcattagacggaaaaaataagagagcgaggtgtgaggcccaaagagacaatttggaactcccacactgctcttcccaggaagaagccgcggccaggggcgacgggagtagcctgatggatccagcaaaggttaagggagatggacagcaacatcatatgaaggaccaggaggaggaagaggagaagtgggatgcaaccagcccgaaggccgcctcctcaaagaccggtaaatgccaagagaaaaaaagaaaacattgtcagatagagtcccaggaggagactggcatgcctaacaaagcttccaagcaggatccgcccacggaccagggggacaagcctgcactgtccctacccctcgcctcttttgatgcctccgacctcgaatgcgctctttgcatgcgtctcttttatgagccagtgaccactccctgtggccatacgttctgtctcaagtgcctcgagagatgcttggaccacaacgccaagtgtcctctgtgtaaagatgggctgtcacagtgcttggcatcgcgcaaatattcaaaaaacgtgataatggaagaactgatcgccaagtttcttccggaggagctgaaagagagaagaaagctctacgaagaagagatggaagaactgtctaatcttaacaaaaatgttccaattttcgtgtgcacaatggcgtatcctacagtcccctgccccctccacatctttgagccatgctataggctcatgattcggagatgtatcgaaaccggaacacgccagttcggcatgtgtttgggggacccagtcaaggggtttgccgagtacggttgtattctggagatccgtaatgtgcaatttttcgctgatggcaggtcagtggtggactctatcggtaagcggcgctttcgcgtgcttcatcagtcgcagcgcgacggatacaatacagccgatatagagtatatagaggatcagaaggtgcagggggaggattgtgcagaactgatggggctgcacaactgtgtctaccagcaagcctcactgtggttccacagcctcaaactatccttgaaaaacaggatactgaatcacttcggcccaatgcctgaaaaggatgctgatccacagatgaaccccaacggacccgcttggtgctggtggatgcttgcggtgctccccttagaatctagggcacagttgcctttcttggcgatgcggtctctcaaagatcgtctcaacggcataagacgggtgctggccttcatctcccgcaatcaaaattag

SEQ ID NO: 48577 - DNA, 1512 bp, Artificial Sequence
  Description of Artificial Sequence: Synthetic coding sequence
atgggcttcaaggcccacttccggaaggcccaggccctggccaccctggggaaagtggaggaagcactgcgggagtttttgtactgtgtttcccttgatggcaagaacaagcgggccagatgcgaagctcagaggctcctgctttctttcttctctccatctgtccccggggattcacaggagcattcgcctgatattttgaagctattggcgccacacccacgacttaaagagaacgtggaatccatgaccaccgaagtgacatctcacaatctcccgcgcctcctgcaggacaatttggaattgcctcattgctcttcccaggaggaagccgctgccagaggagatggaagttccctcatggatcctgccaaagtaaagggcgacgggcaacagcaccatatgaaggatcaggaggaagaagaagagaagtgggacgctacatcacccaaagcagccagcagcaaaacaggcaagtgccaagagaagaaacgcaaacattgtcagatcgaatcgcaggaggaaacagggatgcccaataaagcctctaaacaggaccctcccactgaccagggggacaaaccagccttatccctcccactggcatcatttgacgcatcggacttagaatgtgctctctgtatgcgcttattttatgagccggttactaccccttgtggccatacgttctgccttaagtgtctggaaaggtgtctggaccacaatgccaagtgcccattgtgcaaggacggcttaagtcagtgtctggcctccaggaagtacagcaagaacgtgataatggaagagttgatcgccaagttcctgccagaagaattaaaggagcgccgaaagctgtacgaggaagagatggaggagctttcaaatttaaacaagaacgtacccatttttgtctgcacaatggcctatccaacagtcccctgccccttacacatcttcgagccgtgctataggttgatgattcggcggtgtatagagacagggaccaggcagttcggtatgtgtcttggagacccagtcaagggattcgccgagtacggatgcattctagaaattagaaatgtacagttcttcgcagacggtcgatccgtggtcgatagtattggcaaacgccgatttagggttctgcaccagtctcagagagacggatacaacactgccgatatagaatacatcgaagaccagaaggtgcagggagaggattgtgcagagctaatggggctccataactgtgtttatcagcaggcatccctttggtttcattcgttgaaacttagcctgaaaaatcgaattttgaatcatttcggacctatgcctgagaaggatgccgatcctcagatgaatcccaacggaccggcttggtgctggtggatgcttgcggtgttacctctggaaagccgtgcacagctgcctttcttggcaatgcggagcctcaaagatcgactgaacggcatcaggcgcgtgctggcatttatctctaggaaccaaaattag

SEQ ID NO: 48578 - DNA, 1578 bp, Artificial Sequence
  Description of Artificial Sequence: Synthetic coding sequence
tgatgcggcgtgaagctgagcgccctgatggtggccaccggccgggctaggggggctcgccgcgcagggcagcagccgcctcctccactccgggtgaacgtggtattgagtgggctgctgggcaaacttttccccggcccagccagggcctcacaattgcggcacgagggaaaccgtctatacagggagcgtcaggttgaggccgccctactgaagtacaacgaagcggtcaagctcgctcctaatgaccaccttctctacagcaacagatcccaaatttacttcactctagaatcccacgagaatgccttacacgatgccgagatcgcttgtaagctgcggcccatgggatttaaagacaacctagagctgccccactgcagtagccaggaggaagccgccgccaggggggacggatctagcctgatggacccagcaaaggtgaagggtgacgggcagcagcatcacatgaaggaccaagaagaggaagaagagaagtgggatgcaacttcaccgaaggccgcatctagcaaaactggtaaatgccaggagaagaaacgcaaacactgtcagattgaatcacaggaggaaacaggtatgccgaacaaagctagtaaacaggatccccccaccgaccagggagataaaccagccctcagccttccactggctagctttgacgcaagtgaccttgagtgcgccctgtgcatgcgtctgttctacgagcctgttactactccctgcggacatactttctgtttaaaatgcctggagcgctgcctcgatcataacgcaaaatgcccactgtgcaaggacggtttgtctcagtgtctcgcctccagaaagtactcaaagaacgtcataatggaggaacttattgctaagttcctgccagaggagctgaaagagcgtaggaaattgtatgaagaagagatggaggaactcagtaacctgaataagaatgtgcccatctttgtgtgtacgatggcctacccgaccgtgccctgccccctccacattttcgagccttgctaccgcctgatgatacggagatgcatcgagaccggtactcggcaatttggcatgtgcctgggcgacccggtgaagggttttgcggagtatgggtgcattctggagattcgcaacgtccagttctttgccgacggcaggtctgtggtggattcgattggtaaacgccgttttagggtcctgcaccagtcccagcgggacggatacaacaccgctgacattgagtatatcgaagatcagaaggtgcagggggaggactgtgcagaactgatgggacttcacaattgcgtttatcagcaagcgagtctgtggtttcacagcctcaagctgtctctgaagaatcggatcctcaaccacttcggtcctatgccagagaaggacgctgatccacagatgaacccaaacgggcctgcttggtgctggtggatgctggccgtactgcccctggaatctagagcccagctgccattcctggcaatgagaagccttaaagatcgactcaatggcattcggagagttctcgcatttatctccaggaatcagaactag

SEQ ID NO: 48579 - DNA, 1389 bp, Artificial Sequence
  Description of Artificial Sequence: Synthetic coding sequence
atgggcgccgccggccgggccacccggctggtgggcggccgggagcagagaggagccgtcggcggtggatggtgggggggagagcccgatatcccctacacacacacgaccgaacacccgcctatgggatcacccctgccaaaccttagggcccacgtcagaacaggtcgacccccagacccgtgcacagctgccgcaagggacagacgtcctctgggccgcggaggccgaggggctgcccagacattcgggcagagaactcgagggggaccacgctgccctggctcccaccggcagaggcccccgagtatgaaggccgcgccacgattgcctcaccggctccgccaccgtggccaacctccagaaccctcctccttacgtgctctacacgcggatccaatcccaagtggactgtcaccaggaccttgcggggccccgcccacgtggagcggtcgtagagcgccaggcgaccgagacaacaggcccacctctgggccttggcagagacacacacgccggagccgggtgtggtcccagagagggccaccgcaaccaaaactggtgtcccgatccggaagggaggatacgagagccggaaggggcgcccagacaggcaaggctcgcgataggaagggcaaaggtacgagagagccggcagagggacggctcggtaagaaacctcaggcaaagccaggacaccaggagaatactgctacaggatcacatcgccaccgctatgaaggcggtccagcagctccacggctcggctccagaacagcccccggcacacaccgggaccccccacatgaaccgggttcacgccatcgggaccctgaggctaccagtgctaccaatcctacccccggtccaagatgctggtttcttgtacacccacctaccctgtccagctctggacgcccagcccgcccccccctgggcatgctgccaatggctaggcaccccaacccagttccaaggaaaagaggctgtaggcaccgatcactcctcttacgcggcgccggaggagagcctgctcgatccggcgctggacacgcacctgacggtacccccggaacggccaccgctagagccgcatcgcaacccctgggcaggagacctggccccgcaggttccagcccagatagcgagggtggcggagccggccacacagtcggagatgagcccccatccgtgcctacagccgaggattcactaaagcgtgagagcgtacgtgacagtagtttctctcccgaaagttccgaggtggatggaggattgtgctccgaactgctttggttccagctggcggccagacggcgcgagatttccaacgtatcccgggaagctcgagccacagtgatcgaaccccggaaatggaggctgcaatag

SEQ ID NO: 48580 - DNA, 495 bp, Artificial Sequence
  Description of Artificial Sequence: Synthetic coding sequence
atgcggccccagccccggggcggcagcggccggaaggagaacaccggagaggaaagggagggaagggccgagcggtaccacgcgatctcagcagacggagagcggaggctacagccggggacagccgtattgacccgccatgtcagcttcttgttcggcggtcgggaggcagaggaacatgttatggaaaccgaccgcgttgagggtgctcgggacggcgacaagcggaaggaagtctgtttcgtgcccatacaggggtcattttgtttcatgcggttgacatgtgctaggctcgtggcagctctcgacatccatgggctgagcttttcactgaggttctgtgggtcgagggacacaaaacacgaagacattaccggcagggagggacaggtcacaccattgccccgtgggactccccagctctgcactgcccgggtgggacttagctcgccaaggacccgggggcagggagtcccgatcagctgtaagacctag

SEQ ID NO: 48581 - DNA, 261 bp, Artificial Sequence
  Description of Artificial Sequence: Synthetic coding sequence
atggtgcggcacccctacagcgtgcagacccagctgagcaccgaggccaaggccatctggcggtctatgcagcagcaagaaactaatttactcgcaaatctgacgaccaacgacgctcgggacaattctaaggatttccagaattcaaaagtcggggccgcagctacctccagagatgaggggtgcaactgtcccattattggcgagatcgtgatctcttgctattggctgtttgaaattccgccattaattagtagatag

SEQ ID NO: 48582 - DNA, 192 bp, Artificial Sequence
  Description of Artificial Sequence: Synthetic coding sequence
cagcagcaggagaccaacctgctggccaacctgaccaccaacgacgcaagagacaattctaaggactttcagaattccaaggttggcgccgccgccacaagccgcgacgagggctgtaactgccctattatcggcgagatcgttatctcgtgttattggctatttgaaatcccaccacttattagcgaatag

SEQ ID NO: 48583 - DNA, 249 bp, Artificial Sequence
  Description of Artificial Sequence: Synthetic coding sequence
atgcagtgcctgtacttcatcctgatcctgaagggctacttccaccagcaacaccatacattactgattaccatcgcgctctgtttcctgcagcagcagcaggaaactaacttattggctaatcttactaccaacgacgctagggacaatagcaaggacttccagaacagtaaggttggagcagcagccaccagccgcgatgaaggtgagactcagaaatgcatccaaaaacctctgcacgagaagtag

SEQ ID NO: 48584 - DNA, 795 bp, Artificial Sequence
  Description of Artificial Sequence: Synthetic coding sequence
atgccccggagcctgaagcgggcccagctgcggagcctgctgcccaggcctccggccgtgagccatactcaaccttggtacagggccgcccacccaacaacgagtcctacggctgcaagtcgagacgtacacccagctagcggagccgtaccagggccgtggctggtggaaggcacagccgttagagaaggaccacagctacaagacgcagtgccccagagacctactagaccgtctaaagccctgtggccagctcagatgagcgcagctcccgctattcggctgggccagatggtgccaggcgacacaagaggtctgtggggacctcagggcaccctactgacctggacttatcggggcggccaaggggggaggtggactagaagggcagaggggccgcgcgaagggacctttgccgagcagcgcccccactttcagtctagcggagcccagcaagaatcacgcctggccatggggccacccccattgggccttggtgatgcggctggcgacggacgaggccagacaggccaggagaaggggcgcgcagagggtcggcaagcgagaaagagcgcctgtaaatgcccccgcaaggggcccaacccaggaccgtggacgcgcgccgctgcctggtggggacggctggagggcgcaaaggcaagcgctaagggagagcaggttagggaccctggcgggcacttgtgggaacagggccacgtgtccccctgcgccaggttcaaccagggccattcatgtgggagcccgaaggtaagccatactacatgggtttcatag

SEQ ID NO: 48585 - DNA, 447 bp, Artificial Sequence
  Description of Artificial Sequence: Synthetic coding sequence
atgggcagcgagcagagcagcgaggccgagagccggcccaacgacttaaacagtagtggccttctttccgggcagacttcccccactaatgctaagctggagaaactcgatagtcagcaagttctccaattgtgcctgcggtatcaggaccacctgcaccagtgcgccgaggccgtggcgtttgatcagaatgctctcgtcaaaagaataaaagaaatggatctgtctgttgaaacactattttcgtttatgcaagaaagacaaaagcggtatgctaagtacgcagagcagatccagaaggttaacgagatgtcagcaatcctgcggagaattcagatgggaatcgatcagacagtacccctgctggaccggttgaatagtatgctcccagagggcgaacgactggagccattctccatgaaaccagaccgcgaactccggttatag

SEQ ID NO: 48586 - DNA, 591 bp, Artificial Sequence
  Description of Artificial Sequence: Synthetic coding sequence
atgggcagcgagcagagcagcgaggccgagagccggcccaacgacttgaacagcagcgtgacccccagccccgcaaaacatagagccaaaatggacgacatcgtggtcgtggcacagggtagtcaggcatcaaggaacgtgagtaatgacccggacgttatcaaattgcaggagatacccacctttcagcctttgctgaagggactgctaagcggtcagactagccccacgaacgccaagctcgagaagctcgatagtcagcaggtcctgcaattgtgtctcagataccaagatcacctacatcagtgcgcagaagcggtcgccttcgaccagaatgccctggtcaagcgcatcaaggagatggatctgagcgtggagactctgttttcctttatgcaggagcggcagaaacgatatgccaagtatgcggaacaaattcagaaagttaatgaaatgtccgctattctgagacgcatacagatggggattgaccagaccgtgcctctgctggatcggctgaactctatgctcccagagggcgagcggctcgagccctttagcatgaaacctgatcgggagctccgcctgtag

SEQ ID NO: 48587 - DNA, 501 bp, Artificial Sequence
  Description of Artificial Sequence: Synthetic coding sequence
atgcagggcacccgggccgagctgagcgcccacagccccagccgggccgccgggaacaggcgacacgagcagggcctgccccccggagcccaggcctgcattactttgactaatcgaacaggtttcttatgccacgaccagaggagctgcattcctgcatctggagtctgtgatggagttcgtacgtgcactcacggtgaagacgaagatgaatccttgtgtagagacgttccacagagccttcctcattttctagtggctcattgcggagacccagcctcctggatctacagcgatcagaaatgtgatgggacaaataactgtggtgattgtagcgatgaactgtcccccgtcacggtttgtcccccatgcggaccaggatggtggagatgcccaagtactttttttaagtactgtgattgcatcccccggcacctctgcagggaccacgtccaacactgtagcgattggtcagacgagtacgcatgccccggcccctag

SEQ ID NO: 48588 - DNA, 489 bp, Artificial Sequence
  Description of Artificial Sequence: Synthetic coding sequence
atgaacaaggtgttcccccagggcgagaacggctacaccgccgccgaatccaaggcccaccctggcggggagggcgctcaggcctgcatcacattgacaaacagaaccggttttctttgccatgaccagcgctcctgcatcccggcgagtggcgtctgtgacggcgtacgtacatgtactcacggagaggacgaggacgagtcactgtgtcgcgacgttcctcagtcactgcctcatttcctcgtggcccactgcggcgacccagcctcttggatctactcagaccagaagtgtgatggcacaaataactgcggagactgttcagatgagctgtccccagtgactgtgtgcccgccgtgcgggcccggatggtggcgatgccccagcacattcttcaagtattgcgattgcataccacgccacctgtgccgtgaccacgttcagcactgtagcgattggagtgatgagtatgcgtgccctggaccctag

SEQ ID NO: 48589 - DNA, 759 bp, Artificial Sequence
  Description of Artificial Sequence: Synthetic coding sequence
atggagggccacgtgtactggaccgacgacgaggtgtgggccatcagacgggcatatctcgatggctcaggggctcagaccttgatcaacacaaaaatcaacgacccagatgacatcgcggtcaattgggtagcgcgatctctgtattggactcacacaggaacagaacacattgaagtgacttgcctcaattccacctcccacaagattctagtaagcgaggatatggacgagccccgagccatcgctctccacccggaaatgggcttgacctattggatagattggggcgagaacccagaaatcaagagagccaatctcgaccggcaggaactgcgggttttggtgaacgccagcttgggatggcccaacgggctcgcgctagacctgcaggagggaaagctctactggggggacgctaagaccgacaaaatcgaggccattagcgtagacgaaaccaaaaggcaaacactgctcaaagataagctccctcacatctttcggtttactcttctgggggactttatctattggaccgcatggcagcaccattccatcaaacgcgtacataaggtgaaagcgaacagagacgttattatcgaccagctgcctgacctcatggggctcaaggctgtgaatgtagacaaggtggtaggcacaaatcctcatgccgaccgcaatggaggggccgctacatgcgcttccagtagacctacgcagcctgggttagcagcgccatcccgcgcctggaactgctag

SEQ ID NO: 48590 - DNA, 759 bp, Artificial Sequence
  Description of Artificial Sequence: Synthetic coding sequence
atggagggccacgtgtactggaccgacgacgaggtgtgggccatcagaagagcttatttagatggaagtggcgcccagaccctgattaacacaaaaataaacgatcccgacgacattgcagtgaattgggtggctcggagcctgtattggactcacaccggtaccgagcatatcgaagttacctgcctgaactctacaagtcataagattctcgtcagtgaggacatggacgaaccacgggcaatcgccttacaccccgaaatgggactgacttactggattgattggggagagaatcccgagatcaagcgggctaacctggacaggcaggaactgcgcgtcctggtcaatgcctctctcggctggcctaacggtctggctttagacctccaagaaggaaaactctactggggggacgccaagacagataaaatcgaagcgatcagtgtagacgaaacaaagcgtcaaacactgttaaaagacaaactgccccacattttcagattcacccttttaggcgactttatctactggacagcttggcaacaccattcgataaaaagggtccataaggttaaggccaaccgggacgtgataattgatcagctgcccgatctcatgggtctgaaggccgtgaacgtggataaggtggtcggaacgaaccctcatgcagaccgcaatggaggtgcagctacctgtgcgagtagtcggcctacgcagccaggactcgctgctcctagccgtgcgtggaactgctag

SEQ ID NO: 48591 - DNA, 675 bp, Artificial Sequence
  Description of Artificial Sequence: Synthetic coding sequence
atggagggccacgtgtactggaccgacgacgaggtgtgggccatccgccgggcttacctagacggcagcggagcccagacactaatcaacacaaagattaatgatcctgacgacatagcggtcaactgggtggctaggagcctgtattggacccacactgggacagagcacattgaggttacatgcctgaactccacaagccacaagatcctggtcagtgaagacatggatgaacccagagccatcgcgctgcatccagaaatgggcttaacctattggatagattggggtgaaaaccccgaaattaagagggcaaatctggatagacaggaactgagagtcctggtgaacgcatccctgggctggcccaacggcctggcccttgacctgcaggagggcaaactctattggggggacgcaaagactgataagatagaggctatttctgtcgatgagaccaaaaggcaaaccctgctgaaagacaagctgcctcacatttttcgcttcactttgttgggcgactttatttattggacggcttggcagcaccactccatcaaacgtgtgcacaaggtgaaggccaatcgggacgttatcatcgaccagctgcccgacttgatgggactcaaggcagtgaatgtggataaggtggtggggcctgggaccgccgagtag

SEQ ID NO: 48592 - DNA, 12 bp, Artificial Sequence
  Description of Artificial Sequence: Synthetic coding sequence
atggagggctag

SEQ ID NO: 48593 - DNA, 1158 bp, Artificial Sequence
  Description of Artificial Sequence: Synthetic coding sequence
atgagcggcagcagcggcaccccctacctgggcagcaagatcagcctgattagcaaagcacagatcagatatgagggtattctctacaccatagacactgataactcaacggtagccctggcgaaggtccgctcattcgggaccgaagatcgacctactgataggccagcacccccgcgggaggaaatctacgagtatattatcttccgcggttcagacattaaggacattacagtgtgcgaaccccccaaggctcaacataccctcccccaggatcccgctatcgtgcagagttccctggggtcagccagcgcctcaccatttcagcctcatgtgccgtactctccatttagaggcatggctccttacggcccattggcggccagctccttgctgtctcagcagtacgcagcctccttgggactcgaaaaattagtcagcccacctgcctcagcggcagcatcttccccctccagttctccgtcgccacagccagtgagtgaactggacctcagcagcgagccacagcaactcacggccaagggaaactcatccctcggggaactgcatgcagtgctgcaaacaatacttagagctcgtggaaaggcagccgaccgcatgacggtcgccgtcgctgaccacctgccatcaccttgctctagacgccgctcaggcaatagaaggacgagaaataggtctaggggccagaatcgaccaacaaacgtgaaggaaaatacaatcaagttcgaaggggatttcgactttgaaagtgcaaatgcccagttcaacagagaagaactggataaggagttcaaaaagaagctgaattttaaagacgataaggccgagaagggcgaggaaaaagacctggccgtagtaacccagtctgccgaagcaccggctgaagaggacttattggggcccaactgctactatgacaagagcaaaagcttttttgataacatttcatcagaactgaagacaagctctagacggaccacatgggctgaggaacgtaagttgaacactgagacctttggcgtgtccggcagattcctgagaggtcgatctagtagaggcggatttagggggggtagagggaatggaacaactcgcaggaaccctacatcacatcgtgctgggaccggaagggtttag

SEQ ID NO: 48594 - DNA, 1158 bp, Artificial Sequence
  Description of Artificial Sequence: Synthetic coding sequence
atgagcggcagcagcggcaccccctacctgggcagcaagatcagcctaatcagcaaagcccagatccgatatgaggggattttatatacaatagacacggacaactccaccgtggcccttgccaaagtgcgaagcttcggcaccgaggatcggcccaccgatcggccagcacctccaagggaggaaatttacgagtacataatctttcgtggatctgacattaaggacattactgtctgtgagcctcctaaggcccaacataccctgccacaggaccctgccattgttcagtcatccctggggagcgcctctgcatctccattccagcctcatgtgccttattcccccttccggggtatggccccctatggacccctggccgcctccagcctgttatcgcagcagtacgctgcgtcactgggtcttggtgcaggctttccgagcatccctgtcggaaagtctcccatggtggaacaggccgtacagacgggctcagcagacaatctgaatgcaaaaaagcttctgcccgggaaaggtaccaccgggactcagctgaatggcaggcaggcccagccctcttcaaagacagcctcagatgtggtgcaaccagctgcagtgcaggcacaaggccaggtcaatgatgaaaataggcggcctcagcgacgccggagcgggaatcgccgcacccggaatcggtcgcgcggtcagaaccgcccaactaacgttaaagagaatactattaaattcgaaggcgattttgactttgaatctgctaacgcccaatttaacagagaagaactcgataaagagtttaagaaaaagttgaattttaaggatgataaagctgaaaagggggaggagaaagatcttgccgtggttactcagtctgctgaggcacctgcagaagaggatctactcggtcctaactgctactacgacaaatcaaagtctttttttgataacatcagctctgaacttaagacctcctcccgcagaaccacatgggctgaggagagaaagctaaataccgaaacctttggcgttagcggccgtttcctccgaggtcgctccagccgtggcggtttccgcggcgggcgcggcaatggcaccactcgacggaatcccacctctcatcgagcaggtacaggacgcgtctag

SEQ ID NO: 48595 - DNA, 672 bp, Artificial Sequence
  Description of Artificial Sequence: Synthetic coding sequence
atgagcggcagcagcggcaccccctacctgggcagcaagatcagcttaatttcaaaggcccaaatcaggtatgagggtattctgtatactatagacaccgataactcaactgtcgcacttgcaaaggtcagaagttttgggactgaggataggcctaccgatcggccagctccccccagagaagagatttacgaatacatcatctttcgagggtctgatatcaaggacataaccgtgtgtgagccccccaaggcccagcatacacttccacaggaccctgctatagtgcaatcttctctgggcagtgcctcagcatctccatttcagccccacgtcccgtatagccccttcagaggtatggctccctacgggccccttgccgcgtcatcgctgctctcccagcagtacgccgccagtctgggcctcggggcaggcttcccttcgatcccagtgggtaaatcgccgatggtcgagcaagccgtccagacgggtagcgcagataacctgaacgccaagaagcttctccccggcaagggaactacaggaacacagcttaatggcaggcaggcccagccctcatctaaaaccgcatcaggaaaccgccggacacggaacaggagccgagggcaaaatcgcccaaccaacgtgaaggagaacaccattaaattttag

SEQ ID NO: 48596 - DNA, 747 bp, Artificial Sequence
  Description of Artificial Sequence: Synthetic coding sequence
atggccccctacggccccctggccgccagcagcctgctgagccagcaatatgcggcctcgttgggactggagaagcttgtctctcctcctgccagcgccgccgcctctagcccttcctctagcccttcaccacaacctgtttctgagcttgacctgagctcagaacctcagcaactgaccgctaagggagcgggatttccaagcattcccgtcggcaaatctcctatggttgagcaggctgtccagaccgggagcgctgataacctgaacgctaaaaagctgctgccaggcaaaggaactactggaacccagttaaatggtcggcaggcgcagccttcctccaagacggcttctgatgtggtccagcccgcggcagttcaggcacagggtcaagtcaatgatgagaacagacggccgcagcggaggcgatcagggaacagacggacacgtaatagatctcgaggacagaatcgtcctacaaatgtgaaagaaaatacaataaagttcgagggtgacttcgacttcgaatcagccaacgcccagttcaatagggaagaactcgataaggagtttaagaagaagttgaattttaaggacgacaaggcagagaaaggagaagagaaggacctggccgtcgttacccagtcagctgaagcaccagctgaggaagatctactgggtccaaattgttactacgacaagtccaaatccttttttgacaacatctctagcgaacttaagacatag

SEQ ID NO: 48597 - DNA, 720 bp, Artificial Sequence
  Description of Artificial Sequence: Synthetic coding sequence
atggccccctacggccccctggccgccagcagcctgctgagccagcagtacgccgcctccctcggattagaaaaactcgtgtccccaccagcgagcgctgccgcatcctccccctcatccagcccatccccacagcccgtaagtgagctggatctgtcatccgaaccccagcaactgaccgctaagggctgcctcttctgcttcagaagcctgtttacctacacacagtcacacattgtcttattcagagtgccaaccggccccggtacactcgaaagagaggagatggaacggggtgccggcttcccatcaatccccgtcggaaagagccctatggtcgagcaagctgtccagacaggctccgccgataatttaaacgcgaagaagctgctgccaggaaaaggcacaacaggaacacaactgaacgggcgacaggctcagccatcatccaagacggcctctgacgttgttcagcctgcagccgtccaagctcaaggccaagttaacgacgagaatagaagacctcagcggagacgatcgggaaatcggcgtactcgcaatcgctcgcgcggacaaaatcgacctaccaacgtcaaagagaatacaattaaatttgagggcgattttgattttgagagtgcaaatgcccagtttaatcgggaggaactggataaggaatttaagaagaggcctattcttctgttggtgttttggacttag

SEQ ID NO: 48598 - DNA, 666 bp, Artificial Sequence
  Description of Artificial Sequence: Synthetic coding sequence
atgagcggcagcagcggcaccccctacctgggcagcaagatcagcctgattagcaaagcccagatcagatatgaaggaatcctgtacaccattgacacggacaatagcactgtagccctcgctaaagtgcgcagtttcggtacagaagatcgccccacagaccgccccgccccaccacgcgaggagatatacgagtacattattttccgaggcagcgatatcaaagatatcactgtctgtgagccaccaaaagcgcagcatactttgccacaggacccagctatcgtgcagagcagcttgggatctgcatcagccagccctttccagcctcacgttccctactctccttttaggggaatggcaccttacggtccgcttgccgcctcaagtctgctctctcaacagtacgcagcatctctcgggctcgaaaagttggtgtctccacccgcctccgcggccgcttcaagcccctcttcttcacccagtcctcagccagtgagtgaactggacctatccagtgagccacagcagcttaccgccaaagggaactctagtctgggcgaattgcacgctgtgctgcagaccattcttcgggcccgtggtaaggctgcagatagaatgaccgtcgctgtggcagaccatctgccctctccttgtagccgatag

SEQ ID NO: 48599 - DNA, 891 bp, Artificial Sequence
  Description of Artificial Sequence: Synthetic coding sequence
atgagcggcagcagcggcaccccctacctgggcagcaagatcagcctgatctctaaggcccaaatccgatacgagggaatcctttacactattgatacagataatagcaccgtcgctctggccaaggtgcggtctttcggaactgaagatagaccaactgaccgccccgccccgccacgggaagaaatttacgaatacattattttccggggatctgacatcaaggacataaccgtttgtgagccacccaaggcccagcatacactgccacaggacccggcgattgtgcaactgaataagagaccggatgagggcgttcgcggtgacggtatggccttcgcagttttgacccggtgcctggtggtgcaatcttctctgggatcggcatctgcctcaccattccagcctcatgtgccatacagtccatttaggggaatggctccttatggccctttggccgcatccagtctcctttcccaacagtatgctgcatccttgggattgggagctggcttcccctcgattcccgtcggcaagtcgcccatggtggagcaggctgtgcagacggggagcgcggataatcttaacgcaaagaagctgttgcctggaaaggggacaactgggacccaactgaacggaaggcaagcgcagccctcaagcaaaacagcttccgacgtggtgcaaccagcagccgtgcaggctcagggtcaggtgaacgacgagaacaggaggccccaaaggagacgcagcggaaaccgacggactagaaaccgtagtaggggtcagaatcggcccaccaatgttaaagaaaacacgataaagtttgagggagattttgacttcgaatctgcaaatgcacaatttaacagagaggagctggataaagagtag

SEQ ID NO: 48600 - DNA, 693 bp, Artificial Sequence
  Description of Artificial Sequence: Synthetic coding sequence
atggccccctacggccccctggccgccagcagcctgctgagccagcagtatgccgcaagcctgggtttggaaaagctagtttctcccccagcatcagctgccgcctcctcgccatctagcagtccgagccctcagcccgtgtctgagcttgacttgagcagcgaaccccagcagctaaccgccaagggctgcctcttttgttttcgcagtctctttacttacacccagagccacatcgttctgtttagggtgccaaccggaccaggtaccctggaaagggaggagatggaaaggggtgcgggcttcccgtctatccccgtcggtaaatcccccatggtagaacaggcagtgcaaaccggtagcgccgataatctgaacgccaagaaactgctgcccgggaagggcactaccggaacccagctgaacggccggcaggcgcaacctagtagcaagactgcttcggatgtcgtacagccggccgcagttcaagcccaaggccaagtgaacgacgagaaccggcgaccccagcgtaggagatctggcaacaggcgtacccggaacaggagccgggggcagaatcgcccaaccaacgtgaaggagaataccattaaatttgaaggggattttgacttcgagtcagcaaacgcacagtttaacagggaagagctagacaaagagttcaaaaagaaatag

SEQ ID NO: 48601 - DNA, 1158 bp, Artificial Sequence
  Description of Artificial Sequence: Synthetic coding sequence
atgagcggcagcagcggcaccccctacctgggcagcaagatcagcctgattagcaaagcacagattcggtatgagggcattctgtacaccatcgacaccgacaactcgactgtggcccttgcaaaggtacgctctttcggcaccgaagacaggccaacagaccgcccggcgcctccgcgggaggaaatctatgagtacattatcttccggggcagcgatataaaggacataacagtgtgtgaaccaccaaaagcccagcataccctccctcaagaccccgcaatcgtacaaagttccctggggagcgcatccgcctcaccttttcagccacatgttccctacagtcctttccgtggcatggcaccctacgggcctttggccgcatccagcctcctgagccaacagtatgctgcatcattaggactgggtgcgggcttcccaagcatcccagtgggcaaatctcccatggtggaacaggcagtgcagactgggagcgctgataacctcaacgcaaagaagctgctgccagggaagggtacaactggcacacaacttaacggtcgccaggctcagcccagtagtaagaccgcaagtgatgtggtacagcctgcggcagttcaagcccagggtcaggtcaacgacgagaataggcgaccccaacgacggcgtagtggcaaccggcgcaccagaaataggtccaggggccagaacagacccacaaatgtcaaagagaatacgataaaattcgaaggcgattttgattttgagtcagctaacgcccagttcaacagagaggagttagataaagaatttaaaaaaaaactgaactttaaggatgacaaagccgaaaaaggtgaggaaaaggatcttgcagtcgtgacacagtctgctgaggctcccgccgaagaggatctgctgggtccaaactgctattacgataaatccaagagcttcttcgataacatcagctctgaacttaagacctcatctagacgaactacatgggccgaggaacgaaaattaaatactgagacattcggggtgtccgggcgttttctgcggggcagatcttcaaggggagggttcaggggcggccgtggtaatggaactactcggcggaacccgacttcacaccgcgccggcacggggagagtgtag

SEQ ID NO: 48602 - DNA, 1428 bp, Artificial Sequence
  Description of Artificial Sequence: Synthetic coding sequence
atgccccaccggaagaagaagcccttcatcgagaagaagaaggccgtcagcttccatctggtccatagaagtcagagagatcccctcgccgcagacgaatctgccccgcagagagtactcctcccaacacagaagattgataacgaggagaggcgcgcggaacagcgaaagtatggagtcttttttgacgacgactacgactacctgcagcacctcaaagaaccaagcgggccctctgagctgattccgtcatccaccttcagcgcccacaatcgtcgcgaggaaaaggaagaaaccctcgtgatcccttcgacaggcatcaagctgccgagttccgttttcgcttctgagtttgaagaggacgtcgggctattaaacaaggctgccccggtctcagggccacgattggactttgatcctgacatcgtagcagctctggacgacgatttcgacttcgacgatcccgataacttgttagaagatgacttcattctgcaggctaataaggcgacgggggaggaagaaggaatggatattcagaagagtgagaacgaagatgacagcgaatgggaggatgtggatgacgaaaaaggcgatagcaatgacgactatgactctgctgggctgctcagcgacgaggattgcatgtcagttccaggtaaaactcaccgagctattgctgatcacttgttctggtcagaggagacaaagtctcggttcactgaatattctatgacaagtagtgttatgagacgaaacgagcagttgacactgcacgatgagcggtttgagaaattttatgaacagtatgacgatgacgagatcggtgcactggataatgcggagctcgagggctcgattcaggtggactcgaatagactgcaggaggtgctgaatgattattataaggagaaagccgaaaactgtgtgaaactgaacactctggaacccctggaggatcaggacctgccgatgaacgaacttgacgaatccgaggaagaagagatgatcacagtcgtactggaagaagccaaagaaaaatgggattgcgaaagcatctgcagtacatactccaacctgtacaaccacccacagctaattaaataccagcctaaacccaagcaaatcaggatctcgagcaaaacgggtataccactgaatgtgctgccaaaaaaaggattaaccgctaagcagacagagagaatccagatgatcaacggtagcgatcttcctaaggtttccacgcagccaagaagcaaaaacgaatctaaagaggacaagcgggcaaggaagcaggctattaaggaagagagaaaggaaagaagggtggagaagaaggccaacaaattagctttcaagttggaaaagaggcgccaagagaaggaattgttgaacctgaagaaaaacgtggaaggtctgaaactgtag

SEQ ID NO: 48603 - DNA, 714 bp, Artificial Sequence
  Description of Artificial Sequence: Synthetic coding sequence
atgaagggcatcctggtggccggcatcaccgccgtgctggtggccgccgtggagtcgctatcctgtgtgcagtgtaatagctgggaaaagagctgcgtgaacagcattgcctctgaatgtcctagccacgctaatacctcatgcattagctcttcagcttccagtagcttggagacgccggtgcggctgtatcaaaacatgttctgtagcgccgagaattgttctgaagagacacacatcaccgcatttacggtgcacgtgtctgcagaagaacattttcatttcgtgtcccagtgttgccaaggaaaggaatgttctaacacttccgatgctttagacccaccactgaagaatgtatcatcaaacgctgaatgtcccgcctgttacgaatccaacgggactagttgccacggtaaaccctggaagtgttatgaagaagagcagtgcgttttcctggtcgccgagttgaagaatgacatagaatctaagtcgctggtgcttaagggatgttctaatgtgagcaacgccacctgccagttcctgagtggtgagaacaaaaccctaggcggggtaatatttaggaaattcgagtgcgccaacgtgaatagcctgacccccaccagcgcacctacgacaagccacaatgtgggctctaaggccagcctgtatttactcgcccttgcttctctcctgctgaggggcctattaccatag

SEQ ID NO: 48604 - DNA, 5622 bp, Artificial Sequence
  Description of Artificial Sequence: Synthetic coding sequence
atgcggaccggctgggccaccccccggcggcccgccggcctgctgatgctattgttctggttcttcgacttggctgagccaagtggccgcgctgcaaatgacccgtttacaattgtgcacggaaacacgggaaaatgcatcaagcctgtctacgggtggatagtcgcagatgattgcgatgaaactgaggataaactttggaagtgggttagtcagcataggctgtttcacctgcattcccagaaatgcctggggttggacattaccaagagtgtgaacgaattgcgcatgttcagttgcgatagctccgccatgttatggtggaaatgtgaacatcactcactgtacggagctgcccggtacaggctagccttaaaggatggacatggcactgccatcagcaatgccagtgacgtgtggaagaaagggggctctgaagaatcgttatgtgaccaaccttatcacgagatctacacacgcgacggcaactcctacggtcggccatgcgaatttccattcctaattgacggcacctggcaccatgattgtatcctggatgaggaccacagcggaccatggtgcgcgacgaccctgaattacgaatacgaccgcaagtgggggatttgcctcaagcctgaaaacggctgtgaggacaactgggagaagaacgaacagttcggtagctgctaccagtttaatacacagacagccttatcatggaaggaggcctacgtgagctgccagaatcaaggggcagatctcttgtccatcaattccgccgcagaactgacctacctcaaagagaaggagggcatagcaaaaatattttggatcgggctcaaccagctttacagcgcacggggctgggagtggtccgaccataagcccttgaattttctgaactgggatcctgacagaccctctgccccaaccatcggaggtagtagttgcgctcgcatggacgccgagagcggactatggcagtctttcagctgcgaagcgcagctcccttatgtgtgtcggaaaccgctgaataacactgtggagctcaccgacgtgtggacttacagcgatactcgctgtgatgcagggtggctccctaataatggattctgctacctgcttgtcaacgagtccaattcatgggacaaggctcatgccaaatgcaaggcattttcttccgacttaatttcaattcacagtctggccgacgtcgaggtggtcgttaccaaattacacaacgaggatatcaaagaggaggtgtggatcgggttaaaaaatataaatattcccacactgttccagtggagtgacggcactgaggtgactctcacctactgggacgaaaatgagcctaatgtaccatataacaagactccaaactgtgtgtcatatctgggtgaactgggccagtggaaggtccagtcctgcgaggagaagctcaagtacgtttgcaagcggaagggggaaaaactcaatgacgcatcttccgacaaaatgtgtccacctgatgagggctggaaaagacacggagaaacatgctacaaaatctatgaggacgaggtaccgtttggcaccaactgtaatctcactatcacctctagatttgaacaagagtacttgaacgacctcatgaaaaaatacgacaagtcacttcggaagtatttttggactggtctgcgagatgtagatagctgcggcgaatataattgggccacggttgggggacgccgtcgggctgttaccttcagcaattggaactttctagagcctgcctcacctggtggatgcgtagccatgtctaccggcaaaagcgtgggcaaatgggaagtgaaggattgcagatccttcaaggctttaagcatttgcaagaaaatgagtggaccgctgggacctgaagaggcttcgccgaaacctgatgacccatgccccgagggctggcagtcttttcctgccagtttgagttgttataaagtgtttcatgctgagcgcatcgtgcggaagcgcaattgggaagaagccgaacgattctgccaggccttgggggctcacctttcttcattctcacatgtggacgagattaaggagttcctccattttctcactgatcagttctccggccagcactggctctggatcggtctaaacaagcggagccccgatttgcaaggctcgtggcagtggtccgaccgcacccctgtttctaccattatcatgcctaatgaattccagcaggattacgacattcgtgattgcgctgcagtgaaggtgttccaccggccttggaggaggggttggcacttttacgatgatcgtgaattcatttacctgcgaccgtttgcctgcgatacaaagctggaatgggtgtgccaaattcccaagggtaggacccccaagacccctgactggtacaatcccgatagagcaggcatccatggacctccactgataatcgaagggtcagaatactggtttgttgccgacctgcatcttaactatgaggaagccgtgctgtactgtgcgtccaaccattctttccttgcaaccattaccagcttcgtggggctgaaggcgattaagaataagatagctaacatatcaggggatgggcaaaaatggtggatcagaattagcgagtggcccattgatgatcacttcacttactctaggtacccctggcatcgttttcccgtgacattcggagaggagtgtctttacatgtccgccaaaacttggcttatcgatcttgggaagcctacagattgctccacgaaactaccatttatttgcgagaagtacaacgtcagttctctggagaagtattcacctgactccgcagctaaagtccaatgttcggagcagtggattcctttccagaacaaatgtttcctcaagatcaagcccgtcagcctgactttttcccaggccagtgatacctgccacagctacggcggaactctacctagcgtgctgtcccagattgaacaggacttcattactagtctcttacccgacatggaggctactctgtggattggactacgctggactgcctacgagaaaataaacaagtggacagacaacagagaactgacctactccaactttcaccctctgttggtaagtgggcgcctgcgtattccagagaacttcttcgaagaagaatctagataccactgcgccttaattctgaaccttcaaaagtccccatttacaggtacttggaattttacaagctgtagtgagcgccattttgttagcctttgccagaaatattctgaagtgaagtctcgacagactctccagaatgcctctgagacagtgaaatatctcaacaacctatacaaaattatcccgaaaaccctgacatggcattcagccaaaagggaatgtctcaagtcaaatatgcagcttgtgtccatcacggacccataccagcaagcttttctttctgtccaggcccttctccacaattcctcactgtggattggacttttctctcaggatgatgagctgaacttcggttggagcgacggtaaacgactgcattttagccggtgggccgagacaaatgggcaactcgaagattgtgtcgtgctggacacggacggcttctggaaaactgtggactgcaatgataaccagcctggagctatttgctactattctggcaacgaaactgagaaggaggttaagccagtcgatagcgtaaaatgcccaagtccagtgctgaacaccccttggattccctttcagaactgctgttataattttatcatcacgaaaaaccgccatatggccacgacccaggatgaggtacataccaagtgtcagaagctcaatcccaagagtcacatcctatctatccgcgacgagaaggaaaacaacttcgtcctggagcaactgctgtatttcaactacatggccagctgggtgatgctggggatcacctaccgtaacaaaagcctcatgtggttcgataaaaccccactgtcatacacacactggagggccggtagaccaacgatcaagaatgagaaatttctggccggcctttccaccgatggtttctgggacatacagaccttcaaagtcattgaagaggcagtctacttccaccagcactccattctggcctgcaagatagagatggtggattataaagaggagtacaataccaccctgccgcagttcatgccctatgaagatgggatctactcggtcatccagaaaaaggtgacatggtatgaggccctgaatatgtgtagccagagcgggggccatttggcgagcgtgcacaaccaaaatggccagctgttcttagaggacatcgttaagcgggatgggtttccgctctgggtcggcttaagcagtcatgacgggagtgaaagcagtttcgagtggtccgatggatctacgttcgactatattccatggaaaggacagacctcccctggcaactgcgtcctgctcgatccaaagggtacatggaagcacgagaagtgtaactctgttaaggacggggcgatttgctacaagcccaccaagagtaagaagttgagtcgtctgacctactcatctcgctgcccagcagccaaggaaaacggctcaagatggatccaatacaaggggcactgttacaagagcgatcaggctcttcactcattctctgaggcaaagaaactgtgctctaaacacgatcactcagctacaatcgtgagcattaaggacgaggatgaaaataagttcgtctccaggctgatgcgcgagaacaataacatcactatgagggtgtggttagggctgagccaacacagtgtggatcagagttggtcctggctggacgggagcgaagttacttttgtgaagtgggaaaacaagtcgaaaagcggggtggggaggtgtagtatgctgattgcgtccaatgaaacttggaaaaaagtggagtgtgaacacggctttggcagggtggtttgtaaagttcccctggactgcccctcaagcacctggattcaattccaggatagttgctacatcttcctgcaggaagctatcaaggtggagtcaatagaagatgtgcgtaaccagtgtaccgaccacggcgccgacatgattagcattcacaacgaagaggagaacgctttcatcctcgataccctgaagaagcagtggaaaggccctgatgacatcctgctggggatgttctatgatacagacgacgcaagttttaagtggttcgacaattccaacatgacctttgacaagtggacagatcaggacgatgacgaagacttagtagatacttgcgctttcttgcacattaagactggcgagtggaagaagggaaattgtgaagtatctagtgtggagggcactttgtgcaaaactgcaatcccatataaaaggaagtacctcagcgacaaccatattctcattagcgcgctggtgattgcctccacagtgatactgaccgttctgggggcaattatctggttcttatacaaaaaacattctgacagtcggttcaccactgtgttctcaaccgctccacaatccccatacaacgaggattgcgtgctcgtcgtaggagaagagaatgaatacccagtccaatttgactag

SEQ ID NO: 48605 - DNA, 5454 bp, Artificial Sequence
  Description of Artificial Sequence: Synthetic coding sequence
atgcggaccggctgggccaccccccggcggcccgccggcctgctgatgctgctcttctggtttttcgatctcgccgaaccctcgggacgggcagccaatgatccttttaccatcgtgcacggtaacactgggaaatgtatcaagcccgtttatggttggatcgttgccgacgattgtgatgaaaccgaagataagttgtggaagtgggtgtctcagcacagactctttcatctgcattctcaaaagtgtctgggcctggatataaccaaatccgtgaatgaactacgcatgttcagctgcgattcctctgcaatgctgtggtggaagtgcgagcaccacagtctatatggagcagcccgctatcgattagccctgaaagatgggcatggcacagcgatatccaatgcttcagatgtctggaagaaaggcggcagtgaggagagcctgtgcgatcagccgtaccacgagatctatacacgggatggcaacagctacgggagaccgtgcgaattcccatttctgattgacggaacctggcaccatgactgtatcctggatgaagatcatagcgggccttggtgcgcgaccactttgaactacgagtacgatcgcaagtggggcatatgcctcaagcccgaaaatggatgcgaggataattgggagaagaacgaacagtttgggagctgttaccaattcaatactcaaactgccctgtcttggaaagaggcctacgtgagctgtcaaaatcagggcgccgatttattatccatcaactccgcagcagagctgacctatttgaaagaaaaagaaggcatagcaaagattttctggatcgggctcaaccaactctatagcgctcggggctgggaatggagcgaccataagccactaaatttcttaaactgggacccagatcgcccatccgcacccacaattgggggatcttcatgcgcccgcatggatgcggaatccggactctggcaatcattctcctgcgaggctcagcttccatatgtttgccgcaagcccctgaataacactgtcgaactgacagatgtgtggacctacagtgacacccgctgcgacgctggttggctgcccaataacggcttttgttatctattggtcaacgaatctaactcctgggataaagcacacgcgaagtgcaaggctttctcgtcagacctgattagcattcacagcctggcagatgtggaagtggtggtaacaaaactccataatgaagacattaaggaagaggtgtggatcggattgaagaatatcaacattcctaccctattccaatggtctgatggaacagaggtgacactgacctattgggatgaaaacgagcccaacgtcccctacaataagacgccgaactgcgtgtcgtacctaggcgagcttggacagtggaaggtgcagtcttgcgaggaaaagctgaaatacgtctgtaagcggaaaggcgagaagcttaatgatgctagctctgacaagatgtgtcctcctgacgaaggttggaagaggcacggcgagacttgttacaagatttacgaagacgaggttcctttcgggaccaattgtaacttaacaataacctctcggttcgagcaagaatatctgaacgacctaatgaagaagtacgacaagtcgctgcgtaaatatttttggacaggtctacgggatgtggactcctgcggcgagtataactgggctacagtgggaggaaggcgcagagcggttaccttttctaactggaactttcttgagccagcctcacccgggggatgcgtggccatgagcaccgggaagtcagtagggaagtgggaggttaaagattgcagatcatttaaggctctttcaatctgtaaaaagatgagcggccctctcggacctgaggaggcctcaccaaagccagacgacccctgtcccgaaggctggcagtcttttccggccagcctgagttgctacaaagtcttccatgctgaaaggattgtgcggaaacgtaattgggaggaagctgaacgcttctgccaagcactgggcgcgcacttgtcttcgtttagtcacgtggatgaaattaaagaattcctgcactttctgaccgaccagtttagcggccagcactggctgtggatcggcttaaataaaaggtcccctgatttgcagggcagctggcagtggtccgatcgcactccggtgagtaccattattatgcccaatgagttccagcaggactacgatatccgcgactgcgccgctgtgaaggtgttccacagaccttggcgacgcggatggcacttctacgatgatagagagttcatataccttcggcccttcgcgtgcgatactaaactagagtgggtctgccagataccaaaaggccggacccccaagacccctgattggtataacccagaccgagcggggatccacggcccccctctgatcattgagggatctgagtattggttcgtggcagatctacatctgaactacgaggaagcggtcctttactgcgcctctaaccattccttcctggccacgataacctctttcgtgggcctcaaggccattaaaaataaaatagctaatatttcgggagatgggcaaaaatggtggattcggattagcgagtggccaatcgacgaccatttcacatattctcgatatccctggcacagatttccggtcacatttggagaggaatgcctctacatgtcggctaaaacttggctgatcgatttaggtaaacccaccgactgctccactaagctcccatttatttgcgaaaaatacaacgttagcagcctcgagaagtatagcccagacagcgcagcaaaggtgcagtgttccgagcaatggatcccttttcagaacaagtgctttttaaagattaaacctgtgagcctcactttttcgcaggctagtgacacttgccatagctacggcggaacacttccttcggtgctctcccaaatagagcaggatttcatcaccagtctattgccagatatggaagcaacattatggatcgggctgaggtggacggcttatgagaaaatcaacaaatggacggacaatagggaactgacatactctaactttcatccgcttctggtttcggggagactgcgcatccctgagaatttcttcgaggaagagtccaggtaccattgtgcactgatcttgaacctgcagaaatccccatttactggcacatggaattttacgtcttgttctgaacgtcatttcgtgagcctgtgccaaaagtattctgaagtgaaatcacgccagacactgcagaacgcaagtgaaactgttaagtacctgaataatctgtataagattatcccaaaaaccttgacctggcacagtgctaagcgggagtgtttaaaaagtaacatgcagctggtctctattacagatccgtatcaacaggctttcctgtcagtgcaggcgctccttcacaatagttctctgtggatcggcctgttctcccaggatgatgagctgaattttggatggtcagacggaaagcgcctccacttctcccggtgggccgagactaacgggcaactcgaagactgtgtggtgcttgatacggacggcttctggaagaccgtggattgcaatgataaccagcctggagccatctgttactatagcggaaacgagactgaaaaggaggttaaaccagtggactccgtgaagtgcccttcacccgttctcaacactccctggatccctttccaaaattgctgctacaattttattataaccaagaaccgccacatggcaaccacacaagacgaggtacataccaaatgccaaaagttaaaccctaaatcccacatcctgtctattagagatgagaaagaaaacaacttcgttctggaacagttactgtacttcaattatatggctagttgggtgatgctgggaatcacctatagaaataaatctctcatgtggttcgacaagacacctctgtcatacacacattggcgcgctggcaggccgaccattaagaacgagaagtttttagcaggactgtcaactgatggcttctgggacatacagacattcaaagttattgaggaggctgtgtacttccaccagcatagcatcctcgcttgtaaaatcgagatggttgactacaaagaagagtacaataccaccctgccccagttcatgccatacgaagacggaatctattctgtcatccagaaaaaggtgacatggtatgaagcattaaacatgtgtagtcagtccggtggacacctcgcctcagtgcacaatcagaacgggcagctgtttctggaggacattgtcaaacgggacggcttcccactgtgggtggggctgtcgagtcatgacgggtctgaatcgagtttcgaatggtctgacgggtccacatttgattacatcccctggaagggacaaaccagtcctggcaattgcgtgttgctagacccaaaaggtacatggaaacatgagaagtgtaattctgtaaaagatggtgccatttgttataaacctactaagagtaagaagctgtcacgattgacatactcctctagatgcccagccgccaaagaaaacgggtcaagatggatacaatacaaaggccattgctacaagtctgaccaggccctccacagcttttcggaggccaaaaagctttgttccaaacacgaccacagcgcaactatcgtgtccatcaaagatgaagatgaaaacaaattcgtttcaagactgatgcgggagaataacaacatcactatgcgggtttggttgggtctgagccagcactccgtggattgcccatcttcaacttggatacagttccaggattcctgctatatattcctgcaggaagcgatcaaggtggagtccatcgaagacgtacgaaaccagtgtacggaccatggcgccgacatgatctctattcataatgaagaagaaaacgcatttatcctggacacactgaagaagcagtggaaaggcccagacgacattttattggggatgttttatgatacggacgacgcctcttttaaatggtttgacaactctaatatgacctttgacaagtggacagaccaggacgatgacgaagacttggtggacacctgcgcttttttgcatataaaaacgggcgaatggaagaaaggaaactgtgaggtatcatcagttgaggggacactctgtaagaccgccatcccttacaagcggaagtacctatcagataaccacatccttatctccgcattagtgatcgctagtaccgtgattttaaccgtactgggagcgatcatctggttcctttacaaaaaacacagtgattccaggttcaccacagtcttttcgacggcccctcagtccccttacaatgaggattgcgtgttggtggtgggcgaggagaatgagtatcccgtccagtttgactag

SEQ ID NO: 48606 - DNA, 498 bp, Artificial Sequence
  Description of Artificial Sequence: Synthetic coding sequence
atggccctgctggccctgctgctggtggtggccctgccccgggtgtggactgacgctaatctaacagccagacagcgcgacccagaagatagccagaggaccgatgagggcgataacagggtctggtgtcacgtgtgtgaaagggagaatacgttcgaatgtcagaatccacgcaggtgcaagtggactgaaccgtattgcgtcatcgcggctgtgaagatttttccacgcttcttcatggtcgctaaacagtgttcagccggctgtgccgccatggaaagacctaagccagaagaaaaacggtttctactggaggagcctatgccctttttctacctgaagtgctgtaaaatcagatattgtaaccttgaggggcctcccatcaatagttccgtattcaaggaatacgccggttctatgggagagtcctgcggcggactctggctggcgatcctgcttctcctggcttccattgcagcagggctcagccttagctag

SEQ ID NO: 48607 - DNA, 639 bp, Artificial Sequence
  Description of Artificial Sequence: Synthetic coding sequence
gacttcggctactgcccccgggtgtactgcgagaaccagcccatgctgcccatcggagtgttggtcatggtaggatttaccgttggaaaagtccccgttccagacatccggacttgtcatttctgccttgtggaggacccctccgtaggatgcattagcgggtcagagaagtgcactattagtagctcttctttgtgtatggtgatcacaatttactatgatgtcaaggttagatttatagtgcgtgggtgcgggcagtatatcagctatagatgtcaagaaaagagaaatacctatttcgcggagtattggtaccaggcccagtgctgccagtacgattattgcaatagctggagttccccccaactgcagtcttccctgcccgagccgcatgatcgcccactcgcactgcctctctcagacagtcagattcagtggttttaccaggcactcaatctcagtctgcctctacccaactttcatgccggcaccgaacccgacggcctggatccaatggtaaccctgagcctcaacttgggactgagctttgccgaactgtgcaggatgtatctgttcctgaactcatcggggctgttggtgctgccacaagctgggctcttaaccccacatccctcgtag

SEQ ID NO: 48608 - DNA, 639 bp, Artificial Sequence
  Description of Artificial Sequence: Synthetic coding sequence
gacttcggctactgcccccgggtgtactgcgagaaccagcccatgcttccaattggtgtgctggtgatggttggcttcacagtcggaaaggtgcctgtgccagatatccggacatgtcacttttgtttggttgaggatccgtccgtgggttgtatctccggctctgaaaagtgtactatctcctctagtagcttgtgcatggtcatcactatctactacgacgtgaaggtacggttcattgtccgcggatgcggacagtatatctcttatcggtgccaggaaaaacgaaatacatactttgcagaatactggtatcaggcacagtgttgtcagtacgactactgcaattcctggtcatcaccgcagctacagtcctcactcccagagccgcacgatagacccttggcactgcccctttccgattcacaaattcagtggttctaccaggcgctgaacctaagtctgcctctgccaaatttccatgccggcactgagcctgacggcctggatcccatggtgacattgtccctcaatctgggcctatcttttgctgagctcaggcggatgtacctattcttgaatagcagtgggctgttagtactgccacaggctggcctcttgactccacacccgagttag

SEQ ID NO: 48609 - DNA, 687 bp, Artificial Sequence
  Description of Artificial Sequence: Synthetic coding sequence
atgagcagcagcgaggaggtgagctggatcagctggttctgcggcctgcgcgggaatgaatttttctgcgaggtggacgaggactatatccaggacaagttcaatcttaccggcctgaatgagcaagtgcctcattataggcaagctctggatatgattctggatctagagcctgacgaagaactggaagataatccgaaccagagtgacctcatcgaacaggctgccgaaatgctctatggactaattcacgctaggtatatcctgacaaatagaggtatagcccagatgttagaaaaataccagcagggtgattttggttattgcccccgtgtgtattgcgagaaccagccgatgttgccgatcggcctgtctgatatccccggggaggccatggttaaactgtactgcccaaaatgcatggacgtctatactcccaagagttcaaggcatcaccatacagatggggcctactttggaacaggcttccctcatatgctctttatggtgcaccctgagtaccggcctaaacgtccagctaatcaatttgtgccatctagctgttccagacaccctgatgttcctctgttgcccagacgtcggcctttctgcagaatgcattttcggttgcgcgaggtataccatcagcaactcataccagtgcacggcgatcatcatctattgtag

SEQ ID NO: 48610 - DNA, 639 bp, Artificial Sequence
  Description of Artificial Sequence: Synthetic coding sequence
gacttcggctactgcccccgggtgtactgcgagaaccagcccatgttgcctatcggtgtgctagtgatggtgggtttcaccgtaggcaaagtccccgtgcctgatatcaggacatgtcacttctgtctggtagaagatcccagcgtcgggtgtataagcggaagcgagaaatgcaccatcagctcatctagtctctgtatggtgatcacaatctactacgatgttaaggtgcggtttatcgtccgaggatgcggccagtacatctcatataggtgtcaggaaaaacggaacacgtattttgctgaatactggtaccaggcccagtgttgtcaatacgactattgtaactcctggagctctccccaattgcagagctctctccctgagccacacgaccggcccctggccctgcctctgtctgattcgcaaatccagtggttctatcaggccctcaatttgagtctgccgctgccaaattttcatgcaggcactgaacccgacggcctcgatcccatggtgacactgtctttgaacctgggactatcattcgccgagcttcgccgaatgtatttgttcttgaattctagcggtctactcgtattgccccaggccggcctcctgactccccaccccagctag

SEQ ID NO: 48611 - DNA, 639 bp, Artificial Sequence
  Description of Artificial Sequence: Synthetic coding sequence
gacttcggctactgcccccgggtgtactgcgagaaccagcccatgctgcctattggtgtgctcgtgatggttggctttaccgttgggaaggttcctgttcccgatattaggacatgccacttttgcctggtagaggatccgagcgtgggctgcatctcgggtagcgaaaagtgtacaatctccagctcttcactatgtatggtgatcacaatctactacgatgtaaaggtgcgctttattgtacggggctgtggacagtatatctcctaccggtgtcaggaaaagcggaacacatacttcgcggagtattggtaccaggcccagtgttgtcagtatgactactgcaattcgtggtccagtccccagttgcagagttctcttcccgagccacacgaccgccccctggctctgcctctcagcgactcacaaatccagtggttctaccaggctcttaacttatcccttccactacctaatttccatgccggtacagagccagatggcctagatcccatggtaaccctgagcctgaacctgggacttagcttcgcagagctctgcagaatgtatttattcctgaacagttccggtctacttgtgttaccccaggctggtctccttacacctcacccgtcgtag

SEQ ID NO: 48612 - DNA, 687 bp, Artificial Sequence
  Description of Artificial Sequence: Synthetic coding sequence
atgagcagcagcgaggaggtgagctggatcagctggttctgcggcctgaggggtaacgagtttttctgtgaagtcgatgaggattacattcaagataaattcaacctgactggactcaatgagcaggtgcctcattaccgccaagctctcgacatgatactggatctcgagccagatgaggagctggaggacaatcctaatcagtccgatttgatcgagcaggcagctgagatgctctacggtctgattcatgccaggtatatactgacaaatagaggaatcgcccaaatgcttgagaagtatcaacagggagatttcgggtactgtccacgggtctactgcgagaatcagccaatgctcccaattggactgagcgatattccaggcgaagcgatggtgaagctgtactgtcccaagtgcatggacgtgtacacccctaagagctctaggcaccatcacacagatggtgcatatttcggtacgggattcccccatatgctgtttatggtccaccctgagtatcgacccaagcgtcccgctaaccaatttgtgccaagcagctgctcccggcacccagacgtcccactcctccctaggagacggccattttgccgcatgcattttaggctccgggaggtttatcatcagcagcttatacccgtacacggtgatcatcaccttctatag

SEQ ID NO: 48613 - DNA, 606 bp, Artificial Sequence
  Description of Artificial Sequence: Synthetic coding sequence
atgaaggtgcacatgctggtgggcgtgctggtgatggtgggcttcaccgtggggaaagtcccagttccagatatcaggacgtgtcacttctgcctcgtggaggaccccagcgtggggtgtatctcagggtccgaaaaatgtaccattagctcttcatctttgtgcatggtgattacgatttactacgatgtgaaagtcaggtttatagttcgaggatgtgggcagtatattagctacagatgtcaagagaagcggaacacgtatttcgcagaatattggtatcaagcacaatgttgccagtacgactactgtaactcctggtcatccccacagctacagagctcactgcccgagccacacgatcgcccgcttgccctgccactgagtgattcccaaatacagtggttttaccaagcactgaacctcagtctccccttgccaaatttccatgctgggacggagccagatggcctcgaccctatggttaccctcagcctcaatttgggccttagcttcgctgaactttgccgaatgtacctatttctcaatagcagcgggctcctggtgctgccccaggccgggttgctgaccccacatccatcctag

SEQ ID NO: 48614 - DNA, 606 bp, Artificial Sequence
  Description of Artificial Sequence: Synthetic coding sequence
atgaaggtgcacatgctggtgggcgtgctggtgatggtgggcttcacagtgggaaaggtgccagttcccgatattcggacatgccacttctgcttggtcgaggacccgtctgttgggtgtatcagcgggagtgaaaaatgtaccataagcagctcttcactctgtatggtcatcaccatttactatgatgtaaaggtcaggttcatcgtaaggggatgtggacagtacatctcttataggtgtcaggaaaagagaaatacctactttgcagagtactggtaccaggcgcaatgctgtcagtacgattactgtaactcctggtcttctccacagctgcagtcttctctgccggaacctcatgacagaccccttgctttaccactgagcgattcacagatccagtggttttatcaggcattgaatctctcgttgccattgccaaacttccatgcaggcacggaacccgacggcctcgacccgatggtcacactgagtttaaatctgggtctctccttcgccgagctttgtcggatgtatctttttctgaacagtagcggcctactggttctgccacaggccggactcctgactccacacccatcttag

SEQ ID NO: 48615 - DNA, 303 bp, Artificial Sequence
  Description of Artificial Sequence: Synthetic coding sequence
atgggcaccagcagcatcttcctgtgcgtgctgttcctgtgcggcgctctcgggctgaccatgagcccagccagggggcgcctcagatgttatatctgcggatttaccaagccttgccaccctgtgcctactgaatgcagagatgacgaggcatgcgggatctcaataggaacctccggccgcacactagttcagtggccctttagccggcgattgcccacgagcattcacccagctttccccgtcgcaccagcttccgcctgcctctttcatcccacggaccaaagcgagataaccgagtag

SEQ ID NO: 48616 - DNA, 378 bp, Artificial Sequence
  Description of Artificial Sequence: Synthetic coding sequence
atgggcaccagcagcatcttcctgtgcgtgctgttcctgtgcggcgctttagggctgaccatgtcccctgctagagggagactccgatgctatatctgcgggtttaccaaaccatgtcatcctgtgcccacggaatgtcgcgatgacgaagcctgcggaatatcaatcggtacgagtggaaagagctgcctttcaagggcccagtgtccgcttccaggttacgctacatactggctgcactcttatacactctggcatcactgttgtgagcaggacttatgcaatattgctgccagtccccagcagttgacatctctccttgcctcccttccattgttcgtggcctcctttgctgggcggggccacctgttgcactag

SEQ ID NO: 48617 - DNA, 303 bp, Artificial Sequence
  Description of Artificial Sequence: Synthetic coding sequence
atgggcaccagcagcatcttcctgtgcgtgctgttcctgtgcggcgctctgggcctgaccatgtcgccggcgagaggaagactgcgctgttatatatgcggctttacaaagccctgtcatcctgtcccaaccgagtgcagggacgatgaagcatgtgggatcagcattgggacaagtggaagaaccctcgtacagtggcccttttctcggcggttgcctacctcaatccatccagctttccctgtagcgcccgcttcagcatgtctgtttcaccctaccgaccagtctgaaatcacagaatag

SEQ ID NO: 48618 - DNA, 201 bp, Artificial Sequence
  Description of Artificial Sequence: Synthetic coding sequence
atgggcaccagcagcatcttcctgtgcgtgctgttcctgtgcggcgcccttggactcaccatgtctccagctcgcgggcggctgaggtgttatatctgcggctttacaaagccctgtcaccccgtccctacagaatgcagagacgatgaggcctgcgggataagcatcggcaccagcgaccagagtgaaatcaccgagtag

SEQ ID NO: 48619 - DNA, 201 bp, Artificial Sequence
  Description of Artificial Sequence: Synthetic coding sequence
atgggcaccagcagcatcttcctgtgcgtgctgttcctgtgcggcgccttgggtctgacaatgagtcccgcccgcggtcgcctgcgatgctatatatgtggcttcacaaaaccatgccatcccgtaccaactgagtgccgcgacgatgaagcctgcggtataagcattggcacctctgatcagtctgagattacagagtag

SEQ ID NO: 48620 - DNA, 201 bp, Artificial Sequence
  Description of Artificial Sequence: Synthetic coding sequence
atgggcaccagcagcatcttcctgtgcgtgctgttcctgtgcggcgcactaggcctgaccatgtcccctgccagagggcgccttagatgctatatctgcggattcacaaaaccttgtcatcctgtgcccactgaatgcagggatgatgaggcgtgtgggatctcaattggaacctctgaccagagtgagatcacagagtag

SEQ ID NO: 48621 - DNA, 303 bp, Artificial Sequence
  Description of Artificial Sequence: Synthetic coding sequence
atgggcaccagcagcatcttcctgtgcgtgctgttcctgtgcggcgccctcggtctcaccatgagcccagcccgcgggaggttgcgctgctatatatgtggctttacgaaaccatgccaccccgtgcctacagaatgcagagacgatgaggcctgcggcatctcaattggaacctctggacgcacgctcgtgcagtggcccttcagcagacgcctgccaacctcaatccaccccgcttttccggtagccccagccagtgcttgcctttttcatcctaccgaccaaagtgagatcacagagtag

SEQ ID NO: 48622 - DNA, 303 bp, Artificial Sequence
  Description of Artificial Sequence: Synthetic coding sequence
atgggcaccagcagcatcttcctgtgcgtgctgttcctgtgcggcgccctcggcctgaccatgagtcccgcacgcggtcgcttgaggtgctatatctgcggattcactaagccatgccatccagtccccactgagtgtagagacgatgaggcatgtggcattagcattggaactagcgggcgaacactggtgcaatggccgtttagtcgaagattgccgacatcaatccacccggcattcccagtggcccctgcctcggcgtgtctgtttcacccgactgaccagagcgagattactgaatag

SEQ ID NO: 48623 - DNA, 201 bp, Artificial Sequence
  Description of Artificial Sequence: Synthetic coding sequence
atgggcaccagcagcatcttcctgtgcgtgctgttcctgtgcggcgccctgggcctcacgatgtcccctgcccggggcaggctgaggtgttacatctgtggcttcacaaagccatgccaccctgtacccaccgagtgtagggatgacgaagcctgtggcattagcattggcaccagcgaccagtccgaaatcactgaatag

SEQ ID NO: 48624 - DNA, 201 bp, Artificial Sequence
  Description of Artificial Sequence: Synthetic coding sequence
atgggcaccagcagcatcttcctgtgcgtgctgttcctgtgcggcgcactcggcctgacaatgagcccagcacggggccgcctgcggtgttacatttgtggattcacaaaaccttgtcatcccgtgccaactgaatgcagggatgatgaggcatgcggcatatccataggcaccagtgatcagagtgaaatcaccgaatag

SEQ ID NO: 48625 - DNA, 303 bp, Artificial Sequence
  Description of Artificial Sequence: Synthetic coding sequence
atgggcaccagcagcatcttcctgtgcgtgctgttcctgtgcggcgctcttggactaaccatgagcccagcccggggaagacttagatgttacatttgcggttttactaagccttgccatcccgtgcctacagaatgccgggacgacgaggcatgcggtatcagcatcggtacctcaggacggacactcgtccaatggcccttctctagaaggctccctacatcaatccaccccgcatttcccgtcgcccctgcgtccgcctgcctattccatcccaccgaccaaagtgagattacagagtag

SEQ ID NO: 48626 - DNA, 201 bp, Artificial Sequence
  Description of Artificial Sequence: Synthetic coding sequence
atgggcaccagcagcatcttcctgtgcgtgctgttcctgtgcggcgccctgggcttgactatgagcccggcgcgcggaaggctgaggtgttatatatgcggttttaccaaaccttgccacccagtgcctacggagtgccgtgatgacgaggcttgcggcatttcaataggaacaagcgaccagtctgagattactgaatag

SEQ ID NO: 48627 - DNA, 303 bp, Artificial Sequence
  Description of Artificial Sequence: Synthetic coding sequence
atgggcaccagcagcatcttcctgtgcgtgctgttcctgtgcggcgcccttggacttacgatgtccccagcccgtggtcgtctcaggtgctacatttgcggctttacaaaaccttgccatccagtgcccaccgagtgccgggacgatgaagcatgtgggatcagcattgggacatcaggccgtaccctggtgcaatggcccttctctcgcagattgcccacatctatccaccccgcttttcccgtcgcacctgcgtccgcctgcctctttcatccgaccgatcaaagtgagataacagaatag

SEQ ID NO: 48628 - DNA, 387 bp, Artificial Sequence
  Description of Artificial Sequence: Synthetic coding sequence
atgggcaccagcagcatcttcctgtgcgtgctgttcctgtgcggcgccttaggcctaacaatgtctcccgcccgagggcgactccggtgctatatttgtggcttcacaaagccatgccacccagttcctacagagtgccgggacgacgaggcttgcggcatttccattgggacctctgtgaaaaaactcccactgaaaggacccgtaccatcagcccgcctgtgccatctgttagctgccttactccactccgtcgcccccctgttgagggccggcccagtacagcacagcaggttccccaccgccgctcaccagccgcctcggctgccggcccctctgtgcggccagctccgatgggagcgaacccccccacctttagcgtcatag

SEQ ID NO: 48629 - DNA, 378 bp, Artificial Sequence
  Description of Artificial Sequence: Synthetic coding sequence
atgggcaccagcagcatcttcctgtgcgtgctgttcctgtgcggcgccttagggctcaccatgagcccagcccgcggcagacttcggtgctacatttgcgggtttacgaagccatgtcaccccgtaccaacggagtgtagggacgacgaagcctgtggcatctccatcggcacaagtggcaagagttgcttgtcccgggcccagtgtccattacctggctacgctacatactggctgcactcttacaccctttggcaccattgctgcgagcaggacctctgtaatattgctgcttctcctcaacaactgaccagcctgctggcctctctgcctttatttgtcgcatcatttgccggtagaggccatttgcttcattag

SEQ ID NO: 48630 - DNA, 378 bp, Artificial Sequence
  Description of Artificial Sequence: Synthetic coding sequence
atgggcaccagcagcatcttcctgtgcgtgctgttcctgtgcggcgcgctgggtctaaccatgtcccccgcacgtggccggctccggtgctatatttgtggtttcaccaagccctgtcatccggttccaacagaatgccgagacgatgaagcctgcggcatctctatcggcaccagtggtaagtcttgcttatctagagcccagtgtcctctgcccggttacgctacctattggctgcacagctatacactgtggcaccactgttgcgagcaggatttgtgtaatattgccgcttccccccaacagctgacatctctactggccagcttgccactgtttgttgcctcctttgctgggcggggtcacctcctgcattag

SEQ ID NO: 48631 - DNA, 378 bp, Artificial Sequence
  Description of Artificial Sequence: Synthetic coding sequence
atgggcaccagcagcatcttcctgtgcgtgctgttcctgtgcggcgcgctaggattgacaatgtcgcctgcccggggtcggctgcgatgttatatttgtgggttcaccaagccatgccaccctgtgcctactgagtgtagagatgatgaggcttgtgggatctcaattggaacatcggggaaatcttgtctgagtagagcccagtgtcccctccccggatacgccacttactggctgcattcctataccctgtggcaccactgctgcgagcaggacctctgcaatatagccgcctcccctcagcagctcacctccctcctcgcaagtctccctcttttcgtagcgtcgtttgctgggcgtggacatctcctccattag

SEQ ID NO: 48632 - DNA, 378 bp, Artificial Sequence
  Description of Artificial Sequence: Synthetic coding sequence
atgggcaccagcagcatcttcctgtgcgtgctgttcctgtgcggcgcattaggcctgactatgtcccccgctcgggggcgcctccgctgttacatctgtggtttcactaaaccatgtcatcccgttcccacagagtgtagggacgacgaggcttgcggaattagcattggaacaagtggtaagtcttgcttatcccgggcgcaatgccccctgccagggtacgccacgtattggctgcattcctacaccttgtggcaccactgctgcgagcaggacttatgcaatattgcggcctccccccagcaactcacaagtttattggcatcactgccattatttgtggcctcctttgcagggaggggacacctgttgcactag

SEQ ID NO: 48633 - DNA, 378 bp, Artificial Sequence
  Description of Artificial Sequence: Synthetic coding sequence
atgggcaccagcagcatcttcctgtgcgtgctgttcctgtgcggcgccttaggacttacaatgtcacccgcccgggggcgccttagatgttatatttgcggcttcaccaagccctgtcaccctgtccctacggagtgccgggacgacgaggcctgcgggatcagcattggcacttctggtaaatcctgcctgtctagagcacagtgtcctctgcctggctatgcaacatattggcttcactcctacacactgtggcaccattgctgcgaacaagacctatgcaacattgcagcctcacctcaacagctaacttctctcttagcatccctgcccctgtttgtcgcctctttcgcggggcgaggccacctgctgcactag

SEQ ID NO: 48634 - DNA, 378 bp, Artificial Sequence
  Description of Artificial Sequence: Synthetic coding sequence
atgggcaccagcagcatcttcctgtgcgtgctgttcctgtgcggcgcactgggtctgacaatgtcacctgctcgcggcagattgaggtgctatatttgtggcttcactaagccatgtcaccccgttccaactgagtgcagagacgacgaggcatgtggaatatcaatagggaccagcggaaaatcctgcttatcgagggcccaatgccccctgccaggttacgcgacttactggctgcactcgtacacactatggcatcactgttgtgagcaggatctgtgtaacatcgccgcaagtccccaacagctcactagcctgctggcgagcctgcctctcttcgtggcaagcttcgcaggcagggggcacctcctgcattag

SEQ ID NO: 48635 - DNA, 894 bp, Artificial Sequence
  Description of Artificial Sequence: Synthetic coding sequence
atggccgtgctgttcctgctgctgttcctgtgcggcaccccccaggcggcggacaacatgcaggcaatctacgttgctctaggcgaagcagtggagctgccttgcccaagcccgccaactctgcatggcgatgaacacctgtcatggttctgctctcctgcagcgggctcattcaccactcttgtggctcaagtgcaggttgggaggcctgcacccgatcccgggaaacccgggcgggaatccaggctgcggctgctagggaattactccctctggttggagggctcgaaagaagaggacgctggacggtattggtgtactgtcctgggccagcaccataattaccagaactggagagtctatgacgtccttgtgctcaaaggctcacagctgtccgcccgcgcggccgacggctccccttgtaatgtcctgttgtgttctgtagttcccagtcgcagaatggattcggttacgtggcaagaggggaaaggcccagtcagaggaagggtccagtccttttggggctccgaggccgctctgcttctagtttgcccaggggagggcttgtctgaaccccgcagtaggagacctagaatcattagatgcctgatgacccataacaagggagtcagtttctctttagcggcttccatagacgcatcacctgcactatgcgcaccttcgacgggttgggatatgccctggatactgatgcttttgctgacaatgggccagggcgtggtgatcttggccctgtctatcgtgctctggcggcagagagtccggggcgccccaggtagggatgctagcattcctcagttcaagcctgaaatccaggtctatgagaacatccatctcgcccgcctcggcccacccgcccataagcccagatag

SEQ ID NO: 48636 - DNA, 894 bp, Artificial Sequence
  Description of Artificial Sequence: Synthetic coding sequence
atggccgtgctgttcctgctgctgttcctgtgcggcaccccccaggcagctgacaatatgcaggccatctatgttgccctgggagaggccgtagaactgccttgtccctcccctcctactctgcatggggacgaacatttaagttggttctgcagtcccgccgcgggatcctttaccaccctggtagcgcaggtgcaggtgggccgacccgcccctgaccccggcaaacccggccgggagtctcgattgcgtctgttgggaaattactccctgtggttggaggggagcaaggaagaggatgccggtaggtattggtgcacagtcctagggcagcaccacaactaccagaactggagagtgtacgacgtgttggtcctgaagggtagtcagttgtctgcccgcgcagctgacggctctccatgtaacgttctcctctgctcggtggtacccagcaggagaatggatagcgtaacatggcaggaaggtaaagggcctgtgaggggaagggtccagagcttttgggggtccgaagccgcactgctgctagtctgtcccggcgagggtctttcagagccccgttcacggaggcccaggattatccgttgtcttatgacacataacaagggagtgtcgttcagtctggctgcaagcattgacgcttctcctgcattgtgcgctccttccactggctgggatatgccctggatcttaatgttgctcctaacgatggggcagggcgttgtcatcctagcgcttagcatcgtcctgtggcgccaacgcgtcagaggcgctcctgggagggacgcaagcatcccccagttcaagcccgagatccaggtctacgaaaacatacatctcgccaggttagggcctccagcacacaagcctcgatag

SEQ ID NO: 48637 - DNA, 1149 bp, Artificial Sequence
  Description of Artificial Sequence: Synthetic coding sequence
atggccgtgctgttcctgctgctgttcctgtgcggcaccccccaggccgctgacaacatgcaagccatctatgtggccctcggagaagctgtggagcttccttgtccatcccccccaaccttgcacggcgatgaacatttatcctggttctgctcacccgctgctgggtccttcacgacattggtcgcccaggtacaggtaggccgaccagctcctgatcctggtaaacccggcagggaaagtcggcttcgactgttgggaaattacagcctctggttggagggatcgaaagaagaggacgcgggaaggtactggtgtacagttctgggtcagcaccacaattaccagaattggcgggtctacgatgtcctggtgctgaaaggttcacagctgtcagcaagagctgctgacggtagtccgtgcaatgtattgctgtgctctgttgtgcctagtcgcagaatggacagcgtcacatggcaggagggaaagggtccagtaagaggacgcgttcagtccttctggggatccgaggcagctctgctgttagtgtgtcccggcgaaggcctctctgagcccagaagtaggaggccacggatcattcggtgcctgatgacgcataacaagggcgtgagcttctcccttgctgcatccatcgatgccagcccagctttgtgtgccccaagcaccggctgggacatgccttggattctaatgctgctgcttacgatgggtcaaggtgtggtaattctcgcgttaagcatcgtcctgtggagacagagggtgcggggcgcccctggtagaggaaatcgaatgcgctgctataactgcggtggtagtccatcatctacctgcaaggaggcagtgaccacatgcggggaggggaggccccagccagggctcgagcagattaagcttccagggaatcctcctgtgacactgatccaccagcaccccgcttgcgtcgccgcccaccactgcaaccaggtcgaaacagagtccgtgggagacgtcacctatccagcccatagggattgctatctgggggacctgtgtaactccgcagtggccagtcatgttgccccggctggcatcttggccgccgcagccacggcactaacatgtttactgcctggcctatggtcggggtag

SEQ ID NO: 48638 - DNA, 237 bp, Artificial Sequence
  Description of Artificial Sequence: Synthetic coding sequence
atggcccccctgcccggcgccgagctggtgcggcggcccctgcagctctacaggtacttactgcgttgctgccagcagcttccaaccaaaggaattcaacaacactacaaacatgccgtgcggcagagtttccgggtgcacagtgatgaggacaacccggagaggatacagcagatcatcaagagggccatcgaggatgctgactggattatgaacaaatataaaaaacagaactag

SEQ ID NO: 48639 - DNA, 1572 bp, Artificial Sequence
  Description of Artificial Sequence: Synthetic coding sequence
atggagaccatgaagagcaaggccaactgcgcccagaaccccaactgtaatatcatgatttttcaccctaccaaggaagaatttaacgatttcgataagtatattgcctatatggagtcacagggagcgcatcgcgccggactggcgaaaatcatccctccaaaagagtggaaggcccgggagacctacgataatatcagtgagatactgattgccacaccattgcaacaggtcgccagcggccgtgcgggggtctttacccagtaccacaagaaaaagaaagccatgaccgtaggggagtacaggcacctggcaaattccaaaaaatatcagactcctccacatcagaatttcgaggacctcgagagaaaatactggaaaaacagaatttataactcccccatttatggcgccgacatcagcggctccctgttcgatgaaaacaccaagcagtggaatcttggtcacctggggaccattcaggacttgctcgaaaaggagtgtggcgtagttatcgagggcgtcaataccccatatctgtattttgggatgtggaaaacaacgttcgcctggcataccgaagacatggatctttactctattaattacctgcatctgggtgagcctaagacctggtatgtagttccccccgagcatggacagagactggagaggctagccagggagctttttcctggctctagtagaggttgtggcgcctttctgcgccacaaggtggctctcatttccccgacggttctgaaagagaatggcatcccattcaatcgtataacccaggaagcaggagaattcatggtgacattcccttatggctaccacgcaggcttcaatcacggatttaattgcgccgaagcaatcaatttcgctacgccacgatggattgactatggtaagatggctagccagtgcagctgcggcgaggccagggtcaccttctccatggacgctttcgtcagaattttacagccagaacgctacgatctttggaagagggggcaagatagggcagtcgttgaccacatggagcctagagtgccagcaagccaggaactgagcactcagaaagaggtccagctgcccaggcgagccgcgttgggccttcgtcagctcccgtctcattgggctagacactccccatggcccatggccgcccgctccggcacccgttgtcatacactggtttgctcgagtctgccacggaggagcgctgtgtcaggtactgcgacacagccacgtgctgccgcagttcattcctcgaaaaagccttctagcacgcctagtagcacgccagggccgtccgctcagatcattcatccaagcaacggacgccggggccgtggccgtcccccgcagaaactgagggcccaggagttgacactgcaaacgcctgctaaacgcccactgttggccggcacaacctgtaccgccagtggacccgagcccgagcccctaccagaggacggggcgctgatggataaaccagtgcccctgagtcctggtctccagcacccagtaaaggcctcaggttgctcttgggcgccggtaccctag

SEQ ID NO: 48640 - DNA, 780 bp, Artificial Sequence
  Description of Artificial Sequence: Synthetic coding sequence
atgaagcacagcaagaagacctacgacagcttccaggacgagctggaagactacattaaagtccagaaggcaaggggcctagagccaaaaacctgctttaggaaaatgaaaggggactatttggaaacctgcgggtacaagggcgaggtgaattctagacccacgtacaggatgttcgatcagcggttgccctcagaaaccattcagacctaccccagatcttgtaatattccacagacagtggaaaatcggctgccccaatggttgcccgcccacgactcaagattgagattggattctctgtcttactgtcagtttacccgcgactgcttttcagagaagccagtgccactcaatttcaatcaacaggagtacatatgcggaagccatggggtggaacaccgggtctacaagcattttagtagcgataattccacctccacacatcaggctagccataagcaaattcaccagaagaggaagaggcaccctgaagaaggcagagagaagtcagaagaagaacggtcgaaacataagcgcaagaagagctgcgaggagatagacctggacaagcacaaatctatccaaagaaaaaagacagaggttgaaatcgagactgtccatgtgtccactgagaagctgaagaatcggaaggaaaagaagagcagagacgtggtcagcaagaaagaggagcggaagaggaccaaaaagaaaaaagagcagggccaggagcgtactgaagaggagatgctctgggaccagtccatactaggattctag

SEQ ID NO: 48641 - DNA, 684 bp, Artificial Sequence
  Description of Artificial Sequence: Synthetic coding sequence
atggccagccccagccggcagcccccccccggcggcagcggcctgctgcagggctctagagcaagaagctacgggtctctcgtgcaatctgcttgctcacctgttagagaacgaaggctcgagcaccaattagaacccggggacacactagctggactggcactgaagtatggagtcaccatggagcagatcaagcgggccaatagattgtatacaaacgactccatcttcctcaagaagactctgtacattcccattttaacggagccccgagatctgtttaatggattggacagtgaagaggagaaagacggagaagaaaaggtgcatccctccaattcagaagtttggccgcattctaccgagagaaagaaacaggagaccggcgctggcagggcaaatggcgaggtgctacccactcccggccaggaaacccccacaccaattcacgatctgagcgcgagcgacttcctgaagaagctcgattcacagattagcctgtccaaaaaagcagctgcacagaagctcaagaagggagagaacggcgtgccgggtgaggatgcggggctgcacctgagttccccttggatgcagcagagagcggtgctcggccccgtcccccttacaagaacgtcccgtacacgcactctgagagaccaagaggacgagattttcaagctgtag

SEQ ID NO: 48642 - DNA, 540 bp, Artificial Sequence
  Description of Artificial Sequence: Synthetic coding sequence
atgcggagcggccccctgcggatcagcgagtggaagatggagcagatcaaacgagcgaacagactctacacgaatgactccatctttctcaaaaagaccctgtacatcccgatcctgactgaacctagggaccttttcaatggccttgattctgaggaggaaaaagacggtgaagagaaggttcatccttctaattccgaggtctggcctcactccacggagaggaagaaacaagagacgggcgctggacgggctaatggggaagtcttacctactccaggtcaggaaaccccaactcctattcacgatctctcagccagcgacttcctgaagaagttggattcacagatttcactgtctaagaaggccgctgcccagaagctgaaaaagggcgaaaatggcgtgcccggcgaagatgcggggctgcatctgtcaagtccctggatgcagcagagagctgtgcttgggcccgtgcctctgacacgaaccagtagaacccgaactctgagagatcaggaagatgaaatattcaaactgtag

SEQ ID NO: 48643 - DNA, 648 bp, Artificial Sequence
  Description of Artificial Sequence: Synthetic coding sequence
atggccgacagcagccccgccctgagcctgcgggagggcggcccccgagccccaagaccttccgccccatcaccgcctccccgctctagatccggctccgaatccgaggaggctgaattgagcttaagcctcgctcgcacaaaaacacggtcctacggctcaaccgcgagtgtaagagcgccacttggcgccggggtgattgagcggcacgttgagcacagagtgagggccggggatacccttcagggaatcgcgttgaagtatggagtgaccatggagcaaattaagcgagctaacaagctgttcaccaacgactgcatatttttaaagaaaacactgaacattccggtcattagtgaaaagcccctgctgtttaacggcctgaactcaatcgactcccccgagaatgagaccgccgataacagcttctctcaggaggaagagcccgtggtggctggtgaagatctcccccccccgtccccgcaagagagcgatgttcagcccgttcagccagaagaggtcagcgcgagagattttctccagagactcgatctgcagattaagctatccacgcaggctgccaaaaaactgaaggaagaatccagggatgaagagtccccatatgctacctccttatatcattcttag

SEQ ID NO: 48644 - DNA, 375 bp, Artificial Sequence
  Description of Artificial Sequence: Synthetic coding sequence
atggagcagatcaagcgggccaacaagctgttcaccaacgactgcatttttctgaagaagacattgaatattccagttatctccgaaaagcctctactgtttaacggactgaattctattgactcccccgaaaacgaaactgccgataatagcttctctcaggaagaggaacctgtcgttgccggagaagacctcccgccgccctcaccccaggaaagcgatgtacagccagtccagcccgaagaggtgagtgcccgcgactttctccagcgcctggatctgcagattaaattgtccacacaggctgcaaaaaaacttaaggaagaatcaagggatgaggagtccccatacgcaaccagcctctaccattcttag

SEQ ID NO: 48645 - DNA, 375 bp, Artificial Sequence
  Description of Artificial Sequence: Synthetic coding sequence
atggagcagatcaagcgggccaacaagctgttcaccaacgactgcattttcttaaaaaagacactcaatatccctgtgatatccgagaagcctctactctttaatggcctgaactcaatcgatagccccgagaatgaaacagcagataactcattttcacaggaggaagagccggtcgtggccggtgaggatctgccgccccctagcccgcaggaatccgacgtgcagcccgtgcagccagaggaagtgtcagctagggacttcctccagagactggacctgcaaattaaattatccacccaggccgccaagaagctgaaggaggaaagcagggatgaggaaagtccgtatgccactagcctgtatcattcttag

SEQ ID NO: 48646 - DNA, 495 bp, Artificial Sequence
  Description of Artificial Sequence: Synthetic coding sequence
atgaagatggtgatgcccagctggttcgacctgatgggcctgagccctgacgctcctgaggatgaggccggtatcaaaaaagcagctgagaacattaaagctctcatagaacacgagatgaaaaatggtattccagctaatcggatcgtgttgggtggttttagccagggaggggccctgtcactatatactgctctcacctgtccgcatccgctggcgggcattgtggccctttcatgttggctgcccctgcatcgcgcattccctcaggccgctaacggatcagccaaggacttggccatcctccaatgccacggagaactagaccccatggtgccagttcgcttcggcgccctgaccgctgaaaaacttaggagtgttgtaacccctgcaagagtacagttcaaaacatatccgggtgtgatgcattccagctgcccacaggagatggcggctgtaaaggaatttctggaaaagctccttcccccagtgtag

SEQ ID NO: 48647 - DNA, 543 bp, Artificial Sequence
  Description of Artificial Sequence: Synthetic coding sequence
atgtgcggcaacaccatgagcgtgcccctgctgaccgacgccgccacagtttccggggccgaacgagaaacagctgccgtcatattccttcatggcctcggggacaccggtcattcatgggcagacgcgttgtctaccattcgcttgccccatgttaaatacatctgtccacacgccccacgcatcccggttacccttaatatgaaaatggtgatgccatcttggttcgatctgatgggactgtccccagacgcgcccgaggatgaggccggcataaagaaagctgccgagaatatcaaggctctgattgaacacgagatgaagaacggaatccctgcaaatagaatcgttctcggaggattctcgcaaggcggtgctctgtccttgtatactgctctgacctgtccccatccacttgccggtattgttgctctctcttgctggctgccgctgcatcgcgcattcccccaagtgaacgtccctactgatcctcctgctttatgcgtgtgcatccttgtggcctgggggctgctgcagcattag

SEQ ID NO: 48648 - DNA, 549 bp, Artificial Sequence
  Description of Artificial Sequence: Synthetic coding sequence
atgtgcggcaacaccatgagcgtgcccctgctgaccgacgccgccaccgtgagcggtgcagaacgggagactgcagctgttatctttctgcacgggctcggcgacacaggtcattcctgggcagacgccctatctactattcgcctgccacatgtgaagtacatttgtccacacgccccaagaatcccagtgactcttaacatgaagatggtaatgcccagctggttcgacttaatgggactgagtcccgacgccccagaagacgaggccggcattaagaaagcagctgaaaacatcaaggcactgattgagcacgaaatgaaaaatgggatccctgctaataggatcgtactaggaggattctcccagggtggggcgctgtcgttatatacagccctcacctgcccacatcccctggcgggtattgtggcgctttcttgttggcttccactccatagagccttccctcagggccccgtgcaagacattcccggctgccacgctcagctcctgtcttcaggcgatggatcatgtgagggaatatcttag

SEQ ID NO: 48649 - DNA, 414 bp, Artificial Sequence
  Description of Artificial Sequence: Synthetic coding sequence
atgtgcggcaacaccatgagcgtgcccctgctgaccgacgccgccaccgtgtccggcgccgaacgcgagaccgccgctgttatttttctccatggcttgggcgacactggccatagctgggctgacgcgctttcgacaatccgcttaccgcacgtgaaatacatttgcccgcatgcacccaggattccagtgactctgaacatgaaaatggtgatgccctcttggtttgatttaatgggtctgagtccagacgctcctgaagatgaggccggaattaagaaagctgctgaaaacaggcgcggtcctgtaccattgcatggtcctcacttgcctccaccttcggggtggcatcggggagtcgaactcttggccgcgtctgctccaggcttacctcccggggagtgtccccattag

SEQ ID NO: 48650 - DNA, 627 bp, Artificial Sequence
  Description of Artificial Sequence: Synthetic coding sequence
atgctgcccccctgcctggagctgagcggcaagcggccccggcactcatgggctgacgccctgtcgacgatccggcttcctcatgttaaatacatttgtccccatgccccccgcatcccagtgactttgaatatgaaaatggtgatgccgtcatggtttgatttgatgggccttagccccgacgcccctgaagacgaagcaggaattaaaaaagcagctgagaacattaaggccctgatcgagcacgaaatgaagaacggcatacctgccaatagaattgttctggggggttttagccagggcggcgcgttgtctctgtacacagccttgacatgcccacatccattggccggaattgtggctctaagttgctggctccctctgcacagagccttcccacaagcagcgaatgggtcggccaaagacctcgctatcctgcagtgccacggggaattggaccccatggtgccagttaggtttggggctctgaccgcagaaaagcttcggtccgtggtcacaccggcacgagttcagttcaagacttaccccggcgttatgcacagcagctgcccgcaggagatggccgccgttaaagaattcctggagaagcttctacctccagtctag

SEQ ID NO: 48651 - DNA, 696 bp, Artificial Sequence
  Description of Artificial Sequence: Synthetic coding sequence
atgtgcggcaacaccatgagcgtgcccctgctgaccgacgccgccacagtgagcggtgcagaaagagaaaccgctgccgtaatttttttgcacgggctgggtgataccggtcatagttgggccgacgcattatctaccatacgcctgcctcatgtgaagtatatatgtccgcatgctcctcgaatccctgttaccttgaatatgaagatggtgatgccctcttggtttgacctcatgggactctcccctgacgccccagaagatgaagccggcatcaaaaaggcagccgaaaacatcaaagccctcattgagcacgagatgaagaatggaatccccgccaatcgaatcgtcctgggaggattctctcaaggtggcgccctaagtctctacactgcccttacctgtccgcatccattggccggcatcgtggccttgtcctgttggctgcctttgcatcgcgctttcccccaagccgctaacggaagcgccaaggacctcgcaatactgcagtgtcatggcgagcttgatccgatggtgcctgtccgctttggcgcccttacagccgaaaaacttagatcagtggtgacgcctgcgagggttcaatttaagacctatcctggcgtcatgcattcgtcgtgtcctcaggagatggccgcggtcaaggagtttctcgagaaactgctgcctccagtgtag

SEQ ID NO: 48652 - DNA, 405 bp, Artificial Sequence
  Description of Artificial Sequence: Synthetic coding sequence
atgtgcggcaacaccatgagcgtgcccctgctgaccgacgccgccacggtgtctggggccgaaagagagactgccgctgttatctttttgcacggcctgggagataccgggcacagctgggcagatgccctctctacaatccgactgcctcatgtgaaatacatttgtcctcatgcccctcgcattcccgtgacccttaacatgaaaatggtgatgccttcatggtttgatctcatgggcctgagtcccgatgctcctgaggatgaagccggcatcaaaaaagctgcagaaaaccgcagaggccctgtgccactgcatgggcctcacctgccaccgccttcaggctggcaccgaggcgtggaattgcttgcagcctccgcccccggtcttcctcctggttcctag

SEQ ID NO: 48653 - DNA, 489 bp, Artificial Sequence
  Description of Artificial Sequence: Synthetic coding sequence
atgctgcccccctgcctggagctgagcggcaagcggccccggcactcgtgggccgatgctctgtcaaccatcagacttccgcatgtgaaatatatatgcccacacgccccgcggattcccgtcacactcaacatgaaaatggtgatgccctcctggttcgacctcatgggcttatcaccggatgcacccgaagatgaagcagggattaaaaaggcagctgaaaacattaaagccttgatcgagcacgaaatgaaaaacggaattcctgctaatcgcattgtgctgggcggctttagtcagggcggggctctcagtctttatactgcccttacttgcccgcaccccctggccgggattgttgccctgtcctgttggctcccgctccaccgcgcattcccacaagccgctaacggcagcgccaaggatctggccatccttcagtgtcacggcgaactggacccaatggttcccgtgcgatttggcgcctag

SEQ ID NO: 48654 - DNA, 276 bp, Artificial Sequence
  Description of Artificial Sequence: Synthetic coding sequence
atgtgcggcaacaccatgagcgtgcccctgctgaccgacgccgccactgtcagcggcgcagaaagagaaacagcggcagtaatattcctccacggcttgggtgataccggacacagttgggcagatgctctctcaacaattcggcttccgcatgtcaagtatatttgccctcatgcaccaaggattcccgtgaccctaaacatgaagatggtgatgccaagctggttcgaccttatgggcctgtcccctgacgctcccgaggacgaggctggctag

SEQ ID NO: 48655 - DNA, 1476 bp, Artificial Sequence
  Description of Artificial Sequence: Synthetic coding sequence
atgaagatggccgcccccaccgccaacaaggccgccagcctgggctgcaacaataaacccgcgttcccagagctagactttcgttctggagcccgggtggaagaattgaacaagctgatccaggaattcacaaaacatgatcagagagagtatgacgaccagcgcgcactggaaatacacacagccaaggactttatttttagtatgcttggcatggtgcaaaaactggaccaaaaactgcctgtagccaacgagtacttactgctgagcggtggcgttcgagagggagtggtggatctggatttggacgaactcaatgtttacgcgaggggcactgactacgatatggattttacgcttctagtgccagccctgaaactccatgaccgcaaccagcccgtgacattagacatgagacattccgctttatgccactcttggctttccctcagactgttcgacgagggcacgatctccaaatggaaggactgttgcactatagtggatcatataaacggtgccacaaactatttcttttctccaaccaaggtggccgactggttttacgactctatcagcattgtgctttccgaaatacagaagaagccccagcggggcatgccaaaagtggagaaggtagagaaaaacggcacaattatctctataattctcggagtcgggtccagccgcatgctatacgacatcgtccccgtagtgtcctttaaaggatggccagccgtagcacagagctggctgatggagaatcatttctgggacggtaagattactgaagaggaggttattagtgggttctacctcgtgcctgcctgctcatacaagggtaagaaggataacgaatggagactgagcttcgccaggtctgaggtgcagcttaagaaatgtattagcagcagtctaatgcaggcttaccaagcgtgtaaagctattattatcaaactgctgtctaggccaaaggccataagcccttatcatctgcggagcatgatgttatgggcctgtgatcgacttcccgctaattatctggcccaggaagactatgccgcccacttcctgctgggtctcatcgacgatctgcaacactgtctagtaaacaagatgtgtcctaactactttattccccagtgcaatatgttggaacacctctctgaggagaccgtgatgcttcacgcgaggaaattaagctcagttcgatcagatcctgctgaacatcttaggacagctatagagcacgtgaaggcggccaatcgcctgacacttgagctccaacggcgtggaagcacaaccagcataccctcccctcagtccgacgggggtgatccaaaccagccagacgatagactggcgaaaaaactacagcagctcgtaaccgagaatcccgggaagtcgatctcggtattcataaacccagacgatgtcacaaggccacatttccgtatcgacgacaaattcttctag

SEQ ID NO: 48656 - DNA, 1089 bp, Artificial Sequence
  Description of Artificial Sequence: Synthetic coding sequence
atgaagtacctgaccgtgggcgacctggaggactgcctgctgaacaaggtggacttacggagacagcagattagtcaggctgtggaagaagtgcagaaggtcgtccaccacctgacaactaacatctctaatcaggatatcagattccaggccgtcccatattccgatacatataatgaaaacataaaagttttggcacctagccagttcttggttaccgtgcctattaaaggtctcgcgggatatagagaggccagagaacaacattggaggtattacaccttacagggcaccaggctgccttgccctttgcgcgatcccgaaggcctacaacagtggctggaagtcgagcagttcatgaaaagcctttggcagtggcacgagacagacgtaaatattgacggcgacattgtgcctgctaaggttcttctcgtgtttcgaaagctggtcgaaaatgccgtgaggacatgccacctctctggcaaggtgtcattgcttggaaataggtctgcagtttgggtggccgtggaaaccagcgcttaccaggtggagctggaacttgtcccggcggtggaaatccctaccacctggtctaagaaagctagatggccacgttgtctgcagaggtggccaagccaggaaagagtggagtgtataaaatcattcggattcaatctgcttgcctgcagcaattatcactggcagctgtcctttctccgcgccgaacaggtgctcttggagcagctggacgaggacggggggtgtcgtagaaagtgttttcaggtcatgaggcatcttaaggaggatatctggtgtcccggaaaccgcccggttattaccagccatcacttgcagacagtgctgttctggacctgtgaaaagtacccgcacttcaaagattggcaggtcttctcgaaagcgttccttcgtctggtccgcaagctgcacaaatgtgtttctcagcactttctgaaacactattttgtgcgaaatagtaaccttttccaatgtaccaatcccactgagttagacactgtcgcgcaaaagctcgccactttcctcaagaatcctcaaattgggcctccttag

SEQ ID NO: 48657 - DNA, 4371 bp, Artificial Sequence
  Description of Artificial Sequence: Synthetic coding sequence
atgcggctgcccctgctgctggtgttcgccagcgtgatccccggcgctgtcctgttgttagacacccgtcagttcctgatttataatgaggatcataaacggtgcgttgacgctgtatcgccttctgccgtgcaaaccgcggcttgtaaccaagatgccgaaagccagaagtttaggtgggtctccgagagtcagatcatgagtgtagcctttaagctgtgcttaggggtgccgtcaaaaacagactgggttgccatcactctctatgcatgcgacagcaaatccgagtttcaaaagtgggagtgcaaaaacgatactttgttaggcatcaaaggcgaagacctctttttcaattatggcaatcgccaggagaagaacatcatgctgtataaaggaagtggtctttggagcagatggaagatctacggcaccaccgataacttatgctcccggggctacgaggcgatgtacaccctcttggggaatgccaatggcgctacttgcgctttcccattcaagttcgagaataagtggtacgctgactgtacatctgctggaaggtctgacggttggctttggtgcggaaccactactgactacgatacagataaactgttcggatattgcccactcaaattcgagggaagcgagagtctttggaacaaagatcccctgacgtctgtgagttatcagattaactccaagtccgccttgacttggcatcaagcacgtaaaagttgtcagcaacagaacgccgagttgttgtcaattaccgagatacatgagcaaacatatctgacaggactgaccagttccctcacttcaggtctttggattgggttgaacagcctgagcttcaattccgggtggcaatggtccgatcgctccccattcaggtatctcaactggcttccagggtctccatctgctgagccaggcaagagctgtgtatctctgaatcccggcaagaacgccaagtgggaaaacctggagtgtgtgcaaaaactcggatatatttgcaaaaagggcaacacgacactcaactctttcgtaatcccaagtgagtctgacgtgcctacccattgccctagtcaatggtggccctatgccggccactgttataagatacatcgggatgaaaaaaaaatacaaagagatgctctaaccacctgcaggaaggagggatccgacctggcatctatccatacaatcgaggagtttgatttcattatcagtcagctaggatatgaaccaaatgacgaattgtggatagggctaaacgatattaaaattcagatgtatttcgaatggtccgacggaacacctgtgacatttaccaagtggcttcgtggggaaccctcccacgagaacaatcgtcaggaggattgcgtggtgatgaagggcaaggacggatattgggctgatcgggggtgcgagtggccacttggctacatttgcaaaatgaaatcccggtcacagggtcctgagattgttgaggtggaaaaagggtgtaggaagggctggaagaagcatcacttttattgttacatgattggccatactcttagcacatttgccgaagctaaccagacctgcaacaatgagaatgcatatctaaccacaatcgaggacaggtatgagcaggcatttttgacttcattcgtgggcttgcgtcccgagaaatatttctggacaggcctgtccgacatccagaccaagggtacattccagtggacgattgaggaagaagtgcgcttcacccattggaactctgacatgccaggacggaaacccggatgtgtggccatgcgcaccgggatcgccggcgggctatgggacgtactcaaatgcgatgaaaaagccaagtttgtctgcaagcactgggccgagggggtgacccacccgccaaaaccaaccactactccagagcctaaatgccccgaagactggggagcctccagtcgcacctccctctgttttaaattgtacgccaagggcaagcatgagaaaaagacctggtttgagagtcgtgatttttgcagagccctcggaggggatcttgcatccattaataataaggaggaacagcaaaccatctggcggctgattacagccagtggatcctatcacaagctgttctggctcggactcacttacggctctcccagtgaggggtttacatggtccgatggcagccccgtgtcttacgagaactgggcctacggagaacccaataactatcagaacgtagagtactgcggtgagttgaagggagatccgaccatgtcttggaatgacattaattgcgagcatctcaataattggatttgtcagatacagaaaggccagacgcccaagcctgagcccactccagctcctcaagataatcccccagttaccgaagacggctgggtgatttacaaggactaccaatactatttttctaaggaaaaggaaaccatggacaatgcccgagcattctgtaagcggaattttggagacctcgtctccattcaaagtgagtctgaaaaaaagttcctctggaaatatgtcaaccggaacgacgcccagtctgcctattttatcggactgctgatttccctggacaaaaagttcgcttggatggacggctccaaggtggactatgtgagctgggcaaccggtgaacccaactttgcaaatgaggatgagaattgcgtcacaatgtattccaattcgggattttggaacgatattaattgcgggtatccgaatgctttcatttgccagagacataactcatccatcaacgccactaccgtgatgcccacaatgcccagcgtcccaagtggctgtaaagagggctggaatttctatagcaacaagtgctttaagatctttgggtttatggaggaggagcgtaaaaactggcaagaggcaaggaaggcctgtataggctttgggggcaacctggtaagcattcaaaacgagaaggaacaagctttccttacctaccatatgaaggactctaccttcagcgcgtggactggactgaacgacgttaatagcgagcatacctttctgtggacagacggtagaggcgtgcactatacaaattgggggaagggctatccgggaggacggagatcttctctatcctatgaagatgccgactgtgtggtgatcataggtggggcaagcaatgaagccggaaagtggatggacgatacctgcgactccaagcgaggatacatttgccagactcgtagcgatccctccctgacaaaccccccagctaccatacagacagatggcttcgtgaaatacggtaaatcatcgtatagtctcatgcgacagaagttccagtggcatgaagccgagacctactgtaaactccacaactcactcatcgcgtcgattctcgatccttatagtaatgcattcgcatggctgcaaatggagacctcaaatgagagagtatggatagcacttaacagcaatctcaccgataatcaatacacttggactgacaagtggcgcgtccgttatactaactgggccgcagacgaacctaaactaaagagcgcctgtgtgtacttggacctggacggatactggaaaacagcccactgtaatgagtccttctacttcttgtgtaagagatcagacgagatccctgctaccgagcctccccagctgcccggccggtgcccagagtctgaccatacggcctggataccctttcacggacattgctactatatcgaaagttcctacactagaaattggggtcaagccagtttggagtgcctgcgcatgggaagcagcctagtatccattgagtcggccgccgaatcttcgttcctatcgtaccgcgttgaaccactcaagagcaagactaatttttggatcggcctcttccgtaatgtggagggcacatggctttggatcaacaattcccccgtttcatttgtgaattggaacactggcgacccttccggcgaaaggaatgactgcgttgctctgcatgccagctcgggcttctggtctaacatccactgctcatcttacaaaggatatatctgtaagaggccaaagattatcgatgctaaacctacacacgaattgctcaccaccaaggcggatactcgtaagatggaccccagtaagcccagctcaaatgtggcgggcgtggttattattgtcattctgctcattcttaccggagctggtctggccgcctattttttctacaagaagcgccgggtgcacctgccacaggagggtgcctttgaaaatacgctgtactttaatagtcagtcttcacccggcacgtctgatatgaaggacttggtgggcaatatagaacagaatgagcactcagtgatttag

SEQ ID NO: 48658 - DNA, 1497 bp, Artificial Sequence
  Description of Artificial Sequence: Synthetic coding sequence
atgcggctgcccctgctgctggtgttcgccagcgtgatccccggcgcagtgctcctgctggacacccgtcagttcctcatctataacgaagaccacaagagatgcgtggatgcagtgtcacccagtgccgtacagacagccgcctgcaaccaagacgctgagagtcagaaatttcgatgggtctccgaatcccaaatcatgtccgtggccttcaagttgtgccttggtgtccctagcaaaaccgattgggtggcgataaccctctacgcatgcgacagcaaatctgaattccagaaatgggaatgcaaaaatgatacacttctgggcatcaagggcgaagatctgttttttaactacggcaacaggcaggaaaaaaatattatgctctataaaggcagtggcttgtggagcaggtggaagatatatggtactacagacaacctctgttctaggggctacgaagccatgtataccctgctcgggaatgccaacggtgcgacctgcgcattccccttcaagttcgagaacaagtggtacgccgattgtacttccgccggaaggtctgatggatggctttggtgtggtaccaccaccgactacgacacagataagctcttcggctattgcccgctaaaatttgaaggctccgagagtctctggaacaaggatcctctgacatctgtgagctatcagatcaattcaaagtccgcccttacatggcaccaggcacgtaaaagctgccagcagcagaatgctgaactcctcagcataacggagattcatgagcagacttacttaaccggattaacctcgtcattgacctcaggtctctggattgggctgaacagcttgtctttcaactctggatggcagtggagcgaccggtctccgttcaggtatctcaactggctcccaggctcaccatctgcagagcctggaaagagttgcgtgtcactgaacccgggtaaaaacgcaaaatgggaaaatctcgaatgtgtgcagaagctcggctacatctgtaaaaaaggtaacaccaccctgaatagttttgtgattccaagtgaatctgacgtccctactcattgcccaagccagtggtggccctatgctggacactgctacaagatccacagggacgagaaaaagattcagcgcgacgctctcacaacgtgtcgtaaggagggtagcgatctcgcatcaatccatacaattgaagagtttgattttattataagtcagctgggctacgaaccaaatgacgagctgtggatcggccttaacgacatcaagatacagatgtactttgagtggtctgacggtacccccgtcacctttacgaaatggctgaggggggaacccagccatgaaaacaatagacaggaagattgcgttgtgatgaagggcaaggctggggtccaatggcataacctcggcagcatgcagccactccctagagagtttaagcgcttctcttgtttaagcctgccgagtagctag

SEQ ID NO: 48659 - DNA, 507 bp, Artificial Sequence
  Description of Artificial Sequence: Synthetic coding sequence
accggccagggcggcgtgcggagcgcccccggcaccggccggatcgcctttcctcctaaggcatcaaggggttctacaaataccgcacatctcagcatagccaattcttggcctagatctgcctctacccccgagacccgaacaaaatttacccaggataacctgtgccacgctcagcgggaaaggctggactccgccaatctgtgggtgttagtcgactgcatactccgggatacaagcgaagaccttggtttgcagtgtgacgccgtaaacctggctttcggccggcgatgtgaagaacttgaagacgctcgccacaagttgcagcatcacctgcacaaagtggggcaccctgaacctaggcgaaggctgagacgtctgccaaccacattaccacccctcatcacttggcctgggcccagcacaccgttctctagcgtccccctgatcccgcgcgatcctagatctaaatgtcacttgagcgtcaatctgtgcaagaccaggtag

SEQ ID NO: 48660 - DNA, 1941 bp, Artificial Sequence
  Description of Artificial Sequence: Synthetic coding sequence
atggagttccaggaggtgcagcagacccaggccctggcctggcaggctcagaaagcccccacccatatctggcagcccctccccgcccaagaggcacagcgtcaggctcctcctttggttcagctcgagcagccattccaaggggctccaccttctcaaaaggccgtccagattcagctcccaccacagcaagcccaagcgagtggtccgcaggcagaagtgcctacactgccgctccagccttcttggcaagccccacccgcagtgctccaggcccaacctggcccccctgtggccgccgccaactttccactcggatctgccaaatctttaatgaccccctccggggagtgccgtgcatcctccattgatcggcgggggtccagcaaagagcgtcgaacgtcaagtaaggagaggagagctccatcaaaagatcgaatgatcttcgctgctacgttctgtgccccgaaagctgtgtccgcggcaagagcacatctgcctgcggcctggaagaacttgccagccactcctgaaactttcgctccttccagctctgtgttcccagcgacctcacagtttcagcctgctagcctaaacgcctttaaaggcccttcagccgccagtgagacacccaagtccctcccttacgcccttcaggacccatttgcgtgcgtcgaagctctccccgcagtgccttgggtgccccagcctaacatgaacgccagcaaagcatcccaagcagtgcctaccttcctgatggcaacagccgctgctccacaggcaaccgccaccacgcaggaagcctccaagacctccgtagagccccctcgccgcagtgggaaagccaccagaaaaaagaagcatctggaggctcaggaggatagccgggggcatacgctagctttccatgactggcagggcccaagaccctgggaaaacctgaacctgtcagactgggaggtgcagtcgcctatacaagtgtccggcgattgggagcatcctaacaccccccgggggctctccggctgggaaggtccttctacatccagaattctgagcggctgggaagggccatcagcttcgtgggcactttccgcgtgggagggtccgagcacttcgcgcgccctgggtcttagcgagagccctggttcctccttaccagtggtggtctccgaagttgccagcgtttcccctgggtcaagcgcgacacaagataatagcaaggttgaagcacaaccgctctcccccctggacgagagggccaatgctctagtgcagtttttactggtgaaagaccaggccaaggtgcctgtgcagcgctcggagatggtcaaagtcatcctgcgcgagtacaaagatgagtgtctcgacatcattaatcgcgcaaataacaagctagaatgtgctttcgggtatcagcttaaagaaatagatacgaaaaaccacgcctacatcatcataaacaaactgggttaccacacagggaaccttgttgccagctaccttgacaggcccaaattcggacttctcatggtggtgctgagtctgatatttatgaaaggcaactgcgtgcgggaagatctgatttttaattttttgtttaagttgggactcgatgtgagagagaccaacggactgttcggcaataccaagaagttgatcacagaagtgttcgttcgtcagaaatacctagagtacagaaggatcccgtatactgagcctgcagaatatgaattcttatggggtcctcgtgccttcctggagacatcgaagatgcttgtgttaagatttcttgcaaaacttcacaaaaaagaccctcagtcctggccattccattacctggaggccctggcagagtgtgagtgggaggacaccgatgaggatgagcccgatacaggcgactcggcccacggcccaactagtcggccacctcctcgatag

SEQ ID NO: 48661 - DNA, 828 bp, Artificial Sequence
  Description of Artificial Sequence: Synthetic coding sequence
atgcccctgctgtggatcaccggcccccggtaccacctgatcctgctatccgaggccagttgtctgagagcaaattacgtccacttatgcccactgttccagcataggtggcttgaaacatgcaacgcccctccacagctcatccagggaaaggctcatagcgctccaaagcccagccaagcatctggacatttctctgttgagctggtgaggggctatgcaggatttggtctgactcttggcggcggcagagacgtagccggtgacactcccttggcagtgagaggtctcctgaaagatggccccgcccagcgatgtggcaggttggaggtcggggacgttgtccttcacattaatggggaaagcacccaggggttgacgcacgctcaggcagtggaaagaatccgcgcagggggcccgcagctgcacctagtaatcagacgccctctcgaaactcacccgggtaaaccccgcggcgtaggcgagccacggaagggagtggtaccttcatggccagatcggagtccagaccccggaggacccgaggttactggatctcgctccagcagcactagcctggtgcagcatcccccctctaggaccacactaaagaaaacccgtggaagcccagaacccagccctgaggcggccgctgatgggcctacagtgagcccgcctgagagaagagcggaagatccaaatgatcagatccccggctctcctggaccctggctcgtgccctccgaggaaaggctgtctagagccctcggagtgagaggcgccgcccaattcgcccaggagatggcggccggaagacggcgccactag

SEQ ID NO: 48662 - DNA, 813 bp, Artificial Sequence
  Description of Artificial Sequence: Synthetic coding sequence
atgcccctgctgtggatcaccggcccccggtaccacctgatcctgctgagcgaagcctcttgcctgcgggccaactacgtccacctatgtcctctctttcagcaccgctggttggagacgtgcaacgctcctccccaactcatccaaggcaaggcccatagcgcacccaagcccagtcaggcctcaggccactttagtgttgagttagttagaggctatgcagggttcgggctgacactcggaggaggtcgagacgttgcaggagatacgccccttgccgtgcgtggtttactcaaagatggcccagcacagcgatgcgggcgcttggaagtcggcgacgtggttctgcatattaacggtgagagtacgcagggtctgactcatgcccaggcagtggagcgaatcagggccggagggccacagctgcacttagtgatacggagaccccttgagactcacccagggaaaccacgtggcgtcggagagcctcggaagggtgtggaccgcagccccgatcctggcggacctgaagtgacaggtagccggagttcgtctacatctctggtgcagcatcctccaagtaggaccaccttaaaaaaaaccagaggatcccctgagccgtctcccgaggctgcagccgacggcccaaccgtatccccacccgaacggcgcgcggaagatcctaatgaccagatcccggggtcacctggcccatggctggtacccagcgaggaacggctgtctagagccctcggcgttcggggcgcagcccagttcgcgcaagaaatggccgccggccgccggcgacactag

SEQ ID NO: 48663 - DNA, 1005 bp, Artificial Sequence
  Description of Artificial Sequence: Synthetic coding sequence
atggagccccggaccggcggcgccgccaaccccaagggcagccgggggtctcgggggccgtctcctctggcaggaccctctgcacgacagttgctggctaggttggacgcaaggccattagcggcacgcgctgccgtcgacgtagctgcactggtcaggagagctggcgcaaccctgcggttgcgccgaaaggaagccgtgagtgtgctcgattctgccgacattgaagtgaccgacagcagacttccacacgccacaatagtggatcacagaccgcaacaccggtggctagagacgtgtaacgcccccccacagttgatccaggggaaggcgcacagcgctccgaaaccgagtcaggcttctgggcattttagtgttgaactcgtgagggggtacgccggatttggacttactctgggtggtggaagggacgtggcgggagatacacccctcgccgtgcggggactgttaaaagatgggcccgctcagaggtgtgggcggctcgaagtaggagatgtggtccttcatatcaacggagagtctacacaaggtttaacccacgcccaagccgtcgagagaatccgcgcaggaggtccgcaactgcacctggtgattagaagaccactggaaactcatcctggcaaaccacgtggggtgggagagccccggaaaggcgtcgttccttcctggcctgacaggtcacccgatcccggcgggccggaagtgactggcagtcgtagttcgtccacctcgctcgtccagcatccaccaagccgtacgacactaaaaaagactagggggtccccggaaccaagccccgaggctgccgcagatggtcccactgtcagccctccagagcgccgggcagaagatccgaacgatcaaatccctggtagccccggaccatggcttgtgccatccgaggaacgactgtcacgtgctttgggcgtacggggggcggctcaatttgcacaggaaatggccgccgggcgccgacggcattag

SEQ ID NO: 48664 - DNA, 714 bp, Artificial Sequence
  Description of Artificial Sequence: Synthetic coding sequence
tgacggggccccagccccctggccggccccagcgcccggcagctgctggcgagactcgacgccaggcccctggccgcccgggccgcggtcgacgtggcggctcttgtgaggagggctggggctacgttacgtctgcggcgcaaagaggccgtgtctgttctggatagtgccgatatcgaggtgaccgattcaagactcccccacgcaacaattgtggatcaccgccctcaggggaaggctcacagcgccccaaaaccctcccaggcatccggccacttcagcgtggagctggtccgggggtatgccggtttcggtctgacactggggggcgggcgcgatgttgccggagacacgccccttgctgtgagaggattactgaaagacggtccagcacagagatgcggtcggctggaagtaggtgatgtggtgctgcacatcaatggtgaatccacccaagggctcacccacgcacaagctgtcgagcgtatccgcgctggtggcccacagctacacctcgttattagacggccgctggaaacacacccgggaaaacctagaggggtgggagagcctagaaagggtgtcgatcgttcaccggaccccggaggaccggaagtcaccggatcccgctcttccagcacctcgctggttcagcacccaccttcacgaaccacattgaaaaagactaggggcagtccagagccatcaccttag

SEQ ID NO: 48665 - DNA, 645 bp, Artificial Sequence
  Description of Artificial Sequence: Synthetic coding sequence
gcctggggcgtgagcagctactgccccgtgctggccgtgagcgtgcttgattcagctgacatcgaggttaccgactcccggctccctcacgccaccatcgtggatcaccgccctcagcatcgctggctcgagacctgtaacgcaccccctcagctcattcaaggcaaggcccatagcgcccctaaaccgagccaagcctcaggccacttttctgtggagctggtgcgcgggtatgcaggattcggccttacgctcggcggagggagagatgtggcgggtgacacgcctctggccgtcaggggcctgctcaaagatggccccgcgcagcgttgtggacggctggaggttggggacgtggtgttgcatatcaatggcgaatccacccagggcctaactcatgcacaggcggtcgaaaggatccgcgctggcggtccacagctgcacttagtgatacggcggcctctagagacacatcctgggaagccacggggcgtcggtgagccacgaaaaggggtcgatcgctctccggatccaggtggccccgaagttaccggatccagatcatccagtactagtctggtgcagcatcctccttcaagaactaccttgaaaaaaacgcgaggaagccccgaacctagtccctag

SEQ ID NO: 48666 - DNA, 777 bp, Artificial Sequence
  Description of Artificial Sequence: Synthetic coding sequence
atggagccccggaccggcggcgccgccaaccccaagggcagccgggggtcccgcggtccgagccccctggccggtccttccgcgaggcagctattggcgagactggatgctcgacccctggcagcaagagccgcagtagacgtggccgccttggtccgtcgtgccggggctaccctccgccttcggcgcaaagaggccgtctcagtcctggacagtgctgatattgaggtgaccgactcacgcttgccccatgctacaatagtggatcacagaccgcaggttggagatgtcgtccttcacatcaacggagagtcgactcagggccttacccacgcacaggcagtcgagcgcatcagggccgggggcccacagctgcatctggtcatccggaggcctttagagactcaccctggaaaaccgaggggagtcggtgaaccaaggaagggagtggtcccttcctggcccgatcgaagccccgatcctgggggccccgaggtcactgggtcccggtcatcctcaacaagtctggtccagcaccccccctcacgcactacgttaaaaaagacaaggggcagtcctgaacctagcccagaagctgcagctgatgggccgacagtctcacctcccgagcgccgggccgaagaccccaatgaccagatcccgggctccccgggtccgtggctagtgccttcggaagaacgtctgtcaagagctctaggggtcaggggggccgcccagttcgctcaggaaatggccgctggaagacggcgccactag

SEQ ID NO: 48667 - DNA, 432 bp, Artificial Sequence
  Description of Artificial Sequence: Synthetic coding sequence
atgagccccaacagccccctgcactgcttctacctgcccgccgtgtccgttctggactccgccgacatcgaggtgacagactcaagactcccccacgcgacaatcgtcgaccacaggcctcaagtaggagatgtcgtgctgcacataaatggcgaaagtacgcagggcctgacccacgctcaagctgtggaaaggattagagcgggcggtccacagctccatctggttattaggcgtcccttggagactcacccgggtaagccacgaggagtcggggagccccgtaagggcgtggaccgctccccagaccctggcgggccagaagtgaccggatcccgaagctcctcaactagtctcgttcagcatccacccagtcgtactacgctaaaaaagaccaggggaagtccagagccgtcccctgaggctgcatag

SEQ ID NO: 48668 - DNA, 606 bp, Artificial Sequence
  Description of Artificial Sequence: Synthetic coding sequence
tgaggccggctgctggccatggagccccggaccggcggcgccgccaatcccaagggttcccgcggatcacgagggccttccccccttgctggaccgtctgcaagacagctacttgcccgactagacgcccggccgctggcggctagggcagcggtagacgtggcagctctggtacgtcgggcaggggcaacgctgcgcctcaggagaaaagaagcggtctccgtattggatagcgctgacatagaagtgacagacagtagactgcctcatgctactatcgtagatcacagaccccaggtgggtgatgtggtgctgcacatcaatggcgaatcaacacagggcctaacccatgcccaggcggtggaaaggattcgggccggcgggccccaattgcacctggttatcaggagaccactggagacccaccctggcaagccccgcggggttggtgagccaaggaaaggggttgaccgaagccccgacccaggaggcccggaagtgactggctcacgctccagttccacttcattagtccagcaccccccttcccggaccaccctgaagaaaacgcgggggtcacctgaaccatcgcccgaagccgcctag

SEQ ID NO: 48669 - DNA, 531 bp, Artificial Sequence
  Description of Artificial Sequence: Synthetic coding sequence
atggcccggctgcccaagctggccgtgttcgacctggactacaccctctggcctttctgggtagatacccacgttgatccacccttccacaaaagttcagatggtactgtgcgggaccgccgagggcaagatgtgagactgtaccccgaggttccagaagttcttaagaggctccagtcacttggcgtccccggcgccgcggcttcccgcacctctgagattgagggggccaatcaacttttggaactattcgacctctttcgatactttgtccaccgtgagatctaccccggctccaaaattacccacttcgaacggcttcaacagaagacaggtatcccattctctcaaatgatttttttcgacgacgagcgccgtaatattgtggacgttagcaaactgggggtcacatgcattcacatacagaatggtatgaatcttcaaaccctctctcagggtttagaaaccttcgcaaaagcacagaccggccctcttagatcttctcttgaagagtcccccttcgaggcttag

SEQ ID NO: 48670 - DNA, 369 bp, Artificial Sequence
  Description of Artificial Sequence: Synthetic coding sequence
atggcccggctgcccaagctggccgtgttcgacctggactacaccctgtggcctttctgggtggatacacacgtcgacccgccgttccataaatccagcgacgggacagttcgagaccgccgggggcaagacgtgcggctctatccggaggtgccagaggtattgaaacggctgcaatccctcggcgtgccaggggccgcagctagtcgcacgagcgaaatcgagggtgctaatcagttactggaactattcgacctgttcaggtgttatctccactcccatccggagtggaatgagagctctaacagcaaatctcgtgtgagagacatttgtgaaggccccaattgggccttcgaggtgcagccttag

SEQ ID NO: 48671 - DNA, 1515 bp, Artificial Sequence
  Description of Artificial Sequence: Synthetic coding sequence
atggccgccccccccgcccccgccgccaagggcagcccccagcccgagccgcacgcccctgaaccgggtccagggagtgcgaagcggggtcgagaggactctcgggccggcaggctctccttctgcacaaaggtgtgctacgggattggaggagttcccaaccagatagcctctagcgccactgccttctatctccaactattcctgctcgacattgctcaaatacctgctgcccaggtctccttggtgttgttcggcggcaaggtgtcaggcgccgccgctgaccctgtggccggattctttataaacaggtcccagcggacaggctccggtcgattgatgccttgggttctgggatgtacacccttcatcgccctggcctattttttcctgtggttcctgccccccttcacaagccttagggggctctggtacactaccttttactgtctgtttcaagcactggctaccttctttcaggtaccatacacggcactgaccatgcttttaaccccctgtccaagagaaagggacagtgccacagcataccgaatgaccgtggaaatggcagggacattaatgggggcgaccgtgcatggattaattgtaagtggcgcacaccggcctcatagatgtgaagccaccgccacgccgggccctgtcaccgtgagccctaatgcagcccacctctattgtatcgctgctgccgtagttgtggtgacataccccgtgtgcattagtctattgtgcttgggtgtgaaggagagaccagaccccagtgcgcctgctagcgggccgggattgtccttcttagcagggctgtcactgacaacccgccaccctccctacttgaagctggtaattagtttcctcttcatttctgccgccgtgcaagtggagcagagctatcttgtcctcttctgtacacacgcatctcaactgcatgaccatgttcagggccttgtcttgacggtgttagtatccgcggtgctcagcactccgctttgggaatgggtcctacagagatttggtaagaaaacaagcgcattcggcattttcgccatggttccttttgctattctgctcgcggcagtcccaaccgccccagtggcatatgtggtggctttcgtctccggggtgagcattgccgtgtcacttctcctgccttggtccatgttgcccgacgttgtagatgatttccaacttcaacaccgtcacggtcccggcctagaaaccatcttctattcatcctacgtttttttcactaaactgagcggtgcgtgtgctcttggaatcagcaccctgtcactcgagttcagtggatacaaggcaggcgtctgtaaacaagctgaagaagtggtggtcactctcaaagtactcattggcgcggtgcccacatgtatgatcctcgcaggactgtgcattcttatggtgggctccacacctaagaccccgtctagggacgcctccagtcgcctgtctctgagaagaaggaccagctactcgcttgcctag

SEQ ID NO: 48672 - DNA, 1494 bp, Artificial Sequence
  Description of Artificial Sequence: Synthetic coding sequence
atggccgccccccccgcccccgccgccaagggcagcccccagcccgaaccacatgcccccgagcctggccctggatcagccaaacgggggagggaggactctcgggcagggcgactatcattttgcacaaaggtctgttatggcattggaggcgttcccaatcaaattgcaagcagcgcaaccgccttctacttgcagctgtttctgctggatattgcccagatcccagcggcccaagtaagtctcgtactattcgggggcaaagtgtccggtgctgccgccgatcctgtggccggatttttcattaatcgtagtcagcgcactggttcagggagattgatgccatgggtgctcggttgtacacctttcattgccttggcttatttttttttatggttcttaccacccttcacctcactgagagggctctggtatacaaccttctactgcctgttccaagctttggctaccttctttcaggtgccttatacagccctcactatgctgttaaccccgtgccccagagaacgagacagcgcaactgcttacaggatgacagttgaaatggccggaaccctaatgggagcgacagttcacggccttatcgtcagtggagcgcacagaccccacaggtgtgaagccacagcgacacctggccccgtaaccgtctcccccaacgccgcccacctctactgcattgcggccgccgtcgttgttgtcacttaccctgtgtgtattagcctgctctgcttaggggttaaagagagaccagatccaagcgcccccgcaagcggtccaggcctctccttcttggcggggcttagcctgaccacaagacacccgccctatttaaaactggtaattagcttcctgttcatcagcgccgctgtccaagtggagcagtcctatctcgttctcttttgtactcacgcttcccaactgcatgaccatgtccaaggactcgttttaacagtgctcgttagcgctgtattatcgacccctctttgggagtgggtcttgcagaggttcgggaagaagaccagtgcgttcggtatctttgctatggttccattcgccatcctgctcgcagctgtccccactgcccctgttgcttacgtcgtggcgtttgtgagcggtgtttcaattgcggtaagtctgctgttgccttggtcaatgttgccagatgtggtggacgattttcagttgcagcaccgccacgggcccgggctggagaccatcttttacagttcttacgtatttttcacaaaactgtccggagcatgtgccctggggatctcaacactcagcctggagttttctggatataaagcgggcgtttgcaaacaagctgaggaagtggttgtgacattgaaggtgctgataggggctgtgcctacatgtatgatcctggccggcctgtgcattctaatggtggggagtactcccaagacccccagtagagatgcgagctctcggctgtctttacggcggtag

SEQ ID NO: 48673 - DNA, 1449 bp, Artificial Sequence
  Description of Artificial Sequence: Synthetic coding sequence
atggccgaggccgccacccccggcaccaccgccaccaccagcggcgccggcgctgcagccgctacggccgcggcggcttcacccaccccgatcccgactgtaaccgccccgtccctaggcgccgggggagggggcggcggtagcgatggatctggcggagggtggaccaagcaggtgacatgcaggtattttatgcatggggtgtgtaaggaaggcgataactgccggtactcccacgatctttcagattccccttactcagtggtatgcaaatactttcagagaggatactgtatatatggtgatcggtgtcggtacgaacattcgaagcctctgaagcaggaagaggctaccgcaacggagctgacaactaaaagtagcctcgctgcgagttcctctctgtcctctatcgtgggcccgctggtggaaatgaataccggcgaggcggaaagtagaaactctaactttgccacagtcggcgccgggtccgaagattgggttaatgccatcgaattcgtccccggacagccttattgtggaagaaccgcgccttcctgtaccgaggcgccccttcagggatccgtgacaaaagaggagtccgagaaagaacaaactgcagtcgagacaaagaagcagttgtgcccatacgccgccgtcggagagtgcaggtacggggaaaactgtgtgtatctgcacggcgactcatgtgacatgtgtggcctgcaagtactccacccgatggatgcagcacaacggtctcagcacataaagtcctgtattgaagcccacgaaaaggacatggagctgagtttcgccgtgcagaggagtaaggatatggtctgtggtatttgcatggaggtggtgtatgagaaagctaatccgagcgaaaggaggtttggcattttgtcaaattgtaatcacacatactgtctgaaatgtatacgtaagtggagatccgccaagcagtttgaaagtaaaattatcaagtcctgccccgagtgcagaatcacttcaaattttgtcattcctagcgagtactgggtcgaggaaaaggaggaaaagcagaagctaattctgaagtacaaagaggccatgtcaaataaggcatgcagatatttcgacgagggaagagggagttgcccgtttgggggcaattgcttttacaagcatgcctaccccgatggccgtcgggaagaacctcaacggcagaaggtgggcacgtcctctcggtaccgcgcccagcgccgcaaccacttctgggagttgatagaagagcgagagaacagtaacccctttgacaacgacgaagaagaggtagtgacttttgagttaggcgagatgttactgatgctgctcgctgccggtggggacgatgagttgacagacagtgaggacgagtgggacctgtttcacgacgaacttgaagatttctatgacctcgatttatag

SEQ ID NO: 48674 - DNA, 651 bp, Artificial Sequence
  Description of Artificial Sequence: Synthetic coding sequence
atggagctgagcttcgccgtgcagcggagcaaggacatggtgtgcggaatatgtatggaagtggtgtacgagaaggccaatccctccgaaagaagatttggcattttgagcaactgtaaccacacttactgtctgaagtgcattcggaaatggcgaagcgctaaacagttcgaatcgaaaataattaagagctgtcctgaatgtagaatcacctcaaacttcgtgatcccatcagaatattgggtagaagagaaagaggaaaaacagaagctgatcttaaagtacaaggaagctatgtcaaataaggcctgccgttactttgatgaggggcgcgggagctgcccgttcggggggaattgcttttataagcacgcctaccctgacggtcggcgtgaggaaccccagcggcagaaggtcggtacgagctcacgctacagggcacaacgaagaaatcacttctgggagctgatcgaagagagggaaaacagcaacccctttgataacgatgaggaggaggtggtcaccttcgaactcggagaaatgctgctgatgctcctggccgccggcggggatgacgaacttacagactccgaggacgagtgggacttgttccacgacgaactggaagacttttacgacctggatctgtag

SEQ ID NO: 48675 - DNA, 1257 bp, Artificial Sequence
  Description of Artificial Sequence: Synthetic coding sequence
atgcacggcgtgtgcaaggagggcgacaactgccggtacagccacgacctgtcagactccccatactctgttgtgtgtaagtacttccagagggggtactgtatttatggtgataggtgccgctatgagcattccaagcccctgaaacaagaggaggcgacagccaccgaactgacaactaagtctagtcttgccgcatcttcatctctcagtagcatcgttggcccgttggtggaaatgaacaccggggaggccgaaagccgaaactccaatttcgctaccgttggcgccgggtccgaggactgggtaaacgcaattgagttcgtgcccggacaaccttactgtggcaggacagcaccgtcttgtactgaagcccctttacaagggtctgtgaccaaggaggagtccgaaaaggaacaaacagcggtcgaaactaagaagcagctatgcccgtacgccgccgtcggagagtgccggtacggtgagaactgcgtatacttgcatggtgattcctgcgatatgtgcggcctacaggtcctgcatcccatggacgcagcccaaagatcacagcatattaaatcttgtatcgaagcccatgaaaaggacatggaactgagttttgctgtgcagcgttccaaggatatggtgtgtgggatctgtatggaagtcgtctacgaaaaggccaacccaagtgagagacgttttggaattctgtctaattgcaatcatacttactgcttaaagtgtataaggaagtggcgatctgctaagcagtttgagtccaaaatcataaagagttgccccgaatgccggatcacctctaattttgtgatcccatccgagtactgggtggaagaaaaagaggaaaaacagaaactgatcttaaagtataaggaggccatgtccaataaggcgtgcagatatttcgacgaaggccgaggaagttgcccgtttgggggcaactgcttctataagcatgcttaccctgatggtcgcagagaggaaccccagcgccaaaaggtgggcaccagtagtcgttatagggcccagcgccggaatcacttctgggagttgatcgaggagcgggaaaatagcaacccctttgacaacgatgaggaggaggttgtgaccttcgaattaggggagatgcttctcatgcttctggctgcaggcggcgatgacgagctgaccgacagcgaggatgaatgggacttgttccatgatgagctcgaagacttttatgatttggacctgtag

SEQ ID NO: 48676 - DNA, 990 bp, Artificial Sequence
  Description of Artificial Sequence: Synthetic coding sequence
atggccgaggccgccacccccggcaccaccgccaccaccagcggcgcaggcgcggcggccgctactgccgcagccgccagtcctactcctataccaaccgttacagctcccagtcttggcgcggggggcgggggtggcgggtcagacgggagcggagggggctggacaaagcaagtaacttgtcgatacttcatgcatggtgtgtgcaaggagggggacaattgcaggtactcccacgacctgtctgatagcccatatagtgtagtatgcaagtacttccagagaggatactgcatctacggagataggtgccgttatgagcattccaagcctctcaagcaagaagaggccacagcgaccgagcttacaactaagtcctccttggcagcctcttcctccctgagctccatcgttggacccctagtcgaaatgaatactggtgaggccgagagcagaaatagtaattttgcaactgtgggtgcaggaagcgaagactgggtaaacgctattgagtttgttcctggtcagccttactgcgggcgtacagcaccctcatgtacggaggctcccctacaggggtctgtgaccaaggaggagagcgagaaagagcagaccgcggtggaaacaaagaaacagctgtgtccatatgcagctgtgggagaatgtcggtatggcgagaattgtgtgtatctccacggggatagctgcgatatgtgtgggttgcaggtcttacaccctatggacgctgctcagagaagccaacacattaaatcttgcattgaagcccatgagaaagacatggaactatcctttgcagtgcagcgatccaaagatatggtatgtgggatatgtatggaggtcgtgtatgaaaaagcaaacccttccgagcggcgtttcgggatcctctctaactgcaatcatacttactgcctcaagtgtattcgcaagtggcggtccgcgaaacagttcgaatcaaaaattatcaaatag

SEQ ID NO: 48677 - DNA, 1557 bp, Artificial Sequence
  Description of Artificial Sequence: Synthetic coding sequence
atggccaagttcgtgatcgccggccgggccgactgcccctactacgccaagacagagcttgtcgcggactatctccagaagaacctgccagatttcagaattcacaaaataacccagcgccccgaggtttgggaagactggctgaaagatgtttgtgagaagaataaatggagccataaaaatagccccataatttggagagaactgcttgaccgtggaggcaaaggcctcttactgggcggatataacgaattcctggagcacgcccaattgtattacgacgttacaagcagcatgactactgaattaatgatggtcattgctcaagagaatctgggagcacatatcgaaaaagagcaggaggaagaagctttaaaaacctgtatcaatccactgcaggtgtggattacttccgcatccgcgcccgcctgctacaaccttattccaattcttacttctggggaagtatttgggatgcacacagagatatcaatcaccctgttcgacaacaagcaagccgaggagcaccttaagtcactcgtggtcgaaacacaggacctcgcctctccagtgcttcggagcgtttcaatctgcacaaaagtggaggaagcatttcgacaggcccacgtgatagtcgtcttggacgactccactaacaaggaggtgttcactctggaggattgtctcagatctcgagtaccactctgtaggctttatggttatctgatcgagaaaaacgcccatgagagcgttagggtgatcgttggcggaaggaccttcgtgaacctgaagacagtgctactgatgaggtacgcccctcgaattgcacataacattatcgccgtagctttaggtgtcgagggcgaggcaaaagcaatcctcgccaggaaactcaagaccgctcctagttacataaaagatgtgataatatggggaaatatttcggggaacaactatgtcgacctgagaaaaactcgcgtctacaggtacgaatccgctatctggggcccgctgcattatagccgacccgtgctgaatctcattttcgactcagaatgggtcaaaagagagtttgtcgctatactcaaaaacctaactacgaccggtagacagttcgggggcatcctggctgcccacagtatagccacgacactcaaatattggtatcacggcagtcccccaggggaaatcgtttctctgggtatcctgagcgagggacagtttgggattccaaagggaatcgtgttctccatgccagtcaagttcgaaaacggcacttgggtggtacttaccgatctgaaggacgtggagattagcgaacaaatcatgactcgcatgacttcagatctgatacaggagaagcttgtagctttgggtgacaaaattcactttcaaccttatcagtcaggccataaagacctggttcccgacgaagaaaaaaatttggctatgtccgatgccgccgaatttcctaatcagattccacagactaccttcgagaagcctcagtcccttgagtttctcaacgaatttgaggggaaaaccgtggagtcttag

SEQ ID NO: 48678 - DNA, 852 bp, Artificial Sequence
  Description of Artificial Sequence: Synthetic coding sequence
atggccaagttcgtgatcgccggccgggccgactgcccctactacgcaaagacagaattagttgccgattacttacagaaaaacctgccagatttcagaattcataagatcacacagagaccggaagtatgggaagattggctgaaggacgtgtgcgaaaagaacaagtggtcacataaaaatagcccaatcatctggcgggagttgctcgatcgcggaggcaaaggcctgcttctcggagggtacaatgagttcctggagcatgcgcagctctactacgacgttaccagcagtatgacaacagaactgatgatggtgattgcccaggaaaacctgggggcccatatagaaaaagagcaagaagaggaggccctgaagacttgcatcaacccccttcaagtatggattacaagtgaatgggtgaagcgagaatttgtcgctatccttaagaacctcactactacgggccgacagtttggaggaatactcgcagcacactccatcgctaccacgctgaagtactggtatcacgggtcccctcccggcgagattgtgagcctgggcatcctgtctgagggacaatttgggatccctaagggtattgtattctcaatgccagtgaagttcgagaacgggacgtgggtggtgcttacggacctcaaggatgtggagatctcagagcagatcatgacccggatgacatccgacctcatacaagagaaattggtcgcattgggagacaagatacacttccagccttaccagtctgacaccccacggattaacactctgcatccatccatccaatcctcgtggcattccgttctgacaatcacaattagaaagcggtag

SEQ ID NO: 48679 - DNA, 1554 bp, Artificial Sequence
  Description of Artificial Sequence: Synthetic coding sequence
atggccaagttcgtgatcgccggccgggccgactgcccctactacgcaaaaactgaactggtcgccgactatctccaaaaaaatctccctgacttccggatccacaagataacgcaaaggcccgaagtctgggaggattggcttaaagatgtctgcgagaaaaataagtggagtcacaaaaattctccaatcatttggcgcgagctgctggatagggggggcaaagggcttctcttaggcgggtacaacgagtttctggaacacgcacaactgtactatgatgttaccagctctatgacgacggaattaatgatggtcatcgcccaggaaaacctgggggcccacatcgagaaggaacaggaggaagaagccctgaaaacatgcatcaacccactacaagtgtggattacatccgccagcgctcctgcgtgttataatttgattccaatcctgacttctggggaggtgttcgggatgcataccgaaataagcatcacactgtttgacaataaacaggctgaagaacatctcaagtcactggtggtggaaacacaggacctggcttcacctgtgttgcgctctgtgagcatctgcacgaaggttgaagaagccttcagacaggcccacgtgattgtagttctcgacgactccactaataaggaagtatttaccttggaggattgcctgagatccagggttccactctgccgcctgtacggctacctgatcgaaaaaaatgcccacgaatctgttcgtgtcatagttgggggtagaacctttgtgaatctaaaaactgtgctgctgatgcggtacgccccgcgtatcgcacacaatattattgcagtcgcccttggggtagaaggagaggccaaagccatcctggcaaggaaattaaagacagcgccgtcatatattaaggacgtaatcatctggggtaatattagtggaaataattacgtggatctgaggaagaccagggtctacagatacgagagcgccatctggggccccctgcactattccagaccggtgctgaaccttatcttcgactctgagtgggtgaagagagaattcgtggccattctcaaaaaccttaccaccaccggacgccagttcggtggaatccttgccgcccatagtattgccaccacgctgaaatactggtatcatggcagccctcctggagagatcgtgtcactggggatcctctcagagggtcagttcggcatcccaaagggcatcgtgtttagcatgcccgttaaatttgagaacggaacttgggtcgttttgacagacctgaaagatgtagaaatctctgaacagatcatgacccgcatgacctccgatctaattcaggagaagttagttgctctgggtgacaaaatccactttcagccatatcaaagcgggcataaggacctggtcccggatgaagaaaagaatctggctatgagcgatgcggagttcccgaaccaaattccccagacaacttttgagaagccacagagcctcgagttcctcaacgagttcgaaggcaagaccgtagagagttag

SEQ ID NO: 48680 - DNA, 705 bp, Artificial Sequence
  Description of Artificial Sequence: Synthetic coding sequence
atggagcggggcggcggcggcagcggcaccggcagccggcccgagggcacagctcgcggaacctccttacctggaaaaattgctgagcccggagccgtgagaactagccagccaaactaccggccgcaaggcatggagggtttcctgaagagcgacgagagacagagactcgccaaggagcggagggaagaaagggagaaatgtctagccgcacgtgaacagcagattttggaaaagcagaaacgcgcacgcctgcaatacgagaaacagatggaagagcgttggagaaaactggaggagcaacgccaaagagaagaccagaagcgcgcggctgttgaagaaaagaggaagcagaagcttcgcgaagaagaagaacgcctcgaggctatgatgagacgcagtctggaacgcacacaacagctcgaactcaaaaagaagtactcgtggggtgctccactcgcaatcggccccggcggccatgacggggaatctgaaaacacgccccctcctcctcttggcttggccgccagcactttgcctccagatgcggggaccaccgcagccgccgcagaatcaactaatgcatgtgacaaactatcaactagcaccatgtctctgcctaagccgaccgagccccccatgaacaaacgcctcagcagtagcactgtagcaattagttattcccccgatcgcgatgagaagtag

SEQ ID NO: 48681 - DNA, 2322 bp, Artificial Sequence
  Description of Artificial Sequence: Synthetic coding sequence
atggagcggggcggcggcggcagcggcaccggcagccggcccgaggggactgctcgtggcacatctttacccggcaaaattgcagaacccggcgcagtccggaccagtcagcctaactaccgtccccaagggatggagggctttctaaagagcgatgagcgccaaaggttagcgaaggaaaggcgcgaagagcgcgaaaaatgcttagctgcccgtgagcaacagatcctggagaaacagaagcgggcgcggctgcaatacgaaaagcagatggaagagaggtggcgcaaattggaggaacaacggcagcgcgaggatcagaagcgtgcggctgtcgaggagaagaggaagcagaagctccgcgaggaggaggagagactggaagcaatgatgagaaggagcctggagaggactcaacagctggagcttaaaaagaaatacagctggggcgcacccttggccatcggcccagggggccatgatgcctgcgacaaattgtcgacatctaccatgagcctgcctaagcctaccgaacctccgatgaataagcggctatcctctagcacagtggctatcagctattcccctgacagagcccaccacatgcacttgtcccctatggaggccatcctggtctcgcgcctcctcacacccacccagtcttccctggcccggtctagagcctccgtgatgctgagcgggcaagcaaacgatagcgtgttccacgtgtgtcccaggctcgcacccctggggccgctcaatcccagttacaaatctagtcccacacgcaacatcgagaagaagaaggcaaccagcacctcgacttccggcgccggagatgttgggaaggaagccctctcagggggggaggcctcactggtggagaaagtgaagcgcggccagaggacagctacgtcactcccggttgttaactttggctcacccctccggcggtgtgagttctcgggcggtatccctaagagaccatcgtctccagtgatctcaaagacagctaccaaggcctatccccagagccccaagacaactaagcccccatatccgggtagccctgtgaagtatcgccttcccgctctttccgggcaggatatgccaaagcggaaagcagaaaaggagaagtctaataaggagcgcgaaggcaccttagcccagcaggccgcagggccgcagggtgaagaagcgctcgaaaagcatgtggtcgataaacacgcaagcgaaaaacacgccgccgccgctggaggcaaggctgaaaactctgcggcattaggaaagccgaccgccggcaccaccgacgccggcgaggcggccaaaattcttgctgagaagcggcgacaggccaggctgcaaaaggaacaggaggaacaagagcggctcgagaaggaagagcaggacaggctggaaagggaagagcttaaacggaaagcagaggaagagcggctgcggctcgaggaggaagccaggaaacaggaagaagaaaggaaaagacaagaggaagagaagaaaaaacaggagggagaggaaaaaaggaaagcaggagaagaagctaaacggaaggccgaggaagaactactcttgaaggagaaacaggaacaagaaaagcaggagaaagcgatgatcgaaaaacagaaggaagccgcagagaccaaagctagagaggtggccgaacagatgcgccttgagagagagcaaatcatgctgcagatagagcaagaacgcctggagcgcaagaagcggattgacgagattatgaaacgaacaaggaagtctgacgtgtcgccccaggttaagaaagaagaccctaaggtgggagtccaacccgccgtgtgtgtagagaaaaaaaccaagctcgtagtgcctaacaaaatggagataaacgggcttaacacttgtcaggaagtaaatggagtcgatcacgctgcaccagaaacttatcctcaagacattttcagcaacgggttgaagccagccggtggtctaatccatctggacgctcttgatggcaaatccaacagcctagacgattccacagaagaggttcagtcaatggacgtgagtccggtttctaaggaagagctaatatcaatccccgaatttagtcctgtaagtgagatgatcccaggagtgagcctcgaccagaatggtacaggcaacgcccgggctctccaggacctgttggattttactggtccccccacattcccaaaaagatcatcagagaatcttagcttggacgattgcaataaaaatcttatcgaaggtttcaacagcccaggccaggaaactccactgaatacattctgctag

SEQ ID NO: 48682 - DNA, 2199 bp, Artificial Sequence
  Description of Artificial Sequence: Synthetic coding sequence
atggagcggggcggcggcggcagcggcaccggcagccggcccgagggaactgcaagaggcacctctctccctggcaagatcgcggagcccggagctgttcggacctcacagcccaattacaggccacaggggatggaggggttcctgaagagcgatgaacggcagaggcttgcgaaggagcggcgcgaggagcgagagaaatgtttggccgcacgagaacaacagatactggaaaagcagaagcgtgcccggttacagtacgagaagcaaatggaagagcgctggagaaaactcgaagagcagaggcagcgggaagatcaaaagagagcagcagtggaagaaaaaagaaaacagaaactacgggaggaggaagagaggctggaggccatgatgagaagatctttggaaaggacacagcaactggagcttaaaaaaaagtattcatggggcgccccccttgccataggccctggggggcacgatgcttgtgataagctgtctacaagcacaatgagtctgccaaagcctaccgagcccccgatgaacaaacgtctatcttcctctacggtggccattagttactcaccagatagggtgtttcacgtgtgtccacggctagcccctttggggccattaaacccatcatataaaagcagcccgacgcgcaacatagagaagaagaaggctaccagtaccagtaccagtggagccggtgatgtgggcaaggaggccctatctggcggggaggcctctctcgttgagaaggtgaagagaggacagcgcaccgcaacatcacttcccgtggtgaatttcgggagtcccctacggcgctgtgagttctcaggcggtatcccaaagcggcccagctcccccgtgattagtaagaccgccaccaaagcttacccacagtcaccaaagaccactaagccaccgtaccctggatcccccgtcaagtacagactgccagcgctgtccgggcaagatatgcctaagaggaaggccgagaaggaaaagagcaataaggagagggaggggacccttgcgcaacaagcagccggcccccagggcgaagaagccttagagaaacacgtggtggacaagcatgcatccgagaaacatgcagcagccgcgggaggcaaggccgagaacagcgctgcgcttggcaagccaacggccgggactaccgacgcaggcgaagcggccaaaatactggccgaaaagagacgacaagctaggctgcagaaagagcaggaagaacaggaacgtctggagaaagaggagcaggatagactcgagagagaagagctcaagcgcaaagcagaggaagaaagattgaggctcgaggaggaggctcgcaagcaagaggaagagcgcaaaaggcaggaggaagagaagaaaaagcaggaaggggaggagaagaggaaagccggagaagaggccaagcgtaaagctgaggaggagctcctgctcaaggaaaagcaagaacaggagaagcaggaaaaggccatgatagaaaagcaaaaggaagccgcagagacaaaggctagagaggtggcagagcagatgcgcctggaaagagagcagatcatgctgcagattgaacaagaacgcctcgaacggaaaaaaagaatagacgagattatgaaaaggacaaggaaatccgacgttagccctcaggttaaaaaagaggacccaaaggtgggggtccagcccgctgtgtgtgtggaaaaaaagaccaagctagtggtgccaaacaagatggagatcaatggcctaaatacttgccaggaggtgaacggagtcgaccacgccgcccccgagacctacccccaggacatcttcagcaacggtctcaaacctgccgggggcctcatccacctggatgctctggacgggaagtcaaacagcctggatgactccaccgaggaagtgcagagcatggatgtgtcccctgtctccaaggaggagctgatatcaatcccggagttctctcctgtcagcgagatgatccctggcgtcagtttggaccaaaacggtacagggaacgcccgcgcgctccaggatctcctggattttaccggcccgcccacattccctaaacgttcctcagaaaatctctccctggacgactgcaacaagaacctcatagaaggattcaatagccctggacaggaaacaccactaaatacattctgctag

SEQ ID NO: 48683 - DNA, 2064 bp, Artificial Sequence
  Description of Artificial Sequence: Synthetic coding sequence
atggagcggggcggcggcggcagcggcaccggcagccggcccgagggtaccgcccggggcacaagtcttcccggcaaaattgccgaacccggagctgtaagaaccagccaaccaaattatcgcccgcagggcatggaggggtttttgaaatctgatgagcggcagcggctcgccaaggaaagaagagaagagagagagaagtgcctggcggccagagagcagcagattctcgagaagcagaaacgggctcgcctgcaatatgaaaagcagatggaggagagatggcggaaacttgaggagcaacgacagcgggaggatcagaagagggccgcggtggaagaaaaacgtaaacagaaactgcgagaggaggaggagcgcttggaagcaatgatgagacggagtctggaacgtactcaacagctcgaattgaaaaagaagtactcgtggggcgcacctttggcaatcgggcctgggggccacgatgcccctctaggccctctgaaccccagttataaaagcagccccactcgcaacattgagaaaaagaaggccacaagcactagcacctcgggcgcaggcgacgtgggaaaagaggccttgtcaggtggagaagcctcactagtcgaaaaggtgaaacgcggacagaggacagccacttctctacccgtggttaatttcggaagtcctctgcgtcggtgtgagttttccggcgggatacccaaaagaccttcctcccccgtcataagcaagactgctaccaaagcgtatcctcagagtcccaaaactaccaagccaccttaccctggctcaccagtgaaatatcgccttccagccttaagcggccaagacatgcccaagagaaaggccgagaaggaaaaaagtaataaggaaagggagggtacactggcacagcaggcagcaggaccccagggcgaggaggccttggagaaacacgtagtggataaacacgcgagcgagaaacatgccgccgccgccggaggtaaggccgagaattcagctgccttgggaaagccgacagcggggaccaccgacgctggtgaggctgcgaagatactggccgaaaagcgacgacaggctaggctgcagaaagagcaagaggaacaggagcgactggaaaaggaggagcaagataggctggagcgggaagaactgaagaggaaggcagaggaggaacggttgagactggaagaagaggcgaggaagcaagaggaggaacggaagcggcaggaggaggaaaaaaaaaaacaggagggtgaagagaaaagaaaagccggcgaagaagctaagaggaaagctgaagaggagcttttgctaaaagagaagcaagagcaagagaagcaggaaaaagctatgatcgaaaagcagaaagaggctgcagagacgaaggcccgagaggtggcagagcagatgcggcttgaaagagagcagattatgctgcaaattgaacaagagcggctggagcgaaagaagcgcattgatgagatcatgaagcggactaggaagagcgatgtaagtcctcaggttaaaaaagaggatccaaaggtgggagtgcagccagccgtctgtgtggagaaaaaaactaagctcgtggtgccgaacaaaatggagatcaatggcttaaatacatgccaggaggtgaatggagtcgatcatgctgcccctgaaacctacccccaggacatcttttctaacggccttaagcctgccggaggtctgatccacctggacgcattggatgggaagagcaactccctggacgacagcaccgaggaagtccagtcgatggacgtatctcccgtcagtaaagaggagctgatcagcattcccgagtttagtccagtaagtgaaatgatcccgggagtatcactcgaccagaatggcacagggaacgcacgcgcactgcaggatctgctggactttactggcccccccacttttcctaaacggtcctctgaaaatcttagcctcgacgactgtaataaaaacctgattgaggggttcaattccccaggacaggagacaccccttaacactttctgctag

SEQ ID NO: 48684 - DNA, 2043 bp, Artificial Sequence
  Description of Artificial Sequence: Synthetic coding sequence
atggagggcttcctgaagagcgacgagcggcagcggctggccaaggaaagacgggaggagagggagaagtgtctggccgcccgggagcagcagatcctggagaagcagaaaagagccagattgcagtacgagaaacagatggaggaacgatggcgtaaattggaagaacagaggcagcgtgaggatcagaaacgggctgcagtggaagaaaagcggaagcaaaaactgcgggaggaggaagaacggttggaggccatgatgcgccggtctctggagcgaactcagcaattagaattaaaaaagaagtacagctggggggctcctctcgctatcggcccgggcggtcacgacgcctgtgataagctgagcacaagtaccatgtcactcccgaaaccaactgagcctccaatgaacaaacgtctgagttcctcaactgtcgccattagctactctcctgacagggctccattgggacctctgaacccgagctataagtcctcgccgactaggaatattgaaaaaaagaaggctaccagtactagtacaagtggggcgggggatgtcggaaaagaagccttgtcagggggtgaagcctccttggtggaaaaggttaagaggggccaaagaacagctacaagcttacccgtggtgaacttcggcagtcccctcagacgctgcgagttcagcggtgggatcccaaagcgaccctcaagccctgtcatcagcaaaaccgcaacaaaggcctatccgcagtctcccaagacaacaaaacctccctaccctggaagtccagtgaagtaccgcttgcccgccttgtcgggacaggacatgcctaaacgcaaagccgagaaagaaaagagtaataaggagagggaagggactctggcccagcaggcagctggcccacagggcgaagaagcattggaaaaacacgtcgtcgacaagcacgccagtgagaaacatgctgctgccgccggcggaaaggctgagaatagtgcggccctgggtaaacctactgccggcactacggatgctggagaggctgccaaaatcctagccgagaagaggagacaggctaggctgcagaaggaacaggaggagcaggagcggctggagaaggaagagcaggatcgccttgagcgggaggagctgaagcgtaaggctgaggaggaaaggctccgcctagaggaggaggccagaaaacaggaagaggagaggaagagacaggaggaggagaaaaagaagcaagaaggcgaggaaaaaagaaaagctggtgaagaagcaaaaagaaaagctgaggaggagcttctcttgaaggagaagcaggaacaggagaaacaggaaaaggctatgatcgagaagcagaaggaagccgctgagaccaaagctagggaggttgcagagcaaatgcgcctggagcgggagcagataatgttacagattgaacaggaacgattagagcggaagaagcggattgatgagattatgaagcgtacccgcaagtccgacgtctcccctcaggttaaaaaagaggacccaaaggtgggagtccaaccagccgtgtgcgtcgagaagaagaccaagttggttgtacccaacaagatggaaattaatgggctgaatacatgtcaggaagtcaatggagtggatcacgcagcaccagagacatacccacaggatatcttcagtaatggcttgaaacccgccggcggcctaattcacttggatgccttggatggcaagagtaatagtctagatgatagcacagaggaagtgcagtcaatggatgttagcccagtgagcaaggaggagctaatatccattccagaattcagccccgtttcagagatgattccaggggtgagcctggatcaaaatggaacagggaatgccagagctctacaggatctgcttgatttcacaggaccacccacgtttccaaagcggagtagcgagaatttatcccttgacgattgcaataaaaatttaatcgaaggcttcaactcacctgggcaggagacgcctctgaatactttctgttag

SEQ ID NO: 48685 - DNA, 1854 bp, Artificial Sequence
  Description of Artificial Sequence: Synthetic coding sequence
atgatgcggcggagcctggagcggacccagcagctggagctgaagaagaagtactcctggggagctcctctggctataggccctggtggacatgacgggctcgccgcctccaccctcccacccgacgccggaacaaccgcagccgctgccgaatcaactaacgcgtgtgataaactgagtacatctactatgagcctgcctaaacctactgagccaccgatgaacaagagattgtcatctagcactgtcgcaatttcttatagccctgatagagcacctctcggtccactgaacccatcatataaatcatccccaacccgcaatattgagaaaaaaaaggccacctctacatctacctccggcgccggggatgttggaaaggaggccttatctggcggcgaagcatcattggttgagaaggtcaagcggggtcagcgtaccgctacaagccttcccgtagttaacttcgggtccccccttaggcgatgtgagttcagcggaggtatcccgaagaggccatcttcgcccgttatttcaaagacagcgacaaaagcctacccacagtcacctaagaccaccaaaccgccttatcctggctctcctgtcaaatacagactgcccgccttgtccgggcaagatatgcccaagcgtaaagcagagaaggaaaaatccaataaggaaagggaggggactctcgcccagcaagccgccgggccccagggtgaggaggcgctggaaaagcatgtggtcgataagcacgcctccgagaagcacgcagcagcagccggcggcaaggcagaaaattccgcagccctcggaaaaccaaccgcgggtacaacagatgcaggggaagctgccaaaattctcgccgaaaagaggagacaggccagactccagaaagagcaagaggagcaggagaggctggaaaaagaggagcaggatagactggaaagggaggagctgaaacgcaaagcggaggaggagcggttaaggttggaggaagaggcgcggaagcaggaggaggagcgcaaaaggcaggaagaagagaagaagaagcaagagggtgaggaaaaacgaaaggccggggaagaggcgaagaggaaggccgaggaggagctcttactcaaggaaaaacaggagcaggaaaaacaggagaaggcaatgatagagaagcagaaggaggcagctgagaccaaggcacgggaggtggctgagcaaatgcggctcgaaagggaacagatcatgctccagatcgagcaagagaggttagagcggaagaagcgaatcgatgagattatgaagcgtacaagaaaaagcgacgtgagcccacaggttaaaaaagaggaccccaaagtgggggtgcagcccgctgtgtgtgtcgagaagaagactaaattggtggttccaaacaagatggaaatcaatggtctcaatacctgccaggaggtgaacggagttgaccatgctgctcccgagacatacccgcaggatatcttcagtaatggcctgaagccagcaggaggtctgatacacttagatgcactggacggtaagagcaatagcctggacgacagcacagaggaggtgcaatctatggacgtgagtcccgtttctaaagaagaactgatctccattccagaatttagtccagtgtcagaaatgataccaggtgtctcactggatcaaaatggcacagggaacgcccgagcactacaagatctcctggactttaccggccctcccacctttcccaaacgctcgagcgagaatctcagtctggacgattgtaacaaaaacctgattgaaggcttcaactctcccggacaggaaacccctctgaacacattttgttag

SEQ ID NO: 48686 - DNA, 1248 bp, Artificial Sequence
  Description of Artificial Sequence: Synthetic coding sequence
atgcggggccgggactggcccaagaaggacgagaagaaggagaagaacgtctggttgctgggatctaatcgcagctggcgaaataggaaagagcccggttgctcaactaagtccaagtggcgctcagacggcgaaaattggaaatcctctggaagcggtcggacaaagcgggagctactgtggaagagaaaaggcaattctgctgccttgggaaagcctactgccggaactaccgacgccggggaagccgctaaaatacttgccgaaaagaggagacaagcacggctgcagaaggagcaagaagaacaggaacgtctggaaaaggaggaacaagaccggctggagcgcgaggagcttaagcgcaaagccgaggaggaaaggctgcggctcgaagaggaggcacggaagcaagaggaggaaaggaagcgacaggaagaggaaaagaaaaagcaagagggagaggagaaaaggaaggcaggggaagaggccaagaggaaagcggaagaggagctccttcttaaggagaagcaggagcaagagaagcaggagaaggccatgattgaaaagcagaaagaggcagccgaaactaaggcaagagaggtggccgaacagatgcgtctggagagggagcagatcatgttgcagattgagcaggagagactcgaaagaaaaaaacgcattgatgagataatgaagcggactaggaaatccgatgtaagcccccaggtgaagaaagaggaccccaaggtaggcgtgcagcctgcggtatgtgtcgagaagaagacaaagctggttgtgcccaataagatggagattaatggtttgaatacctgtcaggaggttaatggggtcgatcatgccgcacccgaaacatacccgcaggacattttcagcaacggactaaagcctgccggggggcttatccatttggatgccttagacggcaagtccaactctctagacgatagtacagaggaagtgcagagcatggacgtgtcgcccgtgagtaaagaggaactaattagtatacccgagtttagtcctgtctccgagatgataccaggcgttagcctggatcaaaacggcaccgggaatgcaagagcacttcaggatctgctggactttaccgggcctccgacctttcctaaacggagttcagagaatttatcactggatgactgtaataagaacctgatcgaaggcttcaactcccctggccaagagacccccttaaacacgttttgctag

SEQ ID NO: 48687 - DNA, 522 bp, Artificial Sequence
  Description of Artificial Sequence: Synthetic coding sequence
atgctgcccccccccccccggcagccccccccccaggcccgggccgcccggggcgcagtgcgactacagaggccctttttgcgatcaccattgggggtgcttcggctgctccagcttctggctggggccgctttttggatcacaattgccacctctaaataccaaggccctgtgcattttgctctctttgttagtgtcctcttttggctgttaaccttaggcctttatttcctgaccctgctgggtaaacatgagttagtgcctgtgttggggtctcggtggctgatggtaaatgttgcccatgacgtcctggcagctgccctgtacggcgctgccaccgggatcatgagcgatcagatgcagcggcattcttactgtaatctgaaagattatccgcttccctgtgcatatcacgcgttcctggctgctgcagtttgtggtggtgtgtgtcacgggctgtatctcctcagtgccctttatggctgtggtagaagatgccaaggtaagcaggaggtcgcatag

SEQ ID NO: 48688 - DNA, 1158 bp, Artificial Sequence
  Description of Artificial Sequence: Synthetic coding sequence
atgcagaccagcagcaagcccagcgacttcctgaacctggccaagaagaaacggaagttcagcgagctacttactacagtcgtgcttctctgtctgctcaccccgtcctggacctcgacgggccgcatgtggagtcacctgaatagactgctattctggtccatcttcagctctgtgacgtgtcgcaaggccgtcctggattgtgaagcaatgaagaccaatgagttcccctcaccatgtcttgacagtaaaactaaggtcgttatgaaggggcagaacgtgtccatgttctgctcccataaaaataagtccctccaaattacctacagcctcttcagacgcaagacccatctgggcacccaggacggcaaaggggagcccgcgatatttaacttgtcaatcacagaggctcatgaatctgggccctataagtgtaaagctcaggtaacctcatgcagtaagtatagcagagatttctcatttaccatagtagacccagtgaccagccccgtccttaacatcatggtgatacagaccgagaccgaccggcacattacactgcactgcttgtctgtcaatgggtcccttcccattaattacacattcttcgagaaccatgttgctatctcgccagccatctctaaatacgatagagagcctgccgagttcaatctaactaagaagaacccgggcgaggaagaggaatataggtgtgaggcgaaaaatcgcttgccaaattacgcaacatactcacacccagttaccatgccaagcactggaggggatagctgtcccttctgtctgaagctgctactgccagggttgctgcttctgctggtggtgataattctcatcctggccttttgggtcctacccaaatataaaacccgcaaagctatgcggaataatgtgcctcgcgataggggagacacggccatggaggtggggatttacgctaatatcctggaaaaacaggccaaggaagagtcagtccccgaagtcgggagccggccatgtgtttctacagctcaggacgaggccaagcacagtcaggagcttcagtacgctacccccgttttccaagaggtggccccacgagagcaggaagcttgtgattcatataagagcggctatgtgtactcagaactcaacttttag

SEQ ID NO: 48689 - DNA, 1413 bp, Artificial Sequence
  Description of Artificial Sequence: Synthetic coding sequence
atgaagttcctgctgatcctgctgctgcaggccaccgccagcggcgcactgcccctgaactcctctacgtcactggaaaaaaacaatgtgctgtttggggagcgctatctggagaagttttatggacttgaaatcaataaactgcctgtgactaaaatgaagtacagcggaaatctgatgaaggagaaaatccaggaaatgcagcatttcttggggctgaaagtgactggtcagctcgacacctctacactcgagatgatgcatgctcctcgttgcggtgtgcccgacgtacaccacttccgcgagatgcccggtgggccagtgtggcggaaacactacattacatacaggatcaacaattatacacccgatatgaatcgtgaggatgtcgattacgctatccgcaaggcttttcaggtgtggagcaatgtcacccctctgaagttttcaaaaatcaacacaggcatggcggacatacttgttgtgtttgcccgcggcgctcacggggattttcatgccttcgacggaaaggggggaatcttggctcatgcttttgggccggggtcaggaattgggggtgacgcacattttgatgaggatgagttttggaccactcattccggcggcacgaacttattcctcaccgccgtgcacgagatcggtcattctctcggactggggcattcctctgatcccaaggcagtgatgtttccaacttataaatatgtggatataaatactttcaggttgagcgctgacgatattcggggcatccagtccctgtatggtgaccccaaagagaaccagagactgcctaatccagacaactctgagccagcactttgcgatcccaacttaagtttcgacgctgtaacaacagtgggcaacaaaatcttcttttttaaggatcgcttcttctggctgaaagtgtccgagagacccaaaacctccgtaaatctcatcagcagcctatggcctaccttgccctctggaatcgaagctgcttacgagatcgaggccagaaaccaggtgtttctatttaaggatgacaagtattggttgatttcaaacctgcggccagagcccaattatcctaagtcaattcactccttcggttttcccaattttgtgaaaaaaatcgacgccgctgtgttcaaccctcgtttctatcgaacttatttctttgtggacaaccagtattggagatacgacgagaggagacagatgatggacccaggataccctaagctcattactaagaatttccagggcatcggtcctaagatcgacgcagtcttctattctaagaataagtattactactttttccagggctctaatcaatttgagtacgattttcttcttcagcgcatcaccaagactttgaagtccaattcctggttcggttgctag

SEQ ID NO: 48690 - DNA, 324 bp, Artificial Sequence
  Description of Artificial Sequence: Synthetic coding sequence
atggccggcgaggacgtgggcgccccccccgaccacctgtgggtgcatcaagaaggcatatatagagatgaataccagcggacttgggtggccgtagtggaggaagaaacctccttcctgcgcgctcgagttcagcagatccaagtgccattgggagacgccgcacggccctctcacctcctgacatcacaattgcctctcatgtggcagctgtaccctgaagagcgctacatggataataattccaggctatggcagattcagcatcatctgatggtgcgaggcgtgcaagagctcctactcaaactgctacctgatgattag

SEQ ID NO: 48691 - DNA, 3345 bp, Artificial Sequence
  Description of Artificial Sequence: Synthetic coding sequence
atgctgagctgcctgaaggaggagatgcccccccaggagctgacccgcaggctcgcgaccgtgattactcacgtggatgagatcatgcaacaagaggtccgtccacttatggcagtggaaatcattgaacagctccaccggcaattcgcgattctgtccggcggaaggggagaagacggagctcctattattactttcccagaattttctgggttcaaacacattcccgacgaagatttcctgaatgtaatgacctacctgacttctatcccttctgtcgaggccgcctccatcggattcatcgttgtgattgacaggcggcgcgataagtggtctagtgtcaaagctagtctgacaagaattgcggtagccttccctggcaatctgcagctgatctttatcttgcgcccctcgcggttcatacaaagaacctttacagacattgggattaaatattaccgcaatgagtttaaaaccaaggtgcctatcattatggtaaactccgttagtgatttgcacggatacattgataaaagccaactgacacgagagttgggaggtactttggaatatcgtcatggacagtgggttaatcaccgtaccgccatagaaaattttgctcttaccttaaagacgactgcccagatgttgcagaccttcggatcttgcctggccacggccgaattaccacggtctatgctgagcaccgaggacctcctcatgtcccatactagacagagagacaagctccaggatgagcttaagctgctcggcaaacaggggactaccttgcttagctgcatccaggaacccgccacaaagtgtcccaacagcaagcttaatctcaaccagttagagaatgtgacaaccatggagcggctgctggtacaactggacgagactgaaaaagcttttagccacttttggagtgagcaccacctcaagctcaaccaatgcctgcagctacaacattttgaacacgatttttgcaaagccaagctggccctggacaacctcctggaagagcaggctgagttcactggcatcggcgatagcgtgatgcacgtggagcagattctaaaggagcataaaaaactagaggaaaagagccaggagccactggagaaggcgcaactacttgcactagtgggggatcaactgatccagagtcatcactacgcggctgacgctatacgcccgagatgcgttgaactgaggcatctgtgcgacgattttatcaatgggaacaaaaagaagtgggacatacttggaaaaagtctggaattccacaggcagctggataaagtgagccagtggtgtgaggctggcatctacctcctcgccagtcaggccgtggataaatgtcagagccgcgaaggggtcgacattgcactcaatgacatcgcgaccttcctcggaactgtgaaagagtatccactactaagtccgaaggaattttacaacgagtttgagctgctactcactctggatgctaaggccaaggcccagaaggtccttcaacggttagacgatgttcaagaaatttttcacaaacggcaggtgagcttaatgaagctggcggccaagcagacccgccccgtgcagcctgtagctcctcaccccgaatctagcccaaaatgggtgagttcaaagacttctcagccttccacttccgttccgcttgcgaggccactccgtaccagcgaagaaccgtacactgaaacggaactgaatagcagaggtaaggaagacgacgagacgaagttcgaggtcaagtccgaagagatatttgaatctcatcatgagcgcgggaatcccgagcttgaacaacaagcccggctgggcgacctgtccccccggcggcggataatccgtgacctcctggaaacagaagaaatctacataaaagaaattaagagcattattgatgggtatatcactcctatggactttatttggttgaaacacctcatccccgacgttctgcagaataataaggactttcttttcggaaatattcgggagctttatgaatttcataatcgcacatttctcaaagaactggaaaaatgcgcagagaatcccgagcttctggctcattgcttcctgaaacggaaggaagatctgcaaatttattttaaataccataaaaaccttcccagagcgcgagccatatggcaggagtgccaggactgtgcatatttcggtgtgtgccaaaggcagctggaccataaccttcccctgttcaagtatttgaaaggccccagtcagcgactcattaagtaccagatgttgcttaaggggttgctcgatttcgaaagcccagaggatatggaaatagacccaggggaactcggcgggtcggcgaaggatggcccaaagcgcaccaaagactcagcttttagtactgagctgcagcaggcgttggccgttatcgaagacctgataaagtcctgcgagctggctgttgacttggccgctgtgaccgaatgccccgatgatatcggcaagttgggcaaattgctgctccatggcccgttttcagtttggacaatacacaaagatagatacaagatgaaagacctcatcagattcaagccttctcaacgccaaatatacctgtttgagaggggaatcgtattttgtaaaatccgtatggaaccaggcgatcaggggctctcaccacattacagtttcaagaagaccatgaaactgatgaccctgtcgatcagacagctaggtagagggagccacaggaagtttgagattgcttcacgaaatggtctggaaaaatatattctccaggccgcatcaaaggaaattcgtgactgttggttcagtgaaatcagtaagctcctcatggaacaacagaacaacatcaaagaccaggggaacccccagtttgagatgtcaacaagcaaagggagtggtgccggatcaggtccctggataaaaaacatggaaagggccactacatccaaagaggaccccgcatcctctactggggggattaagggatgttctagtagagagttctcttctatggacactttcgaagactgcgaaggtgcagaggatatggaaaaagagagttccgcactgtctctggccggactgttccagtccgacgattctcacgagacatgctcatcgaagtcagcctttcttgagcgaggcgagtcttcacagggcgagaaagaggagcgagatgaggaagaaactgccacacgatcaacagaggaggagagggccggagcctccaccggacggctcgctcccgctggtgccaccgctggctttcaggccagagccttacgccccaggacgtctgcacaggagagttag

SEQ ID NO: 48692 - DNA, 1887 bp, Artificial Sequence
  Description of Artificial Sequence: Synthetic coding sequence
atgctgagctgcctgaaggaggagatgcccccccaggagctgacccgtcgccttgcaacagttatcactcacgttgatgaaattatgcagcaagaggtgagaccattgatggctgttgaaatcatagagcaattgcaccgtcagttcgccatcctgagcggggggcggggcgaagatggcgccccaatcattacctttccagaattctctggtttcaaacacattcccgacgaggattttctgaacgtcatgacctatttgactagcatacctagtgtcgaggccgccagcatcggtttcatcgtggtcattgatcgcagacgggataagtggtcgagcgtcaaggccagtctgacccgcatcgctgtggcctttccaggcaatcttcaactcatattcatactgcgcccatcgaggttcattcagagaacatttactgacataggtattaagtactacaggaacgaattcaagactaaggtgcccattatcatggtcaactctgtctctgaccttcatggatatatcgataaaagtcaactgacccgcgagttaggcggcactctggagtaccgacatggacagtgggtgaatcatcgcacagctattgagaattttgcactgaccttaaagaccaccgcccagatgcttcaaacattcggttcctgtctggcaacagcggagcttccgcggtcgatgctgtctactgaagacctactcatgagccataccagacagagagataaacttcaggacgagctgaaactgctaggaaagcaaggcacgaccctgctgtcatgtattcaggagccagccacgaagtgtccaaactctaaactcaacctgaaccagcttgagaatgtgactaccatggagcgactcctggtgcagttggacgaaacagagaaagcattctcgcatttttggtcagagcaccacctgaaacttaatcaatgtctgcagctgcaacactttgagcacgacttctgtaaggcaaaattagctcttgacaatctgctcgaggaacaggctgagttcaccggtataggagatagtgtgatgcacgtcgaacagattttgaaagagcacaaaaaactggaggagaaatcacaggagccactcgagaaggcccagcttctggctctggttggcgaccaattgattcaaagtcaccactacgctgctgatgctataagaccccgatgtgtggagttgcggcacctttgtgatgatttcattaacggcaacaaaaagaaatgggatatcttgggaaaatcactcgaattccaccggcagttggacaaagtctcccagtggtgtgaagccgggatctaccttcttgccagccaagctgttgataagtgccagtcaagagagggggtcgacattgccctgaacgatattgcgaccttccttgggacagtcaaggagtatccgctgttgtcccccaaggagttttataatgaattcgagctgctgctgacactcgatgcgaaagccaaggcccagaaggttttgcagcgcctggacgacgtccaggagatcttccacaaacggcaggtgagtctgatgaagctggcagctaagcagactcggcctgttcagccagtggctccccatcctgaatcctctccaaaatgggtcagttccaaaaccagccagccttctacttccgtgcccctcgcacgccccctaagaacatcagaagagccttataccgagacagaactgaactcccggggcaaggaggacgacgagaccaagttcgaggtgaagagtgaagagatcttcgagtcacatcatgaacgggggaacccagagctggagcagcaggctagactgggcgacctcagcccaagaaggtatagcagccaatactttaaatag

SEQ ID NO: 48693 - DNA, 519 bp, Artificial Sequence
  Description of Artificial Sequence: Synthetic coding sequence
atgcacgtggagctgcggcacctgtgcgacgacttcatcaacggcaacaaaaaaaaatgggacatccttggaaagtcgctggagtttcaccggcagttggataaagccaaagcccagaaagtgctccagagattagacgatgtccaggagatttttcataaacgccaagtttccttgatgaagctagctgccaagcagacaaggcccgtgcagccagtcgcacctcaccccgagagctctccaaaatgggtgtccagcaagactagccaacccagtaccagtgtgcccttggcacggcccctgcgcacatctgaggaaccttatacggagactgaactcaactcccgaggcaaggaagacgacgaaaccaaattcgaagtgaagtcagaagaaatctttgagtcccatcacgaacggggcaaccccgagttggagcagcaggcaaggctgggtgatttgtcgccccggtctgtcatcactgtgtgcgtctgtgagatgctgacattaggggtccagtag

SEQ ID NO: 48694 - DNA, 2136 bp, Artificial Sequence
  Description of Artificial Sequence: Synthetic coding sequence
atgctgagctgcctgaaggaggagatgcccccccaggagctgaccagacgcctcgccacggtgatcactcatgtggatgaaatcatgcagcaggaggtgaggccactcatggcagtagagatcatcgaacagttacacaggcaattcgccatcttatcaggcggccgcggggaggacggggcccccattatcacatttccagagttttctggatttaagcatatcccggatgaggactttctgaatgtcatgacctatcttacttcaattccctccgttgaagctgcatcaattggctttatcgtagtaattgaccgcaggcgtgacaaatggagctcagtcaaagccagtttgacacgaattgctgtggcttttcctggaaacctgcagctcatctttattctccgcccatctcgattcattcagcgtacttttaccgacatcggtatcaaatactatcggaacgaattcaagactaaggtccccattatcatggtgaacagtgtgtccgatctgcatggctacatcgacaagagccagctgacacgcgaactcggcgggactttggaataccggcatggccagtgggttaatcacaggacagcgatcgagaacttcgcactcacacttaagacgacagcccagatgttacaaacgttcggatcctgcttggccacagcagagctgccccgttccatgctgagcactgaggatctgcttatgagtcataccagacagagagataagcttcaggacgagttgaagctgctggggaaacagggcacaaccctcctgtcgtgcattcaggagcccgcgaccaaatgcccaaactccaagctgaacctcaaccaattggaaaatgtaaccactatggagagacttttggtgcagctggacgaaaccgagaaagctttctcacacttctggtcagagcaccacctgaagctgaatcagtgcctccagttacagcacttcgagcacgacttctgtaaggccaagctggctctggataatctcctagaggagcaggcagagttcacaggcattggggattcagttatgcatgtcgagcaaatactgaaggaacataagaaactggaggagaaatcccaggagcccctggagaaagcccagttactcgctctggtcggagatcagttgattcagtcccaccactacgccgccgacgccatccgcccccgctgcgtggagctgcgccacctttgtgatgacttcatcaatggcaacaagaagaaatgggatatcctgggcaaatccctcgagttccacaggcagttggataaagtttcacagtggtgtgaggcagggatttacctactggcttcccaggcagtggataagtgtcagtctagagagggagtggatattgccctcaacgatatagcgaccttcctgggcactgttaaagagtatccactcttgtctcctaaagagttttacaacgagttcgaattgttactgactctggacgccaaggcaaaagcccagaaggtgttgcagaggctggacgatgttcaggaaattttccacaaaagacaggtcagcctgatgaaactggcagcaaaacagactcggccggtccaaccagtagcaccacatccagaatcctccccaaagtgggtcagttccaagacaagccagccatccacaagtgtcccattggccaggcctctgagaacttcggaggagccctacacagagacagagctgaatagcagaggtaaggaagacgacgagactaagttcgaagtaaagtcagaggaaatatttgaaagccatcacgaaagaggaaatcccgagttggagcagcaggcccggttaggggacctaagcccaagacggcgcatcattagagatctgctcgaaaccgaagagatctatataaaggagattaagtcaataatagatggatatatcacacctatggatttcatctggcttaaacatttgatccctgatgtcctccaaaacaacaaggacttcctgttcggaaacatccgtgaactttatgaatttcataatcgaaccttcctcaaagaactagagaagtgtgcagaaaatccagagctgctggcccactgctttctcaagcgggtaagcttatacagccagtag

SEQ ID NO: 48695 - DNA, 3225 bp, Artificial Sequence
  Description of Artificial Sequence: Synthetic coding sequence
atgctgagctgcctgaaggaggagatgcccccccaggagctgacccggcgcttagctacagttataacccatgtggatgagataatgcagcaggaagtgcgacccctgatggccgtggagattatcgagcagctacatagacagttcgccattctaagcggcgggagaggcgaagatggcgcacccattattaccttccccgagttttctggcttcaaacacatcccagatgaggatttcctgaacgtgatgacttacctaacgtctattccctccgtggaggccgcatctatcggcttcattgtggtgatcgataggcggcgcgataagtggtccagtgtaaaagctagccttacgagaatcgctgtggcatttcccggaaatctccagcttatcttcatcctcaggcccagcagattcattcagcggacatttaccgatatcggaattaagtattataggaacgagtttaaaaccaaggtgccaatcatcatggtgaacagtgtgtcggacctgcacggctatatcgacaagtcccagcttactcgggagctggggggaacactggaatatcggcacgggcaatgggttaatcatcgaaccgccatcgagaactttgcgctgactctgaaaaccactgcccaaatgctccagacattcggttcctgtttggcaaccgccgagctgcctcggtccatgctgtccaccgaagatctgctgatgtcccacaccagacagcgcgataagctccaggacgaactgaagctgctggggaaacaaggcaccaccctgctatcttgtattcaggagcccgcgacgaagtgcccaaactccaaactgaaccttaatcagctggagaacgtcactaccatggagagattgctggtgcaactggatgaaactgaaaaggcctttagccatttttggagcgagcaccacctaaagcttaatcagtgcctgcagctccagcattttgaacatgatttctgcaaagcgaaattagcattagacaacttactggaagaacaggccgagttcaccggtatcggcgacagtgtgatgcacgtggaacaaattctgaaagaacataaaaaactggaagagaagtcacaagaacccttggagaaagcccagttacttgcgctggtgggcgatcagttgatccagagccaccactatgccgccgacgctatccgcccacgctgtgttgagttgaggcacctgtgtgacgattttataaacggaaacaaaaaaaagtgggatattctgggcaagtcactggagttccatcggcagctggataaggtttctcaatggtgtgaggccggcatctacctgctagcctcgcaggcagtggacaagtgtcagtctagagaaggagttgatattgccttgaatgacattgctacttttctgggtacagtgaaagagtatcccctcctcagccccaaggagttttacaatgaatttgaactcctgctgaccttggatgccaaggccaaagctcagaaagtgctccagagactcgatgatgtgcaagagatctttcacaagcgccaggtgagcttaatgaagcttgcggctaagcaaacacggcctgtgcagcctgtggcaccacacccagagagctccccgaaatgggtcagttcaaaaacaagccagccctcaacctccgtgcctctcgcccggccactcagaaccagcgaagagccctacactgagacagaactcaattccagagggaaggaggacgacgagaccaagttcgaggttaagtcagaagagattttcgagtcacatcacgaaagaggtaaccccgagctggaacagcaggcgcgcctcggagacctcagccccagaagaaggattatacgggatctcctggagactgaagagatttatatcaaggaaattaagtccatcattgacggctatattaccccaatggactttatctggcttaaacatctgattccagatgtgctacagaacaacaaagatttcctgtttggaaatattcgtgagctctatgaattccataataggaccttcctaaaagaattggagaaatgcgcagaaaaccccgaactgctggcacactgtttcctcaaaaggaaggaagatctgcagatatactttaaatatcacaaaaatttaccaagagcccgggctatttggcaggaatgccaggattgcgcctacttcggagtgtgccagaggcagttagatcacaaccttccgctcttcaaataccttaaaggacccagccaaaggcttattaagtaccagatgctccttaagggtttgctggactttgagagtccggaagatatggaaattgacccaggggagttaggcggaagtgccaaggacggccctaagcggacaaaagactcggccttctccaccgaacttcaacaagccctggcggtgatcgaggacttaatcaagtcatgtgaactggcagtcgacttggccgcagtgaccgaatgccccgatgacatagggaagttagggaaattactgttgcatggccctttctcagtgtggaccatccataaggaccgttacaaaatgaaggacctgatccgatttaaacctagccagaggcagatctacctgttcgaaagggggatcgttttctgtaaaattaggatggagcctggcgaccagggtctgagtccacactatagttttaagaagacaatgaagctcatgaccttgtctattagacagttggggcgcggttcccacaggaagttcgaaatagcttcacgcaatggcctggaaaagtatattttacaggccgccagtaaggagataagagactgctggttttccgagatcagtaagctgcttatggagcaacagaataacatcaaagaccaaggaaacccgcagttcgaaatgagcacttcaaaggggtccggcgctgggagtgggccatggatcaaaaatatggaacgcgcgaccacaagcaaagaagatccagcctcgtcaacaggcgggattaaggggtgttctagccgggaattctccagcatggacacttttgaggactgtgaaggggctgaggacatggagaaagagagctcagcattgagcttggccggcctttttcagagcgacgactcacacgaaacctgtagctccaagtctgcattcctggaaaggggtgaaagctcgcagggagagaaagaagaaagggacgaggaggaaacctag

SEQ ID NO: 48696 - DNA, 360 bp, Artificial Sequence
  Description of Artificial Sequence: Synthetic coding sequence
atggaggagcccgagatgcagctgaagggcaagaaggtgaccgacaagttcacagaatctgtgtatgtgctggcaaatgaaccgagcgtcgctctgtatagactgcaggagcacgtgaggcgcagtttgccagagcttgcccaacataaagcagacatgcagcgttgggaagagcagtcccagggagcaatatacactgtggaatatgcttgctcagctgtgaaaaatctggttgattcatcggtctatttccgctcagtagaaggcctgctaaagcaggcgattagcatccgagaccacatgaatgcctccgcgcaaggacacagtcctgaagagccacccccgccatccagcgcttag

SEQ ID NO: 48697 - DNA, 330 bp, Artificial Sequence
  Description of Artificial Sequence: Synthetic coding sequence
atggaggagcccgagatgcagctgaagggcaagaaggtgaccgacaagttcacagagagcgtgtacgtcctggcgaacgaaccctcagtggcactttaccgactccaggaacatgtccggcgttctctgcctgagctggcccaacataaggctgacatgcagcgatgggaagagcagtcccaaggcgccatttatacagtggagtacgcctgctcagccgtcaagaacctggttgattcatcagtgtacttccgaagcgtggagggcctgcttaagcaggcaataagtatacgcgatcacatgaacgcctctgcccagggacacaggtag

SEQ ID NO: 48698 - DNA, 717 bp, Artificial Sequence
  Description of Artificial Sequence: Synthetic coding sequence
atgctggccctgaccctggccaaggccgacagcccccggaccgccctcctgtgctcggcttggctgcttacagctagcttttccgcccaacagcataaaggctcgctccaagtgcaccagacactaagtgttgagatggaccaggtgttgaaagccctgtcattcccgaaaaaaaaggcagctctgctgtcagcagccatcttatgtttcctgcggaccgccctgagacagagcttttcctccgcactggtagcgctcgttccatccggagcccagcccctaccggccaccaaagataccgtgctggcccccctgagaatgtcccaggtgagatcattggtaattggtctacaaaatttgttagttcagaaagaccccctgctcagccaagcatgcgtaggatgtctggaggctctcctcgactatctcgacgcacggtcccccgacatcgcattgcatgtggccagtcagccatggaacagattcctgctcttcaccctgctggacgcaggggagaatagtttccttagacccgagatactacgcctgatgaccttgctgcagagcatggggcacctggcggatcattccatggcccagaccctccaagcctcattggaggggttacctccttcaacatcgagcggtcagccacctcttcaggacatgctatgtctggggggggtggctgtaagtctgtcacatattaggaactag

SEQ ID NO: 48699 - DNA, 1824 bp, Artificial Sequence
  Description of Artificial Sequence: Synthetic coding sequence
atgtgcctgaacctgctgagcgcccccgagaagaccggccccccctccaaggaggaactgagtgctgtatcagaattgctgcagcacggcctgccccagatttccagtaggtcccccgagagtctggcctttctgtcagacagacagtacatggagggggccgctagacagcgccaatactgcatcctgttattattctatctggcttatatacacgaggacaggtttgttagtgaagcagagctgtttgaagccgtgcagtcatttttgttgtcgctgcaggaccagggcgaacggcccccgctcgtggtgttcaaagcttctatttatctcttagctatctgccaggacaaagataatactctcagagagaccatggtgtcggcaataaggaagttcctggaggggattcccgatctgcagctggtctacactcaccatcccttgctgttgcgattctttcttctttacccagaactgatgtcccgctatggtcaccgggtcctggagctgtggtttttttgggaagagtcctcctacgaggaactggatgatgtgaccagcgcaggccagccagccctgcccgcttctctggtggtgctgtttcagctccttcgttccatcccttcgatcctcctcattctgcttgatttaatctattcttctccggtagatacagcccacaaagttcttatcagcctccggaccttcctgcgccggaatgaggatatacaggtggggggtcttatccgcgggcacttcttgctgatactccagaggctgttagtggagcatggagcctcaccctccggcgtctcaaagttatgcggtaaatgttcaccaactgatgtggacatcctgcagccaagtttcaacttcctgtattggagcctccaccaaacaacaccttcgagccaaaagcgagccgcagcagtgctcctttcttcaaccgggctgatggagctgcttgagaagatgttggcccttaccctggccaaagcggattcacctcgcactgctctactgtgctccgcctggctcctgacagccagttttagcgcgcagcaacataagggaagtctacaggtgcaccagaccctttcggtggagatggatcaggttctaaaggccctgagttttccaaaaaagaaagccgccctactgtccgcagccatcctttgcttcctgagaactgctctgagacagtcgttttcctcggccctggtggccctagtcccctctggtgcgcagcctctgccagcaaccaaggacacagttctggcccctctgcggatgagccaggtaagaagcctcgttattgggctccagaacttgcttgttcagaaagaccccctgctgtctcaggcttgtgttggctgtttggaagctttgttagactatctggatgcaaggagtccagatatcgctcttcacgttgctagccaaccttggaaccggtttttgctgtttactctgctggacgccggagaaaattccttcctacggcccgagatcctgagactcatgaccctctttatgcgataccgctccagctcagtactgtcacatgaagaggttggagatgtgctccagggggtggctctcgcagatttgagtacattatctaatactacactccaggcactgcacggttttttccagcagttgcagtcaatgggacatctagctgatcacagcatggcccagacacttcaggcctccctggagggacttcccccctccacatcgagcggccagcctcccctgcaggatatgctttgcttgggaggagtggcagtatccctcagccatattagaaattag

SEQ ID NO: 48700 - DNA, 3825 bp, Artificial Sequence
  Description of Artificial Sequence: Synthetic coding sequence
atggccgtgcggcaggccgccaccgccggcacccccggcccccggagggaggaagaggctgcgctgctgtttgagagagctcattaccgacacgacccacgatggttgctaccagtgactccacggttatgcttagcttgcgccctggaacttctacccgatcctggggttagcctggtgaggaaaaagcacatgctttcgtgctttcaggacgccctcgtcaggcatactagcttggtcacacaacttgttagtcaggaccagcgagtgtgcatccatttcatctcagttctgttcggtctgctctgttcaatggaagatgggtctgtcaccgacctctgcattgaagttcttattcaaatcacaacccagctgaagctggagcagactatcagatgtctccttgacgaatgtcacaaggagctgtgcaatatgcctagtatgagaggcagcttagcgactctcaccctgcttgggaaacttgtggatgcaattcctgccttagcggacgaattggttatggaacacggcaacttgatggaacacctgctgcgcggcctggtgtatccttcagaaggtatccaagcatccgtgtgttacctgtacggtaaattatattccagcccagtcgccgcggagatgctgtcaggacatttccgcgaaaagttgttccctctctttctttccatcctggatggtgcccaaacaaaagagctgcagattaactgccttggcctcctaaggcagctactgaagtacgacttgtttgtgtcaatgatcatgaaccaagatggtttgggggagagcgccaaaaacattgaagggtcgagcggtaacaccagcctgcctcttgtcttgaagaaactgcttctttcacgagacgagaccctgcaggtagcctctgcgcattgtatcaccgcagtgctggtgcactcccctgcaaaacacgccagtgcctttattcacgcagacatccctgagttcctttttgaacatctgtcaagctcttccgaggtcctggtttggagtagctgtaattgcttaactctgttagtagaggagcctctcttctttagcaagtgtcatactgtgtacggaatcgaagccgtggtgcggtccctccaaggctccttaaagatgaacaacatagaactccacaagcaagggctcctgttgtttgctgaaatcctgactcgccaacccgaggaaatcaaattatttacttcctcagctatgtgcagagatgccggccgagccttgcaggaggctgtgagttcccccgtgctggaggtggctgctgaggccctgaaagccacaagtgccttcctgcgcaaagaccaccagtccacccccccggtgcaatatggggaactgcaggccctcttggaggccatgcttaatcgttgtgccgagttctcgcaaaccctgctaagccggcggcctcttggtcatgcctcgtcgagagattctgaaaaggccatcctgcagaggggcaaattcctgctgagtaccctcgaagggtttcggagcgcatgtagactggctatagagtttcagtccgaaccctctgcccaagaaaacccgtttacagcgccatccgccaaaaaagaggacaccctcgaggctttctcagaatttttgttgtcggcctgcgactctctctgtatccccatggtcatgaggcatctcgagcagactactcatccagctctgatggaagtgttcctgagcatcctccataatctgttcgtgattgtgcctcacatgaaagaaaaattcagcaagaaactcgcttcaagttcgttcattcgattaaccctcgaattaaaagcccggttttgttcgggattatcccacagcgcgctgaaccaggtatgttctaattttctttattacatgtgcctgaatcttctgtccgcgcctgagaagactggaccaccctccaaagaagaactgagtgctgtttctgaactcttacagcatgggcttccacagatcagctcaaggagcccagagagcttagctttcctaagtgacagacagtatatggagggggctgcacgccaaaggcagtattgtatcctcctccttttttacctcgcgtatattcacgaagacaggttcgtgagcgaagcagagctatttgaggctgttcagtctttcctgctgtctctacaggatcaaggggagagaccccccctggtggtcttcaaggcatctatctacctgttggccatctgccaagacaaggacaataccttacgcgaaaccatggtgtcagccattaggaaattcctggaagggattccagacctccagctcgtttatacccatcaccccctgcttctaaggtttttcctgttatacccggagctgatgagtcgctacggtcaccgggtactggaactttggttcttctgggaagaaagctcttacgaggagttagatgatgtaacctctgcagggcaacctgcccttcctgccagtttggttgttttgttccaactgcttagaagcatacctagcatcctcttaattctcttggatctaatatactcaagccccgttgacaccgctcacaaggttcttatcagtttgcgaactttcttgcgccgtaatgaggacatccaggtcggcggcctgatcaggggacacttcctcctgattctgcagcggctccttgtggagcacggtgcctccccctcaggagcaagcggcaacctccccttgctgctgagcctccttagccttatgcagctaaggaacgtttccgagcaggagctggatagcgtggccatgaagttgctacatcaggtaagcaagctgtgtggaaagtgcagtcccacagatgtggatattctgcagcccagctttaatttcctgtattggagcctgcatcagactacaccctcctctcaaaaaagagcggccgccgtgcttctttctagtacgggactcatggagttgctagagaagatgctggcactgacacttgccaaagcagattcaccgcggactgcccttctgtgctcagcatggctgctgaccgccagcttctccgcccaacagcacaagggaagtctgcaagttcaccagaccctttccgtggaaatggaccaggtgctgaaggccttaagctttcctaagaagaaagccgctctcctgtctgctgccatcttgtgtttcctccggaccgccttgaggcagtcattttctagcgccctcgtcgccctggttcctagtggcgcacagccactgccggccacaaaagacactgtcttagctccactaaggatgtcacaagttcgaagcttggtgatagggcttcagaatttgctggttcagaaggaccccctcctgtcgcaagcctgcgtaggttgcctggaggcacttttggattacttggacgcccgtagcccagacattgctctacatgtggcatcccagccttggaatcgctttctgttatttaccctgctagatgctggagagaactcctttttaaggcccgaaattctccggcttatgacactgttcatgagatacagaagcagctcggtattgtctcacgaggaagtgggcgacgtactgcagggggtggcacttgccgatctctctacactgagtaatactacattgcaggccctgcacggcttctttcaacagctgcagtcaatgggccatctggctgatcactcgatggcccaaaccttgcaggcgtcactggaaggactcccaccatcgacctcctctgggcagcctcccctacaggatatgttatgtctgggaggggtggctgtcagcttaagccatattcgcaactag

SEQ ID NO: 48701 - DNA, 1155 bp, Artificial Sequence
  Description of Artificial Sequence: Synthetic coding sequence
atgggccacccccaccaggagagcagcctgttcttcaccgccagcggcaatctacctcttctgctgtccctgctctccctgatgcagcttcgcaatgtatctgagcaggaactggactccgtggccatgaaactcctgcaccaggtatccaagctttgtgggaagtgttctccaactgacgttgacatattgcaaccatccttcaattttctgtattggtcccttcaccagactacgccaagtagccagaaacgagccgccgctgttctcctatcttccactggactgatggagctgttggaaaaaatgcttgccttgactttggcaaaagccgatagcccaaggacagctcttctttgtagcgcctggcttttgaccgcatccttctccgctcagcaacacaagggttccctgcaggtgcaccaaactctatcggtcgaaatggaccaggtgcttaaggccctgtctttccctaaaaaaaaagccgccctactgtccgcggcgatcctgtgcttccttcgtactgcattaagacagtcattctcttccgcgctcgtggctttggtccccagcggagctcagcccctacctgctactaaagatacagtgctggcaccactgaggatgtcgcaggttaggtccctcgtcattgggttgcaaaatctgctagtacaaaaggatccccttctaagtcaggcttgcgtgggatgcttagaagcgctgctggattatctcgacgcaagatcccccgatattgcgcttcacgtggcctctcaaccatggaatagatttttactctttacactgcttgatgctggggagaactccttcttacgcccggaaatcctgaggctgatgaccttgttcatgaggtataggtcctcatcagttctgagccatgaagaagtcggagacgtgctccagggtgtggcccttgcggacttatccaccctgtcgaatacaacgttgcaagcactgcacggatttttccagcaactacagagcatggggcacctggccgaccatagtatggcgcagaccctgcaagcctcactggaaggactccccccgtccacatccagtggacagcctcctctccaagatatgctctgcttaggaggtgtggccgtatcccttagccacatccgtaattag

SEQ ID NO: 48702 - DNA, 1521 bp, Artificial Sequence
  Description of Artificial Sequence: Synthetic coding sequence
atgaaccaggacggcctgggcgagagcgccaagaacatcgagggcagttctggcaataccagccttccgttagtgctcaaaaagcttcttctcagtcgcgacgagacacttcaagtggcaagtgcgcactgtattacagccgtcctggtgcatagcccagcgaaacatgctagtgcatttattcatgcagacatccctgagttcctattcgaacatctatcctcttctagcgaggtcctggtatggtcctcctgtaactgcctcaccctgctggttgaggagccattatttttttctaagtgtcataccgtgtatggtattgaagccgtggttcgatcattgcagggttctttgaagatgaacaacatcgagctgcataaacaaggcttgctcctgttcgctgaaatcttaactcgccagccagaggagatcaagttatttacatcctctgccatgtgccgggacgctggccgcgccctacaggaggctgttagctcccctgtgcttgaggttgcggcagaagctctgaaagccacgtcagcctttctccgcaaggatcaccagagcacacctcctgtgcagtacggcgaactgcaagccctgttggaagcaatgcttaaccgatgtgcagagtttagccagaccttattgtctcggaggcccctgggtcatgcgtcatctcgcgattccgaaaaagccattctgcagcgcgggaagttcctgttatctactctggaagggttcagaagtgcctgtcgcctggccatagaatttcagtccgagccctctgcccaggagaacccttttaccgccccttctgccaagaaggaggacactctggaagcgttctcagaatttctgctttcagcttgtgatagtctctgtattccaatggtgatgcggcacttagaacagaccacccaccccgcactcatggaggtgttcctctccatcctgcataacctgttcgtaattgtgccccacatgaaggaaaaattcagcaaaaagctggccagctcatcctttatccggctgacattggaactcaaagcccggttctgttccgggctgagccacagcgcgctgaatcaggtgtgctctaactttttgtattacatgtgcctgaacctcttgtcggcccccgagaagaccgggcccccatcaaaggaggagctttccgctgtgtccgagcttctccaacacggcctgccccagataagctcacgatcccccgaaagtctcgcttttctctcagatcgacagtacatggagggagccgctcgccagcgacaatactgcatcctgctcctgttttacttagcttacattcatgaagatcgcttcgtttcggaagcagagctcttcgaagccgtgcagtcatttttgctgtcacttcaggatcagggtgaaaggccgcctttggtcgtgttcaaggcctcaatttacctactggcaatctgccaggacaaagataatactttgcgagaacaactgcattgtagcttaatcagcatctcgtag

SEQ ID NO: 48703 - DNA, 810 bp, Artificial Sequence
  Description of Artificial Sequence: Synthetic coding sequence
atggagggcgccgcccggcagcggcagtactgcatcctgctgctgttttatcttgcttatattcacgaggataggttcgtgtccgaggccgaactgtttgaagcagttcaatctttccttctgtccctgcaagatcagggtgagagaccaccactggtcgtgttcaaggcatctatctacctactcgcaatctgtcaagataaggacaacactcttagggagacaatggtcagcgctattcggaaattcctggagggcattcctgatttgcaactggtttatacccaccacccactgctactaaggttctttttgctgtatcccgaactaatgtctcgttacggacatcgcgtgctcgagctgtggtttttctgggaggagtccagttacgaagaactcgacgacgtcacctccgccggtcaacctgcactgcccgctagcctcgtcgtgcttttccagctgttgaggtcaattccgtccattctcttgattttgctggacttgatctattcatctccagtcgacaccgcccacaaggttctcatctcgctcagaacctttcttcggcgaaacgaggatatccaggtcggcgggctgataagggggcacttcttacttattttgcagcgcctgctcgtggaacacggagccagcccttctggggtccttctggttctgcactctctcggggagcccaccatagcagccgagcctcctctgcctgatgccgcccaggagtgtgtccgcgcaaggaccggacagcgggggcatgaagcacctagcccgagatgtcccggatgcctcgggtag

SEQ ID NO: 48704 - DNA, 1203 bp, Artificial Sequence
  Description of Artificial Sequence: Synthetic coding sequence
atgagcaaggtgagcaccatgttcagcgaggacgacttccagagcacagaacgagccccttatgggcctcagttacaatggagtcaagatctccctagagttcaggtgtttagggaacaggcaaacctagaggatcggtctccccgacgcacacaacgcatcaccggaggagagcaagtgttgtggggccccatcacccagatcttccctaccgtccggcccgccgacctcaccagagtaatcatgcctctggagcagaggagtcagcactgcaaacctgaggaaggactgcaagcgcaggaggaggacctgggactggtaggcgcccaggccctgcaggcggaagagcaggaggccgccttcttcagttccacccttaatgtcgggaccctggaggagctacctgccgcagaatctccatcacctcctcagagcccacaagaggaatcattttctcctacggcaatggatgccatctttggctcgctttccgacgaaggcagcggctcacaagagaaggaaggaccaagcacaagcccagaccttatcgacccagaatcctttagccaggatatactgcacgacaaaattatagacttggtgcatctgctcttacggaaatatcgggttaagggcctcattacaaaagctgaaatgttgggaagcgtgattaaaaattatgaggactatttccctgagatatttcgcgaggccagcgtttgcatgcaactattgtttggcatcgatgttaaggaggtggaccccactagccacagctacgttctagtcacatccctaaatctgtcctacgatggtatccagtgcaatgaacagagtatgccaaaaagtggtctgctcattattgtgctgggggtgatctttatggaaggtaattgtattcccgaagaggtgatgtgggaggtcctaagcatcatgggagtgtacgcgggccgagagcacttcctatttggcgaacccaaacggcttttaacgcagaattgggtacaagaaaaatatctcgtctacaggcaagtacccggaacagatcccgcctgctatgaatttctttgggggccccgagcacatgccgagacctcaaagatgaaggtcctggagtacatcgccaacgccaacggccgggaccccacctcgtaccctagcctgtatgaggatgcgctaagggaagaaggagagggagtgtag

SEQ ID NO: 48705 - DNA, 957 bp, Artificial Sequence
  Description of Artificial Sequence: Synthetic coding sequence
atgctgctgggccagaagagccagcggtacaaggccgaggagggccttcaggcccagggggaggctcccggactcatggatgtgcagatccccacagcagaagagcagaaggccgcatctagcagctcgacgctaataatgggcactctggaagaggttaccgactccggctcaccctctcctccccagtccccggagggagcatctagcagtctgacagtgactgatagcactctgtggagccagtccgatgaaggtagctcttccaatgaggaagaggggccatctacatctcccgatccagctcacctggagtcactatttcgggaggccctggacgaaaaggtggcggagttggttcgtttcctgctgcggaaataccaaattaaggaacctgttacaaaagccgagatgcttgagtccgtgatcaaaaactataagaatcactttcctgatatcttcagcaaagcttctgagtgcatgcaggttattttcggcatcgacgtgaaggaggtcgatccagcaggacactcctatatcctcgtgacatgcctcgggctgtcttacgacggactactgggcgatgatcagagcactcctaagacaggactgctgattatcgttctgggcatgatccttatggaggggtccagggctcctgaggaggcgatatgggaggctctatctgtcatgggcctttatgatggaagagagcacagcgtgtactggaagcttaggaaactcctgacacaggagtgggtgcaggaaaattatctggaatataggcaagcgcctggaagcgatccagtgcgatatgagtttctatgggggccacgggcgctcgcagagacaagctatgtgaaggtgctggagcacgttgtgagggtcaacgcccgggttcgaatttcatacccctcactccatgaggaagcgttgggggaggagaaaggggtttag

SEQ ID NO: 48706 - DNA, 957 bp, Artificial Sequence
  Description of Artificial Sequence: Synthetic coding sequence
atgctgctgggccagaagagccagcggtacaaggccgaggagggcctgcaggctcagggcgaggcacctggactcatggatgtgcagatccctaccgctgaggagcagaaggctgcctcatcctcatccaccctgataatgggcacattggaagaagtgaccgatagtggctccccctctccgccacagtctcccgagggcgctagtagttctctcaccgtgactgattctacgctgtggtcacagtccgacgagggctcaagctccaatgaagaggaggggcctagcacatcccctgaccctgctcacctggagagtctgtttagggaggccttggacgaaaaggtggctgaactggtgcgctttttattaaggaagtaccagatcaaagagccagtcactaaggcagagatgctcgaatcagtaatcaaaaattataagaatcattttcccgacattttctccaaggcatccgagtgcatgcaagttatctttgggatcgatgtcaaagaagtcgaccctgccggccactcttacattcttgtgacctgcctgggtttaagttatgatggcctcttaggtgatgatcagtctacccccaagactggtctcttgattattgtgctggggatgattctcatggagggttccagagcacctgaggaagctatttgggaggcgctgagtgtgatggggctctatgacggccgcgagcattccgtgtattggaagttaaggaaactgcttacacaggagtgggttcaagagaactatcttgagtaccggcaggcccccgggagtgacccagtgcgatatgagtttctttgggggccgagagccctggcagagacgtcctacgtcaaagtgctcgagcatgtcgtccgcgtaaatgcaagggtacgaatcagctatccttctctccacgaggaggccctgggggaggaaaaaggcgtgtag

SEQ ID NO: 48707 - DNA, 957 bp, Artificial Sequence
  Description of Artificial Sequence: Synthetic coding sequence
atgctgctgggccagaagagccagcggtacaaggccgaggagggcttgcaggcccagggcgaagccccaggtctgatggatgttcagatccctacagccgaagaacagaaagccgccagcagtagtagcacattgatcatgggcacgctcgaagaggtgactgactctggaagccccagtcccccccagtctccggaaggggcttcttcttccctcacagtgacagattcaacactgtggtcacagagtgatgaggggagctcctctaacgaggaagaaggtccgagtaccagcccagacccggcccatttagagtcattgtttcgggaggcacttgacgagaaagtagcggaactggtccggtttctgcttaggaaatatcagattaaggagcctgtgaccaaggccgagatgctggaatctgtgatcaaaaactacaagaatcacttccccgacatcttcagcaaggcctcggaatgtatgcaagttatctttggaattgacgtgaaggaggtcgatcccgccggccactcctacatcctagtgacgtgccttggtctctcttacgacgggctgctcggtgatgatcaaagcacccccaagacgggactgttaatcatcgtgcttgggatgattctcatggaaggctcccgggctcctgaagaggccatttgggaagcgctctccgttatgggcctctacgatggccgtgaacactccgtttattggaagctgaggaagctcctgacacaggaatgggttcaggagaactacctggagtataggcaagccccaggttccgacccagttcgctacgagtttctctggggtccacgggccttggccgaaacttcctacgttaaggttctggaacacgtggtaagggtgaatgcgcgtgtgcggatctcctatcccagtctgcatgaagaagcactcggggaggagaagggcgtttag

SEQ ID NO: 48708 - DNA, 945 bp, Artificial Sequence
  Description of Artificial Sequence: Synthetic coding sequence
atgcccctggagcagcggagccagcactgcaagcccgaggagggcttggaagctcggggtgaagcactggggcttgtgggggcgcaggctcctgctactgaagaacaacagacagcatcaagctcatctactctagtggaggtgacactgggagaggttccagctgcagattccccgagccctccccacagtccacagggcgcgagcagttttagcacgactatcaactatactctctggaggcagagtgacgagggctcatctaaccaggaggaggaggggcctcgaatgttcccggacctcgagtctgaattccaagccgcaatcagccggaaaatggtggagttggttcatttccttttgctcaagtaccgggcacgcgagcccgtgactaaggccgagatgcttgagtccgtcctgagaaactgccaggactttttcccggtaattttctcaaaggcttctgagtacttacagctcgtctttggcatcgaggtggtggaggtggttccgattagtcacctttacatactcgttacttgccttgggctgagttatgatgggctgttgggagacaaccaggtcatgccaaagacggggctcctgatcatcgttctagccattatagctattgagggtgattgtgcccccgaggaaaaaatctgggaagagctctccatgcttgaggtctttgagggacgggaagattccgtctttgcccacccacggaaactgctcatgcaggatctggtccaggagaattacctggagtacaggcaggtccccggctcagaccccgcatgctacgaattcctctgggggcctagggctcttattgagaccagctacgtgaaggtgctgcatcacactctcaaaatcgggggggagcctcatataagctacccaccactacacgaacgcgctctgcgagaaggcgaggagtag

SEQ ID NO: 48709 - DNA, 945 bp, Artificial Sequence
  Description of Artificial Sequence: Synthetic coding sequence
atgcccctggagcagcggagccagcactgcaagcccgaggagggcctggaagcaagaggagaggccctagggcttgtgggcgcgcaggcacctgctaccgaggagcagcagaccgccagtagttcaagtacactggtggaggtgacactgggagaagtcccagccgcagactcccccagcccgccccactctcctcagggtgcctccagcttctccacaaccattaattacaccctgtggcgacagtcggatgagggttccagtaaccaggaagaggaggggcctaggatgtttcctgatctggagtcagaattccaggccgcgattagcagaaagatggtggagcttgtgcacttcctgttactgaagtaccgggctcgagagcctgtcaccaaggccgagatgctggagtccgttctgcgcaattgtcaggactttttccccgtcattttttcgaaggcttctgagtacctgcagttggtcttcggcatagaagtggtggaggtggtgcccatctcccacctgtatatcctcgtgacatgtctggggctgtcttatgacgggttactgggcgataaccaagtcatgcctaaaacaggcctcctaatcatagttctggccataatcgccattgagggggactgtgctcccgaggaaaaaatctgggaagaactgagtatgttagaggtgttcgaggggcgcgaggattcagtgttcgcccatccgaggaaactgctcatgcaggatctggtgcaggaaaactacctggaatatcggcaagtccccggctccgaccctgcctgctatgagttcttgtggggccccagggccctgatcgaaacttcgtatgtgaaagtccttcaccatacgcttaaaattggaggcgagcctcacatctcctacccccctctccacgaacgcgcactgcgggaaggtgaggaatag

SEQ ID NO: 48710 - DNA, 102 bp, Artificial Sequence
  Description of Artificial Sequence: Synthetic coding sequence
atgcccctggagcagcggagccagcactgcaagcccgaggagggcctggaagctaggggtgaagccctgggtctggtgggagctcaggcacctgcaacctag

SEQ ID NO: 48711 - DNA, 363 bp, Artificial Sequence
  Description of Artificial Sequence: Synthetic coding sequence
atgcccctggagcagcggagccagcactgcaagcccgaggagggcctagaagccaggggggaggctctgggcctggtgggtgcccaggcccccgccacagaagagcagcagactgcctcctcttcaagcaccctcgtggaagtgacactgggcgaagtccctgctgcagatagtcctagccccccacacagcccgcagggcgcctctagcttctccaccaccatcaactacacactgtggcgacaatctgatgaaggtagctccaatcaagaagaagaaggaccccgaatgtttcccgaccttgaatcagagttccaggccgctattagtcggaagatggtggaactggtgcactttctctag

SEQ ID NO: 48712 - DNA, 459 bp, Artificial Sequence
  Description of Artificial Sequence: Synthetic coding sequence
atgcccctggagcagcggagccagcactgcaagcccgaggagggcttagaggcacggggtgaggccctggggcttgtgggggcccaggcgcctgctactgaggagcaacagacagcgtcatcttcaagcactctggtggaggtgactttaggagaggttcccgcagctgactcaccatcccccccacattccccccagggtgctagcagtttctcaacaacgatcaactatactctgtggcggcagtccgacgaagggtcctctaatcaggaagaggagggccctagaatgtttccagatctcgagagcgagtttcaggcggctatcagccggaaaatggtggagctggtgcatttccttctactcaaataccgagcccgtgagcccgtgactaaagctgagatgttggagtccgtcttgcggaactgccaggatttcttcccggtgattttctcctag

SEQ ID NO: 48713 - DNA, 270 bp, Artificial Sequence
  Description of Artificial Sequence: Synthetic coding sequence
atgcccctggagcagcggagccagcactgcaagcccgaggagggcctggaggcccggggagaggctcttgggctcgtaggagcacaggcccccgccaccgaggaacagcaaacagcaagttcatcgtctactttggtggaggtcacactgggagaggtcccggccgctgactctcccagcccaccacattctcctcagggagccagctcattcagcaccaccataaattacaccctgtggcggcagtccgacgagggatcctccaattag

SEQ ID NO: 48714 - DNA, 447 bp, Artificial Sequence
  Description of Artificial Sequence: Synthetic coding sequence
atgcccctggagcagcggagccagcactgcaagcccgaggagggcctcgaagcccggggggaagccctgggcctggtgggcgcccaggcgcctgccaccgaagaacaacagactgccagctcatcctccaccctcgtcgaggttacgctgggggaggtgccagcagccgattccccttcgccaccacactcccctcagggtgcctcctccttctcaaccacaattaactatactctttggcgccaatcagatgaggggtcgagcaaccaagaggaagaaggaccccgcatgttccctgacctggaatcagagttccaggctgctatcagcaggaagatggtagagttggtacattttcttctgctgaaatacagggccagggaacccgtgaccaaagccgagatgctggaaagcgtccttcgaaactgccaagacttctttccatag

SEQ ID NO: 48715 - DNA, 114 bp, Artificial Sequence
  Description of Artificial Sequence: Synthetic coding sequence
atgcccctggagcagcggagccagcactgcaagcccgaggagggcctcgaggctagaggggaggccttaggtctagtcggagctcaagcccctgctacagaagagcagcagtag

SEQ ID NO: 48716 - DNA, 1032 bp, Artificial Sequence
  Description of Artificial Sequence: Synthetic coding sequence
atgccccggggccagaagagcaagctgcgggcccgggagaagcggcatcaggcgagatgtgaaaatcaggacctgggggccacccaggctacggtcgctgagggagagagcccatctccggcctatttactgtttggtgaccggcctcagaacctccctgctgcggagactccaagcattccagaagcactccagggggccccctccactacaaacgctattgctccggtttcttgtagcagcaacgagggtgcatcaagtcaggacgaaaagtctctgggctccagcagagaagcggaagggtggaaggaagacccattgaataaaaaagtggtgtccctcgtccactttctgctgcagaaatacgaaacgaaggagcctattaccaagggtgacatgatcaaattcgtcattcgcaaggataagtgtcattttaatgaaatcctaaagcgggcttccgagcatatggaattagccttgggcgtggatctgaaagaagtcgaccccattcgtcactactatgcatttttctccaaactggatcttacttacgatgaaacgacgagtgatgaggaaaaaataccaaagaccggtctactgatgatcgcccttggagtcatcttcttgaatggcaacagggcgcccgaggaggccgtgtgggaaatcatgaacatgatgggtgtctacgcagatcggaagcacttcttgtacggagatcctaggaaagttatgaccaaggacctggtgcagctgaagtacctggaatatcagcaggtgccgaactccgacccccccagatacgagtttctgtggggccctcgggctcacgccgagacatctaagatgaaggtactcgaatttgtggccaaaatccacgacactgtgccttctgctttcccaagctgttatgaggaggctctacgagacgaggagcaaaggacacaggcaagagccgccgctagagcacatactgccgccatggcaaacgcaagatcacggacaaccagctcgtccttctctcacgccaagtag

SEQ ID NO: 48717 - DNA, 2337 bp, Artificial Sequence
  Description of Artificial Sequence: Synthetic coding sequence
atggcccagaagatggactgcggcgccggcctgctgggcttccaggccgaagcatctgttgaggactctgccttgctgatgcagactttaatggaagccatccaaattagcgaggcaccccccacaaatcaggctaccgccgccgcgtcccctcagtcatctcaacccccaactgccaatgagatggccgatatacaggttagtgccgccgccgccagacccaaatctgcctttaaagttcagaacgctaccaccaagggacccaacggggtgtatgacttctctcaagcccataatgccaaggacgtccctaatacccaacctaaggctgcatttaagagtcagaatgccacccctaagggcccgaacgcggcctacgacttctcacaggcagccacaaccggagaactcgccgccaataagtccgagatggcattcaaagcacaaaacgctacgactaaagtggggcctaacgccacctataacttttcccagagcctgaacgccaacgaccttgcaaacagtagacccaagaccccctttaaggcttggaatgacaccacaaaggcgccaaccgcagacacccaaactcaaaatgtgaatcaggcaaagatggctacctcccaggccgatatcgagactgatccaggtatttcagagcctgatggtgcgactgctcagacctctgccgacggctcacaggcccaaaatcttgagagccgcacaattatccgagggaagagaacgcgcaagatcaacaacctaaacgttgaagagaactcctcaggggaccaaaggcgcgcacccctggcagccgggacctggagatccgctcctgttcccgttaccacccagaacccgccgggcgccccccccaacgttttgtggcaaactcctctcgcctggcagaacccctctggttggcagaatcaaaccgcccgccagaccccaccagcgcggcagtctcctcccgctcggcagactcccccagcatggcaaaacccggtggcgtggcagaatcctgtgatctggccgaatcccgtaatatggcaaaatccggttatttggccaaacccgatcgtgtggcctgggccggtagtgtggcccaatcctctcgcctggcaaaaccccccaggctggcagacccccccgggctggcaaactcccccggggtggcagggacctcccgactggcaggggccacctgactggcctctcccacccgactggccgctcccaccggactggcccttgcccacagactggcccctgccccccgactggataccagcggattggcccattccccccgactggcagaacttgcgcccctctcccaacctgcggcccagccctaattcccgcgctagtcagaatccgggggccgctcagccaagagatgtcgcccttctccaggaacgggcaaataaacttgttaagtacctgatgttaaaggactataccaaggtgcccataaagagaagtgaaatgctgcgggatattattagggaatatacagacgtgtacccggagataattgaaagagcatgctttgtactggagaaaaagttcggaatccaactgaaagaaatagacaaggaggagcacctgtatatacttatttctacccccgagagcctggccggcattttgggcacaactaaagacacccctaaattaggactcttgctggttatcctgggtgtgattttcatgaacgggaaccgggcaagcgaggccgtactctgggaggcactgcgaaaaatggggcttcgccctggtgtccgacacccattactgggcgaccttaggaagctgctgacatatgagttcgtcaagcagaaatacctggactatcgcagggttcccaatagcaatccgcccgaatacgagtttctgtggggactcagatcataccacgaaaccagtaaaatgaaagtgctgagattcattgctgaggtccaaaagcgcgatccccgcgattggaccgcccagttcatggaggccgctgacgaggcgttggatgccctggacgctgccgctgctgaagcagaagccagggcagaggctcgtacaagaatggggattggagacgaagctgtaagcggcccatggtcctgggatgatatagagtttgagctcctgacttgggacgaggaaggggattttggcgacccatggtcccgaatcccattcacattttgggctagatatcaccaaaacgcccgtagtcgcttcccccagacattcgccggccccataattggtcctggcgggactgcctcggcaaacttcgcagccaattttggcgcgatcggctttttctgggtcgagtag

SEQ ID NO: 48718 - DNA, 2337 bp, Artificial Sequence
  Description of Artificial Sequence: Synthetic coding sequence
atggcccagaagatggactgcggcgccggcctgctgggcttccaggccgaagcttccgtggaggatagtgctctgctgatgcagacactgatggaggccatccaaattagcgaagcaccccccacaaaccaggccactgcggctgccagtccacagagctcacaacctccaactgctaatgaaatggcggatatacaggtttcagcagcagctgcccgaccaaagtctgcatttaaggtgcagaatgccacgaccaagggcccaaatggtgtctacgacttctctcaggctcacaatgccaaagatgtcccgaacacacagcctaaagccgcattcaagtcgcagaatgccacccccaaaggtccaaatgccgcttatgatttctcacaggctgcaacaactggagagttggcagcaaacaagagcgagatggctttcaaagcacaaaatgccacaacaaaagtaggcccaaacgcgacatacaatttttctcagtcgttgaacgccaatgatctggcaaactcacggcctaaaacgccattcaaagcctggaacgacactactaaggcgcctaccgcagacacacagactcagaacgtgaatcaagccaagatggctaccagccaggcagacatcgagaccgaccctggaatctccgagcctgacggagccacggcccagacatcagccgacggctcgcaggcccagaatctggagtcccggacgatcatcagaggtaagcggacaagaaagataaacaacttgaacgtggaagaaaacagtagtggtgaccagcgaagagcgccccttgctgcgggtacatggcgatctgcaccagtgcccgtaacgacccagaatcctcccggcgctcctcccaatgtgctctggcagacacccctggcatggcagaacccttccggctggcagaatcagacggcccggcagactcctcccgcaagacagtcccctccagcgaggcagactcctcccgcgtggcagaaccctgtggcgtggcagaacccagtcatttggcccaaccccgtgatttggcagaatccggtaatttggcctaaccccatcgtgtggcccgggcctgtggtgtggccaaaccccctggcatggcagaatccccctggatggcagactcctcccggctggcagacgcctccgggttggcagggtccaccagactggcaggggcctccagactggcccctcccccccgattggccactgcccccagactggcctttgcccacagactggccactgcctcctgactggattcccgcagattggcccatccctccagattggcaaaacttgaggcctagcccgaatctcagaccgagcccaaattctagggcatcccagaaccctggcgccgctcagccacgtgacgttgctctcctacaggagcgggcaaacaaattagtcaagtatcttatgctgaaggactataccaaggtgccaatcaaacgttcagaaatgctgcgggatattatccgtgaatataccgatgtgtatcccgaaatcatcgagcgcgcttgctttgtgttggagaaaaaattcgggatccagctcaaggaaatcgataaagaagaacacctctacatcttgattagcacccccgagtcccttgctggtatcctcgggacaaccaaagacacccctaagctgggtctgcttctggtcatactcggagtgattttcatgaacgggaacagggcctccgaagcagtgctgtgggaagccctgcgcaaaatgggactgcgcccaggcgtcaggcatcctctactaggcgatttaaggaagcttcttacatatgagttcgtcaaacagaagtacctggattacagacgggtgccaaactccaaccctccggaatacgagttcctctggggcctccggtcgtaccacgagacatcaaaaatgaaggtgctccggttcattgctgaagtgcagaagagggatcctcgtgactggacagcacaatttatggaggccgcagatgaggccttggatgccctggacgcagccgcggctgaggcggaggccagagcagaagcccggacccggatgggaattggggatgaagcagtctccggaccatggtcctgggatgacattgaatttgagcttctgacctgggatgaggagggggactttggagatccctggtcacggattcccttcacattttgggccagatatcatcagaacgcacgttccagatttccccagacattcgccggcccaataattgggcccggagggaccgcttctgctaatttcgccgccaatttcggtgcaattgggtttttctgggtggaatag

SEQ ID NO: 48719 - DNA, 2220 bp, Artificial Sequence
  Description of Artificial Sequence: Synthetic coding sequence
atggccgagggcagcttcagcgtgcagagcgagagctacagcgtggaggatatggacgagggcagcgatgaagtgggagaggaggagatggtcgagggcaatgactatgaggagtttggagccttcggcgggtacggaactctaacaagttttgatatccatatactccgggctttcggttctcttgggccgggtttaagaatcttgtctaacgaaccatgggagcttgagaacccggtgttggcccagacactcgtggaagcactgcagcttgaccccgagactctggcaaacgaaacggccgcacgggccgctaacgtggctagagctgccgcctcaaatcgcgccgctcgtgctgctgccgcagccgctcggactgctttcagccaggtggtggcctctcaccgagtcgcgactcctcaggtcagcggggaggatactcagccaacaacttatgcggcagaggctcaaggcccaaccccggagccacctcttgcatctccacagactagccagatgctcgtgactagcaagatggccgcgccagaagccccagccacctctgcacagtcacagactggctctcctgcccaggaagcagccaccgaggggccatcttctgcttgcgcctttagccaggcaccttgtgctagggaagtggatgctaatcgaccttctacggccttccttgggcagaacgacgtgttcgactttacccagccggctggcgtgtccggcatggccttccccagacctaagcgccccgcgcctgcccaggaagctgccaccgaaggaccttccgcggcctccggcgtccctcagactggccccggaagagaggtggctgcaacaaggccaaaaaccaccaaaagtgggaaagcgctcgcaaaaacaagatgggtcgagccgcaaaatgtggtcgccgccgctgctgccaaggctaagatggctactagtatacccgaacctgagggtgctgctgcagcaaccgcacagcacagcgctgagccatgggctcggatggggggaaaacggactaaaaaatctaagcatctggacgatgagtatgaaagctctgaagaagaaagggaaactcctgcagtacccccaacatggagagcctcccagccatcactgactgtgagggcccagctagccccccggccccctatggcgcctagaagccagatccccagcaggcacgtgctgtgtctccctccaaggaacgttacgttgctgcaggagagggccaacaagttggtcaagtacctgatgattaaagactataagaagatcccaatcaagcgcgccgacatgttgaaggatgtcataagagagtacgacgagcactttccagagatcatcgaaagagctacatacacactcgaaaaaaagtttggtatacacctcaaagaaattgataaggaagagcacctatatatccttgtgtgcacaagagattccagcgctcgcttgttgggtaagacaaaggacacgcccagattatcgctgctgctcgtgattctgggggtgatcttcatgaatgggaacagagctagtgaggccgtgctgtgggaggccctccggaaaatgggattgcgtcctggcgttaggcacccctttctcggcgatctgaggaagctcatcacagacgacttcgtgaaacagaagtacctggagtacaagaaaattcctaattcaaaccctccagaatacgaattcttatggggcctccgggcacgccatgagactagcaagatgcgggtgttgaggttcatcgctcaaaatcagaacagggaccctagggagtggaaggcccatttccttgaagcagtcgatgatgcttttaagactatggacgttgatatggccgaggagcacgctagagcccagatgcgcgctcaaatgaatataggcgatgaagctctcatcgggagatggagctgggatgacattcaggtggaactcctgacctgggatgaggacggcgatttcggggacgcatgggctcggatccctttcgccttttgggcccggtatcaccagtatattctgaacagcaaccgcgccaaccggcgcgcaacctggagggctggggtatcaagcggcactaatggcggggcctcaacttctgtgctagacggcccatcaacctccagcacaatccggacacggaatgcggccagagccggcgcgtccttctttagctggatccagtag

SEQ ID NO: 48720 - DNA, 2274 bp, Artificial Sequence
  Description of Artificial Sequence: Synthetic coding sequence
atggccgagggcagcttcagcgtgcagagcgagagctacagcgtggaggacatggatgaggggtctgacgaagtaggagaggaagagatggtggaaggaaacgattatgaggaatttggagcttttggtggttatggcacattaacatcatttgatattcatattctgagagccttcgggtcactgggtccaggtcttcgaatcctgtccaacgagccttgggagctggagaatcccgttctcgctcagactttggtagaggcgttacaacttgatccagagaccctcgcaaacgagaccgctgcccgcgccgctaacgtcgcgcgggctgccgcttcaaaccgggcagctcgcgctgctgctgccgcagcccgcacggccttcagccaggttgttgcaagccatagagtggctaccccgcaggtgagcggtgaagacacgcagcccacgacctacgcagccgaggctcagggaccaactccagagccacctttggcttccccacagacttcccagatgctcgtcacctctaaaatggctgcacctgaggcacccgcaacctccgcacagagccagaccggcagccctgctcaggaggcagcaaccgaaggccctagctccgcttgtgctttttctcaggcaccgtgcgctcgggaggtggacgccaaccgcccgagcaccgcgttcctgggtcagaacgacgtctttgattttactcagcctgccggcgtctccggaatggccttcccgaggcccaagagacccgcccctgctcaggaggccgcgacagagggcccttctgcagcaagtggcgtgccacagaccgggccggggcgtgaagttgctgccacgcggcccaagacaactaagtccgggaaagccctggcaaagaccagatgggttgagccacagaatgtggtggcagccgccgccgccaaagccaagatggcgacgagtatcccagaacccgagggcgcggctgcagcgacagctcagcacagcgcagagccttgggcccgcatggggggaaagcgcaccaaaaagagcaagcatctggacgacgaatacgagagcagcgaagaagaacgggaaaccccagccgtaccacccacatggcgcgccagtcaaccttcgttgaccgtgcgcgcgcagctggcgcctcggcctccaatggcgcccaggagccagataccaagcaggcacgtcctttgtctgcctccccggaatgtcacattgttgcaggagagagcaaacaaacttgtcaagtatctgatgatcaaagattacaagaaaatcccaattaagagagcagatatgcttaaggacgtaatcagggaatatgatgaacatttccctgagattattgagcgtgcaacttacacgcttgagaaaaaatttggcatccacctcaaggagattgacaaagaggagcatctatacattctggtttgcacgcgggactcatcagcgagactcctgggcaaaaccaaagatacgccaagactgtcgctgctcttggtgattctcggcgttatttttatgaacgggaatagagcgagcgaggccgtcctctgggaggcactgagaaagatggggctgagacccggtgtccgccacccatttctgggcgatcttaggaagctcataaccgatgattttgtaaaacagaagaatccagaactgagagaagaaacacccttgtctatggcgccgtcttggtacctggaatacaagaaaatccctaattctaatccaccagaatacgagttcctgtgggggctccgtgccaggcacgagacctccaagatgagggttctccggttcatcgcccagaaccagaatcgggacccgcgcgagtggaaagcccatttcctcgaggctgttgatgatgctttcaaaaccatggacgtggatatggcggaagaacacgccagggcccagatgcgtgctcaaatgaatatcggagacgaggcattgatcggccggtggtcttgggatgatatccaggtagagctgttgacgtgggacgaagacggcgacttcggggacgcatgggcacggatcccgtttgccttctgggctaggtaccatcaatatatccttaattctaacagagccaaccggcgtgccacttggcgcgccggagttagctccggtacaaatggcggagccagtacatcagtacttgatggcccaagcacaagttccactatccgcacacggaacgctgcgagggccggcgcctcatttttctcctggatccagcaccgctag

SEQ ID NO: 48721 - DNA, 2091 bp, Artificial Sequence
  Description of Artificial Sequence: Synthetic coding sequence
atggagagcgagtacgtgctgtgcaactggaaggaccagctgtggcccgcaaaagtgctgagcaggagcgagacttcctccaatagtaaacgcaagaaggccttctccctggaagtacagatcctgtccctggatgagaaaattaagctcgactcaacagaaaccaaaatcttgaataagtcacagattgaggcaatcgcggcctccctaggccttcaaagtgaggattccgcacccccgacagaagaaaccgcgtatggaagatctttgaaggtagctcttggaatcctgaacgagcggaccaacctgtcacaggcctctacttcagacgaggaggaaatcacaatgctgtcacaaaatgtgccccagaagcagagtgactccccgccacataagaaatatcgaaaagacgaaggagaccttcctgggtgtctggaggagagggaaaacagtgcctgtctgctggcaagctctgaaagcgacgactctctgtacgacgacaagtctcaggcgcctaccatggtggacaccatcccttccgaggtggaaacaaagtcgctccagaatagtagttggtgcgaaaccttccctagtctgtcagaagacaacgacgaaaaggaaaacaaaaacaagattgatatcagtgctgttatgtctgtgcatagcgccgtgaaggaagaaagcgcatgtgtgaaagatgaaaagttcgcccccccactgtcacccctctcctccgatatgctcatcatgccaaaagccctcaaggaagaatcagaggacacgtgcttggaaaccctcgccgtgccttcagagtgttctgcattttcagagaacatcgaggacccgggtgaggggccttctaacccctgtttagacacttcacagaaccagccttccatggagtccgagatgggggctgccgcgtgcccaggtagttgttctcgtgagtgtgaggtctctttttccgcgagcaacccggtctgggattacagccatctcatgtcttctgaacgcaacttccagcgtttggatttcgaggagctcgaggaagaaggccaagccagcgacaagtctttgctgccctctagaataaatctgtccttacttgatgacgatgaggaggatgaggaactacccaggttcattctccactatgagacacacccctttgaaacaggcatgatagtgtggttcaaataccagaagtatccattctggccagccgtaatcaaatcaatcagaaggaaagagaggaaagcgtccgtcctatttgttgaagcgaatatgaattccgagaaaaaaggaatccgggtgaattttcgaaggcttaagaagttcgattgtaaggaaaagcagatgttggtggataaggctcgagaggattactctgagtctatcgactggtgcatttcactgatatgtgattatagggttcggattggctgtggctctttcaccggttcccttctcgaatactacgcagccgacattagttaccccgtgcgaaaagagactaagcaggacacgttccgcaacaagttccccaaactacataacgaagacgctcgcgagcctatggctgttactagtcaaactaagaagatgtctttccagaagatcctgcccgatcgcatgaaagccgccagggaccgggccaacaagaaccttgtcgatttcatagttaacgccaaagggacagaaaatcatctccttgccatcgtaaacggaacaaaaggctcacgttggctgaagagcttcctgaacgccaacaggttcactccctgtattgagacgtattttgaggacgaggatcagctcgacgaggtagtcaaatacctgcaggaggtttgtaaccagatcgatcagattatgcccacttggatcaaggatgataagattaagttcatcctggaggttctattacccgaagccatcatatgttccatcagcgcagtagatggcctggattacgaagctgccgaggccaagtatctcaagggaccctgcctgggctaccgtgagagggagttgttcgacgcgaagataatctacgagaagaggcggaaagcacctacaaatgaggcacattag

SEQ ID NO: 48722 - DNA, 2091 bp, Artificial Sequence
  Description of Artificial Sequence: Synthetic coding sequence
atggagagcgagtacgtgctgtgcaactggaaggaccagctgtggccagccaaagttctgagtcgatcagagacatctagcaattctaagaggaagaaagccttcagtcttgaggtgcagattctgagcctggatgagaaaatcaagctcgactcaacggagaccaagatactgaataagagccagatagaagccatcgcagcctccctagggctccagagcgaggactcggcaccccccaccgaagaaacggcctacgggaggtcgttgaaggtggctttgggaattctgaatgaacgaacaaatctcagccaggcatcaacttctgatgaagaggaaattaccatgttgagtcagaacgtgccgcaaaagcagtctgacagccccccacataagaagtatcgtaaggacgaaggggacttaccaggttgcctcgaggaacgtgagaatagcgcctgtctccttgcttcttccgaatctgacgactcattgtacgatgataagtcccaagcacctactatggtagacaccatccccagtgaggtcgaaacgaaatccctccagaacagttcatggtgcgaaacatttccctcactttcggaggacaatgacgaaaaggagaataagaacaaaatcgatatctccgctgtgatgtctgtccacagcgcggtgaaggaagagtccgcctgcgttaaagacgagaagtttgctccccccctttcacctttgagttcagacatgctcataatgccaaaggctctaaaggaagagagtgaggacacctgtctggagactcttgcggtccctagcgagtgcagcgccttttctgagaacatcgaagatccaggggagggccccagtaacccttgcctggacacatcacagaaccaacccagcatggaatccgagatgggagctgccgcgtgtcccggcagctgttctcgcgaatgcgaagtctccttctcagcgtcaaacccggtgtgggactactcccacttgatgtcatctgaaagaaactttcaaaggctggatttcgaggaactggaagaggagggtcaggcttcggacaagagcctccttccgtcccggattaatctcagcctgcttgatgacgacgaggaagacgaggaactcccgagatttatacttcattatgaaacccacccgttcgagaccgggatgatcgtctggtttaagtaccagaagtatccattctggcccgccgtgatcaaaagcatcagacgtaaagaaagaaaggccagtgtgctattcgtggaggccaacatgaactcggagaagaaaggcattcgggtaaatttccgccggctgaagaagttcgactgtaaggagaagcaaatgctcgttgacaaagccagggaggattactccgaatccatcgattggtgtataagtttgatctgtgattatcgagttagaataggctgcggctcctttactgggtctttactggaatattatgcggcagatatctcgtatcctgtacgcaaggagacaaaacaggacacattccggaacaagttccccaaactgcacaatgaggatgctcgtgagcccatggcagttacatcacagaccaaaaagatgagttttcagaagatccttcctgatcgcatgaaggccgcaagggaccgtgcgaacaagaaccttgtggacttcattgtgaatgcgaaaggtaccgaaaatcatttattggccatagtgaacggtaccaagggtagcaggtggttaaagtccttcttaaatgcgaacaggttcaccccctgtatcgaaacttattttgaggacgaggaccagctggatgaggtggtaaagtatttgcaagaagtatgtaaccaaatcgaccagattatgccaacgtggatcaaagatgataaaattaagttcatcctagaggtattactgccagaagctattatctgcagtatttccgccgtggatggtctcgactatgaagcagcagaagcaaaatatcttaaggggccatgcctgggatatcgcgaaagagagttatttgatgccaagattatttacgaaaagcggagaaaagccccaacaaatgaagcccattag

SEQ ID NO: 48723 - DNA, 2091 bp, Artificial Sequence
  Description of Artificial Sequence: Synthetic coding sequence
atggagagcgagtacgtgctgtgcaactggaaggaccagctgtggcccgctaaagtgctgtcccgatccgaaacgtcatctaacagtaaaagaaaaaaagccttcagtctggaggtccagatactgtcactagacgagaaaatcaagctcgacagtaccgaaacaaaaatcctgaataagtcacagattgaggcgatcgccgcttcgctggggctgcaatccgaagattcggcccctcccacagaggagaccgcatatggccgtagcctgaaagtcgccctaggcatcctgaacgaaagaactaatctgagccaggcatcaacctccgatgaagaggaaattacaatgctgtcccagaatgttccgcagaaacaaagcgactctcctccacataagaaatatcggaaagatgagggggatctccctggatgccttgaagagcgtgagaactctgcctgcctgctcgcctcatccgaaagcgatgactctttgtacgacgataaatcccaggcccctacgatggtagacaccattccatccgaggtggagacgaaatctctccagaactcctcgtggtgcgagacctttcctagccttagcgaggataacgatgaaaaagagaacaaaaataaaattgacatcagcgccgtgatgtctgtccatagcgcggtcaaagaggagagtgcatgcgtgaaggacgagaagttcgcacctcctctatctccgctgagcagtgatatgctcatcatgccaaaagccctcaaggaagaaagcgaggacacatgccttgagacccttgctgtacctagcgaatgttccgctttctctgagaatatagaagatccaggggagggcccctctaatccatgtcttgacacctcccaaaatcagccaagcatggagtccgaaatgggggctgccgcttgccccggatcctgcagccgagagtgtgaggtttcattttccgcctccaatcccgtgtgggactattctcatctcatgtcaagtgagagaaactttcagcgcctggactttgaagaactagaggaagaggggcaggcaagcgacaagagcttgttaccctcaaggatcaacctgagcctgctggacgatgacgaggaggacgaggaactcccgcgatttatcctgcactacgaaactcaccccttcgaaaccgggatgattgtttggtttaaatatcagaagtatcccttttggccggctgtcatcaaaagtattaggcggaaagagcgcaaggctagtgttttgtttgtagaggccaatatgaactctgaaaagaaaggtatcagggtcaattttcggagactgaagaagtttgactgtaaagaaaagcagatgctggtcgacaaggctagagaggactacagcgagtctatagactggtgtatttcccttatctgtgactatcgggtccgcattggttgcgggtctttcaccggctccctcctggagtactatgcagccgatattagttacccagtgaggaaggagaccaagcaggacacattccgtaataagttccctaagctgcacaatgaggatgctagggagcctatggctgtgacctcacaaacaaaaaaaatgtcctttcagaagattctccctgatcggatgaaagccgcccgagatcgcgccaataaaaacctagtggattttattgtgaacgctaaaggcacagaaaaccacctgcttgccattgtcaatggcaccaagggcagtaggtggttgaaatcttttttgaatgccaatcggtttactccttgtatcgagacttattttgaggatgaagatcagctagatgaagttgtcaaatatctgcaggaggtgtgcaaccagatcgaccaaatcatgcccacatggattaaagacgacaaaattaagttcatccttgaagtgcttctcccagaggcaatcatctgcagcatttccgctgtagacgggctggactacgaggccgccgaggccaaatacctgaaaggtccgtgccttgggtatagagaaagagagctatttgacgctaaaatcatctatgagaagagacggaaagcgccgactaatgaagctcactag

SEQ ID NO: 48724 - DNA, 396 bp, Artificial Sequence
  Description of Artificial Sequence: Synthetic coding sequence
atggcccggagcctggtgtgcctgggcgtgatcatcctgctgagcgccttctctggacctggagtgaggggtgggcctatgcccaaattggccgacagaaagctgtgtgctgaccaggaatgcagtcatcctatctctatggccgtggctcttcaagattacatggctcctgattgtcgcttcctgaccattcatcgtggtcaagtggtttacgtgttttcaaaacttaagggacgcggcaggttgttctgggggggctcggtgcagggggattactacggcgatcttgccgcaagactcggatacttccccagcagcattgtgcgtgaagaccaaacattaaagcctgggaaagtggatgtgaagacagataagtgggacttctactgtcaatag

SEQ ID NO: 48725 - DNA, 2226 bp, Artificial Sequence
  Description of Artificial Sequence: Synthetic coding sequence
atggccgagggcagcttcagcgtgcagagcgagagctacagcgtggaggatatggatgaaggcagtgacgaggttggagaggaggaaatggttgagggcaacgactacgaggagtttggggcattcggcggttacggaacactgacctccttcgacatccacatcttgagagccttcggctccctgggacctgggctccgcatcctgtcaaacgagccgtgggagttagaaaatcccgtcctggcccagacactggtcgaggccctgcagctcgatcccgagacgctcgcaaacgagacagctgcacgggctgccaacgtcgctcgggccgccgccagcaaccgagcagctcgggccgcggcagctgcagctagaaccgcattctcccaggtggtagcctcacacagggttgccacccctcaggtctctggtgaggacacccaaccaacaacgtacgccgcagaggcacagggccccacaccagagccacccctggcaagccctcagactagtcagatgctggtgacaagtaagatggctgctcccgaggcaccggccacgagcgcccaatcacaaacaggcagccccgcacaggaggctgccactgagggtccatcctctgcttgtgctttctctcaggccccgtgcgccagggaagtggacgccaaccgcccaagtaccgcttttctgggacaaaacgacgtgtttgatttcacccagcccgccggcgttagtggaatggcgtttcctaggcccaaacgccccgcccccgcccaggaagccgccaccgaaggaccctcagcggcatcaggtgtcccccagaccgggccagggcgtgaggtcgctgccacgaggcccaagacaaccaaatctggaaaggcactcgctaaaacacgctgggtggaaccgcagaatgtggtggccgctgccgcagctaaggctaagatggcaaccagcattcccgagcctgagggagccgcagctgcaaccgcccaacactccgctgaaccctgggcccgcatgggtgggaagcggactaagaaatctaaacacctggatgatgagtatgagagctccgaagaggagagggagacgcctgcagttcctccaacatggagagcaagtcagcccagcctgacagttcgagcccaactcgccccgagacccccaatggcaccccgcagccaaataccatctaggcacgtgctctgcctccccccgagaaatgtaactttgctccaggaacgagccaacaaattggtaaagtacctgatgattaaggactataaaaaaattcctatcaaaagagctgatatgttgaaggatgtgattagagagtacgatgaacatttccctgaaattatcgaacgcgccacttacacactagaaaagaagtttggcatacacttgaaggaaatcgataaggaagagcacctttacattcttgtgtgcactcgcgattcctctgcccgactgcttggcaaaacgaaggacacccctcgactgagtttgctcctcgtgatcctcggcgtgattttcatgaatggcaaccgcgcaagcgaagccgtgctatgggaggcactccgtaagatggggcttcggcccggcgtgcggcaccctttccttggcgatctgcgcaaattgatcactgatgatttcgtcaaacaaaaatacctggaatacaagaagatccctaacagcaaccctcccgagtatgagtttctctggggtcttagggcaagacatgagacaagcaaaatgcgcgtcctgcgcttcatagcccagaaccaaaacagagaccccagagaatggaaggcgcacttcttggaggccgttgatgatgcttttaagactatggatgtggacatggccgaggaacacgcaagggcccaaatgcgtgcccaaatgaacattggcgatgaagccctgatcgggagatggtcctgggacgatatccaggtggaactcctgacgtgggatgaggacggagactttggagacgcctgggcaagaattccatttgccttttgggctaggtatcatcaatacattttgaactccaaccgggccaatcggagggcaacttggagagccggggtctccagcggtaccaatggtggggccagcacctctgtactggatggcccttcaaccagtagtactattcgcacaagaaatgccgccagagctggtgcatctttcttttcctggatacaacaccgatag

SEQ ID NO: 48726 - DNA, 4446 bp, Artificial Sequence
  Description of Artificial Sequence: Synthetic coding sequence
atgagcaagaccctgaagaagaagaagcactggctgagcaaggtgcaggagtgtgctgttagttgggctggcccccctggcgatttcggcgcagaaatacgggggggcgctgaacgaggggagtttccctacctcgggcgacttcgggaggaaccaggcggaggtacctgctgtgttgtaagcggtaaagcgcccagccccggcgatgtgctgcttgaagtcaatggcactccagtcagcgggctgactaaccgcgacaccttggctgtgatccggcacttccgcgaacctatccgcctgaagactgtcaaaccaggaaaagtgatcaataaggatctgcgccattatctgtccctgcagtttcagaaaggttcaattgaccataaactgcagcaggtcattagggacaacctctatttgcgtaccatcccttgcaccacccgggcaccaagggacggggaagtaccaggcgtggattacaacttcatatccgttgagcaatttaaggctctggaggaaagcggtgctctccttgaatctggaacatatgacgggaatttctacggaacccctaagccacctgctgaaccgtcccccttccagccagatccggtagatcaggtgctgttcgataacgaattcgatgcagaatcacagcgtaagcgcacaacctccgtgtcaaaaatggagcgcatggacagcagcctgccagaggaagaggaggacgaggataaagaggcaatcaacggttctggcaacgctgaaaatagggagaggcatagtgagtcttcagattggatgaaaacagtcccatcttacaaccaaacaaatagcagtatggactttcgcaactacatgatgagggatgaaaccctggaaccgctacctaagaattgggagatggcgtataccgatactggcatgatttacttcattgatcacaatacaaaaaccacgacatggctcgacccaaggttgtgtaagaaggccaaggcacctgaagactgtgaggatggcgaactgccctacgggtgggaaaaaattgaggacccccagtacggaacatattatgtcgaccaccttaatcagaagactcaattcgaaaaccctgtcgaggaggctaaacggaaaaaacaattgggtcaagtcgaaatcggctccagtaaaccagacatggaaaagtcccacttcacccgtgacccctcacagctcaaaggagtgcttgtccgggcctcgctcaagaagtccactatgggtttcggattcaccattattggcggagatcgcccagatgaatttcttcaggtgaaaaatgtattgaaggatggacccgctgcacaagacggaaaaatagcccccggagatgtgattgttgatatcaacgggaactgcgtgcttgggcacactcatgcagatgtagttcaaatgttccagcttgtccccgttaaccagtatgtcaacctgacgctgtgccgtggataccctctccctgatgactccgaagacccagtggtggacatcgtggccgccacaccagtcataaatggacaatctctgaccaaaggggaaacttgcatgaacccccaggacttcaagccgggagccatggtgctcgaacaaaatggcaaatctggacataccctcactggagatgggttgaatggaccctcagacgctagtgaacagagggtctccatggcttccagcggaagttctcagccggaactagtgacaatacccctgattaagggcccaaaggggttcggatttgcaatcgccgattcaccaactggacagaaggtcaagatgattctagacagtcagtggtgtcaggggctccagaagggcgacattatcaaagaaatatatcaccagaacgtgcagaatttaacccaccttcaagtggtggaggtgctgaaacagtttcccgtcggagctgacgtaccgcttttgatcctcaggggaggcccacctagtccgacaaaaacagccaaaatgaaaacggacaaaaaagagaatgcgggctccctggaggcaatcaatgagcccattccccagcctatgcccttccccccgagtatcattcgtagtggatcccctaaactcgatccaagcgaggtgtacctgaagagcaagactctctacgaggacaagcctccaaataccaaagatcttgacgtgttcttaaggaaacaggaaagtgggttcggcttcagagtccttggcggcgatggacccgaccagagtatttatatcggagctattattccactcggggctgccgaaaaagacggccgcctgcgcgccgccgatgagcttatgtgcattgacggaatccctgtgaaagggaaatctcacaaacaggtattggatctcatgaccaccgctgcccggaacggacatgtgctgttaaccgttaggagaaagattttttacggtgaaaagcagccagaggatgatagctcccaagctttcatatctacccagaacggaagcccaaggctgaaccgagccgaagtgccagcccgacctgccccccaggaaccttatgatgttgtgctccagcgcaaagagaacgagggatttgggttcgtgatcctgacctcaaagaataagccccctcccggcgtgatcccacataaaatcggccgcgtcatcgagggatcccccgcagatcgttgtggaaaacttaaagtcggtgaccacatttcggctgttaacggacaatcaatcgtcgaactcagtcacgataacattgtgcagttaattaaagatgcaggtgtcactgtgacactgaccgtgatcgccgaggaagagcatcatggaccaccgagcggaaccaatagcgcgcgccagagcccagcactccagcataggcccatgggacagagtcaggccaaccacatacctggcgaccgctcggcactcgagggggagatcgggaaggatgtcagcacgtcttaccggcattcttggtctgaccacaagcatctggcgcagccagacacggcagtgatttcagtggtggggagtcgacataaccagaaccttgggtgttatccagtggagcttgaacgtggtccacgcgggttcggattttccctccgcggtggcaaggaatataacatgggccttttcatcttgagattggccgaggacggacctgccataaaggacgggaggatccacgtgggggaccaaattgtagaaataaacggagaaccgacccagggaatcacacacacccgtgctattgaactgattcaggctggggggaacaaggtgttacttctgctccgtcccggaactggactgatccccgatcatggggattgggatattaacaatccctctagtagcaacgtgatatacgacgaacagtctccgttaccaccatcatctcatttcgcgagtatattcgaagaaagccatgtgcctgtcatcgaggaatccctgcgtgttcagatttgtgagaaagccgaagaactgaaagatattgtgccagaaaaaaagagtaccctgaatgaaaatcagcccgaaattaagcaccagtccctcctgcaaaagaacgtgagcaaacgggatccccctagctcacacgggcacagcaacaagaaaaaccttctcaaagttgaaaacggcgtcacccgacgcggccggagcgtctcacccaagaaacccgcctctcagcattccgaggagcatctggataaaatcccgagccccctaaagaataatccgaaaagaagaccaagggaccagtctctgtcaccttcaaaaggcgagaataaatcctgccaagtatccactagggctggctcagggcaagatcagtgtaggaagagtcggggcaggtccgcgtctccgaagaagcagcaaaagattgaggggagcaaagcaccctctaacgcagaggccaagctgctcgaagggaagtctcggaggattgcggggtatactggcagtaatgcagagcaaattccagacgggaaggagaaatccgacgtgatccgtaaggacgctaaacaaaaccagctagagaagtcacgaactagatcaccggaaaagaagatcaagaggatggtagagaaatctctgccgagtaagatgaccaataagacaactagcaaagaagtctcggagaatgagaaggggaaaaaagttactactggcgaaacaagcagcagtaacgacaagatcggagaaaatgtgcaactgagtgaaaagcgattgaagcaagagcccgaagagaaggtggtctcaaacaagactgaagaccataagggcaaggagcttgaagccgcggataagaacaaagagactggaagattcaagcccgagtctagctcaccagtgaaaaaaacccttattacccccggcccgtggaaagtcccttccgggaacaaagttaccggcacgataggtatggcagagaagaggcagtag

SEQ ID NO: 48727 - DNA, 3378 bp, Artificial Sequence
  Description of Artificial Sequence: Synthetic coding sequence
atgagcaagaccctgaagaagaagaagcactggctgagcaaggtgcaagaatgcgcagtctcctgggcaggtcccccgggggatttcggagctgagataagaggcggagccgagaggggtgaattcccctacctgggaaggctccgggaagaacctggcggaggaacttgttgcgtggttagcgggaaagccccatcccccggcgacgtcctgctggaggtcaacggaactcctgtttccggcctcacaaaccgcgataccctagccgtgatccggcacttcagagagccgattcgcttgaagactgtgaagccaggaaaggtaattaacaaggacttacgacattatctgtcccttcagttccagaagggatcaatcgatcacaagctacaacaggttatcagggataatctctacctccggacaattccatgcaccacacgggccccccgcgacggggaagtcccaggtgttgactacaactttatcagcgtggagcaatttaaagccctagaggagtcaggcgccctgttggaatccggcacatacgacggaaacttttatggtacaccaaaaccacccgccgaaccttcccccttccagcctgatcccgtggaccaggtactgtttgataacgagtttgatgccgagtctcagcggaagcgaaccacctccgtgagcaaaatggagcgaatggatagcagcctgccggaggaggaagaagacgaagataaggaagccattaatgggtccggcaacgccgagaaccgcgagaggcatagcgagtcaagcgactggatgaagactgtgccaagctacaatcagaccaacagctccatggacttcagaaactatatgatgcgtgatgaaacactggagccccttccaaagaattgggagatggcctatacagatacaggaatgatctattttatcgaccacaacaccaaaacgacaacatggctggaccctagactctgtaaaaaggccaaggcccctgaggattgcgaggatggggaactcccgtacggttgggaaaaaatcgaagaccctcagtatggaacatattacgtcgaccatttgaatcagaagacccagttcgagaaccccgtggaggaagccaaacgtaagaagcaactggggcaggtggagattgggagttctaaaccggatatggaaaagagccactttacccgggaccctagccagctgaagggagtacttgtgcgcgctagtctgaagaagagtaccatgggtttcggcttcaccatcattggtggagatcgacctgacgagtttctacaggtcaagaatgtgttgaaagatgggcctgccgcccaggatggaaagattgctcccggcgacgtaatagttgacattaacggaaattgcgttctggggcatacccatgccgacgtcgtccaaatgtttcagctcgtgcctgtgaaccagtacgtcaacctcaccctgtgccgggggtacccccttcccgacgactctgaagacccagtcgttgatatcgtggctgctactccagtgattaacggacagtctctgacgaagggggaaacctgtatgaatccccaggattttaagcctggtgcaatggtgctcgagcagaacgggaagagtggccatactctgaccggagatggccttaacgggcccagcgatgcttcagagcagcgggtttcaatggctagtagcggaagcagccaacccgaattggtgaccatcccactcataaaagggcctaaggggtttgggttcgcaattgccgatagtccgacagggcaaaaggtgaagatgatcctggatagccagtggtgccaggggctgcagaagggggacatcattaaagagatctatcaccaaaatgtgcagaatctgactcacttacaggtggtagaggtgctcaaacagttccccgttggcgccgatgtgccgttgttaatcctaaggggtggacctccctccccaaccaaaactgccaaaatgaaaacagataagaaggagaatgccgggtctctggaagcaattaacgaacccattcctcagccgatgccattccccccatctataatacgctctggaagccccaagctagacccatctgaggtctacctcaagtcaaaaacactgtacgaggacaagccaccaaacacaaaagatctggacgtctttctaagaaagcaagagtctggatttgggtttagagtgctcgggggagacgggccagaccaatccatctacatcggtgcgatcattcccttgggtgccgcggagaaggacggacgattgagggccgctgacgagctgatgtgcatagatggcattcccgttaaaggtaaaagccacaaacaagtccttgatcttatgaccaccgctgcccgtaacggtcatgtgctccttacggtacgacgtaaaatcttctacggcgagaaacagccggaggacgattcaagccaagcttttatctccactcagaacggatctcctcggttgaacagggccgaggtgccagcaaggcccgctcctcaagagccatatgacgtggtgctccagcgaaaagagaacgaaggctttggtttcgttatactcacctcaaagaataagcctccccccggcgtcattccccataagatcggtcgagtaatcgaggggagcccggctgatcgttgtggcaagttgaaggtaggtgatcacatttcagccgtgaatggtcaatcgattgtcgaattgtcccacgataacattgttcaattaattaaagatgcaggcgtaaccgtgacactcaccgtgatcgccgaagaagaacaccacggtcctccttctgggaccaacagcgcaagacaatcccctgctcttcagcatcggcctatgggccagtctcaggcgaatcatattccaggcgatcgcagtgctttagaaggcgagattggcaaggacgtcagtacatcttatcgtcatagctggagcgatcacaaacatctggcccagccagatactgcggtaataagtgtcgttgggagtcgccacaatcagaatctcggttgttacccagtggaattagagaggggaccacgcggtttcggcttctccttgaggggcggcaaagagtacaatatgggccttttcatccttcgtctagcagaagacggaccagcgatcaaggatggacgaatccacgtcggagatcagatcgttgaaatcaacggcgaacccacacaaggtatcacacatacaagggcaattgagttgatccaggccggcggaaacaaggtcctcctgctactgcgccctggcaccggtctcatacctgatcacggcttggcaccaagtggactctgctcctatgtaaagcctgaacaacactag

SEQ ID NO: 48728 - DNA, 3378 bp, Artificial Sequence
  Description of Artificial Sequence: Synthetic coding sequence
atgagcaagaccctgaagaagaagaagcactggctgagcaaggtgcaggagtgcgctgtaagttgggcaggaccaccaggtgactttggggccgaaataagaggaggtgccgagaggggcgagttcccttatctgggtcgcctgagggaggagccgggaggcggcacatgttgcgtggtctccggtaaggcaccatccccaggggatgtgctgctggaggtcaatggcacccccgtgagtggactgacaaaccgtgacactctagctgtgattcgccacttccgcgagcccatccgtttaaagacagtcaagccgggaaaagtcattaacaaggatctgcgtcactatttatcactgcagttccaaaaggggtctattgatcataaattacagcaggtaattcgcgacaatctatatctgaggacaattccatgtaccactagagccccccgagacggggaggtccccggtgtggactacaactttattagcgtagagcagttcaaggctcttgaagagtccggtgccctgctagaatctggtacatacgacggcaatttctatggaacgcctaagcctccggcggagccttccccatttcaacctgaccctgtcgaccaggtgctatttgacaatgaatttgacgcggagagtcagagaaaacgtaccacttccgtcagcaagatggaacggatggatagttccctgcctgaggaggaagaggatgaagacaaggaggcaatcaatggctctggcaacgctgagaatagggaacgccatagcgagagttccgactggatgaagaccgttccatcttacaatcagacaaactctagcatggatttccgtaattatatgatgagggacgaaaccctggaaccactccctaagaattgggagatggcttacaccgatacaggaatgatatacttcattgaccataacactaaaactacaacttggctcgatcctagattatgcaaaaaggcaaaagcaccggaagattgtgaggacggcgaactcccttacggctgggaaaaaatcgaggacccccagtatggtacatattacgtggatcaccttaaccagaaaacccagttcgagaaccctgtggaagaggccaaaagaaagaaacagttaggccaagtggagattggatcctccaaacccgacatggaaaagtctcacttcaccagggatccttcccagctgaaaggcgtgctcgtccgcgcttctctgaaaaaatcgactatgggttttgggtttacgattatcgggggcgaccgccccgacgagtttctccaggttaagaatgttctcaaggatggtcctgcagcgcaggacggaaagatcgcacccggcgacgttattgtggacatcaatggcaattgcgtcttgggtcacacccacgctgacgtagtgcagatgtttcaattggtccctgtgaaccaatacgtcaatctcactttgtgcaggggttaccctcttcctgacgacagcgaggaccctgtggtcgatattgtcgccgccacacccgtgatcaacggacagtccttaacgaagggcgagacctgcatgaacccccaggacttcaaaccgggagcaatggtcctggagcaaaatggaaagagcggtcacactcttactggagatggacttaacggtccttcagatgcaagtgagcaacgtgtgagcatggcctctagtgggagcagccagccagagctggtgacgattcctctgatcaagggcccgaagggattcggctttgccattgccgattccccaacagggcaaaaagttaaaatgatactggactctcagtggtgtcagggtttacagaaaggcgacattattaaggaaatatatcatcagaatgtgcagaacctgactcacttacaagtagtcgaggtactcaaacagttccctgtcggagccgatgttcccctcttaatcctgcgcggcggaccgccaagccctacgaaaaccgccaagatgaagactgataagaaagagaacgccggatccttggaagcgatcaacgagccgattccccaacccatgccgttcccaccttctatcatcaggagcgggtctcctaaactggacccaagcgaagtgtacctgaagagcaaaacactgtacgaggacaagccgccaaatacaaaggatttagacgtgttcctacgcaagcaggagagcggttttggttttcgagtgctgggcggagacggacccgatcagtccatctatataggcgccattattcccctgggggctgcagaaaaagacggacgactccgcgccgctgacgagctgatgtgtatcgacggcatccctgtgaagggaaaatctcataagcaggtgcttgatctgatgacaaccgccgcaagaaatggccatgtgcttctcaccgtgcgacgtaagatcttttacggtgagaaacagccggaagacgattcatcccaggcctttattagcacccagaacggaagtcccagacttaatcgggccgaagttcctgcgcggcctgcaccgcaggaaccatatgatgtagtgctgcaacgcaaagagaacgaaggttttggctttgtcattcttacctccaagaataagccaccgcccggcgtgattccacacaagatcggtcgcgtgatagagggttctccagcggacagatgtgggaagttaaaggtgggtgatcacataagtgccgtgaacggtcagagcattgtcgaactgtcacatgataacattgtgcagctgatcaaagacgcgggagtgacagtgaccctgacagtaattgccgaggaggaacatcatggcccaccctctggcactaatagtgcacgccagtcgcctgctttgcagcaccgtccaatgggccagtcccaggctaatcatattcctggagacagaagtgccttggagggcgaaatcggaaaggatgtcagcaccagctatcggcattcctggtcagaccacaagcatcttgcccagcctgataccgcagtgataagtgtcgtgggaagtagacataatcagaacttgggttgctaccctgtggagctggagagaggcccgagaggattcggattttctctccgggggggaaaggagtacaatatgggcctttttattctgcgccttgctgaagatggacctgccatcaaagacgggcgcattcatgtgggagatcaaatcgtggaaatcaacggcgagcctacgcaggggattactcacactcgagccattgagctgattcaggctggtggcaataaggtgcttcttctcctaagaccaggcactggcctcatccctgaccacggactcgcccccagtggcttgtgcagctacgttaagcccgagcagcactag

SEQ ID NO: 48729 - DNA, 1230 bp, Artificial Sequence
  Description of Artificial Sequence: Synthetic coding sequence
atgggccagagccaggccaaccacatccccggcgaccggagcgccctggaaggggagattggtaaagacgttagtacttcgtaccggcactcttggagcgatcacaagcacttagcgcagcctgatactgccgtgatttccgtcgtgggaagcaggcacaaccagaaccttggttgttacccagttgagctggagagaggcccacgaggctttgggttcagtctgaggggtggcaaggagtataacatgggtctattcatcctgaggctcgcagaggacggtccagccattaaggatgggcggatccatgtgggcgatcagatagttgaaataaacggagagcctactcagggcataacacatacaagggccattgagctgattcaggccggcggaaataaggtgcttttgctgctgaggccaggaacagggctgattcccgatcacggggactgggatattaataacccctcaagctcaaatgtaatctacgacgaacagtctccattgcccccctcatcccattttgctagcatttttgaggaatcacatgtaccggtgatcgaagagagcctccgcgtgcagatttgcgagaaggctgaggaactgaaagacatcgttcccgaaaagaaatccaccttgaatgagaaccaacccgagatcaaacaccagtcccttcttcaaaagaatgtatctaagcgagatccgccatcatctcacggacactccaacaaaaaaaacctgctcaaggtcgaaaacggagtgaccagaagggggcgctcagtttcgcctaaaaagcctgcctcacaacacagtgaagagcacctggacaagattccctccccactgaagaacaaccccaagagacgccctagggatcaaagtctcagcccaagcaaaggcgagaacaagtcctgccaggtctcgacacgggctggaagcggccaggatcaatgtcgcaaaagccggggtaggtccgccagccccaaaaagcagcaaaaaatagaaggatcaaaggccccaagtaacgcagaggctaagctgcttgagggcaagtcgagaaggatcgcaggctataccggatccaacgcggaacagattcctgatggtaaggaaaagagcgacgtgattaggaaagatgcaaagcaaaaccagcttgagaaagccgaacaggggcttcagcgaaaaaagagcaaggagtggcttcggaatttgttccacccaaaatag

SEQ ID NO: 48730 - DNA, 1200 bp, Artificial Sequence
  Description of Artificial Sequence: Synthetic coding sequence
atgggcagcagccggtgcggccccggcgcccaccccgtgcacctgtggccgccccacttcgcattcagcggccaccaccccagggacctggggccccactccgggcccgccctactcgtctctttagctagcgaggttcaggatctccacctggctcagcggaaggaaatggcgagtggtttttctaaaggtccgacccttggcttgttacccgacgtgccaagcctaatggaaaccctctcctactcatattgttacgtcggtattatgactggccccttcttccgctataggacgtatctggattggctggaacagcctttccccggcgcagtgccaagtttgagaccactccttcgaagggcctggcctgctccactttttggtctgctgttcttgctgagttcccaccttttccctttggaggccgttagagaggatgctttctacgcaaggcctctgcctgcacggctgttctacatgatccctgtatttttcgcgtttaggatgagattctatgttgcctggattgcggcagaatgcgggtgcattgctgcaggatttggagcctaccccgtggcagccaaggccagggcaggaggtggtcccacactccaatgtccacctcccagttccccggaaaaggcagcctccctagagtacgattacgaaactatacgaaacatcgactgctatagcaccgacttctgcgtgcgtgtcagggatggaatgcggtactggaacatgacagtgcagtggtggctggcccaatatatttataaatctgctcctgccagatcttacgttctgaggtctgcctggacgatgctgctgtccgcatactggcacgggctgcaccccggttattacctgtcttttttgaccattccgttgtgtctcgccgcggagggcagattagagtctgccctgcggggaagattatcccctggaggccagaaagcatgggactgggtccactggttcttgaaaatgcgtgcctacgactacatgtgcatgggctttgtcctcctctctctggctgacacattgcgttattgggccagcatctacttctgtatccacttcctcgcactggccgccttggggctaggcctcgctctgggaggaggctctccgagtagacgcaaggcagcaagccaacctacaagtttggcccctgagaagttgcgagaagaatag

SEQ ID NO: 48731 - DNA, 1200 bp, Artificial Sequence
  Description of Artificial Sequence: Synthetic coding sequence
atgggcagcagccggtgcggccccggcgcccaccccgtgcacctgtggcccccgcacttcgccttttctggacaccaccctcgggacttgggacctcactccggtcctgctttgctcgtatcactcgcaagcgaagtacaagacctacacctggcccagcggaaggaaatggcgtcaggatttagcaaaggcccaacgctggggcttctgccagatgtcccctctctcatggaaacattatcctactcatattgttatgttggaattatgacaggcccattcttcagataccggacctacttggattggctggaacaaccattcccgggcgcagttcccagccttcggcctttgctccggagggcttggcctgctcccctgttcggactgctttttctgctttccagccacctcttccccttggaagcggtgcgcgaagatgccttctatgctcggccattaccagcccggcttttttatatgattcctgtgtttttcgccttcaggatgagattctacgtggcctggatagcagccgaatgtgggtgtatcgccgccggatttggtgcctaccctgtggctgcgaaggcacgagccgggggggggccaactcttcaatgccctcctcccagctcacctgaaaaagctgcgagcctggagtacgattacgagaccattaggaatatagactgttattcaactgacttctgtgtacgggtgcgtgatggtatgaggtactggaatatgacggttcaatggtggcttgcgcagtacatttacaagtcggcaccggcccgatcttatgtgttacggtcagcatggacaatgctgctttccgcttattggcatggactgcatcccggctattatttgtcctttctgactattcctctttgcttggctgctgagggtaggttggagtccgcactccgcgggcggttgagccccggcggtcagaaagcatgggattgggtgcattggttcctgaagatgcgggcatacgactatatgtgtatgggctttgtccttttgtcgctcgcagatactctgcgatattgggcctctatctacttctgtattcatttcttggcactggccgcattgggcctgggtttagcacttggcggaggcagtccctcccggcggaaagccgctagtcagcccacctccctcgccccagaaaagctgcgggaagaatag

SEQ ID NO: 48732 - DNA, 1200 bp, Artificial Sequence
  Description of Artificial Sequence: Synthetic coding sequence
atgggcagcagccggtgcggccccggcgcccaccccgtgcacctgtggcctccacactttgccttctctggtcatcacccacgcgacctcggaccacactcaggacccgctctgctggttagccttgcttcagaggtccaggacctacatctagcccaacggaaagagatggcttccggcttcagcaagggccccacactgggtctcctgcccgacgtcccaagcctgatggagacactctcttattcgtactgctacgtggggataatgacgggtccattttttagataccggacctacctcgactggctagaacaaccattccctggagccgttccctctctcaggcccctgcttaggagagcttggcctgcccctctgtttggcctgttgtttttacttagctcccatttatttccacttgaggccgtcagggaagatgcattctatgctagacccttaccagcccgcctattctatatgattcctgtgtttttcgcctttcgcatgcgattctacgtggcctggattgcagcagagtgtggctgtatcgccgctggcttcggggcctaccccgttgcagccaaagctcgcgccggcggcggacctaccctccagtgtccaccgcctagttcgcctgagaaagctgcatccctggaatacgactatgaaaccatccggaatattgattgctatagcacggacttttgtgtgcgtgtaagggatggaatgcgatactggaacatgactgtccagtggtggctcgctcagtacatttataagagcgcccctgccagatcatacgtgctccgatccgcatggacaatgctccttagcgcgtattggcacggcttgcaccccggatactacctgagcttcttaacaataccactgtgcttagccgctgaagggaggctggaatcggccctacgggggcgtctgtctcccggaggacagaaggcctgggactgggtgcactggtttctaaagatgcgcgcttacgactatatgtgcatgggctttgtgcttctgtctttagcagacaccctgaggtactgggcatctatttatttttgcatccattttctggctttggctgccctcggcctagggctggcccttggtgggggatcccccagcagacgaaaagccgccagccaacctacctctcttgcacccgaaaagttacgtgaggagtag

SEQ ID NO: 48733 - DNA, 1200 bp, Artificial Sequence
  Description of Artificial Sequence: Synthetic coding sequence
atgggcagcagccggtgcggccccggcgcccaccccgtgcacctgtggcccccccatttcgctttttcgggccatcacccacgcgatctcggtccccacagcggccccgcactgctcgtgtcgttggcgtccgaggtacaggacctgcacctggctcagcgcaaggagatggcttccggctttagtaaggggcccacgttgggtcttttgcctgacgtacccagtctgatggagactctttcttactcctactgttacgtgggcattatgaccggccctttttttagatatcggacatatctggattggctagagcagcctttccccggtgccgtgccatccctgcgccccttgctgcggcgggcttggcctgcgccactgttcggactgttgttcctattgtccagccacctgttccctctggaagctgtgcgagaagacgcgttttatgcccgccccttgcccgcaaggttgttctacatgattcccgtgtttttcgcctttagaatgcggttctacgtggcatggatcgctgccgagtgtggttgcatagcagccgggttcggggcttatccagtggcggctaaagctcgcgctggaggcggtccaactctacagtgtccccctccctcctctcctgaaaaggcagcttccctggaatatgactatgagactattcgcaacatcgactgttactctaccgatttctgtgttcgtgtgcgcgatggtatgagatattggaacatgactgtgcagtggtggttggctcagtacatctacaaatccgcccctgctaggtcctacgtgttgcgatctgcttggactatgctgctctcggcctattggcatggcttgcatcccggttactatctgtctttcctcaccattcctctgtgtttggcggctgaaggacgactcgaaagtgccctgagaggcaggctgagtcctggcggtcagaaggcatgggactgggtgcactggtttctgaaaatgagagcatacgactatatgtgcatggggttcgtgctcctgtcactagccgataccctcaggtactgggctagtatttacttctgcattcacttcctggcacttgccgccttaggactcggcctcgccctgggcggtggcagcccatcccggcgaaaggcggcatctcagcccaccagtctggcccctgagaagttgcgcgaggagtag

SEQ ID NO: 48734 - DNA, 1200 bp, Artificial Sequence
  Description of Artificial Sequence: Synthetic coding sequence
atgggcagcagccggtgcggccccggcgcccaccccgtgcacctgtggccaccccattttgctttctccggacatcaccctcgtgaccttggacctcatagcggcccagcacttctcgtgtctctggcgagtgaggtccaagatctgcatctggcccagcgtaaggaaatggccagcggattcagcaaagggccaacgttaggtctccttcccgacgttccttccctcatggaaaccctgtcatattcttattgctatgttgggattatgactggtccctttttccgttatcgaacatacctagactggctggagcagccattccccggtgccgtgccctcacttaggccactccttagaagagcttggccagcacctttgtttggccttctgttcctgctgtcaagtcacctgttccccctcgaagcagtgagagaggacgctttctatgctagacccctgcctgctagactgttctacatgattcccgtcttcttcgcctttcgcatgagattctacgtggcgtggatcgcggcagaatgcggatgcattgctgcgggctttggtgcttatcctgttgctgctaaggctcgggcaggcggaggccccactctgcagtgtccacctccttcctcacccgaaaaagctgcttcgctggagtatgactacgaaacgatacgaaatatcgattgctacagtacagacttttgtgtgcgtgttagggatggcatgaggtattggaatatgactgtgcaatggtggctggcccaatacatttacaagagtgcacctgctcggtcctatgtgttgcgctccgcttggaccatgttactcagcgcctattggcacggtttgcatccgggttactacctctcttttctaaccatccccctctgtttggctgcggagggaagactggaatctgcactgcgaggcagactatcacctggaggacagaaggcctgggattgggtacactggttcttgaagatgcgcgcttatgattatatgtgcatgggatttgtgctcctgagcctggcggacactctgcggtattgggctagcatctacttctgtattcactttctggcccttgcagccttaggccttggccttgcactgggaggcgggtcgccgagccgccgcaaagcagcttcacaacctacctcactcgctcctgagaaactgagggaggagtag

SEQ ID NO: 48735 - DNA, 1200 bp, Artificial Sequence
  Description of Artificial Sequence: Synthetic coding sequence
atgggcagcagccggtgcggccccggcgcccaccccgtgcacctgtggcccccccatttcgctttctccggtcatcacccaagagatctaggccctcatagcgggcccgccctccttgttagcctggccagcgaggtgcaggacctgcacctagcccaacgcaaggaaatggcatctggcttcagtaagggacccacactcggtctactgcctgatgtaccatcactcatggagaccctgtcctacagttattgttatgtcgggattatgacggggccattctttcgctataggacctacctggactggctcgaacaaccctttcccggagcagtgcctagcctgagacccctacttaggcgagcatggcccgccccattgtttggcctcctattcctgctgtcctcccatctcttccccctggaggctgtcagagaggacgccttctacgcccgacccctccctgcgcgactgttctacatgatccctgtattttttgcattccgcatgagattttatgttgcttggattgctgccgagtgcgggtgcatcgctgccggctttggggcttatccggtagcagctaaagcaagggcaggcggtgggcccacactacaatgccccccaccatcaagcccggaaaaggccgcctccctcgaatatgactacgagaccatacgtaatattgattgttacagcaccgacttttgcgttagagtgcgggacggcatgagatattggaatatgactgtccagtggtggttggctcagtacatctacaagtcagctcccgcaagaagttacgtcctacgatctgcctggactatgctgctaagtgcatattggcacggtttacatcctggttactacctgagttttttgacaattcctctgtgtctggcagccgaaggcaggctcgaatccgccctacgaggccgcctatctcccggtggtcagaaggcctgggactgggtccactggtttctcaaaatgagagcatatgattacatgtgtatgggttttgtgttactctctctggccgacactcttcggtattgggcatccatctacttctgtatccacttcctagcccttgcagcgctcggcctcggccttgcactgggcggggggtcaccatcgcgaagaaaggccgcttctcagccgacgagtcttgccccggagaagcttcgagaagagtag

SEQ ID NO: 48736 - DNA, 1200 bp, Artificial Sequence
  Description of Artificial Sequence: Synthetic coding sequence
atgggcagcagccggtgcggccccggcgcccaccccgtgcacctgtggccacctcacttcgccttctcgggacaccatccaagggatctcgggccacatagcggccccgccctgctggtgtccttggcctctgaggttcaggacctgcacttggcacagcgcaaggagatggcttcagggttcagcaagggacctacactaggattacttccagatgtgcctagtctgatggagacattgtcttactcttactgttacgtcggcatcatgaccgggccttttttcagataccggacatacctggactggttggagcagcctttccccggtgctgttccatccctgcgacctctcctgcgcagggcatggcccgcaccactttttggtctgctcttcctgttgagcagtcatttatttccgctcgaggccgtaagagaagatgctttctatgctcgacccctacccgctcggctattctacatgattcccgtgttcttcgcattcagaatgcgtttctacgttgcttggatagctgcggagtgcggctgtatcgcagcaggttttggcgcttaccccgtagctgcaaaggccagggcgggagggggcccaaccctccagtgtcctcctccatctagccctgaaaaagcggctagtctagagtacgattatgaaactattaggaatatagattgttatagcacggatttctgtgtaagggttcgcgacgggatgagatactggaacatgactgtgcagtggtggctggcacaatacatctacaaaagcgctccagcccgcagttatgtgctgcggagcgcttggacaatgttgctctccgcttactggcacggcctccatcccggctactatctgagctttctcactatcccactgtgcctggcggccgaggggcgcctcgagtccgccttaagaggccgcttaagcccaggaggtcagaaagcttgggattgggtgcactggttcttaaaaatgcgggcttacgactacatgtgcatgggctttgtgctgctgtccttagcagacacgctgagatattgggcgtcgatctatttctgtattcacttccttgcacttgccgcattaggtcttggactcgcactggggggggggagccccagtcgacgaaaggcagccagccagccaacctcgctcgcgccggagaaacttcgagaggaatag

SEQ ID NO: 48737 - DNA, 1200 bp, Artificial Sequence
  Description of Artificial Sequence: Synthetic coding sequence
atgggcagcagccggtgcggccccggcgcccaccccgtgcacctgtggccaccccacttcgctttcagcggtcatcatccccgtgatctgggcccccatagcggtccagcccttctggtgagtttggctagtgaggtacaggacttgcacttggctcagaggaaggagatggctagcggcttttcgaaaggccccaccctcgggctgctccccgatgtgcctagcttgatggagaccctgtcctactcttattgctacgttgggattatgacaggaccgttcttccgatacagaacatatctggactggctggagcagccttttccaggcgccgtgccaagcctcagacccctgctgagacgagcttggcctgcaccactgtttgggctgctgttcttactgagttcccacttgttccccctggaagctgtgagagaagatgccttctacgctcgacctttaccagcgagacttttttatatgatacccgttttctttgcgttccgcatgcgattttacgtcgcctggatcgcagccgaatgcggatgtatagccgcaggctttggagcctatcctgtggccgctaaagcacgagcgggaggagggcctacccttcagtgtccacctccttcatcaccagagaaagctgcatctctcgaatatgattacgaaacaatacggaacatcgattgttattccactgacttctgtgttcgcgtgagggacggaatgagatactggaacatgactgtacagtggtggcttgctcagtacatttataaatccgctcccgcccggagctatgtgctccggtccgcatggactatgcttttaagtgcctattggcatggccttcaccctggctactatttatcatttctcacgattccattgtgcctggccgccgaaggtaggctggaatctgcactgcgaggaagactgtctcccggcggccagaaggcgtgggattgggtccactggttcctgaaaatgcgtgcctacgactatatgtgtatggggtttgtgttgctgagtctagctgacacacttcggtattgggcatctatttacttttgcattcattttctggctttagctgcactgggacttggactcgcgctgggaggaggatccccatctagaagaaaggcagcttctcagcctacaagtttggcaccagaaaagctgagagaagagtag

SEQ ID NO: 48738 - DNA, 1200 bp, Artificial Sequence
  Description of Artificial Sequence: Synthetic coding sequence
atgggcagcagccggtgcggccccggcgcccaccccgtgcacctgtggcccccccatttcgcattctcagggcaccacccacgagaccttggtccccacagtgggcctgccctgctagtgagccttgctagtgaagttcaggacttacacctggcacagcgaaaggagatggcgagcggcttcagcaaaggcccaacactgggattgctgcctgacgtgcccagcctgatggagaccctttcatactcatactgctacgtcggcattatgactggccctttttttagatataggacatacctggactggttggagcagccattccctggggctgtcccttcattaaggccgctgctgaggcgtgcctggccagctcctctgttcggtttgctttttcttctttccagccacctcttccctttagaagccgttagagaggacgcattctatgctcgaccattgcctgcacgccttttctacatgataccagtgtttttcgcttttaggatgcgattctacgtagcatggattgcagccgaatgcggatgcatcgcagctggcttcggggcctaccctgtagccgcaaaggctcgagctgggggcggacctacgctgcaatgccccccacctagtagtcccgagaaagccgcatctctggaatacgactacgagaccatacgtaacatcgactgctatagcactgacttctgcgtccgtgtgagagatggaatgcggtattggaatatgaccgtacaatggtggctcgcacagtatatatataagtcagcgccagcccgttcctatgtgctgaggtcagcttggaccatgctgctgtcagcttactggcacggcctgcaccccggctactatctgtcctttctcaccatccccttatgtcttgctgccgagggcagactggagtccgccctccggggccggttaagccccggaggacagaaggcatgggattgggtccactggtttctcaaaatgagggcttatgattacatgtgcatgggatttgttctcctgtctctcgcggacacgctgcggtattgggcttccatttacttctgtatccatttcctcgctctagcagcactcggactggggcttgccctgggaggcggctccccatccaggaggaaagccgcaagccaaccgacgtctctggctccggagaaattgcgcgaggagtag

SEQ ID NO: 48739 - DNA, 1200 bp, Artificial Sequence
  Description of Artificial Sequence: Synthetic coding sequence
atgggcagcagccggtgcggccccggcgcccaccccgtgcacctgtggcctccacacttcgcgttcagcggtcaccacccacgcgatctgggtcctcacagcggcccagctctcctggtttctctggcatcagaagtccaagacctgcatttagcacagaggaaggagatggcctcgggattctctaagggcccaaccctgggtctgctaccagatgtcccttccctgatggaaacccttagctacagttattgctacgtcggcataatgacgggaccattttttaggtacaggacttaccttgactggctcgagcagccctttcccggggctgtgccaagtttacgcccattgttacgccgagcctggcccgcgcccctcttcggattgctcttcctcctatcctcccatctgttccctttggaagctgtgcgagaagatgcattctacgccagacctctgccagcacgcctcttctacatgattcccgtcttcttcgctttccggatgcgattttatgtggcttggattgccgctgaatgcggatgtatcgccgcgggctttggcgcgtatcctgtggctgccaaggcccgtgcaggcggtggcccgaccctccagtgtccaccaccctctagcccagaaaaagcggcttccttagagtatgactacgagactattagaaacatcgactgttattctactgatttctgtgtgcgggtgcgggacggaatgaggtattggaacatgactgtacaatggtggctggctcagtatatctacaagagcgcccccgcccgcagctatgttctgaggtccgcatggacaatgcttctgtccgcatattggcacgggctccacccaggctattatttgagctttctcaccattcccctttgtttggctgctgagggccggctcgagtctgccctcagaggaaggctctcccccggtggccaaaaagcatgggattgggtccactggtttcttaagatgcgagcctatgattacatgtgcatgggcttcgttctcttgagtttagcagatactctgcgatactgggcgagcatctacttctgtatccatttcctagcgctggcggctctgggcctagggctcgccctaggcggggggtctccctcccgacggaaggctgcatcacagcccacgagcctcgcaccagagaaacttcgcgaggagtag

SEQ ID NO: 48740 - DNA, 1200 bp, Artificial Sequence
  Description of Artificial Sequence: Synthetic coding sequence
atgggcagcagccggtgcggccccggcgcccaccccgtgcacctgtggccacctcactttgccttttccggtcaccatccacgcgacctgggccctcatagcggccccgccctactggtgagtctggccagcgaagtgcaggacttgcatttggcacagaggaaggagatggcgagtgggttttcaaagggtcccacactcggcctgctccctgacgtcccctccctgatggagaccctttcttattcctattgctatgttggcatcatgacgggcccattctttcgttatcgcacctacctggactggctggaacagcccttccctggagctgtgccgagcctgaggcccctcctgaggagagcttggcccgccccgctgtttggcttactatttcttctctctagtcatcttttcccactcgaggcggtacgtgaggatgctttttacgctaggcccctgccagcacgtctattctacatgatccctgttttcttcgcttttcgcatgcgattctatgtcgcttggattgccgcagagtgtgggtgtatcgctgcaggatttggcgcctaccctgtagcagccaaggcaagagccggcggagggccaacactgcagtgtccgcccccctcaagtcccgaaaaagcggcgtccctcgagtacgattacgaaactatccggaacatcgactgctactctactgacttttgcgttcgcgtcagggacggaatgcgatactggaacatgactgtgcagtggtggttggcccaatacatttacaagagtgctccagcgaggtcttacgtattgcgaagtgcgtggaccatgctgctgagcgcctattggcacgggctgcaccctgggtattaccttagctttcttacaatccctttgtgtctggcggctgagggacgactcgaatcggccctccgcggcagactgagcccaggaggccagaaagcatgggactgggtgcactggttccttaagatgagggcttacgattacatgtgcatgggttttgtgctattaagtctggctgataccctccgctattgggcctctatctatttctgcatccactttttagctctcgcagctctcggattaggacttgccctcgggggcggttcaccttcaaggaggaaagcggcgtcacagccgacaagccttgcacccgaaaaactgagagaggagtag

SEQ ID NO: 48741 - DNA, 1200 bp, Artificial Sequence
  Description of Artificial Sequence: Synthetic coding sequence
atgggcagcagccggtgcggccccggcgcccaccccgtgcacctgtggcccccacattttgcattcagcggacaccaccccagggatctggggcctcactctggacctgccttgctcgtgagcctggcttccgaagtgcaggatctgcatctggcccaacggaaggaaatggcctccggtttttctaaaggtccgacgcttggattacttcccgatgtgccctctctgatggaaaccctgagctattcttattgctacgtaggaatcatgacagggcctttcttccgctatcggacgtaccttgactggctagaacaaccatttcctggagccgttcccagcttaaggcccttgttaaggagagcatggcctgctccactgttcggattgctgttcctgctgagctcacatctgtttccactggaggcagttcgggaggatgcattctacgctcgcccattgcccgctcgattattttacatgatcccggtttttttcgcttttcgaatgaggttctacgtcgcatggattgccgcagagtgcggctgcatcgccgccggtttcggcgcctacccagtggccgctaaagcccgtgcaggaggaggtccaactctgcagtgtccccccccaagttctcctgaaaaggctgcctctctggagtacgattacgaaacaattcgaaacattgactgttattccacagacttttgcgtgagagtgagagatggaatgcgttactggaacatgaccgttcagtggtggctagctcaatacatctataagagcgccccagctagaagctacgtcttgagaagcgcttggaccatgctcttgtctgcctattggcatggattgcatcctggctactatctttcatttcttactatccccctgtgcctggcagcagagggacggctggagagcgccttacggggccggctgagtccaggcggccagaaagcatgggattgggtgcactggtttctgaaaatgcgggcgtacgactatatgtgtatggggtttgttctgttgtccctcgccgatacacttaggtactgggcgtccatctatttttgcatccacttcctagccctggccgcactcgggctcggactggcgctgggcggcggaagccctagcagaaggaaggctgcaagtcagccaacatccctggcacctgaaaagctgcgggaggagtag

SEQ ID NO: 48742 - DNA, 876 bp, Artificial Sequence
  Description of Artificial Sequence: Synthetic coding sequence
atgagcatgcccctgcaccagatcagcgccatccccagccaggacgctatatcagctcgcgtctaccggtcgaagaccaaagagaaggaacgagaggagcagaacgaaaaaacattagggcacttcatgtcccatagtagcaatatttctaaagcaggcagcccgccatctgccagtgccccagccccggtcagctcctttagccgcacaagtatcacgccaagcagccaggatatttgtcgcatctgtcattgtgaaggggacgacgagtcacccctgataaccccatgtcactgcactggctcattgcatttcgtgcatcaagcctgtctgcaacagtggatcaaaagctcggacacacggtgttgcgagctctgcaaatacgaattcataatggaaaccaagctcaaacccctacgcaaatgggaaaaactacaaatgacgtcaagcgaacggcggaaaataatgtgctccgttacattccatgttatcgctatcacatgtgtagtctggagcttgtacgtcctcatagaccggacagcggaagagatcaagcagggccaggcaactggcattttggagtggcccttttggacgaagctggtggtcgttgctatcggcttcacgggcggccttctgtttatgtatgtgcaatgtaaggtgtatgtgcagctctggaagaggcttaaggcttacaaccgtgtaatctatgtgcagaactgtccagagacaagcaagaagaacatcttcgagaaatctcccttgaccgagcccaatttcgagaataagcacggatatggcatttgtcatagcgataccaacagctcttgctgtacagagcctgaggacacaggggccgaaatcattcatgtgtag

SEQ ID NO: 48743 - DNA, 1089 bp, Artificial Sequence
  Description of Artificial Sequence: Synthetic coding sequence
atggccagcggcagcgccggcaagcccaccggcgaggccgccagcccggcccctgcatcagcaatcggcggggctagcagtcagccccgaaaaaggctcgtgtctgtctgtgaccactgcaaagggaagatgcaactggtcgctgatctgctacttttgtcaagcgaggcgcgaccagtattgtttgagggaccagcttcctccggggcaggagctgaaagtttcgaacagtgtagggatacaattatcgccaggactaaggggctgtccatcttaacacacgacgtgcaaagccagcttaatatgggccgattcggtgaagccggcgactctctggtcgagttaggggatttggttgtgagcctgactgaatgttcagctcacgcggcttatctggcggccgtcgctactccaggggcacaacctgcccagcccgggctggtagaccgctacagggtgacacgatgtaggcacgaagtcgagcaggggtgcgcagtcctccgagccacgccgctggcggacatgactccccagcttctcctcgaggtctctcagggcttatctagaaatctcaaatttctgactgatgcctgcgccctagcatctgacaaatctcgggaccgtttttctcgggagcagttcaaactgggggttaaatgtatgagcaccagcgcctcagcactgctggcatgtgtgagggaagtgaaagtggctcccagtgagctcgccaggagccgctgtgctcttttttctgggccactcgtgcaggctgtgtcagcattggtgggttttgccaccgagccccagttcctcggccgggccgcggctgtgtccgcagagggtaaagctgttcagaccgcgatattgggcggtgcaatgtcggttgtcagcgcttgcgtgcttctgacccagtgcctgcgggacctggcccaacaccccgacggcggagcaaagatgagcgaccacagagaaagactcaggaatagtgcttgtgcggtgtcagagggctgcactttactgagccaggccctccgagaaagaagttctccacgtacgttacctcctgttaatagcaactcagttaactag

SEQ ID NO: 48744 - DNA, 879 bp, Artificial Sequence
  Description of Artificial Sequence: Synthetic coding sequence
atgcgggagtggtgggtgcaggtgggcctgctggccgtgcccctgctcgctgcctatcttcatattcctcctccgcagttgagcccggctctccactcttggaaatccagcgggaagtttttcacttacaagggcctcagaatcttctaccaggatagcgtgggtgttgtcggctcccccgagatcgtggtgctgctccacggattccccacaagcagttacgactggtataagatctgggagggcctaacccttcgcttccatcgagtcatagctttggatttcctgggcttcggcttttctgacaaacctcggccccatcactacagcatttttgagcaggctagtattgtagaggctctgttaaggcatctcggcctgcagaacaggcgcatcaacctgctgtctcatgattatggggatatcgtcgcccaagagctgttataccgctataagcagaacagatccgggagacttaccatcaaaagtctctgtctgtccaatggcgggattttccctgagacacacagacctcttctgctgcagaaacttttgaaagatgggggagtgctgtcacctatactgacacgcctgatgaatttttttgtgttctccagaggattactgcagtatattaatcaaagaaagaaatttagaagaagatgggtgggagcactagcttccgtgacgattcccattcatttcatatatggccccctcgatcccgttaacccttatcctgagtttctcgagctctaccgcaagactctgcctcgtagcactgtgtctattctggatgatcacatatcccattaccctcagttggaagatccaatgggctttctcaatgcttacatgggtttcattaacagcttctag

SEQ ID NO: 48745 - DNA, 981 bp, Artificial Sequence
  Description of Artificial Sequence: Synthetic coding sequence
atgcgggagtggtgggtgcaggtgggcctgctggccgtgcccctgctcgctgcatatttgcacatcccacctccacagctcagcccggcccttcactcatggaaatctagtggaaaatttttcacctataaagggctgcggatcttttaccaggactcagtcggcgtcgtcggctcaccagagattgtggtcttgcttcacggattccccacttcgtcttacgattggtataaaatttgggagggccttacactgcgattccaccgcgtgatcgctctggacttccttgggtttggattctccgacaagcctaggcctcaccattactcaatttttgagcaggcctctatcgtcgaagccttgctgcgccacctggggctacagaatagaagaattaacctcttgagtcacgattacggagacatcgtggcccaggagctgctttacaggtataagcagaatcgctctggacggctgaccattaaatccctatgcttatcaaatggagggatattcccagagacacaccgaccactcctgctgcagaaactcttgaaggatggtggagttctctctcctatattaacccggttgatgaatttctttgtattctctcgcggcctgacacccgtgttcgggccgtacacacggccctcggaatcggagctgtgggatatgtgggctggaatcagaaataatgatggcaacttggtcattgattccttactgcagtacattaatcagcgcaagaaatttcggagacgctgggtcggtgccttagccagcgtgacaatcccgattcactttatttacgggcctctcgatccagtgaatccctatccagaatttcttgaactgtatcgcaaaactctgccacgctctactgtctcaattttggacgaccacatttcccactacccgcaattggaagatcctatggggttcctgaatgcctatatggggtttattaattctttctag

SEQ ID NO: 48746 - DNA, 879 bp, Artificial Sequence
  Description of Artificial Sequence: Synthetic coding sequence
atgcgggagtggtgggtgcaggtgggcctgctggccgtgcccctgctggctgcatacctgcacatcccacccccacaactgagccctgccctgcactcatggaagtcttccggcaagtttttcacatacaaagggttacgcatcttctaccaagacagtgtgggtgtggttggcagccctgaaattgtggtgctgcttcacggctttcctactagtagctacgattggtataagatttgggagggtcttacccttagattccacagagtaatagccctggatttccttggtttcggattcagcgacaagccaagacctcaccattattctatctttgaacaggcatctattgtggaggcactactgcggcatctgggactccagaatagacggatcaacttgctgtcgcatgattatggcgacattgtggcccaagagctgctctaccggtataaacagaaccggagtggaaggctgacaattaagagcctgtgcctttctaatggagggattttccctgaaacacatcggccccttttgctccagaaactgttgaaagacggtggggtgcttagccccatcttgactagactgatgaatttttttgtattctcacgtgggctcctgcaatacataaaccagcgtaaaaaattccgaaggaggtgggtaggtgccctcgcctctgtgacaatacctatacatttcatctacggcccgctcgatccagtaaacccatacccagaatttcttgaattataccggaagaccctgccgcgaagtaccgtctccatcctggacgatcacatttctcattaccctcaactggaagatcctatgggctttttaaatgcttatatgggatttattaactctttctag

SEQ ID NO: 48747 - DNA, 981 bp, Artificial Sequence
  Description of Artificial Sequence: Synthetic coding sequence
atgcgggagtggtgggtgcaggtgggcctgctggccgtgcccctgcttgcggcataccttcacatacccccaccccagctttcacctgctcttcactcctggaagtcttcggggaagttcttcacatataagggcttgcgtatcttctaccaggactccgtgggggtcgttggttctcccgagatcgtcgtgcttctgcatggctttcctacatccagctacgactggtataaaatatgggagggtctgacgctgcggtttcaccgcgttatcgctctagacttcctcgggttcggcttctccgacaagcctagacctcatcattattctattttcgagcaggcttcaattgtcgaggcactgcttcgccatctaggcctgcagaatagacgcattaatctcctgagtcacgactacggggatatcgtagcgcaggagttactgtaccggtataaacagaatcggagcggccgcctgaccattaaatccctctgtctcagcaatggtggcatcttccccgagacacaccgtcccctgcttctccagaaactgttgaaggatggaggcgtcctatctcctattttgaccaggctgatgaacttcttcgtgtttagtagaggcttaacaccggtgtttggtccctacacaaggccatctgagtccgaactgtgggatatgtgggccgggattaggaacaatgatggcaaccttgtgatcgatagccttttgcaatatataaaccaaagaaagaaattcagacgtcgctgggtcggggctttagcatccgtaaccattccgattcactttatctacggtcccctggatcccgttaacccttatccagaatttttggaattatacagaaaaaccctccctcgctcgacagtgtcgatcctggatgaccatatttctcactacccccaactggaagatcctatgggttttttgaatgcctatatggggtttatcaactcattctag

SEQ ID NO: 48748 - DNA, 801 bp, Artificial Sequence
  Description of Artificial Sequence: Synthetic coding sequence
atgcggaccgagcccctgtgcggcgccagccccctgctggtgcccggtgatccatattcagtggtggtgttactccaagggtatgccgaacctgagggtgtcggagacgcagtgagggcagacggctcggttacactggtgctgcctcagacccggggccctgccagtagccaccgcgaaagcccgcgcgggagcggtggagcagaggctgccctagaagaggcagccagggggccaatactcgttgacaccggcgggccatgggctcgggaggccttgttgggggcgcttgctggccagggggttgctcctggcgacgtgacattagtggtcgggacccatggacactctgatcacattggtaacctaggcctctttcctggcgcagccttacttgtgagccatgacttttgtctgcccgggggacggtacctgccccatggattgggcgagggccagccactacgactcggacccggcttggaagtgtgggctaccccgggccatggtggtcaacgagatgtatcagtggtcgtggccgggaccgcattgggtaccgttgtagttgcaggcgacgtattcgaacgtgacggagacgaggactcctggcaggcgctcagcgaagatcctgccgcccaggagagaagccggaaacgcgtccttgtagtggccgacgtggtggtccctgggcacgggccgccattccgcgtgcttcgcgaggcctcccagcctgaaaccgagggcggcggcaatagccagcaggagccagtagtcggtgatgaagagcccgcgctgcactag

SEQ ID NO: 48749 - DNA, 342 bp, Artificial Sequence
  Description of Artificial Sequence: Synthetic coding sequence
atgcggaccgagcccctgtgcggcgccagccccctgctggtgcccggggatccttacagtgtggtcgttctgctgcagggttatgccgaaccagagggtgtcggggatgccgtgcgtgccgatggcagcgtgacccttgtactgccacagacacgggggcccgcctcatcccatcgagagtcacctcgaggatcaggcggggccgaagctgccctggaggaagctgcacgcggacctatcttggtagatacaggaggtccttgggcccgagaagccctcctcggcgcacttgctggccaaggggtggcccccggggacgtcacgctagtggtaggaacttag

SEQ ID NO: 48750 - DNA, 840 bp, Artificial Sequence
  Description of Artificial Sequence: Synthetic coding sequence
atgagcgccctggagtggtacgcccacaagagcctgggcgacggcatcttctggatccaggagagattctacgaatctggtaacagagccaatatctggcttgtcaggggctctgaacaggacgtggtgatcgatacaggtctgggcctgcggtcgctccccgagtatctatattcttccgggctgctccaagatcgcgaggctaaagaagacgccgccaggagacccttactggccgtggccacacacgtgcacttcgatcactctgggggactgtaccagtttgaccgagtcgcagtgcaccacgcagaggcggaggcgcttgcccgaggcgacaattttgaaacagtcacatggctgtctgacagtgaagtcgtaaggactcccagccccgggtggcgggcacggcagtttcgggtgcaggcggtgcagccaacgcttatcttgcaggacggagacgtgatcaacctgggggaccgccaactgactgtcatgcatatgcccgggcatagcagagggtccatttgtctgcatgataaggataggaaaattctattttccggggacgtcgtgtatgacggcagtttaattgattggttgccctattcccgcatcagcgattacgttgggacgtgcgagcgccttatagagctcgttgatagggggctggtggagaaagttctgccaggccacttcaacacctttggggccgagcgtctgtttaggttagccagtaattacatctctaaagccggcatatgccataaggtctcaacctttgctatgcggtccctggcctccctggcccttagggtgaccaacagtagaacttcgccttag

SEQ ID NO: 48751 - DNA, 600 bp, Artificial Sequence
  Description of Artificial Sequence: Synthetic coding sequence
atgagcgccctggagtggtacgcccacaagagcctgggcgacggcatattctggatccaggagcggttctacgagtctggcaaccgcgcgaatatatggcttgtgagaggttccgaacaggacgtggtgattgacacgggcttggggttgcggtccctgccagaatatctttattcttccggtctcttgcaagaccgggaggctaaagaagacgcagccagacgcccgctgcttgctgtcgccacacacgtgcactttgatcatagcgggggactctaccagttcgaccgggttgcagtgcaccacgccgaggccgaggccctcgctagaggggataattttgagacagttacttggctaagcgactctgaggtagtgaggacacccagtcctggttggcgggcgcggcagtttcgagtccaggccgtgcagcccacattgatcctgcaagatgggaatggtccccctagggcacgggccctggttaagggaggctattgggaggagactgtgcgcgttcctcacgtggctgatcttcgcggacataagggagattatttcgggacatcacagtcacacttctgcttcacgcttccctag

SEQ ID NO: 48752 - DNA, 630 bp, Artificial Sequence
  Description of Artificial Sequence: Synthetic coding sequence
atggccgcccggcggcccctgctggccgtggccacccacgtgcacttcgaccatagtggcggcctgtaccagtttgatagagttgctgttcatcacgccgaagccgaggcattagcaaggggagataacttcgaaaccgtcacatggctctctgacagcgaagtggtgcgaacgccatcccccgggtggagggcccggcagttcagggtgcaggcagtgcaaccaactctcatcttgcaggacggcgacgtcatcaacttgggagatcgacagctaactgtcatgcacatgccaggacactctaggggctctatctgcctgcacgacaaagataggaaaatactttttagcggcgacgtggtctatgatggtagcctgatcgattggctaccatactctagaattagtgattatgtgggtacatgtgaaagacttatcgagctcgttgataggggtctggtggagaaggtgctccctggacattttaataccttcggcgcagaacgtctgtttcgtcttgccagtaattacattagcaaggcgggaatatgccacaaggtcagcacctttgccatgcggtctctcgccagcctggctctgcgggtgactaattctcgaacttccccctag

SEQ ID NO: 48753 - DNA, 840 bp, Artificial Sequence
  Description of Artificial Sequence: Synthetic coding sequence
atgagcgccctggagtggtacgcccacaagagcctgggcgacggcatcttttggattcaggaaagattctatgagtccggaaacagagcgaatatctggcttgtgcggggctccgaacaggatgtggttattgacaccggattgggcttaaggtctctgcccgagtacctgtactcatccgggctgctccaggacagagaagccaaggaggacgcagcccgcagacctttactggccgttgcaacacacgtgcatttcgaccatagcggcgggttataccaattcgaccgcgtcgccgtgcaccacgcagaagctgaagcccttgcccgcggcgataactttgagactgtgacatggctgtcagatagcgaagtcgtccgaacaccctcgcccggatggcgcgccagacagttcagggtgcaagccgtacagccgacattaatattgcaggacggcgatgtgattaacttaggcgatcgccaactgaccgttatgcatatgccgggccacagcaggggaagcatctgtctgcacgataaagacaggaaaattttgttcagtggcgacgtcgtgtacgatggatcattgatagattggcttccttatagccgcatcagcgattatgtgggaacgtgtgaaaggctcatcgaactggtggaccgaggcttggttgagaaagtgctgccagggcacttcaataccttcggcgcggaacgactgttcaggctagccagcaactatatcagtaaagccggtatttgccacaaagtgtccacctttgctatgcgttctctggcctccctcgccctgcgcgtaactaacagccgaacttccccctag

SEQ ID NO: 48754 - DNA, 153 bp, Artificial Sequence
  Description of Artificial Sequence: Synthetic coding sequence
agctgcacctacgccagcttctgcaagtgcaaggagtacaagtgcactagttgcaagaagaactgttgtagttgctacccggtgggttgtgcgaaatgcgcccaaggctgtatctgtaagggcgcgagcgacaaatgttcttgttgcgcttag

SEQ ID NO: 48755 - DNA, 123 bp, Artificial Sequence
  Description of Artificial Sequence: Synthetic coding sequence
atggaccccaactacagctgcaccaccggcggcagctgcacctgcgcgggaagctgcaagtgcaaggaatgtaagtgcacttcatgcaagaaatcctgttgcttctgttgccccatgggctag

SEQ ID NO: 48756 - DNA, 186 bp, Artificial Sequence
  Description of Artificial Sequence: Synthetic coding sequence
atggaccccaactgcagctgcaccaccggcgtgagctgcgcctgcacaggttcttgcacctgcaaagagtgcaaatgcacaagttgtaaaaaaagctgttgttcctgctgtcccgtggggtgtgcaaaatgcgcccacgggtgtgtctgtaaaggtaccctggagaattgttcctgctgtgcctag

SEQ ID NO: 48757 - DNA, 879 bp, Artificial Sequence
  Description of Artificial Sequence: Synthetic coding sequence
atggagaccgccgagaaggagtgcggcgccctgggcggcctgttccaggcgattgtgaatgatatgaaatcatcctaccctatctgggaggatttcaattctaaggccaccaagctgcattcccagcttaggacgactgtcttggcagccgtcgccttcctggatgcgttccagaaagtggctgacatggccacgaatactagaggagccacgcgggacataggctccgccctgacaaggatgtgcatgcgccacaggtctattgaaacaaagctgaggcaattcacaaacgcgctactcgagagtctgatcaaccccttgcaagagcgtattgaggattggaagaaggcagctaaccagcttgacaaagaccatgccaaagaatataagcgagctaggcatgaaatcaaaaagaagagcagtgacacccttaaactgcagaaaaaggctcggaaaggcaagggtgacctgcagccgcaactggattctgccttgcaggatgtcaatgatatgtacctgctgctagaggaaaccgagaagcaggccgtacgccgggcccttattgaagagcgcgggcggttctgtaccttcattaccttccttcaacctgtagtcaatggtgaactaactatgctaggggaaattactcacctacagggcataatcgacgatcttgtggtgcttacggccgaaccacataaactgcccccggcttccgagcaggtgattaaggatctcaagggctcggactatagttggagttaccagaccccccctccctctgtcccttcagagccttttgtgagctttctgagcgtgaggttctggaagaattctcctctgctcccagctccatccaccccaagttccccgatctag

SEQ ID NO: 48758 - DNA, 2244 bp, Artificial Sequence
  Description of Artificial Sequence: Synthetic coding sequence
atggagaccgccgagaaggagtgcggcgccctgggcggcctgttccaggcaatagtgaacgacatgaaaagctcctaccctatctgggaggacttcaactccaaagcaacaaaattacattctcagctgcgtactacagttctggccgcggtggctttcctggacgcctttcaaaaggtagccgatatggcaacgaatactcgcggggctacgcgagacattggcagcgctctaacaaggatgtgcatgagacacaggagcatcgagacaaagctgaggcagtttacaaacgcactgttggagagccttatcaaccctctgcaggaacgtattgaagattggaagaaggccgccaatcagctggacaaggaccacgcaaaggagtataagcgagctagacacgagatcaagaagaaaagctccgatactctcaaattgcagaagaaggcgagaaaggaactgctgggcaagggggatctccagccccagctggactctgcactgcaggatgtgaacgatatgtatctcctgctggaggaaaccgagaagcaagctgttcgtcgcgcccttattgaggagaggggcagattctgcacatttataaccttccttcagcccgtggtgaatggcgagctgacaatgctcggtgagataacacatctgcagggtattattgacgatctcgtagtgctgacagccgaaccccacaagctgccaccggcatcagagcaggtcatcaaagaccttaaaggatccgattactcatggagctatcaaaccccaccttcttctccatcatcatcatcttctaggaaatcgtctatgtgctctgcacctagtagtagttcatccgcaaaggggggaggagccccttggccgggcggcgcccagacatactctccttcaagtacctgtaggtatcgctccctggcacagccagctaccactaccgccaggctgtccagtgtgagctcccatgatagtgggtttgtgtcgcaggatgcaacctacagtaagccaccttcaccaatgcctagcgacatcacttcccaaaagtcgtcttcctcagcgtcctctgaagctagtgaaacatgccaaagcgtgtccgagtgctcatcccctactagtgattggagcaaggttggttctcacgagcagcctagtggcgctactttgcagcggcggaaagatagggtggaacttctgcgggataccgaacctggcccagcgtccggtgggactctgggtccatcgggagaagaggcgccgaggcctagaatgtcccccgctacaatcgccgcgaagcacggcgaggaggtgtcccctgccgcttccgatctggctatggtgctgaccaggggactgagtctggagcatcaaaagagtagccgtgactctttgcagtactcaagcggatattccacacagaccaccacccctagctgttctgaagacacgatcccgtcgcagggctctgattacgactgttactctgtgaacggcgacgcagacagcgagggacctcccgagttcgataaaagcagtacaatcccgcgcaattccaatatcgctcagaattacagacgactgatccagaccaaaagacccgcctcaaccgccggcctcccaacagccggtctgcctaccgccaccggcctgccgagcggggctcccccaggagttgcaacaatcaggcggacaccatcaaccaagcccaccgtcagacgtgcactgtcaagtgccggtccaattcccatcagacccccaatagtgcccgttaagactccaacagtaccagacagccccggctatatgggacccacacgagctggctctgaggagtgtgtcttttatacagacgagaccgcttccccccttgcacctgatttggctaaagcatctccgaaaaggctttccctccctaatacagcgtggggctcccctagcccagaagccgctggataccccggcgcaggagctgaggacgagcagcagcaactcgccgctaacaggcattcattggtagagaaactgggagaattggtggccggcgcccacgcgctgggagaaggacagttcccattcccaacagcactttccgccacacctacggaggaaacccctactccaccaccagccgccaccagcgatccccctgccgaagacatgctggtggctatccgtagaggagtgcgtcttcgtcgaaccgtgaccaatgaccgctctgcccccagaatcttgtag

SEQ ID NO: 48759 - DNA, 1149 bp, Artificial Sequence
  Description of Artificial Sequence: Synthetic coding sequence
atggagccccgggccggcgtgagcaagcaggacatccgggagcagatatggggctacatggagagccagaatctcgccgattttccgcgaccagtccatcatcgcataccaaattttaaggggagttatttggcatgtcaaaatatcaaggaccttgacgtctttgcccgcactcaggaggtgaaggtggacccagataagcccttggagggtgttcgactgttggtgctccaaagcaagaagacgctgttggttccaacacctcgcctccgaaccggtctctttaataaaattacacccccccctggagccacaaaagacatcctccggaagtgtgcaacttcacagggtgtccggaactactcggtgccgattggactggacagtcgggtgctagttgatttggtcgtcgtcgggtcagtggctgtatcagagaaaggatggcgaattggaaaaggagagggatacgccgacttagagtacgctatgatggtgtctatgggcgcagtttcaaaggagacccctgtcgttactatcgtgcacgactgccaagtcgttgacatacctgaggaattagtggaagagcacgacatcactgtggactacatattgactccaactcgcgtgattgccactgggtgcaaaaggccaaaaccgatgggaatcacctggtttaagattagcctcgagatgatggagaaaattcctatccttcggtctctacgcgctcgagagcaacaagcagggaaggacgttaccctccaaggcgagcaccagcaccttcccgaacccgggtgtcagcaaaccgtgcctttgtcagtgggacggcgtccaccggatacacctgggccagagacaaatagcatggaggctgctccgggcagtccgcccggagaaggagcccctttggccgcggacgtgtatgtgggcaatctgcctggagacgcgagagtgtccgatctgaagcgtgccctgcgggaattgggatcagtgcccctgagactgacctggcaggggccgcgccggagagcatttctgcactaccctgattcagctgcagctcagcaagcggttagttgtctgcaggggctgcgcctgggaactgataccttaagagtggccctggcacgtcaacagagggataaatag

SEQ ID NO: 48760 - DNA, 1152 bp, Artificial Sequence
  Description of Artificial Sequence: Synthetic coding sequence
atggagccccgggccgtgggcgtgagcaagcaggacatccgggagcaaatctggggatatatggaatctcagaatttggctgactttccccgccctgtgcatcatcgcattcctaattttaagggtagttacctagcctgccagaacattaaagatctggacgtttttgccagaacccaagaagtgaaagtcgaccctgataaaccgctggaaggcgtaagattattagtcctccagagcaagaagactctgctggtcccaacgccgcgtctgaggacagggctctttaataagatcactccaccccccggagcaaccaaggacatcttgagaaagtgtgcaacttctcagggcgtgcggaactacagtgtccccataggcctggactctcgagttctggtagatttggtcgttgtgggctctgtcgctgtgagtgaaaaaggctggcggattggaaaaggtgaggggtacgcagaccttgaatacgctatgatggtgtccatgggggctgttagcaaggaaacacctgtggtcacaatcgtgcacgattgccaagtcgtcgacattcccgaggaactagtggaagaacatgacataacggtagactatatcttgacccctacgagagtgatagcgacagggtgtaaacgacccaagcctatgggcataacgtggttcaaaatttccctggaaatgatggagaaaatacctatcctgcggtctctgagagccagagaacagcaagctggcaaggatgtgaccctccaaggggagcaccagcacttgccagaacctgggtgtcaacaaactgtcccgctttcagtcggaagacgtccccccgatacaccaggacccgagactaactctatggaggcagcaccaggctctccccccggagagggggctcctctggccgcggacgtgtacgtgggaaacctgcctggtgatgccagggtctcggatctgaaacgagcactgcgcgagctgggctcagtacctctacggttgacctggcagggtcctcggagacgcgcattcctccattaccccgattcagcggccgctcagcaggccgtcagctgcctgcagggactacgacttgggacggacaccctgcgggtcgctttagctcgacagcagcgggataagtag

SEQ ID NO: 48761 - DNA, 1152 bp, Artificial Sequence
  Description of Artificial Sequence: Synthetic coding sequence
atggagccccgggccgtgggcgtgagcaagcaggacatccgggagcaaatttgggggtatatggagagccagaacctcgccgactttccccgccctgtccatcacaggattcccaattttaaaggtgcttcccacgccgctgaacagctgcctcgactacaagcttttaaaactgccaggacaatcaaggtgaaccccgacgccccccaaaagagcgcaaggtttttcgtcctggagagtaaaaaaactctactggtgcccacccccagactgagaactggactgttcaacaagatcacacccccacccggggccactaaagatatattacgaaagtgcgctacctcacagggagtgcgcaactattccgtcccgatcgggctggactctcgggtgctggtcgatctggtagtagttggctctgtggccgtttccgagaagggttggcggatagggaagggagaggggtacgcagacttggaatacgcaatgatggtgagcatgggcgccgtctcaaaggaaacaccagtggtgactatcgtgcatgactgtcaggtcgtcgatatacccgaggaactcgtggaggagcacgacatcaccgtggattacatcctgacaccaacacgtgttatcgcaacaggatgtaaacgcccgaaaccgatgggcattacctggtttaagatctccctggaaatgatggagaagattcccattctgagatccctcagggccagggagcagcaggccggcaaggatgtgaccctgcagggcgagcatcagcacctgcctgaaccaggctgccaacagactgtgcccctgtcggtgggaagacgcccacccgacaccccagggcccgagacaaactcaatggaagccgcgcccgggtcccccccaggagagggggcccctctagcagccgatgtttacgttggcaacctgcctggtgacgccagggtaagcgatctgaagagagccttacgagagcttggttccgtgccacttcgacttacctggcaagggccccggaggcgggctttcctgcattacccagattccgccgccgcccaacaggctgtttcttgccttcaagggctgcgtctgggtacggatacgctgagggtcgcacttgccagacagcaacgagacaagtag

SEQ ID NO: 48762 - DNA, 1146 bp, Artificial Sequence
  Description of Artificial Sequence: Synthetic coding sequence
ggcccccggctgggcgtgagcaagcaggacatccgggagcagatctgggggtacatggaatcacagaatctggctgacttcccccgccctgttcaccaccgtatacccaactttaaaggcagttatctggcctgtcagaacattaaagacctggacgtgttcgcacgaacacaagaggtaaaagttgaccccgacaagccccttgagggtgttcggctactggtcctccagtccaaaaagactctcttagtaccgactcctagactcaggactgggctgtttaacaaaattactcctccacccggggcaacaaaggacattctgagaaaatgcgctacctcccagggagtgaggaattacagtgtcccaattgggctcgactcacgggttctggtggatctggttgtagtcgggtctgtagcagtgagcgaaaaaggctggagaattggcaagggggaaggatacgctgatctcgagtatgccatgatggtgtctatgggcgccgtgtccaaagagacccccgtggtgactatagtgcacgattgtcaggtagtggacatccctgaggagctggtcgaggaacatgacataactgtcgattacattctcactcctacccgcgtgattgccactggctgtaagcgaccaaaacccatggggatcacatggttcaaaatttcccttgaaatgatggagaagattccgatactgcgcagcctgagagctcgggagcagcaggctggcaaagatgttaccctgcaaggcgagcaccagcacttgcctgaacctggctgccagcagaccgtacccctgtcggtcgggcgacggccaccggatacaccaggacctgaaactaactcaatggaagcagcacctggaagcccacccggagagggcgctccccttgccgccgatgtgtatgtcggaaacctcccaggggacgcacgtgtaagcgacctcaagcgggcactgagggaattgggaagtgtccccttgcgcttaacctggcaaggcccacgtcgacgcgcctttctgcattatcccgattcagctgccgcccaacaggctgtctcctgtctgcagggccttaggttggggacagatacgctccgcgtggctctggctcgacagcagagagacaagtag

SEQ ID NO: 48763 - DNA, 663 bp, Artificial Sequence
  Description of Artificial Sequence: Synthetic coding sequence
atgatggtgagcatgggcgccgtgagcaaggagacccccgtggtgaccatcgtgcacgactgtcaggttgtggatatccccgaggagctggtggaggaacacgacatcaccgtagactatattctcacgcctacccgtgtgatcgccaccgggtgcaagcggccaaagcccatgggcatcacttggttcaagatcagcctggaaatgatggaaaaaatcccgattctgaggtctctgcgggcgagggagcagcaggcaggcaaagacgttaccctgcaaggcgaacatcagcatctgcccgagccaggctgccagcaaaccgttccattgtctgtggggagaagacctcctgataccccaggtccagagacaaactctatggaggccgcccccggctctccaccgggagagggtgctccgttagctgctgatgtgtacgtaggaaatcttcccggtgatgcaagagtgtctgacctgaagagagctctgcgcgaactgggcagcgtgcccctaagattaacctggcagggacccaggcgacgggccttccttcattatcccgattctgccgcagcccagcaagctgtctcctgcctccaggggttaagattgggaaccgatacgttaagagtcgccttggcaagacagcagagagacaaatag

SEQ ID NO: 48764 - DNA, 579 bp, Artificial Sequence
  Description of Artificial Sequence: Synthetic coding sequence
atgtgcagcgagcccaagcaccacgtgaacggcaaccggaccgtggagcctttccctgaaggaacacagatggctgtgttcggcatgggttgtttctggggggccgaacgtaaattttgggttctgaagggagtctactccacccaagtgggttttgctggcggatatacatccaaccccacctacaaagaagtgtgctcagagaagaccgggcatgctgaggtcgtgcgggtcgtctatcagccggagcacatgtcatttgaggaacttctaaaggtcttttgggagaaccatgatcccacccaagggatgagacagggaaacgatcacgggacacagtaccgctcagcaatataccccacatcagcaaagcagatggaagcagcattgtcctcaaaagagaattaccagaaagttcttagcgaacacggtttcgggccgatcacgactgatataagggaagggcaaaccttctactacgctgaggattaccatcagcagtatctttctaaaaatcccaatgggtactgtgggctcggcggcacgggcgtgtcttgtcccgtcggtatcaaaaaatag

SEQ ID NO: 48765 - DNA, 588 bp, Artificial Sequence
  Description of Artificial Sequence: Synthetic coding sequence
atgctgagcgccacccggcgggcctgccagctgctgctgctgcactcccttttccctgttccacgtatgggcaactcagcttctaatatagtgtcgccccaggaagccctcccaggacgaaaggagcagactccagtggctgcaaaacaccatgtcaatgggaacaggactgtggagccattcccggagggtacccaaatggctgtctttgaaaagacaggccacgctgaggtagttagagtcgtgtatcaaccagagcacatgtcattcgaagagctattgaaggtgttctgggagaaccacgatcctacgcaaggcatgaggcaggggaatgatcacggcacccaataccgttctgcgatctatccgacttctgccaagcagatggaggcggccctgtctagcaaggaaaactaccagaaggtgttaagtgagcatggcttcgggcctattactacagatatccgggaggggcagaccttctactacgctgaagactatcaccagcagtacctctccaaaaatccaaatgggtattgcggtctaggcggcactggggtctcctgtcctgtgggtatcaaaaagtag

SEQ ID NO: 48766 - DNA, 510 bp, Artificial Sequence
  Description of Artificial Sequence: Synthetic coding sequence
atggccgtgttcggcatgggctgcttctggggcgccgagcggaagttttgggtgctaaagggagtttatagtactcaggttggcttcgcagggggctatacttctaatccaacatataaggaagtgtgctctgagaagaccggccatgctgaggtagtccgggtcgtgtatcagcccgagcacatgtcctttgaagaattattgaaggtgttttgggaaaatcacgatccaactcagggtatgcggcagggcaacgaccacggcactcagtacagatctgccatataccccacatccgcaaagcagatggaggctgccttatcttcaaaagaaaactatcagaaagtgctatccgagcatggcttcggcccgatcaccactgatattagggagggtcagacattctattatgctgaggattaccaccagcagtacctgtccaaaaacccaaatggctactgtgggctcggaggtacaggcgtgagttgccctgtcggcatcaagaagtag

SEQ ID NO: 48767 - DNA, 627 bp, Artificial Sequence
  Description of Artificial Sequence: Synthetic coding sequence
atgggcgagcccgccttcaccagcttccccagcctgcccgtgctggggaagctgaagcgaaacatgatgccgtgggcgctccagaaaaagcgtgaaatacacatggccaaagcccacagacgccgggccgcccggagtgcactccccatgcggctgacaagttgtatctttcgtcgcccagtaacccggatcagatctcatcccgacaaccaggtccggcgccgcaagggcgacgagcatttggagaagccccaacagctttgtgcctatcgtcgtctgcaggcactgcaaccctgctcatcacaaggggaggggagcagccccctccacctcgagtcggtgctgtccatattggccccagggactgctggcgagtctctcgacagagctggcgccgagcgcgtaaggtctcctttggagcctacccccggcaggttcccagcagtcgctggcggccccacacccgggatgggttgccagctcccgccacctctgtcaggacagctagttacaccggcagatatacgacgccaggcacgacgcgttaagaaggctagggagaggctcgcgaaagcactacaagcagatcgcctcgcaagaagggccgaaatgcttacaggcgggtag

SEQ ID NO: 48768 - DNA, 627 bp, Artificial Sequence
  Description of Artificial Sequence: Synthetic coding sequence
atgggcgagcccgccttcaccagcttccccagcctgcccgtgctgggcaaactgaaacgcaatatgatgccatgggcactccaaaagaaacgcgagatacacatggccaaggctcatcgccgtcgagccgcccggtctgccttgccaatgagactaacttcatgcatctttaggaggccagtcactcggatcaggagtcatcccgacaatcaggtacgcaggagaaagggagatgaacacctcgagaaacctcaacagctgtgtgcctaccgaaggttgcaggctctgcagccctgttcttcccaaggcgagggttcttctccactgcatctcgagtcagtgctcagtattctcgcccctggcaccgccggggagtccctcgaccgtgcaggcgctgaaagagtccggagccctctcgaacctacgcccggacggtttccagcggttgccggcggcccaactccaggaatgggatgccaactgcctccccccctctccgggcaacttgtaacccccgccgacatcagacgacaggcccgccgcgtgaaaaaagctcgggagcggctagcaaaggcactgcaagccgacaggctagccaggagagccgagatgctgaccgttcgctag

SEQ ID NO: 48769 - DNA, 627 bp, Artificial Sequence
  Description of Artificial Sequence: Synthetic coding sequence
atgggcgagcccgccttcaccagcttccccagcccccccgtgctgggcaaactgaagaggaatatgatgccgtgggccctgcaaaagaagagggagatacatatggctaaagctcatagacggagagctgcacggtctgctctacctatgcgcttaacttcgtgcatcttcaggcgccccgtcactcgaatcagaagtcacccggataatcaggtgagacgtagaaaaggagatgagcacttggagaagccacaacagctttgtgcataccgcagactccaggcgctacagccctgtagctctcagggggagggctcttcacctttgcatctcgaatctgtgctcagcattctcgcgcctggcacagccggagagtcccttgacagagcaggtgccgaaagggtccgcagccccctggaacctaccccagggcgctttccggctgtcgcagggggccccactcccggtatggggtgccaactgccccctccactttcgggtcagctcgtcacgccagccgacatacgccgccaagcgcgccgcgttaagaaggcccgggagagattggccaaggcactgcaggccgaccgtctggctcggcaggccgagatgctgacgtgtaggtag

SEQ ID NO: 48770 - DNA, 627 bp, Artificial Sequence
  Description of Artificial Sequence: Synthetic coding sequence
atgggcgagcccgccttcaccagcttccccagcccccccgtgctgggaaagctgaagcggaacatgatgccttgggctctgcagaagaagcgtgaaatacacatggcgaaggcacacaggcggcgggccgctcgaagcgccctgcccatgagattgacatcgtgcatctttagacgacccgtgacacggatacgctcccatcccgataaccaagtccgaagacggaagggagatgagcacttggagaagccccaacaactgtgcgcatatagaagattacaagccttacaaccatgctcaagtcagggtgagggcagtagccctctgcacctggaatctgtcctgtccattctggccccaggcaccgcaggcgagtcactcgatagagccggggcggaaagggtgaggatcccactcgagcctacccctggacgctttcccgccgtcgcaggtgggcccactccaggaatgggttgtcagttgccacccccattatcgggacagttggtaacaccggccgatattaggcgacaagccaggagggtcaagaaagcacgtgaaagattggctaaggctctgcaagctgacagactggcccggcaggccgagatgctgacatgccgatag

SEQ ID NO: 48771 - DNA, 627 bp, Artificial Sequence
  Description of Artificial Sequence: Synthetic coding sequence
atgggcgagcccgccttcaccagcttccccagcccccccgtgctgggaaaactgaagagaaatatgatgccttgggccctgcaaaagaaaagggagattcacatggccaaagctcacagaaggcgcgcagcgcgatcggccctgcccatgaggctcacctcttgtatttttcgacgacctgtcaccagaatacgttcccaccctgacaatcaggtgagacggagaaagggagatgagcacttggagaaacctcagcagctgtgcgcgtataggcggcttcaggcactccagccatgcagcagccagggagaggggtcatcccctctgcatcttgaatctgtgctcagcatactggcaccagggactgctggagagagtctggacagagcaggggcggagcgggtgcgaatccctctcgagccaactcctggtcggttcccagccgtggctggtggtcccactccaggcatgggctgtcagctgcccccccctttgtcagggcagctggtcactccagcagacattcgccgacaggcgcggcgcgtcaaaaaggcccgcgagaggctggccaaagcgttacaggctgaccggcttgcgaggcaggctgaaatgctgacaggcggctag

SEQ ID NO: 48772 - DNA, 627 bp, Artificial Sequence
  Description of Artificial Sequence: Synthetic coding sequence
atgggcgagcccgccttcaccagcttccccagcccccccgtgctgggcaagcttaagcgaaacatgatgccctgggctctacagaaaaagcgggagattcacatggctaaagctcaccgaagacgggccgccagatcagcactgcccatgcgtctgacttcgtgtatctttcgccgtcctgtgactaggatccggagccatcctgataatcaggtccgaagaagaaagggcgacgagcatctggaaaaaccccaacagttgtgtgcctataggcgcttgcaagccttgcaaccttgcagctcgcagggcgaggggagcagtcctctgcatctggaatccgtgctctcgatccttgccccaggcaccgctggggagtcactggacagggcgggggccgagcgggtgagaatcccccttgaacccacacccgggaggtttccagcagttgcagggggaccaacgcccgggatgggctgccagctgcctcctcccctgtcaggccagctggttacaccggctgatattcggaggcaagcaagacgggtgaagaaggcacgcgaaaggctggccaaggctttgcaagccgacaggctggcccgacaggcagagatgttgaccgtgagatag

SEQ ID NO: 48773 - DNA, 615 bp, Artificial Sequence
  Description of Artificial Sequence: Synthetic coding sequence
atgggcgagcccgccttcaccagcttccccagcctgcccgtgctgggcaaactgaaaagaaacatgatgccttgggcactgcagaaaaagcgtgaaatccacatggccaaggctcataggcgcagggccgcccgtagtgcactgccaatgcgattaacttcttgcattttccgccggcccgtcactaggattcgaagccacccagataaccaagtcaggcgccgaaagggggatgagcacctggagaagccacagcagctgtgcgcatacaggagactccaggcattacaaccatgcagcagccaaggcgagggctcttctccactgcacctggagtcggtcctgtcaatcttggcccccggaaccgcgggtgaatccttggaccgggctggtgcggagcgagtgaggagcccactggagccgacccccggaagatttccagcagtcgctggggggccaactcccggcatggggtgtcaactgcctcccccactgagtggacagctggtgacccccgctgacattagacggcaagcgcggcgagttaagaaggctagagaacggctggccaaagcgctgcaagccgatcgtctggccagaagagctgaaatgtag

SEQ ID NO: 48774 - DNA, 759 bp, Artificial Sequence
  Description of Artificial Sequence: Synthetic coding sequence
atgagcagcgaggtgagcgcccggcgggacgccaagaagctggtgcggtccccttccgggcttcgaatggtcccagagcacagagcctttggaagtcccttcggtctggaggagccgcagtgggtgcccgataaagagtgcaggaggtgtatgcagtgtgacgccaagtttgactttctcacacgcaagcaccactgtcgtaggtgcggaaagtgtttctgcgatagatgctgttcccagaaagtgcctctccgacggatgtgctttgtggatcctgtccggcagtgtgctgaatgtgccctcgtgagcctgaaggaggcagagttctatgataagcagttaaaagtgctgctttctggtgctaccttcttggttaccttcggcaatagtgaaaaacccgagactatgacctgtagattgagcaacaatcagcgctatctgtttctagatggcgactctcactatgagattgagatcgtccacatatctactgtgcagatcctcacagaagggtttcctccaggggagaaggacatacacgcttacacctcattacgcggaagccaaccagcgagcgagggcgggaatgcaagagccacaggcatgtttctgcaatacaccgtgccaggtactgagggagttactcagctgaagctgactgttgtggaggatgtgaccgtgggaaggaggcaggccgtggcctggttggtggccatgcacaaggccgctaagctgctttatgaatcacgggatcagtag

SEQ ID NO: 48775 - DNA, 2808 bp, Artificial Sequence
  Description of Artificial Sequence: Synthetic coding sequence
atggcccccgccgagatcctgaacggcaaggagatcagcgcccagattcgggcccggttgaagaaccaggtgacgcagctcaaagagcaggttccgggattcacacctaggctcgctatcctgcaggtcggtaatagggatgattccaatctctatatcaacgtgaaactgaaggcagccgaagagatcggtatcaaagccacccacatcaaattgcccaggaccacaactgagtcagaggtgatgaagtatatcacctctctcaatgaagactctaccgtgcacgggttcctggtgcaattgcctctcgactcagaaaactctatcaatactgaggaagtgataaatgctatagccccagaaaaggatgtggacggtcttacaagtattaacgctggtaaactcgcacgcggcgacctgaatgattgtttcatcccttgcacccctaaaggatgtcttgagcttatcaaggagacgggagtccctattgccggcaggcatgcagtggtcgtcggccgctccaaaatagtaggggccccgatgcatgatctgctcttatggaacaatgcaaccgtgaccacttgtcacagcaaaaccgcgcacctagacgaggaggtgaacaaaggagatattcttgtcgttgccacgggacagcccgagatggtgaagggcgagtggattaaacccggagcgattgttattgattgcgggataaattacgtcccagacgacaagaagccaaatggaaggaaagtggtcggcgacgtggcttatgacgaggccaaggagagagcctccttcataacccctgtgcccggcggcgtaggacctatgacagtcgctatgctaatgcagagtaccgtcgagagcgcaaagagatttctagagaaattcaagcccggcaaatggatgatccaatacaacaatctcaacctaaagacaccagtcccgtcggacatagacatctcccgtagttgcaaaccgaagcccattggcaagctggcacgcgaaattggccttctgtccgaggaggttgagctgtacggagagacaaaagccaaagtactgctttccgcccttgagagattaaagcacaggcctgatggcaaatatgtggtcgtcacaggtattacacctacaccactaggcgaaggtaaatcaacaaccactatcggcctagttcaagccctgggggcccatctttatcagaacgtattcgcctgcgtacggcagccgtctcaggggccaacattcgggattaaaggaggtgccgccggtgggggttacagccaggtgattccgatggaagaatttaatttacatctaacaggtgacatccatgcaataactgcagcgaacaatctagtcgccgcagctatcgacgcacgaattttccacgagctgacgcaaacagataaggcactgtttaaccgcctagtgccatctgttaacggcgtacggcgcttttctgacatccagatccggcgcttgaagaggctgggcatcgagaaaaccgaccccaccacgctaaccgatgaggagattaacagatttgcgagactcgatattgacccggaaaccatcacgtggcaaagggtgctggacacaaatgataggtttctgcgcaagatcacgattggacaagcccctacagaaaaagggcatactagaacggcccagtttgacatctccgttgcctcggagatcatggccgtactggctcttaccactagtttggaagacatgcgggagcgcctggggaagatggtggtggcctcgtcgaagaaaggggagcccgtgagcgctgaggacctcggggtgtccggtgctctgacagtcctaatgaaagacgcgattaagccaaatcttatgcagacgcttgaaggtactccagtctttgtccacgccgggccatttgcaaatatcgcccacggaaacagctcgatcatcgctgatagaattgccctaaagcttgtgggccctgagggcttcgtggtgacggaagccggattcggcgcagacattggcatggagaaattctttaacatcaagtgtcgctattctgggctgtgtccacacgtggtggtgctggttgccactgtgagggcactgaaaatgcacggaggagggcctacagtcaccgccggattgcccctgcctaaggcgtatattcaggaaaatctggaattggtcgagaaaggcttttctaatttgaagaagcagattgaaaatgcacgtatgttcggaatccccgtggtggtcgctgtgaatgccttcaaaacagatactgaatccgagcttgatctcatcagccggttaagcagagagcacggcgcattcgacgctgtgaaatgtacgcattgggccgagggcggcaaaggtgcgctagccctggctcaggctgttcaacgggcggcccaagctccctccagcttccaattgctgtatgatttaaagcttccggtcgaggacaaaattagaattattgcccaaaaaatttacggagcggatgacatcgagctacttcccgaggctcagcacaaggccgaagtctataccaaacagggcttcggtaatttgcccatttgtatggctaaaacacacttatccctcagtcacaacccggagcagaaaggagtccccacaggctttatccttccaatacgggacataagagccagcgtaggagccggcttcttgtaccctctggtgggtactatgtcaactatgccgggcctgcctacaaggccctgtttctatgatatagatcttgacccagaaactgaacaggtgaacggcctgttttag

SEQ ID NO: 48776 - DNA, 852 bp, Artificial Sequence
  Description of Artificial Sequence: Synthetic coding sequence
atggcccaccggggcgcccacttcgccttccggagccggtggcagaagacagacgacgagttgtgccggcactctatgtctttcatcctgcacaaagctatccggaacgatttcttccagagctacctttacctactggagaagatccctctggttaagctgtatgcacttacttcacaggtgatcaacggggaaatgcagttttacgctagagcaaaactgttttatcaagaggtcccggctaccgaggagggcatgatgggtaatttcatagagctgtcttcacctgacatccaagccagccagaagttcctgaggaaattcgtgggaggccctggacgagcgggcaccgactgtgccctggattgtggatcagggatcggcagagtctctaaacacgtcctgctgcccgtgtttaacagcgtcgaactcgtcgatatgatggaatctttccttctggaagcacagaattacttgcaagtcaaaggagataaagtggagtcatatcactgctatagtctgcaagaatttactccaccattccggcgctatgacgtgatatggatccagtgggtcagcgggcacctgaccgataaagatctgctcgcattcctgagccgctgcagggatggactgaaagagaatgggatcatcatcttgaaagacaacgttgcgcgcgaaggatgcattctagatttgagcgacagctccgttaccagggatatggatatactgcgcagtctcattagaaagagtggactggtggttctgggtcaagaaaagcaggacggattcccagagcagtgtatccctgtctggatgttcgccttgcactcggaccggcattcctag

SEQ ID NO: 48777 - DNA, 1191 bp, Artificial Sequence
  Description of Artificial Sequence: Synthetic coding sequence
atgaaggagtgcaacgccacccggcggccccagatgagcttcctgaaaatggatatgacccagatggaatttccagatgcctccttccaggtggtactggataaaggtaccttggatgcagtgctgaccgatgaagaagagaaaacgcttcagcaggttgacaggatgctggccgaggtcggccgagtcttgcaagttggcggcaggtacttatgtatatctctggcgcaggcacatattcttaagaaggccgtggggcacttcagccgtgaaggctggatggttcgggtccaccaggtagcaaactcgcaggaccaggtgctggaggctgagcctcagttctccctgcctgtgtttgcgttcattatgacaaagttcagaccagtcccaggaagtgcactgcagattttcgagctctgcgctcaggagcagcggaaaccagtgcggctagaatctgccgagcgactggccgaagcggtccaagagagacaacagtatgcatggttatgtagtcagctccggcgtaaggcacgtttagggtcagtgagtttggacctttgcgatggtgacaccggcgagccaaggtatactctgcacgtggtcgattccttacctctgtttgtgcacgatcattttccaaagagctgtattgacgccgtggaaattgaccccagtatgctagaagtcgcgacccaatggtttgggttttcgcagtcagacagaatgaaagtccatatcgccgatgggctggactatatcgctagcctggcaggcggaggagaagccaggccttgctacgacgtgattatgttcgacgtcgatagtaaagatcccactctgggcatgagctgccccccacctgcatttgtagagcagagtttcctacagaaagtgaagtctatattgactccagaaggggtttttatccttaatcttgtctgccgcgacctgggactgaaggactcagtgttggccggtctgaaagccgtattcccacttctgtacgtgaggcgcatcgaaggagaagtcaatgagatcctgttctgtcaattacacccagaacagaagttggccacccccgaactgctggagaccgctcaggcactcgagcggaccctaagaaagcctggacggggatgggacgatacctacgtgttgtcggacatgctaaaaaccgtgaaaattgtgtag

SEQ ID NO: 48778 - DNA, 2100 bp, Artificial Sequence
  Description of Artificial Sequence: Synthetic coding sequence
atgaacctgctgcccaagagcagccgggagttcggcagcgtggactactgggagaaattctttcagcaacgcgggaagaaggcattcgaatggtatggcacctaccttgaactgtgcggggttcttcacaaatacatcaagccgagggaaaaggtgctggtgatcgggtgcggtaactccgaactgtcagaacaattatacgacgtgggctacagagacattgttaacatcgacataagcgaggttgtcattaaacagatgaaggagtgcaacgctacacgccgccctcaaatgagcttcctgaagatggacatgacacaaatggagttccccgacgccagctttcaggtcgttctcgataaaggcacccttgatgctgtcctgactgatgaagaggaaaagacactacagcaggttgaccggatgcttgcagaggttggcagggtgcttcaagtggggggtaggtatctctgcatcagccttgctcaggctcacatccttaagaaagcagtgggacacttctctcgggaaggctggatggtgagagtgcatcaagtcgcgaatagtcaggatcaggtgcttgaagccgaaccccagttctccttgcccgtatttgcatttatcatgaccaaattcagacctgttccaggcagcgctctccagatctttgagctctgtgcccaggagcagaggaaacccgtgagactggagtcggctgagcggctggctgaggcagtgcaggaaaggcaacagtacgcctggctgtgcagtcagctccgacggaaggcacgtctcggatcagttagcttggacttgtgcgatggcgacaccggagaaccccgctatacattgcatgtggtcgactcacctactgtgaaaccgagtcgggataaccattttgccatctttatcattccacagggacgtgagaccgagtggttgttcggaatggatgaaggcaggaaacagttagcagctagtgctggctttcggcgcttaatcacggtggccctacaccgggggcagcagtacgaaagtatggatcatatccaggccgaactgagtgctagagtgatggagcttgctcctgcaggcatgccaacccagcagcaagtgcctttcctctcagtgggaggggatattggcgtgcgcaccgtgcagcaccaggactgctcgcccctgtccggggactacgtgatcgaagatgtgcagggagatgacaaaaggtatttccgcagactgatattcctgtccaaccgcaacgtggtccagtctgaagcacgcctcttaaaggacgtgagccacaaggctcaaaaaaaacgcaaaaaagacagaaagaagcagcgccctgcagatgcagaagatttgcctgcagcgcccgggcaatccatcgacaagtcttacttgtgttgcgaacaccataaagccatgatcgcaggcctggctctacttagaaaccctgagctgctgctggaaattcctctggctctgctggtggtgggcctagggggaggaagtctgcccctgtttgtgcacgatcattttccaaaaagttgcattgacgccgttgaaattgacccttctatgctggaggtagccacacagtggtttggcttcagccagtccgaccgcatgaaggtccacattgcagatggtctagactacatcgcgagcctggccggagggggtgaggcaagaccttgctatgacgttatcatgttcgatgtggattcgaaagaccctaccctgggcatgagctgtccccctcccgccttcgtcgagcagtcgtttctgcaaaaggtgaagtccattctgactccagagggtgtgtttatactgaacctggtttgtcgggacttaggcctgaaagactcagtgcttgccggactcaaagctgtgttcccactgctctatgtgagacgcattgaaggcgaggtgaatgagatcctgttctgccagctgcatccagaacaaaaacttgccacaccagagttattggaaactgcacaggccctcgagagaactctgcgtaaacctgggagaggatgggatgacacctacgtcctatcggacatgctgaaaactgtaaaaattgtgtag

SEQ ID NO: 48779 - DNA, 1842 bp, Artificial Sequence
  Description of Artificial Sequence: Synthetic coding sequence
atgaaggagtgcaacgccacccggcggccccagatgagcttcctgaagatggacatgacccagatggagtttccagacgcctcatttcaggtggtcttggacaagggaaccttggatgcagtcctgacagacgaggaggagaaaacactgcagcaggttgacaggatgctggctgaagtaggccgggtgctgcaagtggggggcagatatctgtgcatatccttggcacaggcacacattctgaagaaggccgtggggcactttagcagggagggctggatggttcgggtccaccaggtagcgaatagccaggatcaggtattggaggcagaaccacagttcagcttgcctgtttttgccttcatcatgactaagtttcggcctgtccccggttccgctttgcagatattcgagctgtgtgcacaggagcagcgtaaacccgtacgactcgaatctgcggagcgtcttgcagaggcggtgcaggaacgccaacagtacgcatggttgtgtagccaattgaggagaaaggccaggcttggatcagtgagtcttgacctctgtgacggggataccggagaaccccggtacactctccacgtcgtcgattcccctacggtgaaacctagtcgcgataaccatttcgctatcttcatcattcctcagggcagagaaacagagtggctcttcggtatggatgaggggcggaagcaactagcagcatcagccggcttcagacgactgatcaccgtggccctgcacagaggacagcagtatgaaagcatggaccacatacaggctgaattatcagccagggtaatggagctcgccccagctggaatgccgactcagcagcaggtcccctttcttagtgtgggtggcgacatcggtgtgagaactgttcagcatcaagattgctcacccctgagtggagactatgtgatagaggacgtacagggcgatgataaacgatattttaggaggctgatctttctgagtaacaggaatgtggtccaatcagaagctcgcctgcttaaagatgtgtctcacaaagctcagaaaaaacggaaaaaggaccgcaaaaagcaacgacctgccgacgctgaagatctgccggctgcccctggacagtccattgacaagtcatacctttgctgcgagcaccataaggccatgatagctggtctggccctcctgcggaaccctgaacttctgctcgaaatccctctcgccctgctagtggtcggcctcggcgggggtagtttgcctctgttcgttcacgatcactttccgaaatcctgcattgatgcagtagaaatcgacccttccatgcttgaggtcgccacacagtggtttggattttcccaatcggatcgcatgaaggttcatatcgccgatggcctggactatattgctagcctggctggaggcggggaggcccgtccatgttatgacgtgattatgttcgacgtcgatagcaaggatccaacacttggtatgagctgtcctccccctgcatttgtggagcagagctttcttcagaaggtaaaatctatcctgactccagagggcgtctttatcctaaacctggtgtgccgcgaccttggtttgaaagacagtgtgctcgctggtcttaaagcagtatttccacttctctacgttaggcgaatcgagggagaggtgaacgagatccttttctgccagcttcacccggagcaaaagctcgctactcccgaactgttggaaaccgctcaggccctagagagaacactgaggaagcccggtcgaggttgggatgatacgtatgtgctatctgatatgcttaagaccgtcaaaatagtatag

SEQ ID NO: 48780 - DNA, 1632 bp, Artificial Sequence
  Description of Artificial Sequence: Synthetic coding sequence
atgaacctgctgcccaagagcagccgggagttcggcagcgtggactattgggaaaagttcttccaacagcgcggcaaaaaggcttttgagtggtacggaacatatctggaactttgtggcgtgctgcacaagtacattaaaccacgggagaaggtgctcgttatcgggtgtggcaacagcgaactcagcgagcagttatacgacgtggggtatagagacatcgtgaacattgatatctctgaagtagtcatcaagcaaatgaaggaatgcaatgccactcgccggcctcagatgtcttttctgaaaatggatatgacacagatggagttccccgacgcatcattccaggtcgttttagataaggggactttggacgcggtcctgactgatgaggaagagaagacactgcagcaggtggaccgcatgttggccgaagttgggagagttctgcagggtcgggaaacagaatggttgtttggcatggacgaaggccgaaaacagctggcagcttccgctgggttccgtagattgattacagtcgcgttacaccggggacaacagtacgagtccatggatcatatacaggctgagctgagtgcccgcgtaatggaactggccccggcgggcatgccaacccagcaacaggtgccattcctctccgtcgggggagatattggggttcgtactgttcagcatcaagactgttccccgctgtccggcgactacgtgatcgaggatgttcagggagatgataagaggtactttcggcgccttatctttctttcaaacagaaatgtcgtccagtcggaggcaagactcctaaaggatgtctcccacaaggcccaaaagaagagaaagaaggaccgaaagaaacagaggcccgccgacgctgaggatctgccagccgccccaggacagtcgatagataaatcatacctgtgctgcgaacaccacaaagcaatgatcgcgggcctggcgctgcttcgtaacccggagttgctgcttgaaattcctttggcccttcttgttgtggggctgggggggggttcactgcccctgtttgtccatgatcattttcccaagtcttgcattgatgccgtcgagattgatcccagtatgctggaggtggccacccagtggttcggttttagtcagtctgaccgtatgaaagttcatattgcagatggactggattatatcgcttcactagccggcgggggcgaggctcgcccgtgttatgacgttatcatgtttgacgtggattccaaagacccaaccctaggaatgagttgccctccacccgcctttgtggaacagagcttcctacagaaagtcaagtccatactcacaccggagggcgttttcatcttaaatctggtgtgtagagacctaggattgaaagactcagtacttgctggtctgaaggccgtatttccactgctgtatgtgcggcggatcgaaggcgaggttaatgagattctgttttgccagctgcaccccgaacagaaactcgccacacctgagcttctggagaccgcccaggctcttgaaaggactctgcgcaaacccgggagggggtgggatgacacctacgttctttcagacatgctgaaaaccgtgaagatagtatag

SEQ ID NO: 48781 - DNA, 2097 bp, Artificial Sequence
  Description of Artificial Sequence: Synthetic coding sequence
atgcgggccttcgtggtgagccgggagttcggcagcgtggactactgggaaaagttcttccagcaaagagggaaaaaagcgttcgagtggtacggcacatatctggagctttgtggagtattacacaaatacatcaaaccgcgggagaaggttttggtcatcggctgcggcaactctgaactgagcgagcagctgtacgacgtagggtatcgagacatcgtgaatattgacatcagtgaagtggtgatcaagcagatgaaagaatgcaatgcaacaagacgcccacagatgtcttttttgaaaatggatatgacacaaatggagttcccagatgcgagttttcaggtggtcctggataaaggaacgttagacgcggtcttgaccgatgaggaggaaaagaccctccagcaggtggatagaatgttggccgaagtcgggagggtgcttcaggtgggcgggcgatacttgtgcatctcgctcgctcaggcgcacattctgaaaaaagcggtgggacactttagccgggaaggatggatggtgcgtgttcatcaggtggcaaatagccaggatcaggtccttgaggcggagccccagtttagtttgcctgtgttcgcgttcatcatgacaaagtttcgccctgttccaggctcagccttacaaattttcgagctttgcgcacaggaacagagaaagcctgtcaggttggaaagcgcagaacggttagctgaggctgtccaggaaagacagcaatacgcttggctttgctctcagcttcgccgtaaggcacggctcgggtcagtgagcctggatctgtgcgatggcgatactggcgagcctagatacaccctccacgttgttgactctccaactgtcaaacccagcagagataatcactttgcgatctttattattcctcaggggagagagactgagtggctttttgggatggacgagggcaggaagcagcttgctgcctctgccggtttccggcgcctgatcactgttgctctccataggggtcagcagtacgaaagtatggaccacatacaggcagaattgtctgctagggtgatggagctggcacctgccggcatgcccacccagcaacaggtgcccttcctgagcgtggggggagatattggcgtgcgtacggtgcagcaccaggattgttccccattgagtggcgattatgtgatcgaggacgtgcagggggacgataaacgatacttccgtcggttgatctttctgtcaaaccgaaacgtggtgcagagcgaagcaaggctcctcaaggatgtatctcacaaagcccagaagaaaagaaaaaaagaccgcaaaaagcaaaggcctgctgatgcggaggacctgcccgccgctcctggccagtctatagacaaatcttatttgtgttgtgagcaccacaaggcaatgatcgctggcctggcactcctgcgaaaccccgaactgctcttggagatccctctagcactgttagttgtaggtctggggggtgggtctctccctctctttgtacacgatcatttccccaagtcatgtatagacgcagttgagatagacccctctatgttggaggtggctacccaatggttcggctttagccaaagcgaccggatgaaggtacacatcgcggatggactggactacatcgccagcttggctggtgggggcgaggcccgaccctgctatgacgtgattatgtttgatgtcgattccaaagacccgaccttgggaatgagctgccccccacccgcctttgttgagcagagcttcctacagaaagtgaaaagtatccttacccctgagggtgtgttcatccttaatcttgtttgcagggacctcggtctaaaagatagcgtgctggccgggttaaaggctgtcttccccctcctgtatgttcgccgtattgagggagaagtgaacgaaattctgttttgtcagctccacccagagcagaaactggctacaccagagttgctcgagactgcacaggctctggagcgcacactcagaaagcctggaagaggctgggacgatacctacgtgctatcggatatgctgaaaacggtgaagatagtgtag

SEQ ID NO: 48782 - DNA, 822 bp, Artificial Sequence
  Description of Artificial Sequence: Synthetic coding sequence
atgctgcggtacccctacttctgccggatgtacaaggagtgcctgtcttgttggctggagtcgggaatacctaacctcggggtttggcccaatcgcatccacactacagccgagaaataccgcgaatatgaagccagagaacagaccgaccaaacacaggcccaggaactgcacagatcacaggatagggactttgagacaatggctaaacttcacattcctgttatggtagacgaagtagtgcactgtctttcgccccagaaaggacagatattcctcgacatgacattcggcagtggcggacataccaaggccattctgcagaaagagagcgatatcgtcctgtacgccctggacagagaccccacagcctacgcgctggctgagcacttaagtgagttataccccaagcagatccgcgctatgctgggacagttctcccaggcagaggccctcctaatgaaagctggcgtacagcccggcacttttgatggcgtactcatggacttaggctgttcaagcatgcagctcgacaccccagaaagggggtttagtctgcggaaggacggacctctggatatgaggatggatggaggtaggtaccccgacatgcccacagcagcggatgtcgttaatgctctcgaccagcaggccctcgcctcaatcctacggacatatggggaggaaaagcatgccaagaagatcgcatcagcaatcgttcaagcacgatcaatctatccgatcacccggactcagcagctggcctccatcgtagctgagtatagcgagacctatttcccggtggctcagaccctgtattag

SEQ ID NO: 48783 - DNA, 822 bp, Artificial Sequence
  Description of Artificial Sequence: Synthetic coding sequence
atgctgcggtacccctacttctgccggatgtacaaggagtgcctgtcttgttggctcgagagcgggataccgaatctgggcgtctggcctaaccgcattcatacaactgccgagaaataccgagagtacgaagccagagaacagaccgaccagacgcaggctcaggaactccatagaagccaggatcgggatttcgagacaatggccaaactgcacattcccgtcatggttgatgaggtggtccactgtctttccccacagaagggccaaatttttctggatatgacttttgggagcggaggccacaccaaagcaatccttcagaaggagagtgatattgtgctgtacgccctggatcgcgaccccaccgcctatgccctggcagaacacctgagtgaactttatccaaaacagattcgggcaatgctgggtcaattcagtcaggcggaggccctcctcatgaaggccggcgttcagcctggtacctttgacggcgtcctcatggatttgggctgctcttccatgcagttggacactcccgagaggggcttctcactccgaaaagacggtcctctagacatgcgcatggacggcggccggtatccagatatgcccaccgccgccgatgtggtgaacgccttggatcagcaggctttggcgtccatcctgcgaacctacggagaggaaaaacacgctaaaaagatcgcctcagccatcgtgcaggcccgttccatttacccaattacacgtacacagcagcttgcatcaatagttgctgaatacagcgagacatacttcccagtggcgcagaccctgtattag

SEQ ID NO: 48784 - DNA, 300 bp, Artificial Sequence
  Description of Artificial Sequence: Synthetic coding sequence
atgctgcggtacccctacttctgccggatgtacaaggagtgcctgtcatgctggctggaatcaggcatccctaatctgggtgtgtggcccaacaggatccacactaccgccgagaaatacagggaatatgaagcacgtgaacaaaccgaccagacccaggcacaagagcttcaccgttcacaggatagggactttgaaaccatggcaaaactgcacatccctgtgatggtggatgaagtagtgcactgcttgtcaccacagaaaggacagagcctgggcgtgaggagcgtgggcatctag

SEQ ID NO: 48785 - DNA, 1224 bp, Artificial Sequence
  Description of Artificial Sequence: Synthetic coding sequence
atgctgcggtacccctacttctgccggatgtacaaggagtgcctgtcatgctggttggaatcagggatcccaaacctgggggtttggcccaaccgaattcacacgacagcagagaagtatcgggaatacgaggcaagagaacaaacagatcagacacaagcgcaggagcttcacaggtcccaggaccgggactttgagacaatggccaagctgcatatcccagtaatggtggatgaggtggtccactgcctgagtccacagaaggggcagatattcctggacatgacctttggctctggaggacacacaaaggccatacttcagaaggagtccgatatcgtcttgtatgccctggatcgggacccaactgcatacgcgcttgctgagcatttatctgagctgtaccctaagcaaataagagcaatgctcggtcagttttcccaagccgaagctctcctgatgaaagctggtgtccagcctggcactttcgacggtgttctgatggatctgggctgctcttccatgcagcttgatacacccgaacgaggattttccttgcggaaggacggtcccttggatatgaggatggatggcgggcggtatcccgacatgcccaccgcagctgacgtggtcaacgccctcgaccagcaggctctggcaagcattctcaggacatacggcgaggagaaacacgccaagaaaatagcctcagcaatcgtgcaggcacgatcaatctatccaatcacccgcactcagcaattagcttcaattgttgcaggcgcctttccaccatccgccatctatacaaggaaggatctgcttcagagaagcactcatatcgccactaagacctttcaggctctgcggatctttgtaaataacgagctcaatgaactttacacaggtctcaaaaccgcccagaagtttctgcgccctggggggaggctcgtggccttgagttttcatagcctggaagatcggatagtgaaaaggtttctgctcggtatcagtatgacggaacgatttaatctgtctgtgcgccagcaggtgatgaagacatcccaactggggtcggaccatgagaacaccgaggaagtctctatgcgtagggcccctctgatgtgggagctgatccacaagaaagtactgtcaccgcaggatcaagacgtgcaggataatccacggggacgatctgcaaagttgagagccgctatcaagctctag

SEQ ID NO: 48786 - DNA, 1689 bp, Artificial Sequence
  Description of Artificial Sequence: Synthetic coding sequence
atggccctgagcaagagcatgcacgcccggaaccggtacaaggacaagcccccagatttcgcttacctcgctagtaagtaccctgactttaagcagcacgttcagattaatctgaacggcagagtgagtttgaactttaaagatcccgaagccgtccgggcactcacgtgcaccctactccgagaggatttcggcctgtctatcgatatccccctggaacgattaattcctaccgttcctctgcggcttaattacatccattgggtggaagatctgatcggacatcaagactcagataaatccacacttagaaggggcatcgatataggcaccggcgctagttgtatttatcctctgctgggtgcaacactcaacggatggtatttcctggccactgaggttgatgatatgtgctttaactatgcaaaaaaaaacgtggaacagaataacttatccgacctcatcaaggtggtgaaggtgccccaaaagacattactcatggacgcgttgaaggaggaaagtgaaattatatatgatttctgtatgtgtaacccccccttcttcgccaatcagttggaagccaagggcgtgaacagcaggaacccccgacgaccgccaccgagctctgtgaataccggcgggattacagagattatggcagaaggaggcgaactggagttcgtcaaacgcattattcatgacagtctgcagctgaaaaagcggctccggtggtacagctgtatgttgggcaagaagtgctccctggcccctctgaaagaggagcttcggatacagggtgtgcccaaagtgacttacactgaattttgccagggcagaaccatgcggtgggccctcgcctggtccttttacgatgatgttaccgtgccatcccctccgagcaaaaggcggaagctcgagaaacccagaaagccgataactttcgtagtgctagccagtgttatgaaggaactgagcctcaaggcttccccactgcggtcagagacagctgaaggaatagtggtggtaaccacctggatcgagaagatcctgacggatctgaaggtccagcacaaacgagtgccctgcggaaaggaggaagtgagtctcttcctcacagccatcgagaactcgtggatccacctgcgtagaaaaaaacgagagcgagtgcgtcaactgcgcgaggttcctagggctcctgaggatgtcattcaggccctggaggaaaagaaacccacaccaaaagagtctggaaacagccaagagctggctagagggccacaggagagaactccttgtgggccagctctgcgagaaggcgaggccgctgctgtggaaggaccatgtccctctcaggagagtctatctcaggaagaaaaccctgagcccactgaagacgagcggtctgaggagaagggcggtgtggaggtactggaatcgtgccagggctcctccaacggcgcacaagatcaggaggcgtcagagcaattcggtagccccgtggcagaacgaggcaagcgcctcccaggtgtggctggtcagtatctgtttaagtgcctgataaacgtgaagaaggaggtggacgatgcccttgtggagatgcattgggtagagggccagaaccgtgatttgatgaatcaattgtgtacatatattcggaaccagatcttccgcctggtggccgtgaattag

SEQ ID NO: 48787 - DNA, 675 bp, Artificial Sequence
  Description of Artificial Sequence: Synthetic coding sequence
atggccctgagcaagagcatgcacgcccggaaccggtacaaggacaagccaccggatttcgcgtacctggcttctaagtaccccgatttcaagcaacatgttcagatcaatctgaatgggagagtcagtttaaattttaaagatcctgaggctgtccgcgccttgacgtgcactcttctgcgagaggactttgggttatctatagatattcctctcgagcgcctgatccccacagtcccattgcgactgaactacatccactgggtggaagatctgattggacatcaggacagtgataaaagtacccttcgcagaggtattgatattggtaccggcgcctcttgcatttatccgctcctcggtgcgacactgaatggatggtattttctagcaacggaggtggacgacatgtgcttcaattacgccaagaagaatgtggaacagaataacctgtcagacttgatcaaggtcgtcaaagtaccacagaaaaccctgctgatggacgcccttaaggaggagagtgagatcatctacgacttttgcatgtgtaatccgccttttttcgcaaatcagctggaggcaaagggggtcaactccaggaatccccgaagaccacccccctccagcgtgaatacaggcgaaagcctcgagcccggcagacgacggctgcagtag

SEQ ID NO: 48788 - DNA, 606 bp, Artificial Sequence
  Description of Artificial Sequence: Synthetic coding sequence
atgaaggagctgagcctgaaggccagccccctgcggagcgagaccgctgagggtattgtggtcgtgacaacctggatagaaaaaatcttgacggacctgaaggttcagcataaacgagttccttgcgggaaggaggaagtctcactttttcttacggccattgaaaatagctggatacacctgaggcggaagaaacgcgaaagggtgagacagctcagggaagtccccagggcccctgaggacgtgattcaggcgcttgaggagaaaaaacccacaccgaaggaatctggtaatagccaggagctcgctaggggccctcaggagcggacaccctgcggccccgcacttagggagggggaagcagccgccgtagaaggcccctgccctagtcaggagtccttatcacaagaagaaaatcccgaacccaccgaggatgaacgttcagaagaaaaaggtggcgtggaggtgctggaatcatgtcaggggagctcgaacggtgcccaagaccaggaggcctgttggctgaagctcgcaccccaactgtggaccgcctccgccagatccgaagggttatttgtggagagtggtcttgggtctactgcttag

SEQ ID NO: 48789 - DNA, 1035 bp, Artificial Sequence
  Description of Artificial Sequence: Synthetic coding sequence
atggccgagggcggcgagctggagttcgtgaagcggatcatccacgacagtttacagctcaagaagagactcagatggtattcttgtatgttggggaagaagtgctcgctggctcctctgaaagaagagctgagaatccagggcgtgcctaaggtgacttatacagagttttgtcagggcagaactatgcggtgggcgttggcctggtctttctacgatgacgtgactgtcccttcccctcccagtaagagaaggaaacttgaaaagcctagaaagccaataaccttcgtggtattagccagcgtgatgaaagagctgtctctcaaggcttctcccctcagatccgaaactgctgaagggatcgtggtggtcactacctggattgagaagattttaacggatctgaaggttcagcacaaacgcgtaccgtgtgggaaggaggaggtaagtctttttctgacagccatcgagaatagctggatccacctgcggcggaaaaagagggaacgcgtgagacagctcagagaggtacctcgagcacctgaggacgtgatacaggccctggaggagaagaagccgacacccaaggagtcgggcaacagccaggagctggcccggggcccccaggagaggaccccttgcgggcctgcactgagggagggggaagctgcagccgtggagggcccctgcccatctcaggaaagtctgtctcaagaggagaatccggagcccacagaagacgagcgcagtgaggagaaagggggggtggaggtcctcgagtcctgccaagggagcagcaatggagcacaagatcaggaggcctctgaacagtttggtagcccagtggctgagcgcggaaaacggctgccaggagtggctggtcaatacctgtttaaatgtcttatcaatgtgaaaaaggaagtagacgatgcgctggtcgaaatgcattgggtggaggggcagaacagagacctgatgaatcaactctgtacgtacatccggaaccagatcttccgcttggtggctgttaattag

SEQ ID NO: 48790 - DNA, 795 bp, Artificial Sequence
  Description of Artificial Sequence: Synthetic coding sequence
atggacgtgtgcctgagcagcgcccagcagcccggccggcggggcgaaggtctgtcatcacctgggggatggctggaagcagaaaagaaaggggcgccgcagaaagactctacagggggggttctggaggagtccaataagatcgagccatctctacactctctgcagaagtttgtcccgaccgactatgcatcctacacccaagaacattacagattcgccggtaaggagattgttattcaggagagcatcgagtcctatggcgccgtggtctggcctggggccatggccctgtgccagtatcttgaggagcacgccgaagagctcaactttcaagacgcaaagattttggaaattggtgcaggtcccggactggtgagtatcgttgcttcaatcctgggcgcacaggttaccgctaccgacctgccagacgtcttagggaatctgcaatacaatctgctcaagaatacacttcagtgtacagcccatcttcctgaggttaaggagttggtgtggggcgaagacttggataaaaactttccgaagtctgcattctattatgactacgttcttgcctctgacgttgtgtatcatcactacttcctggacaagctcttgacaaccatggtgtatctttctcaaccaggaacagtgctcctatgggccaacaagttcagattcagtaccgactacgagttcctggacaagttcaaacaagttttcgacacgacactacttgccgaataccccgaaagctctgtaaagctgttcaaaggcatccttaagtgggattag

SEQ ID NO: 48791 - DNA, 489 bp, Artificial Sequence
  Description of Artificial Sequence: Synthetic coding sequence
atgtggggccggctgctggccgccttcccccccgtgcccaccccccagtcaactctcttctatagggcagatgtcgttgttacagatctggaggaactccaagaccttcttaagatgaatattaacatgaacaaacacctcgtgaccggttccgtgcaggccaaagtgctgaaatggggcgaggagattgaggggtttccctctcctcccgatttcatcctgatggccgactgtatctactatgaggaatcactcgaacccctccttaagactttaaaggacatatcagggtttgagacttgtattatctgttgctacgaacagcgcacaatggggaaaaatccagagatcgaaaagaaatattttgaactgcttcagctggatttcgacttcgagaaaattccgctcgaaaagcacgatgaggaataccggtcggaggatattcacatcatctatatacggaagaagaagtccaagttcccttcgtag

SEQ ID NO: 48792 - DNA, 585 bp, Artificial Sequence
  Description of Artificial Sequence: Synthetic coding sequence
atggccgacaccctggagagcagcctggaggaccccctgcggagctttgtgcgcgtgctggagaaacgtgatggaactgttctgcggctgcagcaatactcatccgggggcgtcggctgtgtggtgtgggacgcggccatcgtattaagcaagtacttggaaacgccagaattctctggtgacggtgctcatgccctatcccggagatccgtgttggagctcggctctggcacgggcgccgttggactaatggctgccactctgggcgccgatgtagtggtcactgatctagaggagctgcaggatctgctgaagatgaacatcaatatgaataaacatctcgttacaggatcggtacaggccaaggttctcaagtggggggaagaaattgaaggatttcccagtccccccgattttatactgatggctgactgcatttactacgaagaatcccttgaaccacttctgaagaccttgaaagacatttcggggttcgaaacttgcataatctgttgctacgagcaacgcacgatgggtaaaaacccagaaattgagaaaaaatacttcgagaagttcccatcgtag

SEQ ID NO: 48793 - DNA, 690 bp, Artificial Sequence
  Description of Artificial Sequence: Synthetic coding sequence
atggccgacaccctggagagcagcctggaggaccccctgcggagcttcgtgcgggtgttggagaagcgagacggcacagtgcttagactacagcagtacagttccgggggggtaggttgcgttgtatgggacgccgcaatcgtgttaagtaaatacctggaaacaccagaattcagtggcgacggcgcgcacgccctatcgagaagatccgttctggagctcggctctggaacgggagcggtggggctaatggccgccactctaggcgcggatgtcgtggtgactgatctggaggaattacaggacctgttgaaaatgaatattaacatgaataaacacttagtgactgggagtgtccaggctaaagtgctgaagtggggcgaggagattgaaggcttcccatccccccccgattttatcctgatggccgattgcatatactacgaggagtcccttgagcctcttctgaagacacttaaggacatatccggcttcgaaacttgtataatctgctgctatgaacaacggacgatgggaaagaaccctgaaatcgaaaagaaatactttgaactcctgcagttggactttgacttcgagaaaatacccctggagaagcacgatgaggagtaccgctctgaagatattcacatcatttatatcagaaagaaaaagagcaaatttcctagctag

SEQ ID NO: 48794 - DNA, 618 bp, Artificial Sequence
  Description of Artificial Sequence: Synthetic coding sequence
atggtgcagctggcccccgccgccgccatggacgaggtgaccttccggtcagatacagtgttgtccgatgtgcacctgtataccccgaatcaccggcatctcatggtgcggttgaatagtgtgggtcagccggtcttcctatcccagttcaaacttttgtggtcacaagactcatggaccgatagtggagcaaaaggcggctcacacagagatgttcacactaaagagcctccatcagctgaaaccggatccaccgggtcccctccgggttccggacacggcaacgaaggcttctcacttcaggcaggcaccgacacaacagggcaagaagtggccgaggctcagttggacgaggacggcgacctcgacgtcgtgcgaagaccacgagctgcttctgattccaaccccgctggcccactcagggacaaggttcatccaatgatcctggctcaggaggaggatgacgttctgggagaggaagcgcaggggtccccccacgatatcatccggatcggcgtggccgggcgcccagcgcctgggcggttacacccggtaccgactggacctctccctagaatgtacagtgctggggcgcgcgggcggcatggggcaaggtag

SEQ ID NO: 48795 - DNA, 1215 bp, Artificial Sequence
  Description of Artificial Sequence: Synthetic coding sequence
atggtgcagctggcccccgccgccgccatggacgaggtgaccttcagaagtgataccgtgctgtctgacgtgcacctgtatacccccaatcatcgccatctgatggtaaggcttaactcagtgggccaaccggtgtttttgagccagtttaagcttctatggagccaagatagctggactgattctggtgccaagggggggagccatcgagacgtgcatactaaagagcctccttccgccgagacaggcagcaccggaagcccacccggcagcgggcatggtaacgaggggtttagtctgcaggctgggactgataccaccgggcaggaggtcgccgaggctcaattagacgaggacggcgatctggatgtggttagacgaccgcgcgccgcatctgactccaatcctgcgggtcctttacgggataaggttcaccctatgatactggcacaggaagaagatgatgtgctgggcgaagaggcccagggttcaccccacgacattatccggatcgagcatacaatggccaccccgcttgaggacgtgggcaagcaagtgtggcgtggagcccttctgctggctgattatatcctgttcagacaggatctgttccgtgggtgcactgccctcgagctgggggccgggactggcctcgcatctatcattgccgccacaatggcacggacagtgtactgcaccgatgtgggagcagacttgctcagcatgtgtcagcgtaatatcgcactcaacagccatttggcagcaaccggtggaggtatcgtccgggtcaaggagttggactggctcaaggacgacctgtgcaccgatccaaaggtccctttcagctggagtcaggaggagatatccgacctgtatgatcacacaaccatactgttcgccgccgaggtgttttacgatgacgatctgacagacgcagttttcaagactctgtccagacttgctcaccggctaaaaaacgcctgcaccgccatcttaagcgtcgaaaagaggcttaactttactctccggcacttggatgtaacgtgcgaggcatacgatcacttccggtcttgcctccacgcgttggaacagctagccgatgggaaactcagattcgtggtggagcccgtggaagcctccttcccgcaactcctggtctatgaacgcctgcagcagctagagctctggaaaattatcgctgaaccagtaacttag

SEQ ID NO: 48796 - DNA, 1137 bp, Artificial Sequence
  Description of Artificial Sequence: Synthetic coding sequence
atggccggcagctaccccgagggcgcccccgccgtgctggccgacaaacggcaacagttcggctctcgatttttaagggatcctgcaagagtctttcaccataatgcgtgggataacgtcgaatggtctgaggagcaggcagccgccgctgaacgcaaggtgcaagagaattcgatacagagggtttgccaggagaagcaggtggactatgagatcaacgcccacaaatattggaacgacttttataagatacatgagaatggctttttcaaagaccggcactggctcttcacagaattccccgagctagccccttcccagaaccaaaatcacctcaaagactggtttctggagaacaaatcagaagtgcccgagtgccgcaataatgaagacggccccggactcatcatggaggagcaacacaaatgcagttccaaatccctggagcacaagacccagactctgcccgtcgaagagaacgtcacacagaaaatctctgacctcgagatatgtgccgacgaatttcctggttcatccgcgacctacaggatcctggaggtagggtgcggcgtagggaacaccgtattccctattcttcaaacaaacaatgaccctgggctgttcgtgtactgctgtgatttctctagcaccgccatcgaactggtgcaaaccaattccgaatacgatccctccagatgctttgcatttgtgcacgacttatgtgatgaagaaaagagctaccccgttcctaagggcagtttagatatcattattctgatcttcgtgctcagtgccatagtccctgacaaaatgcagaaggctatcaaccggctgagccggctgcttaagcccggtggtatgatgctgctccgggactacggccgatacgatatggctcagctgcgattcaagaaaggccagtgcctttcaggcaacttttatgtgaggggtgacgggacaagagtctactttttcacccaagaggagctcgataccctgttcacaacggctggcctcgagaaggtgcagaacctggtggatcggcgtctccaagttaatcgaggtaaacaacttacaatgtacagagtgtggattcagtgtaaatactgcaaacccctcctctcaagcacaagttag

SEQ ID NO: 48797 - DNA, 654 bp, Artificial Sequence
  Description of Artificial Sequence: Synthetic coding sequence
atggccggcagctaccccgagggcgcccccgccgtgctggccgacaagcggcaacaattcgggagcaggttcctgcgagatcctgcacgagtatttcatcacaacgcgtgggataatgttgaatggtctgaggaacaggccgccgccgcggagcggaaggtccaggagaacagcattcagcgtgtttgtcaggagaaacaagtggattacgaaattaatgcccataagtattggaacgatttctataaaattcacgagaatggcttcttcaaggatcggcactggctcttcactgagttccctgaactggcgcccagtcaaaaccagaaccaccttaaagactggtttcttgagaataagtctgaggtccccgagtgccgcaacaatgaagacgggccggggctgattatggaggagcagcacaagtgtagctccaagagtcttgagcacaaaactcagacactgccagttgaggaaaatgtaacacagaaaatcagcgatttggagatctgcgcggatgaatttcctgggcagccaccaactgaatactggagattggctgtcgtttgggagacccagagctttcagttttataagcgcacgatgacccaggattctctctttattgctgtgatcttcttacctcaactatag

SEQ ID NO: 48798 - DNA, 1137 bp, Artificial Sequence
  Description of Artificial Sequence: Synthetic coding sequence
atggccggcagctaccccgagggcgcccccgccatcctggccgacaaacgccaacagttcggttcccgtttcctctccgaccccgccagggtctttcaccacaacgcttgggataacgtggaatggtccgaagagcaggccgcagcggcagagaggaaggtgcaggaaaatagcatacaaagagtgtgccaagaaaaacaggtggactacgaaatcaacgcacataagtactggaacgacttttacaagatccatgaaaatggtttctttaaagatcggcactggctgtttaccgagttccccgagctggcgccatctcagaatcagaaccacttgaaggattggtttttggagaacaaatccgaagtgtgtgaatgtcggaacaacgaagatggtcccgggctcatcatggaagagcagcacaagtgttcatctaagagcttggagcataagacccaaacacctcctgttgaagagaatgttactcagaaaatcagtgacttggaaatctgtgccgacgagttcccagggtcatctgctacttacaggatactggaggtggggtgcggagtcggtaacaccgtgtttcctatcctgcagactaacaacgaccctggcctcttcgtgtattgttgcgacttttcatccaccgccatagagctggtgcagactaattccgaatatgacccatcacgttgctttgcatttgtgcatgatttatgtgacgaagaaaaaagctatcccgtcccgaaggggtccctcgatataatcatacttatttttgtgctgtcggctgtagtgcccgacaagatgcagaaggcaatcaatcggctttcccgcttactaaaacccggcggaatggtacttctgagggactacggcagatacgatatggcacaattaagattcaagaaaggccagtgtctttccggtaatttctatgtgcgaggtgatggcactagagtttacttcttcacccaagaggagctggataccctgtttactaccgccggtttggaaaaggtgcagaatctggtggacagacgtctacaagtcaaccgcggtaagcagcttactatgtaccgtgtgtggatccagtgtaaatactgtaagcccttgctgtctagcacatcctag

SEQ ID NO: 48799 - DNA, 1419 bp, Artificial Sequence
  Description of Artificial Sequence: Synthetic coding sequence
atgagcgtggtgcaccagctgagcgccggctggctgctggaccaccttagcttcataaacaaaattaattaccagctccaccagcaccacgaaccctgctgccgaaagaaggagtttacaacctctgtgcacttcgaatcactccagatggactccgtctcaagctcaggggtgtgcgctgcatttattgcgtccgactcctccactaaacccgagaacgatgatggcgggaactatgagatgttcacaagaaagtttgtatttagacctgaactgtttgacgtgacgaaaccctacataactccagccgtccataaggagtgccagcagtcaaatgaaaaggaggacctcatgaatggcgttaagaaggagatctcgatcagcattataggcaagaagagaaagcgatgtgtcgtatttaaccagggcgaactcgacgctatggaataccataccaagatacgtgagctcatcctagacggaagtctgcagttaatacaagagggactcaagagcggttttttgtacccgttgtttgagaagcaggataagggctcaaaacctataacgctgcctctggacgcttgctccctgagtgaactatgcgaaatggccaagcatctgccatctctgaatgagatggagcaccagactcttcaactggtggaagaagataccagtgttacagagcaagatctgtttttaagggtggtcgagaataactcttccttcactaaggtaattacccttatgggccagaaatacctgctcccgcctaagtcctccttcctcttaagcgatatcagttgtatgcaaccactgctgaactatcgcaagacatttgacgtgatcgttatcgatcccccatggcagaataaaagtgtgaaacgtagtaatcgctactcctacctcagcccactgcagattcagcaaatccctatccccaaacttgcagcccctaactgcctcctcgtcacttgggtaacaaatcggcagaagcacctcaggtttatcaaggaggaattgtacccatcatggagcgtggaggtggtggccgagtggcattgggtgaagattaccaatagcggagaatttgtcttccctcttgactcgccccacaagaaaccctacgaaggacttatcctcgggcgggtacaggaaaagaccgccctgccacttcgaaacgccgacgttaatgtcctgccaatcccagaccataagcttattgttagcgttccttgtacactacatagtcacaaacccccccttgccgaggtcctgaaagactatattaaacctgacggagaatacctagaactcttcgccagaaacctgcaacccggatggacaagctggggcaatgaggtcctgaaattccagcatgtggactacttcatagccgtggaaagcggctcttag

SEQ ID NO: 48800 - DNA, 1419 bp, Artificial Sequence
  Description of Artificial Sequence: Synthetic coding sequence
atgagcgtggtgcaccagctgagcgccggctggctgctggaccaccttagcttcattaacaagataaattaccagctacaccagcaccatgaaccatgctgtaggaaaaaggaattcactacaagcgtgcacttcgaatccctgcagatggacagcgtcagctctagcggggtgtgcgccgctttcattgcaagtgactcaagtacaaaacctgaaaatgacgacgggggtaactacgaaatgttcacccgaaagttcgtttttcggccagagctgttcgatgtcactaagccttatattacacctgccgttcacaaggaatgccagcagagtaacgagaaggaagaccttatgaatggcgttaagaaagagatatctatttccataattggtaaaaagcgaaagcggtgtgtagtgtttaaccagggtgagcttgacgccatggagtatcacactaaaattcgggagctcattctcgatgggtcactgcaactgatacaggaaggactaaaatctggatttctgtatcctctttttgagaaacaggacaagggttccaaacctatcaccctgccattagacgcctgctcgctgagtgagctttgcgagatggccaagcatctgccttctttgaatgagatggagcaccagacacttcagctcgtggaagaggatactagcgtgacagagcaggatctgtttctacgtgtggtggagaacaatagttcttttaccaaagtcattactctcatgggccaaaagtacctgttgccccccaagtcatctttcctcctgtccgatataagttgtatgcaacctttgctgaactaccgtaaaacttttgacgtcattgtgattgaccctccctggcaaaacaaatctgtgaaaagaagcaacaggtactcttacttatcccctctgcagatacagcagatccccatccccaaactggcggcgccaaattgtctgcttgtgacctgggttacgaatagacagaaacatctgcggttcatcaaagaagaactctatccttcctggagcgtagaagtggtggctgagtggcactgggtaaagattacaaactccggagagttcgtttttccgttagactctccacacaaaaagccttacgaagggctgatcctgggccgggtccaggagaagacagctctccctctgcggaatgccgatgtgaacgttctgcccatccccgaccacaagttaatcgtgtctgtcccttgcacgttgcatagccacaagcctcctctggctgaggtgctgaaggattacatcaagcccgatggggagtatttggaactgttcgccaggaacttgcaacctggctggacctcctggggtaacgaagtgcttaaatttcaacacgtggattatttcatcgctgtggaaagcggctcctag

SEQ ID NO: 48801 - DNA, 855 bp, Artificial Sequence
  Description of Artificial Sequence: Synthetic coding sequence
atggccagcctgcagcggaagggcctgcaggcccggatcctgaccagcgaagaagaggaaaagctcaaacgcgatcagacactggtatcagactttaagcagcagaagctggagcaggaggcccagaagaattgggatctcttctataaaaggaacagcacgaatttcttcaaggatcggcactggacaacgcgcgagtttgaggagctaagatcttgccgggagttcgaggatcaaaaactgaccatgttagaagccggatgcggggtgggaaactgtctcttccctttgctagaggaggacccaaacattttcgcatatgcttgtgactttagtccgcgggcaatcgagtacgtaaaacagaaccctctgtatgacacggaaagatgcaaagtcttccagtgtgatctgactaaagatgacctcctggaccatgtgccacctgaatcagtggacgtcgtcatgctgatattcgtgctgtcagctgtgcaccccgataaaatgcatttggtacttcagaacatctacaaggtcctcaagcccggaaagtctgtgctctttcgtgactacggtctatacgaccatgcaatgcttcgctttaaggccagtagcaagctaggcgaaaacttttatgttaggcaggacggcacacgctcctatttctttaccgacgattttctagcccagttattcatggatactggttacgaggaggtagttaacgagtatgtgttccgggaaactgtaaataagaaagaaggactttgcgttccccgcgtgtttcttcagagcaaatttctgaaacctcctaaaaacccctctcccgtggttctgggtctagatccgaaatcatag

SEQ ID NO: 48802 - DNA, 855 bp, Artificial Sequence
  Description of Artificial Sequence: Synthetic coding sequence
atggccagcctgcagcggaagggcctgcaggcccggatcctgacctcggaagaggaggaaaagcttaaaagagaccagactttagttagcgactttaagcaacagaaattagagcaggaagcccagaaaaactgggacttattttataaaagaaacagcaccaatttcttcaaggacaggcactggactaccagggagttcgaggaactaagaagctgcagagaatttgaagatcagaagcttaccatgctggaagctggctgcggggttggcaattgtctgttccccctcctggaagaggatcccaatatctttgcttatgcatgtgacttctcccccagagctattgagtacgtgaaacagaaccccctgtacgatacagaaagatgcaaggttttccagtgtgatctgacgaaagatgatctgttagatcacgtccctcctgaaagtgtggatgtggtcatgctcatcttcgtcttgtctgccgtgcatcccgacaaaatgcatctggtgctgcagaatatttataaggtgttgaaacccgggaagtccgtgctgtttcgagactacggcttgtacgatcatgccatgctgagatttaaagcaagctcaaagctgggagaaaacttttacgttcgccaggacgggacccgctcatacttttttacagatgattttctcgcacaactgtttatggataccggatatgaggaggtagtgaacgagtacgtctttagggagacggtgaataaaaaggaaggtctctgtgtacctcgggtgtttctgcagagcaagttcttgaagcccccaaaaaacccatctcctgtggtgttgggcctggatccaaaaagctag

SEQ ID NO: 48803 - DNA, 735 bp, Artificial Sequence
  Description of Artificial Sequence: Synthetic coding sequence
atggacatcctggtgcccctgctgcagctgctggtgctgctgctgacgctccccctgcatctcatggccctgctcggctgttggcaaccactttgtaagtcttatttcccctatctgatggcggtcctgacccctaagtcaaaccgtaaaatggaaagtaagaagagagaactgttcagccagatcaaaggactcaccggagcttctggtaaggtggccttgctggagttgggctgcgggacaggcgctaatttccaattctaccctcctggctgccgcgtgacatgcctcgatccgaaccctcactttgaaaagttcttgacaaagagcatggcagaaaaccgccacctgcagtatgaaagattcgtggtggccccaggggaagacatgcggcagttggctgatggatcaatggacgtggtggtgtgtactcttgtgctctgctcagtccagtcccctcggaaggtgttacaagaggtgaggcgcgtcctgcgaccgggcggagtgctgttcttctgggagcacgtggccgagccctatgggtcttgggcttttatgtggcagcaggttttcgagcccacttggaaacatataggcgatggatgctgcctgactcgtgagacatggaaagatcttgaaaacgctcagttttccgagatacagatggagagacaacctccccctctaaagtggctgccagttgggccccacattatgggtaaggccgtcaaatag

SEQ ID NO: 48804 - DNA, 957 bp, Artificial Sequence
  Description of Artificial Sequence: Synthetic coding sequence
atgcggctgctggccggctggctgtgcctgagcctggccagcgtgtggctggcccggcggatgtggacgctgcgttccccacttaccaggtctctttacgtgaatatgacatccggccctggcggccctgctgctgccgccggcgggcgtaaagagaaccatcagtggtacgtttgtaaccgcgagaaactgtgcgagagtctgcaagcggtgtttgttcagtcgtacttagaccaaggcacacagatattcctcaacaactctattgagaagtctggctggctctttattcagctgtaccatagtttcgtgtccagtgttttctccctgttcatgagtagaacttctattaacggcctgctcggtagaggcagtatgttcgtattcagtcccgaccagtttcagcgtttgcttaaaattaaccctgattggaaaacgcataggttgttagatttgggtgcaggcgacggggaggtgactaagattatgagtccgcactttgaggaaatttacgctacagaactatccgagaccatgatctggcagctgcagaaaaaaaaatatagggtcttagggatcaacgaatggcagaataccggcttccagtatgatgtgatttcctgcctgaaccttctggatcgttgcgatcagccactaactctgttgaaggatattcgcagtgttttggaaccgacgcgtggaagagtgatcctggcgttggtgctaccatttcatccctacgtcgagaatgtcggcggcaaatgggagaagccaagcgaaattctagaaatcaagggccagaattgggaggagcaagtcaactccctgcccgaggttttccgcaaggctggctttgtgatcgaggcttttacacgactgccttacctgtgcgagggcgatatgtataacgattattacgtgctcgacgacgctgtgtttgttttaaagccagtgtag

SEQ ID NO: 48805 - DNA, 954 bp, Artificial Sequence
  Description of Artificial Sequence: Synthetic coding sequence
atgcggctgctggccggctggctgtgcctgagcctggccagcgtgtggctggcccgcaggatgtggaccctgagatccccgcttaccagaagtctgtatgtcaacatgacaagcggcccaggcggccctgctgcggctgccggcggccgtaaagaaaaccatcagtggtacgtctgcaatagggaaaaactgtgcgagtccctgcaagccgtcttcgtgcagagttacctggaccaagggactcagatctttctcaataatagtatagaaaaaagcgggtggctctttatccagctctaccatagtttcgtaagttcagtatttagcctgtttatgtcaagaactagtataaacgggttgctcggccgcgggtcgatgttcgttttctcgcctgaccaatttcagcggctcctgaaaattaaccctgactggaagactcatcgcttgctggacctgggcgcgggagacggcgaagtgaccaagattatgagcccgcacttcgaagagatctatgcaactgaattgagtgaaaccatgatctggcagctgcagaaaaaaaagtacagggtgctggggataaatgagtggcaaaatacgggttttcagtacgacgtgatatcatgtctgaaccttctggatcgttgcgatcagcctctgaccctgttgaaggacatccggagtgttcttgaaccaacacggggccgcgttatcctggctcttgtcctccccttccatccgtacgtagaaaacgggggcaaatgggagaaacccagtgagattttagaaattaaagggcagaattgggaggagcaggtaaattcactgccggaggtctttaggaaagccgggttcgtaatcgaggccttcaccaggctcccatacctgtgtgagggtgatatgtataacgattactacgtactggacgatgccgtttttgtgctgaagcccgtgtag

SEQ ID NO: 48806 - DNA, 849 bp, Artificial Sequence
  Description of Artificial Sequence: Synthetic coding sequence
atgtggaccctgcggagccccctgacccggagcctgtacgtgaaggaaaaccatcagtggtacgtgtgtaatagagagaagctctgtgagtcgttgcaggctgtctttgtacagagctaccttgaccaaggcacccagatctttctaaacaactccatcgagaagtctggctggctgtttatacaactgtatcacagcttcgtatcctctgtcttcagcctcttcatgtcacgcacaagcatcaatggcctgctcggccgcggttccatgtttgtgttttctcctgaccagttccagaggttgttgaagattaaccctgattggaagacacaccgcctgctcgatttaggcgcaggggatggcgaggtcaccaaaatcatgagcccccactttgaagaaatatacgccacagaactgtcggagacaatgatctggcaactgcaaaaaaagaagtatagggtactaggcatcaacgagtggcagaataccggtttccaatacgatgtaatctcttgcctgaacctgctcgacaggtgcgatcaacccctgacacttttaaaggacataaggagtgttctggaacccacgagaggcagagttatactggcactggtgttgccgttccacccctatgttgaaaatgtgggcgggaaatgggaaaaaccttcggaaatcttggagatcaaagggcagaactgggaagaacaggtgaattcactgcctgaggtgtttcgtaaggcaggttttgttatagaggcttttactcggctgccatatctctgtgagggcgacatgtataacgattactatgtgttggatgacgcagtatttgttctgaagcctgtttag

SEQ ID NO: 48807 - DNA, 165 bp, Artificial Sequence
  Description of Artificial Sequence: Synthetic coding sequence
atgatgaagccccaggccgagaccggcgaggccgcccgggacccctcccttagacctgcccgcactgttctggtgggctcgttgagctggctgcgcaagcaactccaaccaacccactgcaaatacgaaggccctagaaaagctcgccgcctctggttcgcatag

SEQ ID NO: 48808 - DNA, 231 bp, Artificial Sequence
  Description of Artificial Sequence: Synthetic coding sequence
atgatcgccggcgagcaccggctggaccccgccaccatcagcctgggagtggaccagaccgatgatcatcagcaaccgacgcactcacggattaggaagaagcgcgtgagtccgaccagtgtctggttccagccgtacttttgtatcctgaaaacgctgtgcaccaccctggacactgtgcaagatgacgccacttcttcctggatgctgatttgtcatgtcgatttctag

SEQ ID NO: 48809 - DNA, 7290 bp, Artificial Sequence
  Description of Artificial Sequence: Synthetic coding sequence
atggacatgagcgaccccaacttctggaccgtgctgagcaacttcacccttccccacctaaggtctgggaacagactgagacggacgcagtcgtgtcggaccagtaaccgtaagtcccttatcggaaatggccagagtcccgctctccccagaccccactcccctctgtccgcccacgctggaaactccccccaggactctcctcggaacttcagtccctcagcaagcgcccacttcagttttgcaagacgcactgatggtcgacggtggtccttggccagtttaccctcttccggctacgggaccaacactccaagctccacagtctccagctcatgcagcagccaggaaaaacttcatcagttaccatatcagcccactccagacgaattgcacttcctaagcaaacatttctgcaccactgagtccattgctacggagaatcgttgccgaaatactcccatgagaccaagaagcaggtctctcagtccaggccggtctccagcttgctgtgaccacgagattatcatgatgaatcatgtctacaaggaaagattcccaaaagccaccgctcagatggaagagcgcctcaaggaaatcatcacttcgtactctccagacaatgtgctgccactggctgatggtgttctatcgttcacccaccaccagatcatcgagctggcacgggattgcctcgataagagtcaccaggggctgattacctctcgctattttctggaactgcagcacaaactggataagttgctgcaagaggctcacgatcgttctgaatctggggaactggcctttatcaagcagctggtacggaagattctcatcgttatcgccagacccgccagactgctcgagtgtttggaattcgatccggaagaattctactatctcctggaggctgcagaggggcacgcgaaggaagggcaggggatcaaaaccgacatcccccgatatattattagccagctggggctcaataaagatccactggaggagatggcccacttaggcaactatgactccgggacagcagagacacccgaaacggacgagtccgtttcctccagcaacgcgagcctgaagctccgccgcaaaccccgggaatctgattttgagaccattaaattgatttcaaatggcgcttacggggctgtatattttgtccggcacaaagaaagcaggcaacgttttgctatgaaaaagattaacaaacaaaacctaatccttagaaatcagatccagcaggccttcgtggaacgggatattctcacgtttgccgagaaccccttcgtggtgagcatgtattgctcatttgagactagaagacacctgtgcatggtgatggagtatgtggagggaggcgactgcgcaactctcatgaagaatatgggacccctccccgtagatatggccagaatgtactttgctgaaaccgttctcgcattggaatacctccacaactatgggatcgtccatcgggatctgaagcccgacaaccttctcgtaacttctatgggacatattaaattaactgacttcggtttaagtaaggtggggctgatgtcgatgacaactaatctttacgaaggtcatatcgagaaggacgcaagagagtttttagataagcaggtttgtggcactccagaatacattgcaccagaagttatcctgcgacaaggttacggaaagccagtggactggtgggccatggggattatcttgtacgagtttctggtcggctgtgtgcccttcttcggagatactcccgaagagttgtttggacaggttatcagcgatgagattaactggccagaaaaggatgaagcgccccccccagacgcacaagatctgatcacactgctgctgcgccagaacccacttgagcgattagggacaggcggcgcttatgaggtcaagcagcacaggttctttagaagtcttgattggaacagtctcctgcggcagaaagccgagttcatccctcagctggaatcagaggacgatacctcttattttgatactcgtagtgaaaagtatcatcatatggagactgaagaggaggacgataccaatgatgaagacttcaacgtggagatccggcaattctcttcatgctcccatagatttagtaaggtattcagctccattgatcgaatcacccagaacagtgctgaagagaaggaggactctgtcgataagacaaagtctactactctcccttcgacagagactctatcttggtcatctgagtactcagagatgcaacaactgagcacatcgaattcatctgataccgagtctaatcggcacaagttaagtagtggactgctcccgaagctagccatatccactgaaggagagcaagacgaggcagcctcgtgtccaggcgacccccatgaggagccaggtaagcctgcactcccacccgaagagtgcgctcaggaggagcccgaggtcacaacacccgcttccactatttccagctccacgctctccgttgggtccttctcagagcatttggaccaaatcaacggacggtcggagtgcgtggacagtaccgataacagtagcaagcctagctctgagcccgccagccatatggctaggcagcgactcgagtcgacagagaagaaaaaaattagtggaaaagtgaccaaaagcctctccgcaagcgccctgtcactgatgattcctggggatatgtttgctgtaagtccccttggtagtcctatgagtccccactcactgtccagcgacccctcttctagccgcgatagctccccgagccgagatagctcggccgccagtgctagtccccaccagcccatcgtcattcactcttccggcaagaattacggctttactattcgcgctattcgagtgtacgtcggtgattcagacatttatacagtacatcacatcgtgtggaatgtcgaagagggcagtcctgcatgccaagcaggcttaaaggctggcgacctgattactcatattaacggagaacccgttcacgggctggtgcacacagaggtcattgagttgctcctaaagagtgggaataaggtgagcatcaccactaccccttttgagaacacttctattaagacagggcctgcacgaaggaacagctataagtcccgaatggttaggagaagtaaaaagtccaaaaaaaaggaatcccttgaaagacgccgtagcctgttcaagaagctggcaaagcagcctagcccgttgcttcatacatcccgcagcttctcttgtctgaatagatccttgtcttctggcgaaagtctgccgggctcaccaactcatagcttaagcccacgcagcccaacgccatcttacagatcaaccccagattttccaagtggaacaaattcatcccagtcgagtagcccctctagctctgcgccgaacagccccgccgggagtggacatattcggccaagcacattacacggactcgcaccaaaactgggtggtcagagatacagaagtggacggcggaaatctgccggtaatatacccctgtccccactggctcgtaccccatcccctacacctcagccgaccagcccccaaagatccccctcccccctgctgggacatagtcttgggaatagtaagatcgcccaggcgtttccctctaagatgcactctccacctacaattgtcagacacatagtgaggcccaagagtgcggaacccccacgcagccctctacttaaacgagtacagagcgaagaaaagctgtccccttcctacggctctgataaaaagcatctgtgttccagaaaacacagtctggaagttacccaggaggaagtgcagcgagaacagtctcagcgagaggcccccctccagtccctggatgagaatgtctgcgacgtgccacctctcagccgagcccggcctgtagagcagggctgccttaagaggcccgtatcaaggaaagtgggcagacaggaatcagtagatgacctcgacagagacaagctaaaagcaaaggttgtcgttaagaaagccgatgggttccccgaaaagcaggagagtcaccaaaaatcacatggccctgggtcggacctcgagaacttcgctctgttcaaacttgaggagcgggagaagaaagtgtatcccaaagccgtggagcggtcctcaacgttcgagaacaaagccagtatgcaggaagcacccccactaggctcgctcctaaaagatgctctacacaaacaggcctcggtgcgagcatctgagggtgcgatgagcgatggtcgcgtgccagcagagcacagacaagggggcggggacttccgcagagctcctgcacctggcactctacaggacgggctgtgccacagtcttgatcggggaatttctgggaagggcgagggaaccgagaaatcatcgcaggcaaaagagcttctcaggtgcgaaaagctggactccaagttggcaaacatcgactatctgcgtaagaaaatgtcacttgaagacaaagaggacaacctgtgcccggtgctgaagcctaagatgaccgctggatctcacgaatgtttgcctggtaaccctgtgcgccctacgggcggacaacaggaaccacccccggcttccgagtcacgtgccttcgtcagctcaacacatgctgcccaaatgtcagcggtgagtttcgtgcccttgaaggccttgaccggccgcgtggatagtggcaccgagaaaccaggcctagtggcccccgagtcacccgtacgcaaatcaccgagtgaatacaaactagaaggccgttccgtgtcctgtctgaaacccatagagggcacgttggatatcgctttactcagcggaccccaggcttcaaagactgagctgcccagccctgagtcagctcagagcccaagcccttccggggacgtccgggcatccgtgcctcctgtgctgccttcttcttctggaaaaaaaaacgacaccacatcagcacgcgagctttctccctcttctctgaaaatgaataaatcgtacctgttggagccgtggttcctccctcccagtcgcggcctgcagaatagtcctgcagtgtccctgcctgaccctgagtttaagcgggacagaaagggcccccacccaactgctaggagccccggtaccgttatggaatcaaatcctcagcagcgtgaaggcagcagtccgaaacaccaggatcatactacagatccgaagctgcttacgtgtctggggcagaacctccactcacccgaccttgcccgtccaagatgtcctctgccaccagaggctagtccctcccgtgagaagccagggcttagggagtcttctgagcgaggacctcctaccgcacgtagcgagagatcagctgctagagccgacacttgccgagagccctcgatggagctatgttttcccgagacagccaagacctcagacaattctaagaatttgttgagtgtgggccggacgcacccagatttctacacccagacccaggccatggagaaagcctgggcacctggtgggaagacaaatcacaaggatggtccaggcgaagcgaggccccctccacgcgataatagctcactccactccgcgggaattccatgcgagaaggaactcggcaaggttaggcgcggagtcgaacctaagcctgaggcgctgctggcgagacgcagtttgcagccccctggaattgaaagcgaaaagagcgagaaactttcctccttcccttccttgcagaaggacggagctaaggagccggagagaaaggagcagcccctgcagcggcatcccagttcaatacctccacccccactcaccgccaaagacctgtcaagtccagcagctcgacagcactgttcttccccctcgcacgcctccggccgtgaaccaggagccaaaccctcgaccgcagaacccagcagcagcccccaggacccaccaaaaccagtggctgcccacagtgaatctagctcccacaagcctagaccaggtccggacccgggcccacccaaaacaaagcaccccgaccggtctttgagctcccagaagccttcagtcggagcaactaagggcaaagagcctgcgacccagtcgctgggggggtcaagccgtgagggaaaaggccattccaaaagtgggcctgacgtcttccccgcaacgccggggtcacagaataaggcgtccgacggaataggccagggcgagggaggtccatcagtgccactgcacaccgacagggcgccactggacgcaaagccgcaaccaaccagtgggggcagaccactggaggtcctggaaaaacccgttcatctcccccggccaggccaccctggccccagtgagcccgctgaccagaaactgtctgccgttggggaaaagcagacccttagccccaagcacccaaagccgagcacggtgaaggattgccctactctgtgtaaacagacagataatcggcagaccgacaagtccccttcccagccggccgctaataccgatcgtagggctgagggcaagaagtgcacagaggcgctttacgcaccggccgagggtgataaactggaagccggcctgagcttcgtgcattccgagaacagactcaagggcgcggagcgcccggctgctggtgtgggcaaaggctttccagaggctcgtggcaagggcccaggcccacaaaagcccccaactgaggccgataaacctaatggaatgaaacgcagtccatcggcaactggccaatccagtttccgtagtacagcactgcctgagaagagtctgtcctgctcatccagctttcccgagactcgagctggcgtacgcgaggcatcagccgcaagtagcgacacaagtagtgccaaggctgcaggaggcatgttggaactcccagccccctcgaaccgcgatcatagaaaggcccaacccgcaggagaaggccgaacacacatgacgaaaagtgactctctacccagcttccgggtgtctacactgcccttagaatcccatcaccccgaccctaataccatggggggtgcctcacacagagaccgcgctctgagcgtcacagccacggtcggcgagaccaagggaaaggacccagctccggcacaaccccctcccgccagaaagcaaaacgtagggagggacgtgaccaagccatcaccagcaccaaacacagataggccaatatcactttccaatgagaaggacttcgtagtgaggcaacggaggggaaaggagagcttgcggtccagtcctcataagaaagcgttgtag

SEQ ID NO: 48810 - DNA, 7335 bp, Artificial Sequence
  Description of Artificial Sequence: Synthetic coding sequence
atgaaggcccagcgggagcggctgcagatccccggcctgaccctggatctcacacctcgctcactgagcccgactcccagtagccccggatccccctgcagtcccttgctcgccttccacttctggtcttgcaggacaagcaaccggaaatcgctgattggaaatggacaatcaccagctctgccaaggccacatagcccattgtccgctcatgctggaaattcacctcaggacagccccaggaatttctctccttctgcttcagcccatttctccttcgccaggtcactgaatcgcaccgatggacgtagatggtcgttggcgagcctgcccagctctggatacggcactaacacaccgtcctcaacggtctcatcatcctgttcgagccaagagaaacttcaccagcttccctaccagcctacgcctgatgagctgcacttcctttcgaagcatttctgtactactgaaagcatcgcaactgagaacagatgtcgaaacacacctatgaggccaaggagtcgcagtctgagtccagggagatccccagcctgttgcgaccatgaaatcattatgatgaatcacgtctataaagaaagatttcctaaggccaccgcgcagatggaagagaggctgaaagaaataattacatcatactccccagataacgtgctgcctctggccgatggtgtgctcagctttacccaccatcagattattgaactcgcccgggattgcctcgacaaaagtcatcaaggcctgattacatccagatattttctcgaactgcaacacaagttagacaagctgctgcaggaagcgcatgatcgctctgaaagcggggagctcgcgtttattaaacagctcgtgcgaaaaatccttatcgttatcgctaggcctgcccggctgttagagtgcctcgaattcgatccagaggagttttattatctgctcgaagctgcagagggccacgcaaaggaagggcaaggaataaagaccgatataccgaggtacatcatctcccaactagggctgaataaggatcctctggaggagatggcccaccttggaaactacgacagcggaacagctgagacccctgaaaccgacgagtccgtctccagcagcaatgcctcgctgaaattgaggcgcaaacccagggagtccgacttcgagactatcaagcttatttccaatggtgcgtatggagctgtgtattttgtgcgacataaggagagtcgccaacggtttgccatgaagaagattaacaaacagaatctgattctgaggaatcagatccagcaggcatttgtggagagagatattctgacctttgccgagaatccttttgtcgtttctatgtactgctcgttcgaaacgagacggcacctctgcatggttatggagtacgtggagggaggggactgcgctacactgatgaagaacatggggccactgccggttgatatggccagaatgtacttcgctgaaactgtcctggctctggagtatctgcacaactacggaattgtacatcgcgatctgaagcccgacaacctcctggttacatctatgggacatatcaaactcactgactttggcctgagtaaagtggggctgatgagcatgactacaaacctctatgaaggccatatcgaaaaagatgctcgcgaatttctggacaagcaggtttgtgggacacctgagtacatcgcgccagaggtcatcctgcgacagggttacggtaagcctgtcgattggtgggccatgggcatcattctgtacgagtttctagtcggctgcgtccctttctttggtgatactccagaggaactgtttggccaagtgatctccgatgaaataaattggcctgagaaagacgaggctccaccccccgacgcgcaggacctgatcactctattgctaagacaaaaccctctcgaacgcctgggcactggcggtgcatatgaggtcaagcagcaccgctttttccggagcctggactggaactccttgctgcggcagaaggccgaatttatcccccagctagagagcgaggacgatacaagctacttcgacactcggtctgaaaaatatcatcacatggaaacggaagaagaggacgataccaacgatgaagattttaacgtggagatccgccagtttagttcctgctcccatcggtttagcaaggttttttcatcgattgatagaattacgcagaactctgcagaggaaaaagaggatagtgtagacaagactaagtccaccaccctccctagcactgagaccctctcctggagtagcgagtactccgagatgcagcagctaagcacatcaaactccagcgatacagagtctaacaggcacaagctctcctccggactcctgccgaagttggccatcagcacagagggagaacaggatgaagcggcctcctgtccaggcgacccacatgaagaacctgggaagcctgccctgccgccggaggagtgcgctcaggaagaacccgaagtgaccaccccagcatcgactatttcatccagtactctctcagtggggtcatttagcgaacatctggatcagatcaatggtagatcagagtgtgttgactcaacagataatagctccaagccgtcctcggagccagcctcgcatatggctcgccaacgactggagtctaccgagaagaagaaaatcagtgggaaggtcaccaagtccctgagcgccagcgccctctccttgatgatccccggtgacatgttcgctgtctctcccctggggtcacctatgtctcctcactccctgtcttctgatccatccagttcccgcgacagctcaccaagccgggacagctctgcagccagcgcctcaccccatcagccaatcgtgatccatagttcaggcaagaactacggttttactatccgcgcaattcgagtttatgtgggcgattccgatatctacacagttcaccatatcgtgtggaacgtggaagagggttcccctgcctgccaggctggcctgaaggccggggatctgatcacccacataaatggtgagcccgtgcacggactcgtgcacacagaagtgattgagttattactgaagtccggcaataaagtttcaataacgactaccccatttgagaatacttccataaaaactgggccagctagaaggaattcgtataaatccagaatggtaagacgatctaagaaatctaagaaaaaagagtctctggaaagaagaaggagcctcttcaagaaattggccaaacagcccagcccactgttacatacatccaggagcttctcctgcctcaatcgaagtctgagctcgggggaaagcctcccaggcagccccactcattcactttcccctcgtagccccactccctcctaccggtctactcctgacttcccatccggtaccaatagttctcagtcgagcagtccctccagcagtgcaccaaatagccccgcaggaagtggtcatatccgaccatccaccctgcatggccttgcccctaagctgggcggccagaggtaccgaagtggcaggcgtaagtctgccgggaacattccactgtcacccctggcacgcacaccaagcccaacgccccaacctacttcgccccaaagatctccctctcctctccttggacactcactggggaatagcaagattgctcaggcatttccctcaaaaatgcacagcccccctaccatcgtacgtcatatcgtgagacccaagagcgccgaaccacctagatctccgttgttgaagcgcgtccaaagcgaagagaagcttagtccctcctacggctcagataagaagcacttgtgctcccggaagcattcattggaagtgacccaggaggaggttcagcgtgaacagtcccagcgagaggcaccactccagtcattagatgaaaatgtatgcgacgtgcctcccctgtcgcgcgctcggcctgtagagcaagggtgtttgaagcgtcccgtatcccgcaaggtgggcaggcaggaatcggtggatgacctcgaccgggataagttaaaggccaaggtcgtagtcaaaaaggcagatggatttccagagaagcaggaatcccaccaaaagtcccatggtcccggctccgacctggaaaatttcgcactgtttaagttagaggaaagggagaagaaggtctatccgaaggcagtagagcgcagttctacctttgagaataaggcttccatgcaggaagcacctccactgggatctttgctcaaagatgccttacacaaacaggcctcagtgcgtgccagtgagggcgccatgtctgatggcagagtgccagccgaacataggcagggtgggggcgacttcaggcgtgctccagctcctggcaccctgcaagacggactttgtcacagcttggatagaggaatctccggtaaaggtgaaggcactgaaaaatccagtcaggcaaaagaactgctgaggtgtgagaagctcgacagtaagctggcaaatatcgattatctaagaaaaaaaatgtcacttgaggacaaggaggataacctatgtcccgtgctaaagcccaagatgaccgccgggagccacgagtgcctgcccggaaatccagtgcgacccacaggtggacaacaggagcctccccccgcctcagaaagtcgcgcctttgtcagcagcacccatgctgcgcagatgagcgcagtgagcttcgtcccattaaaggctctgactggccgggtcgacagcggcaccgaaaagcccggactggtggcacctgaatcccctgtaagaaaaagcccctccgaatataagttggaaggtagatcggtcagctgcctgaaacctatagaagggactttggacatcgctcttctgagtgggccacaggcatctaagaccgaattgccctctcctgagtcagcccagagtcccagcccctcaggggacgttcgggcatctgtcccccccgtcctcccttcttccagcggcaagaagaacgacaccacgagcgccagggagctgagtccttcttctctgaaaatgaataaaagctatctgctggagccctggttcctgcccccctctcgtgggctacagaattcccctgctgtgagcctgcccgaccccgagtttaaacgggatagaaagggaccccacccaaccgcgaggtcacctggtacagtgatggaatctaatccccagcagcgagaaggatccagccccaaacatcaggaccacacgaccgatcctaaactgctgacatgccttggacagaacctgcacagtccagatctggcccgaccccgatgtcccctcccacctgaagctagccctagccgggagaagcctgggcttcgagaaagctcagaacggggacctcctactgcccgttcggagaggtcagccgcacgcgcggatacatgccgtgaaccaagtatggaactttgcttcccagaaaccgccaagacatctgacaatagcaaaaacctgttatcggtcgggcggacccatccagacttctacacccaaacccaagcgatggagaaagcatgggcacctggggggaagaccaaccacaaggatggtccaggagaagctagacctccccccagggataacagctcccttcactctgctggtataccttgcgagaaggagttgggcaaagtgcgtcggggtgttgaaccgaagccagaagcgttacttgcaagaaggtccttacaaccacccggaatagaaagcgaaaagtcggaaaagctgtccagtttcccatcacttcagaaggatggggccaaggaacctgagcggaaagagcagccgttgcaacggcatccttcatccattcctccacctcctttaactgctaaggatctgagcagtccggccgctagacaacattgtagctcccccagccacgcatctggacgggagccaggagctaagccttcaaccgctgaacccagtagctctccccaagacccccccaaaccagtggccgcccattccgaaagctccagccataagcctaggcccggccccgatcccggtccacccaaaactaagcacccagaccggagcctgagttctcaaaaaccgagcgtgggcgcgacaaaagggaaagaacctgccacccaaagccttggaggcagctcacgcgagggcaaggggcacagcaagtctgggcctgatgtgtttcccgcaacccccggctcccagaataaggcctcagacggcatcggccagggggaagggggccctagcgtgcccctgcatactgaccgcgcaccccttgacgctaagccgcagcctacttctggagggcgtccgctcgaagtgctggagaaacccgtacatctgccaaggcccggtcaccccggcccaagcgagccagcagatcagaaattgtccgccgtcggtgagaagcagactcttagcccaaagcatcctaagcctagcacagtgaaagactgccctaccctgtgcaaacagacagataataggcagacggataagtcgccaagtcaacctgcagccaataccgacaggagggccgaaggcaagaaatgcactgaagccctatacgctcctgccgaaggagacaagctggaggctggcctgtcatttgtgcactctgaaaaccggctgaagggagccgaacgtcccgctgcaggagtgggtaagggatttcctgaagcacggggaaaaggcccaggcccccaaaaaccccctaccgaggccgacaagccaaatgggatgaaacggtccccatccgccaccggacagagcagttttcggtctactgcactgccagagaaaagcctgtcttgctccagctcctttcccgaaacacgggccggggttagggaggcctcagctgccagtagtgacacatcttccgctaaggcagcaggcggcatgctcgagcttcccgcgcctagcaaccgtgaccatagaaaagcccagcccgctggggaaggccgcactcacatgactaaaagcgacagcctaccatctttccgcgtcagtaccttgcccctcgagtcccatcaccctgaccctaacaccatgggtggtgctagccaccgggaccgagctttgtcagtaacagcaacagtgggcgagactaaaggaaaggacccagctccagcgcagcctccacctgctcgaaagcagaatgtggggcgggatgtaaccaagccatcccctgctcctaacaccgaccgcccaatcagcctgagcaacgagaaagatttcgttgttagacagaggaggggaaaggagtctctgcggagcagtcctcataagaaggcattgtag

SEQ ID NO: 48811 - DNA, 7305 bp, Artificial Sequence
  Description of Artificial Sequence: Synthetic coding sequence
atggacgagagcagcatcctgcggcggcggggcctgcagaaggagctgtctctgccccggcggggaagccttatagactcccagaagtggaactgtctggtgaagagatgcaggacgagcaatcgaaagtccctcattgggaacgggcaatccccagctctccctcgcccacacagcccactttccgcccacgccggtaattctccacaggattctccacggaacttttcaccctctgccagtgcacacttttctttcgcacggcggaccgacggtcgcagatggtcactggccagtctgccttccagcggctacgggacaaatactccctcctctacagtaagcagcagctgttcctctcaggagaagctccatcagcttccataccagcccacccctgacgagcttcactttctctcaaagcatttctgtacaaccgaatctattgccacagaaaaccgctgccgcaacactcccatgaggccacggagccgctccctttcgcctggcagatctcccgcatgctgcgatcacgaaataattatgatgaatcacgtgtacaaggagcgtttccccaaagcaactgctcagatggaagagcggctgaaagaaataattacatcgtattctcctgataatgtgcttcctctggctgacggggttctgtcctttacacaccatcagattatcgaattggccagggactgcctggacaaatcacaccaggggctcatcacaagccggtacttcctagagctgcagcacaagctggataaactcctgcaggaagcgcacgataggagtgagagcggagagctcgcttttataaaacagctcgtacgtaagatcctaatcgttattgcgagaccagctcgcttgctagaatgcctggagtttgacccagaggaattctattacctcctggaggccgcggaggggcacgctaaagaaggccaaggaattaagactgatataccgagatacatcatatcacaactggggctgaataaagacccactggaagaaatggcgcacctggggaattacgactccggcaccgcagagacccctgagaccgatgaatccgtgtcaagtagtaatgccagtctgaaacttaggcgtaaacctcgcgaatccgatttcgaaacgattaaactgatctcaaacggagcatacggagctgtatatttcgtgcgccacaaagaatctagacaacggttcgctatgaagaaaattaataaacagaatttaatcctgaggaaccagatccagcaggccttcgtggaacgtgatatcctcacttttgccgagaatccttttgtagtgagcatgtactgcagttttgagacaaggaggcacctgtgtatggttatggagtacgtggaggggggagattgtgctacacttatgaaaaacatgggccctctgcctgtcgacatggctagaatgtacttcgcagagacagttttggctctggaatacctgcataattacggtatagtccatagagatcttaagccagataacttgctcgtgacctctatggggcatattaagctaactgatttcggcttgagcaaggtgggtctgatgagtatgactacaaatctttacgagggccatatcgagaaggacgctcgggagttcttggacaagcaggtttgcggaactccagagtatatcgcgcctgaggtaattctgcgccagggttatggcaaacccgtggattggtgggccatgggtatcatactgtacgagtttttagttggctgcgtacccttttttggagacacccccgaagaattgttcggacaggtgatcagcgacgaaatcaattggcccgagaaggatgaggccccgcctcctgatgcccaggacctgattacactgctcttgagacaaaaccccttggagcgattagggacgggtggcgcatacgaggtcaaacagcaccgattctttcgaagtctggactggaatagtctacttcgccagaaggcggagttcattccccaactggaatccgaagatgatacctcttattttgacactcgctctgagaagtaccaccatatggagacagaagaagaggacgataccaatgacgaggactttaatgtcgaaattagacagttcagtagttgcagccacagattttcaaaggtgttttcatccatcgacaggatcactcagaactctgctgaagaaaaggaggactcggtcgataagacaaagagcaccaccctccccagcaccgaaacactgtcatggagcagcgaatattccgaaatgcaacaacttagcactagcaacagttctgacacagagtccaatcggcataaactgtcttccggcctcttgcccaaactcgctatttcaaccgagggcgagcaagacgaagcagcctcatgtcctggggaccctcacgaagaacccgggaagccggccctgcctcccgaagagtgcgctcaggaagagcctgaggtgaccacacccgcttcaacaatctctagttccacactgtccgtcggcagtttttccgagcatctggatcagattaatggacggtccgagtgtgtcgactcgactgacaacagcagcaagcctagtagtgaaccggcctcgcacatggcacggcagcggcttgaaagcacagagaagaaaaagatctccgggaaagtgaccaaaagcctatcagctagtgccctcagtctcatgatcccgggagacatgtttgctgtcagccctttgggcagcccaatgtcccctcactcccttagctctgacccgtcctcctcaagagactcaagccctagtcgggattctagcgccgcctctgctagcccacaccagcccattgtgatacattcctcaggcaaaaattatggttttacaattcgcgccatccgcgtctacgttggtgatagtgacatatacacagtccaccatatcgtttggaacgttgaagaaggctctcccgcctgccaggccggtctgaaagcgggcgatctgattacacatattaatggcgaacccgtgcatggcttagtgcataccgaagttattgagctgttactgaaaagtgggaacaaggtttcaatcactaccactcctttcgagaacaccagcatcaagacagggcctgcccggagaaattcctataaatctcgcatggtccgtcggtccaaaaagtctaaaaagaaggagtcattagaacggaggaggtctctgttcaagaagctcgccaaacagccctctccacttctgcacacctcccggtcatttagctgcttgaaccggtccctcagtagcggcgaaagtctcccaggctcccccacacattcactctccccacggagccctactccctcgtacagaagtacacctgactttccgtcgggtactaacagcagtcaaagttccagccccagcagcagtgccccaaattcccccgcaggttctggtcacatcagaccgtccacactgcacgggctcgctcccaaactaggcggccagcgctaccggagtggccgccggaaaagtgcagggaacattcctctcagcccgttggcgaggactccctcgcctacaccccagcccacatccccccagaggtctccaagtccactgttgggccactctcttggaaattctaaaatagctcaggcctttccttccaaaatgcatagtcccccgactatcgtcagacacattgtgcggcccaaaagtgccgaaccccctaggtcaccactgctgaagagagtccaatcagaagagaagctttcacctagctacgggagcgacaaaaaacatttatgctcgagaaaacattccctcgaggtgactcaagaagaggtgcaacgggagcagagccagcgggaggcaccattacagtcattggatgaaaacgtgtgtgacgtgcccccattatctcgagccaggcctgtggagcagggctgccttaagcgccccgttagccggaaagtgggtcgccaggaaagcgtcgatgatctcgatcgagacaagctcaaagcaaaagttgtcgtcaagaaggcagatggctttcccgaaaagcaagaatcacatcagaaatctcacgggcccggcagcgacttagagaacttcgctctcttcaaactcgaggagagagagaagaaggtctaccctaaggcagtggagcggagctcaacatttgagaacaaggcttctatgcaggaagcaccccctctcgggtccctcctcaaagacgctctgcataaacaggcctccgtgagagccagcgagggtgcgatgtcagacgggcgcgtgcccgctgagcatcggcagggtggcggcgatttcaggcgcgccccagctccggggacactgcaggatgggttatgccactcacttgacagaggaatcagcggtaaaggagagggaactgaaaagagctcccaagcaaaggagctacttagatgcgaaaagttagacagtaagctggctaatattgattacctccggaaaaagatgagtctggaagataaggaggacaatctctgtcctgtgttgaagccgaaaatgacggccgggtcccacgagtgtcttcccggtaacccagtgaggccaaccggcggtcagcaggagcccccaccagcttctgagagcagagcctttgtttcatcaacacatgcagcgcaaatgagtgctgtgtccttcgtcccactgaaggctctgacaggacgggtggatagcgggacggagaagccagggttagtagcccccgagagtcccgtccgtaagagtcctagcgaatataaactcgaggggaggtccgtaagctgtttaaaacccattgagggaaccctggatatagccctgctctccgggccccaggcctctaaaaccgagttgccgtcccccgagtcagcgcagagccctagccccagcggcgacgtgcgcgcgtctgtgcctcccgtcctgccaagttcttcgggcaagaaaaatgataccacttcagcccgcgagctctcgcctagctccctgaagatgaacaagtcttacctgctggaaccatggtttctccctccatcgcgtgggctccagaactcacccgccgtctccctacccgatcccgagttcaagcgcgacagaaagggaccacacccaactgctcgatcacctggtaccgtgatggagtccaacccccagcaaagggagggcagctcacctaaacatcaggatcacactacggatcctaaactgttgacctgcctgggacaaaacctgcactcacccgaccttgctaggcccagatgtcccctccccccagaagcttctccttcccgggaaaaaccaggacttcgggaatccagtgagagaggccccccaaccgctagatccgagcggagtgctgctagagccgacacatgccgggagcctagtatggagctgtgcttccctgagaccgctaaaaccagcgacaattctaaaaatctgctcagtgtaggcaggacacaccccgatttctacacacaaacccaggcaatggagaaagcctgggccccaggcggtaagacgaatcataaagatggccctggggaggctcgtccacctccacgggacaactcatcattacattccgccggcatcccatgcgagaaggaattgggaaaagttcgcaggggtgtcgagcccaagcctgaggccttacttgcaagacgcagcctgcaaccacctggcattgagtctgagaagagcgagaaactgagttcctttccatctcttcagaaagacggagccaaagaacccgaaagaaaagaacaaccactgcaacggcacccatcttcaatccctccccctcctctcacagccaaagatctatcaagccccgcagcccgccagcactgctcatccccctcccatgcttccggccgggagcctggggctaagccatctaccgctgaaccttcgtcgagtccacaggatccacctaagccggtcgctgcgcattcagagtctagcagccataagcctcgcccaggacccgaccccggacccccaaagaccaaacatccagatcgcagcttatctagccagaaaccttccgtcggagccacaaagggcaaagaacctgcgacacaatccctgggcggatcttcaagggaaggtaaaggccactccaagagcgggcctgacgttttccccgccactcccggctcacagaacaaggcttcagacggtatcgggcagggtgaaggaggaccttcagtccctcttcataccgatcgggcgccactcgacgctaaacctcagcctacctcaggcggtcgtcccctggaagtgctcgagaaacccgttcatctacctcggcccggccaccccggcccttcagagcccgccgaccagaaactatccgccgtgggagaaaaacagactctgagccccaaacaccctaagccttcaaccgtgaaagactgtcccactctctgcaaacagaccgataatcgacagacagataagtccccttctcagcccgccgccaacaccgatcgccgtgcggaaggtaaaaaatgcacagaagccctgtacgcccccgccgagggcgataaattggaggccggcttgtcgttcgtacactccgaaaaccggttgaaaggggctgagcggccagcggctggagttgggaaaggcttcccagaggctagagggaaggggcctggcccccagaaaccgcccaccgaagccgacaaacccaacggtatgaagcggtctcccagcgccactgggcagtccagctttcggtctacagctttgccagaaaagtctctgtcatgtagtagctctttcccggaaactcgcgctggggtccgcgaggcctccgctgctagttcagacacctcatccgccaaagccgccggtggcatgttagaactccccgccccctccaatcgggaccaccgcaaagctcaaccagctggggaagggcgcacccatatgacaaaatctgacagtttaccatctttccgtgtgtccacgctgccattagaatcgcatcaccctgaccccaacactatgggcggggcatctcacagggacagggctctgtcagtgaccgcaaccgtgggcgaaactaaaggcaaggatcccgctcctgcccaacccccgcctgcacgtaagcagaacgtagggagagacgtcaccaaacccagccccgcccccaataccgaccgaccaatctctttgtctaacgagaaggatttcgttgtgagacagaggcgaggaaaggagtccctgcgaagttctcctcacaagaaagccctttag

SEQ ID NO: 48812 - DNA, 7881 bp, Artificial Sequence
  Description of Artificial Sequence: Synthetic coding sequence
atgggcgagaaggtgagcgaggcccccgagcccgtgccccggggctgtagtggccacggctcccgaactccagcctctgccctggtagctgccagttctccaggcgcaagtagcgcggagtccagtagcggatccgagacattatccgaagagggtgagcctggcggcttttcacgtgaacatcagccaccgcctccccccccgctcggcggcacgctcggggcaagagcccctgccgcttgggctcccgcaagcgtactgttagagaggggcgttctggcacttccaccgccactgcctggcggcgcggtgccacctgcacctcggggatcctcagcctcccaggaggagcaagatgaggagttggatcatatcctttcgcctcccccgatgccgttccgaaagtgttccaatccagatgtggcatcaggacctggaaagagcttgaagtacaaacggcaactctccgaagacgggcgccagctgcgaagaggatctctcggcggcgctctgaccggcaggtacctccttcctaatccagtggcgggccaagcatggcctgcgtctgctgagacgagtaacttagttaggatgcgctcccaggccctgggacagagcgccccttctctcactgcttctctcaaggagttgtctctgccaaggaggggaagcttctgccgcactagcaaccgcaagtccctgattgggaatgggcagagcccagctctgcctcggccccattcacccctctctgcacacgccgggaactctccccaagattcaccacgaaatttttcacccagcgcttctgctcacttttccttcgcacggtctttgaaccggaccgacggtcggcgctggtctctggcctctctgccctcctcgggctatggaacaaacactccctctagcacagtgtccagcagttgctcttcacaagaaaagctgcaccagctgccttaccagcccactcctgacgagctgcattttctcagcaaacacttctgcactacagaatccatcgcaaccgaaaataggtgccgaaacacaccaatgcgtcctagatccagatccctctctccaggccgttcccccgcttgttgtgaccatgagattataatgatgaatcatgtatacaaggaacggttcccgaaagccacagcccagatggaggagcggcttaaggaaataattacttcctacagccctgacaatgtgttacctctggccgatggggtgctctcttttactcaccaccagattatcgaactggccagagactgcctggataaatctcaccagggcttgatcacatctaggtatttcctggagttgcagcataaactggacaagttattacaggaggctcacgacaggagcgaatccggcgaactggcgtttataaagcaattggttagaaaaattctgatcgtcattgcgagacccgcacgcctgctagaatgtctggaattcgatcccgaggagttctactatctcctcgaagccgcggagggccacgcaaaggaaggccaaggtataaaaaccgacattccacgctacatcatcagccagctcgggctgaataaggatccgctggaggaaatggcccatcttggaaactacgacagcggaactgccgaaacccctgagacggacgagtcagtgagcagcagtaacgcttccctgaagctgcggagaaagcccagagagtccgattttgagactattaaactcatcagcaacggagcctacggggccgtgtatttcgtgaggcacaaggagtcacgtcagcggtttgccatgaagaagataaataaacagaatctgattctgaggaatcagattcagcaggctttcgtggaaagagatatacttaccttcgctgagaacccattcgtcgtctccatgtattgcagttttgagacacggcgccatttgtgcatggtcatggagtacgtggaaggtggggattgcgccaccctcatgaaaaatatgggccctctgcctgtggacatggccaggatgtactttgctgagacagtgctcgcactcgaatatctgcataattatgggatagtgcatagagacctcaaacccgacaacctgctcgtaacgagcatgggccacataaagcttaccgatttcggtctctccaaagtcgggctgatgtctatgaccaccaatctctacgagggtcatattgaaaaggatgctagagaattcctggataagcaggtgtgcgggaccccagaatacattgcgccggaggtgatcctccgacaaggttacggcaaaccggtcgattggtgggcgatgggcataatcctttatgagttcctggtcggctgcgtgcctttcttcggcgacactcccgaagagctttttggacaggtaatctctgatgaaattaattggccggagaaagacgaggcgcccccgcctgatgcccaggacctcatcacactgctgctgcggcaaaacccactggagaggttgggcaccgggggagcctatgaggtgaagcagcacaggtttttcaggagtctagactggaattccttgttgagacaaaaagctgagttcatcccgcaactggagtcagaggacgatacatcatattttgacactagaagcgaaaaataccatcacatggagacagaagaagaggatgatactaacgatgaagattttaacgtagagattcgacaatttagttcatgttcccatcgtttctcaaaggtgttctctagtattgatcgcatcacccaaaatagcgccgaggagaaggaagatagcgtggataagacaaagtcaaccacgctgccgtccacagagactctatcttggagctcagaatactccgagatgcagcagctgagcacctcgaattctagtgacacagagtccaacaggcacaaactatcttcaggtttgctgcctaaacttgccatttccaccgagggagaacaggacgaggcagctagttgccctggagacccccacgaggagcccgggaagccggccctgcccccagaagaatgcgcgcaagaagagcctgaggtcacaactcctgcatccaccatatcatcatccactttaagcgtggggtcctttagtgaacacctcgaccagattaacggtcgctccgaatgtgtggattctacggataactcctccaagccatcgagcgagcctgcatcacacatggctcgtcagaggctggaaagcacagagaagaagaagatttccgggaaagtgacaaaaagcctgagcgccagcgcactatccctaatgattccaggcgacatgtttgctgtcagcccactgggttcacctatgagcccccactctctcagcagcgaccctagcagctcacgcgactcaagtccctctagagactcatcagccgctagcgcctctccgcatcaaccaattgtcatccacagcagcggaaagaattatgggtttactattcgtgcgatccgagtgtacgtgggggatagcgatatctacaccgtgcaccatatcgtgtggaacgtcgaggaaggcagtcctgcctgccaggccggcttgaaagcaggcgacctcataacacacattaacggtgaacctgtacacggtctcgtgcatacagaagtgattgaattgctgctgaagagcggtaataaggtgtctataactacgacaccctttgaaaacacatccatcaagacagggcccgcccggagaaatagttacaaaagccggatggtgaggcggtccaagaaatctaagaaaaaagagtcgctggaacgcagacggagcctattcaagaaattggcaaagcagccatcccccctgctgcatacttcccggtcatttagctgcttgaacagatctctatccagtggcgagagccttcccggatctccaacccactcattatctccacggagtccgactccctcttatcggagcactccagatttcccatcagggacaaactccagccagtccagtagtccgtctagctccgccccaaactcccccgcagggagtggacatataaggccatcgaccctgcatgggctggcgccgaaactgggagggcagaggtaccgaagcggtagaagaaagtcagctggtaatatccctctatctcccctcgcccggaccccgtcgcccacaccccagccgacatccccccaaaggtccccgtcccccttgctcggacattcgctaggtaatagcaagatcgctcaggctttccccagcaagatgcactcccctcccacaatcgtcaggcacattgtcagaccaaaatccgctgagccaccacgtagccccctcctcaaacgcgtccagagtgaggagaagctgagtccgtcttatggctccgacaaaaagcatctgtgctcaaggaagcatagcctggaagtgacacaggaagaggtgcagcgcgagcaaagccaacgcgaggcgcccctgcagagtctggacgagaacgtttgtgacgtgccacccctgtccagggccaggcccgtggaacaaggctgcctgaagcggcccgtatcccgcaaagtgggcagacaggagagcgtggacgacctggatagggacaagctgaaagcaaaggtcgtagtaaagaaagctgatggcttccccgagaagcaggaaagtcaccaaaaatcccacggccctgggtctgacctcgaaaatttcgctctctttaagctggaggaacgagagaaaaaggtgtatcccaaggctgtggagaggtccagtacgttcgaaaataaggcatcaatgcaagaagccccgccattgggcagcttgttgaaggacgctctccataagcaggcgtcagtgcgagccagcgaaggcgcaatgagtgatggacgggtccccgcagaacacagacaaggagggggcgactttagaagagctccagcccctggcaccttgcaggacggcctgtgtcatagcctggacaggggtatcagcgggaaaggcgaggggaccgagaagtcttctcaggctaaggagctgctcagatgcgaaaagctcgatagcaaactggccaatatcgactaccttaggaaaaagatgtcgctggaggacaaggaagataacctttgcccagtcctgaaacccaaaatgaccgcaggatcccacgagtgtttgcccggaaatcccgtgcgcccaaccggcggtcagcaagaacctccaccagcctctgagagtagggcattcgtcagcagcacacatgctgcccagatgagcgcggtgtctttcgtcccactgaaggctctcaccggacgggtggatagcgggaccgaaaagccagggctggtggcccctgagtctcccgtgcgcaagtccccctcagagtataagctcgaaggccggtctgtgtcctgcctgaagcccatcgaaggaacactggacatagccctattatccggccctcaagcttccaagacagaattaccttcaccagagagcgctcagagcccatcgccttccggagatgtccgtgcatccgtgccacccgtgctgcccagttccagcggcaagaagaatgacaccacatcagcccgcgaactgtctcctagcagtcttaaaatgaacaagtcatatctactagagccttggttcctgccaccctccagaggactgcaaaattcaccggccgtgtcgctgccagacccagaatttaagagggaccgcaagggaccacatcctacagcaagatctccagggaccgttatggagtctaacccgcagcagcgtgaaggctccagccccaaacatcaggatcacacaaccgaccctaaactgctcacctgcctcggccagaacctgcatagccctgaccttgctaggcctcgctgccccttaccacccgaagccagccccagtcgggaaaagcccgggctgagagaaagcagcgagcggggccctcccactgcaaggagcgaaagaagtgctgctagggccgatacctgcagggaaccctctatggagctgtgtttcccggaaactgccaagactagtgacaacagtaagaacctgttgtccgtcggtcgcacccatcctgacttctacacacagacacaggctatggaaaaagcatgggctcccggtgggaagactaaccacaaggacggcccgggcgaagctcgcccccctccacgtgacaacagtagcctgcatagcgcagggatcccttgtgaaaaggaattgggcaaagtgagacgaggggttgagcccaagcctgaagctcttctagctcggcgatccctgcagccacccggcatcgagagcgagaaatctgagaagctgtcttcatttccaagcctacagaaagatggcgccaaggaaccagagcgcaaagaacagccactgcagagacatccctctagcattcctcctccgcccttgacagccaaagacctgtcctcaccagctgcccgccaacactgctcctctcccagccatgcttctgggagggagccaggagccaaaccatctacagccgaaccatccagttcccctcaagatcctccaaagcctgtggccgcccacagcgagtcttcttcacataagcctaggccagggcctgaccccgggcccccaaagactaagcaccctgacaggtcgttaagcagccaaaaacccagcgtgggagccaccaaaggtaaagagcctgcaacacagagccttggcggctccagtcgcgagggtaaggggcacagcaagagtgggcccgatgtcttccctgcaacccccgggtcacagaataaagcaagtgatggcatcgggcagggagagggcgggccatctgtgcctttacacaccgaccgtgcacccctggatgccaagccgcagccaacgtctggtggtagacccctggaggtcctcgagaaacccgttcatctacctaggcccggccaccctggccctagcgagccagcagatcagaaattaagcgctgtgggagagaagcagacactgtcaccgaagcaccccaagccttcaacagtcaaggactgtcctacgctgtgtaaacagactgacaacagacagactgataagagcccctcacaaccggctgcaaatacagataggcgcgcggaaggcaaaaagtgtacggaagctctctacgcccccgccgagggtgataaactggaggccggcctgtctttcgtgcactccgagaaccggctgaaaggggcagaacgacccgctgcgggcgtcggcaagggctttcccgaagcccgaggcaaaggacccggaccccagaaaccccccaccgaagccgataagccgaacggtatgaaacgctcacctagcgcgacagggcagagctccttccggagcacggccctgccggaaaaaagtctgtcctgtagtagcagcttccctgagacgcgagctggagtgcgggaagccagcgccgccagtagcgacacttcttcagccaaagcagcaggtgggatgctggaactccccgcaccatccaacagagatcatagaaaggctcagcctgccggggagggaagaacccacatgacaaagtcagattccctgccctcgtttagggtttctacgctgccccttgagtcacaccaccccgaccctaacaccatgggaggcgccagtcaccgcgacagagccttgagtgtgactgcaactgtaggcgaaacaaagggtaaagaccccgctcccgcccagcctcccccggctcggaagcagaacgtgggccgtgacgtgacaaagccgtctcctgcacccaataccgaccgacctattagcctaagcaatgaaaaggacttcgtcgtgaggcagcggcgcgggaaggaaagtctgcgcagctccccacataaaaaggccctctag

SEQ ID NO: 48813 - DNA, 7335 bp, Artificial Sequence
  Description of Artificial Sequence: Synthetic coding sequence
atgaaggcccagcgggagcggctgcagatccccggcctgaccctggacttgacccccagaagtctgtcaccaacaccttctagtcccggaagcccatgtagtccattactggccttccacttttggagctgtagaacttccaatcgcaaatctctgatcggcaacgggcagagtccagctctgccacggccgcactcacctctgtcagcccacgcaggaaactccccccaagactctcccaggaacttcagtccatctgcctccgcacatttctcatttgcacgacggaatgaccgcactgacggccgcagatggagcttggcgagcctgccttcaagcggttatggtacgaacacgccctctagtacagtgtcaagttcatgttcttctcaggagaagttgcatcagctaccatatcaacccacacccgatgagctccattttctttctaaacatttctgcacgacagagtcaatcgcaaccgagaataggtgtcgcaataccccaatgagacctaggtccagaagtttatccccaggtaggtctcccgcctgctgcgaccacgaaattatcatgatgaatcatgtgtataaagagagatttcctaaggcaacagcccagatggaagagcgcttgaaggagatcattacaagttactcccccgataatgtgctccccctagccgatggtgtgctgtcgtttactcatcaccagatcatagagctcgcgagagattgtttagataagagccaccagggcctcattacctctcgttactttctggaattgcagcacaagttggacaagctcctccaggaggcccacgaccgatccgagtccggcgaactagcgtttatcaaacaactcgtgcgcaagatcttgatcgtgattgcaagacccgctaggctgcttgaatgtctcgagtttgacccagaggaattctactatctacttgaagctgcagaggggcatgctaaggaaggacagggaattaaaaccgatattccgcgatatatcatatcgcagctcggactcaataaggatccccttgaggagatggcccacctgggcaactatgacagtgggacagccgaaaccccagagacagacgagtcagtgagctctagcaacgcctctttgaaactccgtagaaagccacgggaatccgatttcgagacaattaagctcatctccaacggagcttacggggctgtctattttgtgcggcataaagaatcccgccagaggttcgctatgaaaaagataaacaaacagaatctgatcctccggaaccagattcaacaggcctttgtagaaagggacattctgacattcgcagaaaacccattcgtggtgtcaatgtactgtagcttcgaaacgaggcgacacctatgtatggtcatggagtatgtggaaggtggcgattgcgccacactgatgaaaaacatggggccgctgcccgtcgacatggctcgaatgtactttgcagagactgtgctggccctcgagtacttacataattacggtatagtgcatcgagacctgaagcctgacaatcttctggtgacgagtatgggtcatataaaactgaccgacttcgggctgagcaaggtgggactgatgtccatgaccaccaatctgtacgaaggacatatcgagaaggacgcccgggaatttttggataaacaggtctgtgggacacctgagtatatcgccccggaggttatactaagacaagggtatggcaaaccagtagactggtgggccatggggattatactctatgagtttctggtcggatgcgtccccttctttggggatacgcctgaggaactcttcgggcaggtaatctctgacgaaatcaactggcctgagaaggatgaggctccaccccccgacgctcaggatctgatcacccttttgcttcgccagaatccattggagaggttagggaccggaggagcctacgaggttaaacaacacaggtttttccgttctctggattggaactctctgctgcggcagaaggcagaatttatccctcagttagagtctgaggacgatacctcctactttgacacacggagtgaaaaataccaccacatggagacagaagaggaggatgacactaacgatgaagacttcaatgtggagataaggcagtttagctcctgctcccatcgctttagcaaagttttcagctctattgacagaattacacagaattctgctgaagagaaggaggacagtgtggacaaaaccaagtcaacaacactgccgtcaactgagactcttagttggtcttctgaatacagcgagatgcagcagctatccacctccaatagcagtgatacagaaagtaacaggcacaaactgagcagtgggctcctacctaaactggccattagtaccgaaggagagcaggacgaggctgccagttgtccaggagacccacacgaggaacccgggaagcccgcgctgccccctgaggaatgcgcacaagaagaacccgaggtgacaacaccagcgtctactatttcctcctctactctctccgtggggtcattctccgagcacctcgaccagattaacgggagaagtgagtgtgttgattccaccgacaattctagtaaacctagttccgaaccagctagccacatggcacgccaaagactggagagcacagaaaaaaagaagatcagcgggaaggttactaagagcctgtctgcaagcgccctctccttgatgatccccggggacatgtttgctgtttcgccccttggaagcccaatgtcgccgcactctctgtcaagtgatcctagcagcagcagagattccagcccttctagggatagtagcgctgccagcgcatcgccgcaccagcccatcgtcattcattccagcgggaagaattacggattcactattagagccatcagggtgtacgtgggcgactcagatatatatactgtccaccatatcgtctggaacgtggaggagggttctcctgcatgccaggccggacttaaggcaggagatttgataacacacataaatggtgaacctgttcacgggttggttcatacagaagtcattgagctgctcctcaagagcggcaacaaagtctcaatcaccactacgcccttcgaaaatacctctattaagacagggcccgcacgacgaaattcatacaaatctcgcatggtccggcggagcaagaaatccaagaagaaagagtctttggaacggagaaggtcattatttaaaaaactcgccaagcagccctccccccttctacatacatctagaagttttagttgcctcaaccgctctttgtctagcggagagtccctgcctggatcccccacccattctctgagcccccggtctcctactccttcttatcgctccacccccgacttcccaagcggaaccaactcctctcagagctcctctccaagttcaagcgctccaaatagccctgccgggtcgggccacatacggccatccactttacatgggctggccccaaaacttgggggccagcgctaccgctcaggtcggaggaagtcagccggcaatatcccactgtcccccctggctcgtactccttccccaacaccgcagcctacttctccacaaaggagccctagtcccctcttgggccatagtctggggaattcaaagattgcccaggcttttccctcaaaaatgcattctccccccaccatcgtgcgccatattgtgcgcccgaaaagtgctgagccccctcgatccccactgcttaagagggtgcagtccgaggaaaagttgtctccaagctatggatcggacaaaaagcatttatgctccagaaaacacagcctggaggtgacccaagaagaggttcagcgcgagcagagccaaagggaggcaccactgcagtcccttgatgagaacgtgtgcgatgtgccacccctatcccgcgctaggccagtagagcagggctgtttaaaaagacccgtgtcaaggaaagtgggcaggcaggagagcgtggatgacctggaccgagacaagctgaaggccaaagtcgtggtgaagaaggctgacggcttcccagagaagcaggagtcccatcaaaagagtcacgggcctggctctgatcttgaaaattttgctctcttcaaacttgaagaaagggaaaaaaaagtgtatccgaaagccgtggagcgaagctcaaccttcgaaaacaaggctagtatgcaggaggccccccccctggggagcttgctaaaggatgccctgcacaagcaggctagcgtccgcgcgtcggagggtgcaatgtcagatggtagggttcccgcggagcaccggcagggcgggggcgatttccggcgagcgcccgcccctggaactttacaggacggtttgtgtcactccctcgacagaggtatctcaggcaagggtgagggtactgagaaaagttctcaggcaaaagagctgcttaggtgtgaaaagttagacagtaagcttgcaaacattgattacttgagaaagaagatgagccttgaggataaggaagataacctgtgtccagtgctaaagcccaagatgactgctgggtcccatgaatgcctacctgggaaccctgttcggcctacaggcggtcagcaggaacctcctcccgcctcggaaagtagggcctttgtgagttctactcacgcggcacaaatgtcagctgtatcattcgtaccactcaaagctctaaccgggcgtgtggacagcggcacagaaaaaccagggttggtggccccagaaagccccgttcggaaaagcccaagcgagtacaagctggaaggacggagcgtgtcatgcctgaagcccatagagggaaccctcgacatcgccctcctctccggcccacaggccagcaaaacagagcttcctagtcccgagtccgctcagtccccgtctccttctggagacgtgagggcatccgtgcccccagtgctgccgtctagtagcggtaaaaagaatgatacaacctccgccagagaacttagcccttcctccctgaaaatgaacaagagctatctgcttgagccttggttcttgcctccaagccgtggacttcagaactccccagctgtgagcctccccgatcccgagttcaagcgagatcggaaggggcctcacccaactgcccgctcacctggcaccgtgatggaatctaacccccaacagagggagggctcgtctcccaagcatcaggaccatacgactgatccaaagctactgacttgtctcggccaaaaccttcactcaccggatttggccaggcctcggtgtcctttgcccccagaggctagcccttcccgtgaaaagccaggcctgcgggaatcatctgagcgaggccctcctactgccaggagtgagaggagtgccgccagggcagacacgtgcagagagcctagcatggaactgtgttttcccgaaaccgctaaaacttcagataactccaagaatcttctgtcagtggggaggacccatccagacttctatacccaaacacaggctatggagaaagcctgggcccccggcggtaagacaaatcacaaagatggacctggcgaagcccgcccgccaccccgcgataattcgagcctgcatagcgctggaatcccatgtgagaaggaactcggaaaagtgcgtcgcggcgttgagccaaaacctgaggcactgctcgcaaggcgatctttacaaccccccggtatagaaagtgaaaagtcagaaaagctgtcatccttcccgtccttgcagaaggatggcgccaaggagccagagcggaaggaacagcctctgcaaaggcatccaagcagcatccccccgccaccgctcactgccaaggatttgagctctcccgcagccagacagcactgctcttcaccttcgcatgccagcggacgcgaacctggcgcaaagccttccaccgccgaacccagcagttcaccccaggatcctcccaaacccgtggctgcacatagcgaatccagcagccacaaaccaaggccagggcctgatcccggaccaccaaagaccaagcaccccgatagatcgctgtcatcccagaagccgtctgtcggagctaccaagggcaaggagcctgccacacaatcccttggtggttctagccgtgagggaaaaggccactccaagtcggggccagatgtgtttcccgcgacccctggaagccagaacaaggccagtgacggtataggtcaaggggaagggggaccttccgtgccattgcacaccgaccgggcgccactggacgccaagccccaaccgacgtctggggggcgaccgctcgaagtcctcgaaaagcctgtccacttgcctcgccccgggcacccagggccttcggagcctgcagaccagaaactgtctgcagtcggcgagaagcaaactctctcccccaagcaccccaaacctagtaccgtcaaggactgtcccacgctttgcaaacagacagacaataggcagactgacaagtccccctcacaacccgcagcaaacactgacagacgggccgagggaaagaaatgcacagaggctctgtacgcccctgcagagggggataaactcgaagccggattgtcattcgtacatagtgagaatcggctgaaaggtgccgaaagaccagcagcgggggtggggaaagggttccccgaagcaagaggaaagggccccgggccgcagaaacctcctactgaggctgacaagcctaatggtatgaagagaagtccctctgccacaggccaatcctccttccgttcaacagctctccctgaaaagtcgctgagctgcagcagctccttcccagaaacccgtgctggcgtgcgggaagcatccgcggcctcttccgatactagtagcgctaaggcagcaggaggcatgctggagctgccagccccctcaaaccgtgatcaccgaaaagcgcaacctgctggggaaggccgaacacatatgaccaagtccgatagcctgccatcttttcgggtctccacccttcctctggaaagtcaccacccggatcctaataccatgggaggcgccagtcatcgggatcgagcactgagtgtcaccgccacagtgggagaaaccaagggcaaagatcctgctcccgcacagccacccccagccaggaagcaaaatgttggaagggacgtaaccaagcccagccctgcaccaaatactgatcgacctattagcctctcgaacgaaaaagattttgtcgttaggcagaggcggggcaaggagtccctgagaagctctccccataaaaaggcactgtag

SEQ ID NO: 48814 - DNA, 753 bp, Artificial Sequence
  Description of Artificial Sequence: Synthetic coding sequence
atgggcgagaaggtgagcgaggcccccgagcccgtgccccggggctgcagcgggcatgggagtcgcacgcccgccagcgccctggtggccgcatcttcaccaggcgcttccagcgcagaatctagctcaggtagcgaaaccctttccgaagagggagagccagggggtttctctagagaacatcagcccccgccaccgcctcctttaggggggacccttggcgcccgcgctcccgctgcatgggcccccgcttccgtgctgctcgagaggggcgtactggccctgccccccccactgccggggggagcggtgccccccgcgccacgtgggtccagcgcaagccaggaagagcaggatgaggagcttgatcatatcctttcccccccacctatgccctttagaaagtgttctaatcccgacgttgcatcgggtcctggcaaatcactgaagtacaaaaggcagctcagcgaagacgggaggcagctgcgccgaggatctctcggaggggcactgacagggcgttacctcctgccaaatcctgtggcaggtcaagcctggcctgcttctgctgagacatctaatttggtaaggatgagaagtcaggcccttggccagagcgcgcccagtttgactgcaagcttgaaggagctgtccctgcctcgaagggggagtttaattgactcccagaaatggaattgcctggtcaaacggcccgtgtgcccaaatgctggaaggacctcccctttaggatag

SEQ ID NO: 48815 - DNA, 2982 bp, Artificial Sequence
  Description of Artificial Sequence: Synthetic coding sequence
atggacatgagcgaccccaacttctggaccgtgctgagcaacttcactcttccacacctgaggtccggaaacaggctcagaaggacgcagtcgtgtcgcacatcaaatcgcaagtctcttatcgggaacggccagtcaccagctttaccccggcctcattcacctctttccgcccatgctggcaatagccctcaggattctcccaggaattttagtccatccgccagcgcacacttctcattcgctaggcgcacagacggtcggaggtggtctctcgcctccttaccgtcaagtggctatgggacgaatactccctcttccactgttagctccagctgcagctctcaggagaagctccatcagctgccgtaccagcctacccctgatgaactgcatttcctatccaagcacttctgcaccacagagtctatcgctactgaaaataggtgcaggaatactcccatgcggcctcgctctagaagtctgtccccagggcgaagcccggcgtgttgcgatcatgagattatcatgatgaatcatgtctacaaggagcggttcccgaaggcgactgctcagatggaggagcgactgaaggagatcattacttcatactcaccagacaatgtgctccccctcgccgacggagtgctgtctttcacacaccatcagattatagagttggctagggactgcctagataaatcacaccagggacttataacaagtagatacttcctcgaactccagcataagctggacaaactgttacaggaagctcacgaccggtcagagagtggcgagttagcctttattaaacagctggtacgcaaaatcctgatcgtcatcgcaagaccggcccggctgctagagtgtttggagttcgaccctgaggagttttactatctgctcgaagctgcagaaggccatgccaaagagggccagggcataaaaacagacatcccaaggtatataatttcccagctaggcctcaacaaggacccgctggaagagatggcgcatctgggtaactatgatagtggcacggcagaaacgccggagacggacgaatccgtttcatcctcaaatgcaagcctcaagctgcggagaaagccgcgcgagtccgactttgaaacaattaagcttatctctaatggcgcatacggcgctgtgtacttcgtgcgccacaaagagagtcgccaacggtttgctatgaaaaagattaacaagcaaaacttaattttaaggaatcaaattcaacaggctttcgttgagcgcgatattcttacgttcgctgagaacccgttcgtggtctcaatgtactgtagctttgagacacggcggcacttgtgcatggtcatggaatatgtggaaggaggcgactgcgccacccttatgaagaacatgggacctctgcccgtcgacatggcaagaatgtacttcgcagaaacggtactggccctggagtatcttcacaactatggaatcgttcatcgggacttaaagcccgataacctgctggtaacgtcaatggggcatatcaagttgactgactttggcctgtctaaagttgggttgatgtcaatgactacaaacctttacgagggccacattgaaaaagacgctcgtgaattcttggataagcaagtctgcggcaccccagagtacatcgcccctgaagtgattttaaggcaggggtacgggaaaccagtcgattggtgggcaatggggataatcctctatgagtttctggttggttgcgttcccttctttggggatacacccgaggagctgtttggacaggtgatttccgacgaaattaactggcctgagaaagatgaggccccaccaccggatgctcaggatctgattactcttttactgcgtcaaaaccctttagagagactgggcacggggggcgcgtatgaagtaaaacaacataggttcttcaggtcgctcgactggaactctcttctgaggcaaaaggcagagttcattccccagctggagtcagaggatgatacttcctattttgacacacgttccgaaaagtatcatcacatggaaaccgaggaagaggacgatacaaacgatgaagactttaatgtagaaatacgacagttctctagctgttctcatcggttttcgaaggtctttagtagcatcgataggatcacccagaactccgctgaggagaaggaggactccgtggacaaaaccaagtccacaaccctgccgagcaccgagaccttgagctggagtagtgagtacagtgagatgcagcagttgtctacttccaactcttccgacacggagagtaaccgacacaagctgagctcaggactgctaccgaaactggctattagtaccgagggagagcaagatgaagccgctagctgtcctggcgacccgcatgaggaacccgggaaacctgctcttcctccagaagagtgcgcccaggaggagcctgaggttactacaccggccagtactatcagctcctctacactcagcgatatgtttgcagttagcccattgggatcccctatgtccccccactccctgagttctgacccttcttccagccgggattccagccctagcagggactccagtgcagcttccgcctcccctcatcaacccatcgtcatacactcctccggcaagaattacggtttcaccatccgagctatccgcgtgtacgtgggtgatagcgatatatacactgtccatcatattgtctggaatgtggaagagggctctcctgcttgtcaggctgggctgaaggccggggacctgattactcatattaatggcgaacctgtgcacggacttgttcacactgaggtcattgagctacttctcaagagtggcaataaggtgtccattactacgacccccttcgagaacacctccattaagacgggacccgcacgacgcaacagctacaagtcccgtatggtaagacggagcaaaaagtcgtag

SEQ ID NO: 48816 - DNA, 507 bp, Artificial Sequence
  Description of Artificial Sequence: Synthetic coding sequence
atggacatgagcgaccccaacttctggaccgtgctgagcaacttcacattgccccatctgcggtcagggaacagactccgtcgcacgcaatcatgtcgcacgagcaacaggaagtcactaatcggaaatggccagtcacccgcgcttccgcgcccgcattctcccctaagcgctcacgccggcaactctcctcaggactctccacgaaacttttccccttccgcaagcgctcacttctcattcgctagacgcacagatggcagacggtggtccttggcatccctgccctcgtctggttacggtactaacactcccagtagcacggtgtcctcctcttgttcttcacaagaaaagctgcaccagctaccataccagcccactccagatgagcttcacttcctatccaagcacttctgtaccacggaatctatcgcgactgaaaatcggtgtagaaatacacctatgcgccctaggtcacgtagtctttcccccggaagatctccctag

SEQ ID NO: 48817 - DNA, 7872 bp, Artificial Sequence
  Description of Artificial Sequence: Synthetic coding sequence
atgggcgagaaggtgagcgaggcccccgagcccgtgccccggggctgcagtggtcatggctccagaacccctgcctccgccctcgttgcagcgagcagccctggggcctcatctgccgagagctcatcaggctccgagacgttgtctgaggagggagagcctggagggttctcccgcgagcaccagcccccaccaccgcctccgcttggtggtacactaggagctagagcccctgcagcgtgggccccagcctccgtgctgttggaaagaggagtattagctttaccgcctccactgccaggcggagctgtccccccagcaccacggggaagttcagctagtcaggaggagcaggacgaggaactggaccacattctgtccccaccgcccatgcccttcagaaaatgtagcaatccggatgttgcctccggccctggcaagtcactcaagtataagaggcaactcagtgaagacggacgtcagctgcggcgtggctccctaggaggcgcccttactggcaggtatcttctgcctaatccagtggctggtcaggcatggccagcatccgccgaaacgtccaacttggttcgcatgagatcccaggcactgggacagtccgctccatcactcaccgcctctctgaaagaactctccttgccacggagagggtccttttgcagaacttcaaatagaaaatccctgattggaaacggacagagcccggccctgcctaggccccactcacccctgtcagcccatgccggcaacagtccacaggactctccgcggaatttcagcccatctgccagtgcacatttcagttttgctcgcaggacagacgggagaaggtggtccctcgctagtctacccagttccgggtatggcacgaacacccccagtagtacggtcagctcttcttgttcatctcaagagaagctccatcagctgccttaccagccgactcccgacgaacttcattttctgtctaaacacttctgcaccaccgaaagcatcgccaccgaaaaccgatgccggaatactccgatgcgtccccgttccaggagtctcagccccgggaggtcgccagcctgttgcgatcacgaaattattatgatgaaccacgtctacaaggagcgcttcccaaaagctacagcacagatggaggagcggctgaaagaaatcataacatcttactctcctgacaatgtcctgccattagctgacggcgtgctctcttttacccatcaccagatcatcgagctcgcgagggactgcctcgataaatcccatcagggactgatcacatcccgctactttctggaactgcagcacaaactcgataaactgctccaggaagcgcacgatcggtcggaaagcggcgaattggcttttattaaacagctggttaggaagatactaatcgtgatcgccagacccgctcggctgttggaatgtctcgagttcgatcctgaagaattctattacctgctggaagctgcagaaggccacgcaaaggaaggacagggaattaaaactgacatccccagatatatcatctcccagttggggttgaacaaggaccctctggaagagatggctcacctggggaactacgactcggggacagccgagacgccagagactgacgaaagtgtgagctcctcgaatgcaagtctgaagttgaggagaaaaccccgcgaatctgactttgagacgatcaaactcatatcgaacggagcctacggggccgtgtactttgtccgacataaggaatccagacagcgatttgcaatgaagaaaatcaacaagcagaacctcattttaaggaatcagattcaacaggcatttgtggaaagagacatcctcacatttgctgagaaccctttcgtagtgagcatgtattgctcatttgaaacgcgacggcacctgtgtatggtgatggagtatgttgaaggaggagactgcgctacccttatgaaaaacatgggacccctgccagtcgacatggctaggatgtattttgcggagaccgtgttagcgctcgagtaccttcataattacggaatcgtccatcgagacctcaagcctgataatctgctggtaactagtatgggtcacataaagttgacagactttggactttcgaaagtggggctgatgagtatgactactaatttatacgaggggcacatagaaaaagatgccagggaattcctcgacaaacaagtttgcggaactccagagtatattgcccccgaggtgatcctacgccagggttatggtaagcccgtcgactggtgggctatggggataattttgtacgaatttctcgttggttgcgtccctttctttggggatacccctgaggaactgtttgggcaggtcatcagcgacgagatcaattggccagagaaggatgaagctccgccgcccgacgcccaagacctgatcacgttgctgcttcgacagaatccactagagcgcctaggaactggaggagcgtacgaagtcaagcaacatcggtttttcagatccctggactggaatagcctgctccggcagaaggctgaattcatcccgcagttggaaagcgaggatgacacctcgtatttcgacactcgctccgagaagtaccatcatatggaaactgaagaggaggatgacactaacgatgaggactttaacgttgagattaggcagtttagctcatgctcacatcgtttttctaaggtgtttagttcgatcgataggattacccagaacagcgcagaagagaaagaggactcagtggataaaacaaaatctactacactgccaagtacagagaccctcagctggagcagtgaatactcagaaatgcagcagctgtctactagcaattcgagcgatactgagagcaaccgtcataagctcagttctgggctactcccgaagctagcgatttctacagagggcgaacaggatgaggcagccagttgtcctggcgatccgcacgaagaaccgggcaaaccagccctaccacctgaagaatgcgctcaggaagagccagaggttacaacccccgcgtcgacaattagcagtagcacattgtccgttggctcctttagcgaacacctggaccaaattaacggtaggagcgaatgtgttgattcaacagataattcgtccaagcctagctcagaacccgcgagccacatggcccgccagcgtctggaatccaccgagaaaaagaaaatttctggcaaagtgactaagtcactgtcagcttcagccttgagcctaatgattcctggagacatgttcgccgtgagtcccctgggaagcccaatgagccctcactcgctcagctctgatcctagctctagccgagacagttcaccatcacgggacagctccgccgccagcgcttccccgcatcagcccattgtgatccattcaagtggcaagaattatgggtttactattagggccatccgcgtctacgtgggtgacagcgatatctacaccgtacaccatatcgtgtggaatgtcgaggaaggcagcccagcatgccaagctggcctcaaagcaggtgatctgatcacacacattaacggtgagccagtgcacggactggtgcacactgaagtgattgaacttctgctgaagagtggaaacaaggttagcataactaccacccccttcgagaacaccagtatcaaaaccggccctgccagaagaaactcatacaagtcccgtatggtgagacgcagtaagaaaagcaaaaagaaagagagcctagaaaggcggcggagcctattcaagaaactggctaagcagcctagccctttgctgcacacgtccaggagtttcagctgcctgaacagaagcctttctagcggagaatccttgcctggatcccccacccactccctcagtccccgttcacctacgccaagttatcgatctacacccgactttccgagtgggacaaactccagtcagagtagctcaccctcctccagcgcccccaatagcccagcagggtccggtcatatcaggccatcaaccctccacggcctagctcctaaattaggcggtcagagatataggagtggccgtcgcaaaagtgctggtaatatccctttaagcccactggcgaggacgccttcgcctacaccacagcctacgtccccccagcgtagtccatccccattactaggtcatagtctgggaaactcgaagatcgcccaggccttccccagcaagatgcattctccgcctacgatcgtccgccacatcgtgcggccgaagagtgcggaaccccctcgcagtcctctgctcaagcgggttcagtccgaggagaaactctctccaagttatgggagcgacaagaagcatctgtgttctcgcaagcactccctggaagttacacaggaagaggtgcagcgtgagcagtcccagagggaggctcccctccagtcgctggacgaaaatgtatgcgatgtacctcccctcagtagagccagacccgtcgaacaggggtgtctcaagcggccagtatcacggaaggtagggcggcaggaaagtgtagacgatctggatagagataaactcaaagcaaaagtagtcgtcaaaaaggcagatggattccctgagaaacaggagagtcaccaaaagtctcacggacctggcagtgacctggaaaatttcgctttgttcaaactcgaagagagggaaaagaaggtctatcccaaagcggtcgaacgctcatccactttcgaaaataaagcttcaatgcaagaggcaccacctctggggagccttctcaaggacgcactccacaagcaagcaagcgtgcgggcttcagaaggagcaatgtcagatggacgagttcccgcagaacataggcaaggtggcggagatttccggagagcacctgcaccaggtaccctccaggacggcctttgccacagtctggatcgtggaatctctggcaagggggaaggaaccgaaaaatctagtcaagccaaggaactgttacgctgtgaaaaactcgatagcaagctggcaaacatcgactacttgaggaaaaagatgtccctggaggacaaagaggacaatttatgccccgtacttaaacctaaaatgaccgctggaagtcacgagtgcctgcccggcaatcctgtccggcctaccggggggcaacaagaaccaccacctgcttcagaatctcgggcttttgtgagctccactcacgccgctcaaatgtcggcagtgagcttcgttccgttaaaggcactgacaggccgcgtggattcaggaacagaaaagcccggcctcgtggctcccgaaagtcctgtgcggaagtctccctcagaatataagctcgaaggccgcagtgtgtcgtgtctcaagccaatcgaaggaacactggacatcgcactactctctggacctcaagccagtaaaacagaattgccctctcctgaaagtgctcagtcccctagtccatccggcgacgtgagagcatcggtgccccctgtcctcccttcctcctcaggaaagaaaaatgacacgacatctgccagagagctgtctccttcctccctgaaaatgaacaaatcctacttgctcgaaccatggttcttgccacccagccgcggtcttcagaatagccctgccgtctccctgcctgatcccgagtttaagagggatagaaaggggcctcatcccaccgcccgaagccccggcactgtgatggagtctaacccacagcaaagggagggcagcagcccaaaacaccaggaccacactacagatccaaagcttttgacttgtctggggcagaacctccatagtccagatttagctcgaccacggtgccccctgccaccggaagcaagccctagtagggaaaaaccgggcctgcgagagagttctgagcggggtcctccaaccgccaggtcggagagatccgcagctcgcgcagacacttgtcgggagccgagtatggagctctgcttccccgaaacagccaaaacctcagataattctaagaatttgcttagcgttgggcggacccaccctgacttctatacccagacccaggccatggagaaggcttgggcgcccggcgggaagacaaatcataaggatggccccggcgaggcacgcccgcctccgcgcgataactcctccctgcactccgctggcattccctgtgaaaaagagctgggcaaagtgagaaggggtgtcgaaccaaaacctgaagctctgctggctaggcggtctctacagcccccgggcattgaaagcgaaaagtcagagaagctttcaagttttccgtcacttcagaaggacggcgccaaagagcctgagaggaaagagcagccactccagcggcacccgtcgtctataccccccccccccctgacagccaaggacctctcctcgcccgctgcacgccagcattgttcctctccatcccatgcatccggacgagagcccggcgccaagccttctacggctgagccttccagttcacctcaggacccacctaagccagtggctgctcattcagagtcatcctcccacaagcctcggcccggccccgatccgggaccaccgaagaccaagcaccccgatcgttctttgtcatctcaaaaacccagtgtgggggcaaccaaagggaaggaaccagccacacagtctttggggggctcctcaagagagggtaagggccatagtaaatctggacccgatgttttccccgccactcctggaagccagaacaaggcatcggacggaattggacaaggggagggcgggccctctgtgcccctgcataccgacagggcaccactggatgcaaagccccaaccgacatctggggggcgacctcttgaagtgctggagaagccagtacacctaccacgccctggtcaccctggtccatcagaacctgctgatcagaagctctctgccgttggggagaaacagaccctgtccccaaagcaccccaagccaagcactgtgaaggattgccctaccctatgcaaacaaaccgacaataggcagacagataagagcccgtcacagcctgccgccaacaccgaccggcgggctgaaggcaagaaatgcacagaagctctgtatgctcccgccgaaggcgataaactggaagcagggctgtcattcgttcattcagagaatagacttaaaggcgccgaaagacccgccgcaggagtcggtaagggcttccctgaagcccgcgggaagggacccggccctcagaaaccccccaccgaggccgacaagcccaacggcatgaagcgttccccctcggccactgggcagtcttcattcaggtctacggccctgccagaaaaatctttgagttgttcttcgagctttcctgagacccgtgcaggagtgagagaggctagtgccgcatctagcgatacgtcctctgcgaaagcagctggaggcatgctggagttaccagccccatccaatagagaccatcgtaaagcccagccggctggggagggcaggacccacatgacaaagagcgattccctcccctcattccgcgtgtccacgctgccattggaatcccatcaccccgatccaaatacaatgggcggggccagccacagagacagagctctcagcgtcactgcaacggtcggggagacgaaaggaaaagatccagcgcctgctcagccaccacccgcccgcaagcagaacgttgggagagacgtgaccaagccaagcccagcaccaaatacagatcggccaatatccttaagcaacgagaaagacttcgttgtgcgccagaggcggggcaaagagtcactgcgcagcagcccacataaaaaggccctctag

SEQ ID NO: 48818 - DNA, 1152 bp, Artificial Sequence
  Description of Artificial Sequence: Synthetic coding sequence
atggccgagccccggcaggagttcgaggtgatggaggaccacgccggaacgtacggcttgggagatcgcaaagatcagggcggctacacgatgcatcaggaccaagaaggggacaccgacgcagggctgaaggctgaggaggcaggcatcggcgatacaccttctttagaagacgaagctgccggacatgtcactcaggccagaatggtgtcaaaatctaaagatgggaccggatcagacgataaaaaggctaagggggccgatgggaagacgaagatagctacgcccaggggggcagccccccctgggcagaagggtcaggccaacgcgactaggatccctgcaaaaaccccgcccgccccgaaaacacccccatcctctggtgagcctcccaagtcaggggatcgctctgggtactcatcacctggctctccaggaacccctggcagtcgatccagaacccccagcctgccaactccccccacacgggaacccaaaaaagtggctgtcgtgagaacacctcccaaaagtccctcatccgccaaatcccgcctgcagaccgcacccgtcccaatgcccgacctcaaaaatgtgaaaagtaagattgggagcaccgaaaacctgaagcaccagcccgggggcggcaaagtgcagataataaataaaaagctggatttaagcaatgtgcagagcaagtgtgggtcaaaagataatattaagcatgtccccggagggggcagtgtgcaaattgtatacaagcctgtcgacttatctaaggtaacctctaagtgcggctcacttgggaatatccaccacaaacctggcggcggacaagttgaagtgaagagcgagaaactcgattttaaagatcgagtgcaaagtaagatcggaagtcttgacaatattacccacgtacccggcgggggtaataagaaaatcgaaacacacaaactcaccttccgcgaaaacgcgaaagccaagacggatcatggggctgagatcgtgtacaagagtcctgttgtttccggcgacacttccccccgacacctctccaacgtttcttccactggcagtatagacatggtcgatagccctcagctagcaacactcgctgacgaagtgagtgcaagcctggcgaagcagggactctag

SEQ ID NO: 48819 - DNA, 1239 bp, Artificial Sequence
  Description of Artificial Sequence: Synthetic coding sequence
atggccgagccccggcaggagttcgaggtgatggaggaccacgccggaacctacgggctgggggatcgcaaggaccaggggggttacaccatgcaccaggaccaggagggcgatactgatgcaggtcttaaggagtcaccactgcagactcccaccgaagatggaagcgaggagcctggatcagaaacaagtgatgccaagtctactcctacagcagaggcagaggaagccggcattggggatacgccaagtctggaggatgaggcagcggggcatgttactcaggcccgcatggtaagtaagtcaaaggacggcacgggatccgacgacaagaaagcgaagggcgccgacggtaaaaccaagatcgcgaccccacggggcgccgcaccgccaggacagaaaggccaagctaatgccaccaggatacctgccaaaacgccacctgcgcccaaaacacctccttcttcaggtgagcctccaaagagcggtgatcgctctggatattctagcccagggagccccggaacgcctggcagtagaagccgtactcccagtctgcctacccccccaacccgggagcctaaaaaggtggccgttgtgagaacaccacctaagtctccttcatctgcaaaaagtaggctgcagactgcgccggtgccgatgccggatctgaagaatgtgaagagcaagattggcagcactgaaaatctcaagcaccagcccggcgggggcaaggtccagatcattaataagaaactggacttatcaaatgtgcaatccaagtgtggaagtaaagataatattaagcacgtgcccggcggagggtctgtgcagattgtctacaagcccgttgatctgagcaaagtgacctcaaaatgtggcagccttgggaatattcatcacaaacccggcggaggccaagtggaagtcaagagcgaaaaattggacttcaaagacagggtccagtcaaaaattgggtctctcgataatattacacatgtccctggcgggggcaataaaaaaatcgagacccacaaacttacttttcgggagaacgccaaggcgaaaactgatcatggggcagagatcgtgtataagagccctgtcgtgtcaggcgacacatcccccaggcatctgagcaacgtatcttcaacagggagtatcgatatggtagacagccctcagctcgccaccctggcagatgaagtgtctgccagtttggctaaacagggactgtag

SEQ ID NO: 48820 - DNA, 1326 bp, Artificial Sequence
  Description of Artificial Sequence: Synthetic coding sequence
atggccgagccccggcaggagttcgaggtgatggaggaccacgccggaacctacgggttaggtgatcggaaagaccagggcgggtacaccatgcaccaggaccaagaaggagacactgacgcggggctgaaggagagccccctgcagactcctactgaggatggaagcgaggagcccgggagtgagacctctgacgctaagagcacccccacagccgaagatgtaactgcaccgctcgtggatgagggagctccaggcaaacaagcggccgcgcagccgcatacagaaattccagaggggaccaccgcggaggaggcaggcattggggataccccctccttggaggacgaggcagcggggcacgtaactcaggctcgcatggtgagtaagtcgaaagacggcaccggctctgacgataaaaaggcaaagggggcggacggcaagactaagatcgccaccccacggggcgctgctccacccgggcaaaaaggccaggcgaacgccacccgcattccagccaagaccccacctgcacccaagacgccaccgtctagcggcgagccaccaaagagcggcgacaggtctggctactcgagccccgggagccccggtactcctgggtcccggagcagaacccctagcctgccaactccaccaacccgcgagcctaaaaaggtcgctgtggttaggacccccccgaagtctcctagcagcgctaagtctaggcttcagacagcccctgttcctatgcctgacctgaagaatgttaagtcaaaaattggctctacagaaaatctgaagcaccagccaggcggaggcaaggtccagatcattaacaagaaactcgacctgagcaacgtgcaatccaaatgcggaagtaaagataatattaaacatgtcccaggcggcggctccgtgcaaatagtctacaagcccgtagatctgagtaaggtgacgagcaagtgtggctccctagggaatattcatcataagcctggtggtggccaggttgaggtcaaatctgaaaagctagattttaaggaccgagtacagtcaaaaatcggatccttggacaacatcacacatgtgcctggcggggggaacaaaaagatagagactcataaactcacatttcgtgagaacgcgaaggctaagactgaccatggtgcagagatagtgtacaaatcccctgtcgtgtcaggggatacttcacccaggcatctcagcaacgtgagctccaccggctctatcgacatggtcgactccccccagctcgccactctggccgatgaggtgtcagcctccctggccaagcagggtctatag

SEQ ID NO: 48821 - DNA, 795 bp, Artificial Sequence
  Description of Artificial Sequence: Synthetic coding sequence
acccgggaggccgagggcgccgacggcaagaccaagatcgccacccccaaaggacaagccaatgctacgcgaatccccgctaagaccccaccggcaccaaaaactccaccatccagcggcgagcccccaaagagcggggatcgatctggctacagtagccctgggagccccggcaccccggggagccggtctcgcacgccaagtctaccaactccccccactcgggaacccaaaaaagtggctgtagtgcggaccccacctaaatccccatcctccgccaagtctcggctccagactgcgcctgttccaatgccagatctcaaaaatgtcaaaagcaaaataggctccacggaaaacctcaaacaccagcccggaggaggcaaagtacagattgtgtataagcccgtcgatctctcgaaggttacctctaagtgcgggagcctgggaaatatacatcacaaacccggtggtggtcaggtcgaagttaagagcgaaaaacttgatttcaaggacagggttcagagcaaaataggatccctggacaatatcacccacgtacctggtggcggtaacaagaaaattgaaacacataagctcactttccgagaaaacgcaaaggcgaaaactgaccatggtgctgagatcgtgtacaaatccccggttgtgtctggcgacacttcccctcggcacttatccaacgtcagcagtaccgggtctattgacatggtggatagcccccaactggccacgctcgcagatgaagtttccgcctctctggcaaagcagggcctatag

SEQ ID NO: 48822 - DNA, 651 bp, Artificial Sequence
  Description of Artificial Sequence: Synthetic coding sequence
atggccgagccccggcaggagttcgaggtgatggaggaccacgccggcacttatggactcggcgatagaaaggaccagcgggagccgaagaaggtggcagttgtgcggactcctccaaagtccccgtccagtgccaagtcccggttgcagaccgcccccgtgccaatgcccgacctgaagaatgtgaaatctaagatagggagcactgagaacttaaagcaccagcctggcgggggtaaagtgcagatcgtgtacaagccagtcgatctctctaaagtgacatctaagtgcgggagcctcggcaacatccatcacaagccaggtgggggccaggtggaagtgaagagcgagaaactggatttcaaggatagggtccagtcaaaaattgggagtctggacaatattacgcatgtgcccggaggagggaataagaagatcgagactcataagctcacatttcgcgagaacgccaaggctaagactgaccacggcgccgagatcgtgtacaaaagcccagtcgtgtcgggtgataccagccctagacatctgtcgaatgtgtctagtaccggatcaatcgacatggtagattctccacagcttgccaccctggccgatgaagtctctgcctcgcttgccaaacagggactgtag

SEQ ID NO: 48823 - DNA, 1152 bp, Artificial Sequence
  Description of Artificial Sequence: Synthetic coding sequence
atggccgagccccggcaggagttcgaggtgatggaggaccacgccggcacctatggcctcggcgatagaaaggaccaggggggatatactatgcatcaggaccaagagggggacacggacgccggactgaaggccgaggaagcgggcatcggcgacacacctagtcttgaagatgaggctgctggtcatgttactcaggccaggatggtgagtaagtcgaaagacgggacaggcagtgacgacaagaaggctaagggggccgacggcaagaccaagattgctacacctcgtggagctgccccccccggccagaaaggccaagccaacgccacccggatcccagccaagactccaccagcccctaaaacgcccccatcaagtggggagccccctaagagcggtgatagaagcggatattccagtcctggaagccccgggactcccggctctagatcccgcactccaagtctcccgacccccccaactagagagcccaaaaaggtcgcagtggtgagaacacccccgaagtcacctagctccgccaagagtcggctgcagaccgcacctgtacccatgccggatctaaagaatgtcaaatcaaagattggtagcacagaaaatctcaaacatcagccaggcgggggaaaagtgcaaatcatcaacaaaaagctcgatctaagcaatgttcaatctaaatgcggaagcaaggacaacataaagcatgtgcctggcgggggaagtgttcagatagtgtacaaacctgtcgacctctcaaaagttaccagcaaatgtggatctcttggaaacattcaccataagccaggaggagggcaggttgaggtgaaatccgagaagctggatttcaaagatcgcgtgcaaagcaagatcggatcactcgataacattacccacgtgcccggtgggggcaataaaaagatcgaaactcataagcttaccttccgcgagaacgccaaggccaaaaccgaccatggagccgaaatagtgtacaaatcaccagtggttagtggcgataccagccctagacacctttctaatgtgagttccacaggtagtatagatatggtggatagtccgcaactcgccactctggctgacgaggtttccgcgtcactcgccaaacaggggctttag

SEQ ID NO: 48824 - DNA, 951 bp, Artificial Sequence
  Description of Artificial Sequence: Synthetic coding sequence
atgctgcgggccctgcagcagcggaagcgggaggccggcatcggcgatactccttctctggaggacgaggcagcggggcacgtcacacaagcccggatggtgagcaagagcaaggatggcactgggagcgacgacaagaaggctaagggcgcagacggaaaaaccaagattgcaactccgcgaggcgcagccccccccggacagaagggtcaggccaatgctaccagaattcccgcaaaaacccctcctgcccccaaaacccccccaagcagtggtgagcctcccaagagcggcgataggagtggctatagcagccctggctcccccggaacacctggcagtcgcagccgtacgccatccctcccgacaccgccgacccgtgaaccaaagaaagtggccgtagttcggactccacccaaaagccctagttctgcaaaatctagactccagacagcaccagttcctatgccagacctgaaaaatgtgaaatctaaaattggctctacggaaaacctgaaacatcagcctgggggcggcaaagtccagattgtgtataagcctgtggacctgagcaaggtgacttccaagtgtggttcactgggtaatatacatcacaagcctggcgggggacaggtggaagttaagagcgagaagctggacttcaaggacagagtccagtctaaaatcgggtcacttgataacatcactcatgtacctgggggcggaaacaagaagatcgagacacacaagctgaccttccgcgaaaatgcaaaggctaaaacagaccacggtgccgaaatcgtctacaagtcacccgtggtgagcggggacacaagtccgcggcacctgagcaatgtttccagcaccggtagtatcgacatggtcgacagtccccagctggcaacacttgccgacgaggtctcagcatctctggcaaagcagggcctttag

SEQ ID NO: 48825 - DNA, 2277 bp, Artificial Sequence
  Description of Artificial Sequence: Synthetic coding sequence
atggccgagccccggcaggagttcgaggtgatggaggaccacgccgggacatacggtttgggagatcgtaaagaccagggcgggtacacaatgcaccaggaccaggagggcgacaccgatgccggactgaaggagagcccgttgcagactccaacagaggacggcagcgaagagcctggcagtgaaacctccgatgcgaaatccacaccgacggccgaggacgtaaccgcaccacttgtggatgaaggcgctcccggaaaacaggctgccgcacagccgcacacagagattcccgaaggcactaccgccgaggaggccggcattggcgacacaccatctttagaggatgaagccgccggacatgttacccaggagcctgagtcaggaaaggtagttcaggagggcttccttcgagaacctggccctcccgggctaagtcaccagctgatgtcgggaatgcctggcgccccgctgctccctgagggacctagagaggccacacgccagcccagcgggacaggccccgaagacacagagggcggccggcacgctcccgagttgttgaagcaccagcttctcggggacttgcaccaagaaggtcccctcttgaaaggcgcaggaggcaaggaacgcccaggttcaaaggaggaggtcgatgaagatcgagacgtggatgaatccagcccacaggatagccctcccagcaaggcaagccccgcccaggacgggaggcctccccaaacggctgctcgggaggcaacaagcatccctggattcccagcagagggggctattccgttaccagtggattttctgtccaaggtgtctaccgagatacccgcttctgaacccaatggcccttcagcaggacgggctaaggggcaagacgcacctctggagtttacattccatgtagagattacacccaatgttcaaaaggaacaggcccatagtgaggagcacctgggaagggcagctttccccggcgcaccaggcgagggcccagaagcgagaggccccagtctgggagaagacaccaaggaggctgacctgcccgagccgtccgaaaagcagcctgctgcagcgccaagaggcaagcccgtgagctgggttccccagctaaaggcaaggatggtgtctaaatcgaaggatggaaccggttccgacgacaagaaggcaaaaacctccacgaggtctagcgccaagaccttgaagaacagaccctgcctgtccccaaagcaccccacgcctggttccagtgacccactgatacagccttcttcccccgcagtgtgccctgaaccccctagctctcccaagtacgtatccagtgtcactccgaggacaggctcctctggggccaaagaaatgaaactgaaaggcgcggacggaaagaccaagatcgccacacctagaggggccgctccaccaggccaaaagggccaggctaatgcgaccaggattcccgctaagaccccaccggcgcccaaaacacctcctagctctggcgagccaccaaaaagcggggatcggtccggctacagctcacccggctcccccggcacacctggtagccgcagcagaactccctccctccccacaccgccaacacgagagcccaaaaaggtcgcagtcgtgagaaccccacctaaatccccttcttcggcaaaaagccgattgcagaccgcccccgtcccaatgcccgatctaaagaatgtcaagtccaagataggatctactgaaaacctaaagcatcagcccggcggcggaaaagtgcagattattaataagaaactggacctgtcgaacgtccagtcaaaatgtggctccaaggataacattaaacacgtccctggaggcggtagtgttcagatcgtgtacaaacccgtggacctttctaaagtgacctcgaaatgtgggtccctgggcaacattcatcacaagcccgggggcggccaagtggaggttaagtccgagaagcttgatttcaaggacagggtgcagtcaaaaatcggatcgttggacaatatcacccatgtgcccggcgggggaaataagaagattgaaacacacaagctgacttttcgcgagaacgccaaagctaagacagaccacggagccgaaatcgtttataaatcgccggtggtgtcaggcgatacgtccccaaggcatttgtctaacgtttcgtcaacgggatcaattgacatggtggactccccccagctcgcaaccttagcagacgaggtatccgcatccctagccaagcagggcctgtag

SEQ ID NO: 48826 - DNA, 2331 bp, Artificial Sequence
  Description of Artificial Sequence: Synthetic coding sequence
atggccgagccccggcaggagttcgaggtgatggaggaccacgccggaacctatggtctcggagataggaaggaccaggggggatacacgatgcaccaagatcaggagggagatacagatgctggattaaaggagtctcccttgcaaacacccactgaggatgggtctgaggagcccggtagcgagacaagcgacgctaagagtacccccacagccgaggacgtgacagcaccccttgttgatgaaggggcccctggcaaacaagcggccgctcagccacatacagaaatccccgaagggacaaccgcagaggaagcgggcattggtgacaccccaagcctcgaggacgaagccgccggtcacgtgacccaggagcccgagagcggcaaagtggtccaagaggggtttcttagggagccaggcccgccaggcctgagtcaccagctgatgtccggaatgcccggcgcccctttattgcccgaaggcccgcgcgaggccactcgacagcctagcgggaccggacccgaggataccgagggtggccggcatgcacctgagcttctcaagcaccagctgttgggagacctgcaccaggagggccccctgctgaaaggtgccggagggaaggaaaggcccgggtccaaggaggaggttgatgaagacagggatgtcgacgagtcgtccccacaggattctcctccgtcaaaggcatctccagcccaggacggacggccgccacagacggcagcgagagaggctacttcaattcctggatttcccgcagaaggtgcaattcctttgccagtggacttcctctctaaagtgtcgacggagattcctgctagcgaaccaaacggtccctccgccggcagggccaaggggcaggacgcccctcttgagttcacattccacgtggaaatcaccccaaacgtgcagaaagagcaggcgcactcagaagagcacctgggacgcgccgcttttcctggggctccgggagagggacccgaagccaggggtccatccctgggggaggataccaaagaagctgatttaccagaacccagtgagaaacagccagcggccgctccgaggggcaagccagtctcctgggtgccacagcttaaagcccgtatggtcagcaagagtaaagacgggaccggttctgatgacaaaaaggcaaagacctctacccgatcctccgcaaaaactttaaaaaaccggccgtgtctctcccccaagcaccctaccccaggtagttcagacccactgattcagccatctagtcctgccgtttgtcctgagccaccttcttcacctaaatatgtttctagcgtcactcctcgcaccgggtctagcggggcaaaagaaatgaagttgaagggtgccgacggaaaaaccaagattgctaccccacgaggcgccgctcctcctggccagaaagggcaggctaacgccacgcgaatccccgctaagacgccccccgcacctaaaactcccccatcctccgccactaaacaggttcagaggcgcccaccccctgcaggcccgcggagtgaacgcggagagccgcccaagtcaggcgaccgtagcggttacagctctcctggctctccaggaacacctggctcccggagccgcaccccttctctccccacacctccaacgcgagaacccaaaaaggtcgctgtggtccggactcctcccaaatccccctcctccgccaaatcccgtctccagactgcacctgtgcccatgccagaccttaagaatgttaagtcaaagattggctctacggagaatctcaaacaccaaccagggggtggtaaggtgcagatcatcaataagaagctggatctctccaacgtgcaaagcaaatgcggctctaaggacaacatcaaacacgtgcccgggggtgggtccgtgcagattgtgtataagccggtggatctgagtaaagtgacatccaaatgcggaagtctagggaacattcatcataaaccaggcgggggtcaggtggaggtaaaatctgagaaattggactttaaggaccgcgtgcagtcaaagatagggtcactggataacatcacacacgtccccggcggtgggaacaagaaaatagaaacacacaaactgacattcagagaaaatgcaaaggcaaagacagatcacggcgccgaaattgtgtacaaatctcctgtcgtcagtggggatactagccctcgacatctgagtaatgtcagctccaccggctcaatcgacatggtggattcaccccagcttgcaacactcgccgacgaggtaagcgcctctctggctaaacaagggctctag

SEQ ID NO: 48827 - DNA, 1233 bp, Artificial Sequence
  Description of Artificial Sequence: Synthetic coding sequence
atggccgagccccggcaggagttcgaggtgatggaggaccacgccggaacctacggactgggtgatcgaaaggatcagggtggatacactatgcaccaggatcaggagggagatacggatgctggacttaaagaaagccctctgcaaaccccaactgaggacggtagtgaggaacccggttccgagacgtcggatgcaaagtccaccccaacggctgaggacgtgacagctccactcgtggacgagggggcccccggtaaacaagctgccgcacagccccacacagagatccctgagggaacaacagccgaagaggccggaatcggcgataccccttcactggaagacgaggccgcagggcacgtgactcaggcgcgcatggtttctaaaagcaaagacggcaccggatccgatgataaaaaggctaaaggggccgacgggaaaaccaaaattgcaactccgcgcggcgccgctccacctgggcagaaagggcaagcgaacgctacgaggatacctgcaaaaacacccccagcaccaaagactccaccttcttctggggagcccccaaagagcggcgatcgttccggctatagcagccccgggagccctgggacaccaggttcccgaagtcgcaccccctctttacctacacctcccacaagagaacctaagaaggtggcagtggttaggaccccgcccaaaagcccgagcagcgccaagtcacgactccagaccgcccctgtgccaatgcccgatctgaaaaatgtcaagagtaaaatcgggagtactgaaaatctgaagcatcagccaggaggcgggaaggtacagattgtgtacaagcctgtggatctcagcaaggtaactagcaaatgcggctcacttggtaacatccaccacaagcccggagggggccaggttgaagttaaatcagaaaagttggatttcaaggatcgcgttcaatcgaaaattggctcactcgataatataactcacgtgccagggggtggcaataaaaagatcgaaacccataagctgaccttccgggaaaatgcaaaggctaagaccgaccacggggccgagatcgtctacaaaagtcccgtggtgtcaggcgacacttccccgaggcacctttcaaacgtgagttcaaccggatcaattgacatggtagactctccacagctcgctaccctcgccgacgaggtgtctgcttctctggccaagcaaggactctag

SEQ ID NO: 48828 - DNA, 1167 bp, Artificial Sequence
  Description of Artificial Sequence: Synthetic coding sequence
atggtggaggccgaggagctggcccagctgcggctgctgaacctggaactactcagacagttgtgggttggacaagacgccgtgcgtcggtccgtggcacgcgctgcatccgaatcttcgctggagtccagcagctcctataactccgagaccccttctacacccgagacgtcttcgacctccctgtctacaagctgtccaagaggaaggtccagcgtttggggacctcctgatgcatgccggggggatctgcgcgatgtcgctaggtccggagtggcttccctaccccctgcaaaatgtcagcatcaagaaagtctaggaaggcctcggccacacagcgccccctccctgggaacctcctccctgcgggatcccgagccctctggcagacttggcgaccccgggccccaggaagcgcaaacacctcggagtatcctcgcccagcagtcaaagctgagcaagcctagggtcacattctctgaagagagtgcggttccaaaaagaagctggcggctccggccatacctggggtacgactggatcgctgggtcattggatacatcttcaagcattacaagtcagcctgaggcgtttttttccaagttacaggagtttcgcgagacgaacaaagaggaatgcatctgctcacaccccgagccacagctgcccggcctgcgggaatccagtggctccggtgtggaggaagaccacgagtgtgtttattgttaccgtgtaaatcggagactatttccggtgcctgttgatcctggaaccccttgtcgcctttgccgcactccgcgagatcagcagggccccggcacccttgcccagccagctcacgtgcgcgtgagtattcccctgtctatacttgaaccccctcataggtaccacattcatcggcggaagagcttcgacgcctctgacacactagctctccctagacattgtctgcttggttgggatatcttcccgccaaagtcggagaaatcaagtgccccgcgaaatctcgatctttggagctctgtctctgccgaggcgcagcaccagaagcttagtggtacctcctcccccttccacccagcatcacccatgcagatgctgcctccaactccaacatggagcgtgccccaggtccctcgtccccatgtgccaaggcagaagccgtag

SEQ ID NO: 48829 - DNA, 1077 bp, Artificial Sequence
  Description of Artificial Sequence: Synthetic coding sequence
atggtggaggccgaggagctggcccagctgcggctgctgaacctggaactactgagacaactgtgggtgggccaagatgcagtcaggaggtccgtagcaagagccgcctccgaatcatcccttgaaagctcaagttcctacaattctgagactccctctacacccgagacctccagcacatcactgtcaacgtcttgcccacgtggacgttcgtcggtctgggggcctccagatgcatgccgcggcgatctgagagatgtcgcaaggagcggcgttgccagtttgcctcccgctaagtgtcagcaccaggaatcgctcgggagaccacggccccacagcgctcccagtttgggaacctctagtctgcgggatcccgagccctccggaaggctaggagatccagggccgcaggaggctcaaacacctcggagcattctcgcccagcagtcaaaactgtccaaaccccgagtgacattcagtgaggagtcagccgtacccaagagatcttggcggctgcgaccctatctcggatacgattggattgccggttctctggatacttctagctctatcacttcccagcctgaagcctttttctccaagctgcaggagttcagggaaaccaataaggaggaatgtatttgcagccatccagagccccagttacccggactcagggagagtagcgggtccggagttgaagaagatcatgaatgcgtgtattgctaccgcgtgaacaggagattgttcccggtacccgttgacccaggcaccccgtgtaggctgtgcagaacaccacgcgaccagcagggtccgggtaccttagcccagccagcccatgtgagtacagcatgctgggcgggcaccttcttcctcaggagccttcgtaaagctcagccccccggtacctggactagcggccctctgtcacccctgcgacccagcactagaagctgccccgctcccgccgcattattcacacgcccccatcagtgcagatgttgcccaaggccgaggcccggccagtgtccacgctcccttgggcccacctctcatggccgttcccccgaggactag

SEQ ID NO: 48830 - DNA, 2070 bp, Artificial Sequence
  Description of Artificial Sequence: Synthetic coding sequence
agcagcggcctgaccgtgaccgccgtgaaggacagcggcgagtggaatttagaggccggagccctcgtcttggctgatgccggcctctgctgcattgacgaattcaattctctgaaggaacatgaccgcacgtcgattcatgaagcaatggagcagcaaaccattagtgtggctaaagctggactcgtgtgtaagttgaatactaggaccactatcctggccgcaacaaacccaaagggacagtacgaccctcaggaaagtgtgtcagtaaatatagccctgggtagcccccttctgagccgattcgatctaatcctggttttacttgatactaaaaacgaggattgggaccgcataatttctagtttcatcctcgaaaacaaggggtatccgtcaaaaagtgagaagctttggagtatggaaaaaatgaagacttatttctgcctcatcagaaatctgcagcccacattgtctgatgtgggaaaccaagtgcttctccggtactatcagatgcaacggcagtcggattgtcgcaacgccgcgaggaccaccattcggttgctcgaaagtctgatcaggcttgccgaggcccatgcaaggttaatgttcagggacaccgtcaccctggaagacgcaattactgtggtcagcgttatggagagttctatgcagggcggcgccctgctgggcggagtcaacgctttacatacgtcttttccggaaaatcccggcgagcagtaccagcggcagtgcgagttgattctggaaaaacttgaactgcagagcttactcagcgaggaactgcggcggctggagcgtctgcagaatcaatccgtgcatcaatcccaaccccgagtgctcgaggtcgaaacgacgcctgggagtctgaggaatgggccaggtgaggagtccaacttccgaacttcatcacaacaggaaatcaactattctactcatatctttagtcctggaggctcaccagaaggctcacccgtgctggacccccccccacatcttgagccgaatagatcgactagcaggaagcacagcgcccagcacaagaacaacagggatgacagtctggactggttcgactttatggctacccatcagtcagagcccaagaataccgtggtggttagtccgcaccccaaaacctcgggcgagaatatggctagcaaaatctcgaactccaccagtcagggcaaggagaaatctgagcctgggcagaggtcaaaggtcgatataggactcctcccgagcccaggggagactggggtaccatggagagcagacaatgtggagagcaacaaaaaaaagcggctggccttagacagcgaggccgccgtctctgccgacaaacctgattcagtgctcactcatcacgtaccaaggaaccttcagaagctgtgcaaagaacgagcccagaaactctgtcgaaacagcacaagggttcccgcacagtgcacggtcccctctcacccccagtctacgcccgtacacagcccggacaggatgctggactcccctaagaggaagcgtcctaagtcactagctcaggttgaggagcctgcaatcgaaaacgtgaaaccccctgggtcacccgtagcaaaactggcaaaatttactttcaagcaaaagtccaagttaattcatagctttgaggaccacagccacgtgtcaccaggagcaacgaaaattgctgttcactcacctaagattagccagcggcgtacaaggcgggatgcagccctcccagtgaagcggcctggaaagcttactagcactccagggaaccagatcagctcgcaaccccaaggcgagacgaaggaggtgtcccagcagccccccgagaagcacggaccacgagagaaggtcatgtgcgcacccgagaaacgtataattcagccggaactggaattggggaacgagaccggctgcgcacacttaacttgtgaaggggataaaaaggaagaggtgtctggcagtaataaatcaggcaaagttcacgcctgtaccctcgccagactggctaacttttgttttacccccccatcagaatctaagtag

SEQ ID NO: 48831 - DNA, 1176 bp, Artificial Sequence
  Description of Artificial Sequence: Synthetic coding sequence
atgaacagcgaccaggtgaccctggtgggccaggtgttcgagagctacgtaagtgaatatcacaagaacgacattttgttgatcttaaaagaacgagatgaagacgctcactacccagtcgtcgtcaacgccatgactttattcgaaactaatatggagatcggggagtattttaatatgtttccctccgaggtcctgactatatttgacagcgctcttaggaggtcggcattaactattctacagtccctgtctcagcccgaggccgtttcaatgaagcagaaccttcatgcccgcatttcaggcctcccggtttgccccgagttagtgcgcgaacacataccaaaaacgaaggacgtggggcacttcctctcggtcactggaacggtgatccgcacgtctctggtcaaagtgttagagttcgaaagagattatatgtgtaacaagtgcaaacatgtgttcgtcatcaaagccgatttcgaacagtactacaccttctgtcgcccgtcttcttgcccttctctggagagctgcgactcaagtaagttcacctgtctatccgggctttcaagcagcccaaccagatgtcgcgattatcaggaaattaaaatccaggaacaggtccagagactgtctgtgggctcgatcccccgatcaatgaaagtcatcctggaggatgacctcgtcgatagctgcaaaagcggagacgaccttaccatttacggtatcgtgatgcagcgttggaaaccttttcaacaggatgtgagatgtgaagtcgaaatagtgttgaaggccaactatatccaggtgaacaatgagcagtcctcggggatcatcatggatgaggaggtgcagaaagaattcgaagatttttgggagtactataagagtgacccttttgcgggtcgaaacgttattctcgcttccctgtgtcctcaggtttttggaatgtatctggtaaagttagccgttgccatggtgctggccggcggcatacagcggacagatgctacgggaactcgggtgcgcggcgagagtcacctcctgctagtaggcgatcccggtaccggaaagagtcagtttcttaaatacgctgccaagattacccctcgctcggtacttactactgggattggaagtacatccgctggtatagtctgtgataacttcaagtag

SEQ ID NO: 48832 - DNA, 3432 bp, Artificial Sequence
  Description of Artificial Sequence: Synthetic coding sequence
atgaacagcgaccaggtgaccctggtgggccaggtgttcgagagctacgtctccgagtaccacaagaacgatattttgctcatactgaaggaacgggacgaagacgctcattacccagtggtggtcaacgcgatgaccctcttcgagacgaacatggagattggtgagtatttcaacatgttcccaagtgaggtgctgacaatattcgactcagccctcagaaggagtgcgcttactattttgcagagtctcagccagcctgaagcagtgagcatgaagcagaacctacatgcacgcataagcggtctgccagtatgccccgaactggttcgggagcatatccctaaaacaaaggatgtggggcatttcctctctgtgacagggacagtcattcgcactagtctggtgaaggtgctcgaattcgaacgcgattatatgtgcaataagtgcaaacatgtattcgtgattaaggcagacttcgaacagtattacaccttttgcaggcccagttcatgccctagcctcgagtcatgcgatagttcaaaatttacatgcttaagtggattatcctcttcacccacccgatgccgcgactatcaagagatcaagatccaggagcaggtgcagcggctaagtgtgggttccatcccccgcagtatgaaagttatcctcgaggatgacctggtggactcctgcaagagtggggacgatctgacaatctacgggattgtcatgcaacgctggaaacccttccagcaggacgtccgctgtgaagttgagatagtgctgaaagctaattacatccaagttaacaatgaacaaagctcagggatcatcatggacgaagaggtgcagaaggaattcgaagacttttgggaatattataaatctgatccctttgcaggccgtaacgtgatccttgcctccctgtgtcctcaagtttttgggatgtatctggtgaagctcgcagtggcaatggtcctcgccggtggaattcagagaaccgatgcaactggaaccagggtgcgcggggagagtcacctactgctggtaggagatcccggcactggcaaaagtcagttcctgaaatatgccgccaagatcactcctcggtctgtgcttacaactggtatcggatcaacttccgccggcctgaccgttaccgccgtaaaggattctggggaatggaacttagaggcaggtgcgttggtgttagcggacgctgggctgtgctgtatcgacgaatttaattccctgaaggagcacgatcgcacgtccatccacgaagcaatggaacagcagacaatctctgtggccaaagccggtctggtgtgcaagctgaatactaggacgacgatccttgcagccacaaaccccaaaggacagtacgatcctcaggagtccgtgtccgtgaacatcgcactcgggtcgccactactaagccggttcgacctgatcctggtgctgctggacactaagaacgaggattgggaccgaataatttcttccttcattctggaaaacaaagggtacccgagcaagagcgagaagctctggtccatggagaagatgaaaacatacttttgtctaatccgaaatttacaacctactttatctgacgtgggaaaccaggtcttgctccgatattatcagatgcagcgccagtctgattgccgaaatgccgcccgaaccaccatacgcctgctggagagcctcattcgcctggcagaagcccatgctcggctgatgtttcgagataccgttaccctggaggacgccataacagtggtgtccgtgatggagagtagtatgcagggaggcgcccttttgggcggagtgaacgcgctgcatactagcttccctgaaaacccaggggagcagtaccagcgccaatgtgaactgatcctcgagaagcttgaactgcagtcactgctgagcgaagagctgagaagacttgagaggctgcagaaccagagcgtgcatcaaagccaaccccgcgtcttggaggtggaaaccacccccggcagcctcagaaacgggcctggggaggagtccaacttccggacctcatcccagcaagagatcaattacagtactcatatcttctccccgggaggcagtcctgaggggtccccagtgctggatcctccaccacacctggagccaaacagatccacatctaggaagcactcagctcagcataagaacaacagggatgactctctggattggttcgatttcatggccacacatcaatccgagcccaagaacacagtggtggtttctcctcatccaaaaaccagtggggaaaacatggcctcaaagattagcaatagcaccagccagggaaaggagaaatcagagccgggtcagaggtccaaagtcgacatcggcttgctgccaagccccggcgagacaggagtgccctggagagcggataacgttgagtccaacaaaaagaaacgactggcactggactcagaggccgcagtctcagctgacaaacccgactccgtgttaactcaccacgtgccacgcaatctccagaagttgtgtaaggaacgagcccagaagctgtgccgaaatagtacacgcgtgcccgcacagtgcaccgtcccctctcaccctcagtctaccccagttcactcccccgaccgcatgctggattcccctaagcgaaaacgtcctaagagcctcgctcaggttgaggagcctgctattgaaaacgtgaaacctccaggcagccccgtggcaaaactggcgaagtttacgttcaaacagaagagcaaactgattcacagttttgaggaccactcccacgttagccccggggcaacaaaaattgctgtgcacagtcccaaaatttcacagagaaggaccaggcgggacgcagcccttcccgttaagaggcccggtaagctcacctccacccctggcaatcagataagttctcagccccaaggagaaactaaagaggtgtctcagcagccacctgagaagcacggaccacgcgagaaagtgatgtgcgctcccgaaaagagaataatccagccagagttagaactcgggaacgaaactggttgtgcacacctcacatgtgagggggataagaaagaggaggtcagtggtagcaacaagtccggcaaagtgcacgcttgtacgctagctcgactagctaatttttgtttcaccccaccttctgaatcaaaaagcaagagccctccacctgaaaggaagaatcggggcgaacggggtccatctagccctccaaccacgactgcgcccatgcgagtgagtaaaaggaaatcatttcagctgaggggaagcacagagaagctgattgtatctaaagagagcctgtttacactgcctgaactgggcgatgaggcttttgactgcgactgggatgaagaaatgcggaaaaagtcctag

SEQ ID NO: 48833 - DNA, 471 bp, Artificial Sequence
  Description of Artificial Sequence: Synthetic coding sequence
atgaacagcgaccaggtgaccctggtgggccaggtgttcgagagctatgtgtcagagtatcataagaacgacatactgctaatactgaaggagagagatgaggacgcccactatccagtcgtggtcaatgctatgaccctttttgaaacaaatatggagatcggtgaatacttcaacatgttcccctcggaagtgcttacgatctttgacagtgctctgcgtcggagtgccctcactatactccaatctctttctcagcccgaagctgtgtctatgaaacagaatctgcatgcccgaatctccggattaccggtatgtcctgagttggtgcgtgagcacattccaaaaacgaaagatgtaggccactttctgtcagttaccggcaccgtgatcagaacctctctcgtgaaagtgctggaatttgaaagagactatatgtgcaataagtgcaagcatgtgttcgtgatttag

SEQ ID NO: 48834 - DNA, 237 bp, Artificial Sequence
  Description of Artificial Sequence: Synthetic coding sequence
atgaacagcgaccaggtgaccctggtgggccaggtgttcgagagctatgtgtcagagtatcataagaatgatatcctgttaatcctcaaagaacgagacgaagacgcccattatcccgtggtggtgaacgccatgactctcttcgaaacaaatatggagattggggagtattttaacatgtttcccagtgaggtactgaccatcttcgattccgccctcagaagatctgcgttatag

SEQ ID NO: 48835 - DNA, 2628 bp, Artificial Sequence
  Description of Artificial Sequence: Synthetic coding sequence
atgagcggcaccaagcccgacatcctgtgggccccccaccacgtggatcgcttcgtcgtctgtgattcggaattaagcctctaccatgtcgagagcacagtcaactctgaactgaaagctggaagtcttcggctgtctgaggacagcgctgctacactcctctctattaattctgacacgccttatatgaaatgcgtggcctggtatctgaattatgacccggagtgcctactagcggtaggacaagctaacggacgcgtcgtcttgacctctctaggccaggaccataatagcaagttcaaagacttgattgggaaagagttcgtgcctaagcatgcgcggcagtgcaacacgcttgcatggaaccccctggactcaaactggttggccgccggcctggataagcatcgggcagactttagtgtgttaatttgggatatatgctccaagtacacacccgacatagtgccaatggagaaggtgaagctgtcagcaggagagacagaaaccaccttgctggtgactaagccactctatgagcttggccagaacgatgcatgtctgagtctttgttggctgccacgcgaccagaaactgttgctggcaggcatgcatagaaatcttgcaatctttgacctgcggaatacatcccagaagatgttcgtgaatacgaaggccgtccaaggagtaaccgttgatccatatttccacgatagagtcgcctcattctatgagggacaggttgctatctgggatctcaggaagtttgagaagcccgtcctgacactcaccgaacaacccaagcccctcacaaaggtcgcatggtgccccactcgcactggactcctcgcaactctgacaagggacagtaacattatcagactctacgatatgcagcataccccaactccaattggcgatgagacagaacccaccatcatcgaaagatcagtgcagccttgcgacaattatatagcctctttcgcctggcatccaacatcccagaataggatgatcgtcgtgacccctaaccggacaatgtcggactttactgtgttcgagcgcatttccctggcatggagtcctatcacgtcccttatgtgggcttgcgggcggcacctgtatgagtgtaccgaagaagagaatgataattccctggaaaaggacatcgccactaagatgaggctgcgggcattgtctcgctatgggctggacactgagcaggtatggaggaaccatatcctcgctgggaatgaagatcctcagctaaagagtctttggtatacattgcactttatgaaacagtacaccgaggacatggaccagaagagccctggcaacaagggttcactggtgtatgccggcatcaaaagtatagttaagagttccctgggcatggtggagagcagtcggcacaattggtctggcctcgacaagcagtctgacattcaaaacttaaacgaggagagaattctggcactgcagctctgtgggtggattaaaaagggaaccgacgtggacgttgggccgttcctgaactctctggtgcaggagggtgagtgggagcgcgccgccgcggttgccctcttcaacctggacattagaagggcgatacagatactgaacgagggggcttcgtccgagaagggggatttaaatctgaacgttgtggcaatggccctgtccggatacaccgacgagaagaattctctgtggcgcgagatgtgttccaccctgcggctgcagcttaacaatccgtatctgtgcgtcatgttcgcctttctgactagcgagacagggtcctatgacggggtgttatacgagaataaagtcgctgtgagagatcgcgtcgcattcgcatgcaagttcctgtctgacacccagttaaatcgctatattgaaaagctgactaacgagatgaaggaagccggcaatttggagggaatcctgctgacggggctcaccaaggacggggttgacttgatggaatcttatgtagaccgaaccggagacgtccagacagcttcttattgtatgctgcaaggtagtcctctcgacgtgctcaaggatgagcgagttcagtactggatagagaattacagaaacctcctggacgcatggaggttctggcataagcgcgctgagtttgatatccataggtctaaactggaccccagtagcaaacccctagctcaagtgttcgtgtcatgtaacttttgtggtaagtccatcagctattcttgctcagcggtgcctcaccaaggtaggggattcagtcagtacggcgtgtctggcagccctaccaagtctaaggtcaccagctgccctgggtgtagaaagcctttgccccggtgcgctctatgtcttatcaacatgggaacacccgtatcctcctgccccggcgggaccaagagtgatgaaaaagttgacttatcaaaggataaaaaattagcacagttcaataactggttcacatggtgccacaactgtaggcacggcggtcatgccggccacatgttatcatggttccgggatcatgcagagtgtccagtgtcagcttgcacttgtaagtgcatgcaactggacaccacaggcaatctcgtgcctgcggagaccgtgcagccatag

SEQ ID NO: 48836 - DNA, 2628 bp, Artificial Sequence
  Description of Artificial Sequence: Synthetic coding sequence
atgagcggcaccaagcccgacatcctgtgggccccccaccacgtggatagatttgtggtgtgtgattccgagctcagtctgtaccatgtggaatcaaccgttaacagcgaattgaaagctgggtcacttcgcttgagcgaggacagcgcagccaccctcctttctatcaatagtgatactccctacatgaaatgcgtggcttggtacttgaactatgatcctgagtgcctcctggccgtcggccaggctaatggccgggtagttctaacgagtttgggtcaggaccataattccaagttcaaggacctcattggtaaggaatttgtgcctaaacacgcacgccaatgcaatacattagcttggaatcctctagacagcaactggttagccgctggcctggacaaacacagggccgatttcagtgtcttgatctgggatatatgcagcaaatatacccccgacatcgtgcctatggagaaggtgaaactctccgccggagagacagaaactacgctgttggtgactaagccactatatgagctgggccagaacgatgcctgcctctccttatgttggcttcctcgagaccaaaagctattgctggcgggcatgcatcgcaacctcgcaattttcgatctgagaaacaccagtcagaagatgtttgttaacactaaagctgttcaaggtgttaccgtggacccttacttccatgaccgtgttgctagcttttacgaagggcaagtcgccatctgggatctccgcaaattcgaaaaacctgtgttgactctgaccgaacaacccaaacccttgactaaagtggcctggtgtcctacaagaacaggcctcttagccaccctcactagagattcgaacataatcagactctacgatatgcagcacactcccaccccaatcggggacgaaaccgaacccaccatcatagaacgttcagtccagccctgtgacaactatattgcctcttttgcgtggcaccccacatcccagaaccgcatgatcgttgtaacgccgaaccgaacaatgtcagatttcaccgtgttcgaaagaatcagtctggcgtggtcacctattaccagtcttatgtgggcatgcgggcgccacctttatgaatgtacagaagaagaaaatgacaattccttggagaaagacatagctacaaaaatgagactgcgcgcattgagcaggtatggactggatactgagcaggtttggcggaaccacatcctggccggaaacgaagatccacaattaaagagtctctggtatactctgcacttcatgaagcagtacaccgaggacatggatcagaagtccccagggaacaaagggtcccttgtatacgccggcatcaagagcatcgtcaaatcgagtctggggatggtcgagagtagccggcataactggtccgggctggataagcagtctgacatccaaaacctgaacgaggaacgcatcttggctcttcaattatgtggatggatcaagaagggaacagacgtggacgtcggccctttcctgaacagtcttgtgcaggagggtgaatgggagcgggccgctgccgtggccctcttcaacctggacattcggagagcgatccaaatactcaatgagggggcatctagcgagaagggtgacctcaatctgaacgtggtcgctatggcactcagcggatatactgacgagaagaactcactctggagagaaatgtgctccaccttacgccttcaacttaacaatccctacctatgcgtgatgttcgcattcttgaccagcgagaccggtagctacgacggcgtgctgtacgagaataaagtggctgttcgcgaccgtgtcgcgtttgcatgtaagtttctgtctgacactcagctgaaccgatacattgaaaagttaaccaacgaaatgaaggaagctggaaacctcgaagggatactgttaaccgggctcaccaaagacggcgtcgacctgatggagtcttacgtggaccgaacgggcgacgtgcagaccgctagctattgcatgcttcaagggtctcccctagacgtgttgaaagacgaacgcgttcagtattggatcgaaaactatagaaacctgctggacgcgtggcggttctggcataaaagagcggaattcgatatacaccgcagcaaacttgacccctcatcgaaacccttggcccaggtattcgtgagttgcaacttctgcgggaaatctatatcctactcatgtagcgctgtgcctcaccagggcagagggttttctcagtacggtgtctcgggtagcccaaccaagtccaaggtgacctcctgtcctggctgtcgcaagccgctccccagatgcgcactttgcctgataaatatgggcaccccagtcagcagctgcccgggcggcactaagtcagacgaaaaggtggacctgtccaaggataaaaaactggcccagttcaataactggttcacctggtgccacaattgcagacacggagggcacgcaggtcacatgctgtcctggttccgagaccatgccgaatgtccggtgagtgcctgcacctgcaagtgcatgcagttggacacaaccggaaatttagttcctgctgagacagtccaaccatag

SEQ ID NO: 48837 - DNA, 195 bp, Artificial Sequence
  Description of Artificial Sequence: Synthetic coding sequence
atgagcggcaccaagcccgacatcctgtgggccccccaccacgtggacagatttgtcgtgtgtgattccgagctgtctctgtaccacgtcgagagtaccgtcaactcagagctgaaggcaggcagcctccgccttagcgaggacagcgccgcaactctgctttccatcaactccgacacaccttacatgaaatag

SEQ ID NO: 48838 - DNA, 453 bp, Artificial Sequence
  Description of Artificial Sequence: Synthetic coding sequence
atgagcggcaccaagcccgacatcctgtgggccccccaccacgtggaccggttcgtggtttgcgattctgaactgagcctctatcacgtcgagagtaccgttaacagtgagttgaaggcaggctctctgcggctttccgaagattcagctgctaccttgctgtcaattaattcagacaccccctacatgaaatgcgtggcctggtacctcaactatgaccctgagtgcctcctcgccgtgggccaggcaaatggccgcgtggtgctcacatccctggggcaagaccataattccaagttcaaagacttaatcggcaaggaatttgtgcccaaacatgcccggcaatgtaatacactcgcttggaatccactcgatagtaattggctggctgccggcctcgataaacacagagctgacttctcagtgctcatctgggatatctgctcaaagtag

SEQ ID NO: 48839 - DNA, 195 bp, Artificial Sequence
  Description of Artificial Sequence: Synthetic coding sequence
atgagcggcaccaagcccgacatcctgtgggccccccaccacgtggataggtttgtggtttgcgactctgaactgagtctgtaccatgttgaatcaaccgtgaacagtgagttaaaggctgggagcctgaggctgtcagaagattctgcagcaactctgctttctatcaacagcgataccccctatatgaaatag

SEQ ID NO: 48840 - DNA, 540 bp, Artificial Sequence
  Description of Artificial Sequence: Synthetic coding sequence
atgagcggcaccaagcccgacatcctgtgggccccccaccacgtggataggtttgtggtatgcgattcggagctgagcttataccacgtggaatcgacagtgaattcagagcttaaggcgggatcactgagactgagcgaggacagcgccgctactttgctctccatcaactcagataccccctatatgaagtgcgtggcttggtacttgaactatgatcccgagtgtctgctggccgtgggccaggctaatggaagagtggtgctaacatccctcggccaggatcacaactccaagttcaaggatctcatcgggaaggagtttgtgccgaaacacgcccgccagtgcaatactctggcctggaacccacttgacagtaactggctggcagccgggctggataagcacagggcagacttctccgtcttaatatgggacatttgttcaaagtacactcccgatattgtaccaatggaaaaggtgaagctgtctgccggcgaaactgagaccacgctactggtgaccaagcctctgtactag

SEQ ID NO: 48841 - DNA, 789 bp, Artificial Sequence
  Description of Artificial Sequence: Synthetic coding sequence
atggccctgggcctgaagtgcagccggatggtgcaccccgccttcagaaactatctggctgctagcatccgccccgtctctgaagtcacgctcaagaaggtttacgaaagacagcatggtcatcggcaatatgtggcatacagcgctgtgccggtgcaccactttgccacaaaaaaggcaaaagccaaaggcaaaggcaaatcccaaacgagagtgaacattagcgccgccttcgtcgaggatatcattaacctggaggaagttaacgaggaaatgaagtcagtgattgaggctaggaaggacaactttaacaaaacactgaacattgggacatcaccaggatctctggacaagatcgcggtcgtaacagcagatggtaagctggctctgaaccagattcgccagatctctgtaaagttgccacagttaattcttgtaaatatggcaagctttccagagtttaccgtggccgcaatcaaagccatcagggaatccggaatgaatctcaatcccgaggttgagggtaccctgattagagtcccgattcctcaggtgatccgggagcatagggaaatgctggtgaagttagcgaaacagaacactaacaaggccacgtactcgctgagaaaggtgtgtacaaatgcaatgaacaagctaaaaaagtctaaggatacagtctcagaggggactatacgtctgactgagaagcagatttcccaaatggctgatgacacagtggccgagctgtaccggcatctcgccgttaagaccaaagagctgctcggctag

SEQ ID NO: 48842 - DNA, 738 bp, Artificial Sequence
  Description of Artificial Sequence: Synthetic coding sequence
atgagcgacgagttcagcctggccgacgccctgcccgagcacagcccggcaaaaaccagtgcggtgagtaataccaaacctggccagcctccccagggctggcctggctctaatccatggaacaatccatctgctccgtcctcagtgccatcaggcctccctccttccgcaaccccgtcgactgtgccgtttggaccggcaccgacaggaatgtacccttctgttccaccgacaggcccccctccaggtcccccagccccattcccaccctccggtccatcgtgtccgccacctggcgggccctatcccgcccccaccgttccaggccccggcccgacaggaccttaccccaccccgaatatgcctttccctgaacttccaagaccatatggcgcccctaccgaccccgcagccgctggtccattagggccttggggaagcatgtcctccgggccctgggcccctggaatgggcggccagtacccaactcccaatatgccgtacccaagccccgggccttaccccgctccaccccccccccaggcccccggggccgcacccccagtaccatggggtaccgttccccctggggcctggggacccccagctccctaccccgcccccacagggtcctatcctacaccaggcctctacccaactcccagcaatccgttccaggtcccatcggggcccagcggcgcgccacccatgcccggagggcctcactcctaccactag

SEQ ID NO: 48843 - DNA, 690 bp, Artificial Sequence
  Description of Artificial Sequence: Synthetic coding sequence
atgagcagccacctggtggagccccccccccccctgcacaacaacaacaataattgtgaagaaaatgaacagagtctgcctcccccagcgggattgaactcgtcgtgggtcgaactgcccatgaattcatcaaatggaaatgataatgggaatggtaagaatggggggctggaacacgtgccttccagctcttctatacataatggagatatggagaagattctcctcgacgctcagcacgagtcagggcagagcagcagtagaggctcgagccactgcgattcgcctagtcctcaggaggatggccagatcatgtttgacgtagagatgcacacaagccgggatcactcttcccagtccgaagaggaagttgtggaaggggagaaggaggtcgaagcactgaagaagagtgcagactgggtgtcggactggtctagcagacccgagaatattccaccgaaagagtttcacttcagacatccgaaacgtagtgtctcactctcaatgcgtaaaagcggcgcaatgaaaaaggggggaattttctccgcagaatttcttaaagtgttcatccctagtttgtttctgtcccatgtgctggctctgggccttggtatttacatcggcaaacggctatctaccccctgtcaacatttgctgcgggagaggaagtccccttggaagtgtgtgtag

SEQ ID NO: 48844 - DNA, 4044 bp, Artificial Sequence
  Description of Artificial Sequence: Synthetic coding sequence
atgcccgccgtgcgggtgtgggacgtggccgagcacagccaggtggcagaattgcaagagcataaatatggtgtggcctgtgtggcattctctccaagcgctaagtatattgtctcagtcggttatcaacacgatatgattgtcaacgtgtgggcgtggaaaaagaatattgtcgtcgctagcaacaaagtgtcatcccgagtcaccgcggtcagttttagcgaggattgctcatactttgtgacagctggcaatcgccatatcaagttctggtacttggacgactccaaaacctctaaggtcaacgccactgttcctctcctgggccgttctggcctcttgggagagctgcgcaacaatctgtttactgatgtggcctgcgggcgtggcaagaaagccgattccaccttttgcataaccagtagcggcctcctgtgcgaattctcagatcgtcggctactagacaagtgggtggaattaaggacaactgtggctcattgtataagtgttagccaggactatattttttgtggctgtgcggacggcactgtcaggctgtttaatcccagtaaccttcattttctgtctactctgcctaggcctcacgctcttggaacagatatcgccagcgtgaccgaggcctcccggttgttcagcggagtggccaatgctcgctatcccgatactatcgccctaacctttgaccctactaaccaatggctgagctgcgtgtataacgatcattcaatttatgtgtgggacgtcagggacccgaaaaaggtgggtaaggtatactcagcactgtaccattccagttgtgtttggtctgtggaagatctgataaagataatttacgttgatggcaatacacaggccctgctagacacagagctccccggcggagacaaggcggacgctagcttactggatcctcgggtcgggataaggagcgtctgtgtctcacctaacggtcagcacctcgccagtggggaccgcatgggtacactgagagtgcacgaactacagagtctgtccgaaatgctaaaagtggaggctcatgacagtgaaatcctgtgtctcgagtattccaagccagacactgggctgaagctgctcgctagcgcatcaagggaccgcctgatccatgtgctggatgcgggccgggaatattcccttcagcagacactggacgagcattcttcgtcgataaccgccgtgaaattcgccgccagcgacggtcaagtgcgtatgatttcctgcggagccgataagagcatatattttagaacagcgcagaaatcaggagacggcgtgcaattcaccaggacacaccacgtggtccggaaaacaacgctctacgatatggacgtcgagccctcctggaaatacacggccataggctgtcaggatcgcaacatccggatcttcaatatatccagtggaaagcagaaaaagctgttcaaaggaagccagggcgaagacggaaccctcattaaagtgcaaactgatccctctggcatctacattgctactagttgcagcgacaagaacctatcgatctttgatttctctagcggagaatgtgtggcaaccatgttcggccacagtgaaattgtgactggtatgaagttttcaaatgattgcaagcatttaatctcggttagcggagatagttgcatattcgtgtggaggctgagcagcgaaatgacaattagcatgcgccagcgactggcagaattgagacaaaggcaacgcggtgggaagcagcaaggcccaagcagccctcagcgggcctcaggaccaaatcgccatcaggcaccctcgatgctttcacctgggcctgcacttagttcagatagcgataaggaaggggaggatgaaggcaccgaggaagaattgcccgcattacctgtgctagctaaatcaaccaaaaaggcactggctagcgttccctctcctgcgctgccacggagcctaagccactgggagatgagtcgggctcaggagtctgtcggctttctggatcccgctcccgccgccaatcctgggcctcgccgccggggtaggtgggtgcagcctggtgtggaactgagcgtgcgcagcatgctagacctcagacagctggaaacgctggctccaagtctccaggatccatctcaggactcccttgctattattccaagtggccccagaaagcatggacaagaagccctagagaccagcctgacatcccagaacgaaaagcctcctcggccccaggccagtcagccatgttcctacccacatatcataagacttctcagccaggaggagggagtattcgcccaggacctggaacccgccccaatcgaggatggaatcgtgtatcccgaaccgtccgataaccccacaatggacacttccgaattccaggttcaggcccctgctcgtggcacattaggaagggtgtacccaggaagtagatcctccgaaaaacactcccctgattcagcatgcagcgtggattactcgtcctcctgcttgtcatcacccgagcaccctaccgaagactccgaatcgactgaaccactttccgtcgacggcataagctccgacctcgaagaacccgccgaaggtgacgaggaggaagaagaagaggagggtggtatggggccatatggcctccaggaagggtctccacagacgcccgatcaggaacaattcctgaagcaacacttcgaaaccctggcctctggagctgcccctggggccccagtccaggtgccggagcggtctgaaagccgttccatatcatctaggtttctgttgcaagtgcagactcggcccctgcgggagccctccccatcgtccagctcactggccttgatgtccagaccagcccaagtgcctcaggctagcggagaacagccccgcgggaatggagcaaatcccccgggcgccccacccgaggtcgagcctagctctgggaacccaagccctcagcaagccgcctccgtgttgctccctcgatgccgtctaaatccagactcaagttgggctcccaaaagggtggccacagcctcgcccttctctggtcttcagaaagcacagtccgttcactccctggttccacaagagcggcatgaggcatctcttcaggctccgagccccggtgcgttattgtcgagagagatcgaggcccaggacggcctgggatctctcccccctgccgacggccgcccaagtaggccgcattcataccagaaccccacgacatcaagcatggctaaaattagtcgcagcataagtgttggtgagaacctgggactcgtggccgagccccaagcccacgcacccatcagagttagtccactctctaaacttgcgcttccttctcgggcccatctggtgctggacatcccgaaacccttaccagaccgcccaacgttggctgccttctcacctgtcacaaaaggcagagccccaggggaggccgaaaaacctggttttcctgtggggctcgggaaagcccactccaccactgaacgctgggcctgcctgggcgagggcacaacgccaaaacctaggacggagtgccaggcccaccctggaccttctagcccatgtgcccagcagctacccgtatcgtctctctttcagggtccggaaaacttacagccgccaccccctgaaaagacccctaatcccatggagtgcactaagccaggggctgcattgagtcaagactcggaaccggccgtctccctggaacagtgcgagcaactggttgccgagctgaggggctcggtgcgacaggcggtgaggctgtaccattcagtggctgggtgtaaaatgccttcagcggaacagtcccgcattgcacaactcctgagagacacgttctcttcggtgaggcaggagctggaagccgtggccggcgccgtcctctcttctcccggctcttctccgggcgccgtaggcgctgagcagactcaggctctcctggagcagtactcagagctgctcctgcgggctgtggaacggcgcatggaaaggaagctgtag

SEQ ID NO: 48845 - DNA, 4545 bp, Artificial Sequence
  Description of Artificial Sequence: Synthetic coding sequence
atggccgtggagggcagcaccatcaccagccggatcaagaacctgttgcggagcccctctataaagctgcgaagatccaaggctggcaaccggcgcgaagatttgagctctaaggtgacacttgaaaaagtcttgggtattactgtcagtggaggaagagggctcgcctgcgacccacggagtgggcttgtagcctatcccgcgggttgcgtggtggttctgtttaatcctcggaagcacaagcagcatcacatcctgaactcctctcgcaaaacaatcactgccctcgcttttagcccagacggaaagtacctggtgacaggagagtcaggtcatatgccagcggtccgagtgtgggacgtggccgaacattcccaggttgccgaactccaggagcacaaatacggggtcgcgtgtgtggcgttcagcccaagtgctaagtacatagtgtcggtgggataccagcatgatatgattgtcaacgtttgggcctggaagaagaatatcgtggtcgcgtctaacaaagtttcatctagggtgaccgcggtaagctttagcgaggactgtagttactttgtgactgcaggtaatcggcatattaagttctggtatctagatgattctaagaccagcaaggtgaacgctacagtgcccctcctgggaagaagcggccttttgggcgaactccggaacaacttattcactgacgtggcctgcggcaggggaaagaaggccgacagtacgttttgcatcacctcttctgggctgctgtgcgagttcagtgatcgccgtctcctcgacaagtgggttgagctccgcaatattgacagcttcacaacgaccgtggcccattgcattagcgtttcgcaagattatatattttgtgggtgtgcagatggaacggtccggttgtttaatcccagtaacttacactttctatcaaccctgcccaggcctcacgctctgggaactgacatagccagcgtgactgaggcttctcgattgttttctggagtggccaacgcgaggtacccggacaccattgccctgacatttgatcctactaaccagtggctgtcgtgcgtgtataacgatcacagcatatacgtctgggatgttagagatcccaagaaggtaggtaaagtgtacagcgcactctatcactctagctgcgtctggtcggtggaggtgtaccctgaggtgaaggattccaatcaggcctgcttgcctccttcttcattcattacctgtagcagcgacaacaccatccggctctggaataccgaaagcagcggcgtccatggcagtacactgcacaggaacatcctgagttccgatctgattaagattatctacgtggacgggaatacacaggcacttcttgatactgaactgcctggaggtgataaagctgacgcgagcctgctggacccacgcgttggtatccggagcgtctgcgtttctcccaatggacagcacttagcttcaggcgataggatgggtacactcagggtgcacgagcttcagtccttgagtgagatgctgaaagtggaggcccatgatagcgagattctgtgcctcgagtattctaagccagacactggattgaagctgctggcaagcgcctctcgggaccgtctgattcatgtccttgatgccgggcgagaatacagccttcagcagacactcgacgaacattctagttccattactgcggtcaagttcgctgccagtgatggtcaggtgaggatgatcagctgtggagcggataaatctatatattttaggactgctcagaagagcggagacggagttcagttcacccgtacccatcacgtggttcggaaaacgaccctttatgacatggacgtggaaccttcctggaaatacactgctatcgggtgtcaggaccgcaatatccgaattttcaatatctcttcaggcaaacaaaaaaagctgttcaaggggtcacagggtgaagatggaactctcatcaaagtgcagacagatcctagtggcatctatatcgccacgagctgttccgacaagaacctctccatctttgacttcagttcgggcgagtgtgtggccacaatgtttggtcacagtgagatcgtgacaggcatgaagttctccaatgactgcaagcacctgatctcagtgtcgggggattcatgcattttcgtctggaggctcagttccgaaatgacaattagtatgagacagcgacttgcagaactgcgacagcgacagcgaggaggaaagcagcagggcccatcatccccacagcgagcatctggccctaataggcaccaggcaccctcaatgctttctccggggcccgcactatcaagcgactccgataaggagggagaggatgaaggcacggaagaggaactgcccgcccttccggttctggccaagtctaccaagaaggctttggcttccgtcccctctccggcccttccacggtctttgagccattgggagatgtcccgcgcccaggagagcgttgggtttcttgatccagcacccgctgcgaaccctgggcccagacgcagaggcagatgggttcagccaggcgtagagctctcggttaggtcaatgttggatctgcgccaactggagacattagctccttccttacaggacccatctcaggactcgctcgccattattcccagcggcccacggaagcacggacaggaagcacttgaaacttctctgactagccaaaacgagaagcccccgaggccacaggcttctcagccgtgcagctacccacatatcatacgtctgctcagtcaggaagaaggtgtgttcgcccaggacttggaacctgctcccatcgaagacggaattgtgtacccagaacctagtgacaatccgaccatggacacctccgaattccaggtccaggccccggcgaggggaactctcggccgggtttaccctggatctaggtccagtgaaaaacacagtcccgactccgcgtgtagcgtcgactactcctcttcatgtttgtcaagtcccgagcacccaaccgaggacagtgagagcaccgaacctctgagtgtggacggaatttcatctgaccttgaagagcccgctgagggagatgaggaagaggaggaagaagaagggggtatgggcccttacggcctgcaggagggatcaccccagactcccgaccaagaacagtttctcaaacagcactttgaaacccttgcatctggcgctgcgcccggagcacccgtgcaggtgcccgaacggtctgaatcccggtctatctctagccgctttttgcttcaagtgcagacgaggcccctgcgagagccttccccttcctcctcctcactcgctctcatgtcccgtcccgcacaagtgcctcaggcatctggagagcagccgagaggcaacggagccaaccctccaggtgcgcctcccgaagtggaaccatcatctggtaatcccagcccccagcaggccgcgtctgtcctcctccctcgctgccgactgaatcccgattcgagctgggctcccaagcgtgtggccacagccagcccctttagtggcctgcaaaaagcccagtccgtccattccctggtccctcaggaacgacatgaagcaagtcttcaggccccatctcctggtgcgctattgtcgcgtgagatcgaagcacaagacggtcttgggagcctcccccccgcagatggccggccctccaggcctcactcctaccagaaccctaccacctctagtatggcaaagatatcccgctctatcagcgtgggcgaaaatctgggcctggtagccgaacctcaggctcatgctcctatccgcgtttccccccttagcaagttagctctgcctagccgagcccatttggtgcttgacattcctaaaccactgcctgatcgccctacactggcagcttttagcccggtgactaagggcagggctcccggcgaagctgagaaacccggctttcccgtgggccttggcaaagcacattccacgactgaacgatgggcctgtctgggcgagggcactaccccaaagcctagaaccgagtgtcaggcacatcccggcccaagcagcccttgcgcccaacagttgcccgtgtccagcctgttccaaggtcctgaaaatctacagccaccaccaccagaaaagacaccaaacccaatggaatgtaccaagcccggagcagctctgagtcaagactccgagccagccgtgtcattggagcagtgcgaacagcttgtggccgagctgagagggtcagtgcggcaggccgtgcgactgtatcactctgtcgccggatgtaagatgccatccgcagagcaatctagaatagcccagttgctgcgtgacacattttcttctgttcggcaagagcttgaggctgtggctggagccgtgctatcctccccaggctcatcccccggcgctgtaggagccgagcagacacaggctctcctggaacagtacagcgagctgctgctgagagccgtggagagacgaatggagcgcaaactgtag

SEQ ID NO: 48846 - DNA, 4527 bp, Artificial Sequence
  Description of Artificial Sequence: Synthetic coding sequence
atggccgtggagggcagcaccatcaccagccggatcaagaacctgctgagaagcccatcgattaagcttagaagaagtaaggccggcaatcgccgagaagacttgagctccaaggtcactctggaaaaggtgctcggcatcaccgtatcgggtggtcggggtctagcctgtgacccccggagcggcctcgtagcctacccggcagggtgtgtcgtggtcctattcaatccacgaaagcacaagcaacaccatatcctgaactcttccaggaaaactattacagcacttgctttcagccctgatggcaaatatcttgtaacaggtgagagcggacatatgcccgccgtccgggtatgggatgtagctgagcattcacaggtggccgagctacaggaacataaatacggggtggcgtgtgtggcattctctcctagcgccaaatatatcgtttcggtgggctaccagcatgatatgatagtcaatgtgtgggcctggaagaagaatatcgtcgtggctagtaataaggtaagcagtagggtgacggccgtttctttctccgaggattgctcctattttgtcaccgccggaaatcgccacattaagttctggtatctcgatgactcaaagacatcaaaggttaacgccacggtgcctctcttggggcggtctggcctgctgggagaacttcgaaataatctttttacagatgtagcttgtggcagaggcaaaaaagccgattccaccttttgcataacctcatctggattgctttgcgaattttctgaccggcggctcttggacaagtgggtggaactgagaacgacagtggcacactgtatcagtgtcagccaagattacatattctgcggctgtgctgatggcaccgtacgtttgtttaatccctctaacctgcacttcctttctactctgccccggcctcatgcccttggtaccgacattgcaagcgtcacggaagctagccggctgttttccggagtggccaacgctcgctatcccgatacaatcgcgttgactttcgaccctaccaaccagtggctgagttgtgtgtataatgatcactcaatctacgtgtgggacgtgcgagacccaaagaaggttggcaaggtttactccgcactgtaccattcttcttgtgtgtggagcgtggaggtgtatcctgaggtgaaggacagtaaccaggcctgtctcccaccatcctcatttattacctgcagctccgataataccatcagactctggaacacggaaagtagtggcgtacacgggagtaccttgcacagaaatatattgagctccgatttaatcaagataatctatgtggacggtaacacccaagccctgctggacactgaactgccagggggcgacaaagccgatgcctctctcctcgatcctagggtgggaatcaggtccgtgtgtgtctcccccaatgggcagcacttggcaagcggagataggatgggaaccctaagggtgcacgaacttcagtccctgtctgaaatgcttaaggtagaagctcacgattccgagatactgtgcctagaatactccaaacctgatacaggactgaagctgctggcatcggcatcccgcgatcggctcattcacgtgctcgatgccgggcgtgaatattctctccagcagacactggatgaacatagctcctccataaccgctgtaaagtttgctgccagcgatggccaggtcagaatgattagttgcggtgccgacaaatctatttatttccggacggcacaaaagtccggagatggcgtgcagttcactcggactcatcatgtcgttcgaaagacaaccctgtacgatatggacgtagaaccttcttggaagtacacggcgatcggctgccaggatagaaatatccgaatcttcaatatctcttccggtaagcagaagaaattgttcaagggtagtcagggggaagacgggaccttgattaaagtgcagacagaccctagcgggatttacattgcgaccagttgttctgataaaaatctgtctatctttgacttttcaagcggagaatgcgtggccacaatgttcggtcactccgagatcgtgactgggatgaagttcagtaatgattgtaagcacctgatcagcgtttcaggcgatagctgtattttcgtctggcgtctgtctagtgagatgaccatcagtatgagacagagactggctgagcttcgccagaggcagaggggcggtaaacagcagggcccaagtagccctcagagggcctctggccctaacagacaccaggcaccatctatgctgtctccaggtcctgctctatcgtccgattctgacaaggaaggcgaagacgaaggcaccgaagaagagttgcccgctctgccagtactggctaaatcaacaaaaaaggcattggcgtcagtcccctcacccgccctgcctaggagcttgagtcactgggaaatgtcccgggcccaagagagtgtgggcttcctagatcctgctcctgccgccaatcccggcccacggcgtcggggcaggtgggtccagccaggagtggagctttcagtgcggagcatgctcgatctgaggcagttggaaactctggccccaagcctgcaggaccctagccaagacagccttgccattatcccctcaggaccccgtaaacacgggcaagaggcccttgaaacttctctgacatcacaaaacgagaaaccaccaagaccacaggccagccagccctgttcatacccgcatattatccggttgctctcccaggaagaaggggtgtttgctcaggacctcgagccagcacctatcgaagatgggatagtgtaccccgaacccagtgataatcccactatggatacatctgagtttcaggttcaggctccagcacggggcactttaggacgggtttaccctggctcacgctctagcgaaaaacattcccccgattctgcctgctccgttgactattcatcttcgtgtctctcctcccctgaacacccaacagaggacagtgagtcgaccgagcccctttccgtggacggcatttcgtccgacttggaagagcctgccgaaggcgacgaggaagaagaagaagaggagggcggcatgggcccttacggcttgcaggagggatccccacagactccagatcaggagcagtttttaaagcagcatttcgaaacattggccagtggcgctgcccccggcgcccccgtgcaggtcccagagcggtcagagtcacgtagcatttcgtcacggttccttctgcaagtccagactaggccattacgggagccgtccccttcttcttccagcttagccttgatgagtcggccagcacaagtgccacaggccagcggcgagcaacctcggggaaatggcgccaatccccctggcgccccccccgaagtcgaaccgagctcggggaatccatctccccagcaggccgctagcgtcttattaccaagatgcagattgaacccagacagtagctgggcgccaaagagagtggctacagcgtcaccatttagtggcctgcaaaaagcccaatctgtccatagccttgtcccccaggaaagacacgaagcgtcattacaggccccctcccccggggcattactctcaagagagatcgaagctcaagacggtctcgggtccctccctccagccgatgggcggcccagtaggcctcacagctatcagaaccctacaacctcctccatggccaagatctctagaagtatctcagtgggcgaaaatttaggattggtagctgaaccgcaggcacacgccccaatacgagtatcccctctgagcaagctcgctctgccctcccgagcccacttggtccttgacatcccaaagccactgcccgatcgacctaccctcgcagcattttcgcccgtgactaagggacgcgcccccggcgaagcagagaaacccggattccccgtcggcctggggaaggcccattccaccacagaacgctgggcctgcttaggcgagggcactactcctaagcctcgcaccgaatgtcaggcacaccccggtccgagttcaccttgtgcccaacagttgcccgtttcatctctgtttcaaggccccgaaaaccttcagcccccccctcctgaaaaaacccctaaccccatggaatgtaccaaacctggagccgccctctctcaggactcagagcccgcagtgagtctcgagcagtgcgaacagctggtcgccgaacttcggggttctgttagacaggcagtgagactataccactcagtcgcagggtgtaaaatgccttccgccgaacaatcacggatagcccagctgttaagagacacctttagtagcgtgcgtcaggaattggaagctgttgcaggggcggtgctctcaagccctggcagcagcccgggagctgtgggggctgagcagacgcaagcgctgctggagcagtacagtgaactgctcctgcgagccgtcgagcggaggatggaacgcaagctctag

SEQ ID NO: 48847 - DNA, 471 bp, Artificial Sequence
  Description of Artificial Sequence: Synthetic coding sequence
atggccgtggagggcagcaccatcaccagccggatcaagaacctgttacggtctccttcaatcaagctaaggagaagcaaggctgggaatcgcagagaggaccttagctccaaagtgaccctggaaaaggtgctgggtatcaccgtcagcggcggaagggggctggcatgtgaccctcggtccgggctcgtggcgtatccagcagggtgcgtggtggttcttttcaatccacgcaagcacaagcaacaccacatcctgaactctagcagaaagacaatcaccgccctagcattctctccggatggcaagtacctggtgactggtgaatctgggcacatgccagccgtgcgtgtttgggacgtggcagagcatagtcaggtagcggagcttcaggagcacaagtatggagtcgcctgtgtcgccttcagtccttctgcaaagtatatcgtgagcgtaggctaccagcactag

SEQ ID NO: 48848 - DNA, 3696 bp, Artificial Sequence
  Description of Artificial Sequence: Synthetic coding sequence
atggccgtggagggcagcaccatcaccagccggatcaagaacctgttacggtctccaagtattaaactgcgcagatccaaagccgggaatagaagagaagacttgtcttctaaggtgacgttagagaaagtgctcggcattacagtgtccggcggcagaggcttggcctgtgaccctcgaagcggcctggtcgcttatcctgctgggtgcgtcgttgtgctctttaacccacgaaagcataagcagcaccacattctcaactcctcccgaaagacgataacagcgctggctttttccccagacggcaaatacctggttaccggggagagtggacacatgccagccgtcagagtgtgggacgtggccgagcatagccaagtcgccgagttgcaggaacacaaatacggcgtggcctgtgtagcttttagtcccagcgcgaaatacatagtcagcgtgggctatcagcacgacatgatcgtcaacgtgtgggcttggaagaagaacatcgtggtagcatctaacaaggtgtctagccgggtgacagctgttagtttcagcgaagactgcagctacttcgttaccgctgggaatcgccatattaagttctggtatctggacgattctaaaacctcaaaagtcaacgcaactgtcccattgctgggccgaagtggtctgctcggcgagttgcgaaacaacctctttaccgatgtggcctgcggaaggggcaaaaaagcggattctactttttgcatcacatcctcaggattactgtgcgaattcagcgatcgaaggcttctcgacaagtgggtagagctgcggaccaccgttgcacattgcattagcgttagccaagactacatcttttgcggctgcgcagacggcacagttcgcctgttcaatccatctaaccttcactttctctcgacactgccccggccccacgcactgggcactgacatcgcatccgtcacggaagcctcccggctgttttctggggtcgccaacgcccggtatcccgataccatcgcactgacattcgaccccaccaaccagtggctatcttgcgtttacaatgaccactccatctacgtctgggatgtccgcgaccctaaaaaggtcgggaaggtgtactccgccctgtatcactcatcctgcgtgtggagcgtggaagtgtatcctgaggtgaaagattcgaaccaggcctgcttgccaccatctagctttatcacgtgcagttctgataacacaatcagattatggaacactgagtcctccggagtgcacgggagcaccttgcatagaaatatcttatcctctgacctgattaaaatcatttatgtggatgggaatacacaggcattgctcgacaccgagcttcccggaggtgataaggctgacgcgagcctcttagaccctcgcgtgggcatccgtagcgtctgcgtcagccccaacggccagcacctggcttcaggagaccgaatgggtaccctccgcgtccacgagttacagtctcttagcgagatgctgaaagtcgaggcccacgactccgaaatcttatgcctcgagtatagtaaacctgataccggcctgaaactgctggcctccgcatccagagatcgcctgatccacgttctggacgccgggcgggaatacagcctacagcaaacccttgatgaacactcaagctcaattactgccgtgaagtttgcagccagcgatggccaggtgaggatgatttcctgtggggccgataagagtatatattttcgaacagcacagaaatctggcgacggcgtgcaatttacacgcactcaccatgtggttaggaaaacaacactatatgacatggacgttgagccgagttggaagtatacagcaatcgggtgccaggatcgcaacatacgcatattcaatatatcaagcggcaaacagaagaagctctttaagggctcacagggggaggacggcacattgatcaaggtgcagacagacccaagcggaatctatatcgctacaagctgcagcgacaagaatctctctattttcgacttctccagtggagagtgtgtcgccaccatgttcgggcacagcgaaatcgtcacaggcatgaagttctccaacgactgcaaacacctaattagtgtttccggggattcatgtatttttgtctggaggctgtcaagtgagatgaccatatctatgcggcagcggctagccgaactacggcagcgacagcgggggggcaagcagcaaggcccaagctcaccacagcgcgcctccggacctaaccgccatcaggcgccatccatgttatcaccagggccggctctgagcagcgatagcgacaaggagggcgaggatgaaggaactgaggaggagcttccggccttaccggtgcttgcaaagtctacgaagaaggcattggcctcggtgcccagtcctgcacttcccagatctttgagtcactgggagatgagccgagcacaggaatcagtggggttcctcgatccggctccggcggccaatcccgggcctagacgacgcgggcgctgggtgcagccaggggtggaactgagtgtgagatcaatgctggacttacggcagttggagactctggctccttccctgcaagatccctcccaggacagcttggcaattatcccatccgggccacggaagcatggtcaggaggcgctcgaaacttctctgaccagtcagaacgagaagccccccaggccacaggcatcacagccgtgttcttatccccacataatccgtttgctgagccaggaagaaggcgtattcgcacaggatctcgagcccgccccaatcgaagacggcatcgtgtatcctgagccctccgacaaccctactatggatacttcagagtttcaggtacaagcccccgccaggggcacattgggccgcgtgtatccaggctccaggtcaagtgaaaagcatagccctgatagcgcttgtagcgtggactacagtagctcttgtctctcttcccccgaacacccaactgaggactccgaatcaaccgagcccctgtccgtggacgggatcagctctgacttagaagaacctgcagagggagacgaagaagaagaggaggaagaaggtgggatgggcccctacgggttacaagaagggtccccccagacccccgatcaggagcaatttcttaaacagcactttgagacccttgcctcgggggccgcaccgggcgctcctgtgcaggtgccagaaagatccgaatccaggagcatatcatcaaggttcttgttacaggttcagacccggccattacgtgagccatctcctagcagctcatctttggcgctgatgagccgaccggctcaggtacctcaggcctccgaacctgccgtgtccttagaacagtgtgaacagctcgtggccgaactgaggggttcagtgcgccaagccgtgagactgtatcactccgtcgctggatgcaaaatgccctccgctgaacagagtaggatcgcacagttgctgcgcgacacgttttcatctgtaaggcaggagctggaggcagtcgccggcgccgtgctcagtagtcctgggtccagcccaggggccgttggggccgagcagactcaagcattactggagcaatattcagagctactgctcagggctgtggaacggcgaatggaacggaagctttag

SEQ ID NO: 48849 - DNA, 2685 bp, Artificial Sequence
  Description of Artificial Sequence: Synthetic coding sequence
atgaaccccggcttcgacctgagccggcggaacccccaggaggacttcgagctcattcagcgcattgggagcggaacttatggcgacgtgtataaggccaggaacgtgaatactggcgagctcgctgctatcaaggtgattaagctcgagccaggcgaggacttcgccgtggtccagcaggagataatcatgatgaaggactgtaagcacccaaacatcgtcgcatacttcggtagttaccttcgacgagacaagttgtggatctgcatggagttctgtggcggcgggtctctccaggacatttatcacgtgaccggaccactgtctgaacttcagatagcttatgtatccagagaaaccttgcagggcctgtactacctgcactccaagggcaaaatgcaccgagacattaagggggccaacattctgcttacggacaacggccacgtgaagctggcggacttcggcgtgagcgcgcagatcaccgcgactattgccaagcgcaagtctttcatcggtacaccttactggatggcgcccgaagtagctgccgtcgagcgcaaaggaggctataatcaactatgtgacctgtgggctgtgggcattaccgcaatcgagctcgctgagttgcagccgcctatgtttgatctccacccaatgagggccctctttctgatgacaaaatctaattttcagccacccaaattgaaggacaaaatgaagtggtccaattcatttcaccacttcgtgaagatggccctcactaagaatcctaagaaaagaccaacggccgagaagctgctacagcacccctttgtcacacagcaccttacccggtcgctcgctatagagctcttggataaagttaataatcccgatcacagcacttaccacgactttgacgatgacgacccagagcctttggttgccgttccgcatcgtatccatagcacctcgcgtaatgtccgggaggagaaaacccggagcgaaattaccttcggccaggtcaagttcgaccccccactccggaaggagaccgagccccaccacgagttgccagactccgatggcttcctggatagctcggaggagatttattatacagcaagaagtaaccttgatctgcaattagaatacggacagggccaccaggggggctactttttgggcgccaataagtctctgctgaaatccgtcgaagaggagctgcaccaacgagggcatgtcgctcaccttgaagacgacgagggagatgacgacgaaagcaaacacagcaccctcaaagctaaaatccccccccccctgccgcctaagcccaagtcaatcttcatcccccaagaaatgcactccacagaagatgagaaccaaggcacgatcaagagatgcccaatgtctgggtcgcctgccaagccgtcccaggtcccccctcgaccccctccacctcggctgccccctcataagcccgtcgcactcggtaacgggatgtcctcattccaattaaatggcgagcgcgacggcagcctgtgccagcagcagaacgagcacagagggaccaaccttagtcggaaagaaaagaaagacgtcccaaagccaatcagcaacggtttgccaccgaccccgaaggttcacatgggagcttgcttttctaaggttttcaacgggtgtcctttgaagatccattgtgccagcagctggattaaccccgacactcgggaccagtatttgatcttcggggccgaggagggtatctacaccctgaatcttaacgaactgcacgagactagcatggagcaacttttcccgcgacgatgtacctggttgtatgtgatgaataattgcctgctgtcgattagtgggaaggccagccaactctactcccacaacctgcctggtctgtttgattacgcacgccagatgcagaagctgccggtcgctatccctgctcataaacttcccgatcgtatcttgcccaggaagtttagcgttagtgccaaaattcctgagaccaaatggtgccagaaatgctgtgtggtgcggaatccctatacagggcacaagtacctatgtggggctcttcagacctctatcgttcttctggaatgggtcgagcctatgcagaaattcatgctgatcaaacacatcgattttccaattccatgccccctacgaatgtttgagatgctggttgttcccgaacaagagtatcctctggtgtgcgttggcgtgtccaggggccgggatttcaaccaggtcgtgcggtttgaaactgtgaatccaaattctacctcgtcatggtttacagagtcagacaccccccagaccaacgtcacccacgtgacacagctagagcgagacacaatcctggtgtgcctggactgctgcattaagatcgtgaacctgcaagggcgactgaagtcctctcggaaactttctagcgaactaacatttgacttccagattgaatccattgtgtgcttacaggattccgttctcgcgttttggaaacacggaatgcaggggaggtcatttcgcagcaacgaagttacccaggagataagtgacagcacgcgcattttcaggctgcttggctccgaccgcgtagtggttctggagtctaggcccactgataatcccaccgcaaactcgaacctgtacatcttagctgggcatgaaaactcatattag

SEQ ID NO: 48850 - DNA, 2622 bp, Artificial Sequence
  Description of Artificial Sequence: Synthetic coding sequence
atgaaccccggcttcgacctgagccggcggaacccccaggaggacttcgagctgatccagcgcattggcagcggtacctatggagatgtctataaggcccgcaacgtcaataccggagagctggcagcgatcaaggtgattaagttggaaccgggagaagattttgccgtggttcagcaagaaataatcatgatgaaggattgcaaacatcctaacatcgtcgcttattttggctcctaccttaggcgtgacaagctatggatctgcatggagttctgcggggggggctccttgcaagatatctaccatgttactgggcccctcagcgagctgcagatcgcttatgtgtcccgggagaccctgcagggcctttattatctgcatagtaaaggcaagatgcatagagacattaaaggtgctaacatattgctcacagacaacgggcacgtgaaactggccgattttggcgtgtccgcacagattactgccacaatcgccaagagaaaatcatttattggcactccctactggatggccccggaagtcgccgctgttgagcggaagggtggttacaatcagttgtgcgacctctgggctgtgggcatcacggccatcgagcttgcagagttacagcctccgatgttcgatctgcaccccatgagagctctgttcctgatgaccaaatcaaacttccaacctccaaagctcaaggacaaaatgaagtggagtaactctttccatcacttcgtcaagatggcactcacgaagaaccctaaaaagcggccgacagccgagaagttgctgcagcacccttttgtcacacagcatctcaccagatcgctcgcaattgaactcctggacaaggtgaataaccccgaccatagtacctaccacgacttcgatgatgatgatcctgagcccttggtggccgtcccacacagaatacacagtacctccagaaacgtgcgagaggagaagacaagatctgagatcacgttcggccaggtgaagtttgacccccctctgcggaaggaaacggagcctcatcatgaattagacctacagctggaatacggacagggacaccaaggagggtactttctgggagcgaataagtccctgctgaaaagcgttgaggaggagcttcatcagcgaggtcatgtagcccacttagaggatgatgagggagacgatgacgaatccaagcattcgaccctcaaggccaaaatcccccctcctctgccaccaaaaccaaaaagtatatttatccctcaggagatgcatagcaccgaggatgagaaccagggaaccataaaacgctgtcctatgagcggttctccagccaagccatcccaggtcccgccgaggcctcctcctcccagacttcctccacacaaacctgtcgcgctgggcaacgggatgtccagttttcaactcaacggcgaaagagacgggagtctttgtcaacaacagaatgaacatcggggaacaaatctgagcagaaaggagaaaaaggacgtgcctaaaccaatatctaatggcttgccgcctactcccaaggtgcatatgggggcctgtttctccaaggtgttcaatggctgcccccttaaaattcactgtgcatcgagctggattaatccagatacgagagatcagtacctgatatttggcgctgaggaagggatatacaccctgaatttaaacgaacttcatgagaccagcatggagcagctatttcctagacgatgtacatggttgtacgttatgaataactgcctgctgtccatctctggaaaggcctctcagctgtactcccacaatctgccaggcctgtttgactatgcacgtcagatgcagaagctgcccgtagctattccagctcacaagctgcctgataggattcttccacggaaattcagcgtctctgcaaaaattcccgagactaagtggtgccagaagtgctgtgtcgtccggaacccatacacgggccacaaatatctgtgtggggcactgcagaccagtatcgtgctgcttgagtgggttgaaccgatgcagaagtttatgttgatcaagcacatagattttccgattccctgccccctccggatgtttgagatgttggtcgtccctgagcaagagtaccccctggtatgcgtgggggtctcaagaggcagagacttcaatcaggttgtacggtttgaaacggtcaaccccaactccacatcatcttggtttaccgaatccgacacaccacagaccaacgtcactcatgtaacgcagttggaacgcgatacaatcctggtgtgccttgactgctgcattaagatcgtcaatcttcagggccggcttaagtcctccagaaaactgtcgtccgagctgacgtttgactttcagatcgaaagtatagtttgcttgcaggactctgtgcttgccttctggaaacatgggatgcaagggagatcctttcgctcaaatgaagtgactcaggaaattagcgattccactcgtatctttcgcctgctgggaagcgaccgcgtagtggtgttggaaagtcggccaaccgacaatcctacagccaactccaatctttatattctagctggtcatgaaaactcttactag

SEQ ID NO: 48851 - DNA, 1344 bp, Artificial Sequence
  Description of Artificial Sequence: Synthetic coding sequence
atgcacagcaccgaggacgagaaccagggcaccatcaagcggtgccctatgtctggctcccccgccaaaccgagccaggttcccccaagaccccctcctcctcggcttccacctcacaagcctgtcgcactcggcaacggtatgagtagttttcagctgaacggtgagagggatggctcactgtgccagcagcaaaacgaacataggggtaccaatctctccaggaaggaaaaaaaagacgtgccgaagccaatttccaacggtctgcctccaacccctaaagtgcacatgggggcatgtttctctaaggtgttcaatggctgtcccctgaaaatccactgtgcgtctagttggattaatcccgacacaagggatcagtacctcatctttggcgctgaggaaggtatatacaccctcaatctcaacgagctgcacgaaactagcatggaacagctctttccacggcgctgtacatggttgtatgtgatgaataactgtttactctcaatctcagggaaggcctcccagctgtacagtcacaatctgccaggcctctttgactatgcccggcagatgcagaaactgcctgtcgccatacccgcacacaagttgcctgatagaatcctgccacgtaagtttagcgtgtccgctaagatcccggaaacgaaatggtgccagaagtgctgcgtggtgaggaacccatacactgggcacaagtacctttgcggagccctgcaaacctccattgtactgctggaatgggttgagcctatgcagaaatttatgctgattaagcatatcgactttcctattccgtgcccactcaggatgttcgagatgctcgtcgtgccagagcaggagtatccactggtgtgtgtaggcgtgagtcgaggcagagactttaatcaagtggttcgatttgaaacagtgaatcccaactccacttccagttggttcaccgaatctgatacccctcagaccaacgtgacccatgttactcagctcgaaagggacaccatcctggtctgtctagattgttgtatcaaaattgtaaacctgcaggggcgcctgaagtctagtcggaagctcagctctgaactgacctttgatttccagatagagtcaattgtgtgtcttcaggattctgtgctggcattttggaaacacggcatgcagggccggagcttcagatctaatgaggttacccaggaaattagcgacagcacccgaatttttcggctgctggggagcgacagagtggttgttctggagtctagaccgacggacaatccgaccgcaaacagtaacctttacatcctggccgggcacgaaaacagctactag

SEQ ID NO: 48852 - DNA, 480 bp, Artificial Sequence
  Description of Artificial Sequence: Synthetic coding sequence
atgcagaagttcatgctgatcaagcacatcgacttccccatcccctgtcctttgcgaatgttcgaaatgcttgtcgtgccggagcaggagtatccgctggtctgcgtgggcgtgagcaggggtcgcgatttcaatcaggtagttcgtttcgaaaccgttaatcccaattccacatctagctggtttacggaatcagatacccctcagacgaatgtgactcatgtcactcagttggagagagataccatcttggtctgcctcgactgctgcataaagattgtgaatcttcagggccgactgaagtcgtcccggaagctgtcctccgagctgacattcgactttcagattgagtccattgtttgcctgcaagattccgtgttagccttttggaaacacggtatgcagggccgcagctttcgatctaacgaggtcacgcaggaaatttcggactccaagaattttcaggctgcatggatctag

SEQ ID NO: 48853 - DNA, 1449 bp, Artificial Sequence
  Description of Artificial Sequence: Synthetic coding sequence
atgttcttcctggtgaccagcgacgagagcaacaagacctggggccgtaatactgttttccgccaagaagaattcgaggacgtcaaaagaaactttaaaaagaaggggtgtacctgggggcctaatagtattcagatgaaagatcggaccgactgtaaagaaagaatccggcccctttccgacggaaacagcccctggtcaacaattctgatcaaaaaccagaagaccatgccactggccagcctgttcgttgaccagccaggcagctgtgaggagccgaagttgagtcccgacggcctcgagcataggaaacccaaacaaatcaaacttccctctcaggcatacatcgaccttccgctgggaaaggacgcacagcgcgagaatccagctgaagcagaatcttgggaagaggctgcctccgccaacgcggctacagtgtccatcgaaatgaccccgacaaacagtctctctcgctctccccagaggaagaaaaccgagagcgccctctacggctgtaccgtgttactggctagcgtcgccttgggcctcgacctccgtgaactgcataaggcgcaagctgctgaggagccccttcccaaagaggagaaaaaaaagcgggaaggaatcttccaacgagccagcaagtcgaggcgcagtgcctccccgccaacttcacttcccagcacttgtggagaagcctcttcccccccttcattaccgctgagctctgccctcgggattctgtctaccccctcctttagtacgaaatgcttactgcagatggatagtgaggaccctctggttgattccgctcctgtcacatgtgattctgaaatgctcacccccgacttttgtccaactgctccaggttctggcagagagccggcccttatgccacggctggacaccgattgttcagtctcccgcaaccttccctcatcttttctgcagcagacatgcgggaatgtgccctactgcgcctcttcgaagcaccgtccctcccaccataggaggaccatgtctgacggcaaccccacccccaccggtgcaacaattattagcgccaccggggcttccgctctgccattgtgcccctcccccgcccctcattcacacttgccccgcgaagtgtcacctaagaaacactccacagtgcacatcgtaccacagcgacgcccagcctctctgcgaagccgcagtgatttgccgcaggcataccctcagaccgccgttagccagctggcccaaacagcttgtgtcgtaggcagacccggtcctcatcctacgcagtttctggccgccaaagagaggacgaagtcacatgttcctagcctgctggatgcagacgtggagggtcaaagccgagattacacagtacccctttgtcgaatgcggagtaaaacgagccggccaagcatctatgaattggagaaagaatttctgagctag

SEQ ID NO: 48854 - DNA, 1713 bp, Artificial Sequence
  Description of Artificial Sequence: Synthetic coding sequence
atggccctgcggggcgccgccggcgccaccgacacccccgtgagctccgctggcggtgcgccaggaggctccgcgagctcttcctccacttcatctggtggctccgccagcgccggcgctggcctgtgggccgcattatatgactatgaggctcgaggtgaagacgaactgtctctccggaggggacagctcgtggaagtgctgagtcaggacgctgccgtgtccggtgacgagggttggtgggccggacaagtgcagcgcagactggggatatttcctgctaactatgtcgccccgtgtagaccagcagcctctcctgctccccccccctcacgtccatcatcccctgttcacgtggcctttgagaggctcgagcttaaggaattaatcggcgctggtggatttggccaagtgtatcgcgcaacatggcaggggcaggaagtagccgttaaagcggctagacaggatccagaacaggacgcagccgctgcagccgagtctgtgaggcgcgaggctagactcttcgccatgctccggcacccaaacattatcgagctgcggggcgtgtgtctgcagcagccacatctttgtctggtactggagttcgcccgcgggggcgcacttaaccgtgccttggccgctgccaatgccgcgcccgacccacgtgctccaggtccccggcgggctaggcggattccccctcacgtgctggtcaattgggccgttcagattgccaggggcatgctgtatcttcatgaggaggctttcgtgccgatcctgcacagagacctgaagtccagtaatatcctgttactggagaagattgagcatgatgacatttgcaacaagactctcaaaatcactgacttcggccttgccagagaatggcacagaacgacgaagatgtcaaccgctggtacttacgcttggatggccccagaggtgatcaagtcatccttgttttccaaagggagcgacatctggtcttatggtgtgttgctatgggagctgttgactggcgaagtgccctatcgcgggatcgacggactggccgtggcctatggagtggctgtgaacaagttaaccctgcccatcccaagcacttgccctgaaccatttgctaagctgatgaaggaatgctggcagcaagatcctcacatccgccctagcttcgcactcatccttgaacagctgaccgccatcgaaggcgccgtcatgactgaaatgcctcaggaatcatttcactcgatgcaggatgactggaaacttgaaatacagcagatgtttgatgaactgcggacaaaggaaaaggaactaaggtcaagagaagaagaactgacaagagcggccctccaacagaagtctcaggaggagcttctgaagcggagggaacagcaactagccgaaagggagattgacgtcctggagcgagagttgaatattctgatttttcagctgaaccaggagaaacctaaagtgaagaaaagaaaaggcaaattcaaacggagccggctgaagttaaaggacggccaccgcatatcactgccatctgacttccagcataagataacagtgcaggccagtcccaacctagataaaagaaggagcctgaactcatccagtagctctccacccagctcccccactatgatgcctagattgcgtgcaattcagtgcgaactgtctgctttaccaaggggtttactttgctag

SEQ ID NO: 48855 - DNA, 3111 bp, Artificial Sequence
  Description of Artificial Sequence: Synthetic coding sequence
atggccctgcggggcgccgccggcgccaccgacacccccgtgagctccgccggtggggctcctggaggcagcgcaagttcctcctctacctcttcaggcggctcagcatctgccggagccgggttatgggctgctctgtatgattatgaagcacggggcgaagacgagctcagcctgcggaggggccagcttgtggaagtcctctctcaagatgccgcagtcagcggggacgagggttggtgggcggggcaggttcaacgacgactcggcatatttcccgctaactacgtcgctccatgtcggcccgctgcctccccagcgcccccaccgtccaggccttcgtcacccgtgcacgtggccttcgaacggctggaactgaaggaattgattggggcaggcgggtttggccaggtgtatagggctacttggcaaggtcaagaagtggccgttaaggcagccagacaggaccctgagcaagacgccgcagcagccgccgaaagcgtgcgccgggaggcccgcctcttcgccatgttacgtcaccctaacatcatcgaactgcggggcgtttgtttgcagcaaccacacctgtgcctggttctggagtttgctcgtgggggggcgctgaaccgcgctctggcggccgctaatgccgccccagacccacgcgcccccggaccaaggcgggcaaggagaatcccccctcatgtgctggtaaactgggctgtgcaaattgcccgtggcatgctgtacctgcacgaggaggcctttgtgccgattttacacagagatttgaagtcatcaaatattctcctgctggagaaaatcgagcatgatgatatttgcaacaagacattgaagataaccgatttcgggcttgcacgggaatggcatagaactaccaagatgagcaccgccgggacatatgcttggatggcgcccgaggtaataaagtctagcctcttttccaaaggaagcgacatctggagctacggggtcctgctctgggagctactcaccggagaggtgccttaccggggcatcgatgggctggcagttgcctatggggtcgctgtaaacaagctgacgctgcccataccatcaacctgcccagagccatttgcaaaactgatgaaggagtgctggcagcaggacccccacataaggccttcatttgcattgatcctggagcagctgacagctatcgaaggcgcagtgatgactgaaatgccccaggaaagcttccacagcatgcaggacgattggaagctcgaaatacagcagatgttcgacgagttgcggactaaggaaaaagagctgcgttcacgggaggaggaactgacaagagcagcgctacagcagaagtctcaagaagaactgctaaagagacgcgagcagcaacttgctgaacgagagatcgatgtgttggagcgtgaattgaacattctgatctttcaactgaatcaagaaaagcccaaggtcaaaaagaggaaaggtaaattcaaacgatcaagactcaagttaaaggatggccataggatctccttaccctccgactttcagcataaaataactgtccaagcctctcctaaccttgataagcggaggtcactgaactcgagcagctcaagcccaccttcttcccctaccatgatgccccggttgagagcgattcagctcacttctgacgagagcaacaaaacttggggccggaatacagtcttcaggcaagaggaatttgaggatgttaagaggaacttcaaaaagaaggggtgcacgtggggaccgaatagcattcagatgaaggatcggacggattgtaaggaacggatccgccccttaagtgatgggaactccccttggtccaccatactgatcaaaaaccaaaaaacaatgccccttgcaagcctttttgtggatcagcctggatcttgcgaagagcccaagctgtctccagacggcctcgagcaccggaaaccaaagcaaattaaactcccttcacaggcttatatcgatctccccctgggtaaggacgcccagcgggaaaatcctgcggaggccgaaagttgggaagaggctgctagcgccaacgccgctactgtgtctatcgaaatgacccctaccaatagtcttagtcgcagcccacaacgaaagaagaccgagtccgccctgtatggctgtacggtgttgctggcgagcgttgctttggggctggatttgcgggaactgcataaagctcaggcagccgaggagcctttgccaaaggaagagaagaagaaacgcgaaggaatattccagcgggcgagcaaaagccgaaggagcgccagccctccaacgagcctaccatcaacatgcggcgaggcctccagcccaccatctcttccactgtcctccgctctgggtattcttagcacaccttccttctctactaagtgtttactgcaaatggacagcgaggaccctctagtagacagtgcccctgtgacctgcgatagtgaaatgttgactcctgacttctgccctacagcgccaggttccggaagagagcctgcgctcatgccgcgcctagatacagactgcagtgtatcaaggaacctgccttcttcctttttgcaacagacttgtggaaacgtgccgtattgcgcatccagcaagcataggccatcacaccacagacgcactatgtcagatggcaaccccacgccgacgggagccacaattatctcagcaacaggagcaagtgcattgccattgtgtccaagccccgctccgcactcccacctcccacgcgaggtaagtccaaaaaagcatagcacggttcacatagtaccccagaggaggcccgcttctctgagaagcaggtcagatctgccccaggcatacccacagactgctgtgtcccagctggctcagaccgcttgcgttgtggggagacccgggcctcaccctacccaattcctggctgccaaagagcggactaagagtcacgtacctagcttgttggacgctgacgtagagggccagtcgcgggattacaccgtgcctttatgtaggatgcgctcaaagacatctcgcccctcaatctacgagctcgagaaggaatttctgtcatag

SEQ ID NO: 48856 - DNA, 792 bp, Artificial Sequence
  Description of Artificial Sequence: Synthetic coding sequence
atggagaacctgaagcacatcatcaccctgggccaggtgatccacaaaagatgtgaggagatgaagtactgtaaaaagcaatgcaggagactggggcatcgcgtgcttggcttaataaaacctttggagatgctacaggatcagggtaagaggtccgtcccaagcgaaaaactcaccacggccatgaacagattcaaagcagccctagaggaggcaaacggggagattgaaaagttcagcaacagatctaacatctgcaggtttctgacagctagccaggacaaaattctgttcaaggacgtgaaccgcaagctgagcgacgtgtggaaagaactgtcgctccttcttcaggtggagcagcgcatgcctgtatcccccatctctcaaggggccagttgggctcaagaggatcagcaggatgcagacgaagaccgtcgggcttttcagatgttacgccgggataatgagaagatagaggctagcttgaggagactggaaatcaacatgaaagaaattaaagagactctgcggcagtccctggagtcatctagcggcaaatccccactggagataagccgcttcaaagtcaagaacgtcaaaaccggatcggcttccgggtgcaattcagagaaaatccgcaaattagtagctgtgaagcgtcagcaggaacctttgggtgaggactgcccatcggagctcagagagatcatcgacgagtgccgcgcccacgatccaagcgtgaggccgtctgttgacgagatcctcaaaaaactgagcactttcagcaaatag

SEQ ID NO: 48857 - DNA, 1416 bp, Artificial Sequence
  Description of Artificial Sequence: Synthetic coding sequence
atggagaacctgaagcacatcatcaccctgggccaggtgatccacaaacgctgcgaagagatgaagtactgtaaaaagcaatgccgaaggctgggccacagggtgttggggcttattaagcccctagagatgctgcaagaccaaggtaaacgaagtgtaccttcagaaaagctcactaccgcgatgaatcgctttaaagcggcccttgaagaggctaatggtgagatcgagaagttttccaacagaagtaatatttgtaggttccttacagctagccaggacaagatcctgttcaaggacgttaatcgcaaactgagtgatgtgtggaaggagctctctctcttgttgcaggtcgagcaacggatgccagtgtcgcctataagccaaggtgctagttgggcacaagaggaccagcaggacgccgatgaggatcggcgcgcattccaaatgctgcgacgggataacgagaaaatcgaggcgtcgttaagacgtctggaaattaacatgaaggagattaaggaaactctgcgacagtacctgcctcccaaatgtatgcaggaaattccgcaggaacagattaaggaaatcaagaaggaacagctcagcgggtccccttggattctgttgcgagagaacgaggtctctactctctacaaaggcgaatatcatcgtgctcctgttgccatcaaagtctttaagaagctgcaagcagggagcatagcaattgttagacagacgttcaataaggagatcaagaccatgaaaaaatttgagtctccaaacatcctgcgaatcttcggcatttgcatcgatgagacagtgacaccaccccaattctctattgtgatggaatattgtgaacttgggaccctgcgagagctgctcgatcgggagaaggacctgacactgggtaagagaatggtgctggtactgggagccgcacgcggattgtatagattgcatcattccgaggcacccgagttacatggcaagatacggagctctaacttccttgtgactcaggggtaccaggtcaaactggctggattcgagctccgaaagacccagacttctatgtctctagggacgacgagggagaaaaccgaccgcgtaaagtccactgcttatctttccccacaggaactcgaggatgtcttttaccagtacgacgtaaaaagcgaaatttactcattcggcattgtgctgtgggagattgccaccggagacatccccttccagggttgtaacagcgagaagatacgaaaacttgtagccgtgaagcgccagcaggagcccttgggagaagactgtccctccgagttgcgggaaatcatcgatgaatgtagggcgcacgacccatctgtaaggcccagtgtggatgaaatcctgaagaagctttcaacatttagcaaatag

SEQ ID NO: 48858 - DNA, 651 bp, Artificial Sequence
  Description of Artificial Sequence: Synthetic coding sequence
atgagcttcctgttcagcagccggagcagcaagaccttcaagcccaagaagaacataccagaaggctcacaccagtacgagttactcaaacacgcagaggcaactttgggttctggaaacctgagacaggctgtgatgttacccgagggcgaagatctgaacgagtggatcgcagtgaacaccgttgatttctttaatcaaattaacatgctgtatggtacgatcacagagttctgcactgaggcatcttgtccggtcatgtctgccggcccgaggtatgagtaccattgggctgatggaacaaacataaaaaaaccgattaaatgtagcgcccctaagtatattgactatctcatgacttgggtccaggaccaactcgatgacgaaaccctgttcccgtctaagattggcgtcccattcccaaagaatttcatgagcgtggctaaaactattctgaagagactgtttcgggtgtatgcccatatttaccaccaacacttcgatagtgttatgcagttgcaagaagaagcacacctgaatacgtctttcaaacatttcattttctttgtgcaggaatttaacctgatcgaccgcagggagctcgcacctctgcaggagctaattgagaaattgggaagtaaggaccgctag

SEQ ID NO: 48859 - DNA, 447 bp, Artificial Sequence
  Description of Artificial Sequence: Synthetic coding sequence
atgctgttctacctgagcagccggagcagcaagaccttcaagcccaagaaaaacatcccagaagggtcacaccagtatgaactccttaaacacgctgaagccaccttaggtagtggaaacttacgacaggccgtgatgcttccagaaggggaagacctgaatgaatggattgctgtaaacactgttgatttcttcaatcaaatcaacatgctgtacggaacaattaccgaattctgtaccgaggcctcttgccctgtcatgagcgctggtccgcgctacgagtatcattgggctgatggcacaaatatcaagaagcccatcaagtgcagtgctcccaaatacatcgattacttgatgacttgggtgcaggatcagctcgacgacgagaccctgtttccttcaaaaataggcgaactgacgctttcgaagtactccttcttcttctag

SEQ ID NO: 48860 - DNA, 807 bp, Artificial Sequence
  Description of Artificial Sequence: Synthetic coding sequence
atgctgggcgaccactgcagcctgcccgaggaccaggcccggcccgggcagtctctccagagtgggttgtgctgtaagatggtccttcaggccgtctctaaagtgctgagaaagagcaaggctaagccaaacgggaagaaaccagctgccgaagagcggaaagcgtacctcgagcccgaacatacaaaggcaagaattacagattttcagtttaaggagctagtcgtgctgcctcgggagatcgacctgaacgagtggttagctagtaataccaccacctttttccatcacatcaatctgcagtacagcactatctccgaattctgcaccggggagacatgtcagaccatggccgtttgcaacacgcaatactactggtatgacgaaagggggaaaaaagtgaagtgcaccgcgccccagtatgttgatttcgtgatgtcgagtgtccagaagctcgtgactgacgaggacgtgttcccgaccaaatatgggcgagaatttccatcgtctttcgaatccctggtcaggaagatttgccggcatttgttccacgtccttgcgcacatctactgggcacattttaaagagactttggcattggagctgcacgggcatttaaacaccttatacgtacactttatcctgtttgcccgggagtttaatttgctggatcccaaagagactgccattatggacgatctcaccgaagtgctctgtagcggagccggcggagtgcacagcgggggctcaggcgacggtgcagggagcggcggacctggtgcacagaaccatgtcaaggagcgttag

SEQ ID NO: 48861 - DNA, 654 bp, Artificial Sequence
  Description of Artificial Sequence: Synthetic coding sequence
atgagcaaccccttcctgaagcaggtgttcaacaaggacaagacctttagacccaagcggaagttcgagcctggtacccaaagattcgagttacacaaaaaagcacaggctagcctcaatgctgggcttgatctgcggctggccgtacagctccctccgggagaggacttgaacgattgggttgccgtacatgtcgttgattttttcaaccgggtcaacctcatttacggcacaatatccgacggatgcaccgagcaatcatgcccggttatgagtggtggaccaaaatacgagtacaggtggcaggacgagcataaatttagaaaacctaccgccctgtccgcacccagatacatggatctgctgatggactggatagaagcccaaatcaacaatgaagacctgttcccaacaaacgtggggactcctttccctaagaacttcctccagacagtgcgaaagattctgtcaaggctgtttcgcgtgttcgtgcacgtatacatccaccacttcgatcggattgcacagatggggtcggaagctcatgtcaatacatgctacaagcacttttactacttcgtgaaagagtttggtctcatcgacactaaggagttggagccccttaaggaaatgaccgccagaatgtgtcactag

SEQ ID NO: 48862 - DNA, 651 bp, Artificial Sequence
  Description of Artificial Sequence: Synthetic coding sequence
atgagcatcgccctgaagcaggtgttcaacaaggacaagaccttccgcccgaaacgcaagttcgagcctggaacacaaagattcgagttgcacaagagggcacaggcctcactgaactccggcgtggatctgaaggccgccgttcaactgccctctggtgaggaccagaatgattgggtggccgttcacgtagttgacttttttaatcgcattaatttaatctatgggacaatttgcgaattttgcacagagcgtacttgtcccgttatgagcggcgggccaaagtacgaatatcgctggcaggatgaccttaagtacaaaaagcccacagcactgccagcccctcagtatatgaacttgctcatggattggatagaagtccagatcaacaatgaggagattttcccgacctgtgtcggggtgccgtttccaaagaatttcctacagatctgcaagaagatcctgtgccgtctcttccgagtttttgtccacgtgtatattcaccatttcgaccgggtgatagtgatgggagcagaggcccatgtcaacacatgttacaagcacttctactatttcgtgaccgagatgaacctgatcgataggaaggagctcgagcccctcaaggagatgacctcgcgtatgtgccattag

SEQ ID NO: 48863 - DNA, 807 bp, Artificial Sequence
  Description of Artificial Sequence: Synthetic coding sequence
atgaagcggcggaacctgttcgccctggagaccggcgtgcccccctggggactgttgtgggtgaggagtcgtagggttgggatggatgagatgaccttccatatatggtatccgcaggtgagagcccctggtcaacagccacaggctcagctcgcaatggcgctatgccttaagcaggtattcgccaaagataagaccttccgtccccgtaagcgctttgagcccgggacacaacgatttgagctgtacaaaaaagcccaggcgagcttgaagtctgggctggacctcagatctgttgttagactgcccccaggtgaaaatatcgatgactggatcgccgttcacgtggtcgacttcttcaaccgaatcaacttgatttacggcacaatggctgaacgctgcagtgagactagctgtcccgtgatggctggaggaccccgttatgagtatcgctggcaggacgagagacagtacagacgacctgctaaactgtctgccccgcgttatatggctctgctaatggattggatcgaaggtctcatcaatgatgaggaggtgttccctaccagagtgggagtacctttcccaaagaactttcagcaggtttgtacgaagattctgactcggcttttccgcgttttcgtgcacgtttacattcatcatttcgacagtatcttgtctatgggcgcggaggcccacgtaaacacatgctacaagcatttttactactttattcgcgagttttctcttgtggatcaacgcgaactggagcccttgcgggaaatgaccgagaggatttgccactag

SEQ ID NO: 48864 - DNA, 651 bp, Artificial Sequence
  Description of Artificial Sequence: Synthetic coding sequence
atggccctgtgcctgaagcaggtgttcgccaaggacaagaccttccgtcctcgcaaaaggtttgagccaggcactcagcggttcgagctgtataaaaaagcacaagcctctttaaagtccgggctggacctgcgtagcgtggtgcggctaccacctggggaaaacattgatgactggattgctgtccatgttgtcgatttttttaaccgcattaatttgatctatgggaccatggccgagaggtgtagcgagactagctgtcctgtgatggcaggcggcccgcgctatgagtatcgctggcaggatgaaaggcagtaccggcgccctgctaagcttagcgccccaaggtacatggcactactgatggattggatcgaaggactgatcaacgacgaggaggtctttcctactcgtgttggggtcccttttccaaaaaacttccagcaggtgtgcacgaaaatactcaccaggctttttcgtgtgtttgtacatgtgtacatacaccacttcgacagcatcctttctatgggcgcagaagctcacgtgaatacctgctacaagcacttctactattttatcagggaattctcactcgtggaccaacgagaactggagcccctgcgtgagatgacggaacggatttgtcactag

SEQ ID NO: 48865 - DNA, 720 bp, Artificial Sequence
  Description of Artificial Sequence: Synthetic coding sequence
atgcccctgagcctggccggctacccccaggtgcgggcccccggccagcagccacaggcccagctcgctatggccctgtgtttgaagcaggtattcgctaaagataagacctttcggcctcgtaaacgttttgaacccggtacccagcgtttcgagctctacaaaaaggcccaggccagcctgaagagtggcctggacctgaggagcgttgtgaggctgccaccaggggaaaatattgatgattggatagccgttcacgtcgtcgacttttttaatcgaattaaccttatttacggcactatggccgaaagatgctccgagacatcctgtcccgtcatggctggaggtcccagatatgagtatcgctggcaggacgaaagacagtaccgccgccccgcaaaactatctgccccccgctacatggctctactgatggattggatcgagggcctgattaatgatgaagaggtcttccctacgcgggtcggcgtgccgttcccaaaaaattttcaacaggtttgtacgaagattctgacacgcctgttcagagtttttgtgcatgtgtacattcaccactttgattccattctgtccatgggagctgaagcccacgtcaacacctgctacaagcacttctattatttcattcgcgaattctcattggtggaccagcgggagttagagcccctgcgcgaaatgacagaacgaatctgccattag

SEQ ID NO: 48866 - DNA, 1959 bp, Artificial Sequence
  Description of Artificial Sequence: Synthetic coding sequence
atgcaccccggcggcggccccagccgggccgagcggctggagctgggccttggacgcgagcgtcctgccaaggctatctttttgcatcggcggccaggggaggggggagggcgagagcgctgtctgcgatgcggacatgtgtgtgtgaggagaggacctgggccacgggaggctgtgccaagcggcaggcctcgccccgacacattgacccctccatgggtgcgccagcgggctgtaaccggaaccttctgcgccagctggactccattgcggaatcgacgcgcccagaggatggccacggacatgcaacggaagcgatctagcgaatgcctggacggcacgcttacacccagcgatggccaaagcatggaaagagccgagagccctacaccagggatggctcagggcatggagcctggggccggtcaagagggggctatgtttgtacacgctcgcagctatgaagacttaactgagagtgaggatggagccgcttctggcgatagccacaaagagggaaccagagggccaccccccttaccaaccgacatgcggcagatctcccaggatttctctgaacttagcacccagctgaccggagtagcgagagatctgcaggaggaaatgctgccaggctcatctgaggactggttggaacctcctggggctgtagggaggccggctactgagccccccagagaaggaactactgagggcgacgaagaagacgcgactgaggcttggaggctgcaccagaaacacgtgttcgttctgtcagaggcaggcaagccagtatattctcggtatggctccgaggaggctctttcctcaaccatgggtgtcatggtggccctcgtttcatttcttgaggccgataagaacgcaattcggtcgattcacgccgacggatataaggtggtgtttgtgaggcggtctccgctggtgctggtggccgttgctagaactcgccagtccgcacaggagctggcgcaagaactcctctacatttactaccagatcttgtctcttcttactggggcccagctgagccatattttccagcagaagcagaattacgatttgaggaggttactctccggctccgagagaattacagacaacctgctgcagctgatggcacgagatccttcattcctgatgggtgcggcacgctgtctcccgctggccgcagccgtcagggacaccgtgagcgcgtccctgcagcaggcacgtgcgcgctcactggtgttttctatactgctcgcaaggaaccagctggtggctctcgtgcgccgcaaagaccagttcttgcacccgatcgatctgcatttactttttaacctcatctcttctagctcctccttccgggagggtgaggcatggacccccgtgtgtctgcctaaatttaatgccgctgggtttttccacgctcatatttcatacctggaacccgacacagatctctgtttactcctggtctctacagaccgagaggactttttcgccgtatccgattgtcggcggaggttccaggaacgcctgagaaaacggggagcccatttagcacttagagaggcactacggacgccatactactctgtggcacaggtgggaattccagacctccgacacttcctgtataagtccaagagctcaggactctttactagtccggaaattgaagccccctatactagcgaggaagagcaggagcgcttactcggtctctaccagtatctccatagccgggctcataacgcaagccgacctctgaaaaccatttactacaccgggccaaacgagaacctactcgcttgggtgacaggagcattcgaactgtatatgtgctactccccactgggcacaaaagcgagtgcagtgtctgcaattcacaagctgatgaggtggattcgcaaagaggaggacaggcttttcattctgacaccactgacgtactag

SEQ ID NO: 48867 - DNA, 1473 bp, Artificial Sequence
  Description of Artificial Sequence: Synthetic coding sequence
atgcaccccggcggcggccccagccgggccgagcggctggagctgggcctcggcagggagcgcccagctaaagccatattcctgcataggcgccccggcgagggcggcggtcgagagagatgcttgcgctgcggccatgtgtgcgtgaggcgtggtccgggaccacgagaagccgtcccttccggaaggccacggcccgacacattgactccgccctgggtgagacagagagccgtgaccggcaccttctgcgcctcctggactcccctccgcaataggcgcgcacagcgaatggcaacggacatgcaaagaaagagaagctcagagtgtctggatgggacattaacgccaagtgacggtcagagtatggaaagagctgaaagccccaccccggggatggcccagggcatggagccagacgggtataaggtggtattcgtgcgcaggagccccctggtgcttgtggctgtggcccgtactcggcaaagcgctcaggaacttgcgcaggaactgctctatatctactaccagattctgtccctcctcacgggcgcgcaattgtctcacatttttcagcagaagcaaaactatgatttgcgtaggctgctctcagggagcgagcgcatcacagataacctgctgcagcttatggctcgggacccttcctttctcatgggagccgcaaggtgtctcccactcgctgcagcggttagagatacggtaagcgcctccctgcagcaggctagagcccgttcacttgtgttctcgatccttctggccagaaatcagttggtcgcactcgttcgtcgaaaagaccaattcctgcatccaatagacttgcacttgctgtttaacttgatatcatcttcaagctcctttagggagggagaagcatggaccccagtgtgtctaccgaagtttaacgcggccggattttttcatgcacacatcagctacctggagcctgatacggatctctgcttgttgctagtgtcgaccgaccgtgaggatttttttgctgtctccgactgtcgacggcgattccaggaaagattgcgaaaaagaggcgcacacctggctctaagggaagcactgcgcacaccttactattcagtggcccaggtgggcatcccagatcttagacacttcctgtataagagcaagagctccggcctgttcacctccccggaaatcgaggccccttacacctcagaagaggaacaggaacggctgctgggactataccagtatctgcacagccgggcgcataacgcgtctagaccactcaagactatctattatacgggacctaacgagaacctcttggcctgggtgaccggcgcctttgaactctatatgtgttacagccccctgggaactaaagccagcgcagtctccgccatccataagctcatgcgctggatccgtaaagaggaagatcgcctgtttatcctaacccccttgacatactag

SEQ ID NO: 48868 - DNA, 2043 bp, Artificial Sequence
  Description of Artificial Sequence: Synthetic coding sequence
atgggctgcggcaccaaggagcccaagatcacccagctgtgcctggccgcaatccagaggctgatgagccacgaagttgtctctgagacggctgctggtaacattatcaacatgctgtggcaactcatggagaatagcctggaggaattgaaactgctgcagactgtgctggttttgctgacaaccaataccgtggtgcacgacgaagcgctctcaaaagcaatcgtgctgtgctttcgtctgcactttaccaaggacaacatcacaaataatactgctgctgccaccgttcggcaggtggtaaccgttgtgtttgaacgcatggtggccgaagacgaacggcatagggatataatcgaacagcccgtcctggtgcagggcaactccaatcgccgcagcgtgtcaactctgaaaccatgcgcaaaggatgcctatatgctttttcaggatctttgccagctggtcaacgcagacgccccatactggcttgtgggcatgaccgaaatgacccgaactttcggattagaactgctagaatccgtcttgaacgattttcctcaagttttcctccagcatcaagaattctccttcctcctgaaggagcgggtttgtcctctggtcattaagctgttctcacctaacatcaaattccgacaaggaagcagtacttcttcgtctcccgcaccagttgaaaaaccctacttccccatctgcatgcgcctcctgagagtggtgtccgtgctcattaaacagttctattctctcttagtgaccgagtgtgagattttcttgagcctgctcgtaaagttcctggatgccgacaaacctcagtggctacgggcagtggcagttgagtccatacaccggttttgcgtccagccccaattattgcgaagcttctgtcagtcatatgacatgaagcagcacagtacaaaagtcttccgagatattgtcaatgccctcggaagtttcatccagtcactgtttctggtcccaccaactggaaaccctgcaacctctaatcaggccggaaacaacaacctggggggcagtgtttcagctccagccaactccgggatggtgggcattggtggaggggtgaccctgctcccagcctttgagtaccggggcacttggataccaattttgactatcaccgtgcagggcagcgccaaggcaacctatctggagatgctggataaggtcgaaccacctaccatacctgaaggatacgccatgagtgtggccttccactgtctccttgacctggttagaggaatcacgtccatgatagaaggagagcttggggaactggagactgaatgccaaacaaccacggaggagggctcgtcgccaacccagtcaacagaacagcaggacttgcagtccaccagcgaccagatggacaaggaaatcgtttctagagccgtgtgggaggaaatggtgaatgcctgttggtgcggtctcctcgccgccctgtctctcttattggacgcctccaccgacgaagctgctaccgaaaatatcctcaaagctgagctcaccatggcagccttgtgcggtcggctaggccttgttacttctcgagacgcattcattaccgccatatgtaaaggcagcctgccgccccactacgcactgactgttctgaataccacaacagccgccacactctcaaataaatcttactctgtgcaggggcagtcagtgatgatgatttcacctagctccgagagccaccaacaggtagtggcagttggacagcccctcgccgtgcaaccacagggcaccgtgatgctgacatcaaagaacatacagtgtatgaggacgctgctgaatcttgcccactgccacggcgctgttcttggcacttcttggcagctcgttctggcaacattgcagcatctggtgtggattctgggcctaaaaccatccagcggcggcgcacttaaaccagggagagctgttgagggcccaagtactgtgccttttaaggatttcatgcagccacccgcctcacgggtccagaatggagagtcctag

SEQ ID NO: 48869 - DNA, 5031 bp, Artificial Sequence
  Description of Artificial Sequence: Synthetic coding sequence
atgagcggcaccagcagccccgaggccgtgaagaagctgctggagaacatgcaatctgaccttagagccttatccctggagtgtaagaaaaagtttccacccgtcaaggaggctgcggagagtggcattatcaaggttaaaaccatagccgctcggaacactgaaattcttgctgcattgaaggagaattcgagcgaggtcgtgcagcctttcttgatgggatgcggaactaaagagcctaagattacacaattgtgtctggccgccattcaacgcctgatgagccacgaagtggtgagtgagacagctgctggaaacataataaatatgctctggcagctgatggagaactctctggaggaattgaagttattgcagactgttctcgtcctgttgactactaacactgtagtacacgacgaagccctctcgaaggccattgtgctttgtttcaggctccattttacgaaagataatattactaacaacactgccgccgcaacggtgcgtcaggtcgtgaccgtggtgtttgaacgtatggtcgcagaggatgagaggcatagagacattatcgagcaaccggtccttgtacagggcaactccaatagacgcagcgtatccaccctcaagccttgtgcgaaggacgcctacatgttattccaagatctttgtcagcttgttaacgccgatgccccttactggctcgtgggtatgaccgagatgaccaggacattcggcctcgagctcttggagagcgtgctaaacgacttccctcaggtgtttctgcagcatcaggagttttcttttttactaaaggaacgcgtctgtcctttagtgatcaagctgtttagccctaatatcaagtttaggcagggctcttctacatcaagcagtccagcacctgtcgaaaagccatactttccgatctgcatgagactgctgagggtggttagcgtgcttattaaacagttttactcccttcttgtgacagagtgcgaaatatttctctcactgttagtaaagttcctggatgccgacaagccacagtggctgcgcgccgtggcagttgagagcattcatcggttttgcgtgcagccccagttgctgcgctcattttgccagtcctatgatatgaagcaacactcaaccaaggtcttcagagatatagttaacgctctcggcagttttatccagtccctgttcctagttccaccaacaggaaaccctgcgacgagcaatcaagccggaaataataatttgggcggttctgtcagtgcccccgccaatagcggcatggtcgggattggcggaggagtcaccctcctaccagccttcgaatatcgcgggacatggattcctatactgacgattaccgttcaaggaagtgccaaggccacatacctcgagatgctagacaaggttgaacctccaaccatccctgaaggatacgctatgagtgtcgcctttcattgcctcctcgacctcgttcgcgggatcacttcaatgatcgaaggggagctcggcgagctagagacagagtgccagacgaccacagaggaaggctcctctcctactcagtctactgagcagcaggacctacagagcacgagcgaccagatggacaaggaaatagtttcccgcgccgtgtgggaggagatggtgaatgcctgttggtgtgggctcctggcagccctgagcctgctgctggacgcatcaactgatgaagctgccactgaaaatatcttgaaagctgagttgaccatggctgcgttgtgtggccggctggggctcgtgacatcacgagatgccttcattacggccatctgtaagggtagcctgcctcctcactacgccctgacggtactgaataccacaacagctgctactctcagtaacaagtcgtacagcgtgcaggggcagtccgtcatgatgattagcccgtcatctgagtcacatcagcaggtggttgcagtgggtcaacccctggctgtgcaacctcaaggaaccgttatgctgacttcgaaaaacatccaatgtatgcggaccctgcttaacttggctcactgccacggagccgttttggggaccagctggcagctggtgctcgcaacactccagcaccttgtgtggattctgggtctgaaacctagtagcggaggggcactgaaacccggaagagctgtcgagggtccttccactgtcttgactaccgccgtgatgaccgatctgccagtcatttctaatatcctgagtaggctgttcgaatcttcccagtatctggatgacgtgtctctgcatcatttgattaatgccttatgtagcctgtccctggaagccatggatatggcttatggtaataacaaagagcccagcctttttgctgtcgcaaagcttctggagacgggcctagtgaatatgcataggattgaaatactgtggaggcctctcacgggccatctcctggaaaaggtgtgtcagcacccaaactcacgaatgcgagagtggggtgccgaggctcttacttctctcatcaaagctggcttaacctttaaccatgatcctcctctgtcccaaaaccagcgcctccaacttctgttgttaaatccgctgaaggaaatgagcaacattaaccatcctgacattcgccttaagcaactggagtgcgtgctgcagatactgcagagccagggcgacagcctgggaccaggctggccattggtgttgggtgtcatgggcgctatacgaaacgatcagggggagtctctgattcgtaccgcgtttcaatgtctgcagctggtcgtcaccgattttttacctacaatgccttgcacctgtctccagatcgttgtcgacgtggccggctcattcgggctccataatcaggagctgaacatcagtctcacgagtatcggtctgttatggaacatttccgattacttcttccaaaggggcgagactatcgaaaaagagttgaacaaagaagaagctgctcaacagaagcaagcagaagagaagggcgttgtcctcaatcgccccttccaccctgcaccaccctttgactgtctctggctgtgtctgtacgcaaaactgggtgagctctgcgtggacccgcgccctgctgtgagaaaatcagccggccagaccctttttagtaccatcggagctcacggcactctcctccagcactccacctggcatacagtgatatggaaggttctattccaccttttggaccgcgtcagggagtcatccaccacggctgacaaggaaaagatcgaatcagggggtgggaacatattaatacaccactcccgggacacagctgaaaaacagtgggcagagacctgggtgctcactctggcaggcgtcgccagaattttcaacacccgtcggtacttgctgcagccgctcggcgacttcagcagggcatgggatgttttactcgaccacatacagtccgcagccctctcgaaaaacaacgaggtctctctggcagccctgaaaagctttcaagaaattttacagatcgtaagtccagtgcgggattcagacaagcctgaaactccccccgtagttaatgtacctgttccggtactgattggtccaattagcggcatgtcacgacccttcgtgaggacggactccatcggtgaaaagttagggcgatatagctcttctgagcctcccatcgttaccgacgaactggaagatctgaacctttggtgggccgcttggaatacctggtaccgcatcggatccgagtctaccaagcctcctatcactttcgataagttaacctttatcccttctcagcctttccttaccgctttaattcaaattttcccagctctatatcagcacatcaagacaggattcaacatggatgatctccaaaagctgggagttatcctgcattccgctatctcagttccgatttctagcgacgcaagtccttttatcctgccgtcttacaccgaggctgtactgacatctctccaagaagcggttcttactgcattagacgttctccagaaagccatctgcgtgggcccagaaaacatgcaaatcatgtaccccgccatctttgatcagctacttgcctttgtcgaattttcttgcaaaccaccgcaatacggccaactggaaactaaacatattgccaacgcgaaatacaatcagattcagctgtttgcccctgctgaatgggtcgccctcaattatgtacctttcgccgaaagatcattggaggtggtggtggatctgtaccagaagacagcctgccacaaagccgtggtcaacgagaaagtgctgcagaacatcattaagactcttagagtacccctgagtctgaagtatagctgcccaagcgaatccacttggaaactggccgtgagctccctgctgcgggtcctctccatcggcctgcctgtcgcccggcaacacgcgtcctcaggcaagtttgactcaatgtggcctgaactggccaacacgttcgaggacttcctctttactaagagcatcccgcccgacaacctgagcatccaagagttccaacggaatgaaaatatcgatgttgaggttgttcaactgatcagtaacgagatcctcccctacgccaacttcattccaaaggaattcgtgggccaaattatgacaatgctgaacaaaggctccattcattcacagagtagttccttcaccgaagccgagatcgacatcaggctacgggaagagttctccaagatgtgcttcgaaaccctcctccagttttctttctccaataaggtcacaacaccgcaggaaggctacatttcaagaatggcgcttagcgtcctccttaaacgcagccaagatgttctgcacaggtacattgaggatgaaagactgtccgggaaatgtcccctgcctagacagcaggtgaccgagattatatttgtgcttaaggccgtgtccacactgatcgactccctcaagaaaacacagccggagaatgcctgtatctccctgtttggcatcccaccatacttctag

SEQ ID NO: 48870 - DNA, 5154 bp, Artificial Sequence
  Description of Artificial Sequence: Synthetic coding sequence
atgagcggcaccagcagccccgaggccgtgaagaagctgctggagaatatgcaatccgacctcagagctttaagcctagagtgcaagaagaagtttcctcccgttaaagaggccgccgaaagcggcattattaaggtcaagacgatcgccgctcggaatacagaaattctagcggctctgaaagagaactcatctgaagtagtccaacctttccttatgggctgtggcaccaaggagccaaagatcactcaactttgtcttgcagctatacagcggttgatgtcccacgaggtcgttagcgaaaccgcagccggcaatattatcaacatgttatggcaactgatggagaattctttggaagaattaaaactgctgcagacggtactggtgcttctaaccaccaacactgtagtgcatgatgaggcactgtctaaagccatcgttttatgtttcagactccatttcacaaaagacaatattacgaataacacagccgcagccacagtccggcaggttgtgaccgtggtgtttgaacgcatggttgccgaggatgagagacaccgcgacatcattgaacagcccgtcctggtgcagggcaactctaatcggcgctctgtgtccactttaaagccctgcgccaaagacgcctatatgttatttcaggacctgtgtcagctcgtgaatgcagatgccccttattggctggtagggatgacagagatgaccagaaccttcgggttggagctactcgagagtgtcctgaacgatttcccacaagtgttcctccagcaccaggagttctccttcctcctaaaggagagggtgtgccccctggtgataaagctgttctctcccaacattaagtttaggcagggctcaagcacctcttcaagcccagcccccgtggaaaagccctacttcccaatctgtatgcgcctgctgagagtggtgtctgtgctcattaagcaattctactcacttctggtcacagagtgcgagatctttctgtccctgctagtgaagtttctggatgctgataaacctcaatggcttagagccgtggccgtggagagcattcaccggttttgtgtgcagccccaactgttacggtccttttgccagtcctatgatatgaagcagcattccaccaaggtgttcagggacatcgtgaatgccctcggttctttcatccagtccctgtttctggtgccccccacaggaaatcctgctacctctaatcaggccggaaataacaaccttggtggaagcgtgtcagctcccgccaacagcggaatggtcggcataggtgggggcgtgactctgctccccgctttcgaatatcgcggcacgtggattccaatcctaactataaccgtgcaaggcagcgctaaagccacctacttagaaatgttggacaaggtggagcctcccacaatccctgagggctacgctatgtcagtagcatttcattgcttgctggatctcgttcgcggaattaccagtatgattgagggcgagttgggagaactcgagaccgagtgccagaccacaacagaggaaggaagctctcccactcagagcacagagcagcaggaccttcagagcacctcagaccagatggacaaggaaattgtatcacgagccgtgtgggaggaaatggtgaatgcgtgttggtgcgggctgctggctgccctgagcttgctgttagatgcgagcacagacgaggctgccacagaaaacatcctgaaagcggagttgaccatggccgcattatgtggccggctgggattggttaccagcagagatgcgttcatcacagcgatttgtaagggctccctcccacctcactatgctctgacggttttgaacacgactacggcagcaactctgagcaacaagtcatattcagtccaaggccaatccgtgatgatgatctccccctcctctgagtcccatcagcaagtggtggcagttggacagccactggccgtgcaaccgcaaggaacggtcatgctaacttccaaaaatatccagtgcatgcgcacactcctaaaccttgctcactgccacggagccgtgcttggtacaagctggcaattggtcctggccaccctgcagcatctcgtctggatcctcggcctcaaaccctcaagtgggggggctctcaagcccggccgggccgtcgagggaccctctaccgttctgacgactgccgtcatgactgacctgccggtgatcagcaatatcctaagccgtctgttcgaatcttcacagtacctggacgacgtcagtctgcaccatttaataaatgctctgtgttcactctcactcgaggctatggatatggcgtatgggaataataaggaacctagtttgtttgccgtggccaaactgttggaaacgggcctggtgaacatgcaccgtatcgaaattctttggaggcccctaacagggcacttattagaggtatgccagcaccccaacagtaggatgcgcgagtggggagcggaggcccttacaagcctgattaaagccgggttgacattcaaccacgacccccccttatctcagaatcagcggctgcagctcctgctgcttaacccactgaaggaaatgtccaatataaaccacccagatatacggttgaaacagttggagtgcgtgcttcaaatcctgcagtctcagggcgattccctgggcccgggttggccattggtgctgggcgtgatgggagcaatccggaatgaccagggagagagcctaataaggacagcttttcaatgcctacaactcgtcgtcacagacttcctgccaacaatgccgtgcacctgcctccagatcgtggttgacgtagcgggctcctttggactgcataaccaagagttgaacatctctctgaccagcattggcctgttatggaacatttcagactacttcttccagagaggtgagacaatcgagaaagagttaaataaggaagaggcagctcagcagaaacaagcagaagagaaaggcgtcgtgctgaataggccctttcacccggcccccccgtttgactgcctctggttatgtctctacgcaaagctgggcgaactgtgcgtggatcctcggcctgcagtgcgaaagtctgccgggcagacgctgttcagtactattggggcacatggtaccctgcttcagcatagtacctggcataccgtcatctggaaagtgctcttccacctgttagatagggtgcgtgagtccagcaccaccgccgacaaagaaaaaatagagtccggaggcgggaatatcctgattcatcacagtagagacacagctgaaaaacagtgggccgaaacctgggtgctgacactggctggcgttgcccgcatctttaacacccgcagatatctgctacaaccactcggtgatttctcccgggcctgggatgtgctgctggatcatatccagagtgctgcactctctaaaaacaacgaagtaagtttggcggcattgaagtcatttcaggaaatcttgcagatcgtgtcgccagtgcgtgactctgacaaacccgagacgcctccagttgttaacgttcctgtcccagttctgattggccctatcagtggaatgtccagacccttcgtacggaccgactcaatcggtgagaagctggggagatactcctctagcgagcctcccattgtgactgacgagctggaagatctgaacctttggtgggccgcttggaacacttggtacaggattggctctgaaagtaccaaaccccccattaccttcgataagctaaccttcattccaagtcagccatttttgaccgcactcatccaaatcttccccgctctgtaccaacacattaaaactggcttcaatatggatgacctgcagaagttgggggtgatacttcactcggccatcagcgttcctatttcaagtgacgcttcaccgttcattttgccctcttacacagaagcggtactgaccagtctacaggaggcagtcttgacggctctggacgtgctgcagaaggccatttgcgttggccctgaaaacatgcagatcatgtatcctgctatttttgatcagctgctagcttttgtcgagttttcatgtaagcccccacagtatgggcagcttgaaactaagcatatcgccaacgccaaatacaaccagatccagctattcgctcccgctgaatgggttgctttgaactacgtcccctttgccgagcgttccctcgaggtcgtcgttgacttgtatcaaaagaccgcctgccataaggctgtggtaaatgaaaaagtgttgcaaaatatcataaagaccctcagggttcccctgagcctcaagtacagttgtccatctgagagcacatggaagctcgcagttagcagcttgttgagagtgctgagcatcgggctccccgttgccagacagcatgccagctccggaaagtttgattccatgtggccagagttggccaatacttttgaggactttctctttactaagtctatacctcctgataatcttagcatccaggagtttcaacggaatgaaaacattgacgtcgaggtagtccagttaattagcaacgagattttaccctatgctaactttatccccaaggaattcgtaggccagattatgacaatgcttaataaagggtctattcatagccagtccagttcttttactgaggctgagattgacatcaggttaagagaggaattcagcaaaatgtgcttcgaaaccctgctccagtttagcttttctaataaagtcaccactcctcaggagggatatatttcccggatggccttgtctgtcttgctgaagaggtcgcaggacgtgctgcacaggtatattgaagacgaacggctaagcgggaaatgtccccttcctcgccagcaagtcactgaaattatatttgtgttaaaggctgtgtccacacttatcgactccctgaagaagacacaacccgaaaatgtcgacggtaacacatgggcccaggtgattgctctctatccaaccctggtggaatgcatcacttgcagctcgagtgaggtttgttccgctctaaaggaggccctggtgcctttcaaagattttatgcagccgccagcttctcgtgtacagaacggggagtcttag

SEQ ID NO: 48871 - DNA, 5028 bp, Artificial Sequence
  Description of Artificial Sequence: Synthetic coding sequence
atgagcggcaccagcagccccgaggccgtgaagaagctgctggagaatatgcagtccgatctgcgagctctgtccctggagtgcaagaaaaaattccccccagtcaaagaggccgccgaaagcgggatcatcaaggtcaagaccattgcggcaagaaataccgagatcctcgcggctctcaaagagaattccagcgaggtggttcagccctttcttatgggatgcggcactaaagagccaaaaattactcagctatgtctcgccgcaatccagcgcctcatgtcacatgaagtggtttccgagaccgcagccggcaatatcatcaacatgctctggcagctcatggaaaactctctggaggagttgaaacttttacagacggtcctggtgctgttaacaaccaacacagttgtgcacgatgaagctctctcaaaagccatagtgctgtgtttcaggctgcacttcactaaggacaatattaccaacaacacagctgccgccaccgttcgtcaggtggtgaccgtggtcttcgagcgaatggtggcggaggacgaacgccatagggatattatcgagcagcccgtgctggtgcaggggaacagtaaccgccgatcagtttctacactgaaaccctgtgcgaaggacgcatatatgctttttcaggatttatgtcagctagtgaatgcagatgccccctactggctagtgggaatgacagaaatgacgcggaccttcggcctggagctgctcgagtcagttctgaatgacttcccccaggtgtttctacagcaccaggagtttagctttcttctgaaggagcgagtttgtcccctggtcatcaaattattctctccaaacataaaatttcgccaaggttcttccacctcctcgagtccagcccctgtagagaaaccgtacttcccaatctgcatgagactcttacgagttgtctccgtgctgatcaagcagttctatagcctgcttgtcaccgaatgcgaaatcttcctttcactgcttgtgaagtttcttgatgccgacaaacctcagtggctgcgggctgtcgctgtagagtccattcatcgtttttgcgtgcagcctcaattactgagaagtttttgccaatcttatgacatgaagcaacactccaccaaggtgttcagggatattgtgaatgcgctgggctcctttattcagtcattgttcctggtgccacctacaggcaacccggctacaagtaaccaggccggcaacaataatctcggaggcagcgttagtgcccctgccaacagcggaatggttgggataggtggcggcgtgactctgctcccagcatttgagtacagaggtacgtggataccgattttgaccattaccgtccagggctcggccaaggccacctacctcgagatgttagacaaggttgaacccccaaccatccccgagggttatgccatgtcggtggccttccactgtctcctggacctcgtcagagggatcacatccatgatcgagggtgagttgggggagcttgaaaccgagtgtcaaactacaactgaagagggcagctcacccactcaaagcactgagcagcaagatcttcaatccaccagcgaccagatggacaaagagatagtgtcacgagcggtatgggaagagatggtaaacgcctgctggtgtgggctgctcgctgcccttagtctgcttctcgatgcgagcactgatgaagcagcaaccgaaaacattctgaaagccgaattgactatggccgctctttgcggccgcttgggcctggtaacctcacgggacgccttcatcacagccatctgcaaaggaagtttgccgccgcactacgctcttactgtgctcaataccaccaccgcagccacactgtctaacaaatcatatagcgtccagggccaatcggtgatgatgatatcccccagctctgagagtcatcagcaagtggtagccgtcggtcagcctttagcagtccagccgcagggcacagtaatgctcacgtccaagaatattcagtgcatgcgtacacttctcaatctggcccactgccacggtgcagtgctcggaacgtcctggcaattagttctcgccactctgcagcacttggtgtggattctcggtttaaagcctagttctggtggggccctgaaacctggccgggccgtggaggggccctctaccgtgctcacgacggccgtgatgacagacttacccgtgatatcgaacattctgtcgagactcttcgagagttcccagtatcttgacgacgtatctctccatcatctcatcaatgcactctgctcactgagcctggaggccatggatatggcttacgggaataataaggagccctcattgtttgcagtcgcaaaactgcttgagacgggactagtgaatatgcatcgcatcgagatactttggcgccctctgaccggccaccttctggaagtgtgccagcacccgaattccagaatgagagaatggggggcagaggctctcactagcctcattaaagcgggcttaacattcaaccacgacccacctctttcccagaatcagcgtctacagctccttctcctgaaccctctgaaggaaatgtcaaacataaaccatcctgacatccgtctgaagcagttagagtgcgttctgcaaatccttcagagtcagggggactccctgggtcccgggtggccgctcgtgctgggcgtgatgggcgccatccgcaacgatcagggggaatccctgatccggactgccttccagtgcctccagctggtggtgaccgacttcttgcccacaatgccttgtacttgtcttcagattgtcgtagatgtagctggaagctttgggctccataaccaggaactgaatatttccctgacatctataggattattgtggaatatcagcgactacttcttccagcggggcgaaacaatcgagaaggaactcaacaaggaagaagcagcccagcagaagcaggcggaggagaagggagttgtgctgaatagaccatttcatcctgctccaccgttcgactgcttatggctgtgtctgtatgctaagctgggagagctgtgcgtggaccctagaccggccgtaaggaaatccgctggacagactcttttctccacaataggagctcacggcaccctgctgcaacatagtacttggcacaccgtgatctggaaggtacttttccacctgctggatcgggtgcgggagagctccacaactgccgataaggagaagattgaaagtggaggcggcaacatactcatccaccactcccgcgacacagctgagaagcagtgggcagaaacctgggtcctgactctcgcgggtgtcgcacgcatcttcaatactcgcagatatctgttgcagcctctgggtgactttagccgcgcctgggatgtacttttggatcatatccagtccgcggctctctccaaaaataacgaggtatcactggctgccctgaagagctttcaggagatccttcagatcgtctctcctgttcgggactctgacaaaccggaaaccccccctgtcgtcaacgtgcccgtcccagtgttgataggacccatatcagggatgtcacgccctttcgttagaacagactctatcggcgaaaagcttggccggtattcctcctccgagccacctatagtcaccgatgaactggaagaccttaacctgtggtgggctgcctggaatacttggtacaggataggcagcgagagtactaaaccccctatcacgttcgataagttaacattcattcccagtcagcccttcctgacagccctcattcagatattccctgctctataccagcatatcaagaccggctttaacatggatgatctccagaagttgggagtgatccttcattccgccatcagtgtgcccatctctagcgatgcctcccctttcattctgcctagttatactgaagccgttcttaccagcctccaggaggcagtgctgactgcactagatgtgctgcaaaaagccatctgtgtggggccggaaaatatgcagatcatgtaccccgcaattttcgatcaattgctcgcattcgttgaattttcttgcaagccaccacaatatgggcagctagagaccaagcatatcgccaatgccaagtataaccagattcaattgttcgcgcccgccgagtgggtagccttgaactatgtaccgttcgcggaacgctcccttgaagtggttgtcgacctctaccaaaagaccgcctgtcacaaagcggtcgtcaatgagaaggtgctacagaatatcattaaaacactgcgggttccattgagtctcaaatactcctgcccttctgagagtacgtggaaattggcggttagcagtctcttgcgggtcctctctatcgggctgccagtggcccgccagcacgcgtccagtggaaaatttgacagcatgtggcctgagctggccaacacattcgaagatttcttgttcacaaagtccatccctccggacaacctgagcatccaggagtttcaaagaaatgaaaacatagacgtcgaagtcgttcagctaatttcaaacgagattctcccctacgcaaattttattcccaaggaattcgtcggccagattatgactatgcttaacaagggttcgatacactcgcaatcctcaagctttaccgaagccgaaattgatataagactacgcgaggaatttagtaagatgtgctttgaaacactcctccagttctctttttccaataaagtgaccactccacaggaaggatatatttctcggatggctctgtccgtgctgctgaagagatcacaagacgtcctccatcgttatatcgaggacgagcgtttatccgggaagtgtccactgcctcggcaacaggttaccgagataatcttcgtgctcaaggccgttagtacacttatcgatagcctcaagaaaactcagccggagaacgcttgtattagtttgttcggtatccctccgtatttctag

SEQ ID NO: 48872 - DNA, 2703 bp, Artificial Sequence
  Description of Artificial Sequence: Synthetic coding sequence
atgctgctgtaccggggcgcccccgccggccccggcgcccccggctgtggacttgctcggcccggtggcggcccccaggcgttcgggatcaggctttcgactatgtccccacggtacttgcagtctaactccagtagccacacacgccctttttctgcgatcgctgaacttctagacaatgctgtcgaccccgatgtgagcgcccgtactgtgtttattgatgtcgaagaggtaaagaataagtcatgtctcacatttacagatgatggatgtggaatgacgcctcataagctgcacaggatgttgtctttcggttttaccgataaggtaataaaaaaatcccagtgtcccataggagttttcggtaacgggttcaaatcgggctcaatgcgcctggggaaggatgccttggtctttaccaaaaatggcggaacacttactgtgggactcctgtctcagacttatctggaatgtgtacaagcacaagccgtcatagtgccaatagttccgtttaatcagcagaataagaaaatgatcatcacagaggacagcctgccgagcttggaagcgatcttaaactacagcatctttaatcgagaaaatgacctgctggcccagtttgacgcaatacccggaaaaaaaggcaccagggtcttaatttggaacattcgacgcaataagaacgggaagagtgaactggatttcgacacagaccagtacgatattctagtgagcgattttgataccgaggaaaagatgactggtggtgtcacgtcggaattacccgagacagaatattctctaagagcattttgcggcattctgtacatgaagcccagaatgaagatctttctgaggcaaaagaaagtgacaactcagatgattgccaagtctttggccaatgtcgagtatgatacttataaaccaacatttaccaacaagcaggtccgtatcacattcggctttagttgcaagaactcaaatcaatttggaatcatgatgtatcacaataaccgactcatcaagtcatttgagaaagtgggctgtcaggtgaagccgactaggggggaaggcgtgggcgtcatcggtgtgattgaatgtaactttttgaagcctgcctataacaagcaggacttcgagtataccaaggaatataggcttactattaacgccctggcacaaaagctgaacgcctattggaaggagaagacctcccaggataactttgaaacgagcacggtggcccgcccaattccgaaggtgcctgaccagacttgggtgcaatgcgacgagtgtctgaaatggaggaagttgcccggcaagattgatccttccatgctcccagcgcggtggttctgctactacaactcccatcccaaataccgcaggtgttccgtgcccgaagagcaagagcttaccgacgaagatctgtgccttagtaaagctaaaaagcaggagcaaacagttgaagagaagaaaaaaatgcccatggaaaatgagaaccatcaggttttctcaaatccaccgaagatactcactgtacaagagatggcaggactgaacaataagactatcggctacgaaggcattcattcgcctagtgtactgccatctggcggcgaagaaagcagatctccatcactgcaactcaaaccactggactcctcagtcttacagttttcatctaagtataaatggatccttggtgaggaaccagtggaaaagcgaaggcgcctacagaatgagatgactacaccatccctggattatagtatgcccgcaccttatagacgggtggaggctcctgtcgcctaccccgagggcgaaaattcccacgacaaaagttcttccgagaggagtacacctccctatttgttcccagaatacccagaagctagcaagaatacagggcagaatcgggaagtctctattctctatcccggggctaaggaccagcgacaaggctcactgttgcccgaggagttggaagatcagatgccacgcctcgtcgcggaggaaagcaaccggggatccaccacaatcaataaggaagaggtgaataaagggccctttgtggcggttgtgggagttgcaaagggggtcagagacagcggggcgccaattcagttaatcccattcaaccgcgaggagctggccgagcgtagaaaggctgttgagtcatggaatcccgtgccatattcagtggcctctgctgccatacctgcagccgcgatcggcgagaaagccagggggtacgaggagtctgaaggtcacaatacccctaaacttaaaaaccagagggaacttgaggagctgaagcgcactaccgagaaactcgaaagagttttggccgaacgcaacctgttccaacagaaagtggaggagcttgaacaggaaaggaatcattggcaatccgagttcaagaaagtccaacatgagttggtcatctatagtacacaggaagccgagggcctttactggagcaagaagcacatgggatatcgacaggccgaattccagatcctaaaagccgaactggagaggaccaaagaagaaaagcaggaactgaaagagaagttaaaggaaaccgaaacgcatctcgagatgttgcagaaggcacaaggttttggaaaggcatatgcagccacataccctagacagcttagcccctatttttgcccaccatctctaggcgcctcttag

SEQ ID NO: 48873 - DNA, 2814 bp, Artificial Sequence
  Description of Artificial Sequence: Synthetic coding sequence
atgctgctgtaccggggcgcccccgccggccccggcgcccccggctgcggcctcgctagacccggtggaggaccccaggcatttggcatacgcctgtctacaatgagtccaaggtacttgcaaagcaattctagtagtcatacccgacccttttctgccatagccgaattactggacaatgccgtggatcctgatgtcagcgctcgcactgtattcatcgacgtggaagaagtgaagaataagagttgtcttaccttcaccgacgatggctgtggaatgacacctcacaagctgcatagaatgctgagttttggctttaccgacaaggtcataaagaagtcccagtgtccaataggggtgtttggcaatggcttcaaaagcggcagtatgcgactggggaaagacgcactagtatttacaaagaatgggggaacattgactgtcggtctgctttctcagacatacctcgagtgcgtccaggctcaagcagtaatcgtgcccatagtacctttcaaccagcagaacaaaaaaatgattataaccgaggactccttgccctctttagaggccatcctgaattattcgattttcaatcgcgagaatgatttgttggctcaattcgatgccatcccgggtaagaagggaacgcgcgtgctgatttggaatatcagacgtaataaaaatggcaagtcagaacttgatttcgacaccgaccagtacgacatcctcgtctctgacttcgacaccgaggaaaagatgacaggtggagttacgagtgagctcccggaaactgagtacagtctccgcgccttttgtggcatcttgtacatgaagccaagaatgaagattttcctgcgtcaaaagaaggtcacaactcagatgatagccaaaagtctggccaatgtggaatacgacacgtacaagcccacttttactaataagcaggtccgcattacttttggattttcctgcaaaaactccaaccagttcgggattatgatgtatcacaataacagactgatcaagagtttcgaaaaagtgggctgtcaggtcaagcccactagaggcgaaggggtcggggttatcggtgtgatcgagtgcaattttctgaagccggcctataataagcaggatttcgaatatacaaaggagtaccggctgacaattaatgccctcgcacagaagcttaacgcctactggaaagaaaaaacctcgcaggataatttcgaaacgagcacagtggcacggcctattcctaaggtccctgaccagacctgggttcagtgtgatgagtgtctgaaatggcgcaagctccctggcaagattgacccatccatgctgcccgccagatggttctgttactataacagccaccccaagtatcgcagatgcagcgtgcctgaggagcaggagctgacagacgaagacctgtgcctaagcaaggcaaagaagcaggagcagactgtggaggagaagaaaaagatgcctatggagaatgaaaatcatcaggtcttttctaaccctccaaagattctaactgtgcaggagatggctggcctcaacaataaaacaatcgggtatgagggaattcactctcccagcgtgctgccctctggcggcgaggagtcacggtctccttctttgcagctcaagccattggacagtagcgtgctccagttttctagcaagtacaagtggatacttggcgaagagcctgtagagaaaaggaggaggctgcagaatgaaatgaccacacctagcctcgattattccatgcctgcaccctataggagggtagaagctccggtggcatatccagagggggaaaatagtcacgacaagtcctcgtccgagagaagcactccgccctacctgttccccgagtacccagaggcgagtaagaatacaggtcagaatcgcgaagtgtcaatcctgtacccgggcgcgaaggatcagcgtcaaggctctctcctcccggaagagcttgaggatcagatgcctcggctagtggcagaggagagcaatagaggaagcacaaccattaataaggaagaagtgaacaagggtccatttgtagccgttgttggggtcgctaaaggagtcagggacagtggagcacccatccagcttataccttttaacagagaggagcttgcagaacggcgtaaagctgtcgaatcttggaatcccgtgccctatagcgtagcttcagctgcaatcccagcagccgctatcggagagaaggcccgaggctatgaggaaagcgagggccacaacactcccaaacttaagaatcagcgggaactggaagagctcaagcgcaccacagaaaagttagagagagtcttagccgaacgtaatcttttccaacagaaggtcgaggaactggagcaggaaaggaaccattggcaatctgagtttaaaaaggtgcagcacgaacttgtgatatattcaacacaagaagccgagggtctatattggtcaaaaaaacacatggggtaccggcaggccgagttccagatcctaaaggcggagttagagcggacaaaggaagagaagcaggaacttaaggagaaactaaaggaaacagaaacgcacctcgagatgctgcaaaaggcccaggtgtcttacaggaccccagagggagacgatctggagagggcattagctaagttaactaggctgcgcatacatgttagctacctgctgacgagcgtgctgcctcacctggaactgcgcgaaatcgggtacgatagcgaacaggtagacgggatcctgtacacagtgctggaggcaaatcatattcttgactag

SEQ ID NO: 48874 - DNA, 1947 bp, Artificial Sequence
  Description of Artificial Sequence: Synthetic coding sequence
atgaccggcggcgtgaccagcgagctgcccgagaccgagtacagcctccgtgctttctgcgggatcttgtatatgaaacccagaatgaagatcttccttcggcagaagaaggtgaccacccagatgattgcaaaatcactggccaacgtcgaatacgatacatacaaaccaacctttactaataagcaggtgagaataacattcgggttcagctgcaagaattccaatcaattcggaatcatgatgtaccacaacaatagattaattaaatcctttgaaaaggtgggttgccaagttaagccaacaagaggcgagggcgtgggtgtcataggagtgatcgagtgcaattttttgaagcctgcctataacaaacaggatttcgagtacactaaggagtacagactgacaattaatgccctcgcccagaaattgaatgcctattggaaagagaaaacgagccaggacaactttgaaacaagcacagttgcccgtcccatccctaaggtcccagaccagacgtgggtccagtgtgatgagtgccttaaatggaggaaactcccaggtaagattgacccttctatgctcccagcccggtggttctgctactacaattcccacccaaagtatcggcggtgcagcgttccagaagagcaggaacttaccgacgaagatttgtgtttgtctaaagctaaaaagcaggagcagactgtcgaggaaaaaaagaagatgcctatggaaaatgaaaaccaccaggtgttttctaatccccccaaaatactcaccgtgcaggagatggctggactgaataataagaccattggttacgagggaattcacagcccaagtgtgctgccttcaggaggagaggagtcaaggtcgccgtctctacagctgaaacccctggatagtagcgtccttcagttcagtagtaagtacaagtggattctgggcgaggagcctgtagagaagagaaggcgtttacagaacgagatgactactcccagtctcgactattctatgccagcaccctacaggcgggtggaagctcccgtggcatatcctgaaggagaaaacagtcacgataagtcaagctcggaaaggtcaaccccaccctatctttttcctgaatatcctgaggcgtcaaaaaataccggccagaatagggaagtgagtattctttaccccggcgctaaagaccaacggcagggtagtcttctccctgaagagctcgaggatcagatgccaaggctggtagctgaggagtccaatagaggcagcacaactattaataaagaggaagttaacaaagggccctttgtggcggttgtcggggttgccaagggtgtgcgcgactccggcgcacctatccagctgatcccgttcaatcgggaagagctcgcagaacgccggaaggccgttgagtcctggaatcccgtgccctacagcgtggcatccgccgcaattccagcagcagctatcggtgagaaagctaggggatacgaagagagcgagggacacaacactcctaaactgaaaaaccagagggaactggaggaactcaagcggaccaccgagaagcttgagcgtgtactggctgaaaggaatctgttccagcagaaagtagaggagctcgaacaggagagaaaccactggcagagtgagtttaagaaagtccagcatgaactagtgatctacagcactcaagaggccgagggcctctactggtccaaaaagcacatgggctaccgccaagcagagtttcagatactgaaagctgaactagagcggacgaaggaagaaaaacaggagcttaaagagaagctaaaagagactgagacccacctcgagatgttgcagaaggcgcagggtttcggaaaggcctacgctgccacctaccctcgacagttaagcccatacttctgcccgccaagcttaggggcttcatag

SEQ ID NO: 48875 - DNA, 384 bp, Artificial Sequence
  Description of Artificial Sequence: Synthetic coding sequence
atgcggcccctggacatcgacgaggtggaggcccccgaggaggtggaggtcctggaaccggaagaagattttgaacaatttctgctgcccgtcattaatgagatgcgcgaggatatcgcgtctttaatccgcgaacacggccgggcgtatctgcgtactagaagtaagttgtgggagatggacaacatgctaatacagattaagacccaagtggaggcaagcgaggagagtgctttgaatcacgtacaacaccccagtggggaggcagacgagagggtctcagagctttgtgaaaaggcggaggagaaagccaaggaaattgccaaaatggctgaaatgctcgtggagctggtctggcgcatagagcgcagtgaaagtagctag

SEQ ID NO: 48876 - DNA, 471 bp, Artificial Sequence
  Description of Artificial Sequence: Synthetic coding sequence
atggccgccgccggcgagggcacccccagcagccggggcccccggcgagatccaccccgacggcctccaagaaatggacatggaaagctgctgttcaaagacgggtcatactacgagggagctttcgtcgacggcgagatcaccggcgaaggccgtagacattgggcctggtccggtgataccttcagcggtcagtttgtccttggagagccccagggttacggggtgatggagtataaggcaggtgggtgctatgagggcgaggtgtcccacgggatgagagagggacacggctttctggtggatcgggatggccaggtataccagggctctttccacgataacaagcggcacgggcccggacagatgctcttccaaaatggcgacaagtacgacggcgattgggtgagagaccgccgccaggggcacggggtactccgctgtgctgatggctccacttataaactttag

SEQ ID NO: 48877 - DNA, 1053 bp, Artificial Sequence
  Description of Artificial Sequence: Synthetic coding sequence
atggccgccgccggcgagggcacccccagcagccggggcccccggcgcgaccctccgcggaggccgcctcgcaacgggtacggggtgtacgtgtatccaaacagcttttttcggtacgagggtgagtggaaagcgggtcgaaaacacggtcacggaaagcttctgtttaaggacggaagctactatgagggggctttcgtggatggggagattaccggggagggtcgcaggcattgggcctggtcaggcgatacctttagcgggcagttcgtccttggggagcctcaggggtacggcgtcatggaatacaaggcagggggttgctacgagggcgaggtcagtcatggaatgagggagggccatggctttctagtagaccgcgatggtcaagtctatcagggctcctttcacgacaataaacggcacggacctggtcagatgctgttccagaatggcgataagtacgatggagattgggtgcgggacagacggcagggacacggcgtgctgaggtgtgccgatggctcgacatataagggtcagtggcattcagatgttttttccggcctgggctctatggcccattgcagcggagtcacttattatggcctgtggatcaacggtcaccctgccgaacaggctacaagaattgtgatcctggggccggaagtgatggaggttgctcagggaagcccgttttccgtgaatgtccaactgctgcaagaccacggggagattgccaaaagcgaaagcggccgcgtcctccagatcagtgccggggtccgttacgtccagctctccgcatatagtgaggttaatttctttaaggttgatcgtgataatcaggaaactctcattcagaccccattcggattcgagtgcatcccgtatcccgtatcttccccggctgcgggagtgccggggcccagagctgcaaaggggggcgccgaagcagacgtcccgcttcctcgcggagacctagagcttcacttgggagcactccacggacaggaagatacacctggcggcttgctaggaagcagtttgttctag

SEQ ID NO: 48878 - DNA, 1494 bp, Artificial Sequence
  Description of Artificial Sequence: Synthetic coding sequence
atggccgccgccggcgagggcacccccagcagccggggcccccggagggacccaccgcgcaggccaccacgaaatggctatggcgtctatgtctacccaaactccttttttcgatacgaaggggagtggaaagcagggcgcaagcatggccacggcaagctgctcttcaaggatggctcttactatgagggagcctttgtagacggggaaattactggggaggggcgaagacattgggcttggtcaggcgacaccttttccggacagtttgtgctcggtgagccccagggttacggggtgatggagtacaaggccggaggatgctacgaaggagaagtcagtcacggtatgagagaaggtcatggttttctggtcgatcgagatggccaagtttatcagggctcttttcacgacaacaagagacatggccccggccaaatgctattccagaacggggacaaatacgacggcgactgggtccgcgaccgcaggcaaggtcacggagtcttgaggtgcgccgacgggtccacctataagggacaatggcactctgacgtcttctctgggctgggatctatggctcattgttcaggcgtcacctactacgggctgtggatcaacggccacccagcagaacaggccaccaggattgtcattctggggccagaggtgatggaagtagcccagggctccccattttcagttaatgtgcagttactacaggaccatggcgagatagccaaatccgaatctggaagagtgctgcagatcagcgctggtgtacggtatgttcagctgagcgcatatagcgaggtgaacttcttcaaagtagatagagacaaccaggaaaccttaatccagactccatttgggttcgaatgcatcccctatcccgttagctcccccgcagcaggcgtgccaggtccccgggctgccaagggtggagcagaagcggacgttccactgcctagaggggacttggagctccatctcggcgcgttacatggccaagaagacactcccggaggacttctggcccgcggccacgcacctcattgccctggggcttgccagagagtggagcagggctgtgccgaattcaccgacgtcctattggggcctcctcctcctggttatcatcctttcctctttctagactccctccacaagaaggcaggaggtcggagccggggcggcctgcatcctcgcggaacccctcctaccgcacaagagccacctggcggaagccggccagaaggtcgtgccaccgaggaacaggcagcagctgcccatctcggagagtacgtccttatgatccgagatgtcacaactccgcctttcctaggccgccgactaccccctgctttcaaacacctgcgggtcgtcgcgaagcgggccgggcagccgccgcatgtattagaggagggacctgaggcctccagctcttggcaagcagcccacagttgtacgccagaaccaccagcaccaagatag

SEQ ID NO: 48879 - DNA, 456 bp, Artificial Sequence
  Description of Artificial Sequence: Synthetic coding sequence
accgccaccacccggctgcccctgctgcgggtggacagcgtgcgggtatcaccacgaaatggcgacaaatatgacggggactgggtgcgggatcgacgccaaggacacggggttcttcgttgtgcagacgggagtacctacaagggtcaatggcatagcgatgtgttcagtggcctaggctctatggcccactgttcgggcgtaacctactatggactgtggattaacggtcacccagctgagcaggccacgcgaatcgtgatcctggggccagaggtgatggaggttgctcagggctcacccttcagcgtgaatgtgcagctcttgcaggaccatggcgaaattgccaaaaatggggtttctctgctgctttcaaggcttgaatgttctggcgccatgtctgcccttaggaacctgcggctccctagatcctctgattccgcgcttgccagctag

SEQ ID NO: 48880 - DNA, 558 bp, Artificial Sequence
  Description of Artificial Sequence: Synthetic coding sequence
gtgaccggcagctgctacctgaagatggccgtgatcaccaagggccgactttggacggagcggagccgggagaaagccgctggcacgggccccggtcaagagaccccatcactggattcgttgttttgggagtctttaaaggcaaccgcaagttggtccacaaagcctgcagatgtgatgaagggcagatcaccgaccgcatgtgggaaggatacaggtttctggtggaccgggatggacaaatgcaccagagccccatccatgactaccaggggaacggccttgggccggtgctcgttccgcacagtgacttccaccaccgcaaccggttctgggacaggagttcgggatacaggctgctgcgccgcgcctaccgcccccccaacctcctccgacccacccatctactctcggagaaattcacgacgacacagattgctgccccggcaccacgagcttcgcgtaggtgaggcgcctccaggggacttatttagtctttcgactgctggggtgttcagtgctaatcgggtgagttgtctggccgcaagtattccatag

SEQ ID NO: 48881 - DNA, 240 bp, Artificial Sequence
  Description of Artificial Sequence: Synthetic coding sequence
atgaacggcttcggccggctggagcacttcagcggcgccgtgtacgaagggcagttcaaggataatatgtttcacggtctcggaacgtacacctttccaaacggggccaagtatactgggaactttaatgagaatcgcgtggaaggggaaggggaatataccgacattcagggactggaatggagcggaaattttcacttcaccgcagctcctgatctgaaattgaagctgcatatgtag

SEQ ID NO: 48882 - DNA, 240 bp, Artificial Sequence
  Description of Artificial Sequence: Synthetic coding sequence
atgaacggcttcggccggctggagcacttcagcggcgccgtgtacgagggccagttcaaggacaacatgtttcatggtctgggtacatatacattccctaatggggccaagtatacgggcaacttcaacgagaacagggtggagggggagggcgagtacactgacattcaagggctcgagtggtctggaaattttcactttactgccgctcctgacctcaagcttaagctgcacatgtag

SEQ ID NO: 48883 - DNA, 240 bp, Artificial Sequence
  Description of Artificial Sequence: Synthetic coding sequence
atgaacggcttcggccggctggagcacttcagcggcgccgtgtacgaaggtcagtttaaagataacatgtttcacgggctcggaacttacacatttcctaatggtgcgaaatacactggcaattttaatgaaaaccgggtggagggcgaaggcgagtacacagatatccagggcctcgaatggagtggaaatttccacttcaccgctgctcccgacctgaaacttaagttacatatgtag

SEQ ID NO: 48884 - DNA, 723 bp, Artificial Sequence
  Description of Artificial Sequence: Synthetic coding sequence
atgcccgtgagcaagtgccccaagaagagcgagagcctgtggaagggatgggataggaaggcccaacgcaacggcctcagatctcaggtctacgcggtgaatggagattactatgtgggggaatggaaggataacgtgaaacatggaaagggcactcaagtgtggaagaaaaagggcgcaatttatgaaggtgactggaagttcggcaaaagggatgggtacggaacattatcgctccctgaccagcagacaggtaagtgccgacgcgtgtattcaggctggtggaagggcgataagaaaagcggctatggaatacaattttttggacctaaggaatattatgaaggggattggtgtggctctcaaagatccggctgggggaggatgtactactcaaatggggatatatacgagggccagtgggagaacgacaagcctaacggagaaggaatgctgcgcttaaagaacggcaatcgctacgaaggctgttgggagaggggcatgaagaatggcgcgggcaggtttttccatctggaccacggccagctgttcgaaggtttttgggttgacaatatggccaaatgcgggactatgatcgatttcggaagagatgaggccccagaacccacccagtttcctattccagaggtgaaaatcctggatccagatggcgtgctggcagaagctttggcaatgttccgcaagactgaagaaggcgactag

SEQ ID NO: 48885 - DNA, 441 bp, Artificial Sequence
  Description of Artificial Sequence: Synthetic coding sequence
atgaccctgaccaagggcagcttcacctacagcagcggcgaggagtatcgcggggagtggaaggagggacggaggcacggctttgggcagctgatgttcgccgatggaggtacgtacttgggacattttgagaatgggctgttcaacggttttggtgtcctgacgttttccgacggttctcggtacgagggagaatttgcccagggaaaattcaatggagttggcgtattcatcagatacgataatatgacgtttgaaggagaatttaaaaatggtcgcgtcgatggatttgggttgctgacattcccggacggctctcatggcataccaagaaatgaaggcctctttgaaaataacaaactcttacgcagggagaaatgctccgctattgtacagagagcacagagtgcgtctaaatctgcccgaaacttaaccgcttag

SEQ ID NO: 48886 - DNA, 615 bp, Artificial Sequence
  Description of Artificial Sequence: Synthetic coding sequence
atggcctggagccgggccggccccatgcggagcggcgtggcccccgggtgtcttggcaactcccaatgggcagccggaattgtacctagcgccgtggctcaggatggcggggtgaagtggggaaatcgttggtggagatggcggcgggcaaggtggcaacctggagcacatcagcgcaaatcacctaggaggtggaatcctgcttccaggagagatgggcaccccgagagacctgctcccggcagaaggcatgggttcgggcagcttatgtttgccgatggaggaacatacctgggacattttgagaatggcctgtttaatggatttggggtcctaacattctccgatggctcacgctacgaaggtgagttcgctcaggggaaattcaatggggtaggtgtctttatccgctacgataacatgacttttgagggcgagttcaagaatggacgggtggacggcttcggcttacttacattcccagacgggtctcacgggatcccacgcaatgagggtttgtttgagaacaacaagttactgcgcagagaaaaatgctcggctatcgtgcaacgcgcacagtctgcttcgaaatctgcgagaaacttgacagcttag

SEQ ID NO: 48887 - DNA, 441 bp, Artificial Sequence
  Description of Artificial Sequence: Synthetic coding sequence
atgaccctgaccaagggcagcttcacctacagcagcggcgaggagtatcgcggtgaatggaaagaaggacggcgacacggctttgggcagctgatgtttgccgatgggggcacctacctcggccactttgagaacggtttattcaacggcttcggcgtgctgacgttttccgacggcagcaggtatgagggggagttcgcccaggggaagtttaatggagtgggcgtatttatcaggtatgataacatgaccttcgagggtgagtttaaaaacggtagagttgatggtttcggattgctcacttttcctgacgggtcccacgggataccacgaaatgagggcctattcgaaaacaacaagctcctgagaagggagaaatgctctgcaatagtccagcgggctcagtctgctagcaagagcgccaggaatcttacggcgtag

SEQ ID NO: 48888 - DNA, 486 bp, Artificial Sequence
  Description of Artificial Sequence: Synthetic coding sequence
atggagtacaccggcagcaagtacatcggcgagtacgtggacggccgtatggagggcaaagctaagtacattctacccaccgaaactatttatgttggagagatgaaggacggcatgttccacggagaaggaaccctgtacttcccttctggctctcaatatgacgctatctgggagaatggcctggcaataaagggcacttacacctttagtgacggcttgcattacgacgaaaaaaattggcactactgtgacggatacgatcggcgtttttatacggaaatcttgaacgggttaaaacctgccggtatggcacagcttacaaatatggatcctcccaggaagatccctaaaggctactacgattgcggagatgggttttacaatccagtgacccgcgtggtgaaggattaccgaaatagattcctacgtaatgctgacgacgacgagcacgagtggataacccgcacatgccgcaagggctag

SEQ ID NO: 48889 - DNA, 333 bp, Artificial Sequence
  Description of Artificial Sequence: Synthetic coding sequence
atggagggcaaggccaagtacatcctgcccaccgagaccatctacgttggtgagatgaaggacggaatgtttcacggcgagggcacgctgtattttccttctggctcccagtatgacgctatttgggagaatggactcgcaattaagggaacatatacattctccgatggactgcactacgatgagaagaactggcactactgcgatggttatgacaggaggttttataccgagatattaaatggccttaaacctgcaggtatggctcagctaacaaacatggaccccccccggaaaattccaaaaggttactatgattgcggggacgggtag

SEQ ID NO: 48890 - DNA, 528 bp, Artificial Sequence
  Description of Artificial Sequence: Synthetic coding sequence
atggagtacaccggcagcaagtacatcggcgagtacgtggacggcaggatggaaggcaaggccaagtacatcctgccaactgaaacgatctacgtgggggaaatgaaagacggcatgttccacggcgaagggacgctctatttcccctcaggctcccagtatgacgcaatttgggagaatgggttggccatcaaaggaacatataccttctctgacggactacactatgatgagaaaaattggcactattgcgacgggtatgatcgccggttttacactgagatcctcaacggattaaagcccgccggcatggcacaactaactaacatggaccctcctaggaaaatccctaaaggatactatgactgcggcgacggcttctataatcccgtcaccagagtagtgaaagattacaggaatcggttcctccggaatgctggacgctttttaccaacattacaacacgttttttcttcccccacttacgagtacgtgcatctatacgtgcaaatgtatgcacatacatag

SEQ ID NO: 48891 - DNA, 1416 bp, Artificial Sequence
  Description of Artificial Sequence: Synthetic coding sequence
atggccgcccccgagcccctgagccccgccggcggcgccggcgaggaggcccctgaggaggatgaagacgaggccgaggcggaagacccagagcggcctaatgccggggccggaggcggaaggtcaggcggcggagggagtagcgttagtggcggcggaggcggcggaggcgcaggcgctggagggtgtggtggaccaggcggtgccctgactcgacgggccgtgacgctgagggttctcctgaaagatgcgctcttggagccaggcgctggggtgttatctatctattatctgggaaagaaatttcttggcgatttgcagcccgacgggcgcatcatgtggcaggaaacggggcagactttcaactccccttccgcctgggctacacattgtaagaaactggtgaatcccgctaaaaaatctggctgcggatgggccagcgtgaagtacaaaggccagaagttggacaagtacaaagccacatggctgagactccaccagttgcacacacctgctaccgcggccgacgaatcaccggcgagcgagggtgaggaagaggaactgctgatggaggaggaagaggaggatgtcctggcgggagtgagcgctgaagacaagagcaggcgccccctagggaaatccccctccgagcctgcgcacccggaggctaccactcctggaaagcgtgtggactctaaaattcgagtcccggtaagatattgcatgctcgggtcccgcgatctcgcacggaatccacatacgctggtggaagtgacctccttcgcagcgataaacaaattccagcctttcaatgtggcagtatcttccaacgtcttatttttgctggacttccacagccatttgaccaggagtgaggtcgtcgggtaccttggcggaaggtgggatgttaactcacagatgttgacagtgttgcgggcgttcccatgtcggtcaagactgggggatgccgagactgccgctgcgatagaagaagaaatataccagagtctgtttctccgggggctatccctggtcggatggtatcactcacacccccattctccagccctgccctccctacaggacatagacgctcaaatggattaccaattgaggttgcaaggctcctccaacggttttcagccatgcctggcactgttgtgcagtccatactacagtggtaatccaggccccgaatctaagatttctcccttttgggtgatgccccctcctgaaatgctactggtcgagttttataaaggcagtcccgatttggtgaggttacaggaaccctggtcgcaggaacacacttacctggacaagctgaagattagcttggcctcccggactcctaaagaccagtcgttgtgccacgtcctggagcaggtgtgcggggtcttgaaacaaggcagctag

SEQ ID NO: 48892 - DNA, 1356 bp, Artificial Sequence
  Description of Artificial Sequence: Synthetic coding sequence
atggccgcccccgagcccctgagccccgccggcggcgccggcgaggaagctccagaagaggacgaggatgaagcggaggcagaggaccctgaaaggcccaacgcgggggcagggggcggtcggagtggaggaggtggaagctcagttagcggcggaggcggcggtggcggtgctggggctggaggatgcggagggcccggaggcgcacttacacgcagagctgtgaccctgcgggtgttgctgaaggacgccctcctggaaccgggcgcaggcgtgttatctatctattatctggggaaaaaattcctcggtgacttgcaacccgatggtagaattatgtggcaggaaacgggccagacattcaatagcccatcagcatgggcgacccactgtaaaaagttagtaaacccggctaagaaatccggatgcggctgggccagcgtgaaatacaaaggtcagaagttggataaatacaaggctacctggctgaggctgcatcagttgcatactcctgccacagcagctgacgagtcaccagcaagtgaaggtgaagaggaggagttactcatggaggaggaagaagaggacgttttggccggagtgagcgcggaagacaaatcacgtcgccctctgggcaagtccccaagcgaacccgctcaccccgaagccacaacgccaggcaagcgtgtcgattccaaaatcagggtccctgtgaggtactgtatgctcggctccagggacctcgccagaaacccgcacaccctggttgaagttacgtcgtttgccgccataaacaaattccaaccctttaatgtggctgtttccagtaacgtgctgttccttctgatctatcagtctttgttcctgagaggcctcagtcttgttggttggtaccatagtcacccccattcccctgcccttccctcgctgcaggatatagatgctcagatggattatcagctcagactgcagggcagcagtaacggcttccagccgtgcctggctttgctatgcagtccatactacagtgggaaccccggacctgagtctaagatctcccctttttgggtcatgccaccccctgaacagaggccttcagactatggcatccccatggacgtggaaatggcttacgtgcaggacagctttctgacaaatgacatcctacatgagatgatgctgctggtggagttttacaaaggatcccccgatctcgtgagactgcaagaaccctggagccaggaacacacctacttagataagcttaagatttccctggcttcccgtactcccaaagaccagagcctatgccacgtgctcgagcaagtgtgcggagtattgaagcaggggtcttag

SEQ ID NO: 48893 - DNA, 1035 bp, Artificial Sequence
  Description of Artificial Sequence: Synthetic coding sequence
tgagccagcatgctgcccgagcagctgtacttcctgcagagcccccccgaagaagagccagagtatcaccccgacgcatctgcacaagagctgaacgtcagggaaagtgacgttcgggtttgcgatgagagcagttgtaaatatggcggggtatgcaaagaggacggcgacggcctgaaatgcgcgtgtcaattccagtgccataccaactatatccccgtttgtggtagcaatggcgatacataccaaaacgaatgcttcctcagaagagccgcttgcaaacatcagaaggaaataaccgtgattgcacgcgggccctgctactctgacaacggctcaggctccggcgaaggcgaggaggaaggcagcggagcagaggtccacaggaagcactccaagtgcggtccctgtaaatacaaggctgaatgcgatgaggatgcagagaatgtgggctgcgtttgcaatattgattgcagcggctactcctttaaccctgtgtgcgcgtccgacgggtcttcatataataatccctgtttcgtgcgggaggcatcctgtatcaagcaggaacagattgatatccggcacttgggccactgcaccgacactgatgatacaagcctgcttggtaaaaaagatgatggtttacagtaccggcctgatgtcaaggatgcaagtgatcagagggaggacgtctacatcggcaaccatatgccttgtcccgagaacttaaatggatactgcatccatggaaagtgtgagttcatctattcaacacagaaggctagttgtcgttgcgagagtggatataccggccagcactgtgagaagacagatttctctatcctatatgtagtaccctcccgccagaagctgacccatgtgctgatcgcggcaattatcggtgcagtccagatagccattatcgtggctatagtgatgtgcatcacccgtaaatgcccgaagaacaacagaggtagacgccagaagcagaaccttgggcattttacctcggacacttcctctaggatggtgtag

SEQ ID NO: 48894 - DNA, 573 bp, Artificial Sequence
  Description of Artificial Sequence: Synthetic coding sequence
ggcagcttcgtgcccgccgaggaggccgagatcggcgccgtggacgctatcttcacccggatccatagctgcgagagtatttcactgggcctaagcactttcatgatagacttgaaccaagtggcaaaggccgttaataacgccactgcccaaagcctggtgctgattgatgagtttggtaaggggaccaataccgttgacggactggcactgctggccgctgttctgcgccactggcttgcaagaggccccacttgcccacatatttttgtggccacaaattttctgagcctagtgcagctgcaactgctgccccagggtcccttggtgcagtatctgaccatggagacatgtgaagatggtaatgatcttgtgtttttctatcaggtcagtgacctgatcagaagtgggaaacccattaaaccagttaaagacttgcttaaaaagaatcaaatggaaaattgccagaccctcgtcgacaagttcatgaagttggatttagaggaccccaacctggatttgaatgtgttcatgtcgcaagaagtgctcccggcagccacttccatactgtag

SEQ ID NO: 48895 - DNA, 1146 bp, Artificial Sequence
  Description of Artificial Sequence: Synthetic coding sequence
atggccgccttcggccggcaggtgctggactggcaccggctgatccccctgacatgggcctgcatggcccgccagacacctcaccttggcgaacagaggagaactaccgccagcttgctccgaaaactcactacagccagtaatggtggagttattgaggagctcagttgcgtgcggagcaacaactacgtgcaggaacctgagtgccgacggaatctcgtccaatgcctcctcgagaaacagggtactccggttgtgcaaggaagtcttgagttggagagagtaatgagttctctgctcgatatgggcttttccaatgcgcatataaacgagctcctcagcgtgcgccgcggcgcgtccttgcagcaactcctggacattatcagcgaatttatcctgctaggccttaaccccgaaccggtctgcgtggttctcaagaaatccccccagctgttgaaattacccatcatgcagatgcggaaacgctcttcctacctccagaaacttggattaggagaaggtaaactgaagagggttttatattgctgtcccgagatctttacaatgcgacagcaggacattaacgatacagtgcgcttattaaaagaaaagtgtctgttcaccgttcagcaggttaccaagatcctgcattcctgtcccagtgtgctgcgagaagatctggggcaattggagtataagttccaatatgcctatttccgaatgggaataaagcacccggatatcgttaaatctgagtacctgcagtactctctaacaaagattaaacaacgccatatttacctagagagactcggtcggtaccagaccccggataagaaagggcagactcagatcccaaacccactgctgaaggacatcctgagggtgtcagaggccgagtttctggcacgcacagcttgtacaagcgtagaagagttccaggtgttcaaaaaattactggcaagagaggaagaggaaagtgagagtagtacgtccgatgataaacgggcctccttagatgaggatgaagatgacgatgatgaagaggataatgatgaggatgataacgacgaggacgacgacgacgaggatgacgatgaggccgaggacaatgacgaagacgaagatgatgacgaagaagaatag

SEQ ID NO: 48896 - DNA, 75 bp, Artificial Sequence
  Description of Artificial Sequence: Synthetic coding sequence
atggccccccggggcttcagctgcctgctgctgagcaccagcgagatcgacctgccggtcaagcgccggacctag

SEQ ID NO: 48897 - DNA, 75 bp, Artificial Sequence
  Description of Artificial Sequence: Synthetic coding sequence
atgaccacccggggcttcagctgcctgctgctgctgatccgggagatcgatctttccgcgaagaggcgcatttag

SEQ ID NO: 48898 - DNA, 75 bp, Artificial Sequence
  Description of Artificial Sequence: Synthetic coding sequence
atggccacccggcggttcagctgcctgctgctgagcaccagcgagatcgacttatctgtgaagcggcgaatttag

SEQ ID NO: 48899 - DNA, 87 bp, Artificial Sequence
  Description of Artificial Sequence: Synthetic coding sequence
atggccacccagggcttcagctgcctgctgctgagcgtgagcgagatagatctgagcatgaagagacagtacaagcagataaggtag

SEQ ID NO: 48900 - DNA, 75 bp, Artificial Sequence
  Description of Artificial Sequence: Synthetic coding sequence
atggccacccccggcttcagctgcctgctgctgagcaccagcgagatagacctgcctatgaaaaggcgggtttag

SEQ ID NO: 48901 - DNA, 75 bp, Artificial Sequence
  Description of Artificial Sequence: Synthetic coding sequence
atgaccccccggggcttcagctgcctgctgctgcccaccagcgagaccgacctgcccgtgaaacgccggacctag

SEQ ID NO: 48902 - DNA, 75 bp, Artificial Sequence
  Description of Artificial Sequence: Synthetic coding sequence
atggccaccggcggcttcggctgcctgctgctgctgatccgggagatcgatttgtcggttaaacgccagatctag

SEQ ID NO: 48903 - DNA, 75 bp, Artificial Sequence
  Description of Artificial Sequence: Synthetic coding sequence
atggccccccggggcttcagctgcctgctgctgagcaccagcgagatcgacttacctgtcaagagacgggcctag

SEQ ID NO: 48904 - DNA, 75 bp, Artificial Sequence
  Description of Artificial Sequence: Synthetic coding sequence
atggcccggcggggcttcagctgcctgctgctgagcaccaccgccaccgacctccccgtgaagcgccggacctag

SEQ ID NO: 48905 - DNA, 3447 bp, Artificial Sequence
  Description of Artificial Sequence: Synthetic coding sequence
atgcccctgttcaagaacaccagcgtgagcagcctgtacagcggctgtagactgaccctgcttagaccagagaaagacggcgctgcaacaagggtggacgccgtgtgcacccacagacctgatcccaagagccctggcttggacagagagaggctgtactggaagttgtcccagctcacgcacgggattactgaacttggaccttacactctggataggcacagcttgtatgttaacggcttcacacaccagtcctcaatgaccacaaccagaacacccgatacctccactatgcatctggccactagtcgtacacccgccagtttgtctgggcccatgacagccagccccctcttggtgctctttactattaacttcactatcaccaacctgcgttacgaagaaaatatgcatcatcccgggagccgaaaatttaacacaaccgaaagagtcctacaaggcctcctgagaccagtttttaagaacacatccgttggccccctgtactccggatgcagactgaccctgcttcgcccaaagaaggacggcgctgccacaaaagtggacgcaatctgtacctataggcctgaccctaagagcccgggtcttgaccgcgagcagttatattgggaactgtctcagctaacacactcaataacagagctgggcccatacacacttgacagagatagcctgtacgtgaacggcttcactcagcgatcctccgtccctacgacatccatccctgggactcctactgttgacttgggcaccagcggcactcctgtaagcaagccaggacccagcgctgccagccccttattggtattgttcactctcaacttcactatcactaatctcaggtatgaagagaatatgcagcaccccgggtcgagaaagttcaatactacggaacgcgtgcttcaagggcttctgcgatcactgttcaaaagcacctctgtaggccctctctacagcggctgtagacttacgctcctccgccctgagaaagacggcactgcaacaggcgtcgacgccatttgtacacaccaccccgatcctaagagcccacggcttgacagagagcagctgtattgggaattgagccagctcacgcataatattaccgagctggggccatatgcgctggacaacgattcgctgtttgtcaatggctttactcatcggtcctctgtctctaccacatcaacccctggcacccctactgtgtacctaggcgctagcaagacgcccgcctctatctttgggccgtcagccgccagtcatctgctgatcctgttcacccttaattttaccattaccaatctgcgatacgaagagaatatgtggcctggaagcagaaagtttaatacaaccgagagagttttgcaggggctgctgaggccactctttaagaatacatcggtgggaccactgtacagtggatgcaggctcaccctactgaggcctgagaaggacggcgaggcaaccggcgtggacgctatctgcacccaccggcccgatcccacagggcccggcctcgatcgggagcaactctacttggaactgtctcagttaactcattctatcactgagcttggcccttacacactcgatagggatagcttatacgtcaacggctttacacacaggtcttctgtcccgacaacgtcgactggcgtagtgagcgaggagccctttaccctgaacttcacaattaataatctccgctatatggccgatatgggacaacccggtagcctgaagttcaacattacagataacgtaatgcagcatctcctcagcccactgttccagcgcagctccttaggggcccggtacacaggatgccgggtgatagccttacgaagcgtgaaaaatggcgctgagacccgggtggatctactttgtacctatctgcaacctctgtctggcccaggcctgcccattaaacaggtgttccatgagctctcacagcaaacgcatgggattacgcgacttgggccctactctttggataaggactctctgtatctcaatggttataacgagccgggccccgacgaaccgcccaccacaccaaagcccgcaacaacgttcctgccacccttatcggaagctacaacagccatgggataccatctgaagaccctgacactgaacttcaccatcagtaatctgcagtatagccccgatatgggaaagggatcggccactttcaactccacagaaggcgtcctccaacatttgctacggccgctgttccagaagtcgtctatgggacccttctacctcgggtgtcagcttatcagcctccgccctgaaaaagatggagcggctaccggggtggatactacttgcacctaccacccggaccccgttggaccaggactggacatccaacagctgtattgggaactgagtcagctgacgcacggcgttacacaactaggattctacgtcttagaccgcgactcgctgtttattaatggctacgcaccccaaaatcttagtatacgtggcgaataccagatcaacttccacatagttaactggaatctgagtaatccggaccccactagttctgagtacattacactgctcagagatatccaggataaggtcaccactctgtacaaagggtcgcagctacacgacactttccggttttgtctagtgacaaatttgactatggactcagtacttgtaacagttaaagccttgttcagcagcaatctggatccaagtctggtggagcaggtctttcttgacaaaaccctgaatgcctcttttcactggctaggttctacctaccagctggtggatatccacgttaccgagatggagagctctgtgtaccaaccaacctctagctcatcaacccagcatttctacctgaatttcaccatcacaaatcttccatattctcaggacaaggcccagccaggtaccacaaactatcagcgcaacaagaggaatatcgaggatgctcttaatcaactgtttcgaaactcaagtatcaagtcttacttcagcgactgccaggtgtcgacatttcgcagcgtaccgaacaggcatcacaccggtgtggacagcctgtgtaacttttccccattggctcgccgggttgaccgcgttgctatctacgaagagttccttaggatgacaaggaacggcacacagctgcagaacttcactttggatcgctcatccgtgcttgtagatggatattccccaaaccggaacgaacccctgactgggaacagcgatctccccttttgggccgtgattctgatcggcctggccggtctgctgggggtcattacatgcctgatttgtggagttctcgttactacgaggcgtcgtaaaaaggagggagaatataatgtccaacagcagtgtcccggatactatcagtcacaccttgatcttgaggatctgcagtag

SEQ ID NO: 48906 - DNA, 750 bp, Artificial Sequence
  Description of Artificial Sequence: Synthetic coding sequence
atgaacagccagcagacccccgtgggcacccccaaggacaagcgggtttcaaatactccactgcgtacagtggacggctcacccatgatgaaggctatgtattctgtggaaataactgtcgaaaaagataaggtgactggggagactagggtcctgtctagcaccaccctacttcctcggcagccactgcctcttgggattaaggtgtacgaggacgaaacaaaagttgtacatgcggtggatgggacggccgaaaacggtatacacccattatctagcagcgaggtggatgaactgatccacaaagcggacgaggtaaccttatctgaggccggttctacagccggggccgcggagactaggggagctgttgagggcgccgctcgcacgaccccttctcgtcgggaaatcacaggcgtgcaggcccaaccaggcgaggccacgagtggcccccccggcatccagcctggacaagaaccacccgtcaccatgattttcatgggctatcagaacgtggaagacgaggcagaaaccaaaaaagtgttgggactgcaggatacaatcacagctgagcttgtggtgattgaggacgcagccgaacccaaagaacccgcaccgcctaacggcagcgccgccgagaccgaggcagccagtagagaggagaatcaggccggcccagaagcgacaacaagtgaccctcaggatctcgacatgaagaagcaccgctgcaagtgttgctctattatgtag

SEQ ID NO: 48907 - DNA, 1344 bp, Artificial Sequence
  Description of Artificial Sequence: Synthetic coding sequence
accgccgccggccccctgctggtgcccttcaccctgaacttcaccataaccaatttgcagtacgaagaagacatgcaccacccagggtcgcggaaattcaataccacggaaagagttctacagggtctgctgggccccatgtttaagaacacgtctgtgggcttgttatacagtggctgcaggctgaccctgctgcggccagaaaagaatggtgcggcgaccgggatggatgccatctgttctcaccgtctggacccgaaatcccccgggctgaaccgggagcagctgtactgggaactgtcccaattgactcacggcatcaaggaactgggaccgtacacattggaccggaatagcctgtacgttaacgggttcacccacaggtccagcgtggccccaacctctacgcccggcaccagcaccgtggatttgggcacaagtggcacacctagtagtctcccctcaccgaccactgctgtaccccttttggttccattcacccttaactttaccattacaaacctgcagtatggcgaggacatgagacatcctgggtcgaggaagttcaatactactgagcgagttttgcaaggtttgctgggtcctctttttaaaaacagtagcgtgggcccattgtacagtggctgtaggctcattagtctccggtccgaaaaggacggggctgcgacgggcgtcgacgccatctgtacacatcacctcaacccccaaagccctggtctggacagggagcagctgtactggcaactgagccaaatgaccaacggcatcaaggagctgggaccatacactttagacagaaacagcttatacgtcaacggatttacccaccggagctcgggcctgactacaagcacgacagggcccttgctggtgcctttcacactaaattttaccatcacaaatctccaatacgaggaaaacatgggacacccagggagcaggaaattcaatattacggagtcagtactccagggattactgaaaccattgtttaagagcacctctgttggacccctctactccgggtgccgtctgacactcctgcggccagaaaaagatggagtcgcaacacgggtggacgcaatctgtacgcaccgccccgatccaaaaatccctggactggataggcaacaattgtattgggagttgagccaactaacacacagcattacggagctgggaccatacacattggaccgtgacagtctctacgttaatggattcacacagagatcttccgtgcccactactagcacgcctggcacttttacagtgcaaccagagacatcagagactccctcttccctgccaggccccacctag

SEQ ID NO: 48908 - DNA, 5322 bp, Artificial Sequence
  Description of Artificial Sequence: Synthetic coding sequence
atgcggcggggcaacatcagccccgccttctggttcctgtggctgctgctattcggactcctgggcccttccagtgagaatactaccgcctttaccaaagggagtgataccaccacagcgtcgataacaggatctgagactaccatggctagtacaatggcttccacaagcgccctgacaactgggtctaagatcacaacagactctaccactggctccgaaaccacctccgcaagcacaatggcatcgaccgccgcatttaccacggggtccgagactaacacagcttctaccaccgatagtggcactaccattgcctcgactcggacgtttacgacaggttccgacacaacaacgggttcgacagctggctccgagacaatcgtcgcatccaccaccgtgtctgggaccacaaccaccttcactatcgcctcaaccactgttcctgagacaaccatggccagttccaccacctccaccgccggctcagagaagacaatggctagctcgattatctccgagacgacaatggcttcaacgaccggttctgagaccgccacggtgtcaaccacaggaagcgagacaacaaccacttcaaccgcctcctccgaggcaaccaaagtgtctactactgggagcgagaccaccactgcatctactgccggatccgagacgaccacaacaagtaccagcatggctgggtcagaagcaacgacaacgtcaactgccgatagcaaagtaattacagctagcagcatgagctcagagactactgttgcgcccgccgcaggttctaacacaaccacagcgagcacgacagggagcgaaaccacaacaatcctgattaaggcaagtgaaacaactaccgctagcactgctggctcagagaccacaactccaagcccaacgggtagccagacaaccatcgtttcaatttccggctcggagattactaccaccagcaccgccggaagtgaaaataccacagtgtcaagcgcaggctctggcacgacaactgcatcgatggccgggagtgagacgaccgtgtcaaccgctggctcggaaaccacaacggtgagtattaccggaaccgagacaacaatggtgagcgcaatgggttctgaaacaacaacaaattctacgacctcatccgaaactaccgtcacctcgacagctgggtcggagactaccactgtgtcaactgtggggtccgaaactacaactgcatatacagccgatagcgaaactaccgccgctagcacgactggatctgagatgacgacagtgttcacagctggctcagaaactataacaccttccaccgccggaagtgagacaactaccgtgtcaaccgcagggagtgagactaccacagtgtctacaaccggatcagagacaaccacagctagcaccgcccacagcgagacaacggccgcctcgactatgggctcagaaacaactaaggtctctactgccggaagtgaaactacagtgtcaactgctggcagcgaaaccaccgccgccagtaccgaggactccgaaacaaataccgcattcacggaagatagtaagacaaccacagcttccactacaggcttcgaaacaacagctgcaagcaccactggctcagaacctacgatggctagtaccatggggtctgaaacaaccatggcctcaacaattggccctgaaacgacgaaagtgtcaaccgcctcatctgaggtgacgaccgtgtttgctgcaggctcagagacaatccgggcatctaccgtcggctccgaaacaacaacagtctctactacaggctctgaaactaccacggcaagtatcatgggcagcgagaccagcaccgacagcacaaccgggagcgaaactaccaccgcatcaaccgaaggctctgaaacaacaacagcgtccacagagggtagtgaggctactaccgtgtcaactaccgggtcagagaccactacagttagtattacagacagcgaaactactactacttgcactgagggctctgaaatgacagcagtgtctaccacagtattcgagacaaccactgcttccacagaagggtcagagataactatcgcaagtacgtctgacagcgagactacaaccgcctcaacagaggggagcgaaacaaccacagttactaccgctggatccgaaactaaaactgcgtatacgacaggcagcgagacaacaaccgcctccaatactggactggaaacgactacagtttttactatcggaagtgataccacgaccgctagcacagagggttccgaaaccactgccgtttctgccaccgggtccgagatgacaaccgtttccaccgaaggctccgaaaatacaacagtatctaccacagggtctgagacaactacagtgtccactacaggcctggagaccaccactacatcgaccgaaggcagtgaaatgaccaccgtgagcactactggggctgaaaccactacagatagtacagagggaagcggaacgactgccgcttccaccgcagggagcgaaaccaccaccgtgtcaacggccgattcagaaaatacaactgcgtcaactgccgacagcgagaccacatccgccagtaccaccggctccgagacgacaactgctagtacaacatcgagcgagactaccacggctagcactgaaggaagcgaaactactaccgtcagtaccacagattcagaaacaacaatggtgagtacgacaggtagcgagagaacaataacgtcaacagagggatcggagaccaccaccgttagcgccacgggcagcgagacgactgtgtctacggaaggcagcggaactaccaccgtatctatcacgggatcagaaacgaccaaggtgagcacaaccggatccgaaactacaaccacatccaccgaagggtctgagattacaacagcgtcaattactggttcagaaactacaaccgcatcaaccgagggatcagaaaccaccaccgcatctaccgagggatcggaaaccacttccgccagcacaacagggagcgagactaccactgcgagtaccacaagcagtgagacaaccatggcgtcgattatgggatctgagaccactatggcttctacaattgggtccgagaccacaaaagttagtacggcatctagtaagatgactacagtgtttaccgagaactctgagactacaatcgcgagtacgacagccagtgaaaccaccaccgtctccaccgcaggaagcgaaactattccagctagcacagcaggtagcgagaccaccactacaacgagcactgaaggatccgaaaccaccaccgcctcaacagaggggtccgagaccactactgctagcaccgagagttcagaaacgactaccgccaccaccatcggctccgagactaccaccgcttctaccgaaggcagcgagacaacaacgacatccactgagggctccgagaccacaaccgcctcaacagaggggtccgagataactaccgtctcaactaccggctcggaaacaacaacagccagcaccgagggatccgagacaacaaccgcaagtactgagggaagcgagttaaccacagtttcgacaacaggttcagaaaccattaccgtgtccgccgaaggtagcgagaccaccacggtaactaccatgggcagtgagacgaccaccgcctccactgccggcagcgagacgacaaccgtgagcaccgcagggtctgagaccactacagccagtattgagggaagcgaaacaaccacagtctcctctacaggttctgaaaccacaacggtcagcacgaccggaacagagaccaccatcaccagtacagagggaagtgagactaccactgtcacaactgccggcagcgagaccaccgccgtttatacgactggctcggagacaacaaccacttcgacagaagggtctgaaacaactacagtctctaccacaggaagcgagacaaccacggcttccaccgccgacctggagactacaactgtgagcacttccgggtcaggaacaacgacggcgagcacagcgggttccgagaccactacggtttatatcacagggagcaagacaaccaccgcgagcacggagggctctgaagccactaccgtgagcaccacctcctcagagactaccacagcctccaccacaggttctgagatgactactgtcttcacaaccgtcagcgagacaacaaccgttagcacaataggatcagaagctaccacatctagtgccgctggctcagaggcgacgacaacttctactgagggtagtgaaacaactactgcctctacagcaggctcggaaaccactacagcttcgaccgccggctcagaaacgactaccgcctctacaagcggctccgagacaaacaccgcatgtactaccggttcggaaacttcgacaccgagttcagccggctccgagacaaatacggctttcattattgggtcagaaagcactatagcatctaccgcctccttggagcccacggccacctcccttactggttcagaaaccacaacagtcagcatcacagcatctggagcaactgccgcatctacaacagttagttcaactacattcgtcctgaccaaagccactgacgtgtctatccagccaatcacaaataccccgatgagcggaactagaacaacaggcaccagacttaccgcatcaagcagtgtgacgatggccccaggcatggattttacagcatcagcagctagccacaccgtccccggcattgtgctgaacactagcggcctgggaacaagtacaatgggggcctcgtctaccacttccgcccatggcgttcggaccacgactggatccacaagagagcctaccagcagtacttttcaggaaacaggacccgtcagtatgggtaccaataccgtgtctatgtctcacactcctacaaacgtgattaaaccttcaggctacctgcaaccgtgggctattatcctgataagtctcgcggccgtcgtggccgcagtgggcctgtcagtgggactctctttttgcctgcggaatctgttcttccctttacgctattgcggtatctactacccacacgggcactcccatagccttggcctcgacttgaacttaggtttggggagtgggaccttccacagcctgggtaacgctcttgtgcacggaggcgagttggagatgggacatggagggacacacggcttcggctacggcgtgggccatggcctcagtcatattcacggtgacggttacggagtgaaccatggcggacattacggccatgggggcgggcactag

SEQ ID NO: 48909 - DNA, 1701 bp, Artificial Sequence
  Description of Artificial Sequence: Synthetic coding sequence
atgaagatgcagaagggcaacgtgctgctgatgttcggcctgctgcttcatctcgaggcagctacaaacagcaatgagacaagtacctcagccaatacaggatcttcagtgatttcctccggggcctctacagcaaccaattccgggagcagcgtgacatcatccggagtgtctacagccacaatttccggctccagcgtgaccagcaacggagtctcaattgtaaccaactctgagtttcataccactagcagcggaatatccacagctacaaattcagagtttagtactgcgtcttctgggataagcatcgccaccaacagtgagagctcaaccacttcttccggagcttccacggcgactaactcggagtcgtctaccccaagttctggcgcatcaacggccaccaactctgacagttccacaacgagcagtggggcttcgacagccacaaactcagacagctccacgaccagctcagaggcatctacagctactaatagcgagagtagtaccacctcctcaggcgctagcacagctaccaactcagagtcttcgaccgtgtcgagccgtgcgagcacagcaacaaacagcgagagctcgaccaccagcagcggcgcatctacggcgacgaactctgagtctcgaacaaccagcaatggggcaggcacggccacaaattctgaatcaagtacaaccagctcaggcgcatcaacagctaccaactccgaaagctccacaccttctagcggagccgggacagccactaatagtgagtcctctaccacatcatcgggtgcaggaaccgcaacaaacagtgagtcttcgactgtttcttctggaatatctactgtaactaacagtgaatcatcaaccccatcctccggagcgaataccgccaccaattccgagagctcaacaacctcttctggtgccaataccgccacaaattccgattcctccactacttccagcggagcctctacggcaacaaacagcgaatcaagcacgacctcatcaggcgccagcacagccacgaactccgaatcaagtacaacctcctcaggagcgagtactgcaacgaactcaggatctagcacaacatccagcggaacgagcaccgctacaaattctgaaagttccactgtctcctccggggcaagtactgccactactagtgaaagttctactacttcttcgggggcatcaactgcaaccaattctgagtccagcactgttagttcaggggcaagtacagcaactaattctgaatccagcaccacatcctccggagctaacacagctacaaattccggaagctcagtgacaagcgcgggcagtggaaccgctgcgctgacgggaatgcacactacgagtcactcggcctcaaccgccgtgtctgaagccaagcccggtgggtcactggtgccttgggaaatctttctcatcacacttgtgagcgtcgtagctgctgtaggtttgtttgcagggctcttcttttgcgtgcggaactccttgtctttacgaaatactttcaacaccgccgtctaccatccacacgggctcaaccacggcctgggccctggaccagggggaaaccacggggcaccccatcgccctagatggtccccaaactggttttggaggcgccctgtgagttcaatcgcaatggagatgagcgggcgaaattccgggccgtag

SEQ ID NO: 48910 - DNA, 1701 bp, Artificial Sequence
  Description of Artificial Sequence: Synthetic coding sequence
atgaagatgcagaagggcaacgtgctgctgatgttcggcctgctgctacatctcgaggccgccacaaactctaatgaaacctcgacatcggctaatactggcagcagtgtgatttcctccggtgcatccaccgccacaaattctggcagtagcgtgactagttctggtgtcagtacagccaccatctccgggagctccgtgaccagtaatggagtgtcaatcgtgacaaattctgagttccacacaacctcaagtggcattagcaccgctacgaactctgagttttctacagcgtccagtggcattagtattgcgaccaactctgagtcttcgacaacctctagcggtgcaagtacagctaccaattcagagtccagtactccttcctctggcgcaagtactgcaaccaattcagattcttctacaacctcttcgggagcttccaccgcaaccaatagtgatagctctaccacttccagtgaggccagtaccgcgacgaactccgaaagctcaactacttcttcgggtgcttccaccgctacaaacagcgagtcttccactgtaagctcccgggcctccactgccaccaactctgagtcaagtaccacatcatctggcgcttctacagctaccaactctgaaagtcggaccacatcaaacggtgcaggaacagccacaaatagcgaatcaagcaccacaagctctggtgcgtccaccgcaactaatagcgaaagttctaccccttctagcggcgcaggtactgcgacgaactccgagagctctactacttcctcaggggccgggaccgcaacaaattctgaatcatctaccgtaagctccggcatttcaaccgtcaccaatagcgagtcctcaaccccctcttctggggcgaatactgctacaaacagcgagtcgagtactaccagctctggcgctaacactgccacaaactcagactcttctacaaccagctctggggccagcaccgcaacaaattctgaatcgtccaccacaagcagtggagcctcgacagccaccaactctgaaagctccactactagctctggtgccagtacagccactaattccggaagttctacgacaagttccggcactagcactgctacaaactccgagagttccacagtgtcgtctggcgcctccacggcaacgacgtctgaatcctctacgacaagcagcggggcaagcacagctacgaattctgagtcctccacggttagttccggggccagtaccgctacaaattccgaatccagtacgacgtccagtggggccaacaccgcgaccaactccggtagctcagtgaccagcgccggctctggcactgccgccctgactggaatgcacaccacgtcccactcggcctctaccgccgtaagtgaagccaaaccaggaggctccctagtcccatgggagatctttctcattaccctggtttctgttgtagcagcggtgggtcttttcgctggacttttcttttgcgtgagaaatagtctgtcgctgcgcaacaccttcaacaccgccgtctatcacccccatggacttaatcatggcctgggcccaggccctgggggtaatcatggcgctcctcacaggccaagatggtccccgaattggttctggcggcggccagtcagcagcattgccatggagatgtccggcagaaatagcggaccctag

SEQ ID NO: 48911 - DNA, 1701 bp, Artificial Sequence
  Description of Artificial Sequence: Synthetic coding sequence
atgaagatgcagaagggcaacgtgctgctgatgttcggcctgctgcttcacctcgaggctgccacaaactcaaatgaaacttcaacaagcgcgaataccgggagttccgtgatctcttccggtgcctccaccgcaacgaactctggctcttccgtgacctcatctggcgtttccaccgcgaccatctcaggaagcagcgtgacgtcaaatggggtctcaattgtcaccaattccgagttccatactacttccagcggcatcagcaccgccaccaactcagagttttcaacggcttcgagcggaatttcaatcgccaccaacagtgagagtagcactacatccagcggcgcatctacagccacaaattcggagtcatctactccctctagtggtgcctcaactgcaacaaattccgacagctcaaccacatcaagtggtgcttccacagcaactaatagtgacagctccacgacaagttccgaggctagtacagcaaccaacagcgaaagttctactacctcgtcaggcgcatccacagccacaaattccgaatcgagcaccgtctcttcgcgtgcgagtaccgccaccaactcagaatcatccaccacgagcagcggagcctcaacagcaacaaattccgaaagcaggacgacctccaacggagctgggaccgctaccaattccgaatcgagcactaccagcagcggtgcctctactgccacaaattccgagagcagcacaccaagctccggtgcaggcaccgctacaaattctgagagttccaccacaagctccggagctggtacggcaaccaatagcgagtcctctacggtgtctagtggcatctctactgttaccaattctgagagttcaaccccttcatccggagccaatacagccactaactctgagtcttccaccacatccagtggtgcaaacacggctactaacagcgattcctctaccacaagtagcggcgcaagtacagccacaaactctgagagctctaccacaagctcgggggcaagtacagcaactaactcagagtcttcaaccacctcaagtggggccagtaccgccaccaactcaggttccagcactacttcaagcggaacgtcgaccgccaccaatagcgaaagcagtaccgtatcctctggggccagtacagctactacaagcgaatccagtacaacctcctctggggcttcaactgccactaattcggagtcgtccaccgtgagcagtggagcctctaccgctaccaattccgaatcctccacgacttcttccggggcgaatactgccacaaacagcggcagtagtgtaacttccgcgggttccggtaccgctgctctgacagggatgcacaccacctcccattcagcttccactgctgtttccgaggctaagccgggggggtctctggtgccatgggagatttttctcatcactttagtgtccgtggtggcggctgtgggtctcttcgccggtctcttcttttgcgtgagaaattctctgtccctcagaaatacttttaatactgcagtgtatcacccccacgggctgaaccatggtcttggccctgggccagggggcaatcacggcgcaccccatcgccctcggtggtccccaaactggttctggcgcagaccggtgtctagcattgcaatggagatgtcaggaagaaacagtggtccttag

SEQ ID NO: 48912 - DNA, 1251 bp, Artificial Sequence
  Description of Artificial Sequence: Synthetic coding sequence
atgaagatgcagaagggcaacgtgctgctgatgttcggcctgctgcttcatctggaggccgccacaaactccaacgagacatccacctcagccaacaccggatcctctgtgatctcttcgggagcaagcacagccactaactccggatcttctgtgacctcctcgggagtttccacggcaacaatctccggttcctccgtgacctccaatggtgtgagtatcgtgacaaattccgagttccatacgacctcaagtggaatttcaacggctaccaattcggagttcagtactgcctcttccggtatttctatagccaccaactctgagtcctcgaccacctcttccggtgcgagcaccgccacaaattcagagtcctcaacacccagtagtggagcttccacagctaccaactctgactcaagtaccacatcttctggagcctctactgcaaccaacagcgactcgtccacgactagttccgaggcctccactgctacaaacagtgagtcttcaaccacgtccagcggagcttcaacagccaccaactcagaatccagcactaccagctctggagcttctaccgccaccaacagcgaatcctccaccacatcgagcggggcttccaccgccaccaactccggaagttcaaccacatcgagcggcaccagcactgccacgaacagcgaatcctcgactgtgagctctggagcttcaaccgctacaacgagcgaaagctccaccacttcctcgggggccagcaccgctactaattcggagtccagtaccgtaagcagtggcgccagtacagccactaactctgagtctagtaccacttcaagcggcgcaaacaccgccacgaactctggaagcagcgtgacatctgccggaagtgggacagcagcgttaacaggtatgcacaccaccagccacagtgcatccacagctgtcagcgaggcaaaacccggcggaagtctcgtgccatgggagatatttctgatcacccttgtgtctgtggtagctgcggtgggactgtttgctggcctgtttttttgcgtcaggaactcactctccttgcggaatacctttaatacggctgtctaccatcctcatggcctgaaccatggcctggggccaggtccaggaggtaatcatggcgctcctcatcggccgcggtggtcccctaactggttttggaggcgaccagtcagttctatcgcaatggaaatgagcggaaggaactctggaccatag

SEQ ID NO: 48913 - DNA, 1251 bp, Artificial Sequence
  Description of Artificial Sequence: Synthetic coding sequence
atgaagatgcagaagggcaacgtgctgctgatgttcggcctgctgctgcacctggaagctgcaacgaactccaacgagactagtacctccgcaaataccggatcatcagtgatcagttcgggtgcctcaaccgccaccaactctggctcgtctgtgacttcaagtggggtatcgacagctaccattagtggtagttccgtcacatcaaacggggtcagcatagttactaattccgaattccatacaacctcatcgggcatctcgaccgccacaaattctgaattcagtactgcctcttcagggatcagtatcgcaaccaactctgagtcaagtaccacaagttctggcgcttctaccgctactaacagcgagtctagcacgccgtctagcggggcaagcaccgccaccaatagcgatagctccacgacatcttctggagcttctacagccactaacagcgattcttctaccacatcttccgaggcttccacagccacaaactccgaaagtagcacgacctcttccggggcctccactgccacaaatagtgaatcttccacgacatccagtggcgccagtacagcaacgaatagtgagagctctacgactagttccggagcatcaactgcaacaaattcaggctctagcaccacttcaagtggaactagtaccgctacgaactccgaatcatctaccgtttcatccggcgcaagcaccgctacaacatctgagtccagcacaacctccagtggggcttcaaccgccacaaacagcgaaagcagcaccgtctctagtggagcttcaaccgccactaactccgagagcagtacaacttcaagtggggctaacacagccaccaattcagggtctagcgtgacgtccgccggctcaggaactgcggccctgaccggaatgcataccaccagtcattctgctagtaccgcagtcagtgaagcaaagcctggtggatcactcgtcccgtgggagatcttcttgattacgctagtgagcgtggtggcggccgtggggctgtttgccggactcttcttctgtgtaagaaatagtctaagtctccggaatacctttaataccgccgtgtaccatccacacgggctgaaccacggtcttggccctgggcctggcggaaaccacggtgcccctcatagacctcgctggtctcccaattggttctggaggcgacctgtttcctcaatagccatggagatgtccggtcggaactctggcccgtag

SEQ ID NO: 48914 - DNA, 1251 bp, Artificial Sequence
  Description of Artificial Sequence: Synthetic coding sequence
atgaagatgcagaagggcaacgtgctgctgatgttcggcctgctgttgcatctggaggctgctactaatagtaacgagacctccacaagcgctaacacagggtccagcgtgatcagctcaggcgcttccacagccacaaatagtggcagcagtgtcaccagtagcggcgtgtctaccgccacaattagtggcagctccgtcaccagcaacggggtcagtatcgtcaccaattccgagtttcacacaacatccagcggcatttccactgctacaaattcagaattctccaccgcgtcctccggcatcagtatcgccacgaatagtgaaagttctaccacttcatctggagcctctaccgcaactaatagcgagtcctctactccatcatctggtgcgagcactgccacaaactctgattcatctacgactagtagcggagcgagtaccgctaccaactccgacagctcaaccacctcttctgaggcgtcgacagccacgaacagcgagagttctaccacatcttccggtgcgagtacagccacgaattcggagtcatcaaccacttctagtggagcttctacagcgacaaactccgaaagcagtaccactagcagcggggcatcgacagcaacaaatagtggatccagcaccacaagctccggcacctctactgcgacaaactctgaaagcagcacagttagtagcggcgcctctaccgctacaacttccgaatctagcacaacaagttctggtgctagcacagcgacgaacagcgaatcctctactgtaagctcaggtgcctctaccgcgactaattcggagagcagtacaacgagtagtggcgccaacacggcgactaacagtggttcctctgtgacttctgcgggctctggaacggctgccctgaccggcatgcatactacatctcacagcgcaagcacggccgtctctgaagcaaagcctggaggatctctggtcccttgggagatcttcctcattaccctcgttagtgtggtggcagccgtaggactgtttgccgggctcttcttctgtgtgaggaactccctctcactgaggaatacatttaacacagcagtataccacccccatggtctcaaccacggcctgggccccggtccgggcggaaatcatggtgctccccaccgtccccgctggtcacccaactggttttggaggagacccgtgtcaagcattgcaatggagatgagcggtcggaacagtggcccctag

SEQ ID NO: 48915 - DNA, 471 bp, Artificial Sequence
  Description of Artificial Sequence: Synthetic coding sequence
accgcccagagcctggtgctgatcgacgagttcggcaagggcaccaatacagtggatgggcttgccctgctggccgccgttctccgacattggttggcgaggggtccaacctgtccacacatttttgtcgccacaaattttctttcccttgtccagctacagctcttacctcaaggcccccttgtacagtatctggtttgtgagggcgttgccaaggcatcgcacgcatcgcatactgccgcacaagctggtctccctgataaactggtcgccagaggaaaggaggtgagtgatctcattagatctggcaaacctataaagcctgttaaggacctgctgaagaagaaccagatggaaaattgccaaacactggtggataagtttatgaagttggacctcgaagatcccaacctcgacctgaatgttttcatgagccaggaggtgctgcccgccgcgacatctatcctgtag

SEQ ID NO: 48916 - DNA, 1206 bp, Artificial Sequence
  Description of Artificial Sequence: Synthetic coding sequence
atgtggcccgtgctgctgttcgtgttcctgagccagaccgtgtacagcgctctggggttgcgggacgcttgtaggtccctgccccagtcaatacaactgtttagagacatcgcgcaagaattttctgatgaccttcatcacatcgcctcattaattggcaaggttgtcgatttcgaaggatctctcgcagaaaacagattcactgtgctgccaaacattgatcctgagattgatgaaaaaaaacgtcgattgatgggactgccttcctttttgacggaggtggccaggaaggaattggagaacctcgattctaggattccaagctgtagcgtaatttatataccattgattggttttctcctcagcattcctaggcttccatctatggttgaggcctcagacttcgagataaacggtctggactttatgtttctgagcgaggaaaagctgcactacagatctgcacggacaaaagaactggatgcactgttaggggatttacactgtgaaataagggaccaggaaaccctgctgatgtatcagctgcagtgtcaggtgttggctagggccgcagttctgactcgagtacttgacttggcttcacgcctcgacgtcctgcttgccctggcgtctgccgccagagactacggctacagtcgaccgcgctactcccctcaggttcttggagtaagaatccagaacggacgccatcccctaatggagctatgcgcaaggaccttcgtgcccaattctacagagtgtgggggcgataagggacgtgttaaggtgattacaggtccaaactcttcaggtaagtctatttacctcaaacaagtagggctgatcacctttatggccttggtaggctctttcgttccagcggaggaagcagagatcggagcagtcgatgccatctttactcggattcactcttgcgagtcaatatctctgggtctgtccacctttatgattgacctgaaccaagtcgccaaagcagtgaataacgccaccgctcagagccttgtgctcattgacgagtttgggaagggcacgaacacagtcgatggtcttgccttgctcgcagctgtgcttagacattggctcgctagggggcctacgtgtccccatattttcgtggctacaaacttccttagccttgttcagctccagttgctcccacaggggccgctggtgcagtacctttag

SEQ ID NO: 48917 - DNA, 1491 bp, Artificial Sequence
  Description of Artificial Sequence: Synthetic coding sequence
accgtgtacagcgccctgggcctgcgggacgcctgccggagcctgcctcagtctatccaactgttccgtgacatcgcacaagaattcagtgatgatctccatcatatcgccagcctcatagggaaagttgtcgacttcgagggctctctggccgagaacaggtttacagtgctgccaaatatagatcctgagatagatgagaagaaacggcgcctcatggggctgcctagttttctcactgaggtagctcggaaagaactggaaaatttggattcccggattccatcttgttcggttatctacattccactcataggtttcttattgtcaatcccacgcctccccagcatggtcgaagcctcagattttgagataaacggactcgatttcatgttcctgtccgaggagaaactgcactacagaagcgctcggactaaagagctcgatgcgttgcttggtgatctgcattgcgaaattagagaccaggaaaccctgctcatgtatcaattgcagtgtcaagtgctggcccgcgctgctgtgttgacaagagtgctggaccttgcttcgagacttgacgtccttctggctctcgcgtccgcagctagggattacggatattctcggccacggtatagcccgcaggttctgggggtgaggatccagaacggacggcacccgttaatggaattgtgcgctcgcactttcgtgccgaatagcacagagtgcggcggcgacaagggccgggtaaaagtgattaccggtccgaactctagcggtaagtccatctatcttaaacaagtcggcttaattacttttatggccctcgtggggtcttttgtcccagctgaggaagctgagatcggagcggtcgacgccatcttcactcggatccattcctgcgagagcattagcctcgggctgtcaaccttcatgatcgacctcaatcaggttgcaaaagctgtgaataacgccacagctcagagtttagttctcattgatgagttcgggaagggcacaaatacagttgatggccttgcattactggcggctgtcttgaggcattggctggctagggggcccacctgcccacatatatttgtggcgacaaatttcctctccctcgtgcagcttcagttgcttccacagggccctcttgtccagtatttgaccatggaaacatgcgaggatgggaacgatcttgttttcttttatcaagtgtgcgagggcgtggccaaagcttcacacgcttcacacacagccgctcaggccgggctgcccgataagttggtagctcgcgggaaagaggtgtccgacttgatcagaagtggtaagccgattaaacctgtgaaagaccttctgaagaaaaaccagatggaaaactgtcagacccttgtggacaaattcatgaaactggacctagaggatcctaatctggatctgaatgtctttatgtcacaggaagtccttcctgccgctacaagcattctctag

SEQ ID NO: 48918 - DNA, 2187 bp, Artificial Sequence
  Description of Artificial Sequence: Synthetic coding sequence
atggccagcctgggcgccaacccccggcggaccccccagggccccaggccaggtgccgcgagttccggttttccatctcccgcccccgtgcctggcccgcgtgaagccgaggaggaagaggtagaggaagaagaggagttggccgaaatccacctctgcgtgctgtggaacagcggatacctggggatagcctattacgatacatctgattccactatccacttcatgcccgatgcccctgaccacgagagccttaaactgcttcagcgggtgcttgacgaaattaacccccaaagtgtggtgacttccgcaaaacaggacgagaacatgaccaggttcctcggaaagctagcgagccaggagcacagggagcctaagcgcccagaaattatcttcctcccttcagtagattttgggctggaaatcagtaaacagcgccttttaagtggtaattactccttcattcccgacgccatgaccgccacagagaagatattattcctctcctccattattccattcgactgtctcttaaccgtgagggctctgggcggtcttctcaagtttttgggtagaaggaggatcggcgtggaacttgaggactacaatgtttccgtccctatcctggggttcaagaagttcatgctcactcacctggtgaatattgatcaggacacttacagcgtgctacagatcttcaaatcagaaagccacccttccgtgtacaaggtcgctagtggcctcaaagaaggtctgtccctgttcggcatcctcaaccgttgtcattgtaaatggggagagaagctcctgcgactgtggttcactagaccaactcatgatctgggtgagcttagctcccggctggatgtgattcagtttttcctgctgcctcagaatctagacatggcccaaatgctgcatcggttgctgggtcatatcaaaaatgtgccgctgattctcaaacgaatgaaactttctcacaccaaagtatctgactggcaggttctctataagactgtgtacagcgcactaggccttcgcgacgcctgtcggtccctgccacagtctatccaactgttcagagacatcgctcaggagttctcagacgacttacatcacatcgcctcactcattggcaaggtcgtcgatttcgagggctctctggctgaaaatagattcacagtgcttcctaatatagatccagaaattgacgaaaaaaagcgcaggctgatgggtcttccttcatttctcacagaggttgctcgaaaggagctagagaacttagactcacggatcccatcatgttctgtcatttacatccccctgatcggcttcttgctatccatcccacggctccccagtatggtcgaggcatccgatttcgagatcaacggactggatttcatgtttctgtccgaggagaaactgcactaccgctctgctagaaccaaagaactggacgctctgttaggtgatttgcactgcgagatccgagatcaggagacactgctaatgtaccagctgcagtgtcaggtactggcaagggcggctgtcctgactagggtgttagatctcgcaagccggcttgacgtgctcctggcccttgctagcgccgccagggattatggttattctagaccacgctattccccacaggttcttggcgtgagaatacagaacggccgccatccgcttatggaattatgcgcacggacctttgtgcccaattccactgaatgtggaggtgacaagggaagagttaaagtcattaccggtccgaattcatcgggcaaatcaatctatctgaagcaggtggggttgataaccttcatggcactggtcggttccttcgtccctgctgaagaagctgaaatcggggccgtcgatgctattttcactcgtatccactcttgcgagtctatctcacttggactctcaacctttatgatcgatctcaatcaacaggtggcgaaggcagtgaataatgccacggcccaatccctagtgcttatcgatgagttcggcaaggggactaacacagttgatggtcttgccctgctggccgcggtcttgcgacattggcttgctcgcggacccacttgcccacatatattcgtcgcaaccaatttcctttccttggtgcagttgcaattgcttccccaggggccactggtccagtatctgtag

SEQ ID NO: 48919 - DNA, 585 bp, Artificial Sequence
  Description of Artificial Sequence: Synthetic coding sequence
atggccagcctgggcgccaacccccggcggaccccccagggcccccgccctggagcggcctccagtggcttcccttcacccgccccagtcccgggtcccagagaggcggaagaagaggaagtggaggaagaggaggaacttgctgaaattcatctgtgtgttctctggaatagcggatatcttggcattgcatactatgacacttccgacagcactattcactttatgccagatgcccccgatcacgaatcgttgaagttgcttcagagagtacttgatgaaattaatccacagtcggttgtgacctccgcgaagcaagatgaaaacatgacccggttcctcgggaagctggccagtcaggagcacagggaaccgaagagaccggaaattattttccttccatctgtcgatttcgggctggagatcagcaagcagaggttgctgagcgggaattactcttttatcccggacgcaatgacagcaacggaaaagattctgttcctttcaagtatcattcccttcgactgcctcctgaccgttcgtgcactagggggacttcttaagttcttgggacggcggcggtag

SEQ ID NO: 48920 - DNA, 1002 bp, Artificial Sequence
  Description of Artificial Sequence: Synthetic coding sequence
aagatcctgttcctgagcagcatcatccccttcgactgcctgctgacagttagagccttaggtggtcttctgaaatttctggggcggaggagaatcggagtcgagctggaagattataacgttagcgttccgatcctgggcttcaagaagtttatgttaactcacctggtgaacatagaccaagatacctacagtgttctccaaattttcaagagcgagagtcatcctagcgtttacaaggtcgctagcggactgaaggagggcctttcactgtttggaattctaaatagatgtcactgtaagtggggcgaaaagctcctgcgactgtggtttactcgacccacccatgacctcggggaactgtcatcaaggctggacgtcatccagtttttcctccttccccagaacctggacatggctcagatgctacatcggctccttggacacatcaagaatgtgcccctcatcctgaaacgcatgaagctgagtcataccaaggtctctgactggcaagtgctgtacaagactgtgtacagcgcactcgggctgcgggacgcctgcagatcactgcctcaaagtattcaactgtttagagatattgcacaagaattctcagacgatcttcaccacatcgcaagcttgatcgggaaggtttacttgtccccgcaggtggatttcgaggggtccttggcggaaaatcggtttacagtattgcctaatatcgatccagaaatcgatgaaaaaaagagacgcctgatggggcttccctcttttctgactgaagtggcgcgcaaggaactagagaatcttgatagccgtataccgtcatgttccgttatctacattcccctcatcggattcctgctatcaattccaaggttaccatctatggttgaggctagcgacttcgagattaatggcttagacttcatgtttctgagcgaggaaaagttgcactaccgatctgctagaacaaaggaattggacgccctgctgggttag

SEQ ID NO: 48921 - DNA, 471 bp, Artificial Sequence
  Description of Artificial Sequence: Synthetic coding sequence
accgcccagagcctggtgctgatcgacgagttcggcaagggcaccaacacggttgacggactcgcactactcgcggctgtgctccggcactggttggcccggggacccacatgtccacacatcttcgtcgccactaatttcctctccttagtgcagctgcagttactgcctcagggtcccctggtgcaatatctggtttgcgaaggcgtcgcaaaggcttcccacgctagccataccgccgcccaggcgggcctcccagataagcttgtggcccggggtaaagaggtgtccgatctgattcgttccgggaagcccatcaagcctgtcaaagacctcctgaaaaaaaatcagatggaaaattgccagaccctggttgataaatttatgaaactggacctggaggaccctaatttggatctgaacgtgtttatgtcccaggaggtgcttccggctgccaccagtattctgtag

SEQ ID NO: 48922 - DNA, 2184 bp, Artificial Sequence
  Description of Artificial Sequence: Synthetic coding sequence
atggccagcctgggcgccaacccccggcggaccccccagggccccagaccaggcgcagcttcaagtggatttccgtccccggcacccgtcccaggaccccgcgaggctgaagaggaagaggtcgaggaggaagaggaactggctgagatccacctgtgtgtgctgtggaactccgggtatctaggcattgcatattatgatacaagcgattccacaatccactttatgccggacgcgccagaccacgagagcctgaagctcctccagagggtgctggatgaaattaacccccaatccgtggtgacgtccgccaaacaggacgagaatatgacccgtttcttgggcaagctggcgagtcaagaacatagggaacctaagcggcctgaaatcatattccttccatcagttgatttcggcctggagatctcaaagcagcgactgctctctgggaactactctttcatccccgatgccatgacagccacagagaagatcctgttcctatcctctataattccattcgattgtttgctcacagtgagagcattgggcggtctgcttaagttccttggacgtagacggatcggcgtcgaactggaggactataacgtttccgtacccattctgggattcaaaaaattcatgctcacccacctggtgaatatcgatcaagatacttattctgtgctgcagatcttcaaaagcgaatctcacccttctgtctataaggttgctagcggcctgaaggaaggccttagccttttcggcattctgaatcgatgccactgcaaatggggcgagaaactactcaggctttggtttacccgcccaacacacgacttgggggaactgagcagccggttagacgtaattcagtttttcctcctccctcagaatctggatatggcacagatgctgcataggttgctgggccatattaagaatgtccccctgattctcaagcggatgaagcttagtcatactaaagtgtccgactggcaggtgctgtacaagaccgtgtactcagccctcggcctcagggatgcctgtagatctctgccccaatccattcagcttttccgagacatcgcccaggagttctccgacgatctgcatcatatcgcttctctgattggaaaggttgttgacttcgagggcagtcttgcagagaatcgatttacagtactgcctaatatcgaccctgagatcgacgagaagaagagacggctgatggggttgccctctttccttaccgaagtggcccgtaaggaactggaaaatctcgactctcggattccctcttgcagcgtgatctatattccactgattgggtttcttctatcaattcccagactacccagcatggtggaggcatccgacttcgaaattaatggtctagacttcatgttcctatctgaagagaaactccattaccggtcagccaggaccaaagaattagacgctttgctgggagatctgcattgcgagattcgcgaccaggagacattattgatgtaccagctgcagtgccaggtcctggcccgtgctgctgtgctaaccagagtgctcgatctggctagcagactggatgtgctactggctctggcttctgcggctcgcgactatgggtactccagaccccggtatagtccgcaggtgttgggagtgcgaatccagaatgggcgccaccccctcatggagttgtgtgcccgcaccttcgtccccaacagcaccgaatgcggaggcgacaaggggagagtaaaagtgattacaggtcctaattcatctggaaaatctatctatcttaaacaggttggtctgattacattcatggcactggtcgggagctttgtacctgcagaggaggccgaaattggtgccgtcgacgcaatattcaccagaatccatagttgcgagagcattagtctcggccttagcaccttcatgatcgacctgaatcaggtcgctaaagctgttaataatgccacggcgcagagcttagtgctgattgatgaatttggcaaggggaccaataccgtggacggcctcgccttactggccgcggtgctgaggcattggctagccaggggaccaacctgcccgcacatatttgtggccacgaactttctcagcctcgtccagctccagctcctcccgcagggcccgttagtgcagtacctgtag

SEQ ID NO: 48923 - DNA, 1527 bp, Artificial Sequence
  Description of Artificial Sequence: Synthetic coding sequence
atgtggcccgtgctgctgttcgtgttcctgagccagaccgtgtactctgctctggggcttcgcgatgcttgtcggagtttgccacagtccattcaactgtttagagatattgctcaggaatttagcgacgatctgcaccatatcgcgtctttgatagggaaggtggtggacttcgaagggtccctggccgaaaacaggtttacagtcctcccgaatattgaccctgaaattgatgagaagaagagaagacttatgggtctgccttcgttcctcaccgaagtcgctcgaaaggaactcgagaatcttgattccaggatcccaagttgtagtgtgatttacatccctttgatcggattcctgctctcaatcccccgacttccttccatggtcgaggcatctgattttgagataaatggcctggattttatgttcctgtctgaagagaagcttcactatcgttctgcccgaactaaagagttagacgccctcctgggcgacttacattgcgagatccgcgaccaggagacactgttaatgtaccaactacaatgtcaagtattggctcgggccgcagtgctcactcgcgtcctggacctggcaagcaggctggatgtgttactggccctggcatccgctgcgcgcgactacggatactctcggccacgctacagcccacaagtgctaggcgtgcgaatccagaatgggaggcaccctttgatggaactctgtgcgcgaacatttgttcccaatagcaccgaatgcggaggagataaaggcagggtaaaagtgatcactggccccaatagctccggaaagagcatttacttaaaacaggtgggccttatcacctttatggccttggtgggatccttcgtgcctgctgaggaggccgagataggggcagtcgatgcaattttcacccggattcactcatgcgagagcatatctctcggcctgtcgacgttcatgatcgacctgaaccaggtagctaaggctgtaaacaacgccaccgctcaaagtttggtgctgatcgatgaatttgggaagggtactaatacagtggacggactcgccctcctggcggccgttctccgccactggcttgctagggggccaacatgcccccacatatttgttgccactaactttctgagtttggtccagcttcagctgcttccgcaggggccactcgtgcaatatttgaccatggaaacctgtgaagatggcaacgacctggtcttcttttaccaggtgtgtgagggagtagccaaagcttcgcacgctagccacaccgccgcgcaagccggcttgcccgataagcttgtcgcacgcggaaaagaagtctcagatctgatcagaagcggaaaaccaatcaaaccggtgaaggatttgctgaagaagaaccagatggagaattgccaaaccctcgtcgataagttcatgaagcttgatttagaggaccccaatttggacttgaacgtatttatgtctcaggaggtgctccccgctgccacctcgatcctgtag

SEQ ID NO: 48924 - DNA, 408 bp, Artificial Sequence
  Description of Artificial Sequence: Synthetic coding sequence
ggctacagccggccccggtacagcccccaggtgctgggcgtgcggatccagaacgggcgccacccgctgatggagttgtgcgccagaacttttgtgccgaacagtaccgaatgtggaggtgataaggggagggttaaagtgatcaccggccctaatagctctggaaagagcatttatctgaaacaagttgccaaggccgtgaataatgccacagcccagtctctggtactcattgatgaattcgggaaggggacgaataccgttgatggcctcgctttactggctgcagtcctacgccactggttagcacgcgggcctacgtgcccccatatattcgtggcaaccaatttcttgtcactggttcaactccagcttttgccccagggtcctctggtacaatatttatag

SEQ ID NO: 48925 - DNA, 1494 bp, Artificial Sequence
  Description of Artificial Sequence: Synthetic coding sequence
accgtgtacagcgccctgggcctgcgggacgcctgccggagcctgccgcagtcgatccaactgttcagagacatagctcaggagttctcagacgatctgcatcatattgcctcattaattggtaaagtggtggacttcgagggttccctggctgagaatagatttacagtgcttcctaacatcgacccagagatagatgagaagaagaggaggcttatgggactgccgtccttcctaacagaggtggcccgaaaagagttggagaatctggattcgcgcattccgagttgctcagtcatttacatccccctgattggctttttactttccatcccccgcctgcctagcatggtagaagcgtccgacttcgagatcaatggtcttgactttatgttcctgtctgaggagaagttacactatcggtccgctagaacaaaggagctcgacgcactgttaggagatctacactgtgagatcagggaccaagagaccttactcatgtaccagttgcagtgccaagtcctggctagggctgcagtactgaccagagtgctggatttggccagtcgtttggatgtattactcgctctagcgtctgccgccagggattacgggtactcaaggccacgatactcccctcaggtgttgggtgtgcgcatccagaatggtcggcatccacttatggaactgtgtgcgcggacctttgtacccaactctaccgagtgcggcggcgataaagggagagttaaagttattacaggaccaaatagtagtggtaagagtatttatttaaagcaagtgggactgatcacatttatggcgttggtggggagttttgttcccgccgaagaggctgagatcggcgctgtggatgcgatctttaccaggattcactcatgcgagtccatatctctgggcctttctacattcatgattgatctcaatcagcaggtggcaaaggccgtcaataacgccactgcacagtcacttgtcctaatagatgaattcggcaagggtaccaacacagtggatgggctagcccttcttgcagcggtcctaagacactggctggcccgcggccccacgtgcccacacatctttgtggccaccaatttcctttcattggttcagcttcaactgctcccacagggaccacttgtccaatatctgactatggagacctgtgaggatggtaacgacctggtcttcttctatcaagtctgcgaaggcgttgcgaaggccagtcacgccagccataccgcagcccaggcgggcctgcctgacaaactagttgccagaggtaaggaggtgtccgacttaatccggtccggaaaacccatcaagcctgtgaaagacctcctcaagaaaaaccagatggagaattgtcagaccctcgtcgacaagtttatgaagttagatttggaggaccccaatcttgatcttaatgtttttatgtcccaggaggttctgcccgctgctacctcaatactctag

SEQ ID NO: 48926 - DNA, 585 bp, Artificial Sequence
  Description of Artificial Sequence: Synthetic coding sequence
atggccagcctgggcgccaacccccggcggaccccccagggccccaggcctggcgctgcctcgtctggatttcccagccctgcccctgttccaggtcctagggaagcggaggaggaggaagtcgaagaagaggaagagctggccgagatccacttgtgcgtgttgtggaactctgggtacttgggcatcgcctactatgataccagtgattctacaattcatttcatgcccgatgccccagatcatgagtctctgaagttactacagagggtgctcgacgaaattaacccacagagcgtcgtgacctcagctaagcaggatgagaatatgaccaggttcttaggcaagctggcaagtcaggaacatagggaaccaaaacggcctgagattatcttcctcccatctgtggacttcggcctggagatttccaagcaacgactgctttccggcaattactcattcatcccagatgctatgactgctacggaaaagatactgttcttgtctagtatcattccctttgattgcctgctcaccgtgcgcgcactgggaggcctgctcaaattcttgggcaggcggcgatag

SEQ ID NO: 48927 - DNA, 1404 bp, Artificial Sequence
  Description of Artificial Sequence: Synthetic coding sequence
accgtgtacagcgccctgggcctgcgggacgcctgccggagcctgccccaatccatccagttattccgtgacattgcgcaggagttctcagatgacctgcaccacattgcatctctgatcggtaaagtcgtggacttcgagggttctttagccgagaaccgatttacagtattgcctaacattgaccctgagatcgacgagaaaaagcgacggctaatgggcctgccctcattcctgacagaagtggcccggaaggagctcgagaacctagattcacgtatcccaagttgcagtgtcatttatatccctctgataggcttccttctgagtataccaagactcccctccatggtggaggcatcagatttcgaaatcaacggtttggactttatgtttctttccgaggaaaaactgcattacagatcagctcggacaaaagaattagatgcactgctcggcgacctgcactgtgagattcgtgatcaggagaccttgctgatgtatcagttgcaatgtcaggtgttagctagggccgccgtattgactagggtactggacctcgcctcgcggctggacgtgttgctggccctggcctcagcggctagggattatgggtattccaggccccgctacagcccacaggtcctgggcgtacggatccagaacggcaggcacccccttatggaattgtgtgcccgtacattcgtgcccaacagcacagagtgcggaggagacaaggggagggtaaaagtgattactggcccgaactcaagcggaaaatccatctacctcaaacaggtaggacttatcacatttatggcgttagttggctcttttgtgcccgccgaggaggccgaaattggggccgttgacgccatctttacaaggatacattcttgtgagtccatctctctcgggctgagcaccttcatgattgacttaaaccagcaggtagcaaaggcggtgaataacgccactgcccagagcctcgtgctgatcgatgagttcggcaaaggaactaataccgtggacgggctcgccctgctggccgccgtgcttcgacactggcttgctagaggcccgacctgtcctcatatcttcgtggctactaatttcctgtctttggtgcagctccagctgctgccccaggggcccttggtccaatacctaaccatggaaacatgtgaagacgggaacgacctcgtgttcttttaccaggtctcagacctcatcaggtccgggaaaccaattaagccagtgaaagatcttcttaagaaaaaccagatggagaattgccagaccctggtggacaagttcatgaagctagacctagaggatccaaaccttgatttgaatgtgtttatgtcccaggaagtcctgcctgcggccacaagtatcttatag

SEQ ID NO: 48928 - DNA, 198 bp, Artificial Sequence
  Description of Artificial Sequence: Synthetic coding sequence
accgcccagagcctggtgctgatcgacgagttcggcaagggcaccaacactgttgacggtttggcattgctcgccgctgtgttgagacactggctggcccgcggcccaacctgtcctcacatttttgtggccaccaattttctatctctcgtgcagctgcagttgctgccccagggacccttagtgcagtatctatag

SEQ ID NO: 48929 - DNA, 348 bp, Artificial Sequence
  Description of Artificial Sequence: Synthetic coding sequence
atcgcccaggagttcagcgacgacctgcaccacatcgccagcctgattgggaaggttgtcgattttgaggggagcctcgctgagaatagatttaccgtcctgccaaatattgaccctgagattgatgaaaagaaaaggaggttgatgggtctgccaagttttctcaccgaagtggcccgaaaggagttggagaacctggactccagaatacctagctgcagtgtgatttatattcccctgattggctttttgctcagtatacctcgacttcccagcatggtagaagccagtgattttgagataaatgggcttgacttcatggttcgcccaagtacttctgtaagatag

SEQ ID NO: 48930 - DNA, 1491 bp, Artificial Sequence
  Description of Artificial Sequence: Synthetic coding sequence
accgtgtacagcgccctgggcctgcgggacgcctgccggagcctgcctcagtccatacagctgtttagagatattgcccaagagttttctgatgacctgcatcacatcgcaagcttaatcggaaaggtcgttgacttcgaggggagcctggccgagaaccgatttaccgtgctaccaaacatcgacccagaaatcgatgagaagaaacgccgtctgatgggcctcccctcatttctcaccgaggtcgcacggaaagagctggagaatctagactctcggatacccagttgctctgtgatatacattccgctcattgggtttctcctgtcaattcccaggctgccatcaatggttgaggcatccgacttcgagatcaatggactggatttcatgttcctgtccgaggagaagctgcattaccggtccgctagaacaaaggaactggacgcgctgctgggcgacctccattgcgagattcgagatcaggagactctgcttatgtaccagctacagtgccaggtgttggcccgagcagcagtgctcacccgcgtgttagaccttgcatctcgcctcgatgtgctgctcgcattggcaagcgcggccagggattatggctactcccggccccggtatagcccccaggtactaggagtgcgtatccagaatggcagacatcctttaatggaattatgcgctcgtacgttcgtgcctaattctaccgagtgtggaggggacaagggtagagtgaaagtgataaccggacccaatagttccgggaaaagcatctacctaaagcaggtcggtctaatcacatttatggcactagtggggtcctttgtccccgcagaggaggccgagataggagcggtcgatgccatttttacacggattcatagctgtgagtctatctccctgggactcagcacgttcatgatcgaccttaatcaggtcgctaaggctgtgaacaatgcaaccgcacaaagccttgttctgatcgacgagttcgggaagggtacaaacaccgtggacggcctggcgctgctggccgctgtgctccggcattggctggcaagaggcccaacctgccctcatatattcgtggccacaaattttttgtcattggtgcaactgcagctgctgccccaaggtcctctcgtacagtaccttaccatggagacttgcgaagacggcaacgacctggtgttcttttatcaggtatgcgagggggtagctaaagccagccacgcttcccataccgcagcccaggcagggttgccggacaagctcgtggcaagagggaaagaggtgagcgacctcatccgttccggtaaaccaattaaaccagtcaaggatctgctgaagaaaaaccagatggaaaattgccaaactctagtggataagttcatgaaattggacttggaggaccctaatttagacctgaatgttttcatgtcgcaggaggttttgccagctgctacctccattctgtag

SEQ ID NO: 48931 - DNA, 477 bp, Artificial Sequence
  Description of Artificial Sequence: Synthetic coding sequence
cacgagagcctgaagctgctgcagcgggtgctggacgagatcaacccccagtcagttgtcacgtccgccaaacaggacgaaaacatgactcgctttcttggcaaacttgcatcccaggagcacagagagcccaaaaggccagaaattattttccttccctcagtcgactttggtcttgaaatcagcaaacagcgcctcttgtccgggaattactcttttattcctgacgccatgacagctactgagaaaatactttttctgtcttcgattattccatttgactgtctgcttaccattcctagccaggtcagagcactgggtggcctgctcaagtttctggggaggagacgcattggcgtggaacttgaagattataatgttagcgtgcccatcctgggattcaaaaaattcatgttgacacatctcgtaaatattgatcaagacacctatcggaatcctcagcaaatgcctctctag

SEQ ID NO: 48932 - DNA, 477 bp, Artificial Sequence
  Description of Artificial Sequence: Synthetic coding sequence
accgtgtacagcgccctgggcctgcgggacgcctgccggagcctgcctcagagcatccagctgtttcgcgatatcgcacaggaattctctgacgacctgcatcacatagctagtctcattgggaaggtgtacctgtcccctcaggtagattttgaaggtagtctggcagaaaacaggtttaccgttcttcccaacatcgaccccgaaatcgatgaaaaaaagagacggctgatgggtctaccttcctttctgacggaagttgcacggaaggagctcgagaacctggatagtcggattcccagctgtagtgtaatatacatccctctgataggatttctgctgtctatccccaggctccctagcatggtggaggcttctgattttgagattaatggattggactttatgttcttgtccgaagagaaactgcattaccgcagcgctcggactaaagaactggacgcacttctggggtag

SEQ ID NO: 48933 - DNA, 2238 bp, Artificial Sequence
  Description of Artificial Sequence: Synthetic coding sequence
atggccagcctgggcgccaacccccggcggaccccccagggcccccgtcctggcgctgcttcaagtggatttccctcccctgctccagtgcctggcccccgggaggccgaggaagaggaggtcgaggaggaggaagagcttgccgaaatccatctttgtgtgctctggaactcagggtatcttgggatagcctactatgacacatcggacagtactatccattttatgcccgacgcccccgatcatgagtctctcaaactactgcagcgagtacttgatgaaattaatccacagagtgtcgtgaccagcgccaaacaagacgaaaatatgacaagatttctaggtaagctggcctcacaggagcatcgcgagcccaaacgacctgagatcatcttcttgccatccgttgacttcggtcttgagatcagtaaacagcgtctgctcagcggtaactactcatttattcccgacgccatgacagctacagagaagatccttttcctaagttctattatcccattcgattgcttacttacacctcccggtgacctgagatttaccccaattcctctgctgatcccctctcaggtgcgcgctctcggcggtcttctcaagtttttgggacgccgacgcattggcgtggaactggaggactataatgtgtctgtgccgattctgggcttcaaaaagtttatgctgacccatcttgtgaatattgaccaggatacatatagcgtgctccagatctttaagtcagagagtcatccatctgtatacaaagtggcctccgggctcaaagaaggcctgagtttgttcggaatcctgaacagatgtcattgcaaatggggggaaaaactactgaggttgtggttcactagacctactcacgatctgggagaattgagctcccgcttagatgtgattcagttttttcttctgccacagaacctggatatggcacagatgctgcacagattactgggccatatcaaaaatgttcccctgatcctgaaaaggatgaaattatcccacaccaaggtgtcagattggcaggtactatacaagacagtgtacagcgcccttggtctgcgagatgcctgccggagcctcccacaaagcattcagctgttccgcgatatcgctcaggagttctccgatgatttgcatcacatcgcttcactcattggcaaggtcgtggacttcgagggctctctggccgaaaacagatttacagtgctgcccaacatcgacccagaaattgacgaaaagaaacgtcgtctaatggggctgcctagttttctgacagaagtggcccgtaaagaattagagaatcttgattccaggataccatcctgcagcgtcatttacatcccactgattggcttcctgctctccataccacgtctgccgtcaatggtggaagcttcggattttgaaataaacggcctggacttcatgttcctgagcgaagagaaactacattatcgctctgcccgcacaaaagagttggacgctttgttgggtgatcttcactgtgaaataagagaccaagagactttgctgatgtatcagcttcagtgtcaagtattggccagagccgcagtcctgactcgtgtgctggatcttgcctcacgcttggacgtgcttctcgctctggcaagtgctgctcgcgactacgggtacagtcggcctcgatatagcccgcaggttctcggggtgaggattcagaatggaagacatccactcatggagctgtgcgctagaacatttgtaccaaattccacagaatgtggaggcgacaaaggcagagtcaaggtgatcaccgggcccaacagcagcggcaagtctatttacctcaagcaggttggcctgattaccttcatggctcttgttggctcctttgttccagccgaagaagctgagatcggagccgtcgatgctatcttcacccgtattcacagctgcgagagcattagcttagggctcagcaccttcatgattgatctgaatcagcaagttgctaaggccgtgaataatgcaactgcccaatcactggttctgatcgacgaattcgggaagggtacaaataccgtcgatggcctggctttgctggcagctgtgctgcggcactggctggctagaggccctacgtgccctcacattttcgtggctactaactttttgtcactagtgcagctgcagctcctgccccaaggacccctggtccagtacctgtag

SEQ ID NO: 48934 - DNA, 2184 bp, Artificial Sequence
  Description of Artificial Sequence: Synthetic coding sequence
atggccagcctgggcgccaacccccggcggaccccccagggcccccggccgggggctgcctcatcaggctttccttcccctgctcctgtgcctggtcctagggaggctgaggaggaggaggtagaggaggaggaggagctggccgagattcacctttgtgtgctgtggaactcaggctacctcggaatcgcctactacgatacaagcgacagcacgattcattttatgccagatgcccccgatcatgaaagtcttaagctcctgcagcgtgtgctggatgaaataaatccccagagtgtcgtgacatcagctaagcaggatgaaaatatgacaaggtttctgggaaagctggcatcacaggaacacagggagcctaagagaccagagatcatatttttaccaagtgttgattttggcctggaaatcagtaaacagcgacttttaagcggaaattactcattcatccctgatgctatgactgcaacggagaaaatactatttctgagtagcatcatccccttcgattgtttactgacagtgagggcactgggcgggctgctgaagttcttgggcaggagacggatcggcgttgagctggaggactacaacgtcagcgtgcctatcttgggctttaagaaatttatgctcacccatctcgttaacatcgatcaggatacgtattctgtgctccagatctttaagtccgagtcacacccgtcagtatataaggtggcctctggcttgaaagaggggctgtccctgttcggcattctgaatcgatgtcactgcaaatggggagagaagctcctgcggctatggttcactcgacctacccatgacctgggcgagcttagctctaggctggatgtgatccagttctttcttctgccacaaaatctcgacatggcccagatgctgcacaggctgctgggacatataaaaaatgttccactcattttgaagagaatgaaactgtcgcacacaaaggtcagcgattggcaagtgctctataagaccgtctattcagcgttgggcctgcgcgatgcctgccgatctttaccccagtctatacagctctttcgggatattgcacaagagttttcagatgatttacaccatattgcatcactgatcgggaaagtggtggactttgagggttcattggccgagaataggttcacggttctcccgaatatagaccctgagattgacgagaagaaaagacgactcatgggcttaccctcctttctgaccgaagtggctcgcaaggagctggaaaatctcgacagtagaatcccctcctgctcagtcatctacattccgcttataggcttcctgctcagcattccacgcttgccatccatggtcgaggcaagcgatttcgaaattaacggattggattttatgtttctgagcgaggaaaaactgcactatcgctctgcccggaccaaggagttagatgccttgctgggcgacctgcattgcgagatccgagaccaggaaacactgctcatgtatcagctgcagtgccaggtgctcgctcgtgctgcagttttgacacgagtattggatctggccagcagattagatgtgcttctcgccctggcctccgcggcccgagactatgggtattcacgcccacgatactcaccgcaggtgctcggggtgcgaattcagaatggccggcatccattgatggaactgtgcgctagaacctttgtgcccaactctactgaatgtggtggcgataagggcagggtgaaggtcatcactgggccaaactctagtggcaaatccatttatctgaagcaagtcggcctgattacatttatggcactggtgggctctttcgttcccgctgaggaagccgagatcggcgccgtggacgccatctttacaaggatccatagctgcgaatctatcagcctgggcctgtctacgtttatgatagacctgaaccaggtcgcgaaggctgttaataatgctactgcgcagtctcttgtcctcatcgatgagttcggcaaagggacaaatacagtggatggcctggccttactagcagctgtcctcaggcattggctggccaggggccctacttgtccacacatcttcgtcgctactaactttttgagtctggtacagcttcagctgcttcctcagggaccactagtgcaatacctgtag

SEQ ID NO: 48935 - DNA, 1401 bp, Artificial Sequence
  Description of Artificial Sequence: Synthetic coding sequence
accgtgtacagcgccctgggcctgcgggacgcctgccggagcctgccacagagcattcagctgtttagggatatcgcgcaggaattctccgatgatctacaccacattgcctccctcataggcaaagtcgttgattttgaagggagcttagccgagaaccggttcacagttttgcccaacatcgaccctgaaatagacgagaagaagagacgcctgatgggccttccgtcatttttaacggaggtagcacggaaggagcttgaaaatctggacagtaggattccctcctgttccgtgatctatatacctctgattggctttctgttgtcaatcccacggctgccgagtatggtggaggcctctgatttcgaaataaatggactcgacttcatgtttctttctgaggaaaagctgcattaccgctccgccagaaccaaggagcttgacgctctgctaggagacctccactgtgagattcgggaccaagagacccttctgatgtaccagctccagtgtcaagtgttggcgagagctgctgtgctgacccgggtgctagacctggcttcccggctggatgttttgctcgctttggcatcggctgctagggactatggatatagccggcctcgatattctccacaagttcttggagtacgaattcagaacggccgccaccctctgatggaactgtgtgctcgcaccttcgttccgaactcaaccgaatgtggaggcgacaagggcagagtgaaagtgatcaccggacccaattcttctggaaagtccatctatctgaagcaggtgggactcatcacctttatggctctggtggggagtttcgtaccagccgaggaggcagagattggtgccgtggacgcaatattcacacggatccacagttgcgagtcaatcagcctcggcctctctacatttatgatagatctcaaccaggtggccaaggccgtgaacaacgccaccgctcaatccctagtgctcatcgacgagtttggtaagggaactaatacagtggacggcctagccttgctagccgccgtgctgagacactggttggctcggggcccaacgtgcccacatatatttgtggccaccaatttcctttctcttgttcagctccagttgctgccacagggacccctcgtccagtatctgacaatggaaacatgcgaggacgggaacgatctggtgttcttttatcaggtcagcgacctcatacgcagtggtaaacccataaagcccgttaaagatctcctgaaaaagaaccagatggagaattgccaaacactcgtcgacaagtttatgaaattagacctggaagaccctaatctcgacctgaatgtgtttatgtcacaggaggtgttgcccgccgccacaagtatactgtag

SEQ ID NO: 48936 - DNA, 765 bp, Artificial Sequence
  Description of Artificial Sequence: Synthetic coding sequence
atggccagcctgggcgccaacccccggcggaccccccagggccccagacctggcgcagcatcctctggcttcccatctccagcacctgtgccagggccaagagaggccgaggaagaggaggtggaggaggaggaagagttggcagagattcacctgtgtgtgctgtggaatagcgggtatctgggcatcgcatattacgacacttctgattcaaccattcactttatgccagatgcaccagatcacgaaagccttaagctactgcagcgtgtgctggatgagatcaacccccaatctgtggtaacatccgctaagcaagatgagaacatgactagatttctggggaagttggccagccaggagcacagagaaccgaaaagacctgagattattttccttcctagtgttgatttcggcctcgagatctctaagcagcgtttactctctggaaactactcatttataccagatgcgatgaccgccacagagaagatccttttcctgtcctcaatcattccttttgattgtcttctgaccgtaagagccctgggagggctcctgaaattcctcggccgtcgccggatcggggtggaattagaggactacaatgtgagcgtcccaatactgggtttcaagaagttcatgcttacccacttagtgaacattgaccaagacacatataggcttgagtgcaatggcgcaatctcagcccagtgcaatctgtgcctactgggttctagcgactcgccggccagtgcctcatag

SEQ ID NO: 48937 - DNA, 792 bp, Artificial Sequence
  Description of Artificial Sequence: Synthetic coding sequence
cactaccggagcgcccggaccaaggagctggacgccctgctgggcgacttacactgcgagatccgggaccaggaaaccttgctgatgtaccagcttcagtgtcaagtgctagctagagcagccgtcctgacacgggtactagacttagcctctcgactggacgtgcttttggctcttgcatcagccgcacgcgactatggctacagccgaccaaggtactcacctcaggtgttaggcgttaggatccagaatgggaggcacccattaatggagctttgcgcaagaaccttcgtgcccaatagcacagaatgtgggggagacaagggtcgtgtcaaagtcatcaccgggcccaacagcagcggtaagtcaatatatctgaagcaggtcgggctgataacctttatggcactcgtgggtagttttgtgccagcagaggaggcagagattggcgccgtcgatgctatctttacacgcattcactcctgtgaatcaatttctcttggactgtccacattcatgatcgacctgaaccaggtggccaaagcggtcaacaatgcgacagcacaatcattggtgctgatcgacgagttcggtaaagggacgaataccgtggatggtctggcattactggcagctgtgctaaggcattggctcgcaagaggccccacttgcccgcacatcttcgttgctaccaacttcctgagcctagtccagctccagctcctccctcaaggcccactcgtacagtacctggactggcccagagtgtccggacaagaaggcggagactag

SEQ ID NO: 48938 - DNA, 480 bp, Artificial Sequence
  Description of Artificial Sequence: Synthetic coding sequence
atgcagaacaacgagatcatcaagcccgccaagtacttcagcgagctggagaagtccatcctgctggccctggttgaaaagtacaagtatgtcctggagtgcaagaaaagcgacgcccgcaccattgccctgaagcagcgtacatggcaggccctggctcatgaatacaactctcagccaagcgtcagcctcagagacttcaagcagttgaagaaatgttgggaaaacatcaaggccaggacaaaaaagattatggctcacgaaagacgagagaaggtgaagcgcagtgtaagtccccttctatctactcatgtccttggcaaggagaagatcgcctctatgctcccggaacagttgtattttttgcaaagtccccccgaggaagaacccgaataccaccccgatgcttctgcacaggtgttttttcaggaacggaaacggtcattggagttgtctattattcttagcggtacctggtag

SEQ ID NO: 48939 - DNA, 924 bp, Artificial Sequence
  Description of Artificial Sequence: Synthetic coding sequence
atgggcagcaccatggagccccccggcggcgcctacctgcacctgggggctgtgacgagtcctgtgggaacagcccgcgtgctgcagcttgcttttgggtgcacgacttttagtctggttgcccatagagggggattcgctggagtccagggaaccttctgcatggccgcttgggggttttgttttgccgtgtccgctctcgtggtagcatgtgaattcacccgactgcatggctgtctccgcctcagttggggaaatttcactgccgcgttcgccatgttggctaccttgctctgtgctacggctgccgtgctttatccactctactttgccaggagggagtgtagcccagagcccgccggctgtgcggctcgcgatttcagattggccgcgtctgtgttcgccggcctgttattcctggcctacgctgtcgaggtagcgctgaccagagcccggcctggtcaggtgtcttcctacatggctaccgttagcggccttctgaagattgtacaagcttttgttgcgtgcattattttcggcgctttggtgcacgacagcagatacgggagatatgtggctactcagtggtgtgtagctgtgtatagcctctgctttctagccaccgtcgcagtggtggctttgtcagtgatgggacacaccggaggactcggctgcccctttgatagattggtcgtcgtgtatacctttctcgccgttctgctctatttgagcgctgcggtaatatggcccgtcttctgcttcgatcccaagtacggggagcccaagaggccacctaattgcgcccgaggaagctgtccctgggattcacagctggttgtggccatcttcacctacgtgaatcttctgctgtacgttgttgatctggcttactcacaacgcatcaggttcgtgccatccctgtag

SEQ ID NO: 48940 - DNA, 924 bp, Artificial Sequence
  Description of Artificial Sequence: Synthetic coding sequence
atgggcagcaccatggagccccccggcggcgcctacctgcacctgggggccgtaacctcccctgtcggcacagccagagttcttcaactagcattcggctgcactacctttagtctggtcgcccacaggggagggttcgccggggtacaggggaccttctgcatggcagcgtgggggttctgctttgccgtgtctgcattggtagtggcctgcgagtttacccggttgcacggttgcctccgactctcctggggaaacttcactgcagcgttcgctatgcttgcgaccctcctttgcgctacggccgccgtgctgtaccccttgtactttgcccgcagagaatgctcacccgaacccgctggatgtgcagcccgggatttccgcctggccgcttctgtctttgccggcctgcttttcctggcatacgcggtggaggtcgcacttacacgggctaggccagggcaagtgagtagttacatggcgacggtgtccggcttgttaaaaattgtccaggcctttgtcgcatgcatcatctttggtgctctggtgcacgactcacgctatggaagatacgtggccactcagtggtgcgtcgcagtgtacagcctgtgtttcttggccaccgtggccgtggtggctttgtccgtcatgggccacaccgggggcctggggtgcccgttcgatcgcctggtggtggtctacaccttcctggccgttctcctctatctgagtgccgccgtcatctggccagttttctgcttcgacccaaaatatggggagccaaaacggccacccaattgtgctagaggctcatgcccctgggacagccagcttgtggtcgcaatctttacctacgtaaacctgcttctgtatgtggttgacctagcatacagccagcgtatcaggttcgtgccctccctgtag

SEQ ID NO: 48941 - DNA, 759 bp, Artificial Sequence
  Description of Artificial Sequence: Synthetic coding sequence
atgtggcgggcccccgaggccgccctgcggcccgaggtgagcctggaaaggcgcgggccggaaatgaagcccgctgttgatgagatgttccctgagggggctgggccttacgtagatctagacgaagtggccagagctcggagagagagtccctccgccggaggtagcaccggtctcctaatggacctggccgccaacgaaaaggccgttcacgccgatttcttcaatgatttcgaggacttatttgatgacgacgacattcacagcagcggacttcctcgcacaagccagcagtcctccatggtacccgccctgcagaggggtcagtcagagcatggagtgcgtgggaaggccgccgagcggcctgttgtgagtgaggaacgatgcgagttgaacggaagggaggtcgccgcactcgaccgcgcgtttggtagcactgggcacggacagggggccgaggccctgatgtttacacgctgccgtgagcatcccctgtgtggcaccaataaagcaacctccgaaggaaaaatgggcacaggacggcttcggaactctctccgcaagaaccagagcaagtggttaggatcttacctggaggtgcttcggactacccgctctcgccgtgaagtgagcgaggactctacaatttccgtttccacacactggagggggaaatgtttcaaaagcgacgagacacccagcgtcgctgggggggaggagggaaaaaagacaactcagccttgcatcgacgttcggtag

SEQ ID NO: 48942 - DNA, 237 bp, Artificial Sequence
  Description of Artificial Sequence: Synthetic coding sequence
atgtggcgggcccccgaggccgccctgcggcccgaggtgagcctggaacgccgtggtcctgagatgaagcctgctgtcgacgaaatgttccctgaaggagcgggaccctacgttgatctggacgaagccggtgggagcactgggctccttatggacctcgccgctaacgaaaaagccgtgcatgctgatttctttaatgatttcgaagatctgttcgacgacgacgacatccaatag

SEQ ID NO: 48943 - DNA, 3645 bp, Artificial Sequence
  Description of Artificial Sequence: Synthetic coding sequence
atgaccctgccccacagcctgggcggcgccggcgacccccggcccccacaggccatggaagtgcatcgtttggagcatcgacaggaggaagaacagaaagaagagcgacaacactcactccgaatgggcagctctgttcgaaggaggacttttagatcttcggaggaggagcacgagtttagtgccgccgactacgctctcgctgccgcactcgcacttactgcttctagtgaactgagctgggaagcacaactcaggcgtcaaaccagcgccgtagaactggaagaacgggggcaaaaacgagtcggctttggcaacgactgggagcggacagagattgctttccttcagacccaccgccttctgcgccagcgcagggattggaagaccctgcgtcgcaggaccgaagaaaaggtgcaggaagccaaggagctgagagagctctgctacggccgcggcccctggttttggatcccattgcgctcacacgcagtgtgggaacacaccactgttttactaacttgcaccgtgcaggcttctccacctcctcaggtgacttggtacaagaacgacaccagaatcgatccacgtttgttccgcgctggaaagtacagaataaccaacaactacggactactctcactggagataagaagatgtgccattgaggactccgcgacctataccgtaagagttaagaatgcacatggtcaggcttctagcttcgctaaagtacttgtccggacttatttggggaaagacgcgggattcgactcagagatctttaagcgaagtacatttgggccctctgtcgagtttaccagtgttctcaagccggtcttcgccagagagaaggagcccttttctctttcttgcctgttcagcgaagatgtgctggatgcagaatctattcagtggttccgggatggttcactccttagatcttctaggcgaagaaagatcctgtatactgaccggcaagcttcgcttaaggttagctgtacgtacaaggaagatgagggcctctacatggtccgtgtcccgtcgcctttcggcccccgggaacagtccacttatgtcctcgtcagggatgcagaggccgagaaccccggcgcccctggttcccccctcaacgtgaggtgcttggacgtgaacagagactgtctgatattgacttgggcaccaccaagcgataccaggggcaaccctatcaccgcatatacaatagaaagatgccaaggggaaagcggcgagtggatagcctgccatgaagcgcctgggggcacatgtcgctgcccaattcagggattagtggaggggcagagctatcgatttcgggtgcgcgccatcagtagggtcggctcaagtgtgcccagcaaggccagtgaactggtggtgatgggtgatcacgacgcggcaagaaggaagactgagataccttttgacctcggcaacaaaatcactatcagcaccgatgcattcgaagacaccgtcaccatcccatcccctcctaccaatgtccacgcgtccgaaatccgtgaggcatatgtcgtcctggcctgggaagaaccaagccctcgggacagggcccccctgacatattccctcgaaaagtctgtaatcgggagtgggacttgggaggctatcagctccgaatctcccgtgaggagtccaagatttgctgtgcttgacctggagaaaaaaaaaagttatgtcttcagagtcagggctatgaaccagtacggcctgtctgacccttctgagcctagcgaacctatagctcttcggggccctcctgcgacgcttcccccacccgcccaggtccaggcattccgcgatacacagactagcgtgagtctgacatgggaccctgtgaaagaccccgaactgctggggtattatatctattcacgcaaggtgggaacttccgagtggcagacagtgaacaacaagccaatccaagggacacggttcaccgtgcccggcctcaggaccggtaaagagtacgaattttgtgtgcggtctgtgagtgaggcaggcgtcggcgagtcctcagccgccacagagcctattagagtgaagcaggcactggctacgccatcagccccttatggtttcgcacttctcaactgcggtaaaaacgagatggtgattggatggaaaccacctaagcgacgcggcggggggaagatcctcggctatttcctggatcagcacgactcagaggaacttgactggcatgcagtgaaccaacagccaatcccgacccgggtgtgtaaagtgtcggacctccatgagggccatttctacgaattcagagcccgggcagcaaattgggcaggggtcggggagctgagtgctccttcgagcctcttcgagtgcaaagagtggactatgccgcagcctggtcccccctacgatgtgagagcctccgaggttagagccactagtttagtgctgcagtgggagcctccactttatatgggggccggacctgtgaccggttaccacgtctcattccaggaggagggcagtgagcagtggaaacctgtgacaccagggcccatctccggaacacacctgcgcgtcagcgatctgcagccaggcaagtcatacgtgttccaggtgcaggccatgaactccgcagggctgggacagccctccatgccaacggatcccgtgttgctcgaagacaagcccggggcccacgagatcgaagtgggcgtggatgaggaaggattcatttatctggcattcgaggcccctgaggccccagattcgagcgagttccagtggtcgaaggactataagggacctctggatccacagagggtaaagattgaggataaggtcaataaatctaaagtgatactgaaggaaccaggtctcgaggatttgggaacttattctgtgattgtgacggacgcagatgaggatatctctgcatcacacacgcttacggaggaagagcttgaaaagcttaagaagctttcgcacgaaatcagaaatcccgtgattaaactgatctcagggtggaacatcgacatcctggaacgaggcgaggttaggctctggctagaagtggagaagctcagtccagctgctgagttgcaccttatttttaacaacaaggaaatattcagctctccgaaccgcaagatcaattttgatcgtgaaaagggtttagtagaagtcattattcagaatctgagcgaggaggataaggggtcatacactgcccaactgcaagacggcaaagctaaaaatcagattacattgacgcttgtggatgatgactttgacaagttacttaggaaagccgatgctaagcgccgggactggaaaagaaaacagggcccttacttcgagcgcccattgcagtggaaggtgaccgaggattgtcaggtccagctgacctgcaaggcttccgtcacaaacaccaagaaagaaacacgctttcagtggtttttccaacgggcagagatgcccgatggacagtatgatcctgagaccggcaccggactgctgtgtatcgaggaggcctcagtggcccccgcctcaggtctgacattttcgtttggctgtaagccaggccgagctaaatcctctggcctcggcgtgcgtgcaggaccacgcctgggatag

SEQ ID NO: 48944 - DNA, 4323 bp, Artificial Sequence
  Description of Artificial Sequence: Synthetic coding sequence
atgaccctgccccacagcctgggcggcgccggcgacccccggccccctcaggccatggaagtacaccgattggaacacaggcaggaggaggaacaaaaagaagaacgacagcactcccttcggatgggttcaagcgtgcggagaagaacttttagatctagctccgaagaggaacacgaattcagcgcagccgattatgccttggctgccgccctggcgctgacagcaagtagtgaactgagttgggaagcccagcttaggcggcaaacctctgccgttgagctcgaggaaagaggacagaaaagagtgggatttggcaatgattgggaaaggaccgagattgccttcctgcagacccacaggttgctgagacagagacgcgactggaagacgttaagaagacgaaccgaggagaaggtgcaggaggcaaaggagctgcgcgaactgtgctacggccgagggccttggttttggattcccctgcgcagccatgccgtgtgggaacacaccactgtgttgctcacttgcaccgtccaggcctcgcctcccccacaagtgacatggtacaagaatgatacaaggatagaccctcgcttatttcgcgcgggcaagtacagaattacgaacaattacgggctattatccttagagattaggcggtgtgccattgaggattccgccacttacactgtacgtgtcaagaatgcccacggacaggcctcttcctttgccaaagtgctggtcaggacatacttaggcaaagacgctgggttcgacagtgagatcttcaaacggtcgacgttcggaccgtccgtggaattcacctcagtcctcaagccagtgtttgcgcgtgaaaaggaacccttcagcctcagctgcttgttctccgaggatgtgctcgacgccgaatctattcaatggtttcgcgacgggtctctcctgaggtccagccgcaggaggaagatcctgtacacagatcgacaagccagtctaaaggttagttgtacctacaaggaagacgagggcttatatatggtgagagtccccagccccttcggtcccagagagcagagcacgtacgtactggtgcgcgatgcagaagctgagaatcctggagcccctgggtctcccctcaatgtgcgttgtctggatgttaaccgcgactgcctgattctcacctgggcaccgccatccgatacccgcggcaatcccattacagcctatacaatcgagagatgtcagggcgagagcggcgagtggatcgcctgtcacgaggcccccgggggtacatgtcggtgccccatccaggggttggtggagggacagtcctacaggttcagagttagagccatctctagggtgggtagctccgtcccaagcaaagccagcgagctggtcgtaatgggggatcacgacgctgctagaagaaaaacggagataccattcgatctgggcaacaaaatcaccatctccaccgatgcttttgaagataccgtcactatcccctccccccccaccaacgtgcacgcaagtgaaattcgagaagcatacgttgtgcttgcttgggaggagccaagcccaagagaccgcgcccccctgacctactcattggagaagagcgtcattggttccggcacgtgggaggcaatttccagtgagagccccgtgagaagccctcggtttgctgtgctcgatctcgaaaaaaaaaagagctatgtgtttcgcgtgagagccatgaatcagtacggactgtccgacccctctgagccatccgaaccaatcgccctacgcggtccacccgcgacccttccacccccagcccaagtccaggcctttcgggacacccagacaagtgtctccctgacatgggaccccgttaaggacccagaactcttaggctactatatctatagcagaaaagttggcactagtgagtggcagacagttaataataaacctattcagggcaccagatttactgtccccggactgcggaccggcaaggagtacgaattttgcgtgcggtcagtgtctgaggccggcgttggcgagtcttccgcagcaacagagcccatccgggtgaaacaggccctggcaaccccctccgctccctacgggttcgccctcctcaattgtggaaagaacgagatggtgatcgggtggaaaccgcccaagcgtcgcggcgggggcaagatccttgggtacttcttagatcaacatgactccgaggagctagattggcacgccgtcaatcagcaacccatccctacacgggtgtgtaaggtgagcgacctgcatgaggggcacttctacgaattccgcgcacgggctgccaattgggccggtgtgggcgagctatccgcaccttcttccctcttcgagtgcaaggagtggacaatgcctcagccggggcctccatacgatgtccgtgcatcagaagtgcgggccacctcactcgtgttgcagtgggagcccccactgtacatgggggctgggccagtgacaggttaccacgtaagtttccaggaggaggggtctgagcagtggaagccagtcaccccaggaccaatttctggtacacatttgcgggtctctgatctgcaaccagggaagtcctacgtttttcaggtccaggctatgaattcagccggcctgggccaaccttcaatgcccacagaccctgtcctcctggaggacaaaccaggggcacatgagatcgaggtgggggttgacgaggaggggttcatctatctggccttcgaggccccagaggcacctgacagctctgaatttcagtggtctaaagactataagggacctctagaccctcagagggtgaagattgaagataaggtgaacaaatcaaaggtcatcctcaaagaaccaggactggaggatcttggcacttactccgtgatcgtgaccgacgctgatgaggacatcagcgcctctcacacattgactgaagaggagctagaaaaacttaaaaaactgtctcatgaaattcggaatccagtaatcaagttaattagtggatggaacatcgatatcttggaacgcggggaagtgcgcctgtggttggaggtagaaaaactgagcccagccgctgaactgcacttgattttcaataacaaagagatcttctccagtccaaacagaaagattaacttcgacagagagaaagggctggtggaagtcatcatccagaacctttcagaagaagataagggcagctacaccgcacaactacaggatggcaaagccaaaaatcaaattactctcactctagtggatgacgactttgacaagctgctccgtaaggcagatgccaaacgaagagactggaaacgtaagcaaggcaccggaccctacttcgagcgcccattgcaatggaaagtgaccgaagactgccaggtccagctgacttgtaaggtgacgaacaccaagaaagagacgcggttccaatggtttttccagcgcgctgagatgccggacggacaatacgatccagagactggcacagggctcctgtgtatcgaagagctttctaaaaaagacaaagggatatacagagctatggtaagcgacgacagaggggaggatgacaccatcctcgaccttaccggagacgctctagatgctatattcacagagttagggagaatcggcgcactcagtgctactcccctaaaaatacaggggaccgaagaagggatcagaatcttcagcaaggttaagtactataatgtggaatatatgaagacaacctggttccacaaggataagcgactcgagagcggtgatagaatccgcactgggactacattagatgaaatctggctacacattctggacccaaaggactccgataaggggaagtatactctcgagatagctgccgggaaggaggttagacaattgtctactgatttaagcggacaggctttcgaggacgctatggcagaacatcagaggcttaaaactttggccatcatcgagaaaaatagagcaaaagtggtccgcggtctgccagatgtggcaaccattatggaagacaaaaccctttgtttaacctgcatagttagtggagatcccacaccagaaatctcttggctgaaaaacgatcaaccagtaacttttctggatcgctaccgcatggaagtgcgagggacagaggttaccataacaattgaaaaagtgaatagtgaggatagcgggaggtacggcgtttttgtgaaaaataaatacggcagtgagacaggtcaggtaactatatcagtcttcaaacacggtgacgagcctaaagagttgaagtctatgtag

SEQ ID NO: 48945 - DNA, 993 bp, Artificial Sequence
  Description of Artificial Sequence: Synthetic coding sequence
atggacatcagcaagaagaaccgggtgcggcagggcagccggggccgcggcaaaacgatctccaagaactccgaatcacgcgggcaacagcgccggcacatggttaccaatacaaagaaggaaacacggttccaatggttctttcaacgagccgaaatgcccgatgggcagtatgatcccgaaacaggcaccggtctgttgtgtatcgaagagctgtccaaaaaggacaaaggcatctacagggccatggttagtgacgatagaggagaggacgataccattctcgacctgaccggggatgctttggatgcgatcttcaccgagctcggacgcatcggggccctgtcggccactcctctgaagattcagggaacggaggaagggattaggatttttagtaaagtcaagtattataacgtcgagtacatgaagaccacctggtttcacaaagataagaggctcgaaagcggggatcgtatcagaaccggtaccacactggatgagatctggctccatatcctggatcccaaggattccgataaagggaagtatacgttggagatcgcagctggaaaggaggtgagacagttgtctactgacctgtctggacaggcatttgaggatgcaatggccgaacatcagcggttgaagacgctggcaataattgaaaagaaccgagctaaagttgtgagaggtctcccagatgtggccaccatcatggaggacaaaaccctgtgcctgacctgcattgttagcggtgatccaacccctgaaatctcttggcttaaaaacgatcagcccgtgactttcctggaccgttacagaatggaagtgagaggaactgaggttaccataacgattgaaaaagtgaattccgaggattccggacgctacggtgtgttcgttaagaacaagtatggctccgagacaggtcaagttactatttctgtgttcaagcatggagacgaacctaaagaactgaaaagtatgtag

SEQ ID NO: 48946 - DNA, 4314 bp, Artificial Sequence
  Description of Artificial Sequence: Synthetic coding sequence
atgaccctgccccacagcctgggcggcgccggcgacccccggcccccccaggccatggaagtgcatcgcctggagcacagacaggaagaggaacagaaggaagagagacagcacagcctgaggatgggatcatcggtgcggaggcgaaccttcagatccagtgaggaagagcacgagtttagtgccgcagattacgccctagcagctgctctggcgctgactgcgagctccgagctctcttgggaagcccaactgcgccgccagacctctgcagtggagttggaggaacgcgggcaaaaacgagttggcttcggcaacgactgggaacgcacagagatcgccttcctccaaacgcatcggttgttacggcagaggagggattggaaaacattaagacggaggaccgaggagaaagtgcaggaggccaaggagttacgcgagctgtgctacggccggggtccatggttctggatccctctgaggtcccacgcggtgtgggagcacacgacagtattgctaacctgcacggtacaggcctccccccctccccaagtcacatggtataagaacgataccaggattgaccctcggctctttcgggccggaaagtataggataaccaataattatggtctgctgtctcttgaaataaggcgctgtgccatcgaggacagcgcaacctatactgtgagagtgaaaaacgcgcatggacaggcatccagcttcgcaaaggttctcgtccgcacttatctgggtaaggacgctgggtttgactcagagattttcaagaggagcacttttgggccctccgtggaattcactagtgtgcttaagcccgtctttgcgagggaaaaggaacctttcagcctgagctgcctgttttctgaagacgtattagacgccgaatcaatacagtggtttagagatggctcattgctgcggagttcgcgacgccgaaaaattctttacaccgataggcaggcaagtctcaaggtgagttgcacgtacaaggaggacgagggtctgtacatggtgcgggttcccagtccttttggaccccgagaacagagcacatatgtattggtgcgggacgcagaggccgaaaatcctggcgccccagggtctccactgaatgttcgatgtttggacgtcaacagagactgcctgatcttgacctgggcgccccctagtgatacacgagggaatccgattacagcatacacaatagagagatgccagggggagtccggcgagtggatcgcttgtcacgaggcgcctggaggcacatgcagatgccctatccaaggccttgtagaaggccaatcttaccgattcagagtgagggcgatttcccgagttggaagctctgtgccatcaaaggcatccgagctagtggtgatgggtgaccacgacgcagctaggcggaaaaccgaaatcccctttgaccttgggaacaaaataacgatcagtaccgatgcgtttgaagacaccgtgactatacccagcccgccaaccaatgtacatgccagcgagatcagggaagcctacgtagtcctggcttgggaagaaccttccccccgggacagggcccccttgacatattcccttgaaaaatctgtgatcggctccggcacatgggaggcaatttcttctgagtctcccgtcaggtcccctcggttcgcagtcttagatctggagaaaaagaaatcgtacgtttttcgggtcagggccatgaatcagtatgggctgtctgacccaagcgagccttccgagccaatagcattgcgcggcccaccagccacactccctccccccgcccaggtgcaagcttttcgagacacacagacatccgtcagcttgacctgggacccagtaaaagatcccgagctgctggggtattacatttactcacgaaaggtgggcacaagcgaatggcagactgttaacaataaacctatccaggggaccaggttcacagtccccggcctgcgaactgggaaagaatacgagttctgcgtacgctccgtgagtgaggccggcgttggagaaagcagcgcagcaacggagccaatcagggttaagcaggcactggcaaccccgtcagctccttatggctttgctctgctgaactgtggaaaaaatgagatggtaatcggctggaaacctcctaaaagacgaggtggcgggaaaattctcggctacttcctcgatcagcacgacagcgaggagttggattggcatgccgtgaatcagcagccaatccctactagggtgtgtaaggtgtcagatttacatgagggtcacttctatgagtttcgcgctagggccgctaattgggccggagttggagagttgtcagctccctccagccttttcgagtgtaaagaatggactatgccccagcccgggcctccttacgatgtgcgagcctctgaagtccgggcaacttcactcgtgctgcagtgggagcctccgctttatatgggtgccggccctgtcaccggataccacgtgagttttcaggaagagggtagtgaacagtggaagcccgtgacccccggccccatctccggcactcatctgcgcgtcagtgacctgcaacccggaaagtcctacgtattccaggtccaagcgatgaattcagccggtctggggcagcccagcatgcctactgatcccgtgctgctggaggataagccaggcgctcatgaaattgaagtaggagtagacgaggaaggcttcatctacctggctttcgaggcgccagaagcccccgatagctcagaattccagtggtccaaggactataaaggacccctcgatcctcagcgcgtcaagatagaagataaggttaacaaatctaaagtgatcctgaaggaacctggattggaagatctcggaacttactccgttattgttaccgatgccgacgaggacatttcagcatctcacacactgaccgaggaggaactggaaaagctcaaaaaactcagccacgagataaggaatcccgtgatcaaactaatatctgggtggaacatagacatcctggagaggggcgaagtccgtctgtggctcgaggtagagaaactctcccccgccgcggagttacacttaatcttcaacaataaggagatcttctcttccccaaacagaaagattaacttcgaccgggagaagggtttagtggaagttatcatccagaacctgagcgaggaggacaagggctcttacactgcccagctccaggacggtaaagctaagaatcagataactcttactcttgtggatgatgatttcgataaactcttgagaaaggcggacgccaaacgccgcgattggaagcgcaaacaagggccttactttgaaaggcctctgcagtggaaggttaccgaggattgtcaggtgcagcttacgtgcaaagtcaccaacaccaaaaaagagacacgttttcagtggtttttccagcgagccgagatgcccgacggacagtacgatccagagaccgggacaggcctcctctgtatagaagagttgtcaaagaaggacaaaggaatctaccgggccatggttagtgatgacaggggcgaagacgatacaatccttgatctcactggtgacgcgctcgatgcaatctttacagagcttggccgaatcggggctctctctgctaccccactgaagattcagggcactgaggaagggatccgaatctttagtaaggttaagtattacaatgtagagtatatgaagaccacctggtttcataaagacaagcggctggagagcggagatcggattcggacaggaacaacgctggatgagatctggctccacatcctggaccccaaggattcggataagggcaaatatactctggagattgcggccgggaaagaagtaagacaactgtctaccgacctctcagggcaagcatttgaggacgcaatggcagagcatcaacggctgaagactctggccataattgaaaaaaatcgcgccaaggtggtcaggggccttccagacgtggccaccatcatggaggacaagactttgtgcctcacatgcatcgtctccggggatccaacacccgagatctcatggctgaaaaacgatcaacctgttacattcctggacaggtaccgaatggaagtcagaggcacggaggtgaccataaccattgaaaaagtgaattctgaggattccggacgatacggggtgttcgttaaaaacaaatatggctcggaaactggtcaggtcaccatctctgttttcaagcatggagacgaacccaaggagctaaaatctatgtag

SEQ ID NO: 48947 - DNA, 996 bp, Artificial Sequence
  Description of Artificial Sequence: Synthetic coding sequence
atggacatcagcaagaagaaccgggtgcggcagggcagccggggccgaggcaagacaatttccaaaaattctgaaagcaggggccaacagagacggcacatggttaccaacaccaagaaggaaactaggtttcagtggttcttccagcgggccgagatgcccgacggacaatacgacccggaaaccggaacgggcctgctttgtatcgaggaagcgagtctgagtaaaaaagataaaggcatatatagagccatggtgagcgacgacagaggagaagacgacaccatactcgatctcacaggggatgcactggatgcaattttcacagagctcggcagaatcggtgctctgtctgcaactcctctgaagatacagggcactgaggaagggatccggattttcagtaaagtcaagtattataacgtagagtatatgaagaccacgtggtttcacaaggataagaggctggaatctggtgataggattaggactgggactaccctcgacgagatatggctccatatcctggacccaaaggacagtgacaagggcaaatatactctggaaattgcagccggaaaagaagtgcggcaattgtcaactgatctatctggtcaggcgtttgaggacgcaatggctgaacatcagcgcctcaagtttttgtatataagccagtaccgcgcgaaagtcgtgcgagggctccccgacgtggcaactattatggaagataagactctgtgtctgacttgtattgtcagcggggatcccactcccgaaatctcatggctgaagaacgatcaaccagttacttttctggaccgctatagaatggaggttcgcggaactgaggtcaccattaccatcgagaaagttaactcagaggatagtggcagatatggcgttttcgtgaagaataaatacggcagcgaaaccggacaagtgactatcagcgtgtttaagcatggcgacgaacctaaggagctcaagtctatgtag

SEQ ID NO: 48948 - DNA, 1065 bp, Artificial Sequence
  Description of Artificial Sequence: Synthetic coding sequence
atggaggccgccaccgcccccgaggtggccgccggcagcaagctgaaggtcaaggaagcctccccggccgacgccgagccgccgcaggcctcccctggtcagggcgccggctcccccactccccagctactgcccccaatcgaggagcaccctaaaatatggttgcctcgagctttacggcagacttatatacgtaaagtgggagataccgtcaacctgctgatcccgtttcaggggaaacctaaaccgcaggcaatctggacgcatgacggttgtgctctcgacacacggagggtgtctgtgcggaatggcgaacaggattcgatcctgtttatccgagaagcacaaagagccgactccggacggtatcagctgcgggtgcagcttggaggcctggaggccacggctacaattgacatcctcgttatagagcgcccaggcccccctcagtcaattaaacttgtggatgtctggggcttttcagcaacccttgagtggactccaccccaggatacggggaatactgcactgttgggctatactgtccaaaaggcggacacaaagagcggcttgtggtttacagtgctggaacattaccacagaacaagctgcattgtgtctgatttgatcatcggtaactcatatgccttcagggtgttcgccgagaaccagtgcgggctttcagagacagccccaattactaccgatttagctcatattcagaaggctgccaccgtctacaaaacgaagggctttgcccagagagatttttcagaggccccaaaatttactcagcccttggctgattgcaccaccgttactggctacaacacgcagcttttttgctgcgtaagggcctcaccgcggcctaagataatctggctgaaaaataagatggacattcaaggaaatcccaaataccgcgccctaactcacctaggaatctgtagcctggagatccgcaaaccaggcccctttgacggcggcatttacacatgtaaggcggtgaacccacttggggaagccagtgtggactgtagagtggacgtgaaagtccccaattag

SEQ ID NO: 48949 - DNA, 1464 bp, Artificial Sequence
  Description of Artificial Sequence: Synthetic coding sequence
atgcaggagttcgcccggcggtacttccggcggagccaggccctgctcgggcaaaccgacgggggcgccgctgggaaggacacagactctttggtgcagtataccaaggctcctatccaggaatctctgctgtccttgagcgacgacgtgagcaagcttgccgtggcttccttcctggcgctcatgagatttatgggcgaccagagcaaacctagagggaaagacgagatggatctgctttacgagctgttgaagctatgtcagcaagagaaactcagagacgagatctactgtcaagtcatcaagcaggttacggggcatccaagaccagagcactgtacgcgtggctggtcattcctcagcctgctgactggcttttttcccccatctactcgtctgatgccgtacctaaccaagtttctgcaagatagcggaccatcacaagagctcgctcggagtagtcaggagcacctccagaggaccgtcaaatatggggggaggaggcgcatgcccccaccaggcgagatgaaggcatttctgaaagggcaggccatccggctgcttcttatccaccttcccggcggagtcgactatcgcacaaatatccagacgtttaccgtggccgccgaagtgcaggaagagttatgtcgccaaatgggcatcactgaaccccaggaagtgcaggagtttgctttgttcttgatcaaagagaagagccagctggtcaggcctctccagccggctgagtatctaaatagcgttgtagtggaccaggacgtgtccctgcattcgcggaggttgcactgggagactcctctccattttgacaacagtacgtatatatcgacccattacagtcaggtgctctgggattatctccaggggaaactgcctgtatcagccaaagcggacgcccagctggcacgactggctgctctgcagcacctgagtaaagctaacaggaataccccttcaggacaggatctccttgcttatgttcccaaacagctgcagcggcaggtcaacactgcctccatcaaaaacctgatgggacaggagttgaggaggctggaggggcatagcccccaggaggctcaaattagcttcatcgaagctatgtcacagctccctctatttgggtacactgtctatggggtgttgcgagtaagcatgcaggcactttccggccccactttattaggcctcaataggcagcacctgattctcatggatcctagctcacaatccctctactgccgaatcgctctgaagtcccttcagaggctccatctgttgtcaccactcgaggaaaaagggcctcctgggcttgaggtcaattacgggtctgccgacaacccgcagacaatctggtttgaactcccccaggcacaggagctcctctacactactgttttcctgattgactcaagtgcgtcttgcaccgagtggcccagcatcaactag

SEQ ID NO: 48950 - DNA, 1998 bp, Artificial Sequence
  Description of Artificial Sequence: Synthetic coding sequence
atggaccggcccgccgccgccgccgccgccggctgcgagggcggcggtggtcctaaccctggtcccgcagggggtcgaaggcctccgcgagcggccggcggagccaccgccggcagcagacagccatctgtcgaaaccctggacagtccgaccggtagccatgtagaatggtgcaaacagctcattgccgcaacgatcagtagtcagatttccggtagcgtgacatccgagaatgtttcccgagattacaaggctcttcgcgacggaaacaagctcgctcagatggaagaagcacctctttttccaggagagagtatcaaggccatagtgaaagacgttatgtatatctgcccgttcatgggagccgtttccggtaccctaacagtgaccgacttcaaactatacttcaagaacgttgagagggaccctcacttcattttggacgtgccattaggagtcatttccagagtagaaaagatcggggcacagtcacatggtgataacagttgtggaattgagatcgtgtgcaaggacatgcgcaaccttcgcctggcctacaaacaggaggaacagagcaaactgggaatattcgagaatctaaacaaacacgctttccctctgagtaatgggcaggcactgttcgcgttctcctataaagaaaagttccccataaatggctggaaggtgtacgatccagttagtgaatacaaaagacagggactgccaaatgagtcgtggaaaatcagtaaaataaattcaaattacgaattctgcgatacctatccagccatcattgttgtgccgacgagcgtgaaggatgatgatctgagtaaggtggcggcttttagggccaagggacgagtgcccgttttaagttggatccatcccgagtcacaagctacaatcacccgttgttcacaacctcttgtaggacccaatgataaacgctgtaaagaagatgaaaaatacctgcaaaccatcatggacgcaaatgcgcagtcacacaaacttattattttcgacgcccgccagaattcagtcgccgacaccaacaagactaaaggtggtggctacgagagtgagtcagcttatccaaacgcagagttggtcttccttgagatccataacatccatgtgatgcgcgagtctctccgcaagctcaaagagatcgtgtacccctctatcgacgaagctcgctggctctctaatgtggatggcactcactggttggagtacatccggatgctcctcgctggagccgtgagaatcgcggacaaaatcgagagtgggaagacaagcgttgttgtccactgctctgacggctgggacaggactgcccagctgaccagcctggccatgttgatgctcgatagctattatcgaaccatcaagggctttgagaccctggtggaaaaggagtggatttcctttggacaccgcttcgccctacgcgtgggacatgggaatgataatcacgcagacgccgaccggtccccaatcttcctgcaatttgtggattgcgtttggcaaatgacgcgccaatttccgtccgcttttgagttcaatgagctctttttgattacaattctagatcacctgtactcctgtctttttggcacattcctctgtaactgcgagcagcaaagattcaaagaggacgtgtacacgaagaccatcagtctctggagctacattaacagccaactggacgagttttccaatccatttttcgtcaactatgagaaccatgtgctgtatccagtggcctctctgtcccaccttgaactgtgggtgaattattacgtgcgctggaatccaaggatgagaccacaaatgccgatccatcaaaatctgaaagagctcctggctgttcgggcagagttgcagaaaagggtcgagggactccagcgagaggtggcaacccgggcagtatcctcatcctctgaaagaggctccagtccaagtcacagcgccaccagcgttcatacatctgtgtag

SEQ ID NO: 48951 - DNA, 819 bp, Artificial Sequence
  Description of Artificial Sequence: Synthetic coding sequence
atgatcagcacctgcctgcccgagtacatcgtggtgcccagcagccttgccgaccaggatctgaagattttttctcacagttttgtaggtcgccgaatgccactctggtgctggtctcactcaaacggctctgccctggtcagaatggccctaattaaagatgttctccagcaacgcaaaattgaccaacgcatttgcaacgcaatcaccaaatcccacccacagagatcagacgtgtataagagcgacctggacaagaccctgcctaatattcaggaagtacaggcggctttcgtgaagctcaaacagctgtgcgtgaacgagcctttcgaggagacagaggagaagtggttaagctcactggaaaacacacggtggctcgagtatgtaagggccttcctgaaacactctgcggagctggtttatatgctggagtctaagcacttgagtgtagtcttacaggaggaagaaggccgcgatcttagctgctgcgtggcctctttggtacaggtaatgctagacccatatttcagaacaattaccggctttcagtccctgatccaaaaggaatgggtcatggccggataccagttcctggaccgatgcaatcatctcaaacggtcagagaaagagtccccattgttcctactattcttggatgcaacttggcagctacttgagcaatacccagcggcctttgaattttcagagacctacctggccgtgttatacgattccacacgcattagcctgttcggtaccttcctcttcaattccccacaccaacgagtgaagcagagcaccgtgtggctgttgtag

SEQ ID NO: 48952 - DNA, 1371 bp, Artificial Sequence
  Description of Artificial Sequence: Synthetic coding sequence
atgcccctgcagaagttccactaccggaacctgctgctgggcgagcacgatgtgcccttaacatgcatcgagcagattgtgacagtaaacgatcacaagcggaagcagaaggtgctgggacctaaccagaaactcaaattcaatccgacagagcttatcatctattgcaaagatttcaggatcgtaagattcagattcgatgagtctgggcctgagtcagccaagaaggtgtgtctcgcgatcgcacattactcccagccaacagatttgcagctgctgtttgcctttgaatacgtgggcaaaaaataccataacagcgccaataaaatcaacgggattcccagcggagatggcggcgggggaggcggaggtggcaacggcgctggtggtggctcgtctcaaaagacgcctctctttgagacttattccgactgggaccgagagatcaaacggactggagcctcagggtggagagtatgcagtataaacgaaggctacatgataagcacatgtcttccagagtatatcgtagtaccctcctcattagctgatcaggacctgaagatcttttcccactcatttgtggggagaagaatgcccctgtggtgctggtctcacagtaacggctctgctctggtgagaatggcactgatcaaagacgtgctgcagcagcgcaaaatcgaccaacggatctgtaatgctataaccaaaagccaccctcagcgcagcgatgtgtacaagagtgacctggataagacactgcctaacattcaagaggtgcaggcagcgttcgtgaaattgaagcaactctgcgtcaacgagccgttcgaggagactgaagagaaatggcttagctccctagagaacacaaggtggctggagtacgtgcgcgccttcctgaaacactccgccgaactggtctacatgctggagagcaagcacttatccgtcgttctgcaagaagaggaaggtcgcgatctgtcatgttgcgttgcaagcttggtgcaagtgatgcttgacccttactttaggactatcaccggttttcagagtctaatccagaaagagtgggttatggccggctaccagttcctcgatcgatgcaatcatttgaaacggagcgagaaggagtcaccactattcctgctatttttggacgccacatggcaactgctagagcagtatcccgcagctttcgagttctctgaaacatacctggccgttttgtacgattcgacaagaatctccttatttgggacattcctgtttaattcgccccatcagagggtgaaacagagtaccgacaagaaattgtacaagacccgcctgttttcctttacgtcccttaaattcctggttaccattcactag

SEQ ID NO: 48953 - DNA, 657 bp, Artificial Sequence
  Description of Artificial Sequence: Synthetic coding sequence
atgttcagcctgaagccccccaagcccaccttccggagctacctgttgccccccccacagacagatgacaaaatcaactcagagcccaaaatcaaaaaactcgagccggtactcctgccgggtgagattgtggtcaatgaggttaacttcgtgcgcaagtgtatagctacagacaccagccagtacgacctatggggtaagttgatatgttcgaactttaagatctctttcataacagatgatcccatgcccttgcaaaagttccactataggaacttacttctgggtgaacacgacgttcctctgacttgcatagaacagatcgtgaccgttaacgaccacaagcggaagcaaaaagtgcttggccctaaccaaaaattgaagtttaaccctacagaactcattatttattgtaaggacttcagaatcgtgaggttcaggttcgacgaatcgggccccgaatcagctaaaaaacagaccaaattgatggagttcccccaggagatggaggaagaagaggaggaagaggtgatggaattagtggtcgccgcagctcggaagctgcactccttgaagctcactcgcatcgggacggagaagtcacgaggccaagtgttgcctggaggggagtttgtgctgctaacaagggtaacctag

SEQ ID NO: 48954 - DNA, 2334 bp, Artificial Sequence
  Description of Artificial Sequence: Synthetic coding sequence
atgttcagcctgaagccccccaagcccaccttccggagctacctgctccctcctccccaaaccgacgacaaaattaacagtgagcctaagatcaaaaaattggagccggtcttgctccctggagaaatcgtggtcaacgaggtcaatttcgttcgtaagtgtattgccaccgatactagtcagtacgacctatgggggaagctgatctgttctaacttcaagatatcttttatcacggacgacccgatgcccttgcagaagttccactatcggaatctgctcttgggtgaacatgatgtacctcttacttgcatagaacagatcgttaccgttaacgatcacaagaggaagcagaaggtgttaggacctaatcaaaaactgaagtttaaccctacagaacttattatttactgtaaagactttcggattgtcaggttcagatttgacgagtccggccccgaaagcgccaaaaaagtctgtttggccatcgctcactatagccagcctacagacctccaactactgtttgctttcgaatacgtgggaaaaaagtatcacaacagtgctaataagataaacgggatccccagcggtgacggcggaggaggtggaggcggcggcaacggggccgggggagggtcttctcaaaaaaccccgctgttcgagacctactcagattgggatagggaaattaagcgaacaggtgccagtgggtggcgcgtgtgctcgatcaacgaggggtatatgatttccacctgtctccctgagtacatcgttgttccttccagcctggcagatcaggatctgaagatcttttctcattcgttcgtcgggcggcggatgcccctgtggtgttggtcacatagcaacggatcagcattagtgcggatggccctaattaaggacgtgctccagcagcgtaagattgaccagcgcatttgtaatgctattacaaaatcacacccgcagaggtcggatgtgtataagtccgatctcgacaaaacactgcctaatatccaggaagtgcaagctgcctttgtcaagttgaagcagctgtgcgttaacgagccattcgaggagacagaagaaaagtggctgagtagcctagaaaacactagatggctcgaatatgtgcgcgcctttctaaagcactccgccgagctggtgtacatgctagaaagtaaacatctctccgtcgtgttgcaggaagaagagggaagggatcttagctgctgcgtcgcctctctcgtgcaagtgatgctcgacccttactttagaactatcaccggtttccagagcctcattcagaaggaatgggtcatggccggataccagttcttggacagatgtaaccatctgaagcggagtgagaaagagtctccgcttttcttgcttttcctcgacgcgacatggcaactgctggaacagtaccctgccgcttttgagttttcggaaacctacctggccgtcttgtatgactccactaggatctctttattcggaacatttctttttaactcccctcatcagcgcgtcaaacaatccaccgagtttgctattagcaagaacatccagctaggcgacgaaaagggcctcaaatttcctagcgtgtgggattggtccctgcagttcacagcaaaggatcgcaccctcttccacaaccccttctacatcggcaaatctacgccctgcattcagaacggttccgtgaaatcttttaagaggacaaagaagagctatagttccaccttgagaggtatgccatctgctctgaagaatggcatcatctcagatcaagaattgcttccgagacgaaactcattaatcttgaagcccaaacctgacccagcacagcaaactgactcccagaacagtgacacagagcagtacttcagagagtggttctcgaaaccagctaacttgcatggagttattctccccagggtgtctgggacacacattaagctgtggaagctgtgttattttcgctgggtcccggaggcccagattagccttggaggctctatcacagcttttcacaaactgagccttctcgcggacgaggtcgatgtcctgagtcgcatgctaagacagcaacggagtgggcctctggaggcctgctatggtgagcttggacagtctcgtatgtacttcaacgcctccggcccccatcatacagacacgtccggaacccctgaattcctctcatctagtttcccttttagtccagttggcaacctttgtaggcgctctatcttaggaacccccctatccaaatttctctcaggagccaagatctggctttcgaccgaaacactggcaaatgaagactag

SEQ ID NO: 48955 - DNA, 819 bp, Artificial Sequence
  Description of Artificial Sequence: Synthetic coding sequence
atgtggtggggcggccggggccagagcttcaacatcgccccccagaaggaggaacctgagatgggctcagtccaggaaaacaggatgcctgagcctagatccagacagccctcaagctgcctggcgagccgttgtcttcccggagaacagatcttagcttgggctccgggcgtgcggaaaggactcgaacctgagctgtcaggcacactgatatgtacgaactttagagtcacctttcagccttgcggctggcagtggaatcaagatacgcccctaaactcagagtacgactttgcattggtaaacatagggaggctcgaagcggtcagcggcctgagccgggtccaactgcttcgccctggttcactgcacaaattcattccggaggaaatccttatccatggccgggatttcagactcctgagagtcggcttcgaggccgggggcttggagccccaggcctttcaggtcaccatggccattgttcaggctcgagctcagtcgaaccaagctcaacagtacagcggtatcacactcagtaaagccggtcagggctccggctcaagaaaaccacccatccccttaatggagactgccgaggattgggagaccgaacgcaaaaagcaggccgcccgcggatggagggtgtctactgtcaacgaacgctttgatgtagccactcgcctgaggtgcttctccagcagccttatagtgtctgggtccagttcatcctccttccagcttattcttaacagtctgtcctttagttttctcctttttatgaccgtgagcggattcctgaccccattgcccagctag

SEQ ID NO: 48956 - DNA, 1923 bp, Artificial Sequence
  Description of Artificial Sequence: Synthetic coding sequence
atgcccccccgggtgaccttccagccctgcggctggcagtggaaccaagatacgccgctgaactccgaatacgacttcgctcttgttaacatagggcgtttggaagccgtgtcagggcttagtcgggtccagctcctacgcccgggcagtctgcacaaatttattcctgaagaaatcctgatccacggtcgagacttcaggcttctcagggttgggttcgaggctgggggcttggagccacaggctttccaggtgactatggctatcgtgcaggccagggcacagtccaaccaggctcagcagtacagtggcatcactctgagcaaggctgggcaggggagcggttcaagaaaaccgcccattcccctgatggaaaccgccgaagactgggaaaccgagcgaaagaagcaggccgccaggggatggcgggtgtcaacagtgaatgaacgatttgatgtggccacctccctgcctcgctatttttgggtccccaatagaatactggactccgaggtcaggcgggcgtttggacattttcaccaggggcggggcccgcgattaagctggcaccatcctggcggctctgatctgctgcggtgcggaggcttttacaccgcaagtgaccctaacaaggaagacattcgagccgtagaactcatgcttcaggccggccactccgatgttgtgctggtggatacaatggatgagctgccttccttagccgatgtccaacttgcccatctgaggttgagggccctctgcctgccggactcgtccgtcgctgaagacaaatggctgagtgcactcgaggggacacggtggcttgattatgttcgagcctgcctgcgtaaggcatccgatattagtgttctggttacctccagagtacgaagcgtgatcttacaggagcgcggagaccgggatctgaatgggctcctatcttcactggtccagttgctctcagcccccgaggctcgaacactcttcggatttcagagcctcgtccagagagagtgggtggcagcggggcatccgttcctgacccggctaggaggtacaggcgcaagcgaagaagcgccagttttcctgttgttcctggactgtgtctggcaactgctccagcagttccctgcggacttcgagtttagcgaattctttctgctggcactacatgatagcgtccgcgtccccgacacactcactttccttaggaacaccccgtgggaaaggggcaaacagagcggtcagttgaacagttatacccaggtctacacccctggatattcccagcctccagcagggaactcattcaacctgcagctgtcagtttgggactgggatctgcgatactccaacgctcagatcctacagtttcaaaacccagggtacgatccagaacactgtcccgattcatggcttccacggccacagccctctttcatggtccccggtcccccctcctctgtgtggttattcagcaggggcgcactgacccctttaaatcaattgtgtccttggagagacagccccagcctgcttgccgtgtcgtcacgctggctgcccaggcccgctatcagctctgaatccctggctgaccaggagtgggggctaccttctcactggggggcctgtcctttgcccccgggcctgcttctcccgggttatctcggaccacagatccgtctgtggaggcgctgctacctgcgtggaaggcctgaagtgcagatgggcctgtctgcaccgacgatttccggtctccaagacgagctgtcacatctgcaagaactgttgaggaaatggactcctcgcatttctccagaggaccacagcaagaaacgtgaccctcacacaatcctgaacccaacagaaatcgccggcatcctgaagggccagtctcacccgttttggataacccggtgctag

SEQ ID NO: 48957 - DNA, 765 bp, Artificial Sequence
  Description of Artificial Sequence: Synthetic coding sequence
atggccatcgtgcaggcccgggcccagagcaaccaggcccagcagtacagtgggataacccttagcaaggccggccagggctcaggctctcgcaaaccgcctattccacttatggagaccgccgaggattgggaaaccgagaggaagaaacaggccgcccgtggttggagagtctcaacggtaaatgagcgcttcgacgtcgcgacatccttgccacgatacttctgggtgcctaaccggatactggatagcgaggtgaggcgcgcttttgggcattttcatcaggggcgcggccctcgcttaagttggcaccacccaggggggtctgacctgctgcggtgcggggggttctacacagcttccgaccccaataaagaagacattagggccgtggaactcatgttgcaggcgggacactcagacgtcgtcctagtggatacgatggatgaactgccatctctcgcagacgtgcaactggctcatctccgcctccgcgctctttgcctgccagatagctccgtagctgaagacaaatggctgtcagccttggaaggaactcggtggctcgactatgtgagggcctgtcttaggaaagcctccgatattagcgttctggtgacctccagggtccgcagcgtcatcctccaggctgctttttccccacgttcacctaacacagtgtggcttcctatcacttccaccgctagggtgggcggatcgtggacttcgcttcctgattcggcctggggtaactggggtcaatag

SEQ ID NO: 48958 - DNA, 1065 bp, Artificial Sequence
  Description of Artificial Sequence: Synthetic coding sequence
atgcccgagccccggagccggcagcccagcagctgcctggccagcaggtgcctacctggcgagcagattttagcatgggcaccaggagtccggaagggcctcgagccagagctatcaggcactttgatttgtaccaacttccgtgtaacatttcagccctgtggctggcagtggaatcaggatactccacttaacagtgaatacgattttgcactcgtaaacattggacggctcgaggctgtcagcggcctctcaagggtccagctgttgagaccaggcagtctccataagttcataccagaggagattcttatccacgggcgagatttccggctgctccgtgtcgggttcgaagccggaggattggaacctcaggctttccaggttactatggccattgtccaggctcgggcccagtcaaaccaggcgcaacagtactctggaatcacactgtcaaaggccggccagggatctgggtcccgaaagccccctattcctctcatggaaacagcagaagactgggaaacagagcggaaaaaacaggcagccagagggtggcgagtatctacggttaatgagagatttgacgtcgctactagtctgcctcgatatttctgggttccaaatcgcatcctggacagcgaagttaggagggcattcggccattttcaccagggaagggggccccgcctgtcgtggcaccacccagggggctccgacctcttgagatgcggcggattttacacagcctcagatccgaataaggaggacatccgggcggtcgagttgatgttgcaggcaggccactccgatgtggtgctcgtggatactatggacgagctccccagcttggccgacgtgcagctggcacacttgagactacgggccttgtgtctgccggatagctccgtggcagaagataaatggctgtcagccctagaaggcacccgctggcttgactacgttagggcctgtctgcgcaaagccagtgatatctccgtcctggtgacctcacgcgtgcgctccgttatactgcagggtagtggcgtgtccccactgccctag

SEQ ID NO: 48959 - DNA, 2130 bp, Artificial Sequence
  Description of Artificial Sequence: Synthetic coding sequence
atgtggtggggcggccggggccagagcttcaacatcgccccccagaaggaggaacccgaaatggggagcgtccaagaaaacagaatgccagaacccagatcccgtcagcctagtagctgcttggcatcaaggtgcctgcccggtgaacagatcctcgcttgggctcccggggtcaggaaagggttagaaccggagctctcgggaacacttatatgtaccaatttccgggttaccttccaaccctgcggttggcaatggaatcaggacaccccactcaacagtgagtacgatttcgcgttagtcaatattggtagactggaagccgtatctgggctgtcgcgggtccaactactacggccaggaagcctccacaagttcatcccagaggagattctgattcatggcagagattttcgcctcctcagagtcggatttgaggccgggggtcttgaacctcaagccttccaggtcacaatggccatcgtgcaggccagggcccagtctaaccaggcccagcagtacagtgggatcactctgtccaaggcaggccaggggtctggctcgagaaagccccctatccccttaatggagacagctgaggattgggaaaccgagcgtaagaagcaggctgcccgtggatggagagttagcacggtgaacgagagatttgatgtcgcgacttcattgccccggtatttctgggtgcctaataggattctggatagcgaagtccgacgcgcctttgggcattttcatcaagggcgcggacccagactcagttggcatcaccctggcggatccgacctactgcgttgcggcggcttctacactgcctcggaccccaacaaagaagatatccgggccgtcgaactcatgctccaggctggccatagtgatgtagtgttggtggataccatggatgagctgccctcccttgccgatgtgcagctggcgcacctgagactcagagcattatgtctccctgatagcagtgtggccgaagacaaatggctctccgccttggagggcacacgatggctggattatgtgcgggcctgcctccgaaaagcaagcgatatcagcgttctagtcacttcgagagtaagaagcgttatcctgcaagagagaggggatagggaccttaatggtctgctgagtagcctggtgcagttgttgtctgcccccgaagctaggactctgtttgggttccagtccctcgtgcagagggagtgggttgctgctggacatccttttctgaccaggctgggcggtactggtgccagcgaggaggctccggtgtttctgctttttctggattgcgtctggcagctgctgcagcaatttccggctgactttgagttttctgaatttttcctgctagctctgcacgattcagtgcgcgtcccggatactctgaccttcctgagaaacactccttgggagcggggaaagcagtctggacagctgaacagctacacacaggtgtatactcccgggtattctcagcctccagccggaaattcttttaatttgcaactgtcagtctgggattgggatctccgttattccaacgcccagattctgcaattccagaatccgggttatgatcccgaacattgtccagactcttggctcccaagaccacagcccagctttatggttcccggacctcccagttcagtatggctgtttagtagaggagctcttacgcccctgaatcagctgtgcccctggagagattctcccagcttactggctgtgtccagtcggtggctgcctaggccagctattagcagcgagtctctggccgaccaggagtggggactgccatcccactggggcgcctgcccactgcctccaggactgctcctccctgggtacctgggtcctcagattaggctgtggagaaggtgctatttaagaggacgcccagaagttcagatgggtctttcagccccaacaattagtggtctccaagacgaactttcgcacctgcaagagcttcttagaaaatggacgccgaggatctcgcctgaggatcacagtaaaaaacgagacccacacacaatattgaatcctaccgaaatcgccggcattctgaaagggcgcgcggagggggatctcggatag

SEQ ID NO: 48960 - DNA, 663 bp, Artificial Sequence
  Description of Artificial Sequence: Synthetic coding sequence
atgaacatccggaacgcccggcccgaggacctgatgaacatgcagcactgcaatttattgtgccttcccgagaactatcagatgaaatactatttctaccatggcctgtcctggcctcagctgtcttacatcgccgaggatgagaacgggaaaattgtcggctatgtcttggctaaaatggaagaagatcctgatgacgtcccgcatggacatattacatccctcgccgtgaagcgctctcatcgaaggctcgggttagctcagaaactgatggaccaggctagccgtgcaatgatcgaaaactttaatgcgaagtatgtgtccctccatgtgcgcaagcggataagcgaggtcgagcccaaatactatgctgatggcgaggacgcttatgccatgaagcgcgacctgacgcaaatggccgacgagctccgccgccatctggaacttaaggagaaagggcgacatgtcgtactgggagctattgaaaacaaggtggaatccaaagggaacagccccccatcttccggtgaggcttgcagagaagagaaagggctggccgccgaagatagcggcggcgactcaaaggacctttccgaggtgtccgagacaaccgagagcaccgacgtgaaagacagcagcgaagcgtccgacagtgcgagttag

SEQ ID NO: 48961 - DNA, 708 bp, Artificial Sequence
  Description of Artificial Sequence: Synthetic coding sequence
atgaacatccggaacgcccggcccgaggacctgatgaacatgcagcactgcaatctgctatgtctacccgagaactaccagatgaaatattatttttatcatggcctgtcctggccccagctgtcctacattgccgaagacgagaatggcaagattgtaggctatgtcctagccaagatggaggaagatccagacgatgtcccacatggccacatcactagtctggctgtgaagcgcagccaccgtaggttgggtctcgcccagaagctgatggaccaagccagtcgggcgatgattgaaaactttaacgccaagtatgtgagcctgcatgtccgcaagtccaacagagcagcgctgcacctctatagtaacacgttgaatttccagataagcgaggtggaacctaagtactacgctgatggagaagatgcatacgcaatgaaacgggacttaacccagatggccgatgagcttcggaggcacctcgagttaaaagaaaagggccgccatgtggtgctcggagccatcgagaataaagtggagtccaaggggaattcgccccctagttcgggcgaagcatgccgcgaggaaaagggtttagcagcagaggattctggtggagactctaaggatctgagcgaggtttccgaaactaccgaaagtacagacgtgaaagatagttccgaggcgagtgactccgcaagctag

SEQ ID NO: 48962 - DNA, 714 bp, Artificial Sequence
  Description of Artificial Sequence: Synthetic coding sequence
atgggccggaagagcagcaaggccaaggagaagaagcagaagcggttggaggaaagagccgccatggacgctgtatgtgctaaggttgatgcagctaatcgtctcggcgatcccctagaagccttcccagttttcaagaagtacgacaggaacggactgaacgtctcgatcgaatgcaagcgggtgagtggcctcgagcctgccacagtcgattgggcattcgacctgacaaagacaaacatgcaaacaatgtacgagcaatcagagtgggggtggaaggatcgggagaaaagggaggagatgaccgacgaccgtgcctggtacctgattgcctgggaaaactccagcgtacctgtcgccttttcccacttcagattcgatgtagagtgcggtgacgaggtcctgtattgttacgaagttcaactcgaatctaaagtgcgccggaaaggtctgggtaagttcctgattcagatccttcagctgatggcaaattccacacaaatgaagaaagtgatgctgacagtattcaagcacaaccatggcgcttatcagtttttccgtgaggctctgcagttcgaaatcgacgacagctcccctagtatgagtggctgttgcggagaggactgtagctacgagattctgagtaggcgcacaaagtttggagactctcaccattcccacgctggcgggcactgcggtggatgttgtcactag

SEQ ID NO: 48963 - DNA, 594 bp, Artificial Sequence
  Description of Artificial Sequence: Synthetic coding sequence
atgcccttcgtgcccaagtggaccctgcccaccggcctgaacgtgtccatcgagtgcaaaagagtaagtggtctcgaaccagcaaccgtcgattgggctttcgatcttactaaaacaaacatgcagaccatgtacgaacaatccgaatggggatggaaagatcgagagaagagggaggaaatgactgacgatagagcatggtatctcattgcctgggaaaattcgtcagtcccagtagcattctcccacttccggttcgatgtagaatgcggcgatgaggtactgtactgttacgaggtgcagttagaaagtaaagtaagaaggaaggggttgggtaaattccttatccaaattctccaattaatggccaactcaacccagatgaaaaaggtcatgcttaccgtgttcaagcataatcacggcgcataccaattcttccgagaagccttacagttcgaaatcgacgacagtagcccctccatgagcggatgctgtggagaagactgttcatacgaaatcctgagcagaagaaccaaattcggagattcccatcattctcacgctgggggtcattgcggcggttgttgccactag

SEQ ID NO: 48964 - DNA, 645 bp, Artificial Sequence
  Description of Artificial Sequence: Synthetic coding sequence
atgagcgacctggaggacgacgagaccccccagctgagcgcccacgccttagctgccttacaggagttctacgccgaacaaaagcagcagatcgaacccggcgaagatgacaagtataacatcggcataattgaggagaactggcaactgagccagttctggtattctcaagagactgcattgcagctggcacaggaagctattgccgcagtaggcgaagggggacgaatcgcttgcgtgtccgctcccagtgtgtatcagaaactgcgcgagctttgccgggaaaacttctccatctacattttcgaatacgacaagaggtttgctatgtacggggaagagttcatcttttacgattataataacccattagatttgccagaaaggatcgcagcccactctttcgacatcgtgattgccgaccccccctacctgtcagaagaatgtctgcgcaagactagcgaaactgtgaagtatctgacccgtggcaagatcctgctctgcacaggggcaatcatggaagagcaggccgcagaattgctgggcgtcaaaatgtgcacttttgtccccaggcacacaagaaacctggcaaatgaatttcgctgctacgtcaactatgactcgggactcgactgcggcatctag

SEQ ID NO: 48965 - DNA, 645 bp, Artificial Sequence
  Description of Artificial Sequence: Synthetic coding sequence
atgagcgacctggaggacgacgagaccccccagctgagcgcccacgcactggcagccctccaggagttctacgcggaacagaagcagcagattgagcccggagaagacgataaatataatatcggtatcatcgaggagaactggcaactgtcacagttctggtatagccaggaaacagctctgcagctcgcccaggaggctatcgccgccgtcggcgagggaggtagaatcgcttgcgtttcagcaccttccgtctaccaaaagctcagggagctgtgcagggagaattttagtatttacatatttgaatatgataaaagattcgccatgtatggcgaggaattcatcttttacgattataataatcccctggatctacctgagagaattgctgcccattcattcgacatcgtgatagctgatccaccttatttgtccgaggaatgtctgcgaaaaacatccgagactgtcaaatacctaacccgtggcaaaatactgttatgtactggagctataatggaggagcaggccgcagaactcttgggagtcaagatgtgtaccttcgtgccacggcatacccgtaacttggcgaatgagttcaggtgctatgtcaattacgacagcgggctggactgcggcatctag

SEQ ID NO: 48966 - DNA, 1110 bp, Artificial Sequence
  Description of Artificial Sequence: Synthetic coding sequence
atgaagctggaggccagctgcggcaccgccaccagcgaggtgcccaagccagaaaaaaagacagcccgcgacgccgagcccagcagtgagacgaggcctcaggaagtcgaggccgaacccaggagcgggtcgggcccagaggccgaggctgagcccctggattttgtggtagccaccgagcgtgaatttgaagaagtgctggcaatcagcggtgggatctacggtggccttgattatctccctagccggtatcactcctggctgagggaccccgaccggacagtggtcctggcaaagcgtaatggcggcgtgattgctctagaatctgttaacgtgatagacgccggcgaaactgtactcgtggagggtctgcgcgtggcgccatgggaacgagggaaaggggtggccgggctactgcagcggttctgcagtcagctggtcaaaaggcagcacccaggagtcaaggtggctagactcactcgggatgatcagctcggcccgagggagctcaagaaatataggctgatcacgaaacagggaatcttactggtgagatttaacgccagcgcactgctggcgggactgggggcgagacttgccgccttacgaacctcagggaccttttctccactcccgaccgaagctgttagcgaggcagggggggacgtggctaggctcctgctctctccctccgtccagagggatgtcctccccggtgggacaatcattcaagactggcagccttataggccaagcgagtccaatcttcggttgctagcagcaaaggggctcgaatggagggtcgactcccgcgcccgccccagggttctcactctttgcacacggccatttcccatccctcatgggggcgatgggacctggcggtacctcaatatcgatgcatttggatccgatggcgctcaggtgcaatcccagttactgtggcatctgcaacggcaggctccccggctggtcggattgaatgtgatgtgtcaactttttttagagccgcagctgtggtcccagctggccgacttttgccaggtgggattggggctagagttggtaaagggatacaccgagcaatatctcctggaggcagacatatag

SEQ ID NO: 48967 - DNA, 471 bp, Artificial Sequence
  Description of Artificial Sequence: Synthetic coding sequence
atgaagctggaggccagctgcggcaccgccaccagcgaggtgcccaaacctgagaaaaaaacagccagagatgctgaaccatctagtgagactcggccccaggaagtggaagccgagcctcgatctggctccggcccagaggcagaggccgaaccgttggattttgtggtggccactgagagagagtttgaagaagtcttagcgatctctggaggcatttatggcggcctcgactacttaccctctcgatatcacagctggctcagggatccggatcgaactgtagtgttggcaaagagaaacggtggggtgattgcgttggaaagcgtcaatgtgattgacgccggcgagacagttctagttgaaggtctgcgcgtagcaccatgggagcgcggcaagggagtagccggcctgctgcagcgattctgttcacagctggtgaagaggcagcaccccggcgtcaaggtctag

SEQ ID NO: 48968 - DNA, 1110 bp, Artificial Sequence
  Description of Artificial Sequence: Synthetic coding sequence
atgaagctggaggccagctgcggcaccgccaccagcgaggtgcccaaacccgagaagaagacggcccgcgacgccgaaccatcctcggagacacgccctcaggaggtggaggcagagccacggagtggatctggaccagaggctgaggccgagcctttggactttgtggtcgctaccgaacgtgaattcgaggaggtactcgcaattagcggaggaatttacgggggactagattacctgccatcccgttaccactcatggctccgggacccagaccgcaccgtggttctagccaagcggaacggcggagtcattgcacttgagtccgtgaacgtgatcgacgccggcgaaactgtgcttgtggagggccttcgggtggcgccctgggagagaggcaagggtgtggctggccttttgcagcggttctgcagccagctcgtcaagcggcaacaccctggggtcaaggtcgcacgcttgacccgggacgatcagctcggaccaagagagctcaaaaaataccggctcataaccaagcagggaatactgctcgttcgcttcaatgccagcgccctgctggccggtctgggcgccaggctggccgcattgcggacgtctggcacgttttctccgctgccaacggaggctgtttctgaagccgggggagatgtcgctagactgctgcttagtcctagcgtgcaaagagacgtcctccctggcggcaccatcatccaggactggcaaccgtatcggcccagcgagtcgaatctgcgcttgctggcagctaaaggcctggagtggcgggtggactctagagctagacccagagtgttaaccctctgtactagacccttccctataccccatggtggagatgggacctggcgctatttgaacatagatgcatttggatcagacggagctcaagtccagtcccaacttctctggcacctccagaggcaggcgccacggctggtggggctgaacgtcatgtgccagcttttccttgagccccagctgtggtctcagcttgccgacttctgccaagtcggcctgggactggaacttgtcaagggatacactgagcagtatctgctggaggccgatatctag

SEQ ID NO: 48969 - DNA, 861 bp, Artificial Sequence
  Description of Artificial Sequence: Synthetic coding sequence
atggagctgatcctgagcaccagccccgccgagctgaccctggaccctgcctgccagcctaaactacctcttgattcgacttgccaaccggagatgacttttaatccgggccccaccgaactgaccctggaccccgagcatcaacccgaggagacacctgctcccagcctggccgaactgacacttgaacccgtccaccgacgtccagagctcctggacgcctgtgccgacctcatcaacgatcaatggcctaggagccgtacaagtcgcttgcattccctggggcagagtagcgacgccttccctctctgcctcatgttgcttagcccacatcccaccctggaggcagcaccggtagtggtagggcatgccaggctgtcgagggtactgaaccagcctcaatctttactcgtggagacagtcgttgtcgcaagagccttacggggtagaggttttggaagacgcctgatggaagggctggaggtcttcgccagggcacggggattcagaaagctccatctcaccacccacgaccaggtgcatttctacacacacctgggctaccagctgggagaaccagtgcaaggcctcgtgtttacatctaggcggctgcctgccaccctcctgaatgcctttcccaccgcgccttcacctcggcctccccggaaagcccccaatctgaccgctcaggccgcacctagggggcctaagggacctcccttgcccccgcctcctcctctgccggagtgcttaacaatttcccctcccgtgccttctggtcccccatcaaaaagcctgctggagacccagtatcagaatgtgagggggaggcccatcttctggatggaaaaagatatctag

SEQ ID NO: 48970 - DNA, 861 bp, Artificial Sequence
  Description of Artificial Sequence: Synthetic coding sequence
atggagctgatcctgagcaccagccccgccgagctgaccctggaccccgcctgtcaaccgaaactgccacttgacagtacgtgtcaacccgaaatgacgtttaaccccggcccaaccgagctcaccctggatcctgagcatcagcccgaagagacacctgcccccagcctcgcagaacttaccttggagcctgtccatcgccggcctgaactgttggatgcatgcgccgacctgataaacgatcagtggccacggagtagaacttcccggttgcactccttggggcaaagcagcgatgctttccctctgtgcttgatgctgcttagtccccaccccaccctggaggcggccccagtggtagttggtcacgcaaggttatccagagtgttgaaccagccacagtccctgctggtcgagacagtcgtggtggcgcgcgctcttaggggacgcgggttcggcagaaggctgatggaagggttggaggtgtttgctcgggctcgtggatttagaaagctccatctgactacccacgatcaggttcatttctacacccacctcggttaccagctgggcgagcctgtgcagggcctcgtcttcacatctcgacgtctccctgctacactcttgaacgcatttcctaccgctccctcaccaagaccccctcgaaaggcacccaacttaacagctcaggctgcaccccggggtcctaaaggtccccccctcccaccgccacccccactccccgagtgcttaactataagccctccagtgccaagtgggccccccagcaagagtcttctggagacccagtaccaaaatgtgagaggtaggccaatcttctggatggaaaaggacatctag

SEQ ID NO: 48971 - DNA, 624 bp, Artificial Sequence
  Description of Artificial Sequence: Synthetic coding sequence
atgcggctgaaccagaacaccctgctgctgggcaagaaggtggtgttggtgccttacacttcagagcatgtgccttcccggtaccatgaatggatgaaaagcgaagagcttcagaggcttaccgcatccgagccacttacactagaacaagaatatgctatgcagtgtagctggcaagaggatgccgacaagtgcacgtttatcgtcttagacgctgaaaagtggcaggctcagcctggggcgactgaggagtcctgtatggtgggagatgtcaatctctttctgacagatctggaggatcttactttaggcgaaattgaggttatgattgctgagccaagctgccgggggaaggggctcgggacagaagcggtgctggctatgttgtcctatggggtgaccactctgggactgaccaagtttgaagccaagatcggccaagggaatgaacctagcattcggatgtttcagaaattgcacttcgagcaagtggccacctcaagtgtcttccaggaagtgactttgcggctaaccgtctccgaaagtgagcatcagtggcttctggaacagacaagccacgtggaggagaaaccttacagggatggatctgccgagccatgctag

SEQ ID NO: 48972 - DNA, 4290 bp, Artificial Sequence
  Description of Artificial Sequence: Synthetic coding sequence
atggacagccagttccacatggccggcgaggccagccagagctggttaaaggccaaagaaaagcagcgcggcaccagttacatggtggccgttatcgagtgggagatcgagagaagtctgctatccagcgaggaccgcgagcagggagcgaccgtgttcctgcgggagatccaggacttacataagcacattctcgaggattgtgccctccgcatggtggacaggttggccgatggctgccttgatgctgacgcacaaaatctgttatctagcctgaagtctcatatcaccgacatgcatcccggcgtcctgaaaactcaccgccttccatggtcaagggacctggtgaaccccaaaaataagacacacgcctgctatctaaaagaattgggtgaacagttcgtggtgagagctaatcatcaggtgctgaccaggttgcgggagcttgacactgccggacaagagctcgcgtggctctatcaggagatcagacaccatctatggcagagtagcgaagtaattcagactttctgcgggcgacaagagctgctggctagactgggacagcagttgagacacgatgacagcaaacagcacacaccattggtgttattcgggccccctgggattgggaaaactgcactcatgtgtaaattggctgaacagatgcccaggctccttggccacaagaccgtcaccgtcctccggctgctgggaacctctcaaatgagtagtgatgcaagagggctgctgaaatcaatatgcttccaggtgtgtctcgcctatggtctcccactgccccctgcgcaggtcctggatgctcatacaagagttgttcagttttttcacacactgttgcacacggtaagctgcaggaactttgaatcactcgtcctactcttggacgctatggacgatttggactcggtgcgtcatgccaggcgggtcccatggttacctttaaactgccctccaagagttcatttgatcttgagcgcttgttcaggtgcactaggcgtcctagacacccttcagcgggtgctgctggacccagaagcatattgggaggtaaagccgttgtcaggtaaccagggacagcagatgatacagttactgctcgccgctgccaggcgcactcttagccctgtccatacggatcttttgtgggcctcgttaccagagtgcgggaaccccggacgcctgcgtttagcctttgaggaagcgcggaagtgggccagcttcactgttcctgtgcccctggccacaaccgctgaagaggcaacccaccagctgtgcactcgacttgagcagacacatggccagctgctagtcgcacatgtcctgggctatattgtttcgtcaaggcacggcctgtccgaggccgaactgaaggacgtgctgtctctggatgacgaggtgcttcaagatgtgtaccgggactggactccaccaagtaaggaactcctgaggttccccccactgctctgggtgcgtctgaggagagaccttggctactacctggctcggagacccgtcgacggattcaccctgcttgccattgcccaccggcaactagttgaggttgtcagggagcgctatttgtccgggtccgagagggccaagcgtcacggtgtgctcgccgacttctttagcggtacttggtcccagggaaccaagaaattaattacccttccactagtcggcaaacctctgaacttagaccggaaggtggcaccacagcccttgtggttctctcatacagtcgccaatctgcgtaagctgaaggaactgccttaccatcttctgcacagtggaagactagaagaactgaaacaggaggtcttgggatctatgtcctggatttcctgtaggggtataagcggaggtatcgaagacctgctggacgattttgatctgtgtgcccctcacttggattctcccgaagtaggcttagtcagggaagcgcttcaactgtgcagaccagctgtagagctgagggggatggaacgttcactcctttatactgaactgttggctcgcttgcacttcttcgcgacctcacacccagccctggtcgggcagctgtgccagcaggctcagtcatggttccagctctgtgctcatccggtattggtacctttaggcggattcttacagccaccaggaggcccccttcgggccaccctcagcgggtgtcacaaggggatcactgcaatggcttggggagtcgaagagaagctactagtcatcggaacgcaagacgggattatggcggtgtgggacatggaggagcagcatgtcatccacatgctcactggacatacaggcgaggtgcggtgtgtaaagattttcgcaaagggaacgctggcgaattcagctagtaaagactacacgctgcatctgtggaacttactgtctggtcaggaaaaatttacgatctgggacggaggtagcaaaaaccctgccgaaccacagatttggaacttgcatgtcgatgaagcacacaaggttgtgtattctgcatctggcagcaaaattaatgcctggaacttggaaacagcagaaccagtgtttcacatactcggagacgcttccgatccttggatgtgcatggccgtgctagccagccaagccactctgttgaccgtgtcgcgggatggagtggtttccctgtggtcatcggcaacaggcaagctgcagggaaaacaacatatgagttctatcaaggaggaaaccccaacatgcgcagtgagcgtgcagaagcaggggaaattggtgacaggtttctcaaacggtagcatatctcttgtctcaagcaaaggggatagacttctggaaaaactgccagacgccgtgaggtttttagtggtgtccgaagacgaaagcctgttagcggcaggctttggaagatctgtgcggatctttcttgccgatagtcgcgggttcagaaggttcatggccatggatctggagcacgaagacatggtcgagacagccgtatttgggacggagaataatctgataatcaccggatcgttggacgcattgattcaggtgtggagcctgagcgaacaggggaccttgctcgacatcctggagggggtcggcgcccctgtgtccctgctggcccgtggtggcgccctcgtggccagcgcttctcctcaaagctcttcctttaaggtatgggatctgtctgatgcccacagaagccgggtgcccgccccctttttggataggacgggactgactgctgtgtcacataatgggtcttacgtgtactttccaaagatcggggacaagaacaaagtgacaatttgggacctggccgagggagaagagcaggacagcctggacacctcttcagagattcggtgtctggaggtggcagaacaacgcaaactgctgttcaccggcctggtatcaggggtcgtgctggtattcccattgaactctcgtcaggacgtgatttgcatccccccccctgaggctagaaaggcaataaactgtatgtccttatccaagtgtgaggatagactcgccatcgcttacgataatatcgttcttgtactagatatcactagcggcgatccatgtcctgtgattgacggccccaggtacactttttatacacagctgcccgaaactttaagttccgtggcaattctgaccgactatagagtcgtctatagcatgaccaacggtgatctgttcctctacgagtgcgctactagcaaggcatttccactggaaacgcaccggtcaagggtcgcctgcgtggaggtcagtcacaaggaacagctggtggtgtccggatctgaggatgccctcctgtgtctctgggatctgcaagcaagaaagtggaaatttgaaatgagctacacttcgagctattgcaggggggtgcagtgtgcctgcttttctaaggatgataagtatgtttacgtgggtctcaaggaccggtctatccttgtgtggtcagtattagacgggaccctgctgaccgtgcagtttgtgcatgccgttgtgaatagaattattcctacaacgtctggatttattgcccccacaagacatgggtatctgatcagggaaaacttccaatgcctgagcgcgaaggcctctccccaggatcctctgaagaatttcaagaaagccatgtggatggtgaaatctcggcagcgcgaggaacttgtggctgctgccggggcacctcaggatctggagagcgaatctgcccagggaaacgagaccaaaagtaataaatgtagccaggtttgcctcattgtctag

SEQ ID NO: 48973 - DNA, 4299 bp, Artificial Sequence
  Description of Artificial Sequence: Synthetic coding sequence
atgcagcggggcaagccctgccgggccctgcccaccctgaagtgccagactttctgccaaagacacggattaatgttcgaagtggtggatcttcgttggggtattcgaaacatcgaggctacagaccatctgaccaccgagttgtgtctcgaggaagtggaccgctgctggaaaacctccattggacctgctttcgtcgcccttatcggggatcagtacggcccctgtctaattccatctagaattgacgagaaggagtgggaagttttgagagaccatctcactgcccggccgtcggacctggagttggtggctagatatttccagcgggacgagaacgccttccctcctacgtacgtcctgcaagcacctgggactggagaggcctgcgaaccggaggaagccacccttacatcggtactgcgcagtggcgcgcaggaggctcgcaggctgggactaattacacaggaacagtggcagcattatcatcgttcggtgatcgagtgggagatcgagcgtagtctgctgtcctctgaggatagagaacaaggggctactgtgttcctgcgagagatacaggatctccataagcacattctggaagactgtgccctcagaatggtggaccggctggcagatggttgcctcgatgccgacgcccagaacctccttagtagcctcaagtcacacattactgacatgcatcccggcgtgctgaaaacgcaccggttaccgtggagccgcgatctcgtgaatcctaaaaacaagacccatgcttgttacctcaaagaattgggggagcagtttgtggtccgcgccaaccatcaggtgttgacgcggttacgggagctggacacggccgggcaggagctggcttggttgtaccaggagattcggcaccatctttggcaaagtagcgaagtcattcaaaccttctgtggcaggcaggaactactcgcaagactcggacagcagcttcgacacgacgattcaaagcagcacactcctctggtgctgtttggtcctccgggcatcggaaaaacagcgctaatgtgcaagttggcagagcagatgccaagactgctgggccacaaaactgtcacagtgctaagactgctgggcacctcccagatgagtagcgatgctcggggccttctcaaatcaatttgcttccaagtctgccttgcctacggcctgcctctgcccccagcacaagtgctggatgcccataccagggtggtccagttcttccacaccctcctgcacacagtaagctgccgaaactttgaaagtctggttttactcctggatgcgatggatgatctggacagtgtcaggcatgctcgtcgcgtgccctggcttcctctcaattgcccccctcgagttcacttgatcttatccgcttgcagcggggctctgggagtgctggacaccttgcaaagagtcctgcttgatccagaggcttactgggaagtgaagccgctgtccgggaatcagggccagcagatgatccagctgctccttgccgctgcccgcagaaccctctcccctgtccacaccgatctgctctgggcctctttgcctgagtgtggaaatcctggcaggctccgcctggcctttgaagaggctaggaaatgggccagtttcaccgttccagtcccactggccacgaccgccgaggaggcaacacaccagctgtgcacgaggctcgagcagacccacggacaacttctggttgcacacgtgctcggctatattgtgtcttctaggcacggactgtctgaggctgagttaaaagatgtgctgagcttggatgatgaagtgctacaggacgtatacagagactggacaccaccaagtaaagagctgctgcgtttccctccattactgtgggtgagactgcgcagggacctgggctactacttggctcgcaggccagtcgatggctttactctgttggctatagcccatcgccagctggtggaagtggtcagggagcgctacttgtccggttccgagagggccaagcggcacggagttctggcagatttctttagcggcacatggagccaaggaactaaaaagctgatcaccctccctctggtgggaaaaccactgaatctggatagaaaggtggctccccagcctctctggtttagccataccgttgctaatttgagaaagctgaaagaattgccatatcacctgctgcattcaggcaggcttgaggaactaaaacaggaggtgttgggatcaatgtcttggatatcctgccgtggaatctctggagggattgaggatttgctggacgactttgatctctgcgcgcctcacctggacagcccagaagtcgggctcgtacgggaggccttgcagctgtgccgacccgctgtggagctgcgaggtatggaacgttctctcttatacacagagctcttagcgcgcctgcacttttttgctacttctcatcccgctctggtgggacagctttgccaacaggcccaaagttggtttcagctgtgcgctcatccggtgttagtccccctgggcgggttcctccagccaccgggcggacctctgcgggccacattgtctggatgccacaaaggtataaccgcaatggcatggggcgttgaggagaagctgcttgtaatcggcactcaagatggcatcatggctgtgtgggatatggaagagcagcatgtgattcatatgctgacaggccatacgggcgaagtccgctgtgtgaaaatctttgcaaaaggcacgttagcaaattctgccagcaaggactataccctgcacctttggaatttactgagtggacaggaaaagtttactatatgggacggtggctccaaaaaccctgcagagccccagatttggaacctgcacgtcgatgaagcgcacaaggtcgtctactccgctagcggaagcaaaataaacgcttggaacttagagacagccgaacccgtctttcacatcttgggcgacgcttcggacccctggatgtgtatggctgtgcttgcctcacaggctaccctgctcacagtgagtagggacggtgtggtgtcgctgtggagcagcgcaaccggcaagctccaaggaaaacagcatatgtccagtataaaagaggagacacccacgtgcgccgtcagcgtgcagaagcagggcaagctggtcaccggattttctaatggaagcatttcactggtctcatcaaagggggatcgcctcctggagaagctgcccgacgcagtccggtttctggttgtctcagaggatgagtcactcctcgccgccgggtttggtcgcagtgtaagaatttttctggccgatagtaggggcttccgccgctttatggcaatggatctggaacacgaggacatggtggaaacagctgtgttcggaacagagaacaatctgataatcaccggatctctggacgctctaattcaggtgtggagtctctctgagcaaggcaccctgctggacatcctggaaggcgtcggcgctcccgtatcactcttagcccggggcggcgctctagtggctagcgcctcaccacagagttcctctttcaaggtgtgggacttgtcagatgcccatcgtagtcgcgtgcccgccccctttctggatcgcacaggattaaccgctgtatcgcataatggcagttatgtttactttcctaaaataggagataagaataaggtgacaatttgggacctcgccgagggagaagagcaggatagtcttgacactagcagtgagattagatgccttgaggtggcggagcagcgcaaactgttattcaccgggcttgtctcaggcgttgtcctggtatttcccctcaatagtaggcaggatgtgatctgcattcctcctccggaggccagaaaggcgatcaattgcatgtccttaagtaaatgtgaagatagactggctattgcctatgataacatcgttctggttctggacatcacaagtggcgacccctgccccgtgattgatgggccgagatataccttctatacacagttgcccgagacgctgagcagcgtggcaattctcacagattacagggttgtgtattcaatgactaatggcgacctgttcctgtatgaatgcgccacgagcaaggcttttcctctggagacccatcgcagtcgtgtagcttgtgtggaagttagccacaaggagcagcttgtggtttctggttccgaggacgcgctgctgtgtctgtgggatttgcaagcacgaaaatggaaatttgagatgtcgtatactgctccttgttag

SEQ ID NO: 48974 - DNA, 4290 bp, Artificial Sequence
  Description of Artificial Sequence: Synthetic coding sequence
atggacagccagttccacatggccggcgaggccagccagagctggttgaaagccaaggagaagcaaagagggacatcgtatatggtagctgtgattgagtgggagatagaaaggagcctcttgtctagcgaggatagggaacagggcgctaccgtgtttctgcgcgaaattcaagacctacacaagcacatcctggaagactgtgctctgaggatggttgatcgcctcgccgacgggtgcctggatgctgacgcgcaaaatctgttgtccagcctgaaaagccacatcacagacatgcaccctggcgtgctcaaaacccaccgactcccgtggtctcgggacctggtgaacccaaaaaataagacgcatgcctgctacttgaaggagctgggggagcagttcgtggttcgggctaatcaccaagttctgacccgactgcgagagctggacacagctgggcaggagttggcttggctgtaccaagagatcagacatcacctgtggcagtccagtgaggttatccaaacattttgcgggaggcaggaacttttggcacggctcggccagcagcttaggcacgacgacagtaagcaacataccccgttggttctttttggtccccccggcataggcaaaactgcgttgatgtgcaagctagcagagcagatgcctcggcttctgggtcacaaaactgtcaccgtcctgaggttactcggaacctcacagatgtctagtgacgcccggggacttctcaagtcaatctgttttcaggtttgccttgcttacgggttaccactgccgcctgcccaggttctcgatgcccacacccgagtggtccagttctttcatactcttctgcataccgtttcctgtcgcaactttgagagccttgttttgctgctggatgccatggatgatctagactcagtgcgccacgcccggagggtgccatggctgccactgaattgtcctcccagggtgcatctgattctgagtgcctgctcgggggccctcggcgttctggacacactgcagcgtgtcttgctcgatcccgaggcttactgggaagttaaaccgctgtctggtaatcagggccagcagatgattcagctgttactagcagccgcccgccgtaccctgtcgccagtgcacacagatttgctctgggcttccttacctgagtgcggcaacccaggacggctccgactggcctttgaggaggctcgcaaatgggctagctttacagtccctgtgccccttgcaactactgcggaggaggctacccaccaactctgcacaagactggagcagacccacggccagcttctcgtggcccacgtgcttggatacatagtttcatctcgccatggattatctgaggccgagcttaaggatgtgctttctctcgacgacgaggtcctgcaggatgtgtacagggactggacaccccccagcaaggaattgctgaggttcccccccctgttatgggtcaggctacggagagacctgggctactacctcgctcggaggcccgttgatggattcaccttgttggctatcgctcacaggcagctggtcgaagtggtgagggaaagatacctgagcgggtcagagcgggcaaaacgacacggcgtactcgcagacttcttctcagggacttggagccaaggtacaaaaaagctgattacacttccactagtggggaagcccctgaatctggatagaaaagtggcgccgcaaccactatggttttcccatactgtcgccaacctaagaaaacttaaagaattgccttatcacttgctgcatagcggtagactcgaagaactgaaacaagaagtgttggggtccatgtcctggatatcatgcagagggatctctggcggtatcgaagacttactggacgactttgacctgtgcgccccccacctcgacagtccggaggtgggcctggtccgcgaggcgctgcagctgtgccgccctgccgtggaacttagaggcatggagcgaagcctcctctataccgaacttctggctaggctgcatttcttcgcgacgtctcatccagccctcgtcgggcaattgtgccagcaggcgcagtcttggtttcagttgtgcgcacacccagtactggtgccactgggtggctttttgcagcctcccggcgggccattgcgtgctacactatcagggtgtcataagggaattaccgccatggcgtggggtgttgaggagaagctactcgtcattggcacgcaagacggtataatggcagtgtgggacatggaagagcagcacgtaatccatatgcttactggccacacaggagaagtgcggtgcgtgaaaatcttcgccaaaggaacactggccaattcagccagcaaggactacaccctgcacctttggaatttgctgtccggacaggagaaattcacaatctgggacggtggatccaagaatcccgccgaaccacagatatggaacttgcacgtcgatgaggcacataaggtggtctacagcgctagcggctctaaaatcaatgcatggaatctggagacagccgaacctgtcttccatatcttgggggacgctagtgacccatggatgtgcatggctgtattagcctcccaggcaacactactcacagtttctcgggacggcgtcgtgagcctttggtcctcagccaccggaaagttgcaggggaaacaacacatgagtagcattaaagaagagacccctacctgtgctgtgagtgttcagaaacagggcaagctggtgacggggttttcaaacggcagcatatctctggttagtagcaaaggggataggctgttggagaagctgccagatgccgtgcgcttcctggtagtgagcgaagatgaatccctgttggcagcaggcttcggcaggtctgtgcggatctttctggccgactccagaggcttcaggcgattcatggcgatggacctcgagcatgaggacatggtcgagaccgctgtgtttgggactgaaaacaatctcataatcaccgggagcctcgatgctcttatccaggtgtggtcactttccgaacagggcaccctcctggatatcctggaaggcgtgggtgcaccagtgagcctgctcgccagagggggtgcgctggtcgcctctgccagcccccaatcatcgagtttcaaggtatgggacttatcagatgctcacagatcccgcgtgcctgctcctttcctggatcggacgggcttaaccgctgtctcacacaatggcagttacgtatacttcccaaagattggcgacaaaaacaaggtgaccatttgggacttagccgaaggcgaagagcaggattcgctggatacatcttctgaaatcagatgtctggaagtcgcggaacagaggaagctcctattcaccgggttggtgtcaggggtggtactggtttttccactgaacagccgtcaggatgtgatatgtatacccccgcccgaggctagaaaagccataaactgtatgtctctgagtaagtgtgaagacaggctggcaattgcctacgacaacatcgtgctggttttagatataactagcggagatccatgtcccgtaatagacgggccaagatacacattctacacacagctgccagagacattatcatctgttgctattttaactgattacagagtggtgtacagcatgactaacggcgacctattcctatatgagtgcgctacgagcaaggcttttccccttgagacccaccgaagtcgagttgcgtgcgtcgaagtgtctcacaaggagcagttggtggtctccgggtcagaagacgccctgctctgcctttgggatctgcaggcacgcaaatggaagttcgagatgtcatacacttcttcctattgtaggggcgtccagtgtgcctgtttctccaaggatgataaatacgtttatgtaggtttaaaagaccggtccattctggtttggtccgtcttggacggcacgctgctcactgtacagttcgtgcacgcggtcgtgaatcgaatcattcccactacctcgggattcattgcccctacacgtcatggctatcttatacgggagaattttcagtgtctgtccgccaaagcctctccccaggatcctctgaaaaatttcaagaaggctatgtggatggttaagtctcgacaaagagaagagttggtcgcagcagcgggcgctcctcaagacctcgaatccgaaagcgcccaaggcaacgaaacaaagtctaacaagtgctcacaggtatgcttaattgtctag

SEQ ID NO: 48975 - DNA, 4077 bp, Artificial Sequence
  Description of Artificial Sequence: Synthetic coding sequence
atggtggaccggctggccgacggctgcctggacgccgacgcccagaatctgctctcctctcttaaatcccacattaccgacatgcaccccggggtgctgaagacccatcgcttgccctggagccgagacctcgtgaaccccaagaacaagactcacgcctgctatctaaaggagttgggagagcagtttgttgtcagggccaatcaccaggtgctgactcgcctgagagaactggatacagccgggcaagagcttgcttggttgtaccaagagattcgtcaccacctgtggcagagcagtgaggttattcagactttctgtggcagacaggaattgttagcacggttgggccagcagctccgccacgatgattcaaagcagcacacaccgctagtgttgttcggacctcctggcatcggaaagactgccctcatgtgcaagctggcagagcagatgcccagactacttggacacaaaaccgttactgtgcttagacttctaggaacctctcagatgagcagtgatgcgaggggcctcctcaaatccatttgcttccaagtgtgcctggcctatgggctcccacttcctcccgcccaggtcctggacgctcacacaagagtggttcaattcttccacacactcctccacaccgtgtcctgcaggaatttcgaatcccttgttctgctactggatgctatggacgaccttgattccgtgcggcacgcccgacgcgtgccttggctgcctttgaactgccctcctagagttcacttgatcctgagtgcctgcagcggcgcattgggtgtgctcgacacccttcaaagagtgctgctcgaccccgaggcctattgggaggttaaacctctgagtggaaatcaggggcaacagatgatacagctgctcctggccgccgccagacggacattatctcctgttcacactgacctgctgtgggcgtccttgccagaatgcggcaatccaggacggcttaggctggccttcgaggaagcccgcaaatgggcttcgttcacagtgcctgttcctttagcaacaaccgccgaagaagccacacaccagctgtgcacacggttggaacagacccatggacagctgctggtggctcacgtcctgggatacatcgtgagttcacgacatggactttctgaagccgaactgaaagatgtcctgtctctcgatgatgaggtcttgcaggatgtatatagagactggacccccccgagcaaggagctacttcggtttcctcccctgctgtgggtgcggctacggcgcgacctagggtattacctggcacgtcgtcccgtggatggtttcacattgctcgccattgcacatcgacagttggtggaagttgtgcgggaaagatacctgtccggatcggagcgggccaagaggcacggggttttggcagacttcttttccgggacttggtcacaaggaactaaaaaacttataaccctccccctcgtgggaaagccccttaatttggatagaaaggtcgcccctcagcctctttggttttcgcatacagtggctaacctgcgcaaactgaaggaactgccttaccatctactccattctggaagattagaggagctgaaacaagaggtcctcggcagtatgtcatggatctcatgcagaggcatctccgggggcattgaagatctgttggacgatttcgatctgtgcgctcctcatctggacagccctgaagttggcctggttagggaggccctacaattgtgtcggcctgccgtagaactcaggggcatggagaggtccctgctgtataccgaactgctggcacggctgcatttctttgcgacctcacacccagctctggtagggcagttgtgccagcaggcccagtcctggttccagctgtgcgcccaccccgtgctggtccccttaggtggcttcctgcagccccccgggggaccacttagagctacgctgagcggatgccacaagggcatcaccgctatggcatggggggttgaagagaagcttctcgtaatagggactcaggatggcattatggcagtttgggacatggaggagcagcacgttatccatatgcttacaggccacaccggcgaagtcaggtgcgtcaaaattttcgcaaagggaactctggctaacagcgcgtccaaagactacaccctgcacctttggaacttactatctggtcaggaaaagtttacaatttgggacggcgggtcaaagaacccggcagaaccccagatatggaatttacacgttgatgaggcccacaaagtcgtgtactcagccagcggcagcaaaattaacgcatggaacctggagaccgcagaacctgtctttcatatactcggagacgcctctgatccgtggatgtgcatggccgtgctggcctctcaggccaccctgctgacagtttcccgcgatggcgttgtttccttgtggagtagcgctaccgggaagctccagggaaagcagcacatgagcagtataaaggaggagactccaacttgtgctgtttccgtgcagaagcagggaaaactggttactggctttagcaacgggtcaatctccctggtgagctcaaaaggggataggctgctggaaaagctgcccgacgctgtgagatttctggtagtctccgaggacgaatcacttctcgctgcaggctttggtagaagcgtgcgcatattcctggccgactcgagaggctttcgacggttcatggctatggatctggaacacgaggacatggtggagacagctgtttttggcactgagaacaacctgatcatcacgggcagcttggacgctttgatccaagtctggagtttatccgagcagggcacacttctggatatcttggagggcgtgggagccccagtgtctctcctagctcggggtggagccctggtcgcgagcgcttccccacaatcatcttccttcaaagtgtgggacttaagtgatgcccaccgctctagggtgcccgcaccatttttggacaggactggcctgacagccgttagtcataatggctcttatgtgtacttcccaaagattggagataagaataaggtcacaatctgggatctggcagagggcgaagaacaggacagcttggatacttcaagcgaaatccggtgcctggaagtcgctgaacagcgcaaattactttttacgggactcgtgtcgggcgttgtactggttttcccactgaattcgcgccaggatgtgatctgtattccaccacctgaagctcggaaagccatcaattgcatgtctctgtctaaatgtgaggataggctcgcaatagcttatgacaacatcgtgctggtcctagacatcactagcggcgacccttgccccgtgatcgatgggccgcgatatacgttttatacacaactgcccgagactctctcctctgtcgccatcttaactgactatagagttgtttacagcatgactaatggagatttatttctatacgagtgtgcgacatcaaaggccttccctcttgagacccatagatctagagtggcatgcgtggaagtgagccacaaggagcagttagtggtgagtggctctgaggacgccctattgtgtctttgggacttgcaggctcggaagtggaagttcgagatgagctatacctctagttactgtcgcggtgttcagtgcgcctgtttttcaaaggacgacaagtacgtttacgttggactcaaagacagaagtatcctcgtctggtccgtgctagacgggacactgttgaccgtacaattcgtgcacgccgttgtaaatagaattatccccactacaagcggattcatcgcacctacacgccatgggtacctgatccgcgagaattttcagtgcctgagtgctaaggcctccccccaagatccactgaagaacttcaaaaaggcaatgtggatggtaaagtctagacagcgagaagagttggttgccgccgcaggcgcaccccaggatctagaaagtgaatcagcacaaggaaatgagactaaatcaaataagtgcagtcaggtatgtttgatcgtctag

SEQ ID NO: 48976 - DNA, 4299 bp, Artificial Sequence
  Description of Artificial Sequence: Synthetic coding sequence
atgcagcggggcaagccctgccgggccctgcccaccctgaagtgccagacgttctgccagcgacacgggctcatgtttgaagtggtcgacctgagatggggtattaggaatattgaagccaccgaccacctgacaaccgaactgtgtctggaggaagttgacaggtgctggaaaacgtccataggtccggccttcgttgccttaataggtgatcagtacggcccttgccttattccatccagaatagacgagaaggagtgggaggtgttgcgggaccaccttaccgcaaggcctagtgacttggagctggtcgctcgttacttccagagggacgaaaatgcatttcctcccacatatgtgctccaggcgcctggaaccggggaggcctgcgagcctgaggaagccacgctgacctctgtacttcgttccggagcccaggaagcacgccgtctggggctgatcacacaggagcaatggcagcactatcacaggtccgttatcgaatgggagatagaacggtcgctgctgtcgagcgaagatcgcgaacagggggcaacagtgttcctgagagaaattcaagatctgcataaacacatcctggaagattgtgccctgcgcatggtggaccgcctggccgatgggtgtttagatgccgacgctcagaatcttctcagcagtctgaagagccatatcactgatatgcacccaggagtcttgaaaacccaccgactgccctggtcaagggatctggtaaacccgaagaacaagacacacgcttgctatttgaaagagctgggggaacagttcgtggttagagcgaatcaccaggtccttacaaggctacgagaactagacaccgctggccaggaactggcatggttgtatcaggagatcagacatcatctgtggcagtcttcagaggtcattcagactttctgcggcaggcaggaactgctggcaaggcttggccagcagctaagacacgatgattcaaaacagcacaccccgcttgtcttgtttggacctcccggtataggtaaaacggccctgatgtgtaaactggcagagcagatgccacggcttctcggacacaagacggttacagtgttaagactgctgggtacttctcagatgagctccgatgcgcggggcctgctcaaatccatttgcttccaggtttgcttggcatacggtttgccactgccaccagcccaagtgctggacgcccacacaagagttgtccaattcttccacacactgctccacaccgtgagctgtcgaaatttcgagtcacttgttctccttctagacgccatggatgatctggacagtgtccggcacgcgcgccgcgtgccctggcttcctctgaactgtcctcccagagtgcatttaatcttgtccgcctgtagcggggcattgggcgtgttagacaccttacaacgggtgttactggatcccgaggcctactgggaggtgaagcctctatctggaaaccaaggacaacagatgatacaacttctgttagccgccgcacgtaggacactgtcccccgtgcacaccgacttactatgggctagtctccccgaatgtggcaatcctggtaggcttcgcttggcttttgaagaggcccggaagtgggctagctttactgttccggtccccttggctacaaccgccgaagaggcaactcatcagctctgcacacggcttgagcagacacatggccagctgctggtggcccatgttctcgggtatatcgtcagcagccgccacggcttgagcgaggctgaactgaaggacgtcctctcacttgatgacgaagtgctccaggacgtgtaccgggactggacccccccatctaaagaacttttaagatttcctccactgctgtgggtgagactgagacgagacctcggttattacctggcgcgccggccggtggacgggttcacacttctggctatcgctcatagacagcttgtcgaagtcgtgagggagagatacctgtccgggagtgagagagctaaaagacacggggtcttggctgactttttctctggcacctggtcacaagggactaagaagttaataacactcccactagttgggaaacctcttaatttggatagaaaggtcgccccgcaaccattgtggtttagccatactgtggctaacctccggaaactaaaggagttgccctaccatctactgcactccggacgtctggaggagcttaaacaagaggtgctcggcagcatgagctggatatcctgtcgcggtatatcaggcggtatcgaggatcttctggatgatttcgacctatgtgccccacacctcgactctcccgaagtggggttggtgcgggaagcattgcagctgtgtagaccggccgtggaacttaggggcatggaacggtcccttctgtacaccgagctcctggcccggctccactttttcgcaaccagccatccagctctggtgggccagctatgccaacaggctcagtcctggttccagctgtgtgctcaccctgtccttgtccctctaggcgggtttcttcagcctccaggcggacctctgcgcgctacactctccgggtgtcataagggaattaccgctatggcatggggagttgaagagaagctgttggttattgggacccaagacgggataatggcagtgtgggacatggaggagcagcacgtcatccatatgttgaccggacacacaggtgaggtcagatgcgttaaaattttcgcgaaaggaaccctggctaattcagcttctaaggattacacactgcacctctggaacttgctgagcggccaagaaaagtttacaatctgggatggcgggtccaagaatccggccgaaccacagatctggaatctccacgtagacgaagcacacaaggtggtctactccgcaagcgggtcaaagattaatgcctggaaccttgagacagccgagccagtgtttcacatcctgggcgacgcttccgatccttggatgtgcatggccgttctcgcctcccaagccactttgctgacagtgagccgggacggagtggttagtctgtggagcagtgccaccggaaagttacagggaaaacagcatatgagctccatcaaggaggaaacgcccacctgtgccgtaagcgtccagaagcagggaaagctggtcaccggtttctctaacggctccataagcctagtgtcaagtaagggggaccggctactggagaaactgcctgacgccgtgcgttttctggtggtgtccgaggacgagagcctgcttgccgctggatttggccgatcagtacgcatcttcctggccgacagccggggctttcggagatttatggcaatggacctcgaacatgaggacatggtggaaacggcagtgttcgggaccgagaataacttgattattactggatcacttgacgctctaatccaggtttggagcttgtcggagcagggaactctgctggacatcctagagggggtgggggctcccgttagcctactggccagagggggagccttagttgcgtcggcttcgccccagtcttcttctttcaaagtttgggacttatccgacgctcacagatcccgcgtccccgcaccattcctggaccgcactggcctgacagcagtgtctcacaacggaagctatgtttactttcccaagatcggcgacaaaaacaaagttactatctgggatctggcggagggggaagaacaggacagcctggacacctcgtccgagatccgctgcttggaggtggccgaacagcggaagctgttgttcacaggccttgtgagtggtgtcgttcttgtcttccccctcaatagtcggcaggatgtaatctgcatccccccccctgaagctagaaaggcaattaattgtatgtccctttccaagtgcgaagatcggctcgcaattgcttatgacaacatcgtgcttgtgctcgatattactagcggagacccttgcccagtaatcgacggcccacgctacaccttctatacccagctgcctgagacattaagtagtgtggccatcctgacagattacagagtggtttactccatgactaacggcgatctgttcctgtatgagtgcgccactagcaaagccttccccctcgagacacaccgcagcagagtcgcttgtgtggaggtctcccataaagaacaacttgtagtgtctggctcagaggacgcactgctttgcctgtgggacctgcaggctcgcaaatggaagttcgagatgtcatacaccgctccttgttag

SEQ ID NO: 48977 - DNA, 1182 bp, Artificial Sequence
  Description of Artificial Sequence: Synthetic coding sequence
atggacgagaacgagagcaaccagagcctgatgaccagcagccagtacccaaaggaggcagtgaggaagcgccagaactctgcacgcaacagtggtgcaagcgacagctcacgtttcagccggaagtcttttaagttagactataggcttgaggaagatgtgacaaaaagcaagaagggcaaggacgggagatttgtcaatccctggccaacttggaaaaacccgagtatccccaacgttctccgatggctgatcatggaaaaggatcacagcagtgtgccttcctcaaaagaggaactggacaaagagctgcctgtgctgaaaccgtattttatcacaaatcccgaggaggccggcgtgagggaggcagggctgagagtgacttggttgggccacgctacagtgatggtcgagatggacgaattgatatttctcacggatcctatcttttcgagcagagccagccccagtcagtacatgggacccaagcgatttagacgtagcccgtgcaccatatccgaactcccaccaatcgatgccgtcctcatttcacataatcattacgaccatcttgactacaactcagtcatagcactgaatgagaggttcggaaatgaactcagatggttcgtccctttgggactcctggactggatgcagaagtgcgggtgcgaaaatgtaatcgagctggattggtgggaggagaactgcgttccaggtcatgacaaggtaaccttcgtgttcactccatcccagcactggtgcaaacggaccctgatggacgacaataaagtgctgtggggcagctggtctgtgctcgggccatggaacagattcttctttgcaggagacactgggtactgcccagctttcgaagaaattggtaagagatttggaccctttgacctggcggccattcctattggcgcatacgaacctaggtggttcatgaaatatcagcacgtggatcccgaggaagcggtgagaattcatactgatgttcagacaaaaaagtcaatggctattcactgggggacttttgcactcgccaatgaacattaccttgaacctcctgtgaaactgaatgaggctctcgagaggtatggtctcaacgctgaggacttttttgtgctgaaacacggcgagtctaggtatctgaacaacgatgacgagaatttttag

SEQ ID NO: 48978 - DNA, 483 bp, Artificial Sequence
  Description of Artificial Sequence: Synthetic coding sequence
atggtggccaacctgagccggggccccgagccccccttcttcaagcagctcatcgtgcccttgattccgtctattgttgacagggctccgaaaggtcggactttcggagacgtccttcagcctgctaagcccgagtatagagtaggggaagtggccgaggtgatcttcgttggcgctaaccccaaaaacagcgttcagaaccagactcaccaaactttcctgacagtggagaagtacgaggctacatcaacctcctggcagatagtgtgtaacgatgcatcatgggagacacgcttctactggcacaaagggttactcggactgagtaacgctactgttgagtggcatatccctgatacggcacaacccggcatctacagaatccgttacttcgggcataaccgcaagcaggacatcttaaaacctgctgtgatactcagctttgaaggcacctcccccgctttcgaagtggtcacaatctag

SEQ ID NO: 48979 - DNA, 498 bp, Artificial Sequence
  Description of Artificial Sequence: Synthetic coding sequence
atgcggcagcaccggcagttcatggaccggacccactacctgctgacattctccagctccgaaacgctgttgcgtcttctcctgcgtattgtcgatcgcgctcctaagggacgcacctttggcgatgtgctccagcctgctaagccagagtaccgcgtgggggaagtggctgaggtcatttttgtgggcgctaacccaaagaattccgtccagaatcagacccatcagacgttccttacagtggaaaagtacgaggccacctcaacatcttggcaaatcgtgtgcaatgacgctagctgggaaacaaggttttactggcacaagggactcctgggcctgtcgaacgctactgttgagtggcacataccggacacggcccagccagggatttaccgaattaggtattttggtcacaaccgcaagcaggatattctgaagcctgccgtgattttgtcatttgagggtacttctccggcctttgaggtcgtaactatctag

SEQ ID NO: 48980 - DNA, 483 bp, Artificial Sequence
  Description of Artificial Sequence: Synthetic coding sequence
atggtggccaacctgagccggggccccgagccccccttcttcaagcagctgatcgtgccattgataccgtctattgttgaccgggccccaaagggaaggacattcggagatgtcctccagccagcgaagccagagtatcgcgtaggagaagtcgcggaggtcatcttcgtcggcgctaaccctaagaactcagtgcagaatcagacacatcagacgttccttaccgtcgaaaaatatgaagccacttccacctcatggcagatagtgtgtaacgatgcttcttgggagactcggttttactggcataagggtcttctgggactgtcaaatgcaaccgtcgaatggcatatccctgacaccgcccaacccggcatctatcgcatccgttactttgggcacaaccggaaacaagatatactgaaaccagccgtaatcctctcctttgaaggaacatccccagccttcgaggtggtgaccatttag

SEQ ID NO: 48981 - DNA, 1122 bp, Artificial Sequence
  Description of Artificial Sequence: Synthetic coding sequence
atggagcccgccgtgagcgagcccatgcgggaccaggtggcccggacccaccttaccgaagatacaccaaaagtgaatgccgatatcgagaaggttaatcagaatcaggctaaacgatgtacggttatcggtggctcaggcttcctcggccagcatatggttgagcagcttctcgctcgcggctacgccgtgaatgtgtttgacatccagcagggattcgacaacccccaagtgagatttttcctgggcgatttgtgcagccggcaagacttatatcctgctcttaaaggcgtcaataccgtcttccactgtgctagccctccaccctcgagcaataacaaagaattattctacagagtgaactacatcgggacaaagaatgtcatcgagacctgcaaagaagccggcgtccagaaacttatactgacttcttctgccagcgtcatttttgaaggggtagacatcaaaaatggaaccgaagacttgccttatgccatgaagccaattgattattataccgagaccaaaattctgcaggagcgggcagtgctgggtgcaaacgatcctgagaagaacttcctgacaactgcaatccgcccacatgggatctttgggcccagggacccccaattggtccccattttaattgaagccgcgcggaacgggaagatgaaattcgtcattggtaatggcaaaaacctagtggattttacatttgtcgagaacgtcgtccacgggcacatccttgccgccgaacaactcagccgggatagtacattggggggaaaagcgttccatataaccaatgacgaacccatcccattttggacgtttctttcgcggatcctgactgggctgaactatgaggccccaaagtatcatataccatattgggtggcctattacttagcccttctgttgagcctcctggtaatggtcatttctccagtgatccaattgcagcccaccttcacaccaatgcgcgtggcactggcggggacatttcattactattcttgcgaacgcgcaaagaaggccatgggctaccagccacttgtgacaatggacgacgctatggagcggacagtgcagtcgtttcgacacttacgtagggtgaaatag

SEQ ID NO: 48982 - DNA, 1122 bp, Artificial Sequence
  Description of Artificial Sequence: Synthetic coding sequence
atggagcccgccgtgagcgagcccatgcgggaccaggtggcccggacccacctcacagaggacacgccaaaagtaaacgcagatatagagaaggtgaatcagaaccaggctaaaagatgtaccgtgatcggtgggtccggctttctgggccagcatatggtggagcaactattagctagggggtatgccgtgaatgtgtttgatatccagcaaggtttcgataacccacaggtgcgattcttcctaggagatctatgcagccgtcaggacctctatcctgccctgaaaggggtaaataccgtattccattgtgccagccccccccctagtagcaataacaaggagctgttctaccgcgttaattatattggaactaagaatgtgattgagacctgtaaagaagctggggtgcagaagctcatattgacttcctctgctagcgttatcttcgaaggcgtagatatcaagaacggaacagaagatctgccatatgcaatgaaaccgatcgattattacactgagactaagatccttcaagagagagcagtattgggtgccaatgaccccgaaaaaaactttctgactacagctatacgcccccatggaatatttgggcctagggatccacagctggtgcctatcttgattgaggccgctcgaaacgggaagatgaagttcgtcattggaaacggcaagaacctggttgatttcactttcgtggagaatgtcgtccatggccatattctcgcagccgagcagctttctcgggacagtaccctcggtgggaaggccttccatatcactaacgatgagcctatacctttttggacgtttcttagccggatcctgaccggcttaaactacgaggccccaaaataccatattccttactgggtagcttactaccttgctctgctgctgtctctccttgtgatggtgatctcaccagtgatccaattgcaacctacattcacacccatgagagtggccttggcaggcacattccactactacagttgcgagcgtgccaagaaggccatgggttaccagcctctagtgacaatggatgatgctatggagaggaccgtacagagcttcaggcatcttcgcagggtgaagtag

SEQ ID NO: 48983 - DNA, 264 bp, Artificial Sequence
  Description of Artificial Sequence: Synthetic coding sequence
atggccggcgccagcctgggcgcccggttctaccggcagatcaagagacaccctgggattatcccaatgattggcctgatctgcctggggatggggtctgcagcgctttacctgcttcgcctggcactgcgtagtccggatgtgtgttgggacaggaagaataacccagaaccgtggaatcgactgtccccgaatgatcagtacaaatttctggccgtgtccacagattacaaaaaactgaaaaaagaccgtccagacttctag

SEQ ID NO: 48984 - DNA, 264 bp, Artificial Sequence
  Description of Artificial Sequence: Synthetic coding sequence
atggccggcgccagcctgggcgcccggttctaccggcagatcaagaggcatcctggcattatacctatgattggcttgatttgtttaggcatgggcagcgctgccttgtatctgttgaggctggccctgcggtccccagatgtttgctgggaccggaagaataaccctgagccttggaaccgcctttcaccaaacgatcagtacaaatttctggcggtttcgacagattacaagaaactgaagaaagaccgcccagacttctag

SEQ ID NO: 48985 - DNA, 387 bp, Artificial Sequence
  Description of Artificial Sequence: Synthetic coding sequence
atgaccggctacacccccgacgagaagctgcggctgcagcagctgagggagctacggcggcggtggcttaaagaccaagagctctcccctcgcgaacccgtgctgcctccccaaaaaatgggacccatggagaagttttggaataaatttctggaaaacaagtctccctggcgcaagatggtgcatggtgtctataaaaagagcatcttcgtcttcacccatgtcctggtccctgtgtggattatccactactatatgaaataccacgtgtcggagaaaccttatggtattgtcgagaaaaaatctaggatctttcctggggatactattctggaaacaggcgaagtaattcctccaatgaaagagtttccagatcagcaccattag

SEQ ID NO: 48986 - DNA, 753 bp, Artificial Sequence
  Description of Artificial Sequence: Synthetic coding sequence
atggacatgctgcaggacctggagagcctgcagttcgagtacggcgtccctgaagaagatcgtatctggctgtatttgcaggggaggagtagagggctgatgatcgaagcgtgtgcccacgcaacattcttctgtaagctgctctataatttaagggcctctctaaataagaaccagagctcccggcatctgtctattggcagtctgaactccgcgacccccgaggagttcaaggtgggaataattggcgggggtcatttgggcaaacagctggcaggaacgctgctgcagctgggcccaatccccgcggagtccctgcggatatccactaggcgtccagagactctaggcgaattgcaaaaattaggaatcaagtgtttttaccacaatgcggatcttgtttcttgggctgatgtgatcttcttatgctgtttgccttcccagctgcccaacatatgtgtggaaatttacacctccctcgagaaggcctccattgtatatagctttgtggctgctatccccctgcccaggctcaaactgttgctgaatcacactaatatcctcagaccacagtatcaatacgatgaggattccgtcagcgtctggggggccaataaaggagtgattgctgctctccaggatcctactatattacaggccacatgcccttattcaccagccgggcacggttctacatatttttggcatagcttcgagaactatttcccagtgggacctttgttgagctactag

SEQ ID NO: 48987 - DNA, 1080 bp, Artificial Sequence
  Description of Artificial Sequence: Synthetic coding sequence
atggacatgctgcaggacctggagagcctgcagttcgagtacggcgtacctgaagaagaccgtatctggctttacctacaggggcgctcaagaggcctgatgatcgaggcatgtgctcatgccacttttttttgcaagctgctctacaatttgagagccagcttgaataagaatcagtccagccggcatctgtcaatcggcagccttaattcagcaacccccgaggagttcaaggtcggaatcatagggggcggacacctgggaaagcagttagcaggcacccttctgcagctgggacccatccctgctgaaagccttcgtatttctaccaggcgcccggaaacgttaggggagctgcagaagctcggaattaaatgcttttaccacaatgctgacctagttagttgggccgacgtgattttcctgtgttgcttacccagccagcttccaaatatctgcgttgaaatttatacatctctggaaaaagcctcgatcgtttattcctttgtcgcagccatcccgctccctcgattgaaactgttgttgaaccataccaacatactgagacctcagtaccagtatgacgaagatagtgtgagcgtgtggggggccaataagggagtaatagctgccttgcaggaccccacaatcttgcaagcgacatgtccatactctccagctggcggcatcatcctcaatatcaaatggctggagggtgtcttttacgcagccctgaacatatgcactgcaagaaatatggcccacagtcaagtgctgcagctgttatccgagttatttctgtccgtccacttcgaggactgtggcaaggacactgcatcttgccccaaacttcaactgacagactttgtgagcaaagcttatgggaagaatctgtcacaagagagaccattcccttggttcgaccttaccgctgtgcagctcaaggaaacccctttttcccagcatctctcttctagcccggtccttcaggatcatttaacccacctctattgtgcttcctttggtataagcctgacgaaggagcagccagtgatcagcactgggtttccgtctcagtag

SEQ ID NO: 48988 - DNA, 672 bp, Artificial Sequence
  Description of Artificial Sequence: Synthetic coding sequence
atggacatgctgcaggacctggagagcctgcagttcgagtacggcgtgccagaggaggatagaatctggttgtaccttcagggccgtagcagggggctcatgattgaggcgtgtgcccatgctactttcttttgcaagctgctgtacaatctcagagccagtttgaacaagaaccaaagctctcgacacctgtcaatcggaagtctgaactcagctacacctgaggaattcaaggtgggaatcatcggcggaggccacctggggaagcagctcgcaggtactctcttgcaactgggcccaatccccgccgagtctcttagaatcagcacccggaggcccgagacactgggggaacttcaaaaacttgggatcaaatgcttctatcataacgcagacttagtttcatgggccgatgtgatatttctttgttgtctcccatcccaactccccaacatttgcgtggagatctacaccagtctcgagaaggcgtcaattgtgtatagctttgtcgccgccattcctttgcccaggctgaagcttctcttgaaccatactaatatcctcagacctcagtaccagtacgacgaggactcagtctctgtttggggggccaataaaggcgtcattgcagctcttcaagaccctaccatccttcaggctacttgtccatag

SEQ ID NO: 48989 - DNA, 699 bp, Artificial Sequence
  Description of Artificial Sequence: Synthetic coding sequence
atggacctgcccatccaggacagccacgacagcagcaccagccccaaaggcaagcaaccaacgacagccgagaagagtgccaccaaaaaggaggacaaggtgccagtgaaaaaacaaaaaaccaggacggtgtttagttcaactcagctgtgtgtcctgaatgatcggtttcagaggcagaagtacctcagtttacaacagatgcaggaactgtcaaatattctaaacctgagttataaacaagtgaagacgtggttccagaatcagcgaatgaagtcaaagcgatggcagaagaacaactggctgaaaaattcaaatggcgtgacccaaggatgtcttgttaatcctactgggaacttgccaatgtggtccaatcagacatggaacaatagtacctggagtaaccaaacccaaaacatccagagttggagcaaccactcatggaatacccaaacttggtgtacccagagttggaataaccaggcatggaactcaccattctacaactgcggagaggagtccctgcagtcttgcatgcagttccagccgaacagccctgcatctgatttggaggcagcgctggaagcagccggcgaggggcttaatgttatccagcagacaacaagatattttaataccccacaaaccatggatctttttttgaactactctatgaacatgcagcctgaggatgtctag

SEQ ID NO: 48990 - DNA, 912 bp, Artificial Sequence
  Description of Artificial Sequence: Synthetic coding sequence
atgagcagcaccctgcccgccctgctgtgcgtgggcctgtgcctgtcacaacgcattagcgctcagcagcagacactgccgaagccatttatttgggctgaacctcatttcatggtgccgaaagaaaaacaggtgaccatctgctgccagggtaattatggggctgtcgaataccaattgcattttgagggatccctgtttgcagtcgatcgaccgaaacctcccgagcgcataaataaagtgaagttttatatccccgatatgaatagcagaatggccggacaatatagttgtatttatcgggtcggagaactgtggagtgagccaagcaatttactggaccttgtggtgacagaaatgtacgatacccctacactttcggtccaccccggaccggaagtgatcagcggggagaaggtgaccttttactgccggctagacacggctacatcaatgttcctgttactgaaagagggccggtccagtcacgttcaacgcggctatggcaaggttcaggctgaattccctctgggccctgtgacgactgcccaccgaggtacctatcgctgttttgggtcatacaacaatcacgcctggtcatttccctcagaacccgtaaagctgctagttaccggagatatagagaatacgtccctcgcgcccgaggaccccaccttcccagatacatggggtacttacctgcttactacggagaccggattgcagaaagaccacgccttgtgggatcacacagcacagaaccttctgagaatgggtctggctttcctggtcctggtggcattagtgtggtttctcgtggaagactggctatctcgtaaacggactcgagaacgagccagccgggcctcaacatgggaaggccgaagacgcctgaacacccagacactgtag

SEQ ID NO: 48991 - DNA, 912 bp, Artificial Sequence
  Description of Artificial Sequence: Synthetic coding sequence
atgagcagcaccctgcccgccctgctgtgcgtgggcctgtgcctgagtcagagaatcagcgctcagcagcaaacgctgcctaaaccttttatttgggccgaaccgcacttcatggtgccaaaagaaaaacaggttacaatatgttgtcagggaaattacggagctgtggagtatcagctccacttcgaaggttccctgtttgccgtggacagaccgaaaccaccggagcgaataaataaggtaaagttctacattcccgatatgaattcccggatggctggtcagtatagttgtatctacagagtgggggaactctggtctgaaccatcaaatctgctagatctagtcgtgacagagatgtatgacacacctaccttgtctgttcatcccgggcctgaagtcatatcaggggagaaggtgacattttattgccgcctagacaccgctactagcatgttccttctgcttaaagagggacgatcgtctcacgtgcaacggggctatgggaaggtccaggccgaatttcccttggggccagttaccacagcacatcgcggcacataccgctgctttggctcttataacaaccacgcttggagtttcccgtcggagcccgtgaaattgctggtgacaggggatatcgaaaacactagtctagcgcctgaggaccctaccttcccggacacctggggaacttaccttctcactactgagaccggccttcagaaggaccacgctttatgggaccatactgcccaaaatctcctgcggatgggtttagcatttttagtgttggtggctcttgtttggttcctggtcgaggattggctgtcacgaaagagaaccagagagagagctagcagggcgtcaacctgggagggaagaagaagactgaacacacagacactatag

SEQ ID NO: 48992 - DNA, 912 bp, Artificial Sequence
  Description of Artificial Sequence: Synthetic coding sequence
atgagcagcaccctgcccgccctgctgtgcgtgggcctgtgcctgtcccagcggatctccgctcagcagcagaccctgcctaaacctttcatatgggctgagcctcacttcatggttcctaaggaaaagcaagtgaccatctgttgccaggggaactacggcgctgtagaataccagttacactttgaaggatctctgtttgccgtcgacagacctaagccgcccgaacgcattaacaaggtaaagttttacatcccagacatgaattccagaatggcgggccaatattcttgcatttaccgggtgggtgagttatggtccgaaccttccaatttgttagacctggtagtaaccgagatgtatgatacccccacactgtccgtgcaccccggacctgaggtaatctccggagagaaggtaactttttattgccgcctcgacacagctacttctatgttcctgctcctcaaggaaggacggtcgagccacgtgcagcgtgggtatggaaaggtgcaggccgagttccctttgggccctgtcaccaccgcccaccgcggaacctacagatgtttcggctcgtacaataaccacgcttggtcgtttccgtctgaacctgtgaagctactcgtaactggcgatattgaaaacactagcctggcccccgaggacccgacctttccggatacatggggaacttacctgctgaccaccgaaaccgggctgcaaaaggatcacgctctgtgggaccataccgcacagaatttacttcgtatgggcctcgcctttctggtgttggtggcgctggtctggttccttgtggaagattggctctcccgaaagcgaacccgcgaacgggcctcccgggcctctacatgggagggacggcgcagactgaacacacagaccttatag

SEQ ID NO: 48993 - DNA, 912 bp, Artificial Sequence
  Description of Artificial Sequence: Synthetic coding sequence
atgagcagcaccctgcccgccctgctgtgcgtgggcctgtgcctgtctcaacgaatcagcgcccagcagcagactctccctaaaccctttatctgggcagagccgcatttcatggttcctaaagaaaaacaggtcaccatatgctgccagggaaactacggtgcagtcgaataccagttgcactttgaaggctcgctttttgccgtcgatcgacctaagccccccgagaggatcaataaagttaagttctatatccctgacatgaatagcagaatggccgggcagtactcatgcatctacagggtgggtgaattgtggagcgagccatctaatctccttgacctggtggtcactgagatgtacgatactcccaccctgagcgttcacccaggccccgaagttatttctggcgagaaggtaactttttattgccgactggacaccgccacaagcatgtttctgctgctcaaagaagggcgctcaagccacgtgcagcgagggtacggcaaagtgcaggccgagttcccactgggaccagttaccaccgcccacaggggcacttacaggtgcttcggaagttacaataaccacgcttggtccttcccgtccgagcccgtgaaactgcttgttactggggatatcgaaaatacgtctctggcacctgaagaccccacattccccgatacatggggaacttacctgttaactacagagacaggcctacagaaagatcatgccctgtgggatcacacggcccagaatctcctgcggatgggtctggcgttcctggtacttgtggcccttgtctggttcctcgtcgaagactggctgtcgagaaaacggacccgcgagcgagcctcgagggccagcacatgggagggacggcgtcgtctcaatacccagactctgtag

SEQ ID NO: 48994 - DNA, 912 bp, Artificial Sequence
  Description of Artificial Sequence: Synthetic coding sequence
atgagcagcaccctgcccgccctgctgtgcgtgggcctgtgcctgagtcagcgaatcagcgcccagcagcaaacactacccaagccctttatttgggcagagccacacttcatggtgcccaaggagaaacaggttaccatttgttgccagggcaattatggcgcggttgagtatcagctccatttcgaagggagtttatttgcggttgatagacccaagccaccggagagaattaacaaggtgaagttttatattccggacatgaattcccgcatggctggccagtactcatgcatctacagagttggcgaactttggagtgagccctcaaacctgctggacctggtggtcacggaaatgtacgatacccccacgttaagcgtgcaccccggtcccgaggtgatatccggcgagaaagtgaccttctattgccgattagacaccgccacgagcatgtttctcctgctcaaggagggccggtcctcgcacgtacaacggggctatgggaaggtacaagcagaattccctctcggtccagtgactaccgcacatagagggacctatagatgtttcggctcctacaataaccacgcttggtcttttccgagcgaacctgtcaagctcctagtgacaggagatattgagaatacctctctcgcccctgaggaccctaccttcccagatacatgggggacctacctgcttacaaccgaaacaggactgcaaaaggaccacgccctgtgggatcatactgcacagaatctgctccgtatgggcctggccttcctggtgctagtggcgttagtgtggttccttgttgaggactggctgagccgcaagagaaccagggagagagcatcacgcgcttccacctgggaaggccggcgacgactgaatacccagacgttatag

SEQ ID NO: 48995 - DNA, 912 bp, Artificial Sequence
  Description of Artificial Sequence: Synthetic coding sequence
atgagcagcaccctgcccgccctgctgtgcgtgggcctgtgcctgtcacaaagaatctcagcccagcagcagactcttcctaaaccgttcatctgggccgaaccccacttcatggtccccaaagagaaacaggtgacaatttgttgccagggtaattacggcgccgtcgagtatcagcttcacttcgagggctctttatttgctgttgatcgccccaagccccccgagcggattaacaaagttaagttctatattcctgacatgaattccagaatggcaggccagtatagttgtatttacagagttggcgaactgtggtccgagcctagcaatttgctggacctcgtggtcaccgagatgtacgacaccccaaccttgtccgtgcatccaggccccgaagtcatcagcggcgagaaggtgacgttttactgtcggctagataccgcaacatctatgttcctgctcctgaaagagggcaggagctcccacgtacaacgagggtacggcaaagtccaggccgagtttcctctcggccccgtcactacagcccaccgcgggacttaccgctgcttcggcagctataacaatcatgcctggtctttcccaagtgaaccggtgaagctcctggtgacgggcgatatcgagaacacctctctcgcaccagaagatcctacctttcctgacacatgggggacttacctgctcaccacggagaccgggttacaaaaggaccacgcactgtgggaccataccgcccagaacctcctgcgcatgggattagccttcctcgtcctggtggcgttggtgtggttcctagtcgaggattggctatcgaggaagcggactagggagagagcctctagggctagtacctgggagggccgtcgacgtcttaacacccagacattgtag

SEQ ID NO: 48996 - DNA, 912 bp, Artificial Sequence
  Description of Artificial Sequence: Synthetic coding sequence
atgagcagcaccctgcccgccctgctgtgcgtgggcctgtgcctgagtcagcggattagcgcccagcagcaaaccctcccgaaaccgttcatttgggcggagccacatttcatggtgcctaaggagaagcaggtgacaatctgctgccaaggaaattatggcgccgtagagtaccagcttcacttcgaggggtctctatttgccgtggaccgccccaagccaccagaaagaattaacaaggtaaagttctatatccctgatatgaacagtcggatggccggtcagtattcctgcatctaccgggtgggggaactgtggagcgaacctagcaacttgttggacttggtggtgaccgagatgtacgacactcccaccctgtcagtgcaccccggccccgaggtcatatctggcgaaaaggtgacattctattgtcgcctggataccgccactagcatgtttctactgctcaaggaaggcaggtcttcccacgtacagagaggctatggtaaagtccaggcggagtttcccttgggccctgtcactactgcccaccgaggcacttatcgatgtttcggttcctacaataaccacgcatggagtttccccagtgagcccgttaaactgcttgttacaggcgatatcgagaatactagtctggccccggaagaccccacgttccccgatacttgggggacttatctgctgacaacagagaccggcctgcaaaaggaccacgccctgtgggaccacactgcccagaacctcctcaggatgggcttggctttcttagtgctggtggctctggtgtggttcctggtggaggactggctgagccggaagagaactagggagagggcatctagagcttcaacctgggagggtagacgacggcttaacacccagactttgtag

SEQ ID NO: 48997 - DNA, 912 bp, Artificial Sequence
  Description of Artificial Sequence: Synthetic coding sequence
atgagcagcaccctgcccgccctgctgtgcgtgggcctgtgcctgtctcaacgtatcagtgcccagcaacagaccctgcctaagccattcatctgggccgagccccacttcatggtgccgaaagagaagcaggttacaatctgttgtcaagggaactatggagcagtggagtatcagctgcacttcgaggggtctctcttcgcagtggacaggcctaaaccccccgaaagaattaataaggtcaaattttacattcccgatatgaacagtaggatggccggccagtactcttgtatctatcgcgtcggcgagctgtggtctgagccgagcaacctgttggacttagttgtcactgagatgtacgacacgcctacactcagcgttcaccctggccctgaggtgatttcaggggagaaggttacattctattgtcggctggataccgccacatcaatgtttctgttgctgaaggaggggcggtcttcacacgtccagcgcggttacggcaaggtccaggctgagttcccactgggaccggtgacaacggcccatcggggtacttatcggtgtttcgggagttacaacaatcacgcctggtcctttccctctgagccagttaaattgctcgtgacaggcgatatagagaatacgtccctcgcccctgaggaccctacatttcccgacacctgggggacctacttgctcaccactgaaacgggcctgcagaaggatcacgcactgtgggatcacaccgcgcagaacttactaaggatgggccttgcctttctggtcctggtggcactcgtgtggtttcttgttgaggactggctgagccgaaagagaacgagagagagggcctctcgagctagtacatgggaggggcgaaggagactcaacactcagaccctgtag

SEQ ID NO: 48998 - DNA, 5730 bp, Artificial Sequence
  Description of Artificial Sequence: Synthetic coding sequence
atggagggcaagcggcagctggagaagcgggacttcggcaagcggcttagcctggactcttctctggtggaatacatggactctaataagtacatagaacacctgctcacacagttggaagagcaacacagaagcctttggcgagaaaagttagctgtagctcggctgcagcgtgaggtggcccagcgcacaagtgaaggcgcaatgcacgaaaagttaattcacgagctggaagaggaacgccacctacgcctgcagagcgagaagagacttcaggaagtcacactagagagtgagaggaaccgcatacagatgaggtccttgcaacagcaattctcccgaatggaggaaacagtgcgcaatctgttgcaaagccagggttcccccgaacagaagaaagaggagacagtgaacatcatggtataccaggaaaagctgagcgaggaagagagaaagcacaaggaagctctggaggatctgcatatggttgttgacgaagatagccggtccgagagcagcagtacagatgagggcaaagagaagacgaaactactccttgagcggttgaaagccctggaggccgagaactcagcgctggccctcgagaacgagaatcaaagggaacaatacgaacgatgtctagacgaggttgcaaaccaggtggtgcaggccctcctgacccaaaaagatcttagggaagagtgcgtgaaactaaaaacccgagtatttgacctggaacagcaaaacaggacactgtcaatactcttccagcagcgggttcgtccaacttcggacctgctgttgcagaagctccacagccgactgctcgacctttcatctggggacctgttaagcgaagtggaaagaaaccgatcgctgacccaatcaaggactgacgcagaggtgcacgaacaccagctgaacacaaagtcagccctcaaatgccctggcctgggtgctgttatcccagggcacctgtgcccaagaaacagctactcaagctctagtgagctgagtctcagctcgacatgttcggagtattcttccggaagttcgtatacttggcacgatgggaagaacctacgcaaacgtcaaagtagccagaactgggacaaaagactgtcaattgacagttcattaccctccgggttcgctagtccgaccaatgagttgcctccgacacggatcaaggagagccacatcctggaagggctgcggaagcttcaaaaacggaaggtactcttagaacccccctctgtgataaccaaatggggctacaaggactgtatgaacagcaacgaaggcatctactcgccggggattaaaagcagttccctgaaagagtaccccccctgcaaaacagccgacttgggttctccttgtaaagagccccacaagacgtttgtgtacgatttggatagccatgtggacgcggatgacgacccttccacactagctctgctgcaagccgtgccaaaccagtcttgtagaccccatgggtctaaattgactcactcagtatcagatagcctgttcggttgggagactaacagaaagcattttttggagggcactagttcagtttaccccaaggagcgccctgagaagctcacttcctgtgcctcatcctgccctctcgagatgaagctttgccctagtgtccaaaccccccaagtgcagcgtgaacgggggcctcagggtcagggccacgggcggatggccctgaacttacagctttctgatacggatgacaacgagacattcgacgaattgcacatcgaatcgtcggacgagaaatcaccaagcgatgtgtctttggctgccgacaccgacaagagcgtggagaatctggacgttctggtcggcttcgggaagagtctgtgcggctcacccgaggaagaggaaaagcaggtacccatcccctcagagacgaggcctaagacattcagtttcatcaagcagcaacgcgttgtgaaaaggacatccagcgaggaatgtgtgaccgttatctttgatgcggaggacggcgagcctatcgagtttagctcccaccagaccggcgtagtgactgtgactcgaaacgaaatctctatcaactctacgcctgccgggccaaaggcagagcatactgaattacttcctcagggaatagcttgtctgcaacctagagcggccgcacgggattacaccttttttaagaggagcgaggaggacaccgagaagaacatcccgaaagacaacgtggacaacgtcccccgcgtctccaccgagtccttttcatccagaaccgtgactcagaatccccagcagcaaaaacttgtgaaacccacacacaacatttcctgccagtccaactcaagaagttctgctcctatgggaatctaccagaaacagaaccttactaaaataccaccccggggcaagagttcgccccagaaatcaaagcttatggagccagaagcaaccacactgttgccaagctccggtctggtgacacttgaaaagtcacccgccttggcaccgggcaaactgtctagattcatgaagactgagagctctggccctctgtttgagctacgctcagacccccacatacccaagcactcggcacagctgccacacagtagccggatgcccagtcggagagattgggtgcagtgtcccaaatcccagactccggggagccgaagccggcccgccatcgaatccagcgactccggagagcccccaactcgcgacgagcattgcgggtcagggccggaggctggcgttaagtcacctagccctcctcccccccctggacgcagcgttagccttctcgcgagaccatcctatgattactcacccgcaccctcctccaccaagtcggagaccagagtcccttccgaaaccgccagaaccccctttaaatctccccttctcaagggcatcagcgcccctgtgatctccagtaaccctgctacaacagaggtgcagcgcaagaaaccttctgtggcattcaaaaaacctatcttcacccatcccatgccttccccagaagctgttattcagacaagatgcccagcacacgccccgtcctcttcattcactgtgatggcgctcgggcccccgaaggtgtctcccaagcgaggcgttcctaagacttcacctcgtcaaacactgggcacaccacagcgtgacattggattacagactccccgcattagtccaagtacacacgagcctctggaaatgacgtcatccaaatcagtgtcccccgggagaaagggtcaactaaatgactcagcctccacgcctccaaagcccagcttcctgggcgttaacgaatccccaagtagccaagtgtcttcatcatctagctctagctcacctgccaagtcccataactctccacacgggtgtcagtcagcccacgagaaggggctgaaaacccggctgcccgtggggcttaaggtgctgatgaagtctccgcagttgctccggaagagctctaccgtcccaggtaagcatgaaaaagactccctcaacgaagccagcaagtcttcagtcgccgtgaataagagcaagcccgaagacagcaagaacccagcctcaatggagattacagcaggggaaagaaacgttaccttgcccgatagccaggcccagggcagtctcgctgatggccttcctctcgagaccgcccttcaggagccgttagagagttcaattccaggatctgatggacgggatggtgtggataatcggtccatgcgccgctctctttcttcttcgaagccgcacctaaaacccgcgcttggaatgaatggggccaaggcgcgaagccactccttctctactcactccggagacaagcctagtactcctcccattgaaggctcgggtaaggtccgcacccagataattacaaatacggcggagcggggaaattccctgacgagacagaattccagtacggagtcttcgcctaacaaagcccccagtgcccctatgttggagtccttgccaagtgtgggcaggccaagtggtcaccccagttcgggcaagggatcccttggctccagcggcagtttttcaagtcaacacggcagcccatcaaagctgcctctgcgcatcccacctaaatcggaaggactgctgatacctccagggaaggaggatcagcaggccttcacccaaggagagtgcccctctgccaatgttgccgtgttaggagaaccgggatctgacagacgatcctgcccgccaaccccaacggattgtcccgaagccctacaaagcccaggacgcactcagcatcctagcacatttgaaacaagctcgacctctaagctggagacctcaggaagacaccctgacgccagcgccaccgccacagacgcagtgtcttctgaagctccgttgagtcccacgatcgaggaaaaggttatgttgtgcatccaagaaaacgtggagaaaggacaggtacagaccaaaccaacttcagttgaggccaaacaaaagcctgggccaagttttgcctcctggttcgggtttcgaaagtcaaggctgccagccctctcatcccgcaaaatggatataagcaaaacgaaagtagaaaaaaaagatgctaaagtcctcgggtttggcaatcgtcagctcaagtctgagcgtaagaaggaaaagaagaagcccgagctgcagtgtgaaacagagaacgagttgataaaggataccaagtccgccgacaatccagacggagggttacagtcaaagaacaataggcgcactccgcaagatatctataaccagcttaaaattgagccgaggaacaggcactcccctgtggcatgcagcacgaaggacaccttcatgacggaactgctaaacagagttgataagaaagctgccccacaaacagaatccggctcaagtaatgcatcttgccggaacgtgctgaaaggctccagtcaggggagctgccttattggaagcagtatcagtacacagggcaaccacaagaaaaatatgaagatcaaggccgacatggaggtgcctaaggacagcctggtgaaggaagccaacgagaaccttcaagaagacgaggacgatgcggtagccgactccgtattccagagtcacattatagagtcaaattgccagatgcgcacattggacagcgggatcggtactttcccgttgcccgatagcggcaaccggtccaccggtagatacctgtgtcagccagactcccccgaagatgccgagccattgctgcctctccagtcagcactcagcgcagtgtcttcaatgagggcccagacgctggagcgtgaggtaccatcttcgaccgatggacagaggcctgccgactctgccatcgtacactccacatcggatccgatcatgactgcgagagggatgcgaccactgcagagccggcttccaaaacctgcctcttctggcaaagtgtcttctcagaaacagaacgaggcagagcctaggccacagacttgtagctcctttggttatgccgaagaccctatggcctcccaacccttgccagactgggggtctgaagtggcggcaactggtacccaagacaaagctccccgcatgtgtacatactccgcgtcaggaggtagcaacagcgactccgacctcgactatggagataatgggttcggcgcgggcaggggacagctcgttaaggctctcaagagcgcggcccccgagatagagacgacctag

SEQ ID NO: 48999 - DNA, 210 bp, Artificial Sequence
  Description of Artificial Sequence: Synthetic coding sequence
atggagggcaagcggcagctggagaagcgggacttcggcaagcggctgtcgctggactctagcttggtggaatatatggactccaacaagtacatcgagcacctgctgactcagctcgaagaacagcaccgaagcctttggcgagagaagctagccgtagctaggctccagcgcgaagtggcccagaggactagcgagggcgcgatgtag

SEQ ID NO: 49000 - DNA, 1773 bp, Artificial Sequence
  Description of Artificial Sequence: Synthetic coding sequence
atggagggcaagcggcagctggagaagcgggacttcggcaagcggctgtccctcgacagcagcttagtggaatacatggattctaataaatatattgaacatttgctcacccaattagaggaacaacacagaagcctgtggcgggagaaactcgccgtcgctcggctgcagcgcgaggtcgcacagcgcacatccgaaggagccatgcacgaaaagctcatacacgaactcgaagaagagcggcacctaagacttcagtctgaaaaacgcctgcaggaagtaaccctggagagcgagcggaacagaattcagatgagaagtttgcagcaacaattctcgagaatggaagaaacagtccgtaacctcctgcaatcacagggctcacctgagcagaaaaaagaagagactgtcaacatcatggtctaccaggaaaagctgagcgaagaagaaaggaagcacaaagaagccttggaggatctgcatatggtggttgatgaagactctaggagcgagtcatcctctactgacgaaggaaaggagaagacgaagctgctgctggagcggcttaaggccttagaggccgaaaactccgcactagctttagagaacgaaaatcagcgtgagcaatatgagcgctgtctcgatgaggtcgccaaccaggtggttcaggcgctactgacacaaaaagacctgagggaggagtgcgttaagctaaaaacgagggtcttcgacctcgagcagcagaatcgaaccttatctattctgtttcagcagagagtgcggcctacatccgacctgcttctccagaaactgcacagccgcctgctggacttgagttctggcgacctcctctctgaggttgagcgtaacaggagcctgacgcagagtcggaccgacgctgaggtacacgagcaccaactgaatactaagtcagcccttaagtgccccggactcggcgcagtgattccaggacatttgtgtccccgaaactcttatagttctagttccgagctgtccctatcaagcacatgcagcgagtacagcagcgggtcatcttatacatggcatgacgggaagaatctgaggaagcgcgtgaaggaggccaatgagaacttgcaggaggatgaagacgacgctgtggccgacagcgtattccagtcccatattatagagtccaactgtcagatgagaacgctggactctgggatcggcacatttcccctcccagactcagggaaccgcagcacaggccgctacctttgccagcccgactcccccgaagatgccgaacctctgcttcctcttcagtcagccctgagtgctgtgtctagcatgagagcccagaccctagagcgcgaagtgccgtccagtaccgacgggcagcggcccgccgattctgcaatagtacactccaccagtgatccgattatgaccgctcgaggaatgcggcccctgcagtcccggctgcccaagcctgcgtccagcgggaaggtctcctcacaaaagcagaacgaggccgaaccaaggcctcagacttgttcaagttttggctatgccgaagatcctatggcgtcacagccgctgcctgattgggggtccgaggtggccgcaaccggaacacaggacaaggccccaagaatgtgtacctacagcgcctctggagggagcaattccgatagcgatttagactacggagataatggttttggggcaggtcgggggcagcttgtcaaggcccttaaatcagcagcgcctgagatcgagacaacgtag

SEQ ID NO: 49001 - DNA, 1773 bp, Artificial Sequence
  Description of Artificial Sequence: Synthetic coding sequence
atggagggcaagcggcagctggagaagcgggacttcggcaagcggctctcactagacagctctttggtggagtacatggacagcaacaaatacatcgagcacctgctcacccagctggaagagcaacatagaagcctatggcgtgagaagctggccgttgccagattacagagagaggtcgctcaaaggacttctgaaggggctatgcatgaaaaattaatccacgagctggaggaggaacggcatctgaggctgcagagtgagaaaagattacaagaagtgacacttgaatccgagcgcaatcgcatccagatgcggtcacttcagcagcagtttagccgtatggaagagaccgtcaggaacctgttgcagagccaagggtcacctgaacaaaagaaggaggagaccgtgaacatcatggtttaccaggaaaaactaagcgaagaagaacgtaaacacaaagaagcgctcgaagacctgcatatggtggtagacgaggacagcaggtccgagtcatctagtaccgacgaagggaaagaaaaaaccaagctacttctggagaggctgaaagcactggaggcggagaattccgcacttgccctggaaaacgagaatcagcgggagcaatatgaacgttgtttagacgaggtcgccaaccaggtagtgcaggcgctgctgacccagaaggacctgagagaggagtgtgtcaaactcaagacacgggtgttcgatctggaacaacaaaacagaaccctcagtatattgttccaacagcgcgtgcgccctactagcgacctgctgttacagaaactccactcacggctattagatctgtcgtccggcgatctgctttcagaagtagaacgcaaccgttcattgacccagagcagaactgatgctgaggtgcatgagcatcagctgaacactaaaagtgccctgaagtgcccaggactgggagcggttatcccaggccacttatgtcctaggaatagttactcttctagcagcgaactgtcccttagcagtacttgctctgagtactcgagcggatctagctatacttggcatgacgggaagaatctgaggaagcgagttaaagaggccaacgaaaacttgcaggaagatgaagatgacgccgtcgcggattctgtgttccagtcccatataatcgaatccaattgccaaatgcggaccttagactcgggaattggaacctttcctctcccagacagcggcaacagatctaccggccgctatctctgccagcccgactctccagaggatgctgagccactccttccactacagtccgccctctcagccgtctcctcaatgagggcccagaccttagagcgagaagtgcctagctccacagatggacagaggcccgcggacagtgcaattgtccattccacgagtgacccgattatgacagcaaggggcatgcggccactgcagagcaggcttccaaagcctgcctcatctggaaaagtgtcgtctcagaagcagaacgaagccgagccaaggcctcagacttgcagctcctttgggtacgccgaggaccctatggcttcacaacctctgcccgactggggctctgaagtggccgctacagggacgcaggacaaagctccaagaatgtgcacctactctgcaagtggaggatctaatagtgatagtgacctggattacggagataacggttttggcgctggccgggggcaattggtcaaggccctaaagagtgccgctcctgaaatcgaaactacctag

SEQ ID NO: 49002 - DNA, 5730 bp, Artificial Sequence
  Description of Artificial Sequence: Synthetic coding sequence
atggagggcaagcggcagctggagaagcgggacttcggcaagcggctttctctcgattcctctttggtcgaatatatggattcaaataagtacatagagcatctcctaacacagctcgaagaacagcatcgctccctatggagagaaaaattagcagtggcacgtcttcagcgcgaagttgcacaacgaacaagcgagggagctatgcatgaaaaattgattcatgaattagaggaagagcggcatttgagactgcagagcgagaaaagactgcaagaggtaactctggagtcagagagaaataggatccaaatgagatctctgcagcaacaattttcccgaatggaagagactgtccgcaaccttttgcagagtcagggctcgcccgagcagaagaaagaagagaccgtcaacataatggtgtaccaggaaaaactcagcgaggaggagaggaaacataaagaagctctcgaggacttgcacatggttgtggatgaagactcccgaagtgagtcatctagcacggacgagggaaaggaaaaaacaaagctgctcctcgagcgcctcaaagcactagaggcggagaattccgccctggctctcgagaacgagaaccagagagaacagtatgaaaggtgtttagatgaagtcgccaaccaggtggtccaggcactcctcacccaaaaagatctcagagaggaatgtgtgaagctgaagactagggtgtttgatttagagcaacagaaccgcactctcagtatactgtttcaacagagagtgcggcccacctctgacctgctgcttcagaagttgcatagtcgtcttctggacttgtcctcaggggatcttttgagtgaagtagaacgcaaccgctccctgactcagtcccgcaccgatgcagaggtgcacgaacatcagctgaatactaaatcggccctcaaatgccctggtttaggcgccgttattcctggccacctatgtcctagaaacagctacagctcctcttccgagctcagcctgtccagtacatgctccgagtattcatcgggcagtagctatacgtggcatgacggtaaaaacctcagaaagcggcagtctagccagaactgggacaagagactgagcatagactccagcctgccatctggattcgcctcccccacaaacgagctgccaccgacgcggattaaggagtctcacattctcgaggggctccgcaaattgcagaaaaggaaggtgttactcgaacctccaagtgtgattaccaaatggggctataaggactgcatgaacagcaatgagggaatttatagcccggggataaaatcatctagcctgaaggagtatccaccctgcaagactgcggacttggggtccccgtgcaaggaaccacataagacttttgtttacgatctggattcccacgttgacgccgacgatgacccatccacattggccttactgcaggccgtacctaaccagagctgtaggccacacggctccaagctcacacactcagtctcagactcactatttggatgggagaccaatcgcaaacactttctggaaggaacaagcagcgtctaccctaaggaaagaccggagaaactgactagttgcgcttcgagctgtccactcgagatgaaattgtgccccagtgtccagacccctcaagtgcaacgagagaggggcccacagggacaaggtcatggtagaatggcactgaatcttcagctgtcagataccgatgacaatgaaactttcgacgagctgcatattgagagtagtgacgagaagtctccaagtgacgtgagcttagccgcagatacggataaatcagttgaaaacctggacgtgcttgtgggatttgggaaatccctctgcggcagtccagaggaagaagaaaaacaagtccctatccccagtgagaccagaccaaaaaccttttccttcatcaagcagcagcgggtggtgaaacggacaagttcagaagaatgcgttactgtgatcttcgacgctgaggacggagaaccaattgagttcagcagccatcagactggggttgttactgtcacacgcaacgaaatttctatcaatagcacgccagctgggcccaaggcagagcatacagaactcctgcctcagggtattgcctgcctgcagccaagggccgccgctcgggattacacattttttaaacgtagcgaggaggatacagaaaagaatattcctaaggataacgttgacaatgtaccgcgggttagcacagaaagcttcagttctcgcacagtaacccagaatcctcagcagcagaaattagtgaagccaacccataacatctcctgccagtcaaacagcagatcttccgcccccatggggatttaccaaaagcaaaatctcacaaaaataccccccaggggcaaaagttccccccagaaatccaaactcatggagcccgaggccaccaccctcctcccttcttccggcctcgtcacgctggagaaaagccccgccctggctcctgggaagctcagccggtttatgaaaaccgagtcttcaggacccctgtttgaactcaggtcggacccccatatccctaagcactccgcccagctcccccactcatcccggatgcctagtcggagagactgggtccagtgccccaaaagccagacacctggctcacgctcccgcccagcaatcgagagttctgattcgggcgagcctccaaccagggacgagcattgcggttcaggacctgaagccggcgttaagtcgcctagccctcccccacccccaggacgaagcgtttctttgttggctcggccctcctatgattacagtcccgcaccttcatctactaagtctgagactagggtaccctctgagactgcgagaacaccatttaagagtccccttctcaaggggatatccgcaccagtaatttcgtccaatcctgctaccaccgaggtccagcgcaagaagccgagtgtcgccttcaaaaaaccaatcttcacccatccaatgccaagtccagaagccgtcattcaaactcggtgcccagctcacgcaccgtccagcagctttacagtaatggctttgggccctccgaaagtttcaccaaaacgtggggtgccgaagacttctccaaggcagaccctgggaactccacagagggatatcggcctgcagacccctcggatcagcccttcgacacatgagccgcttgagatgaccagcagcaagagcgtttcacctggacgaaaggggcagctaaatgatagtgcaagtaccccccctaagccaagtttcctaggggttaatgagtctccatcaagtcaggtgtcttcgagctcctcctcgtcttcgcccgctaaaagtcataacagcccacacggatgccagtctgcgcatgaaaaaggcctgaagacaagactcccagtgggtctcaaagtactgatgaagtcccctcagcttctccgaaaaagctctaccgtgccaggcaaacacgagaaggattctctcaatgaggcctctaaaagttctgttgccgttaacaagagcaaacccgaggactccaagaatcctgccagtatggagataactgctggcgagcgcaacgtaactctgccggatagtcaagctcaggggtcactggcggatgggctccctctggagaccgcactccaggagcctctggaatcttcaatccctggctccgacggtcgggatggcgttgacaaccggtcaatgcgccggtctttgtcttcgtcaaagccccacttgaagcctgcacttggaatgaacggggcaaaggcgaggagccactctttctctacccattcaggagacaagccatccacacctccgattgaagggagtggcaaggtccgcacacaaatcatcactaatacagcggagagaggtaatagtttgactcggcaaaattcttcaacagaaagcagtccgaacaaggccccctctgcccccatgctggagagtttaccaagcgttggccggccgtccgggcatcctagcagtggaaagggatccctaggatcctcaggctctttctccagtcagcacggaagcccgtctaaactcccattacgcatacccccaaagagcgaaggcctgctgatcccaccagggaaagaggatcagcaggccttcactcaaggcgaatgtccaagcgcaaacgtagcggtgctcggagagccaggctctgacaggcgcagttgtccgccaacgccaacagattgcccagaggccctccagtcacctggcagaacccagcacccctctaccttcgagactagttccacgagcaaactagagacgtccggtaggcatcctgacgcctcagcgaccgctactgatgcagtgtcctcagaagcgccactctcgcctacaattgaggagaaagttatgttgtgcatacaggaaaacgttgagaaggggcaggtccagacaaagcctacctcagttgaggctaaacagaagccagggcccagcttcgccagttggtttggcttcagaaagtctcgtctgcctgctctctctagtcgcaagatggatatatccaagacaaaagtggagaagaaagacgctaaggttctagggttcggcaaccggcagctaaagtcagaacgtaaaaaagagaaaaaaaagccggagctccaatgcgagaccgaaaacgagctgataaaagataccaaaagcgccgacaatcccgacggtgggctgcagagtaagaacaataggcgcacccctcaagatatctataatcagcttaaaatcgagcctaggaatagacactctcctgttgcgtgctccactaaggatacctttatgaccgagctgctcaatcgggttgacaaaaaagccgctccccagacagagagtgggtcttccaatgcctcttgtagaaatgtcctgaaaggatctagtcagggttcctgtttaatcggcagttcaatctctacccaagggaaccataagaagaacatgaaaattaaggccgatatggaggttccgaaggactcgttggttaaagaggccaatgagaaccttcaggaggatgaagacgacgcggtcgctgattccgtctttcagtcccacatcatagagtcaaattgtcaaatgcgtactttggacagcggtataggaacatttccgctgcccgattccgggaaccggagcactggcaggtatctgtgccagcccgacagtccagaagacgccgagccgcttttaccattgcagagcgccctgtcggcagtgagcagtatgcgggcccagacactggaacgtgaggtgcctagttctactgacggccagagaccagcagacagtgccatagtgcattcaaccagcgatcctatcatgaccgcccgcggcatgcggcctctgcagtcacggctgcctaaacccgcgtcaagtggtaaggtgtctagccagaagcaaaatgaggccgaacccagaccccagacctgttcttctttcggttacgctgaggaccctatggctagtcagccactgcctgactggggttcggaagtggctgcgaccggtacgcaggataaggcccccagaatgtgtacttattccgcctccgggggctctaactcggattctgacctggattatggagacaacggatttggggccggacgggggcagttggtaaaggcactgaaaagcgccgctccggaaattgagactacatag

SEQ ID NO: 49003 - DNA, 1773 bp, Artificial Sequence
  Description of Artificial Sequence: Synthetic coding sequence
atggagggcaagcggcagctggagaagcgggacttcggcaagcggctcagccttgattcctcccttgtggagtacatggactccaataaatacattgaacacttattgacccagctggaagaacagcacagatctctctggcgggaaaagctcgccgttgctcgtctgcagagagaggtcgcgcagcggacctctgaaggagctatgcatgagaagctgattcacgaactggaagaggagagacatctgcgattgcagtccgaaaagaggctacaggaggtcactctggaaagtgaacgaaatagaatccagatgaggagtctgcaacagcagttttcccgaatggaagagaccgtgagaaaccttctccagtctcagggatcaccagaacagaaaaaagaggaaaccgttaatataatggtgtatcaggagaagctcagcgaggaggagcgaaaacataaagaagctctggaagatttgcatatggtcgtggacgaggacagccgtagcgaaagctcttctacagatgaaggaaaggagaagacaaagttgttgctcgaaagactcaaggctctggaggccgagaactccgcgctggccttagagaacgagaatcaacgggagcagtacgaacgctgtctggatgaagtcgcaaatcaggtggtccaggccctgctcacccagaaagatcttagagaagaatgtgtgaaactgaaaacaagggtctttgacctggagcagcagaatcggactctgtcaattctatttcagcagagagtacgaccgacctctgacctcctcctccagaagctccacagcaggctgttggacctcagttctggtgacctgttatccgaagtcgaacgcaatagatcccttacacagtcaagaacagacgccgaggtgcatgaacaccagttgaacaccaagtccgcactgaagtgcccaggtcttggggctgtcatccctgggcatttatgcccaagaaactcttactcaagtagttccgaactgtccctgtcctctacttgctcagagtacagttccggtagctcctacacgtggcatgatggtaagaacctccgaaaaagagtgaaggaggccaatgagaacctgcaggaagacgaggacgacgccgttgccgattcagtgtttcagtcgcacattatcgagtcaaattgccagatgcgaaccctcgacagcggcatcggtacgtttcccttgcccgattcgggaaaccggtccacgggaagatacctatgtcagccagattcaccagaggacgcggaacctttgttaccgctgcagtcagcgctttctgcggtgtctagcatgcgtgcccagacactcgaaagagaggtgccatcctctacggacgggcaacgacctgcggattccgctattgtccattcaacttctgatcccattatgacggcccggggaatgcgccccctccaatcccgactgccaaagcctgctagctcaggcaaggtgagtagccagaaacagaatgaggcagagccccgaccccagacgtgttcgtcattcgggtacgccgaggacccaatggctagtcagcccctgcccgactggggttctgaggtggccgccaccggcacgcaggacaaggcgccaaggatgtgtacctactctgccagcggcgggagcaattctgactctgacctcgattacggggataacgggtttggtgcaggaagagggcagctggtcaaagctctgaaatctgccgcccccgagatgcccattacatag

SEQ ID NO: 49004 - DNA, 537 bp, Artificial Sequence
  Description of Artificial Sequence: Synthetic coding sequence
atggacagcaacaagtacatcgagcacctgctgacccagctggaggagcaacacaggagcctatggcgtgagaaactggctgtggcccgcctgcaaagggaggtggcccaacgaacttcagagggcgcaatgcatgaaaagctcattcacgagttggaggaggagaggcacctgcgcctccagtcagagaaacggttacaggaagtgaccttagaaagtgagagaaatagaatccagatgcggtctctgcaacagcaattctctcgaatggaagaaacagtgcgaaacttgcttcagtctcagggcagcccggagcaaaagaaggaagaaactgttaacatcatggtttaccaggagaagctctcagaagaggaacggaaacacaaggaggctttggaggacttgcacatggtagtggatgaggattccagatcagagagttcaagtacggatgaaggcaaagaaaagactaaactgctcctggaaaggctcaaggccctggaaaggaatgggtggaactggcacccagtgtcatag
